United States Patent 10,900,036 (RNA INTERACTOME OF POLYCOMB REPRESSIVE COMPLEX 1 (PRC1)) - sequence listing, part 10

SEQ ID NO: 19660 - DNA, 1196 bp, Mus musculus
tgttttgttctcgtggagttttttagtttgttctttgttttgttttgatatttttgttttgtttgtttgttagtatgtttgagacagggtcgtactgtatatagccctggctacatttgctgtgtagactaggttggcctaaaacagattcacctgcctctgcctccctagtgctgggattaaaggcaccatatccggcccagcacaggactctttaagtgtgtgggagagagcctataaaaatagggtttctctgtatagtcctggctgtgttggaactcactttgtagaccaggctggcctcgaactcagaaatccgcctagctctgcctcccaagtgctgggattaaaggcgtgcaccaccaccgcccggctgcaaatagtttttatatgcatattttatatataaagttttgttcctttttctgttgataaaataccttataaaacataatcttaaagcgacattgttactacatgttttcaaaatggctgtcgttatgtcatgtaaattattttaggtttcaaagatgttggtgatcgttcgaaagacacagagagctatgagtatgacttgattggagtgactgttcacacaggaacagcagacggtgggcactattacagtttcatcagagacatagtcaatccacatgcctataagaacaataagtggtgagtttttagtgtttttctttaaaaacatttcccagatttaaagatataaatttatggtagttcttcggatgaattcttgatttcatggaaactttctatgaagttaggcagaatattaaatccttttttctttatatatgtgtcttgtctgtataggtaggcagacagatcagtggaagtcagactttctttcatgttggttcaggttgtcatacttgatagcagttatctgctgagccatcttggtgctccacaaaaagaagctttttcattcaaggcaactttcagacacaccagaagagggcaccggatcccatcacagatggttgtgagccaccatgtggttgctgggaattgaactcaggacctttggaagagcaatcagtgctcttaaccactgagccatctctccagccctcaaggcaactttctttttttttttttttttttttattttttttatttatttatttatttattatatgtaaatacactgtagctgtcttcagacacaccag

SEQ ID NO: 19661 - DNA, 1103 bp, Mus musculus
aaaacctatgattcggttacagataaattcatggacttttcctttgaaaaggtgataattcttttcatatgtaataatttaacaatcttctatattatttaattttatattatactttgtcaaaaattaaaatacgtttctccttgcttcataaagacacatagtgcatatatgctgttttacaaacgcatggaaccagaagaagaaaatggcagagaatacaaatttgatgtttcatcagagttactagaggtaaacattactttgattttaacagtagtttaaattgcattaggtgtttgtgcaagaaatacttcagtataaaagcagtcccaattagatcttagcatacttagaaaaaaatgataacaatactgtccctcaataagtgagtgaaatacatgtgaggtattaggacgtgcttcagcagggaagagtacttgcttgctgctttttcaggcacatgcgtgcgcatgtgcacctgtgaacacatacacactcatacacacacatatacacacctgcccctcaaattctgtaaacaaaatagtgcttatagatatatttagtaattaaatgaagatatattgttgtgatgtagagtgactagaggaagaaaagccgaacatgaggttaaacaatcagagcagatttgaaaatacagtatagtagtttaacatttaaatatacatccagtttattttaaagtaccaaaagacctgtatgagaaacaagctgacctactctggaaatagaactacaagcattgactctactatgagacatactatgcttaggtctaaagcaaagactagagcctgggtctcactagataaccagaaatacaagtgaatctagaaataagaccacgactgaaggtaaggtttgggagagggctaagctgaatgctctaatgcctttttagtattgtagacatcaatggtctagaaataaaaacagtgaagcactaggcatttagggactaagcctgtaatttcccagctaccctgaaatacaccttaatacagcagactagaaaggcaagttagcggtagttgaatacttttaatggagactagaagtggtcctatcagttgcaaatg

SEQ ID NO: 19662 - DNA, 1192 bp, Mus musculus
atttggaagaaaaaaaatcaacatgaattttaatgcatatattttgatttggtaaatttgtaagtttttaggctataccttttcttgtcaaaaaaaaaagtattggtaaaatatattaaactgctttctgataaatgccaacatttttttttctccagtggatttggcatgataacatgcaatttttacaagacaaaaacatttttgaacacacttattttgggtaagtttggtatttttagtatttttttttcttttcccttaagtcttgtgtaagaatttaatgaactctttttaaattccaggtttatgtggcagctgtgcagttgtattccaagtacattaccagatcctaaagctgtgtccctcatgacagcaaaggtgatgatgagctcggatagctttgtcagatttattgctatacaataattgagtctttcatgcttaattgtatcttttttttttaacagttaagtacttcctttgttttagagacattcattcattcaaaagagaaggtatgtgtgtttttcctatagatttatatgccatcatcatcatcaacatcattttaattatgtttaggtgttgttatcattgacataaagtccatatcttgaatattttttattttcctttttaagccaacaatgcttcagtggattgaactactgaccaaacaatttaataatagtcaagcagcctgtgaggtaaggttacaaccaacattgcacagcttaaaattctctaattcgaaggctgttttttttgggggggggttgtttttgttttttaattaaatgaagccaaaaaaatgtttttatctgttatgaatctcatgtaagttgttcctaatatttgttcacttagaaagttacagcttatatttcaaacctgttataaagattaagttaatacttaattcatttcataatctttgacctgccctctagtgttacacaagtataaaaacaaatttcagtttcgatgtcatcctgtagaactataatccatgtacacaggtgggagaaacagaaaaatcatgagtcaagggcagtctgggatggagatggggacacacacacacacacacacacacacacacacacacacacagagagagagaatgaatatgaatgaatgaatatattagagtaaggtagaggtcaaggttagcctgagttgtgcagtg

SEQ ID NO: 19663 - DNA, 2007 bp, Mus musculus
tactgtgtgtgtgctatactgtgtgtgtactatactgtgtactatactgtgtgtgtactatactgtgtgtgtactatactgtgtgtgtactacactgtgtgtgtactatactgtgtactgcactgtgtgtgtgctatactgtgtgtgtactatactgtgtgtgtactacactgtgtgtgtattatacactacactgtgtgtgtactacactgtgtgtgtactatactgtgtgtgtactatactgtgtactgcactgtgtgtgtgctatactgtgtgtgtactatactgtgtgtgtactacactgtgtgtgtactatactgtgtgtgtgctatactgtgtgtgtactacactgtgtgtgtgctacactgtgtgtgtactacactgtgtgtgtgctatactgtgtactacactgtgtgtgtgccatacacctctacatctgctatgtctgttactgactgtgagtttctccttttaaagatgttccagcgtttatgtatccatgtgattcagagactgagacctgtgcacgctcatctctatctacaaccaggaatggaagatgggtaagaagagctttacaaccaagtcttctgaagtatctatgagtagatatttagaatataaaaattagtctctaataagatatgtctcaagaaaggaagactttttaaatttttaactaagtgcatctttaagatattgaaccaactaactttttgtttggattgatttagttccagtaatgagaggataactacttacattattgaaattggtatttgttttacagaattaaaggattggatttttaaaaattgttctagtatgttggcatacacctttaatcccaagccatctagggccacacagccagactctgtcacaaaataaataaataaacaaacaaacaaacaaaaaccaaaaaaacagttttcatacaagacaatatatgtctgcatatttattgtgttctctgaggtatatttgtttttattttcaggtcagatgatatggatgcctcagtagaagatattggtggtcgttcatgtgtgactcgatttgttagaacactgttgttaattatggaacacggtgtaaaacctcacagcaaacatcttactgagtattttgctttcctttacgaatttgccaaaatgggtgaagaagaggtaaggctaattcttgtttgcttgtttttagttttgaattataaacccttttaagatttccaatttgttttttatttaaaattttaacttgcttgttttttagagccagtttctgctttcattgcaagccatatctacaatggtacatttctatatgggaaccaaaggacctgaaaatgtaagtccagttgtgtcctgtatcagtgcagtagggccattcttctaatggttcacatcatgtagaatcatgacaagtcctagaaacttaaagtccctttttctttttgtatttggtagcattaagggtcctagatttgttggtctgttattatagtgtatatatagagtagtaaatcaaattaagtgttaagttgtttcattggaaagtctgaaacaaagcagactttgttttcatactagtagccacagcttaactacagggtctgcaaaggaatgtgttgtttcaatttgtggtttggattgtcacattttaaagttttttttagagtctctgaacatttctgtagttaataaatttaataatattttaacatatagatggatttagagtgtgcaagtacatttcatgatctgtgtgcaacatttcattcaaccctgctcatatccctgagaagtatagtttttatgtttataatacagatgaagcagctgaaacttagagaagttcacttgttttagatcattgaaactcgagactactgattgaaaactgtctcttaaatttgagttggttttaatctaattccatcctatgtagctgttgggttaacaacagtgatagctgatgctgtttctctcctctccctgcctatgttct

SEQ ID NO: 19664 - DNA, 1149 bp, Mus musculus
gataccatgaccaaaccaactctacaagaacaacatttaattggggctggcttacaggttaagagattcagttcattatcatcaaggtgggagcatggcagcatccaggcagtggtagcactggagtagctaagagttctacttcatctgaaggctgctaggagaagactggcttccaggaagtcaggacaagggtcttatagcccacacccacagtaacacacctactccaacaaggccacatctccctatagtgccactccccaggccaagcatatacaaaccatcacagggtctatctaacataaatacttttgagaactattgctttgcatagtcctcctgcttacctaacactgtcctgattgtcatccaggcagtatcaggttaaggtctaacctttgagtgattttacttagtacatactcctgccatgtttttctgatagttatactaaaacaagtcagctgttttcgttatgctattagaactaatcacacattaaaattgaattttgttctgattagcctcaagttgaagtattgtcagaggaagaaggggaagaagaggaggaagaagaagacatcctctctctggcagaagaaaaatacagacctgctgcccttgaaaagatgatagctttagttgctcttttggttgaacagtctcgctcagaaaggtgaaatgtttcaacattcaaaatgcttacagcgtgtttggctttattttttatacataattgttctatcactattcgtttttattacataaatcttttaaaataataattttgcttcaactcttgtggctcacgaatttcagtcctttctatataactcgtctgagtcgtgctagaagcaattattgaagaaatctaagtaaaatatctggcaaaattaaatggacattcattctttaccccagcaactatacttccagggatttgcccccaaaacagaaagatatttatggggaggtaattattaaaataccatttctagtatctaaaagttggagacagccaaatgttcttcagaaggggactagtcattgacaaattaaggaacccattcagtccccagtagttgtgtgtttgcctgtttgtttggttggttggttggtttttgttttttgggttatttttgtttg

SEQ ID NO: 19665 - DNA, 1104 bp, Mus musculus
gtttaagtaaatcaatagtctcagaagtccactggaatcttgttttcgtctgcactattttaaattttgtaaactagcaacagatttttttttctgagcttttcttactacttacaagtaaatatattcagtatagtaggaaaacatgggtaaaacttttgtgaagattctagtttaaaggaaaagaaaaaatatggtctggagaaatagcccaagagcattttatttttggagaggacccaggttcaaatcccagcacctatgcacccacatggcagcttacagccactcatataactgtagtttcaggggagctgacaccctcttctaacttcctctggaacgggcacacatgtggaacacatttatgaatgtagcaaatatacaaataaaatcaataaggaaaaagttaactaaataaatacttagtggcatataccaaaagaaagtaaattaaattctcattcagtttgctgcatgtcatatttttgtcatttcatttataggttattgaatacaatccttctcagtgtctggactggttggcagtgcagacaccccgaaataagctggcacacagctgggtcctccagaatatggaaaattgggtggagcggtttcttttggctcacaattatcctagagtcaggacttgtaagtcaaatgtttaaaatttagctaattatttattgttcaaatttttaggattgttttactgtttgttggttcgatttttagggttttgggagagtggggggtaacccaatgataatgcctgttattatgtaaagctcgaagtggtgtcataaaagacccaggtgtgtgtgtgtgtgtgtgtgtgtgtgtgtgtgtgtgtgtgtgtgtgtgtgtgtgcgcgcgcgcgcgctttaatacttgtaaatcttgacactgagtatctatggtattttgtgtgtgtgtgtgtgtgtgtgtgtgtgtgcgcgcgcgcgcactttaatacttgtaaatcttgacactgagtatctatggtattttgtgttttgtttttgagtgttactaaagaaagtaaaagatgagaaacttttcttaaaagtaactcttgattctaggatagccaaagctaca

SEQ ID NO: 19666 - DNA, 1558 bp, Mus musculus
aggtgggaaaattctacattgtggaaaactgaacatcataggcttgaaaactcgtggtgatacctagtgcttgggaggagagaattagaaagagttcaaggctagctagtgtagcagtttctgtaattgtgattattgttgccacttaaatacagcaatggtagaatggaaagttctacccctactcccctttgggaatctttcttttggacaaaaggtaaatcagagggatatgtaaaagatgtcatgtcccttaatttttattcatttttattaataaagggaagagtggttttgtgtttaataactgctcttcagtctactaaaatcgttcaaggatctgacagttttgttttacattttatagctgcagcttatcttctggtgtcccttataccaagcaattcattccgccagatgttccggtcaacaaggtctttgcacatcccaacccgtgaccttccactcagtccagacacaacagtagtcctacatcaggtctacaacgtgctccttggtttgctctcaagagccaaactttatgttgatgctgctgttcatggcactacaaagctagtgccctatctgagctttatgacttactgtttaatttccaaaactgagaagctgatgttttccacatatttcatggatttgtggaaccttttccagcctaaactttctgagccagcaatagctacaaatcacaataaacaggctttgctttcattttggtacaatgtgtgtgctgactgtccagagaatatccgccttattgttcagaacccagtggtaaccaagaacattgccttcaattacatccttgctgaccatgatgatcaggatgtggtgctttttaaccgcgggatgctgcctgcctactatggcattctgaggctctgctgtgagcaatcacctgcatttactcgacagctagcttctcatcagaacatccagtgggcctttaagaatcttacaccacatgccagccagtaccctggagtaagtacagtttacacttttaatatctgtttcctgtatttggttagcaatatattttctttattaagaaatggcaaaatgtagaatagtcttttcatctttaatcattcacctgttttgtcttccgtgctgggagtgggacccaggctcacatccatgctaggcatgcgcttggcaactgagctacattccacccccctcttcgttttttatttctaaatattttcctttaaaattttatgtgtgtgggtgtttggtctgtgcaacacatgtaatcctgatatccactgaggtcagagagggcagaatttcctggtacaggagttgtagatgatcacaagctgccatggggatgctgggggtcaaacctagtgccctaacctctgccgtctccccagacccatctccgtcgtttataaggatttaaaatgtttgctttcttagataccctcatataatgcgttatgtaatctacaaaataagtgattatattttcttatgctgatgttaaaattttgttaccagtggtacatacaatatattgttttcttgtttt

SEQ ID NO: 19667 - DNA, 1151 bp, Mus musculus
ctatccaaaataacaggggtaaacagccaaacaagcaagcaagcacaaaagcaaaatagaaagaaagaatgtaagtaagcaagtcagtaagcacaaggctatggagtgtctcagttggtaaaggtactttccacaagccactaaggacagtggtgggaaagaaccctgctctgcaaattgtcctgttcccttcctaggcacactgggtaagcatgcgcatgtgtacgtgcacgtatacacacacacacacactttgaagatttatttataaagatagagaatgattgaggataatgcctggcatgcacacaaatacgtgcacttttcataccatacatagtccatacacatactacacatacagagtagctaaatggagaaacctaactcagaaaacaagaaacatttgcttggtatacacacataatatctgagtctgaaaatgccttttagaagataagaatttcatttttgtctaaagtaaaaatgaaattaaaggtttttaattttttattttctaaatcacttgtagtctttcaacacattgcacatgatgtatcatgaagctacagcttgccatgttactggagacttagtagagctgctgtcaatattcctttcggttttgaagtctacacgcccatatcttcagagaaaaggtttggtcatatgtactttttgtttttttaccattttgctaccatttaagaacttgtatttcaaatgagaggcctcagaaaagttgacattctagtttgtgtgccaatggttcctgagctagttagtattgtacaatgtttatcatctcataatgtagagagggaatgaaatgtttgtacatactttacttatacctacttaaaaacagtaggcaagcatagtatgagaatcaagatttaggaggttggaaaacttccacacacaataagttggattgttgttgttgttgttttaatcttcatggctcaaaatacatcatttttagtgtcagtagaagtaagtttaaaaatatttgttagtatctcagtctataaacactgaacctcatggttctagaaaatgcagtgtattactgccctatataccacctgcagtcttggtgatgtgaaaagccgaggcagaaaatccctcgagcttcagagcttaagaca

SEQ ID NO: 19668 - DNA, 1411 bp, Mus musculus
tggaaggcccatcttcattttcagaagatggttcacatatccggtcacagcatgcagaggaacagtctaacaatggcaggtttgacgactgtaaagagtttaaagaccactgttccaaggatactacactagctgaagatgaatccgaattcccttcaacgtccatctccgcagttctgtctgacttagctgatctgagaagctgtgatggtcaagctttgtcctcccaggaccctgaagctgctgtgtccctcagttgtggccattccagaggcctcattagtcatatgcagcaacacgacattttagataccctgtgtaggaccattgaatcaacaatccatgtggtcacaaggatatctggcaaaggaaaccaagctgcttcttgacattagacgtggcatgtctattctcacgtgccctcccctatgctgtttgtcaagtttgctcctttgttttgtgcttcagtttgtccagtgctctctgcttgaatggcaagatagatttataggcttcaattcttggtcaggcagaattccagatgaaaaaaaaaatgtgcatcttctgtatactttctaaagggcaatcagataatggatatgttttatgtaattaagagttcactgtagtggctttcatttaatatggctttctgggagaagcagggctctgaccctgtatgatgtaatttaaacttacagcatttttactgtgtataatatggtgtcctctgtgccagttttgtaccttaaaataagagaggcagattgcctctgatcgctgtggttcttattatcaaaattaagtttacttgtatacggaacaaccacaagaaatttgattctgtaaagaatcctctttagctgtggcctggcagtatataaatggtgctttatttaacagaatacctgtggaggaaataaagcacacttgatgtaaaaataatggttttatttttattgacatgactgctgttctgtgtacttataaactgactgtgatcacttttcctttgttacataagtcgtttgtttcttcaaatgacagcagtaaggagactgaaagggaaccacgtggcctttctgctatttgagaagtcctcttgcatccaaaacagttaatttaccatacagatgtctcatccctccaatcccgaagtgtgtggctatttggaagacatcaaggagagccagagaagtgtaacagaatgcagccacctagccctcacagcaacactctggaaacaccttggaaactggcttagaataaaggaatagtatagcatgccatttatttgtcttaagcttaaatcaattgtagcaatcaagtagcagcctatgaccagccttagctcagcctacctacttatctcagaggaacacccatggaaggtgagatatgacacccgatt

SEQ ID NO: 19669 - DNA, 2146 bp, Mus musculus
ggcagcaacaaaatcctgttgttctagaagcaaatctgactttgttttctgtttaaaaaacctaggtctaaaagtcgttttggtcaagggcgtcctgcataaagcaccctaaacataaaaagagaggaggtacactctggacatctgaaatgcccacttcctgaagatcttcagtgactgataggtgctctatgagtcattcctgcagaccacataaatcatgctacagtgactgctaggtgttctattagttatccctgcaaaccacaaaaatcatgcttacacaaatatatagttaggttttgttaaaatcttaactatatatatgaattttttatataaatttctctttgtataattctaggctgtgtaggagataattgcaaacttcacatagttaggatttctaatatttgttgccttttatttatttgacaaagaagaggcctaacttgacaagtaactaagttggtatgaccctaagaaattaacagaatgactggtagtgttactatgcatgggcactgatcgttgtatgttttggggctgttgaatcttaggcatagcattgagaaatgaattgtgtatgatgaactgtccagtgatgttaaatttagtttgcatggatattaaggagtgacagatctcgaagctgtattaatagaatttcaaggtgaggttatttcaataccatgctggtcaagaagggttgatctttttcagtagtattacgtgggaggtacaatgttattgaacttctgtttctttcagtttttcatgcttatctgtaaatcatttgagcctaaaatccaatccttgcctcgcttctggatgaagctagtggcactctgagtggtgagtcatttcagttctgtggcacggtcagacccatccattctctaagtctgcttgagctccctcacagcatgattgctaggtacgaagagaggtcttaaagttcccaggtagaggagacggctgggaacttcagatattcacataaaactgttttatagatcatgttttaatttttttctaacaaggtagatagcatactcagggaaattttgttccagactgtaagcatgtactaagttatgtgtttggaaattgtttataggtctctgagaaccgtgagatgcacactgtttctatgtttagtttttctctgctttgtgattgatgtcttcaaattattcagataataaatcttgatgatgtaagggaacagcaattgtaaaagaaaaattcatgtcttacacctagtttacacaaaaagaaattataatttttagtatcttttagttgctatatgaagctcttaattatttggtaattatgcttttaatatctatttggaaattttattctggtgtacaaatgcctttcagttatctgatactttggaaatagcttatatcatatttattttcaagaaagtatttctttgtatgtgatatgtaaatcccacgagtaccagccttatagttggctcctggattctctgatagaaggatttggatttatatgtgtaagcaatctatgatcattgtaattagaagggaatatgctcttttgattttcacagatggtagaagtgctcattgcttctccccagagggggctgctttactgattgatgttaacagactcgagtaaaatctgattctctacagaatgtgctttgtattttatatctgtctgtgatacatggacaggcatttcttctgccaagtacgttaaggttttccttacattaattctgagctcaaacttattgaaataaatggcaatgacaaaaattgtggagaaagtcccttgatctgacttgttctgctgtctgaggagactggagtgctctgtattctacataattccctggaaaattagctgtgaaaattggtgaaaaccttaggttttaagattatttgagtgtggcagcacaccccatcactctggaaactgaagtaggaaaatcctccattcaagaccccgcctcagaacatttagcaaatcatttaagggttgaaatactacagcgaacaggcgtatagtatagctcaatagtagtcctgcagcacaccaggcgtatagctcaataatagtacacttgcctcgggtgcacagtagcctggctttgatcccc

SEQ ID NO: 19670 - DNA, 1099 bp, Mus musculus
agcagaggatggcctaggcggccatcactgggaggaaagcccgttggtattgcaaactttatatgcctcaatacaggggaatgccagggccaggaagcaggagtgggtgggttggcgagcagggcagggggagggtataggggactttcgggatagcatttgaaatgtaaatgaaaatatctaataaaaaattaaaaaaagaaagaaacttacttggggaagaagaggctatgctgtgcttttgaaccctcgacttagtttggaatactacatcacaatcttttgaaaatgttcactataacattagcagttcatgattcattttctatgtttcttccatttgcctttaaaatattaacattaaagcaagaatgccacctgacaaatacctccttaactgccttggaaactgcatttaccatgttaccatgctgtaagtaaaacccattctcagctagaaatgctaacccatcccccctttttttgtatgtgtttctgtatttaaggaagacatagtatagctaccacaaggaattgctcttcagaaagtgaaaactgtactgctcgtaatgctggagaagagactggagaatctgaagggtaggaggctagttgtttgttggatgagatttaatactgatactacctctaactgtgaaagtgcatggttggtgctaatgtacagcagttaccatactgtaggggtttacattacacaattgctgagcctccggagtcagaatcatccctgtgtgaacaaaaataatacctaacacattacttgcttgtgttatttatacattttggggggttttcatcaaaaattaattgacatgtttaaaaaaattagaaataacatctagtaacacagaacattgaaaagtaaatttcaatgcccaaagaaaaatcttttaagtaatcagttcttgaagtttattaatgagattagatgtttattttagaaccattttaatataattgctacacagatatttaaaaataagaatgtatttcagtatgcttcagcttttgatattttgaattgttgtgtatatttcttgtaggacaagttgcatgcacagtaaatgattacttgttt

SEQ ID NO: 19671 - DNA, 1169 bp, Mus musculus
tggcttctggctagtcttgacggtcaaacaacaggacttatacctgcaaattatgtcaaaattcttggtaaaagaagaggcagaaaaacaatagaatcgagtacaatgctcaagcaacaacagtcttttaccaacccaacattaattaaaggagtcactaccaccaatcctttggatgaacaggaagctgcctttgaatctgtttttgttgaaactaataaggtttccagtgcacctgattctacagggaaaaatggagacaaacaagatctttgatgtgtttcatgtttgtgggcaggtgaacaatattttagagtattttaaaaaatcatttcttacagagaaattaatttgcagttgaatgaaagcatttgctcgtggctgtgccgagtgttctgctgctagaagttatgtagtcacacgctagctgctagtcaagtgatctgtctacacttgactgtcttgtggaccacgaggacatttgtttcacctagtttttaagattatggagatagttgtcagctccatcttatctcagtccctaggcttattggaacagtaaatttgatgaacagtagaacacacaagctgcctcagaagggatcattaacgcttcttaaagttctgagttagttgacttgaagtcttcaaaaattgagtgataacatctacttataagaacagacaaaaggctaatttttttaaccttataaataaactaaataataaaaattttctcatctgtattatgtccagtgttgaatttactttaggtgatgtgtttttaccagcaaataattgatagtattatcttttattgtatttataaaagtgtgttcttaagaggtcactggagcactgtgaagaagatggttctgactgacagcttcttaacctccttacagtgtcacagatctcatcctgagcgagtcacaatatatagctagatctcatcctgagcgagtcacaatatatggatttttgttcttttcctccaactaaggcaggagtcctttaagattatacttaatgatataatcaattctggcagtaatgatttttaatcctgaattttctgcttctatataagataattacttttgtaaattccaaaatcaggttatacattaaatatttgaaatatgtctgtcggggttggggatttagct

SEQ ID NO: 19672 - DNA, 1171 bp, Mus musculus
aaacaaatacaaacatattttggtgtttcaattattttccaatttcaaatgttttctaatttcaagtggtctatctaacatctgattacataaacaaggaaacaaaagttaaatgacacacctagttactcttataacaggtctggagctgatgttgtgtctccaggagcctttctaaaaacccttgtcaggagcacctgcatctcctgtgggtgacagtgtcctaagaaggacagttaggcttacaaagccaggaggttggcttctggaacttggatatcaagtgacgcccccaagaaatggctaatggtatgtcttatatgatctcataattgtcaattgtaatggcatggtgaagagaaatcttaaacatattgaaccagaagaattaatcatcaaaaataccagaagggaagctcaataaaattttgacttaagtaaaattttcatcagctagtgcaacttcttgactttttttgatgcattgatttgaatagcatttgattattcacgtttctcatctttgcacacaattcatactgactctgaaagatgtattatatcaggaagatgtttttgattgcgatgaaagggcagcctgctcctttgaaaccttgtttcatcatgtgtgaataatagcaaagggtttttcattgtcagaaaattgaaaaggagataacagaaactaactgatgaaaagtgaaaagttaaagacttctatgtaatgtttctcagcttctgatgaaattttgctaaaagattaaataatttgggaaaagtctttgagcattgttttttttttagctcagttttgaatgtactggacccaaaacatgaaggtcaggaacttccaacaaagcattccttgaattatttcctgttgaaaggtaaacagtagctatagacaatgtctttgggagtgaggacacagggctaggaagtcttgtgggtttgtgtcacttggcttacagtgtatcctcttctctatgctttgtttaacttagaagcaatgtttatgtcatctgcagaatgagctctctcttcttatctgtgttgcagatataagctgtagcttattttcagaagggaaaaaaccacccaactctggagagcgagagaaagcaaggaaaaaaagacttgataaaggagaatcttcctagtaagataactg

SEQ ID NO: 19673 - DNA, 1751 bp, Mus musculus
tcagaaaaactatatttttgtggagagacttaaaattggtgatccaggttgtctaattgtaccatatcaagttttaatcataagttggaatattgaaagtttaccataagctgtcagacagcatgcaacaagataaagaagagagactgattttagtcagttagcctaaatggacctgctggtcttcagaaactcaggcagaaaatcacaagtttaaggcctgcacagtctgcagagtgacttcaagggaacaactttgtgagctcctatctcaaaatataaagtggaaaaaagggcgtcctgagctatagttcagtgatagagcacctagcatgtacagctaaagactcggtgcctaactccaaagaactaaaaacctggccttcctacttcctagggtgtggtttgtgctaagaaatgtctgaatagaaacaccgagttaaagattgtgtttctcatgggccctgattagtctattatccaaacattcttaaccacttgatacccagagagaaaaatcacagggtggataaacactttgggagacctatgagaaaagcaggtttctctttagacaaacgtctttaagttgccccatatggacctggctctctccgaggacactttcttatcaagggaagtcagttactggctttacttttggtattttgtgacttgatttctttgtgtaagttgagagtctttgggagtactttaactcctgtgacgttgccactgcagggtttcaggtctgttcagaggttggatgtgcacggaagaggatagaatgcttttgtgtctaggaatggaaagcccacgctattcttggaagcccagcagtgggccataggcatgaaggtgccacccaagtctatccagtttcatcccttgaatatttaagccgaacatcatggcagaatttaaacctcaaggtcaacagtggatgagatcaaatctcaaaagtgatcaggtctgattgttttcatgtctgtagaaaggccgaaacccacgcatgtcctcatcatcttttgtctttttggttggctttggggaggttgggtttggtttggtttggtttggtttggtttggtttggtttggtttggtttggtttggtttggtttttttcccaaacagggtttctccgtgttgccctggctgtcctggaactcatggaagtctgcttctgcctcccagactttatttattttttttagctttcagaactttaaagaatcacaaacaagccaggtggcactaacacactcctttaaaaccagcacccagggggcagaggcaggcagatttctgttagtttgggctggacacttactctgtagtaagtgtcaggccagatggggatacacagagaaaacttgtctcaaaaaacaacaaacccaaaaacaaaccaatacaacaacaaaagaatcacaaacaaaataaaaagaaatgttgactcctcaacaaattgagtttttagcagctttataatttttggtaaaataccaaatttacctatggtaatttttttctaagcttctttagccaaaatgtaacttctcatgagctggagtaaagtaaggctgaggcatcttgggataactatgacttcactgctcttagtgaagcagccatagtgatatatcctgtagctccaatacttggaaggatgaggcaggagggatgcttgagggagacctcagctagtcagtcaccagagaactttaaaacactattggctatggttaatag

SEQ ID NO: 19674 - DNA, 1186 bp, Mus musculus
ttgtgttgccctggctgtcctggaactcactctgtagaccaggctggccttgaactcacagagatctgtctgcctctgcctcccaaactctgggattaaaagtgcaccataatgcctggcctgcttacctgctttaaaaggaaaataaacagatgataaagctagataaaataagggcagaaagaaacattttaggaattgaaagataagttttcccagctgatatattctctgaaaactttaatctcaagtaaactgctgactatttgaattttattgcatgctgactacattatataaattgaacttaaattaatggatcaattctttttatttgtttgctttttaaaaggggcattattgtaggtagccctggctggccttgaacttgtgctgatcctgctcagccttccaaatgctggggctataggcatatgctacaatacctacctattgttaacaagatatacatacagactgtatatttaatttcccttttcagattatgaactactatggaaaaggaaaaataagaattacattagtaacaaagaatgatccatataagcctcatcctcatgatttagttggaaaagattgcagagatggatactatgaagcagaatttggaccagaacgcagacctttgttgtaagtatacagtgacagaaaccttcagcaataggacaaagatataattttagtttatagcaaaataattctgtatttaacttactgtaacatgtacattacattttaattacactttgttacctgtggggaggacacacgtgcttggggtgcatgtggaggtcagagttggctcagctggtggagtcggttctcttctccaccacgtggaccctgaggattaaactcaggttgccagacacctttacccactgagccatctcaccaacctgatattaaaatttttgttcttaccacttgcattcatcctttattaataggtacgcacatgatagttagtagaaattcttcctaatggcacctagactgggctcaaacttactatgtagaatgtctttgtacttaccttcctgcctccaactcccaagtcctgacattagaggtaacaccaccctgtctggctcagtaggagtattttttatgttattattttgttttcctttgttgttcttttgtttttttcaaaacaatttct

SEQ ID NO: 19675 - DNA, 1145 bp, Mus musculus
aatattagtctcctgcacactttattataccatctttaaaacaattgattcacacttccatctatacctgcttataaaaggcagcttgtcaaaccaggatttaaacccaaaattcccatggagcccacattagacagaatatgagtatcctgtaagacttattagagcaatttatctttataccatctttaaagcaattaattcaaacttccactaatatctgcctataggaagcagatagtttttaattgttaagctctctgcttagagcagccatcctgttataccatctatctgttgtgctctctacctggagccacagacttcttttaattaatacctgttcatagcaggcgattatcactgctctctctacttggagtcagtgactaatattccctatctagttctgaaacacaggtgaaatttcccatctttaagtatcaaaaggttatatttctctctttatatcaatgaattttatggcacagggtgctttgtacctttgtctcctgattctttattctcagggaggagctgagtgaagaaagacaatcgttgtctgtgtccctgtttgggggtgggggagcagagtggggagcgaaggatacagggaagtgaacacagaaaggctttcttaggtgtagatgcctctctgccattctctgtaggcccctcaaacccagtcagctttgactccttactgatgcagccccattcaagggttgggagctgggggcagtgaatttttatctaaggttagttgagttcaaatcaatttgttgtggtaaatctccaacccaaataagcctgggcaatgaaaacacaactcaattaatatgaatacatgctgtgcgcataggttgggcatatctaccactacactgccctcttccccatatgaaagaccccttataacttgtggtttctccaggccaggtacttctgctccacttttcttcttcctcctgttcctcccaagtcattctcattctctctctctctctctctctctctctctctctctctctctctctctctctctctctccccccccctctctctctctcccaaaaccttcagctccaccttcccctctttctctgtccaatcactggctctaacctttcttttataaattaagg

SEQ ID NO: 19676 - DNA, 1138 bp, Mus musculus
caacaaaaaacaaaagtcattcaggaaaatggatcagaaagagaactgctgcttaattccaagatgttatgaatctaatgaatctaataatagacctatacattaataatataatagaataactataaaataagtattgtggtgactaagaaatgtcataattggaaatctgtaggtgggaatgggatgagggacctagaaaaatcccattcctttggtccttatcaactgtcaaacttgtgccatgttccttggtagtggattgtgagagtctctgactacacagaggctaatgtgattagtttcttccctgcatttttacaatatatatattcatgttctttgaccctatttctcatcattattatttaaattattgttaaattggcactatctcatagcagtcaaatagcttttgtaggactgaagcaaaattcagagcttgggtgcactcagctatcagttgtcctatgagtggggttcatgacttagcatgcacccatttctcaactccacagcaggttctctgtgagggctcttcattctccttgtgaaaaacacaaacactcagcagttacagattttcttactgtcaactctttacctgtctccgcacccccaactttttttttttaaataacagccacatatttgaaatgagaacaaacttaaatggtcagcttttaaggtattataaaagtgattaagttttatcatgaggagacagctagctaatggttttagtggaacacattaaacctcatagaacacaaaagttaaattttgccatgtaatagggattggttagagggagtaacagagttcccttttctccttgaataaatcctaaacagaccttagaaaatgtgttatcagactgcaaagcaggatgaaatattctatagtcataaaaactaaagcaactttcagaccatttagttggggaaggaaaaaaaaagtgggggctagagcaactcgccaatgtggttgtggtttccctgccaagggcatcagatgctggtctctgcctccattttaacagcttgaccttgtttagaacaacctgaatccaatcctcagacctccctgagagtccccacctgggatagaaagcacacctctccaagagcgctttctg

SEQ ID NO: 19677 - DNA, 1219 bp, Mus musculus
tcacaccactgtaccaatctgaaaaactggcacccactgtgtctcaaagacatcagtttggcaactcagcagatttttcaactgcctgtacgtggttctcactcctcccacactcttccttttcccaagtcctgaagaagtcagacactggtattagacattgatttactttttttaatatgtttttattacgtattttcctcaattacatttccaatgctatcccaaaagtcccccataccctccccactacttccctacccacccattcccattttttggccctggcgttcccctgtactggggtatatacagtttgcgtgtccaatgggcctctctttccagtgatggccgactaggccatcttttgatacatatgcagctagagtcaagagctccgggtactggttagttcataaagttgttgcacctacagggttgcagatctctttagctccttggatattttctctagctcctccattgggggccctgtgatccatccaatagctgacttttatatgcaacctacaccaattggtagagatttgtttctggcaaactgaaatctccccaagccccacatctctatcatgaactaagaataatcacactgacttagcacaacttgtctcctatcaggctctcaatacatggcagctttcttcacctttgagcttctatctgtctgaacatttgccatgtttcaaagcctggttttaactccatctgctccttgaagctctgtcgtgtggctccaacccacattctgttatctattctccaattgtttttgcactctttctctcctactaaaattcacccttcattatgattgacaagtaagctgacatccatagtgaagtcttgtttagtcaagcttttgttgagctttatgttcccactggtgtacacattgactgaaaaatgggctttctcttgagtttcccatatgcccacacagagaccgtcaacatgtatttctttaaattgattaccaacttttttctctgctacaaccagcttgagaaaagggtggcaactcaattgaagaactgcttacctattttctgtgaggtgttgtgcagacaaagggcacctcagataaggaaaacactgattcagaaacgaacggagcacaactagctagtgttgtttagtgtgagaaatagaaccacgggctgtctagatgatgtgaacacaggacttctggtttggg

SEQ ID NO: 19678 - DNA, 1172 bp, Mus musculus
tattgttttttttttttttttctgttattatcttttgaagggctggattcttggaaagatattgtgtgaatttggttttttcatggattacgttggtttctcttgtatggtaattgaatgttttgctgggtaaaagtaaaagtagcctgggctggcatttgttctctctctctctctctctctctctctctctctcttaattttcccccaattttattaggtatttacttcatttacatttcaaatgctatcctgaaagactcttatacccccgcccctgctctgctacccaaccactcccacttcttggccctggtgtttcccctgtactggggcatataaagtttgcaagaccaagtggcctctcttcccaatgatggccaactaggccatcttctgatacatatgcagctagagacacaagctctggggatactggttagttcatatagttgtttctcctatagggttgcaaaacccttcagctacttgggtactttctctagcttttccattggggaccctgtgttccatccaatagctgactgtgcatttgtgttctcttagggtctgtgtgacatctgctgaggatcttctgccttccatagtctctgacgagaagtctagtgtaattctgataggtctgcctttatatattacttgacttttttcccttactaattttagtattctctttatttagtgcatttgttgtcctgattattatgtgtcaggaggaatttcttttctagttcagtctatttggagttctgtaagcttcttgtatgttcatgggcatctctttctttaggttagggaagttttcttctataattttgttgaagatatttactggtcatttaagttgaaaatcttcattctcatctatacctatcctaaggtttggtcttctcattgtgtcctggatttcctgtatgttttgtgtggctctctctacttgctgcagtctctgacctgcagagacaagaatgacacagacaccaaggcgggttcatgcagcagctctttacttgtggctttttcccctacagctctcttccccagcagcttcttccccttccttcttgcagctttatttacaactctgtccactttggcaagggtaacaacaacagaactcctttactcaggccgactgacctcatctagct

SEQ ID NO: 19679 - DNA, 1213 bp, Mus musculus
ataccttaaccttatcctgcagtgcttttacttactacaataaactaggacaaattttcatagaaatttatgtaaattcagtcccttctaagtaccagacatttaaaaaatatgtccaatacttagtagaataaaaaaattccttctttcctccagaataatttgattaaaattgtaacagacttcagttgtaaagcctattggttaccagagtcaaagttgtgcttctcctttggaaactgggtcacttctacagagaatgtaaaatgagtgacttgaggcatatccgtagatatagagatgctaagctgagaagtctatattccttccatccttggcagaaggaaaatcacagggagaaagcaagcatagcattaggtcagaccccagtgacagtgtgttggcagtgggatgaagagtgcggaagcaatcgtctcatgtgtttggtggactaaggtgtgtgtgtggggataatagatggccagagagtcatattcctgagcagttataactcatgcaagtgaaatggaggagggaaatccagcaagagcaggaggaatgggtgatgggtttgtggttggaggtgatcaatgcactttgaagtttgtgccattctggtctgctgcacatgtattgctatggataggctatgaaggtcaaggtctataaactttacctcttcctgttttcagttcctacttatcagttattggcctaaatgctcaatacttaattgtttgggaccaaataagatcacttaattgtgatatcatattagttcatttttacattcttcatatttatctctctatgtttttattgtgacaaatagtcatagttttggtgaatagaaaaccaaagcttaatctgatgtagatcatgaagaatctatgttggatctagttggacaataaattgtgcttctgtgctttccaatcaaatattctttcactagaattgctcaataaaagtcatgaaactctgaaaactcatgatgattttgtaactttttattcttgtaataagtcctatttccaatgaacatatttcttttatatatttcatttgggtatgattaaaatatatcatgagagagacaaagtaggattatttccctaaagtttctaagaaactaataatctattcagagagccaaatggtgttatccaagtgaaaaaattatttatcccccaaaggaatttctacctattac

SEQ ID NO: 19680 - DNA, 1216 bp, Mus musculus
caacttggaaagaggcttaaaggctcactgggtttttgttttgtttttgtttgtttgtttgtttttgttgttgttttgttttgttgttgaactttaaattctttttatattattatttcccagtgtttttcaaatatggaatctaatgataacacatagctgggacctagaaatgtgatcttatttgccttttcgagaccacacaagtcagggaacatcctctatctccagtacctgtattttcttgctttctgagaatgtttatgcgtttgagtgtaaggtatttgtgccaaaccacacaggagcatttagactcaaattccagagcatcagtggttttcatataccttacaattccatcagtttcaataactttgttagactctgcctggttatatgtattcatgtacatgcctgctcatgcaaacacaggtacacacacacacacacacacacacgctaagaacatgttgccgggacccattctttattacaacagcaagtgcttggacaacagaatcctgcagcactacattcacctttcaagcgaaggccttctagggcttctcacattaatagaggatcttcagtaatcaggcagaacatcccactttctgctcttgtggttttaaaagactttagggtacatacctagttctgaaatgaaaggtttccctctcaaacaaaaattccaaaaacaaacttgttcttgaatgtttaaatttgactgctttctgggccactatgaatccatcttgaagtcttgttcctgtggtagtaattcttatccatggttgcagtgaatgaccagagcctgtctctttatctaacacagacctatgctttggcctcatctcttaatctctaacctctagccctaggaactggacttagccctgctcattctaggcaattgctctaccagcgtgctaaatatgaaatccagacgacacttcagtgtgtttgtgtattgatgcttttcatccatcccttccatcactgatgaatgctgttgacaaaaatatttttagatcccttttaaaaatagaatgtgttttccagccaccagccatgacagtggagatgactctgtttttcggatgactcagtgtctactgaaataattgtgtgactattttattattgctcctccacaagtttttcagaggtctgtttacttcattttcaattctggagccacattctttctaacagg

SEQ ID NO: 19681 - DNA, 1179 bp, Mus musculus
atttaaaaatctttactaattttctaatttaatatattttactgggtttacgaacatgtatacaaaactgtaacattagagatgaaaagatgttttctttcttccaaaatgacatacggatgtttcctacttgaaacagcagcatgggtagaggctagatctcaacagcagctccccaaaagatgcatagcaatggttggagatacttgcattgccacaacttgtgtgcatgtgcatatgtgaataactctggtgtctatagcacagaagctaaacaacctacactcatagagtgaaccttttctagagggtgccttggtgagaagcccttttcatatgcatggagatgaaagtataacaaagtaaaaacagaattctaggcctttaggcccaggcttgggaatgtggcctttgtaaaggtatgctaattataaaacagatagcgacattcctccacccacctgcttcatgggttcaacaagtgctcattcaaagaaagtcacaagaacctgcaatgcaaatgtgctattggtaggggctcttagaagctgtcttgagagttaacaattaccaggtattccttgtgactcttgtaactttgcacttccttgtgactcttaactggtatctttggtatcttccaacaacgccctccccacctccttgagttgtggtttcttcctttaaatacccccttacccagctactcggcgtttggtcttctacccctgtgtggtgtatgaccgtgggcccgagagggctcttgaataaaaatcctcttgcagtttgcaacaagactgtttcttgtgggtgattttggggtgtcacctctcctgagtcagaacgttgtgggtctttcagagactccccagtttggcttggctttcagttttactacaatcatcagaccaaatatctgtatcttctgtgcatgctggctagggttgagttcattgtgctgtgctgaaaatcccaaactcagtggtttcttacaagtaacatttatttcttactcttgctacattccaacaagttgacatgtttttggcacagggactctggctgataacaactggttccattgcaactcagatttccataaagggaaaagaaggaagagataaatcaagtactggacctaccagcctctagaaaaatcatttctgcttatatttcatt

SEQ ID NO: 19682 - DNA, 1170 bp, Mus musculus
tgcttattcacacttaaattaatagtgacatatagtgattggtgtgttcttcttgattattttaacatacaccacttattcagttggtgactgaagctaattgaaatgtagttataatcagaataattaaataacaattggtttaatctctgtttaaagaaaaactgaaactcagcttttggtccctcagttcatagcatgagcaccgatactgactcaagtcgatgttgcctactcagtactttttggaaccagcacatcattgaaccttgtacctcctaagcatggggtggctgctactcagctcccagtggcactataatagtgcaatttcagtgtatgtatgcatgtatgtgtatatatatatatatatatatatatatatatatatatatatatatatgtgcatatacataatctcttaagattacatcaatcagtatatgtgttgaggtaataatggtttgtctaatgagtctagtttttatgaatgcctcatgtcagcttgtcacacagacacaggaatgacctactttcatgctttgttacagtatcctgtagagccaccagattgtgttgtggactttcctgtcccattttctgtttcctggacaccacaggtaaataattgagtttattttaaataattagaaagtatattctttttactcaaatgattgttttagggtctaaatttatttatttatttatttatttattcatttatttatttatttatttttaagccattagatgtaaaacctcattctttaataattcatatttttccaaaaattaaagtttgtttttctctctttaaatacaaacatgagcatgtacacacacattgtctagatatctgtaggcaagcatgtagaagtacagtctactgctatacattgttaagtttaaatcttaaaaaattctttagaaagcagtggatataagtggagtgtgtgtgtggttgtgtgtattgctaaaattgatgacctaatagataacttctctaagagatgtcctttgtgtccttgcttgctctccttaggctaattcagttttctactacattgatagaggtcagtgtctttagaatcgttctagaaactggtgttatatacaaagaaggtgatattagtagtaaaatagctttaaaaatcaaaaaagccggtg

SEQ ID NO: 19683 - DNA, 1567 bp, Mus musculus
tgggtgccttggcaataggactgggattgttctatggcttaacaaactttataggtttgtttgttcgtttgtttgtttttagggatccagaaaatagtctgttacaaaatttgaaagatgttttagaaattgatttcccagctcgtagtatcttggaagaatctgtaagtttaattattagcttcaataatctgcattatgttaataataaaatttaaatgcttctctcaggaaaatgaggctgaaaaaaatagaaattggtagaatgttgcaacacagaactcttagttacaagtaacactggcatcaatgggcttgttaactgtctgttagctaggctcttaaagggatctgttcatgatctttagcagggaagtggttaatgacagatacacttattaaaactacaaagaaaagaagagacactaatgagatgtttggggttttgtactgtttgctatagatgactacagtacagttttaattagtttgctgtaagtttgtgaaggacagcgatagtttttcagaagtgagcagcagcattgatactgtaaagataacagaggcagggctggctttggactgagctactgccgttaacaccaagtgatggagatcatctccttgttccctatgctgcagaactgtggcgatctgctgttcactagctcatgtcagactgtctttgtgtagacacagaaatgactgtgaacatggaaaaaatggctaaaacataaaaatcttgccagccccaaatgaaatctgtgtatatgtgagtgcagagtggatactgtgatgagactaggtgttatctctgcttgtatgttccccagtgcacaagcatacttaaaacacagatatagaaacaagtatcatatttgttcttcttaaccttgcttatccacattcaacacaaacacttttcttttgaaggactttagcatggactgtggaatctgttatgcccgtcacctgaatggtgccattcctgatcaagtgtgtaataatccccagtgtggacaacctttccatgaaatatgtctgtatgaggtaaaactagtaattctctacataggaaatacagcattaaaataatctgttttccctaaagtacttctctggtttgccacaaactcctcttactagttaatttcacacacccacaggcttcatgtcttcatcttgtaaactattgagtgtgccagggagaaacagaatctagaatatactcatgaatagcatactgacacataatacatatgtggtaggtataactgaagtctccctaaacttgctaccagtatgcaagttctctagttgtgatgtgccagatgaggaaggcaggaataggtaaggcacttagtcaataggtagtatgtgctactgtgcaggctgcatatacataaatgaataaaataattctcttttggatggtcaaagattcttgtgaccctgagcatctcttttctacatgaattgtgcttccgtctctcaatcagttagttcctggagcactcctgttagagcacatatgattgactgtttttgtgcaaagcatcttacagtg

SEQ ID NO: 19684 - DNA, 1170 bp, Mus musculus
attgcaatagattttcttactttgctttaaaaagaggtaatatactatataagcttgatatttttatgcctttggtgaaagcataccaatttatgtaaagcaaacattatgatattgaccattcatccatgcaataagataaagtaaaattagttccttgatattttcttgataataaactttgtagttgtttaaataacatctattaaataacatctagaacagtatgactattgctatctttttaaaatttttttctattttatttttcattttttattggttattttatttattgacatttcaaatgttataccccttcccagttccccctccacaaagcccctatcctctcctcctccccctgcctctatgaaggtgctcccccacctgtccaccccacttctgcatcagtgccctagcatgctcctaccctggttatagagcctccacaggacagaggagctcccctcccagtgatcccctataaggcaatcctctgctacatattcagctggagccatgggtccctccatgtactcgttggtctgtggccataccaccctgaacgtgcctgatctcgtctgatctcggaagctcagcagtgtcggtacttggatgtgagactataactaccttttaaatagaattaaattggataaaatgaaattattgagagtaattacttttaaatttttaaaaaaaacttccctctcatctcctcttcccccgttatacctgccctccacccttgcaacctccccaccaacaaagaaaaaaaatcagtcttctcatggaagttgtaatgtgtcacattgtgtcctacagtaaacctttttgtccacatatttttgtttgtaaatgtgtattgcagtgatttattggtctgctaagaggcctctggctgctgctactttatcaatactggaatctcactgggactcctcttggatatgctgttgtcctgtgcagtggagatagtgtagttttggatctgaaggactggacaggactctttatggacttcaacagttcactgatggggtagatgttagggtgggttaattcaaagccctagatctgtacctgagaggtatctgacctgttcaacctgctggctcttcctctttcatgccctctggggatggctcaccagccacccctgttacc

SEQ ID NO: 19685 - DNA, 2583 bp, Mus musculus
aaataaataaattatgcacatgtgattcttaataactttgcaagccttctagttacaactgctccttaagaaaattgattaaaagtgcaattagtcactgcccctttacagccaagtatttaaaatgttttgtcaactagttattaattcaaaagtttaggtattgtgaaattttaaaactttaacttcttaaaagacaaaaaaagagagaaattgtatccccgtgcatactatttagtgcattcccatgcacactatttaagtcttacctttattttcaaaatttaatattttaatgtcaaagagtttaataaatgctttatagtatcttaaagggatctacttattggcttatagattaatcctaaaacagctaccttattagaaaagggaaaaacaggttttctccacagaacgctgcagaagcatattagtaaattcgtgtgacgagctggtaaataagttgactcatgtcctgattgaattgactaaaaaactaaattaaattcatgttttagatccatccttacttgtcatttttccagtttagactagcttctagccttttaactttatggcaatagtacatcagagactgtatatccagacttagtaagattagtcatttaatagagtcataatgatttttctcttttcttcagtgtgaccagtcattttaactcaatcttagactggtctaatattcagtccaatgttagagattcctatattctaaattacctagcaatgttaattcagagcacatcccccactccccctagatccctaacctcagaaggattgctggccttacagctaatagaaaaagctattgaagagcaattggtcacttaatacattggtaaaatagaaggaccccctgactaacaaatggaagggtccagatccagttctaatttggggtagggactcagtttgtgtcttttcacgagataaagatagagcgcggtggctgccagataaaataattcgtcagatgaacacagattctaaatattctaaagtatcaccttgaggactaaaattcctcttttgcttaaaagtcggcttgaggactcaggctccaaaaagctactctctgagccagctccccgacaggaggccggagactagcctcagctttacaatttgcatttaaataaagtacctggactgccccaaaagaagttctgctttcctactttctcactgtcgagattttgtctttcaagcaggtaaatcaacattctcgagccggaccagcggatgtgcatccccgccccccttgagagcacaggtggcagctgttatctccattctcaggacattccagcacgtggccttcagtctgatttaaaatttaggttttcctagagagctagaaaggtagatatttctatactaataaagattggtttttgttttgatagacaggcttagtcccttagctgacctctggcttttcacccttgctgttactacaaggtgtccttagctccttaggctgtggaaaaaacagagatgaggaggaacgacttccagctcctattttagccacaaatcgtggtgttactaatgacataattattgcttaggccttgctaatctgaggttgataattctcctttaggagctgcacagcactcagaactgtgcatactggtttgtgatcttacaaattcagtatgggcatcgcttggtgcagagagcactgcaggggaaggtccaacttgaccatttctgagtttcctgtgagataaacccggtttgaaagaggttggtatcaaattttggctaaaaatcaaaaatatttttcggctctgcctcccctccccaaaagataccgagagccacaggtgtgggtcttaacagtacccacgggaggaatcgggtcaatgtccacccaagccaaggttaaaagcccactcatctacggatgaaaaaatcatttgatcacctcagttaagcgttgccttatttaacttaattaataggggggagagagattggagccgtactattgaaagggcaagcccttcactgcctccctgtttcccacctatcatccaaaaatgcgaaggaatatcaacttagtgttattcttattatagtgtatttcaaagttgttcagtcaaacttagccagagttccaacgccctacttaaaattcaactagaaagttacctaccaagtagtaattagcattataaagtcagagcctacagctccaggcttttcagttagttgtttactaagatgagaaaggacagtcttaagccagatacagtttaccataagaaaagttaaagaatcccagggaagcaggttttttctttagccctagattccaggcagaactattgagcatagataattcccccccccccccctcaggccagctttttctttttttaaactttgttaataaaagggaggaaatgtagtctcccctcccccagcctgaaacctgcttgctcaggggtggagcttcctgctcattcgttctgccacgcccactgctggaacctgcggagccacacacgagcacctttctactggaccagagattattcggcgggaatc

SEQ ID NO: 19686 - DNA, 1839 bp, Mus musculus
gctgtggctaaaaaaaaaaaaaaaaatcagatggcagatctaacaaatccaaacaagcggcccaaggagcaatgatcctggcagtcaagaaacctaaagattattatgacatcagagagaccagctttagatacaccgctgaacactatcaagttatggacagtatttgacccacctgggggccaagaaattaaaaagtgtggttaggtcctttgactactatgttacaggactctatgacttgacagaagaaatagtcaaaagctgcaaggcctgtgctatgatgagagaatttctaaaagaaatcttcccaaggtaatagacctgcctttgttgcccaggtaaatcagggactggccaagatattagagattggttagaagttacattgtgcatgcaggccccaaagctcagaacaggtagagagaataaatagaaccattaagagacccttaccaaattgacagcggagactggcgctaatgattagatagctctcctaccctttatgctcttcagggatagaaacacccctggacagtttagactgacccccctccactggtaaaaatagcctttgtacatggtgctgacatgctgctttcccagcctttgttctctaggctcaaggtgctccagtgagtgagacagcgaacaaagaagcagctccagaaggcctactcaagaaaagaagacctgctagacatctccgcacagaaaaccttgagtctccggtggaaagacccttatcttgtactcttgaccaccctactttctacctttatgggaccccttttgattttgcttctgcttttaattataggtccatgtgtgttaaatagacaagtcacctttattaagacaaaaattagtgcagtgcggcttttaattttgagacaacagtaccatgccctaaaggatcaagtatgtcagggaaaagatagtgtctagttctaagattagaactaataacaagtagaaggggggaatgaaagtataacaaagtaaaaacagaattctaggcctttaggcccaggcttgggaatgtggcctttgtaaaggtatgctaatcataaaacagatagcaacattcctctacccacctgcttcctgggttcaaagagtgctcattcaaagaaagtcaccctgaccattaccagaacctgcaatacaaatgtgctattgttaggggctcttagaagctgtcttgagagttaacaattaccaggtattccttgtgactcttgtaactttacacttccttgtgactcttaactggtatctttggtgtcttccaacaacgccctccccacttccttgagttgtggtttcttcctttaaatacctccttacccagctactcgaggcgccacggtcctctacccctacgtggtgtatgaccgtgggcccgagagcgctcttgaataaaaatcctcttgcagtttgcaacaagaccgtttcttgtgggtgattttggggtgtcgcctctcctgagtcagaacgtgggggagtcctcacgttgtgagtctttcagtatccatataatttcctgactctccacttggtattggataaccagttgtggggaagcttttccctggggaagacattttcacccattctcaggattttctagttgaccaaaattctttctcggtttagagacccataagcatttgccttttatgttagactgacattgcttttcaggtcttgtttaggcagctatcctgatgagacttcatggtatatagacacatttttttaaaagatgttttggaatacatttttattgctttagattaattcctattatcctagtccctcttgtacattttg

SEQ ID NO: 19687 - DNA, 1210 bp, Mus musculus
ggagggtgtcctcaaattccttgctgctagaacccacttaggtgacaccaaccttgactttcagatggagcagtgcatctacaaaaaggaaaagtgacagtatctacatcataaatgtgaagaggacctgggagaagctgctgctcgcagctcgagctattgttgccattgagaaccctgctgacgtcagcgtcatctccttcaggaacactggccagggacctgtgcttaagtttgctgctgccacaggagattgtgaaggtccaatcgcttcacacctaggactttcactaactaggtccaagcagccttcagggagccacggcttctagtggtaactgatcccagggctgaccaccaacccctcacagaggcctcatatgtcaacctgcccaccattatgctgtgtaacacagattctctgctgtgctatgtgtccattgccatcccacgcgacaatggagctcacattgtgggtctgacttggtggatgctggccagggaagtactccgcatgcgaggtactatctcccgtgagcacccatgggaggttgtgcctgatctttacttctacagagacccagaggagattgagaaggaggagcaggctgctgctgagaaggctgtgaccaaggaggaattccagggtgaatggaccgcaccagctcctgagttcactgctgctcagcctgaggtggccgactggtctgagggtatgcaggttcactctgtgcccatccatcagttccccacggaagactggagagcactgccagccactgaggattggtcagcagctcccacagcgcaggccacggagtggcttggagccaccactgagtggtcctgagctgctctgcagacgcctgagcaaagggaaaaaaggtggaagaaaaataaagttcataaaagcttaaaaaaaaaaaaaaagaatttggatttttctcctagataatttgtaggagtacctaattatttacttcattgatcccagggcggcgatggtgttccttgctacctgcctcaatgttctaggtacccaaataaaggacacacatacacacacacagcctttatattttgttgtgcctaaaacagctcaatggctgggctacttcctaacccccacctccctccaatatttccaagttattagtcacaaaattctatatttcatcttggctgccctgggcccagtttgggagccgtc

SEQ ID NO: 19688 - DNA, 1139 bp, Mus musculus
aaggaagggagagtggttgtgcgccgcggtgaagggaggggtagcggagaccacgagcggagggctctcggtggctctggtcaccccttctcgcggctaaacctttagagccatggtaaactcgggcctctccagagtcgctgccaccaccgccgctgccgccactaccggctctcaagagtgagggataccggcgaggtgagcgaggaggtggcggctggaacggtggggccagaagccaccatgtcggatacacggaggcgagtgaaggtctatacccttaacgaagaccggcaatgggacgaccgaggcaccgggcacgtctcctccacttacgtagaggagctcaaggggatgtcgctgctggttcgtgccgagtccgacggtaagggtattggaacggtggggtaggggatagtgcatcggttgcggcacaacctgagggttaagcgctgcgctccggtactgtattctgactagcaccactagggacagcgcattggtcttgagcctgcccttctttacgataaaaacaaactgctgggcctggatttactctctgtcagacgtgaactcgcagttctccgcctccatccctattgaggatttgactccttctccccccccccccacccccccatcccaacccggtagttgaggtttagaatgtatgagtgggaagtcagtagaagaccaggtaggaatatcgcccatgagatgacccccgactcccgagccgctttaggtacagtcctgtcggttgtacctatgtagcataaaaggtttagagaaactctgccttaaaaacaagtttcagttgttccaatcgccaggtgctggggaaaactaaaacggactttctcttggagttactacagactgttgccacgaaacacacaagcacgtacatatttattgattgatccctccaaggctgccgttgtagggagtgaaaaagtgggttccacaatctcggcaagttagaaaactaaagcggactgtgaagttgtatttgttgattgcagaattcatagaaaccattttaatattaaaaactgacagccataataaaaaagctactacttatatatactcaagagctgcccaactggaacagctaatgcattcaagaaataaaa

SEQ ID NO: 19689 - DNA, 1099 bp, Mus musculus
tctcttcttatgtacttagataagactgttttgacagcgttaaataggaaatcattaacatttactgaatatatgggcttaatactgttctataataagctttcaaggcctaaattttgtcttttggtaaaatggtaaaatattcataggattatgataattatatataaaattataaaagttttctttaaattatgaagtacttactgtataaagcactaagacataaactaaatccattgcttttcaaatgttccttatagccccctaaagggctccagtgaattgcctctccttgttccaagttttctgtggagtcctgtcctggctcatgtataaggaatctaggacatttatttttagaaggtgattttgaaaaaccttttttgatcaattttggaactatacaagtttttatttttgtttttctcaacaagtattatattgttttataatgtgaattttgtgcctatacaggaagatatcaagtctcttactgcacatatagttgaaaacttttataaagcacttgaatcgattgaatatgttcagacattcaaaggattgaagactaaatatgaacaagaaaaagacagacaaaatcagaaactgaacaggtattatttaagtgtattattacatttatagcaagcaaaattaagtacaaaattgtacacagtttagatcttatccagtgaaattttctctattagcagagcataaggtaaactgtctttctgccacatcagttaattatatgacaacttgatactgcatatagtaattttgatagagtcttaatttgcaacatacaaaaacatttgaagatttctctagctacatcttatttgatatgctgtacatgctaagttaaactacattagttcatcttggttagtcattcttcccaaagtttatctagttatgaccttgtagtcattactcagcatctgacatatttcttacagtgtaccatctatattgcgtagtaaccgatttcgcagagatgcaaaagccttagaagaggatgaagaaatgtggtttaatgaagatgatgatgaagaaggaaaggcagtcataacaccagttgaaaaatcta

SEQ ID NO: 19690 - DNA, 1187 bp, Mus musculus
gctattgtttggaaaagatgggctgtccgtgtagatacgaagtatagtttttccataaaacagatgtttattttgtattaaaaataccactgtacttgttttacaccatttgtatacatgtggtgatattactgctaaactgtaaaattcaggaattaaaatgtgaccctataattccatgattgaggcttctgtttgttttattgtaaaataagtgaataagtgaactatttttgagatatgtccagtttacattgtcttttaaaggctgataaaatccataaagatatgttataagccactaggtcagaaagtcttaaatgcaagactcaaccattctttaaatatcacttacaagaggtaaaccttgagcaaacctaacagcataaagccattctcacctctaaacaaaggtgcacatacatcatgcattcatcttgtatcacaagtgaactgggattctttcagccaatatcagtaagttactgtatgagtaggcattctttcaaacaagttttatgaagcctctaccatcttagtgcttagaatctaagcagccctgatctataaactgttctgttaactcttttgttatgttaactaaagtactgtaccatataaagacttcctttaattttcctttctgaggaacttcaaacttttaagacattattatgggaagtgtttcttacaatggaaatatgaatgttttcttaaagtccaagggcaacagttgtgtaatgcatatgctcacccacatgatgaaaggatccttggaaggcacaactaggaagattccacagtagctgctgtcctgaatgacgaccctcatgcaggctggggtgcttacagcattatctccactcagctagttcaagtcagagcacacatttgtatgccttaggtcctaaaaatatctgtaaacatgtacctaataaaaaactatttttaataaaaagttatgtgaaacagattcacgtgttttaatcactagtttttctgcaggtggaaggttttacattttacattcaaacagattagatgaaattttagtaaaatcccagttgaggccagcaagatcactaagtgggtaaaggagcttgctgctaagcctgatttgatgtttagaaagaccagcactctatggtaggtagcattttcctcaacaggttcagtcagggaatcct

SEQ ID NO: 19691 - DNA, 1161 bp, Mus musculus
catatgtgctcacatatgtaaacattcatacatgcacacaaaacacacaacctgcacagaccaaaagttaaaaggataaaaatttaaatataaactttgactttccaagaaaatctgactactctgaggagttctctagaagcttagatgttaacagtaaaagacagatgtaaacttagagagtggcaatggcagtaagatgcacttctgctgcatttatatccccataagcacctgcttttttcgtttcctttcttcctcctggtcatattcttcttttgattttctgaaatataaaaaaaaaaaaattaaacgttaatcggtttggtgtggccctggctgtcctagaactccctatgtagatcagcttacccttgaactcacacgatccacctgcttctgctgccctaatgctgggaagaaaggtttgcacccctactggctggctaaaaagtaaattttcttcttcatcaaagaataaataaacagcatgttaacctgacattatagtataggcaaagttatccactggactgatccaggataagtgatatagaaatacttttctcctaattaaatataatacaaattggacttcaaacatgaaaatctaaaatgttctaaaacaagaaactttggctcatcagcagaacattcaaaatgtaatgtgtaatgtttgaattccaaattttctggttagggttgctcatctgtgatctgtgcaagtattccaaaatctgaaacattcattcctaagcatttagataagagtcactcactcaagctgtgtatacatgcccccccccaaaaaaatcattttgtcggtagtattttctagggaaaagttcaaatacattcagatcatatacaacactactaacatttcatttaaaaacagttgaaaatgcatacctgaggacctctcttagaattttcatctcttcctgttcaaggtcactgaccacatctgcaccatcagttaagcagtcaggtaacacacctgttcaaaaccaaacaccacatggaagaccatcaactcaactgaaacactcttcacactgttatggaccatgggtacaaattagtttacaatgtatcatttttaaaaattccaagccttgttaattatcttctgcttaacttccttacattttagggatt

SEQ ID NO: 19692 - DNA, 1156 bp, Mus musculus
attcaaagtaccacattaagcttgagtaattcagcctaaagggaaagaaatctatcttcatgaagatgtgatttcaagaagaattgaaacttataagtcctatatccttttctttaagtacatttaaaggagaaatatggaagaagatcactgttacttcttaattagttctcatttatcagtaatggtttctgcatttatgttctgggaagtaaggtaatggtcataaagtcattggataaaatattacgcatattctaaaatgtaatttccatttttatagtgataaattaaatgaattgagacgacaaaaagaaaaattagaagagaaaattatggatcaatacaaattttatgacccatctcctcctagaaggtaacactaattgaatttaaggatctgttttaaagaatatgttattattgttgaacttagactaagaattcttctaattctactaggagaggcaactggattactctaaaaatgagaaaattgataaagtcaaaaaaagatattaatcgggaacgtcagaaatctctaacactaacacccacccgctcagactccagtgaaggatttcttcagctgccccatcaagacagccaagacagctcttcagtaggatcaaactctttagaagatggccaaaccctggggaccaagaagagcagcagtgagtgctctaaacagattattgatttagattgctcttttaaaagacaatttctagtagtcttagtttgatcaatgatatttcgttttaactttatgttcataatattaattgcagactacaatagtgtataggtagagataagaatcattgtgctagtaaggtaaactattgtaaaaagatcattcaattaagaatgagccttttgctcatattcttttatagcataaaattggaacaaagttatattagggaagtaaaaaaaaataaatactaatttgaagaggtattacagaattatttaaagataactgaagtctcaaaaattattgcgggatacttgctgacgttttggttaaaatgaaataaagatggggaaatgtaaatatataaacttaagatttagttttcattagacttagaagtcccacaaattgtgcctgatacaatttctagacttactataatttatacttcac

SEQ ID NO: 19693 - DNA, 1201 bp, Mus musculus
attaaattactttaaaactcttgaatgaaaggtgctatttaaatgtaaatactaagggtttactgaaacacgatacacatactaaaaatctattctctagactttgaaatcttctttgtgactccttagattcaagtctcaaattggtaaatgggtatcatggaagtctagagacagttgcatgtaaaaaaaaaaaaaaaaactgtaaattcactgttggttgagaagttgaaaatgagtgtagaattatgttttagcttaatatataagagaataagttaggtttatattaactagcatccaatttgcacaattagcacacatcccaggacagttaatgaatgagtgtgaggtgacctaatgagggtaaagcagtttgaacctgctgaggtaatcagcacatcagctagaaatactgtaatgtattaacttggagtaggccaaccctgaggagaaaaaaagagaaaactaagagaatacaatgagactagtgcattattctcaattatattaattgccttcctcatagcaattcaacaaaggactagccgataactccatgatttttttttctttgaaatctacttcagaagcagactttgtaggaatctaagccaaatggaaattaatccaaaccatttttctaaccaagcctacacccaactatctggtgctattcctaaacctccatgaacactttaaaaatgagaataacagcatctgcccagagctctaataacatgcctcctagctggccatggaaatgttttggttcaaggttttctgagttggtggttaccaaagagttcacgagacaggttcatgtgaagcacctttcatgcaaggcatgttaaaagcctatttaaaaatcactgtgcacattacagaattgtaaccacctcacaaatggattactacagcctgaactgtcttaacactttatgtcaggaagtaaaatcaatactgtaccaaatctggaattgtgatggggaattatgcattctaaattacttttgtactttaagttactttttatgaaaaaaagtgaattgtctttcttttcagctatttgtcctgagatgtattttttttctttgagtcttgaatatgaatagtacaaaaagagcccattttataattataaatcttgatatacaggttaagctatttggacaatgaaaacgccttaaatggaatgctt

SEQ ID NO: 19694 - DNA, 1137 bp, Mus musculus
gataatatttagcaggtcagagtagcctaaataaaagctgcaaaactatatcttataaaagaacaaagttaaggtcaaaagaataaattcaagaattattccaagctgggcatggtggcacacgcctttgatcccagcactcaggaggcagtggcaggcggatctcttgagttcaaggccagcctggtctacagagggagttccagaacagccagattaaataggatataagagatgacaactacatgtaatttatgaacctgatctaggtgaaaagttttttttttttttttttaagaccaagtatgatccttggatggattatataattaaggttagcactactctggtcactggttttaagtgggaatacacacacacacaggcaaatgaacatatttcaaaatttttaaaataaatttggcctttaacctggccaagaatatgctagaatactttaaaatatcaagacaaaaccaaattgttcttctatgtcagcctattatgagcattgttcatgtgtagacttgagccaatttttttttttttttttggtcttttgagacagggtttctctgcatagtcctggctatcctggaactcactttgtagaccaggctggcctcgaactcagaaaaaccccctgcctctgcctcccgagtgctgggatcaaaggtgtgcgccaccacacctggcttttttcttttttttttatttttttaattaggtattttcttcatttacatttcaaatgctatcccaaaagtcccccagaccgccccccccactcccctacccacccactcccacttcttggccctggtgttcccacatactgaggcatgtagagattgcaagaccaagggacttcccttcccaatgatggccgactaggccatcttctgatacatatgcagctagagacacaagttccaggggtactggttagttcatattgttgttccacctatagggttgccgacccctttagctccttgggtactttctctagctcctccattggggatcctgtgttccatccaatagctgactgtgagcatccacttctgtgtttgccaggccccggcatagcctcacaagagagagctatatcagggtcctttcaggagccaattt

SEQ ID NO: 19695 - DNA, 1233 bp, Mus musculus
tggctagctcactacggtgtgacagacaccttcagcccccaaatgcctttctagcccttaagccttccctccggggcatttccagagagtccccacccacgcgcaaatcatagtgcctcatcccctgagtcctcacctgactctctcctaaccctcactccacagcttagacagtgtaatcaggtatccgggaagtgtggaaatgcatcctgggacaagtagttctaacaagaagaaagcagtgtaaaactacaattcccagatagacttgttttacctctctcttatgtttcacaagccccctttaaaggaaagcctctcttaatcgcatcggctgtataagaaagccttttgaggcattttttttagttgagcacatcatttcgaggccattctgaggtaaaccgagaaaagagcgtaaagaaaccgagcgaacgagcaaatctggcactgcgttagacagccgcgattccgctgcagcgcgcaggcacgtgtgtggccgcctaaggggcgggtccttcggccaggagaccccgtcggccacgctcggatcttcctttccgatccgccatcgtgggtgagtgtatgctctgtggccgcgctctggctagtggcgctacgcgtcgctctcacgggtgtcgtcggatctaatccgtctcttttcgaatgcaggtggagccgccgccacgatgcagatctttgtgaagacccttacggggaaaaccatcacgctcgaggtacgggccaccttgccgttgaggaagccaaggcctgactgaggcccttagtgtttgagggcgggtttctgagttttgagttgtgaaacttggctttgagctgagattatggtgcttagcaaaaacaacgtttggttttcggtgtggtacggtttagcctgctttatcccgagtggcgaaatgtagggtaggtgatgggagacgcttttctccgggcagacgcgttcctgtgcttcccccgccgtcgctcgccctggtatggggactaatttggattgtagcactctgggtagtttgcacgcggtgtcatcttaattgattacctttagctcacctcctccttgctcgttttgtataaagctagcagttaatgacttactatgtaaccgtatattaactacatatatcaaaacttggcaggttgaaccctcggacactatagaaaatgtaaaggccaagatccaggataaggaaggcaagtaaagtttgtcactag

SEQ ID NO: 19696 - DNA, 1170 bp, Mus musculus
cttctttgtctttgacagctcttcaatggcacctttgttaagctcaaaaaggcttcaattaacatgctggggattgtggaatcgtatattgcatgaggcaaccctaacctgaagtcaataaacgaactcatctacaagcgaggctacggcaaaaatcaacaagaagcggattgccttgaaagataattcctagccgggcagtggtggtgcacgcctttgattccagcacttgggaggcagaggcaggcagatttttgagttcaaggccagcctggtctacaaagtgagttccaggacagcccagacagccagggctatacagagaaaccctgtctcggaaaaaaaaaaaaaaaaaaaaaaaagataattccttgattgcgctatctcctggtaagtttggcatcatctgcatggaggatctaattcatgcgatctatacaattgggaaatgcttcaagaaagcaaataacttcctgtggcccttcaaattatcttccccacgaggtggaatgaagaaaaagataactcactttgtagaagacggagatgctggcaacagggaagaccagataaacaggcttattagacggatgaactaaggtgtcagccatggtatttttgtaatctggtcagttaataaacagtcacagcttggcaaattggaaaaaaaaaaaagaactcctccctgttgggcagtggtggcacatgcctttaatctcagcacctgggaggcagaggcaggaggatttctgagttcgaggctagcctggtctacagagtgagttccaggacagccagaaaaacccccatcttgaaaaacaaaccaaaccaaacaaacaaacaaacaaacaaaacaaaaaaccaaagaactcctcctttagggcacaacagataatgtacttgcgggcaaaagcctgaagacctgagttagagaccaaaacaaaggtgggaaaagaaaaaccgaactccacaaagctgtcctctgacctccacacaagaaaccctgccagaatgctgatcaagcatagaaaaccccctttcctttggaaaccaagctgactcctctcatgtgtatcacttaaatgatagcttcttaggtttcaattcaacacttaaaaacaaacccaccatgtatttcagaacactggggataaaatcagtctctagaac

SEQ ID NO: 19697 - DNA, 1185 bp, Mus musculus
agttgggacgcctggttaaggacatgaagatcaagtccttggaggagatctacctgttctccctgcccattaaggagtctgagatcattgacttcttcctgggtgcatccctaaaggatgaggttctgaaaatcaggccagtgtagaagcagactcgggctggccagcggaccaggttcaaggctttcgacgctattggggactacaatggtcatgttggtcttagtgttaggtgctccaaggaggttgccactgccatccgaggggccatcatcttggccaagctttccatcgtccctgtgcggagaggctactgggggaacaagattggcaagccccacactgttccatgcaaggtggcatgccgctgtggctctgtgctggtgcgtctcatccctgcccccagaggcactggcattgtctctgctcctgtgcccaagaagctcctgatgatggccggtatagatgactgctacacttcagccagaggctgcactgccaccctgggcaactttgctaaggccacctttgatgccatctccaagacttacagctacctgacccccgacctctggaaagagactgtcttcacaaatcaggaattcactgatcatcttgtgaaaacccacaccagagtctctgttcaaaggacccaggctccagctgtggctactacataaggattttgtacaagaaaaataaaagaattaagtctgctaaaaaaaaaaaagaaaaagaaaaaaggagtccacaatttcttagctttaaggcaaaaaagctaatagttgttttttcctagaaaaatctctacagttgggttcaacaaatgacaaagcgctttttatcttaaaattatagctaaaaaaagtaaaattctttgattggtctaaatttataagattcgtgtagccatttcatttgttttctgactggccttaaaggtataaatatgctctacatgtattggtcatgaaacattggcttatataagttattgggtatgattaaaaaggtgtaacactggttacaagaaagttagctttaaattggtaactcagggttagagtcattttaaataacaacacgtggcaaaaaccagtcccaaaaaactaggcctctaggatacttctaaattgagataatattttatgtaattcttattctaaaaaagtagattataagaga

SEQ ID NO: 19698 - DNA, 1101 bp, Mus musculus
ggtgggggtggatcccagctccaaaccccgccctccgaacgccaccaaggaagtatggcaggctccgcctgcaccctatttctattggacaaccccgtgatccatcttctctatcccgcagcctattggctctctgtcccccgcgccagccagccctcccctgccgggaaggtgagtcacgccaaactgggcggagagtctgccctcctctctcagttgctcatctgggcggcggcggctgctgcaactgaggacagggcgggtggcgcatctcgagcgcggaggcaggaggagaagtcttattgttcctggagctgtcgcctttgcgggttcctcggcttggttcggccagcccggcctctgccagtcctgcccaacccccacaaccgcccgcggctctgaggagaagtggcccgcggcggcagtagctgcagcatcatcgccgaccatggaagacatagaccagtcgtcgctggtctcctcgtccgcggatagcccgccccggcccccgcccgctttcaagtaccagttcgtgacggagcccgaggacgaggaggacgaggaagacgaggaggaggaggaggacgacgaggacctggaggaattggaggtgctggagaggaagcccgcagccgggctgtccgcggctccggtgccccccgccgccgcaccgctgctggacttcagcagcgactcggtgccccccgcgccccgcgggccgctgccggccgcgccccccaccgcccctgagaggcagccgtcctgggaacgcagccccgcggcgtccgcgccatccctgccgcccgctgccgcagtcctgccctccaagctcccggaggacgacgagcctccagcgcggcctccggcgccagccggcgcgagccccctagcggagcccgccgcgcccccttccacgccggccgcgcccaagcgcaggggctcgggctcagtgggtgagtgctgctgcgcgttacgcccctccctcttttgtgtcttggcccgggggaggaggggacgggcagggctgctcgggaccctagggctttgtctacgagtggcagggtgatggcgcccccgctggcgggaggcgggcagaagggt

SEQ ID NO: 19699 - DNA, 2051 bp, Mus musculus
aacacctgaagttttctcagatttgatttatatctcgcatagtaggtaactgcctctgaaactgcacattattcttttttctttaggtactttaataactgtatttatagggtacagtgtgatgatcccatacattattcattgttgcctggtcagggttagccgattagcatatccatcatcttagatgtttttaattactttgtagtgatttagagtcttcacttggctataaacattgttaactgttgtacagtagccatgtactctttaaaattgacaatagttcatattttcagtaatgatccaagtctgtatttattaactaaatgctattcatattcatttaataataaatgtttactaacacttttattaatatgtcataatacttgcattagctctgagaacattggcattctctaattttcctttctatccatggccacagaaaaaattatggatttgaaggagcagccaggtaacactgtttcgtctggtcaagaggatttcccatctgtcctgtttgaaactgctgcctctcttccttctctatctcctctctcaactgtttcttttaaagaacacggataccttggtaacttatcagcagtggcatccacagaaggaactattgaagaaactttaaatgaagcttctagagaattgccagagagggcaacaaatccatttgtaaatagagagtcagcagagttttcagtattagaatactcagaaatgggatcatctttcaatggctccccaaaaggagagtcagccatgttagtagaaaacactaaggaagaagtaattgtgaggagtaaagacaaagaggatttagtttgtagtgcagcccttcataatccacaagagtcacctgcgacccttactaaagtggttaaagaagacggagttatgtctccagaaaagacaatggacatttttaatgaaatgaaaatgtcagtggtagcacctgtgagggaagagtatgcagattttaagccatttgaacaagcatgggaagtgaaagatacttatgagggaagtagggatgtgctggctgctagagctaatatggaaagtaaagtggacaaaaaatgctttgaagatagcctggagcaaaaaggtcatgggaaggatagtgaaagcagaaatgagaatgcttctttccccaggaccccagaacttgtgaaggacggctccagagcgtacatcacctgtgattcctttagctcagcaaccgagagtactgcagcaaacattttccctgtgctagaagatcacacttcagaaaacaaaacagatgaaaaaaaaatagaagaaaggaaggcccaaattataacagagaagactagccccaaaacgtcaaatcctttccttgtagcaatacatgattctgaggcagattatgtcacaacagataatttatcaaaggtgactgaggcagtagtggcaaccatgcctgaaggtctaacgccagatttagttcaggaagcatgtgaaagtgaactgaacgaagccacaggtacaaagattgcttatgaaacaaaagtggacttggtccagacatcagaagctatacaagagtcaatttaccccacagcacagctttgcccatcatttgaggaagctgaagcaactccgtcaccagttttgcctgatattgttatggaagcgccattaaattctctccttccaagcactggtgcttctgtagcgcagcccagtgcatccccactagaagtaccgtctccagttagttatgacggtataaagcttgagcctgaaaatcccccaccatatgaagaagccatgagtgtagcactaaaaacatcggactcaaaggaagaaattaaagagcctgaaagttttaatgcagctgctcaggaagcagaagctccttatatatccattgcatgtgatttaattaaagaaacaaagctctccactgagccaagtccagagttctctaattattcagaaatagcaaaatttgagaagtcggtgcctgatcactgtgagctcgtggatgattcctcacccgaatctga

SEQ ID NO: 19700 - DNA, 1129 bp, Mus musculus
atggagaatcactgctcttgggcgaatttaatcttcctaatttaaaaaaaaagtaaaaccaacataaagagtccatatgaaactaaaatacttttgacaagtatgaaaacagacaactgtttttgctagaaatttgtgtttttcttctttgcagcttcactgacaaactctttacaaaatgggattgaaaatgtattagtgcttgtcacagtgctttggacgatggattctgtcctgtgtgtacttacttaccactgtgtagctgtctcacctcctgcctgtacttccctaatggtctcaagagtatctcaacttctgcattcctaggacttacttcagcttgactaatccatagtgtgtgctttgaggtagtcatgtgttttcatgtggtatctgtgaactttcatgtatgacttccagagttcttacaattattgacaagatctgactgcatctgatcatttattaaattatcaggcagcattgttctttgtgtgtatgagtgtgtatgtctctgcacatactggtatgtggatatggaggctctaaggcagccttgagtggtggtacagagacaggatctcttattggcctggagctggcatatgagttggccttttggccaatgagccctagaatctgcctctctctgctttcctgacatgaggattacaagtgttggccattgtgctggcctttatgtgtttgggggttggtaggtccctgtaccaactgagttgcttccccagtccgtggtgttcttatagtaggaaatcctactctaccactcattgaatggggattaaggcagtattttgtgattataaattgtggttgccactagcatgagactgtttcaagtagcacagaaatgtataaagaaacaggtaagacttatctataatcccaatattaaagaagtaaaaatatttagtagatttttttcagacttaatggttagacatatttttgtttgttttgtttgttttatatgtagcccaaaatggtttcaaattcactgttgtagcccaggctggctttgttctcttgattcttttaatactctgttttcaagtgtcattataggcatctttatctttctttacagaccagtttttccattatacgt

SEQ ID NO: 19701 - DNA, 1181 bp, Mus musculus
tcaggacctctgctcttaaccattgaaccatctctctagcccttcaactttttaaaaaatttgatttcctatacttatgtcttacaatagtccttttcgtatgtactatttccctgtaatttgaatatcatgcatagtatgaagaagaaatgtctcaagataattttaagtgagctctgccaggcctaagaagtatataagggtaatttgtagctagaatgatttggtcactcaggagggaggttggcccaaaagaaggaaaagtacaaacttagcatttcactgataggtagcttatactgggtttaatgttttagtgtgtttcctccgtgaagaacatgtaaatgtgctaaatccaaatggttaagatagtattctaatttcagacttcttcttttaatttttagttgttgacctcctgtactggagagacattaagaagactggagtggtgtttggtgccagcttattcctgctgctgtctctgacagtgttcagcattgtcagtgtaacggcctacattgccttggccctgctctctgtgactatcagctttaggatatataagggtgtgatccaagctatccagaaatcagatgaaggccacccattcaggtgagatgtttgaaaaatgaggcaacagtgtaactaggattggtagtgagacttcatctcctatctgtagaattatagttgtgtgatttctttgttgcttagagataatctatcaagaacatatctgcctttgagatttcttatggtagaaaagactgggctcattagtatttatagtagatattggttatcacagtgaattttagaattggtgaagttatattgttcttactgtttacatttaatactatctaatactatataccttttccctagtatatgttcttacctacatttgcttcagtttctcagggctttatacagagagaggagataacttcaaattgaagcttcaaaatgacaattatatgccatgaactattgacaaataggattttaaagcagttgtaatgaaatacatgaaaatgttacaaagttctaatttatccacagtattagttttatatatcatttagttttaaagaatttttgaagactccagtttcttttttttttttttttaaatatttctttttagacatacctttttcataaaggcatttaca

SEQ ID NO: 19702 - DNA, 1181 bp, Mus musculus
acatttgacatttttccataaagtgaatatggaaatgagtaggatctttggtagcagatcctaataagactcagaaaataattttctgagtgatctggaggccaagtgtcattaaacattttactcattaaatcctcatgattaacgtccatttaaaatgagaaaacagttttagaagattaaatttgcacacttagattactaagaaaatgatagcagttaaaatttaaaatgtctttaaaacacgcttctatcagcttgggggttttggttttgttttattttgtttgagatatttctgtagccaaagttggttttacactagtaacaatccttctgacttagcctctcaagtgctgggattacacgcatgaaccaccacagccagcttactttggatttttataataagtgtaggcctttatagtagattgttctacactgttaatctcttttatagatctgtgattgctgattgacatgtgagaatcagtgtcagttgaggattttttctttttttctttttttaaagggcatatttggaatctgaagttgccatatcagaggaattggttcagaaatatagtaattctgctcttggtcatgtgaacagcacaataaaagaattgaggcgtctcttcttagttgatgatttagttgattccctgaaggtaagtttattttgcttttcatttacatgtatcagacagattggcaatataaaattctattttctctatccaaataaatcataaagatgaaatgaaatcatatcaatgtaaatttaggtttgaaaactcagtgtcctgtgtttagatttgtgtgagaactatagtttgacacttttctccttcagggaatactttaagaaagagaaattgagaagaaaattttgcttttgattgtgggtttaaaactcaaaactcaagaaaagtgggttgattctgtcttcggatgtaagttcatgcttcatcatgtcagcatacgaagtgaacccaaataggtctcatagtgtacttcggcaaaaaagtatccaaggagctaaagagatctgcaaccctataggtggaacaacattatgaactaagcagtaccccggagctcttgactctagctgcatatgtatcaaaagatggcctagtcggccatcactggaaagagaggcccactggacaggcaaa

SEQ ID NO: 19703 - DNA, 1829 bp, Mus musculus
agtactgattgatattctttggcaatattaattttataatgcttttatcctcttttctcaggcgcagatagatcattatctaggacttgcaaacaagagcgttaaggatgccatggccaagtgagtatgccctgcagccttcttaccaagggcgagaccatcatccggcagtgtccttctgaggccagcattaactctttttaatgcttttttttaaaaaacattaggcaaaggtggaaaattagtttgtattttggtagctttatgattctctaaataatatacagcataacgttttttaaagaagtgggaaacaaacacaaaatttgacatttttcttttttcatttgtagaatccaagcaaaaatccctggattgaagcgcaaagcagaatgaaaaggccccaaacagtagacattcatctttaaaggggacactcccttggttacggggtgggcgggtcaggggtgagccctgggtggccgtgcagtttcagttatttttagcagtgcactgtttgaggaaaaattacctgtcttgacttcctgtgtttatcatcttaagtattgtaagctgctgtgtatggatctcattgtagtcatacttgttttccccagatgaggcacttggtgaataaaggatgctgggaaaactgtgtgttatattctgttgcaggtagtctggctgtatttggaaagttgcaaagaaggtagatttgggggcaggaaaaacaacccttttcacagtgtactgtgtttggttggtgtaaaactgatgcagatttttctgaaatgagatgtttagatgagcatactactaaagcagagtggaaaaatctgtctttatggtatgttctaggtgtattgtgatttactgttagattgccaatataagtaaatatagacataatctatatatagtgtttcacaaagcttagatctttaaccttgcagctgccccacagtgcttgacctctgagtcattggttatacagtgtagtcccaagcacataaactaggaagagaatgtatttgtaggagcgctaccacctgttttcaagagaacatagaactccaacgtaaccgtcatttcaaagatttactgtatgtatagttgattttgtggactgaatttaatgcttccaaatgtttgcagttaccaaacattgttatgcaagaaatcataaaatgaagacttataccattgtgtttaagctgtattgaattatctgtggaatgcattgtgaactgtaaagcaaagtatcaataaagcttatagacttacctttgtgtttagtgttttagtttcatgaatgcacagcaaaaacacggtggtaggcttagagagtggacacatggtaacatgcttttagaaaggttttagttcatgaaacagcttaagaacaaagaatatatttacatagtgagatttatttgactcataacaaaaggttttaaattattttatactttgaaaataaattcatgcaccaatattttaacagaatacagtgcaagatttatgaatatacataaaattacaccatataaattttacaaataagactttcaaagtctttataacagacactattgctcttcaaatatatacatatatcattgattagtcagttgttcatccacatggttacttaatgcaagatctgtctgaatgaaatgtcagtagtacaagacaggcagacacagtgatcactcagcatcaccaggtacagaaaacagaatcagggctgcatagggctctactgaggacccagcaacctgctagtgggttgatgtaaggcattaataagttggcgtgtaaaatagctt

SEQ ID NO: 19704 - DNA, 1914 bp, Mus musculus
ggaggtaagaccaactcctcatgcccgcccctcttgaccaagtcttaacctgtgtcccttcctctatctaggaggaaatgaacacatggatccaggctatctcctctgccatctcctctgacaaacacgacacatctgccagcacccagagtacgccagcatccagtcgggcgcagaccttacccaccagcgtcgtcaccatcaccagcgagtccagtcctggcaagagggagaaggataaagagaaagacaaagagaagaggttcagccttttcggcaagaagaagtgaacttccctgttgtcccgcccttctcttacctttagtaagagtccagcatgcaagttccgaccaacacattactctgtgcctaatgttcctccatgtagttgattttttttcttttcttttttttttatttttgaaataaattttttaatttatagagtatttctgaggggtgggggaaccatacctaaacactttatctccaagtttaaaaagtttgaggtacagagggaaggccagatttttttaatgaaattatatagattagatctcagtatttaaactgttcctcaattttgtgaggctgtgttggaaataacccgcctctgatgctgttggtatgcaaggcagtggtgcttacacaatatttcctgtgctctccagagacgatggaccgatttcctgacactactctcccttcacttccgtggttaccctgagtcttgacttacaaatgcccacgatgggtgtagcctttattaaacagatcatgtattctgatctcttgctgcagccacagtgcagctccatgtaaacctacaggccaaaccatttgtatccggcatcacttactaacacacaacatgtggcttttctgcatcaattgctgtgacagttcagaatgttggtatacaagaaagaatagaaaattgataaggttttaaataatctgtaatttcagtctctttttttctgaaatacattatattgtatgtttgagataattctagtacaaagtataataaactagatgtataataaaccctttaaatcattgctaagtgtataagtggaactgaagcatttactggacaaagtaatgttactctaatggttacttgcttgtgcgtggccacactgttataatttgcttcattaccctgctatttgatacatagtgtgcatttctctgtcactgtaactattgtaataacaaattttcatcttactgcacaatcaaaatggcatctatagtaatgacctccagagtctgagcttggacagagagtgggcgctcaggcctggtgctccatcatacgacctgtacctctcaacttttgccctgttaaatatatgctatgtcattaaatgcttttaaatctagcctatgactagccggtgtttttccttccctgtccaagcatgcctaatagggaatttgcaaagtgtgtgagtgtgagtgtgtgtgtgtgtgtgtgtgtgtgtgtgtgtgtgtgtgtgtgtgtgtgtgtgtgtgtgtgtgtgttggccttggaagctgtaacaaatgaagaatgaataggcgtggtgaatggtgatacttttcatgtcttatagccttaagacctgcacaaggagaggcaaatgtttcatgaaaaagaacaagggataataataaatactatagacaaaggaaggctgtcttcccttacagaacaaaagccattcttggtaatatgcaaaaactggacatggctatggtagtgttcattgagtcttcctcaatgtcaagtttgccacagggcttcctagtgcttaggacttctgaggtggacagtcagaggctatcttggttgtggtatctttcaaatctagcagtcaaggtttcaaatctagcagtcaaggtttactggtcaaggcctcagca

SEQ ID NO: 19705 - DNA, 1261 bp, Mus musculus
cagggtgtcaagctgttttcattttttaggcaaatagaacaaaagccattttggttcatcctgatcacttgaatgatagactcaatgccctgtgcctggcagggagcgcttgcagaggtgtcctagccttagagggctacttcagtgtctctactgacagaaactcctgtatctcaaatggatctcgaagttctctagtaaggagtcctaaggatgacatgtattgggccactagcagggattgaaaacattttaaaagaaatcctttttcttaggagtaaaagctggtaaaaggggtgacttcctggttctgatcaaaaccagaccaaaccctcatttcagcaaagccttgcaagacactcccttgctcatttgccatatttagatgtcttagtggagtcagagccctgtttggtatgtgtttttcatgctaagtctaaattgtcttttcatttcatgatgcattttttctcttttgtcaggataacatcatatagcatcttgtttgtttttcctaatctctatgtacatatctatctacctgtaaccgtagataggtatctagatagataccaagcttttaagctctgggctactatgcatcattattgggtctctgccttaaaacacatccaaatttatattagaaaaaaaaaaaaactgtatctttttctttggtcactaagatcccctgaccatgtctttatggccacaaattatactgtgtcactgatcatatatatgtgtgtgtgtatgtatatgtatgtgtgtgtgtgtatatatatatatatatatatatatagccacacatgatcatacttatatatgatgtttccatatatgtgctgtgtgtttaagttttgtatcatccagactgataccaaattttaaggtttttttttttttaacaaagacaatacacacataagcacattaaaacaggaatgctatgatactgtttagcatttgctctgctgcctatctttctctgtttttaattaacaattggattttattggaagaagaaaaagcagtttcattattttggatgatgatgcagagactcatgttaatgaactcgaaaatggtgttgcttcatgtactttgaaaaccaatcaggtgtttcctgcgctactacttgtcatgttgcattcatgttcacatcctgatttcactgcctcagatgtgcctggccacaaagcactctgaactaattcctaaagagaagcaacaatatgtgtatgtgggggggttgatcaca

SEQ ID NO: 19706 - DNA, 2028 bp, Mus musculus
catcagatctcattacggatggttgtgagccaccatgtatgtgtatgtggttgctgggatttgaactcagaaccttgggaaaaacagccactgctcttaaccgctgagccatctctccagcccagagccttgcttttttgtttgtttgtttgtttcgagacaggatttctctgttgtcctggctgtcctgcctctgcctcccaagtgctgggattaaaggcctgcgccaccactgcttcttaagaactaagtaaacacagctgcttccatatgatacgtgtgctttcttgatttgtaagtgatctctttgtctacagttgggccaaaagtgcagtgttcgtcatagccctttcttcctgtcctagtcagtatggcaggaagtgactgttgctctttatatgacactgcttagacgggagccaagctagaacatggaacatagtttactgtctgcaaatgaacagggagctattggagacttagcattctttccttggtgttaaaacaggctacaagccatgtgacccccaggtaattcgagaccgtgttgcccacatggagttctgctatcaagagctttgtcagctggctgccgagcgtagggctcgcctggaagagtcccgtcgcctctggaagttcttctgggagatggcagaagaggaaggctggatacgagagaaggagaagatcctgtcctctgatgattacgggaaagacttgaccagtgtcatgcgcctgctgagcaagcaccgggcatttgaggatgagatgagtggccgtagtggccattttgagcaggccattaaagaaggtgaagacatgattgcagaggaacactttggatcggaaaagatccgtgagagaatcatttatatccgggagcagtgggccaacctggaacagctctcagccattaggaagaagcgcctagaggaagcctcattactgcaccagttccaggctgatgctgatgatattgatgcttggatgttagatatactcaagattgtctccagcaatgatgtgggccatgatgagtactccacgcagtctctggtcaagaagcataaagatgtagcagaagagatcaccaactacaggcccactattgacacactgcatgagcaagccagtgcccttccacaagcacatgcagagtctccagatgtgaagggccggctggcaggaattgaggagcgctgcaaggagatggcagagttaacacggctaaggaagcaggctctgcaggacaccctggccctgtacaagatgttcagtgaggctgatgcctgtgagctctggattgacgagaaggagcagtggctcaacaacatgcagatcccagagaagctggaggacctggaagtcatccagcacaggtaagtgaagttactactacctgggtgctaaggcgatggactgaaacataagccattaaagtcactactcttttgaattgctttcctcagatttgagagcctagaaccagaaatgaacaaccaggcttcccgggttgctgtggtgaaccagattgcacggcagctgatgcacaatggccaccccagtgaaaaggaaatcagagctcagcaagacaaactcaacacgaggtatgcatggcatcagcagagcgcctgctgtccctgtgtggctctggtgagggtgacagtgcttgcccagctttgctgtcagaaaagagtttcctgcacaggttcacatccttgtagcatggatgtcatgacagcagcatctgctttaccaagtattctcatccatgttttgcaagaaacagcttttaaagtgaggttacattattcaggacatgagtcagagtcacccagtacctaacttctcctcagattaaaattagagccttggtagaagacagacagcaagatagaacctgtctgtgttgtccctttaagttgaagttagggttagaaccctagagcagggttctataatgaagcttgatttgccaaagatagcatcagttgtcagggcagacccctgtcctgttcctgtctgtct

SEQ ID NO: 19707 - DNA, 1125 bp, Mus musculus
catccagtattgtgacgttgctgaccagccatcacttccatttgcacaaaggatgtttaaaatttctgatatactttcttgtctgtttgtctaacttgtcatagacttaggagctcgagcaatttgttcagagcctgtgactgaattgttcacattcatgtaagctgtaaaagttcccctggtttttttcccctcagtatttgaccaaccatcctctcaaggcgtgacactggtcatgaaatacaagagcagttttctttcccttggcttgacaaagtccaacatacttcagtatcttaagtcagatggtaggccctctgtaaagtgagaagtttcttaagtactgttaggaacacatctgaactcaaccagaagtttgcaagggtccaagggcagtgagaaaccagtggcaaagtcagcttacgcactgtattgtgctccccccacccggctcagtgacttacgtttctttatatttctttttgttctgtctctctgtaggacaactttggatttgaccttcccgctgttgaggctgctaccaaaaaacacgaggccattgagacagacatcgctgcatatgaagaacgagttcaggccgtggtggctgtggccagggaacttgaagccgagaactaccatgacatcaagcgcatcacagcgaggaaggacaatgtcatccggctctgggaatacttgctggaactgctcagggccaggaggcagcgtcttgagatgaacctgggattgcaaaagatattccaggaaatgctttatattatggactggatggatgaaatgaaggtaacttttgaccaaaagaaggcaggggaggccagagctgacgcagtcagaccttctctttgtgggagttgtgcgctagtgctctttgtccagtgaactcttctgcaaagccagactgaagccgcagtgctcataagctggctagctcactactaaatgagatgagcaccatggaaaagttgtaaacgaaaccattttatatcccagatctgacgcagtgatttagatttttaccaatgtagagaatcatgattttctttttcattgttaatatgttcagtggtctgtgtattagtgatagtgttctaggatcatatatgc

SEQ ID NO: 19708 - DNA, 1217 bp, Mus musculus
aggcagtgctcataacctctaaactatccttctagccctggagagtgtatagctttgaggttgacaaactgttggtatgggtatgagaccttgtgtgttaatcaagtgctgcactgctcagcagtgtactgagcctgctttattatggttactttgaaacagagtctcaattagttgtttattctagcctcgaacttaggatccttttgcctcaatttttaagtagctgggatttcagtcttgtgccaccaggccttataaactttagtactgactctcaatcttaggtcgtgcgaacagtgttatttacctttgcagtggcagcagtagcactgagattcatttggtcaaatgaatgcacacaaattttagtttgggtttgggcacaaaccatgacaggcgtgtatgattcaggatagttcctctgcccttctgagtaaagtgtctccactctgttctctggctttcagcctaaacccactaagggacggatgcggatccactgtctggagaatgtcgacaaggctcttcaattcctgaaagagcagagagtccatcttgagaacatgggctcccatgacattgtggatggaaaccaccggctgaccctcggcctcatctggacaattattctgcgcttccaggtaaggagcttggcctaaagaatatagaccagctttccacatacgagctttctgttccacaggaaccaggctgatgccaccctggaggaatgccagagctaccatgttcttgtacatttcactgcccctggcatacgtgcctttcctgtcttaatgggacttggtaatatgggttcctaaggtgtacctctgaacatctgatctctgctgtttggctttcagtagccaaggtcaagcagtatggctagtgctgggtacttctaggctggctagactttgctaaattgtggcccgtatagaataggggctccgttctcaccttctcatcccccttggggtggaaaggagcagttttcaggaggaaagggccaaaaggcctttgatgaatttgaattggtgactatgtgatggagttatctctgtatagaagcgagtatgagatggctccttaatccgtgcaactccctcaagtcttgggtacagtttaggctgcctcggggccagggggcccaggaaaagcacttctgtttagtcctggctcacgatccaggcgtatgctttgtgctcttgttc

SEQ ID NO: 19709 - DNA, 1146 bp, Mus musculus
tcccagctactaaattttcttgattttaaaaacttcagcttctctcctatttattgttaagtttaagcccaactggccctttgatatctgatgtccacattggaataaagtagatactccatatttggggtgtggctgtctcctggcataaatgaatacttctagtttccccagtcacttctcaggccactttttgaatttccccatatcatgtaaaaataatttttagagcagtttatccacgcgtgttagtatcttaaaaccacaaaacttggttttctttgctagctgataatgctttaattctggcaccaggaagtaaggttttttttatttttatttttatttttatttttatttttatttatggtttaatttgatctgagccagtgtcttttggtagtgactttttctgagtgtatgtgataattgtactcagtccagaatcacaagattcattataggattgatgggctcttttctttggcttctctgtctagagaagtctagagaacttcttaggaagttctgaaagatgtcatgtccctgataaagggtctttcccccaagatgtgtcttctgagcaacttgcttgtgtgaatgtgtgcattctgtcgtcttctctcgtaaacataaagctgactgctgatttatataggtcacgggatattcccctttactttaagctgtagtgcatctgaaatgtagaaggagctataacaggtacttggtcaaagacagccgaaacaatttacttttgtcttgtggcctctgtaggtgtgggagggaagacatgcagtattaggctacatcttggcattttcttccagattgagcctgtgggtgtgacacctagtctcagccctcacataagtaaactcaaactttgtgacaccagctgtagcactcaaggagccaggcttccctctatagtagggttagcatgattagccccttaacatgctcacttggctcctacagtcgcagagcagcattggacaaagctgctcctctacagtacttcctggaggctctgaaacgcctcaccttaggttcacataaggtgagtctgagagagtatgaggacttaggaacttactggttttagctagtgcatctagaccataatgtctgctgttttggggt

SEQ ID NO: 19710 - DNA, 1197 bp, Mus musculus
aatagagctgatgaagtcatcaacagaaagcgtcacccacctcacccacatattttctagtctagaaagaatctaatgataaagacctcctaggaaggttgaggagcaaaccatctaccaacacactacacttctcattctccacttctgaaatatgattgttagtgtctggcttccctgttagaagtacaagctcataatgattaagaagctcagggagttatctaagccaccaggcttataaatgcagggcatcaccacatatttatggtgattctttaccacctgtggtgacataggcaggtggcatggcacctaaactctcatggtcaaccaaacagccaaacgtgctatttttattacagaataaagaagaaataatgtatatgtagttctaaatgctatgaatttcttttaattttttcctgagatatactttttttctaattcctaaatctatataaggtatttagaacaaaaattgcatgtatgtgcaattttaaaacttagagtatttctaaaacagattgtgacctggagtcttgtcatgagatatgggaatttctgttcatggtgaagttgactgttttcctctgtgtggtcagtagatgctggggctcctgcagtgcaggaggtgggatgaaagtgctcaaagaggatgtgtctccaagtattgccactatcctcacagaactacatttcctgacacaatcacccaactgaaaaaagaataatagcttattaatttagaatagacctcacacagaaacccatccacagttgtagttatctatcttgtcaagaagaaagtcgaagccaggcgtggtggcacacacctttaatcccagaactcaggaggcagaggcaggcggatttctgagttcgaggccagcctagtctacaaagtgagttccaggacagtcagggttatacagagaaaccctgtcttggggggaaaaaaaaaagagagagagagtcagaaaaaaaaattggttgtctcctaaaagcagcacattggactcttgtaccttgaatgtctccctcgttagaactactgtactttatctaagcacactgtacattcccacttcccagcattgagttctcttgttttgactggtctttaaagcaaatgcatccccttctttaccatgcctataatgagctaaaatttctaagcctttggccagataaatc

SEQ ID NO: 19711 - DNA, 1510 bp, Mus musculus
gcattttcagtgttgcccagaagaatccctgaagctgtttgttccccactgctatggtgttataactcagcttacaatgagtaagtcgctacaagtaaaacctgtgtaattttcaaatacatttttctttgttcttagaatactgataatatcaatagatcctttagtctgtgtagcatttatattttgtttgtttgtttaatttatgagattatttttgagagaggatagccttggctatcctggaactcactagagccacctgcctatgcctctgaagaactagcattaaaggtgtacccccttccacatgcacacataatatatcatccaggttagtaagtaactttgaagtcatgccatattgaattaatattttcatgaaacaggtatcaggagctacttggaaaatgtcagtctttttgtgagatgccaattggcagaagtcttggttagtttgatgattttctttcttttatttttttctgtctgtctgtctgtctgtctgtctgtctgtctgtctgtctgtctgtctctttccttccttttttcctttgtttctctctctctctctccctctttctcctctcctcccctcccctcccctcttctctcttttttttttctcctttggctttttctgtgaagcccctgactgttctataactagccttgtagaccagactgaccttgaactcagagatctgcttgtctttgcctcctaagattaaaagcttgtgccattacagcctgtgactttcttaaaaatactttttcacgtctttctgaagtgactttacttttatgaagacttaagtctccctgaaagattttctgaactattaggaatataaaatagaaatattttaatgtactatatccattggactcatgattcttccatgatgctattttgccattgtagatgatgatgtattgaatgaagaagagctagacaaggagttgctgtggaaccttcagcttctgtctgaggtattagaagcatttggaagaaagcactcgcttgcttctaggtttagtcttttgtttggtttggttttggtcagactgatgtttacatatgaaaagtaagacattggggatttaatgttgttgctgttgttttgatgagacaaggtatcattatatttccaatatgtaggaactcatggtaatctttctttcttgccctcctgagtgttgggtttacagggacacaccaccaagctttagcttcaggaagatgaaatatttaaaagtctgtcattgtcaaataagatggaaatgttctgagttcacttttctgttaaagatggataacttatcatttgggagtttattatatttggaatttttaatttttattttgttttgttttttgatgggggatgattgtcactttgtggctcgggttggtctccagcttaccaagatgtgcctgactttgcctctagagtgctgaagctgaaggtgggcaccaccatgccaactcttgagaaatcttttacag

SEQ ID NO: 19712 - DNA, 1159 bp, Mus musculus
ctacatgggtgatggaatgtaaacccctatgccctgggaaagcattcagtgctcttaactgatgagccgtctctccagctccaattccttgttttaaagtacagtgtttaaagctgttactgggatgtagtagtaaccttgtgctttttaacttgtcatggagctaaaactcttcccttccttcctgctatgtagcctaggttggccttgaagttgtgatcttcctgtgtcaactactactgtgctgtgatagctaatgcctgggtagttttctacctttctgcagtggctatgccatatctaacttcaagagttatatataattttaatcctgaactagctggcttcatataaacttgctttctctcctacagtaaatgcttattaagtggcttttagggagacattcaggagtaataaaaatgaattttttatgagtctcttttgcacatattggctcatattatttctatgtctgcctttaaactttagaagtattgtatatacatgtttttctccagcttaacaactaaataaaaagcttctcttttctaggactggggtaagcctggagatttgtggaatctggggatccagtggcatgttccttcttcagaagaagtctcttttgccttctatttgttagactcctttcttcagcctgagcttatcaaactccagtgttgtggagatggagaacttgaaatgtctaggttagttttcttctattattatttgtcaaacctcagtgcctgccccaaactttgttatctgatgtatgtattttcctctttttttttaaatcttcttttgaaggtttctttgattttatgtgcatgagtgcttcccctgcatatttataccatgtgcgtgcctactggctgcagaaatcacagaaggctttgggttccttggaacgtggacttggtggttgtgagccgccgtgtggtttctgggaactgagccatctgtagccccatgatacataaacataatcagtgtttgtttttaaaatgtgcattaaatgtactgagaaaaacattgaacactatgtaacaaaattcgtgaatgtttcaactcttgttttgggtgtgtggtttagcttgggtttttgaagaccttgaacttctgattcctgtcctgtcctgcctgggtcacg

SEQ ID NO: 19713 - DNA, 1168 bp, Mus musculus
ttctgaagtacttggaaccaaaactcacccaggtttacaaaaatgtcagagaaagaataggaaggtatgtgtagttcttccttttggttttatgtcttgagtctttgtagttaagttttaatactaacagtacatacttactggtcatgttcccagtgagtgtgctgttgtctgcctcatgttttgatcattattatgttttgaaaaacaagacttcgaatatgaattgggagcactgtactcagaagccaccaatgagagcagccatcatactacagggttgcccctcaaaattgtatggcatatcttacactgggagtgttcagagaccctccctgggaattatcttttgaaaagtttggctgagctgtaacttttgaacctcagttttaattttcatgtcaaaccccctactcttctgtgttttatttaacagtgtgctgacctacatatttatgatagatgtttctttgccaaatactgctccaacaacatctccttgtatccctgagtttactgctcgcgtcctagaaaaactgaaaccactcacagatgtggatgaagaaattcagaaccatgttatggaagaaaatggcattggtgaagaagatgaacgaactcagggcattaaactcttaaaaactagtgagttgttaaaattggtagaaattcacttgaaaacagagagctctttttagttcatttgaatggttttcccaacacacacacacacacacacacacacacactttttcttatgataaaaaaatgtgtgttttctaattttaatcttttctgttagcttgtttgggcttgctttgtttgtttgtttgtttgtttgggttttgagatactgtctgaccaggtagctgtggctgtcttggaactcattgtgtagactaggctggccttgaactcccaaagatacaccttcctctgcctctacctctcaagtgtactaccatgcttacatttttctccatttttttaaaatcatattttgctgattttcatttgtagttgtttatatgttcttgctatttgttaggattaaaagcatgcatcaccacaccaggcaatttttaccatttttgcgtgttcagtttaaaggctataagtccacaatcacctatgtccagatttctcttcgtgggaagctgaaagtctg

SEQ ID NO: 19714 - DNA, 1113 bp, Mus musculus
agtgaggatgttgcttagctcatgtgagaccctgtgtttgatccttcccagccccactggaagggatgaggggcagagcaagaaaggaaacggggaatgtgggcatttgacaacacttggacttactctactgaggaaggaacagaccctgtaaggtagacatgtgttgcagttctgtttcaagaaatgcatttgtcatgcatgatggtgtgtcatgcattttgtaaggggacagtcgcatagagaaaataatacttaatctgttaaattgtttcaggatcaggaattatacttagaatatgaatgagctgatcaagaaaattgtatctatgctggttttaacaatgacttgttcctggctagaaacaattacacagtcaccgagagtcagctacagaatgtcttcagaatttgcagtttctagttcagccacagaaatcatgctattattatgcacttgtaaatttatattaaatggggaaatatgcacattaaaagtacatctagcatgaatgaaaatttatttcactgtaaatgatatgttgttatttctgttgcagagttggtcaaacgtcatgctggtgtgcttggacttggtgcatgtgttctttctagcccttatgatgttcctacctggatgccccagctccttatgaacctcagtgcacatttgaatgatcctcagcctattgaggtacattctatatggtcccgagaacgagctctaatagccatatcttcagttttgtatgagtgagtttaagtacccaacaagccaaagtaaaaggataaatagcaagtaataggcacatatcatatagacaacaaaataccatcaaattggaggctaagcatatctagcagaaatccactggtgaagcccctttaaggcaaccagcaggagttcccaataaggagaatgaatctccagcagagtagagtatgccctctctagtgaggcttccaagtaaaagaacaaataacagatagagataacactgtcaaatcaagtgcttgtaacagcataatgttactgggcaagtagctagagttcacagttgagctgaacttcccatggctacttttcagtattcctactgctggtacttttac

SEQ ID NO: 19715 - DNA, 1131 bp, Mus musculus
agacatttctctcatgtacaacaaaataaaattctgtatcttctattctttcaaacccagcataaagagtacttacagcattagctagaaagttaggtttcttgctactactattattatggcattttgtgtctggaaagtctcatctcactgaaagctaatattaaagtagaaatagtagttgtattatttattagtaagcacccaagctcttacgcaaaacaggtcaccttcgtagatgtatgtatatatatatatatacatatatatatatattgaactggtctagcaatgtgacaatatattacagttgtttgtcctgaaattaaactagtaattttatagaatataaatatatatataatattcgtggtttagtgacagaaaattgacttggttttctaacattgtgagagctgaggtctaggtggatactagtgtaactgaagataacccacatgtaactctggttgttagaggttaaaatgtatatgggtcaattacagatgactgtaaagaagaccttatccaatttccgaaggacacatcatgacaactggcaagaacacaagcagcagttcactgatgaccagctgcttgtcctcactgacctccttgtgtcaccatgctattatgcatagaggggtgagttacatgggtctttcccagcatgtgtcgtcctaccagtagccaaggaaatacctacaagattttaaggtttgctaacattttagatgtaactgcttagataaagtgaagagagttctttgttttgacttttggagacagggacagctatgtagaccaggctagccgtgcatttgagattcccctaccatagtctcatgaacactaggattgcagctatgtgtcaccacacttgaatgcttttaaacatgacttttgaggtagggggtagatagtttagaggaagagcccaaatttagcaaagatgagaccctaattcgatttccagtgctgaggtaaacaaacatggtagcctgtgcctgtaccctcagaggattttgttgggttgattgtaaatacagctttgtctgtggtcagtggaaataactattatagaatttttcttgatttttgtttccattgttagggaggcaatttatgtga

SEQ ID NO: 19716 - DNA, 1689 bp, Mus musculus
atattcacatgagcatgccgtccgtgcctttggcggccagaagagggaactgagttatagatagttgtaagcctccctgtggctgctgggaacagatacatatgctcttaactgctaagccatctctctgtctcatcatctggattcttttgttcatttgtttatttggtttttgttttgttaattttcagatagagtttttatctctatgtagccctgggtagcctagaaatcactatgttgaacaggtggcctcagagctctttctgcctccacccctcccctttctcaaatgctagtattaaaggcattccctaccatgcacaactcatctaaattcctaagtgcttattacatttctgtaaaaacagagggccagaaagtctttgtatagacaaaggtaaggagaataaacacaatctgtttggtgggattttagaactgagtgttttgataatctgacataattttttgttttatttttcttaatgcagatgactagtcctcattctgggctcatttcatcaaaaactccagatcctcaggtatcatccgtggtgactctgcaagtttcacaactcagcttctcttgagctttcatcattttggtggcttctctgtttggcctcattagtcttcgctcacaggttctcagctgccatttgatttcctaacttgttctgaagtgttccctgagtactgatcactttttcttttgagacatatgacaaagtcacaaagtctcagactagaagtagcctagtactatcatggtattatgaccaaacagtctcgaacgttgttaaaaacaacaatgtcctcggaatggagaatgctcatcaattatgtaggttctctcatttcattcatctcacgttattttgagttcttccccaaaggctgttgagtttagcattagtagggccatgggtcatgaatctgaagttttgaccgccttgtgtctagagagccatgaagagaaaaggatcaaagggggcaaagtctcagagttaacctagaacctgacacgctcaaccacactgcagatgtctgtatctccacagactggagtttttggtgctgagtaagagccaattgctgaaaaactgggggtttggtgaataaattttagactgatttgtatgtgtatacaatgtgtgattttaaaaataaaaaagaacatcaataaacaccatggctgattgttttttaccctgtagtccatacaaatattgttttacaccccaccttgaaatacattacacttcaaatgagtggaagattgcagtttttgatctctctccctcttcttctccctttctgtctccctctcccccccctttttcactctctttccctctccccctctctcccctctacctgtatgcctgcctacagaatcactaatattaataagtcttgatatttgacttgtttagtatgttatgtagatgtaaaagattgtacaataaactgtagagataacactgacaagattttgtacagatgcaacccttaacgcagaccattgtgtgacttgtttttttggtgtatgtttttaagttatattctttatcttctcgtgttacaaaagctgaaacataggttttaggtttttttaaatttatttactagaatatctggatttttatgtaccttttttgtgtgcatttttaaatgataacatgt

SEQ ID NO: 19717 - DNA, 1171 bp, Mus musculus
tctgatacctgtaataccagtacaggagcaggaggatggcaagttcaatgccagccttagctacagaatgacaccttttctcaaacaaaacagaatcatagctccaaactgaaatcctagagataacacagtaggagctggagagatagctcacagtgaagagcattcgctgttctacagagggcacaggttccatttccagcatccacatgatggctcacaactgttcataatgccagtcaggaagcccttcagctcctgtgaggcacttcatgtgtgctgtacaaaacacccacacatatatttgcattatttattttatattttatcttgtgtgtgtgaatcttaagtattttacttgtatgcatgtttaacatgtgcctgcatgatgcctgcagaagtcagaagaggtcatcaaatcccctagaactggagttaagaatggttttatgagctgccatgtgggtggtaggaaatgaactcaaatcctctgaaagtgcttttaactgctgagccactgtgccttagttagggtttccattgatgctacaaaacactgtggccaaaaagcaaattgtggaggagaagactgatttggctcacacttccacattgctgtcctccactgaaagaagtcagcataggaactcaaacaggacaggatcgtggaagtaagagtgatgcagaggccatgaagggatgctgcttattggcttgcttcacatggcttcctcagcctgctttcttatagaacacaggaacactatcccagagatggcaccatgtagtgggtttggcctgatattgcttgttgtctaatgttaatttgggtccccaaatctgcttacatgagtctgcacatagcttctggaaaccactccagttggttctgattggtaaataaaaatgccatcagccaatagctgggctgacagaggttgatttttggaattttgtgggcttgggactgggagagaggagggagagagagacccaccatgatgggagagtgtagaggagaaaagagacgccatacctgagaagagtgcaggacagagaggcatgcccaccatgtgagaaggccccgggagagtgaggcccagagaacggcccagtcaggcagccctctgggcccagggcagcctacatagagtatagagtttagtaagta

SEQ ID NO: 19718 - DNA, 1187 bp, Mus musculus
aatacatataaaataaatctttaaaaaatatttgtacttggaacccacagtgcttgtttggccagggagaggaataagtagctttcattgaataggagattttttttttttttttttttggttttggttttggttttttaagacagggtttctctgtgtaaccctggctgtcctggaactcactctgtagaccaggctggcctcgaactcagaaatccacctgcctctgcctcccaagtgctgggattaaaggcatgcaccagtgaattctaaaatattctttacgttcttactaatgcagaacaaaaactattaaaatgattttcaacaggttagtaaaataagtatatttttcaatagcatccagtaagggtgaaagtgtttgtactatgaaaacattttatggctgcttgaaatttatgttttcagctttctttcttctttttaaaagcatctatgtccattattggttaagtattttgttttgtgttaggtgcaaatgtcaattgccaagccttggataaagctactcctttgtttattgctgcacaagagggtcatacaaaatgtgtggaacttttgctgtccagtggggcggatcctgacctttattgtaatgaagacaattggcaattacctattcatgctgctgcacaaatgggccatacagagtaagtgctcaaaatggaataaaaatggtcttggaattaaaagctaataaggaatagatatgagtcagactctttacctccaggtaaaatgcttggtcattcctttctgaaaccagtttttggaatgcctaaatttactcctcatcttccccatacttttttttttttcttttcttattttttggtctggccctctacatctttgattttcccaccctgaggaagaataactgtatgtaggtggtatagatattggagcaaagggatttctttaactgatggctgttctttccctttcttgctagttttatttcaaatacctttaactagcaatctagcctttaactagccttattcacaaatttgcattatctctgtgtttgcaaaaagagtatgtgatctttttggaatgaagtcttccttttgtgtgagttgagtcctctaccctatcttaaaccctttgactaaactttttatctaatctcatgtctagtctggtatttttctatgcttctg

SEQ ID NO: 19719 - DNA, 1190 bp, Mus musculus
cctgaaataccaaacataaaattggcataggtcatgtggtaaggcaaataacagttaatgaggaaaacaggtatatttactatattactcaattctttttcaggtctatttaaactttgcactaagcaatagtacgggtaatattttgtagcagctctgaagcatgtagacatttactggagttagaaagtgtaggaaagacacttttttttttttttttttttttggtttttcgagacagggtttctctgtagtcttggctgtcctggaactcactctgtagaccaggctggcctcgaactcagaaatccgcctgtctctgcctcccaagtgctaggattaaaggcgtgcaccaccactatcttctagtcagtggatgattcttaaaatatgtatgggaaagatgttgcatgcacctggaatattaaatattcttccatttgtgtatttgaaggaccttggacttgttaataccacgtactaaccgggcttgtgacactggaccagacaaagtgagccctgtttattctgcagtgtttggaggacgggaagagtgcctggaaatgttactgcagaatggctatagcccagatgcacaaatgtgcttggtatttggattcagttcccctctgtgcatggctttccaaaaggagtatgtacatttgttacattttacttgtttttaattcccaagtaacttttcttcatagtggaaactcagtatctctgttactactaagttgctaacttcgaagaggtctgctgcagtatctgtcgttcagtttagcagaagtgaggttgataatgccggatggtttatcttttccttttggacctggattacacttttagtttacagttttagggaatactttaaatgtattagtgtaaatgcaagcctgctctgatgtctttaaaatgatccaagaatcagaaatgaaacttcatcaagtaaggtgctgactgcttcaggctctttacctttagctcaccctcccctcccctcctttaagtttaaaagccttagagcaaactgtggttttcagatattattacatttaacatatttgatatgtagcatttcctaatgtagttcttaataattatattttaaaagtcaaatattaattttcatactctgcatgaaatcaactttgatttgtttaaagggatggctcacaaatttaatt

SEQ ID NO: 19720 - DNA, 1185 bp, Mus musculus
gcctgggtcctttggaagaacagctaatgttattaacttctgagccatcttcacagaccttgaaactttattttctgtcatagatgcaaagaggaaatggtcaggctgcacatccctcggtttcatgtgttacgttcagaacctttggtagtaaaacagactaagagggaaatagcaatttctacttagggttttcttaagtgttagcttgtgttgtcagattattaaaatttaaagacttattttttctgtctctggatgctgacttgagtatgtgaccaattgaagtgagatcaagcaagtggaaaaagtacatacacgtttcatgtagtcatgctgaaccagtagtcttctttcaaaatgagctaagcaacgtagtgtttcttttttattgtataaaatgggctggatgcttatcttaatgtattgcttgtgtgtatgtgtatgttttgtaagtattcatgatagtgtgtacatgttgggggccacaggaggatgttagtatatcacttgccttgatacagggtctctcattggatctggaggtagccagcaagctacactgatgctcctgtttttgtctgggtaagaggtgctggccgccactgtggcttttccattgtttctgaagttcaaactcaggtcgtcatgctttcacaacaagagctattacttttccaaccatttattcagtccactgttagtgaaaattatgtttgtttgtttctccagcctctgttccaagcctaacccatctttgtcgtttggaaattcgggccagtctaaaagcagagcaccttcactctgacattttcatccatcagttgccacttcccagaagtctgcagaactatttgctctatgaagaggttttaagaatgaatgagattctagaaccagcagctaatcaggatggagaaaccagcaaggccacctgacacaggtcctttaattctgtttagtcacaaaagacggcttgtgtgactgtttggatttggtgatcaaatgtccatgtttacagttgcttttcccagtttgtgtctttcccaatattgtgaaccttatccatcttgccttactcagttttatttctagtgcactttgttgtgtattatttgtttacctgaccattttctactttattctgctaataaactgtaattctgatgtggtgctggatgtgac

SEQ ID NO: 19721 - DNA, 1187 bp, Mus musculus
agatgattgtcaacagctgttgcagatgctcttaacaaccgaagagcgagagaaaattctgttagaagctagaaaaatagcccaaaaacagctacaaaatgagatcgacgtgggattccctttgacttgcccccgttgggactgcaacatggctgaaggtagggagagcttaaaaatctattgccaggctccggtctccaaggtgcctcaaaatgggcccactaatttggctaaggtaagaggtaatgcaggggccgatcgaacctccctcaatgttccttaaaaggcttatggaagccttcaggcggttcactccctttgatcttaccttgcaagcccagaaggcctcagtggtctggccttcataaggcagttggcccccgatatcagaaagaaacttcagagattagaaggtgtattacaagagggagacagtaatgcaatccagtgaaagaggcagaaaaagtgtgtgtgtgtgagagagagagaggcgggaggcaaaaaaaaaaaaagaaaaaacaggagagatcgtagacaagaaagaaatttgccacagtggtaagagaaaaagaaaagacaggatctagacaggaaatctgggcaactgaagaccgagcctcagctaaagaggctcagctgtgtcagactcaagttatctatttgagatacaccttttgagatgggaaacagtggctaaagaaagccaggaaaaagactaactcagattcccaccccagctacaccaaggcaagtaagaaaattcttgggcaccgctggtttctgcaggctctggatacctgggttggcgactttagctgcccgttgtaccccctaaccaaggaaggaaaagtgtctgggtggaccccagatcaccagaaagcctttaagaaaatgaaaaaggccctactgatggccagcctttgcctgacctaaagagagagcaggggtcgccagaggagtccttactcagactttgggactttgaaaaaggccagtggcttacctatccaagaagttacaccctgttgccagcgggtggttttcttgcctgaaagctattgctgccataacactgtttttcaaggatgctgataagctcactatgggacagcaaatagctgtagtggcaccccacgatcttgaaagcattatacaaaagccccctgactagatgattaccaatgctc

SEQ ID NO: 19722 - DNA, 2869 bp, Mus musculus
aaacttttgactatgcagtgatttttgaaacttaaaagactttaaaaatagaaaaggatttttgttgacaatctagtacttgtgtggctcatggccactgaaattggagtgttgtaaataaagatgattacacccatataaagtcctgtgtgtcaggagaggatggcatctaaaggttcccatgctgtcttttggtctgtgtggtattgctccctttctcgggctgagctctggtggctcagaagccatcctttactgagtagctacacactgtgtgtctaatctttatgcttcttaccagttgtcacaaatctctgttgtctgggctgtgttggatgtttgcattgctgcaggaaaccatttctgttcttgctgctaagtataaatgctgaagaaaatgacgacaaaacaaggctttgctgcctttaacattatgactgcagttttcactccatacctgaggccaggctcgcttttgccgtgtgtcacatgtattggcctttgaggcagcctgctctgatttgtctcattcctttgtacaaagttggggctgcattagggatggtaggtagcagtcggctctgaatcccttcagatgaaaagccagtagcttaaactctggggaaaatggatgtttactgggctctcgaatgacacttgggacatattggtccaaaggagaactctcgagaactaaataacagtggtttgttttatctccacaggtcaggtatgttggaagcaggagtggacaggatcatttcccaagtggtagaccccaaactaaaccacatcttcaggccacagatagagagagcaatccatgagttcctggctgcccagaaaaaagaagctgtgccggccccgcctccagaacctgaaagccaggaccctccagcaccatcccaggatgcttcctaaggtctgctacaccctctgtcctccctgcctggttgatgtgtgaaatggttagaaaagggctaagctgtgattagaagtcatgcatcacacctattcagaagagtggctgtcccacggaactcagcactcacacgctcccaagtgtcctctgtaccagcagagccaagcatccaagtcaacagagaacctcacggttcctcatcagaaaccactgtggcgggtttacacaggggactcatgtggaggtcatcctctctgaaattgcttacacggagctctgataatggttgacatttgcagttttcacatgaagtcaagcatcatttccaagggtggtttctcagttaccatgcagctctgttccctttgtctcaggtttaggatttaatctaactttaagattagctggagatagagatgaatgtggtcctcgtccctgacaagtcatgtgttgtatgaggagatggcggcaggtagaggaaagccactgtaggaacagacccctcccttacctgttgtcaccccacccccagggagtgttctggccccttgttctgctgctagtgctctcctgtgagtctccaagccactgttagtaataaggtagggagggaggcaggcagttgagcaaggcctttgagcatggctgattagaggttgcaagagcactgctgtcgtagggcagtaccagtggggctgtcttcttgtgcctcttggagaggtccttgatccatcatggagtatagagtattcattttaaatctttctcatttcattaatacatttttaaggaacatacagttattgaacataggcctttgtcaaaagcattttgacatgattgtcttttttttttttttttttttttagaatttgcctggtacctttggaaagctttacttaagcaatggactcctgcttcatacgaatacaactttagtcggccatgtcattactgatgtcaagattttggccttgactgcggtggtgtccacatcagatggagagcaagtttggtggtgggacagttacccgtacttgctcatggattgtgttacctttgaccggcctgttgaagggtgtgaccctagtagacactacagaggtttaagcactacagtgacatgggctgtcctgaacgaacttttatacttgaactcagacactgcatgtggatatcagtgctggcattttgtggtatacagaagccaggctggaggctagctggtcaggacagcgagggtcagtgggagcagctgtttgatggtgggttttgatatgctagagttacagactgcagcgtgtggcagttagcatcagtagccttaaggttgttgtgaccttcctgtgcttgggaatcttaatggtttcctttccttgttggagccctggagtgagtgaggaagctgagacttggggtgcatggaaagctgcacagcttctgtcctggcacctccccatccgcagggatgagtcactctgggtgccgtgctcagttctcatgtttgtgtttttagaaaaaaaactgctaataaatagtggatgttttacaataaagttgtttgacgatctttccctaaaacctcaacagaaccttagagccttgtttgtggaggggaccccctttcctctacctgccccgtctctgtataccacacaggacttgataagaaggaaatactggtgtctgcaacttagaagcacctgattcaggctgggcggggcggctggtggggcaggcagtggtttgcctgttatgatgcagctcaagcttggatgagaactattgtccctgcatagctaaggacaaggcccgaggagcccaaggcttgtatttcttttccttttctctttctcatacgttagttattgacctagggtagtgtgggatggggcagtcagaagacagcttggagatactggttctctcctactatgtgggtcccag

SEQ ID NO: 19723 - DNA, 1102 bp, Mus musculus
atggtgatggtataatcttggggaaggtctactgtggccaggtgcaggagaagagtcccctgtggggtacttgatggaactgaagtccctgcacaggccatcagcgtccccgtgggtgccagcagcccacccggctactcctgactcttatctctttcttccccagcacaagcgctgtatcccggcctcgctggatgcttactactcgtcccaggaccccagctccaggagccgcttctacacagtcatcagccactacagtgtggccaagcagagcactgcccgggccatcgggccatggctgtcagcagctgctgtcatccatgagcccaagccacccaagacgcagggccattagaggtctgccccagctgggatgggggtgggtgggtggagagggaaacccccctccccactagttaagcaaggctggagctacaagacaatactgtactgctagggtacggggtgggggcggggcaggatggggtctggggagcactccccaaaaatattgtgcactggagttgtctgaatcgatctttccttttgttcttttgtattgttgcttcgtacccaagtcaggctcgtgtacaaaggcatgtttcgcgttgattgttcccatgtaagatattttcaaagccgccgcttattctttgttaggataatttagagacagaaaggggagccggataaaatgaatttaaaaagcatgaaacgggctccacgtggaagacacagcagggcagtaaagagcagagtctgtctgggacttcttagataaggccccatggcttctgtgtgggcgtccgagtactgcgtggcgaagggtgggctgttcagtttgcctgtggtctgcaggagagaagcacagcgatggcaggcaaggctgatttggagaggaaggtgatgttggcatttctcaactaggaatgcacagagtaccactcaatggtgagcttgcaagatttgcacaaactcatgggggaggcatccacgctcagccctgggcagcccatggggacctaggctccgatgctcacagggcggctgttgtgcctcagcaaacacaggcgtggatagatgttgtctttcttttgtt

SEQ ID NO: 19724 - DNA, 1360 bp, Mus musculus
tgtgggaacaccggcttgtgcaggatctcctgatcccaaactttcctgtcctctttatttctcaacccctggccctcccgctacaccggcctcacctgccatttggtgttttcccagagaaatccctgctggaattgtgactgcctcgatcctgagtgggttttgtgcaggcaaccaaagctgctgtgagtggaggtgtacaatagtgatacgagacatattctataagtgagaggttcctgagagagacagccagggtcttcagggttgcggtcgtgatcaaggccgcggggatcgtggaggtaaagctgaagacgaggaggtaggtctgggcggctggccgggtgggctacttgctccctgcacagagaggcagccctttggctggtgtcttccttcagtggacctctgtcaccaagctgggccgcctggttaaggacatgagatcaagtccttggaggaaatctacctgttctccctgcccattaaggagtctgagatcattgacttcttcctgggtgcatccctaaaggatgaggttctgaaaatcatgccagtgcagaagcagactcaagctggccagtggaccaggttcaaggcattcgtcgttattggggactacagtggtcacgttggtcttggtgttaagtgctccaaggaggttgccgctgtcatccgaggggtcatcatcttggccaagctttccatcgtccctatgcggagatgctactgggggaacaagattggcaagccccacactgttccatgcaaggtgacaggccgatgtggctctgtgctggtgtgtctcatccctgcccccagaggcactggcatgattttccagtctctgctcctgagcccaagaagctcctggtgatggctggtatagatgactgctacacttcagccaaggctgctctgccaccctgagcaactttgccaagaccacatttgatgccacctccaagacctacagctacctgaaccctgacctctggaaagagactgtgttcaccaagtctccttatcaggaattcactgatcatctagtgaaaacccacaccagagtctctgttcagaggacccaggctccagctgtggctaccacaaaaatatttttatttaaaaaaaaagtaaataaataaataaataaagtgatttaagtatgtgaaagaaaggaagaaagagagaaaggaaggaaggaaggaaggaaggaaggaaggaaggaaggaaggaaggaaggaagaaagaaagaaagaaagaaagaaagaaagaaagaaagaaagaaagaaagaaagaaagaaagaggagggagagagaaagagagaggggagggaggaagagagggggagagagagag

SEQ ID NO: 19725 - DNA, 1156 bp, Mus musculus
cagtttccaggagtggaggcttcccaaggtactcagggaaggcttagcagcctaggccatgctatagagaagggggacgcagaggggtctgatacagtggatgtggtttgtacatgcaggaagacagcaatacctctacaacactgggtgtgcatggcaggaggcttgaggtttactgccaagctttctgtctttcccacaggggctggggcttgtgtcttgctaagagcactagagcccctggagggcctggagaccatgcggcagcttcgtaactccctccgaaaaagcactgtcggccgttccctcaaggaccgtgaactctgtagtggtccctccaagctgtgccaggccctggccattgataagagctttgaccagcgagacctggctcaagatgatgctgtgtggctggagcatggccctctggagtccagtagcccagctgtggtggtggcagcagcccgtataggtattggtcatgcaggggagtggacacagaagcccttgcgcttctatgtccagggcagcccatgggtcagtgtggtagacagagtggctgaacagatggatcagcctcagcaaacagcctgctctgaggggcttttaattgttcaaaagtaaaataaatatcccgtttttagagaactgtccccaagtctcagccagaatttgtgttcatgcagttaattctttatccgggtcaggaaactgggttacccagtatgtatggcaacagagaggaaaaacatcaacgtgcaggtgtatacacctaggaacagaatgagctgaacaggtgtgtttagacactttccagggcagctccacaagggaccggccggaaagggatgacaaggacataacctgtatgtgtataaagaaaggacttggactctgaagacacatcctgggggctggagagatggctaggtggttaagagcacttcctgctcttaaccagaggtcctgagttcaattcccaccaaccacatggtggcatgtaatgccctcttctggtgtctgaagacagcaacagtatactcacatacgttaaataaatacatctttaaaaaaaaaagtcacatcctggaagaccttctccagctcagcaatattaagctgccgtaaggaccagattgaagagggaggctggtgg

SEQ ID NO: 19726 - DNA, 1649 bp, Mus musculus
ggtggctaaggaccagcagcttggtctgtgccaaactaagaacagtacccaagggcctgtagtgtcctgccccagcagcagctgctgctccgtgtagaacagttggctttttagcgtgctctttccctgggagaagcccagggtagcccttccctattttgaccaatagacggctaaggcctggagaggtccacttagttattgcagagctaaaaatcaggacccagatttctagctcccagcccagaccaacttgtacctatgaatgggcttcctgtgaaagcggggtagggttgggagggccaagctccatcccatcccacagtccctacagaagaggggacagccctgtctggttctacacttccccagtgttcatttttaatgtggtttggaaaccacgaagccccctttcccaagatgcttgcatcttacttgcagtgccaaagattttgtgcaaggggatcctttctgcaccccacccctgcccaactctctctgctttcctctgacccacctggcgctgtcactctcttcctctgttcagcctgcagtcccctacgccccacccccaccccccagcactgggcctgggtaggaggcacctgaaggatgaccctgcttagtctgtgccctgggcctcgggggaaagcggcagttagggagaggggaagctgagagagtcttcagctctggagcagcacttgagagcctcatgcccacacccacgctgtgcaggaatcctcatagctttctatttgttggtggtttttgagtttcgacacctctgcttgaccagctttctgaagccgttttacaggcctttggttgttgctgttttgtttttcctgcttgcacttggctctctgtgaccttctcaagtattttacaagtcccttctatgccgcagatgctgggtagaccagggagcggggaggggggcatcaccctgcactgaagaactgagctttgcccactagctccagtgaagaagtcatctgccttctaccctcctctctggtcagctgaggcagagcagacaggccttcctgtgggcaatgagagaatttaccttttgtcctatccttgtgctgctgtgaactgtatgtgtgccgggttccctttctgttcactgtctttttcttgggtcacacacacagtctgaaggtttctgtggcaagctccatcggccatagtgcttcatcactagcctgggcaaccggaagcgagtgggtctgcagagccaagtcactcacccaatttcccttgcctgggacttagcttttcaacatccaggactgtggtcactcctgtcgggatggagcatatatgccagactccccctcaccccccatccctgcctacttccaaggccagggtagcaatgtctgggccaatcacagatcagatcaccgacacaaacttgtgcccctcccctgcaactaacattcacatcaactctgttgatgtgatggcagggaccacctcaatacataatgggaaagttaaggtatggagagtgaagtcacatcctgccttgttcaggttcgggccaccagcaaagaaatgttacagttctgattttaggtgtctctccctcaatcccctgaccaaacattggtcattgaccagatggcccctcttggatg

SEQ ID NO: 19727 - DNA, 1172 bp, Mus musculus
tgttttgttttgttttgttttgtttttgagcctctgccaccagaccgccccatagagttgatttctatggcacagttcttgaccttaaactgtctctgaacccactggggacttggggagtggatggaaagtggggatacatgtgcttcactaaagaacaggtgccaaatctccccacaagaacttaggacagacagtctagtgtttatcgccaaattctggcccttagtgagaggaagaaactgaccatctaaggagagtggtgtggagttgtggtgcagccagaaagcaatggcccgaatgtgtgggccccaggctccatccccagcatcacagataaacaagaaccttaatggcttagctcctgtccttccattgagcccagggctcttcagtgtcgacatagtccataccctgggaagccttgccatttctttgaacagtgtggccatctcggccccttcggtggctgtctaaactttccttcagggtttttcctgtatactatggacagccatatcctaccacagaccaaagattccctgaagtcagaggggtgtggactgaatgggtagaaaattaatttgtatcaaggcccaagggtttgcctttgcctggaagaattgctcctaacttgctaaggttctagcagcaggactgacctgaccccaagcagagctgtacagttaagacaatggttcgtactcctcacctcctggacaaccgtcccacagaccagaccttcctgctctagggagtgatgcttggtccccggtgctatctagttgaggtaccaagcccctcaaatgtgagggttccatcttcttccctgtctctgtactccttccccaaggaagccctcttagctcccatcagaatgagggcttagcttctgtccttcaaaagaccagacccggtgccatcgccagtggccttccctctcacctctgcttttaagagcaaaggtgccctgccaggcttattacagcaataaacaattctaatgcaatggaggtgtccggattatgcctgcaatgcctttgtgccctgtaattactagtagcacctctcgtacataccagagagtgtgataaactgtggtcaccttagccatacatggttcctgtttcggggccactgaggttgcttctaacatccctccagaaacagtg

SEQ ID NO: 19728 - DNA, 2561 bp, Mus musculus
cctgtgcaaaccccaacaccagtggagaactgagctggacttgccttcttccaagatcccgtggctcctttttattgttaccatttcttactcttaaggcgtgaaatttattttcactgctctgaattccctatgaatggatttagttctgaggaattaccagtgaaaaattccatctgtgatggagaccaacaaaaataataaaacacacagagccagcctctgatactcttataattacaatttctaatttgaaagacagttaagaaatagataaccatttattttaaaacatttatcaactgtgtaatggctgtatttaaatgatctcgaatgtaaacagacaccagacccatcaaaaacagcaccaagcaccttttggacacagaatttttatgacatacatgtcaaatttttttttttccagaaccatcaataacagttacaaaacctaatcttttttttcttttaaagtggaacctaaaagagcatagagttttgcttctcttctgggtttgtagtcctacccaccaggaggcagtgagactgggagttgtcagtgttccttcccctcccaccaagttctgctccctgttgacatgcactcagtcctgtggccgtcatgctggcagcgggcaccctctggcgccctgagcagcacgttagtaagtagttagagcttgtattctcagttgagaagtttctagtcttgcttcatagtaatcttaacatatctgtggacccaggcttgacagctagctactatgtgatgtctttgctgaccctgatgctctgcgtgaccatttctgtagcttcctggccccgcctatatattcctgggccaggcaagacagaaatggagtatagctgcttccagtccagaatgaaaagcaatcttctccttcctgcctgcagggaatgtgagtaaaaccctctctgcctgttcctgggaaaactgtgcctattctaagccttggagaaaattccaattcaaaatgttcgtgtgtgatagctaactagtgtcatttaaactgcattggtgggaacagatggtagcgcctggctcagactggagtgctttcacttaactctgactccagtcactgtggtggcagggttcctcccacaccttcccaacaaaggtgaattaacctccatctgcacactgggctaagggactgaacatagtaaatcaggctcaccttctctggagaaagctgccaagggttatatttaatctggagccttttaaaagctgtttttgccaggcatgttgtacctgcctttaatcctgggccttgagaggtagaaagaggcagatctcagaatttgagaccagcctggaatacacagctagttctaggccagccagagctacttagtgagactgtgtcttaaaaaaaaaagttggttccctgagaaggggactatcatgtgaccacactgtctctgaaagtttgtgagatgtgaacagtagatgaaagaagggtctgtgcttttctcagtcaggaaataccaaacctcctattcggatataaaatgccattcataattttagtggcagaatgaaacctctaagcagtttaaaatgtaatttttaagtattaaatttcttatagcctgtttaaatatatctataattataacttacatttctgagaactttaaccatttccctaattctgttcatcatttagtttgtgattgtatctaatttagatttggtggtgactgatctaaattcagaagtgcacacacagctttagcaaccaaggatgcccacatttccatgtggaggctctagggtattccagtgcatctccctcccaccatcaagaaggttggttcatttgtcatattgaataacagtatctcaaagtccgtcagttggaaaagtggttaaacctattatttttctaaaggaaatttgatggtgtcatgaataacctgattgttaaaaggtcttgtttcttgagggtttgtcctaagagatttgtggggtcttttggtttttgtttgtttgtttgtttgtttaaattttaaaggaacatatactttgaataacaatcctccaggcatggtgagaaaaaaacctaggtgctggaaattgtcaataggttaataacctaggtgagaaaaaaacatggtgctggtaattgtcaataggtcgatgtaagattggatcaatacttgatgtgtatcattttagtatgtaggggttttgtgctttttttaaaaaaaaaaattcaacttttctctttgtctttgccattatttctctatacagcgacagtttcctgcatcctataggaaagtgtgaagtgttctctctaaaaccggtagtgaccaccaaacctaagctctgctccaccacatactgcaggtcacttagaggtgtgcctcaccagcactgctgccttggtctaaaataggttcaccatggctcagtcgctactacttgctgtgctgccaaggcaacactggattccaacactcagccagttgggccaaactggggagctccagtttcagtgagcgacccgccttgagaggaatgacac

SEQ ID NO: 19729 - DNA, 1187 bp, Mus musculus
gacaggggcttggcttttcatagctcacagccagctcagatctgagttgcgtgtgactgtagcaccagcagcctgtcgtggaagcgctaacaagggctcaggcaggggccagtgtgctggccagggagctcacgctgtgtctgttcagcttcaggaagccactcagtgcctgtgcgtgttggtagtggaacaagaggtggtcacagagggctggggcccagtgccgtttgtctggagaccctggagatgattggcttaaggcaaagacctgggctgtgaaccagacctgcctgagttcaagccctgagagttgctttctagtgtgtgacctgggacatgtctctttctctctctgggccttttctcttttccacagaaggggtgatttccatctccgttcctcctaggcctgtactgggtcaaggtcagtgctcagcttcctgcctccagaatacctgctgtattgtaagcctttcttagcctgcctcctccttgccagcctttgattcccagctcctgctgaacgctaggctctaggtctgctgcctctcatccccttcttttccttgcaataaccagttcttctctggcctgcactgatgccctctccctggtccctaaaccaacaccctcctatgattggtggcactcatcaccactccctacgacatggtccgagacccgctggttccaggggcctggacctcatctgacacatgcccagtacagccacgagcatccagagacaggaaagtagaaactttagctttgcctgctccagacttcagctgttggccacacatagactttcatggacaggtcagctggaactctttcctcacacctgagccttagccaagttgctaggtgacctcagcaacagctgtgtgtctaggggtgggagtatctgtaccacccttatgcctccctctctctttctttctgtctgtctgtctgtctgtttctctgcctgcctgtttctgtctctgtctgtctctgtctctcagtctctctctctctctctctctctctctctctctctcactcatccgtgtgtgctggaaccctccctctttctgtctgtctgtctgtctgtctgtctgtttctctctctgtttctctctttctgtctgtctgtctgtctgtctgtctgtctgtttctctgcctgcctgtttctgtctctgtc

SEQ ID NO: 19730 - DNA, 2943 bp, Mus musculus
tcagagggacaggcacacaccctcccgcaggcagtgggtgtcctgactgggggtgagcactgtcacttggccatctctttcttctgctagatcctcccctctggctcttctttatccatcctgctctttccccatcacgggagtcctgcctgtacctctcgccccttaacaggcggttccccaggattggccctgggccatgagcagttcaggaaggcgtgtggcaggtggaaggggtgcttacctcagggagctgtccagagcaggacatgctgttctgattggaatcgttggcatcccgctgaataccatctgctctcgcttccccaggccctggaagaggatttgaaccagaagaagcgggaacaggaaatgttcttcaaattaagcgaggaggcagagcccagacccaccacacccagcaaagccagcaacttcttcccctacagctctggggatgcttcctaacacccacaagcctgggctgcggtgggcagcgtggctactggggcccccaagcctctatgaacaagtgactcaggacctcttcctcttgcttctgtgccagctcaattacccatccccctgcagcgccccagttgtccacagtgccaccttggtgcacggtgacctcctcaagactcagattcccatcacctaggagtgatttagactgttgaggtcaggggccaggcaggatgggtgaacccctcctgtttgcccaaacaccagctctactgtctgtgggcacaagcgctactaatgacatcaccgcgaacgcatccttattgtgatccttgtgggttttttgtttgtttgtctgtttgtttgtttgccttcagtaattcctcacagtgtcgggaaacatccctaagagccacttgggttctcagcagccagctcccgggtgtccccattcccttgtttcacatagctgactttgctttgtgtatgtcggggtagggagcgtggagaaggatgccagagatgcctgttctgctgattctgacattgtatcccatcttattttcctctccctgtgagacatgcaatacacacacacacacacacacacacacacacacacacacacacacacacacacactgcaaatacataacttggcccccctgacaccacccaggctgcctctgctgtgacctcctaggaccaatgcattggaacctgcttgcttgcctcctgagcctgatccagggccactgagcatgtcaggtggagcagctggtggggccatgctgagtgctggcgccagaacccagagaaggcacaggctgtactgccagcctgcaactcatttggctgcacacaggatcccgtgttcaggggtacacccccctccacacttgacttctgctgcctagcacgtgccaatctcacccttgcccgcttgtctgcaggtacccaggaaggcttttgacttctgccctagtcctgtactggagtcccactgtacatttccactaagctttggacttctctgttcaggaagaactgttccccaccctcaggaacatgctgcgctcagggaaatgtggagcctccatgactgggccttcgggctgctcaggtagcctcccaagaggctgagccccatagaagaaaagcagcctaagtgctcagttacagtacaggcaaatggctggctgcctcagacaccctctttttaaaaagccccttcccagggacaatggggtggggtgggggaggggggacccaggcggttgagtctggcgagtggctgagaccttagcagtatttctctgtcactgcccgatgctgaagcaactttctaaaaagtttcctcaaatgaaaactgggtgcttgggagggagtgggctagaaaaaaaataggaaaacaggtcttgggactcccagatctagtgtgcagtaaagaagctcacagaaccccaggaaggccatagttctcaggggagcgagtgagccttcgcttgctttcaggcctcacatcaaggagttgactcagagggcagatgggccaggccacgccacaggaggccgggcagggatacttgctttcaggggacttgacagtggctattaggcaaaatgctagttttgtggttcatataacagtctttgaccgctccctgacatcattcgtaatgttccagtcctttgttgaatctgcacttagtaccacctgagccctggtagctctgctgtgccttttggagtggggtctagcctagtcttccagcctcataattatagcgtaagtgcaatgcctgccaccaccaagggcccacgcagtattcctcatgccctgtgctaatcttttctgtataggaacaggcagaagtgtttttagcgcagtaaatataactaacttatatttcccttcatgaaggatggaaataacgtgtatgcatttccaagcaccgtggatatttgtaaactgttctctgcaaacaaaaaaagaatgtaaatatgcttctaataaagtaataaggtgatttgcaagcactgttgttctttctggttggaaagagaagataggtgggcctcctgtgcttgctcagcaaggaagggcttatcctctgagtatgtgagagcctcctccatcaggcagcaggtcagactctggggtttctgatggaaccccaaagagagaggaaagagaccatattctctctggccatttaatatcattccgattcaaagacaaacattggttaacaaacacccccagattttgtatgttaatggactgaattttttccataactctgataagaaagtagattttgcgcagagcccaaatctcaggacacggccgagggacacccatggaattcaaccctggagtttgtccccctgatggtgctaccacacctctctccagctgccacttcttgccatcaatgctgtatcttaaaagaattttccaggacagacttaaca

SEQ ID NO: 19731 - DNA, 1302 bp, Mus musculus
gttttaaaggaccaaccagcccctcccagtgaatgaagcctcttcccatggaagcacactctaggagagagaaggcctctgggctccacctggcctggcattatgaatgcagtggggtcagtgtgtggtggatgtgtgtactgggttggctttcctttttagtttttttactttttagtttagtttgttcttttccttccccaataaatcattctcacatgcttccatgtttgtttctgagaggtgggggctcaaatgtatagaaagtaggccccagtccataaggaggtgtgaacacacccccttactgcttatcacccatttgacaggaacgcccaggaggggagggggaggggaagaagtgagttctgcacagtcggacatttctgttgcttttgcatgtttaatatagacgttcctgtcgatccttgggagatcatggccttcagatatgcacacgacctttgaattgtgcctactaattatagcaggggacttgggtacccaaggaattccaatttctgggattacagtagtaattcccagctgtactctggacttgattttgctaactgtaactgagcaactgtaaattactgctatattaatgtgttaaagcactggggtagtctaattctaactggtaattatgtttgccaattatctgtttgaaataaatatgtgtctgaacagctattgaaactgttaaattgtacagatattatcatgacggctttgtactgtggaatgtgcttaataaaaacaaaagtttgacctttgtccaataaattgctaagtaatgtcaataaatcaagatgagtattatgcagtacacctgacctggcttcctggcgattgttacttcagctactgattcaagccaatcctctaaataaagtgttgcagtgctcctctgttctgtcacatttctcagaaaagcagttttgtcttgccaggagctaagtgacacgccattagaggtggattcccaattcatctgtacggtgaagccgaaggcagtgtttgtggcttatggaattcttcacttttggttttcccagcaagcttcaagggcagagggagagctccccgcttggagccgtccctgcaggtccgtgtctcaggtgagcgtgatgacttcctgagttctgcaagacaggaaaggggtccccaggactcgtaggggaggggatccttcctcttgaaatggtgtgcgtgatggagctgcaggtctctttaaaatatatagcaagaatttggataagaaaatcagtttacaaccctaaaagagcagagtgcagc

SEQ ID NO: 19732 - DNA, 1195 bp, Mus musculus
tagttttatagaactctgttataatttcctaagcttttcataaagcccaccacaggtatacttctgatgaattgtccccaataggaagacatgctatgaagaaaatgttagtatcttagtagagttcctggaggcagcatgactgtacttgcacttggaaacctactgaccaaggattaagcctgagaactgtgtaaatcattaagctatgctctttgtgtatggaggttgcaaaaaaaggcacctcctttagactgaatcttttgtgctgaaatttttcttacatgatgatgtcaagccagctgaaatgtaggctgtagcaaatagttttacaaaacatatttcacaattaagttttactttttaaatgtgtcccacttgttttgctagtaataagcagtggttttcacatcgtcttcctgacacagatgttgtaatgcatatagtaaaggccacttttataaattaagtgcttctgcctgtgttcagactcctgtgtaaaaaccgttgcacaagctttgcactcttctatgctctgctttgtagaccgtttgtcataacatggaaaacaatatgtccatgttaaaaggattggtctgccgggcgtggtggcccacacctttaatcccagaactcgggaggcagaggcaggcggatttctgagtttgaggccagcctggtctacagagtgagttccaggacagccagggctatacagagaaaccctgtctcgaccccccctcccccccccaaaaaaagattggtccatggataatttctgtcactttaaaaataaagtacagtttgaaagaattagtttaaaagtaataaggttaaaatagtcccacttttaagtgatccattttaaaatttgtaaatcaataaagttttttgttgttaaacataaaaaaaaaaaaaaaaaaaaaaaaaaacaagcgcttggatgtccaagtgcaagcaacgatgctcgaatgctgtgtatgaagccgagtcatctcaaagctgccttttcagtcacagatgaatgaatctgtaaatgaatctgcccatgtggagcacattttgcttgaatcacgtggttcaaaatcaaagggaaacgactatgaggaagacaaacaaacagagggaaggctttctacatttttttattattgtttttggtgttaaggcctgggggctgataactgaatgaaat

SEQ ID NO: 19733 - DNA, 1186 bp, Mus musculus
tttttttgcaacctccatacacaaagagcatagcttaatgatttacacagttctcaggcttaatccttggtcagtaggtttccaagtgcaagtacagtcatgctgcctccaggaactctactaagatactaacattttcttcatagcatgtcttcctattggggacaattcatcagaagtatacctgtggtgggctttatgaaaagcttaggaaattataacagagttctataaaactaaaatatagcacaaagtcaaataaaataaaccaagtccgttttcagagtaaaatctattaaaaaatggtattatatatgtatgagaaataaaagaaatgatcactgtggttagtcacagatgcaagagatccaaggatccgaggctttgtgagcacagtaattaagagtaaagtaatatgctagaggaaatggctagtgatgagctcaaagagatgaggaaaaacctgaccaaagaagccatcagggagcatcagatggccaagactggtgggacccagactgacttgttcacttgtggcaaatgtaaaaagaagaactgcacttatacacaggtgcaaactcgtagtgctgatgaaccaatgacaacatttgttgtatgtaatgaatgtggaaatcggtggaagttctgttgagtttggaagaattggcaaagtatctggaccattaagaaaaactaattttgtaattagctttaaaattaagccaggcaactcgtttccttgcaagtgaaatttgtaaacaacatacatctcatgggttggtctttgttgttcacctgacagtctttcttaaatgccttctgtggtctcagatcagccgggagaccataaaataatgatataatgtgttgctttgtttttctctttcataagttgatgttgcattttattaaatattaactttttatagcctagaacacaaaaattttgttgatctgttaatgcataaagataaattgcttttctcattggtatgtacctaaacatgttaaaaggaaaaggcataatataaattttagagttaccaaatgtagtgtgtattccaatagtatgtggccagcttatcaaagttgtgcacacaatttgaactagcatattactttactcttaattactgtgctccaagcgcttgttaaatgcttgcttacacagagctgcctcccttga

SEQ ID NO: 19734 - DNA, 1844 bp, Mus musculus
ttgtcgggctgagaggacccaccccgggttttttgcttttctaacagtaagggaaagcctgactatgaggcagtcccagacagctgaaggaggtgttcccctcccagccactcaggatgagcagtttccttggctcttagaatgatggcctcttagggccttttgttcttctgtttgaatgtcaaggcccaagggcagagagctaattggcagctgtctcctgcatcttccctacccagtcctccccaggaggataaaggaaggccatttctttctcacagagggaaggggaaatgccagcacaggaacgcgggagtgacatgttctccttcccactagcttgacgatgggtgtgcgaggctgtactttggagtgctgaagaacgttctggaatcacaaagagaagcttgctcaaccttgtaaatatgattaaaaaaaaaaaaaggcgctttccgcactacccggggacgggtccatactgcgttgttcttgattcccatcgtaacttaaagggaagcttacacaatgtccggagcccttgacgccctgcagatgaaggaggagggtgtcctcaaattccttgctgcgggaacccacttaggtggcaccaaccttgactttcagatggagcagtacatctacaaaaggaaaagtgatggtatctacatcatcaatctgaagaggacctgggagaagctgctgctcgcagctcgagctattgttgccatcgagaatcctgctgacgtcagcgtcatctcctccaggaacacaggccagcgagctgtgctgaagtttgctgctgccacgggagccactccaatcgctggccgcttcacacctgggaccttcactaaccagatccaagcagccttcagggagccacggcttctagtggtgaccgatcccagggctgaccaccagccactcacagaggcctcttatgtcaacctgcccaccattgctctgtgtaacacagattctcccctgtgctatgtggacattgccatcccatgcaacaacaagggagctcactcagtgggtctgatgtggtggatgctggccagggaagtactctgcatgcgaggtactatctcccgtgagcacccatgggaggttatgcctgatctttacttctacagagacccagaggagactgagaaggaggagcaggctgctgccgagaaggctgtgaccgaggaggaattccagggtgaatggaccgcaccagctcctgagttcactgctgctcagcctgaggtggctgactggtctgagggtgtgcagcttccctctgtgcccatccagcagttccccacggaagactggtgtgcacaaccagccactgaggattggtcagcagctcccccagcgcaggccactgagtgggttggagccaccactgagtggtcctgagctgctctgcagacgcctgagcaaagggaaaaaagatggaaagaaaataaagttgctaaaagctgaagaaaaaaaaaaagcaacatgccgaattatacatgatggaaaagcaaatcatatggtatatgagttatatttaatttatgtattttaagtagctgagttcactcgtgtcttatctcgagctctcggttgacctgggacccggcctctcactgctctctgttcttcagggagcctgggcctgttctcctcctgaggagcctccagggttgggttggagtgaagagccctgagcgtgtcctgtcagtcacagtctggaggggcagggacgacccccatgcaggccacccagtggagcagcagccacagagaaagcatttttttctgacgcagggagggaaaaggtacgggattctctggtgaagcca

SEQ ID NO: 19735 - DNA, 1142 bp, Mus musculus
ggaaagtagatctttataacacagtgttgctatttgttctacctgacaacgaactgggtacagcaccccaataaacccatctcctcatccgtgaagcatggattacaatagctcctagctgggagcacactgaaaagctaaagcagactgctgtggcattgaaaacagcacttacaacatgcatgcactgtacaagtgcttgaaccatgttagtttatttaacattagtgttgctatcactgttgctgttaagcaatggccactgggaagctgggcagtggtggtgcacataccttccaccccagcactcgagagtcagaggcaggtggatctccatgtccgaggccagtcaggtctacagaaggagttccaggacagccaggactacatggagaagccatgtctggaagcaaacaaacagacagacaaaacaacacattttttgagtccaagtccagcctgttctgcagagtgagtttcaaaacatccaaagtactagggatacagagcaaagaccccagtgcagcctggaggtgggaaggggtggacaacactccctgcagaaagtgatgtgcaagtagaggccagaaacccaactaggagttcactttgcgagtgagaggcctgtgcagaactgagcaacagcagacgcatgccgatagcttctcaaagcccaacttgtcaaaacacagtggggagatcagaaaaagatgaggggctggagagatggctcagcggttaagagcactgactgctcttccagaggtcctgagttcaattcccagcaaccacatggtggctcacaaccatctgtaatgagatctgatgccctcttctagagtgtctgaaaacagctacagtgtacttacatataataaataaataaataaatctttaaaaaaaaaaaagaaagaaaagaaaaagatgagagccaaggaggaggtttgaaagtgaccttggggtctctgggggctttaaatagggcaatgcaatatcgcatccctagatggaatgggttgagaggggctgcctggaaagatgggtggcggccgccatcagtgggaggaaagacaggtccccacaccaaggcttaggggacaagtggaagttaatgcccaggtcccagagacttagaggcttta

SEQ ID NO: 19736 - DNA, 1388 bp, Mus musculus
aatgatagtattgcctatttaaattatagctcccaggtttgtagtcaaaagtggttaggattgaggcagactgtcaatgattggaagtagtgatgtcatcaaattcagtcctttcgtgttagctacagattgacctaagttttagaattcaccactgaagagaatacttgatatttttaagtttttagaaacatactggcttgtcttaagtatgtccctttgggtttttctaggttgtgatttttttttttttttgctttgtaatactttgcctagactttaaacattctcactcaaattctgaaacctaaatagggctgacccacaggctgaggaggcaacactggccataaagtatttaagccatttaattaaggaaactcatgctatgagttaattctgtatttttcctttgtaaaatgaaaaatatttaactgaagaaatgaaatttgtttaattctataaagttaacatttctttaccatttttttcctcctttacaggctattcaagatctctggcagtggaggaaatctctttaagaaaagggtttaaacagtttgaaatattctgtcttcatttctgtaatagttaatatctggctgtcctttttataatgcaaagtgagaactttccctactgtgtttgataaatgttgtccaggttcacttgccaagaatgtgttgtctaaaatgcctgtttagttttcaaggatggaactccaccctttacttggttttaagtatgtatggaatgttatgataggacatagtaatagtggtcagatgtggaaatggtagggagacaaatatacatgtgaaataaactcagtattttaataaagtagcactgtttctatttgcttatttaactctcatactttgaagttaacgttagtgccctcatttctgagcagaatcactgttcatacattcccatttaggaacttaacacttaaaacacacctttcctctattgatagccaatctgttggacataaccataggatttattcatcctgttttgctgtggtatattgtaacaatgcatgggaaaatacatacttaagaaaaaaactcagtggatagtgtctttcacaaacactcaggctatctgtatggatgcttttcttgaatccttttaaaatctggtttggaattgagtctaaagttgcctagcaggtcatatggggtaggttaaaagaggtatggtatagtttgtctattcctgctcaagtttgaagtaactttagtcaaaggctgcttcgtgcctgaacctttttttttttttttggtttttcgagacagggcttctctgtatagccctgtcctgtaaaccgggctggcctcagaaatctgcctgcctctgcctcctgagtgctgggatta

SEQ ID NO: 19737 - DNA, 2374 bp, Mus musculus
ttaaagatttttttttttaatgtttcatttgagttgatttcacagaactttaggctttgggttttgatgtaagtatcattgctaggtttgctttcttgtttttgtcttacatacaggctgtgaactaaaggctgacaaagactatcactttaaagtggataatgatgaaaatgagcaccagttgtcattaagaacggtatgtaagctctgaaacttaaaaacatttcagacatttcctactgatgaactaggagtttaatcccagaaaagataggggatctttgtcacttgtaattttgtatagcttggtcactccaaggtgctagataggtgctttgtagaacagtgcttgtttttaatctgccagctttattcatttaaaggaacagttgtgtatatggtaattctgttgtgaaacgcttcaattctaattctaatggtgagatgactagttttcttttcgtcagtagtggtgaaaagccactttaaaagtttctttgaaacatttttattcacaggtcagtttaggagcaggggcaaaagatgagttacacatcgtagaggcagaagcaatgaactatgaaggcagtccaattaaagtaacactggcaactttgaaaatgtctgtacaaccaacagtaagtacatttctaaattttggatttcatgttggttcaggtctcttgcgtcatttggggtcagtgtcatttaggttttgcaaagacgtatcttttaccaagattatttctgctgctattataaataggtttatttcattgtagaacttgctggtaatatctgttgtaaaactcttatttttaggtttccctagggggctttgaaattacaccacctgtggtcttacggttgaagtgtggttcagggcctgtgcacattagtggacagcatctagtaggtaggtttttttttgtcatagttttcaatataggctagcttttttaatattttaaacatttgtatctttgcacatctgccatggaatgcttgtcctggtcagacaagacaatttccctagcatctttaattgctatcacatgagttctggggatcaatctaacacgacgaatgtgtttggttgggttcagctattcaggaccctatgaccaatgaggctatctttcaatctagacttccatttggactgtcgtagttctacaaagacctgatttctgtctttaaaatacagtaaatcttttctgttcatttgctacctttaatggaatcttaaaaatgctatgggttacttgttcttgtcgagttagtatgtctaattctattttagctgtagaggaagatgcagagtctgaagatgaagatgaggaggacgtaaaactcttaggcatgtctggaaagcgatctgctcctggaggtggtaacaaggttccacaggtaaagaaaggaaagatctttttgtttgttttttgtttttcaagacagggtttctctgtgtagccctgggtgtcctggaactcactttgtagaacaggctggccttgaactcagaaatccacctgcctctgcctcccgagcactggggttaaaggtgtgtgccaggaaagagttttaaaaagtatttctggctgggggtggtctacaaagtgagttccaggacacccagggctacacagagaaacattggtatcgaaaaaaaaaaacaaaatttctggcatttactttggctaatcaccaaaatttctcttgctaatggatgcatattattctttcagaaaaaagtaaaacttgatgaagatgatgaggacgatgatgaggacgatgaggatgatgaggagtaagtataagtactatgatctcaaaaacttgatcttacaggtacttgtaagggtttaggaggattgacttgccagtggttgatgtttgaaagtaaaagattttgacctatgattccatgtttgccttacaaacaagctatttattgtatgtgggacattgatgggggggttgaattaatttatttttttgagacagggtttctctgtgtagccctggctgtcctggaactcactctgtagttcaggctggcctggaactcggaaatctgcctgcctctgcctcccaagtgtgtgcgccactgtgcccggctgggacattgatttttcttgggagttattgttaggagtaagattttatgtgttcaatataagtaacagctagatgggaagtatggaattcgttaaaaatatttttattacatattttcctcaattacatttccaatgctatcccaaaagtcccccataccctccccccgaagtatggaattattatttgtagtcttatatttgttaccttcctgtcttatagaagttctggaattggtcaagtatattctgag

SEQ ID NO: 19738 - DNA, 1286 bp, Mus musculus
tcagaaaagaggtgcaaaagcatggctgcggggaaagtagcctagatccagccactccgccctgggctcctgaagctacgtgaaaacgaagagcaagccttcgagcaagccaaatcctgaggtgattatgcttgttccaggcctacggggaacggagggtggagaaaagagacgctctgtggttccctggctgcagccgccatctttcagggtgggctgcgcacgctctcggccctgggcccgcgagcacgagcggagaagacgtggaagccctgaaaacccagagcgaggccacaaagagaaaacgcgcctgcgcttgggcgacagtagtggagggacggggccagagacgaacgcgcgtgcgcagtgagagcccgccaagcacctggaggaggaggggggcgaggtacctaggcgtgaggatgaaaggcgcacgcgcaaaagcgcgactgtgcggggagtgggagggatccagaggaggctcgcggaggcaggactagcgcagatctcgcgagatctcctgcgaccatatatacgtgcggagagcccgcgtcctttccttggcgtgattccgtcctgcgcgtctgttctgtggaacaggaggcagttgttttccgtccggcttctcccacaccgaagtgcgcgcctccacctcatggaagactcgatggatatggacatgagtcctcttaggcctcagaactaccttttcggtaactgactggagggggaagcgtgtgcagggcctggtgatgggggggggggcgggagcccagccgaggcctggcgtgtggggaacgcggcgtaggtggaggccggagagcaaggaggaatctcccaggccttagaagcagcggcctgaacactaggaaagccgccggaaaatggggcgggagcggcccagcctgtagcctcgggtgttaggagcggccggccggccggcgagggtgcgaccttgcctgtggcgcgaacttgagaggcgtttctcctgtgcacgaaagcccgcacggtcgcttccgagctcctttttttcctcttgtgttgagccacggcaggcggcacgggagaaaggggcctgtggagcgaggcgaggcctacctccgccctgttggggaggatacatctgcaggcgctgggctttccaggggccgcatcttgtattctgtggcgaccgagggcttcgcccagtaacggggaatggtccgagcaggcgccctgaggcagaaggggcagcaacccctaggagcacgtggttgccacgtggttgggggttagggagggggtgt

SEQ ID NO: 19739 - DNA, 1165 bp, Mus musculus
ttctaatctgtgatgatcccccctcctcagagagaaaacagaagtgggggccaagtgtccaaggatcaccttcatggcatcacagacataaacccaggttgggactcccaagcccaccaaagctttgaaggcgcatggggacagagaccccagaggtttaatgcaggagtggcctctggagacattctatcccagtattaaaaccgacatgttaggatacccagcaaaccagagggcacaaggaaacagcaagtgccactattcatgtgatcagatagcaggtgtatctgtctgccttagttcagcaataaggaaaaatagtgctgacagtgccacagggaccaccacttggtaaaggcatcagtggaataggggtatggggtgcctttgcacgccacagccctctagaaagattctagtgtacaaacatgcatgcagtatgcgctctatgtcaagccagctacagagtcaatgctcaagcaagaagtggtctgtggatatactgactgagatgtgtctcacttttcagtgcccttccatcaacatgtaagggcagggcaccagggagcacatggtccctgcactgtgtgtcatgatctgaacagcccagaaaaaccctcttggttccctggactccctcccactggcatggcagtctacacataccttgggattgtggtcatggggaccccttccaaaatgcaaagctgggctggcttatagctgaaaacttagatgagtgaccagattatctcagtgcagctgagcatcagaatagggcaggctggtaagagaaactgaagggcaaatgacctgtcatattaccctattcagatgtagtagccagcctggcactttggagggaggcgcatttgagggccatgaatgaggaaaggagcctctggagagagagagagacaggacttggggtatggctctggtggagcatttacagggccctatgttccatgctagcaccacggtgaacaggaacagtgagtcggaaacaattgcaagagaactggattcacctgctaggccttgcttctcggtaagaatgccaagtattgttttccttgttttagagatgagaaaacaaacaagtagactgagaaaaggctgcatagctagaccctcccatacttagtccaagagtagaaataag

SEQ ID NO: 19740 - DNA, 1183 bp, Mus musculus
tccattggcttggaataatgcagtctgtaattgtagacatggcttaaactttgaggtaatttgcatctgtctatattaatgtttttctttaacaaggtaatatgctcttcttttgttcttttaaaaataattatattaaatataaagaatgtatgctaattttgaagaaagaatttttttttaccattctacagttaaaatcgtgataaataaatgttgctataaactgatagcagcttccttgggagcctcagtaagctcctgatttcaggttattagtcttgtgcatcagttgaagacatcacatgatcaccagtaagcagatgcagagattgcaggggagacaggccggatgtagaactgtaaccagaagtgttggcaaaccacaagtttctcttctgttgtgcacctgctttctatacaccagtggtctaaaccagctgcttttatattccccctacctacctactctcagccatcttagaatttgaaccattttttaaaaaagaggtccagaactgaaggaaaaaccatgttgtattatgggatcattcacagtaaatcaggactccatgccaccctctcagggcctgtgctttcggaacattccagtttaatctttgacagaataactaatttaagtgtagtatattgtatgttatggggtcaaaaatgtttttctccctcctcaactactcattctgagatatcagagtgtaaattgcctgtgtagatggttggccacagtgtaatacactacaaacagtttttaatataagcaatttacatgtaccttgtcgttagagatggggaggggaagaagaagaacaccatttggtaaaagatcctaattcttcctaaactagatataccccctttattatcaattttaaaagtagcatttataaagtacctattgtgtaatggctcctatactatgcattttcttctcagcaatgaaatgtcctcttcagccttgtccaaataggcatattccctttcattttgtaaacaataaaaatgatttcagacaagtttcaaaaatggttcctggatcccatgtgagcctgaagacttgacctctagactgcgtgcacgatgttgccaaagtccaagccacaagtggggctgggagtttttctgccagagagacagtatgttttacttaggtggatctgagtaa

SEQ ID NO: 19741 - DNA, 1173 bp, Mus musculus
taaatttactctgatctacacaattggtgagatgaaggctggaatcatatctgagtttagtaaagtgacaaagatggaataatgagtagttattttttaaaataatagatttgaagaatttgagatgcaactgaaactatattatttataatgtataaaagatgagaaaatcatacaaaataatttggaaaagagatttagaaaattatagaccgtcaaagtatcttaatattctgtgctatatggataacaatgtgcagtccttcaattcaactgagatgaaaattttaatgctaaaagcttcccatgtaaacatctgaaaagaaatatggagggaccaagcatattttcagttactgggggagcagttgcccagcatgtgcgagcctctagactaagattagggagtctataggaggagtgttcctccattttggttgaggaagtagtcagggtgaactctgtgagtttggattcatgggtgtattgaactcctccatcacctttgtgcttgataagcttggtgcttgtaccatcactaatagctagatatctgtcatctgttaaatacaagagaccatggaaaaaagatctctagtatctatttcagttcaaaaatctattatccaactcatacattttcagtgactttatgtaaaagatactgaaataaaagtaaaaattgaggtttactgtgaaaataaaaaaagagaagaaaacttttcttaactttttccaagatttccaagtacagttcccccatttcacttcatttaactggattaaggttgatcctgtgcatagagctcatgtgttcattaacagtgcccctactcaagagctttagattacccaacgcctgtgagatagtgaagatttgctgatagtgattcggcttgatctttttgttttgttttgttttgttttttgagacagggtttctctgtgtagccctggctgtcctggaactcactctgtagaccaagctggcctcgaactcagaaatcctcctgcctctgcctcccaagtgctggaattaaaggcgtgcgccaccacgcccagccggcttgatctttataagtgctctagtatataacttcgtgaaaaatcacctggcttacaaaagtattcaggccatttgatgttcagtctttaattttctgcagtaagtat

SEQ ID NO: 19742 - DNA, 1141 bp, Mus musculus
gtgtatgctatcagattcagcccacagtgatgcatttttgtgactttgtgggggtggtggtgggcagagtctctgtgctgagcgcaggctagcctgggattgacagaggtggtgctctcctcctgcttcagcacccactctcctgagtgctgcattaccttatctgcatctcaaaaacccacttgtctttgactctctcttgctgggattaaaggtgtgtatcaccatgcccagatctattaattttaattttaattttaatcatgtcttatttttccccatttgcgaatgaaaaccttaaggcttaaagaggtaagtaaggaactcatgcaaactcgcaacagcttgtcgggcctggaatctcaaagtacttttttccctgctgaatccctgttagcatcactgccctggtaaactgtctgttgaaaactgactttttaatagttgatcatttgttttaaaaaaatagatgatttttctgatttaagtattttctgaaaactaagcttatttctattaatacttctcaccttctttcttctttgttgtaaggacgtcttgcatggctgatctacttggttggcacagttgtaggagggagactaacatataccagcacagatgagcatgatgctatggatggagaactatcctgccggtgagtgacagctatttactgcacagtggaagaacttccacctttgttttaactttatatggccatgtgtaaaccagtgcacgtggcctttgggtgttagtttcctttttacccgaaaggaaatccatggatggagattgtgattagaatttgatttttcaacaaataggctcagatttacttggttttaaccccctagtgctggtgatctcaaccttaccaagctactgaatggctcttcacacattcctaaacggagggagggaaattcttgtgtgtgaatactgtgaatagcttgctttcccaccgatcttgactaaatagttatttcctgtacacttgtgcatggtttttgtttcatttgttttggcgaagacttaaactttatgaaaataaatgtcataggaatttccagagtactgatgttagttttaaagaccctttgagtattttgaatgtgtagaggtgtgtatacactgcatg

SEQ ID NO: 19743 - DNA, 1176 bp, Mus musculus
tatgatctttaggattcttttctagttgtttgaatacttactatctctgaaattttggttggggttaccgtgtttctgtaagtcactttagtgatgaagctgttttcataaaactagtggtggcaactcatgagcataggaagtcctcatccgcagcccctggggtcaccagcttctccttcccgtggtctgtagagcataaggagtcctcatccgctggtgtcgccggcttctccttctcgtggtttgtaaagtatttactgtagttgtgtttgccctcctcagttaaggttgttattgggttttacttatttaaagttattatgaatgggatttttaacctcctgatttttccctttagcaagtgcatcattttgttaaaaaaaaaaaagcttctgagtattggatgttggtttgtgttctgcatcttgttgaaaggctttatcaagtctgagtagtcctcaggcactattaaagattttaccatctgtaaataagaatatttgacgacttttctatttgtattctttaagtgtcttcaggtaacattttaaggactattgaaaaggagtgtggactatatacccttgtcttgttccacatttgaggggaagagatctcggtttccatgtttgtttaaatagtcttccatctttgaataattgggactgatttgctgtataatatctttaatatgttttaatttggtttgtaagaattttattgataattttgttttatttattaaggtctttggttttattgtcttttgaatccatctggtcttgctggtagggtaatgctggctttattgtgtgactttgatgtttcttctcttctattttcttgtgtgtgtgtgtgtagtatgagtgtgtgtacctatgtgtgttcgtgcaggtccacattgcctgcatgtcagatgttgatatggagtgtctttctcagtcactctccctttaaagcttttttgtttattattcttatgtgtgagtgtcttgcatgcatgtatgtctgtgcatcacatgcagaaaacagaagaggacatcagatcccctgtaagtaaagatacagatagtttttagccactttgtaggaattagaaatcaattccaggtactctggaagcacagccagtgctctttaagtccctgcgcactctctccatttcccccactt

SEQ ID NO: 19744 - DNA, 1133 bp, Mus musculus
attatagagcagcaggtttgtattttgaactagtttgttatgacttcagtaaattcacttcttagttctagtagagctctctctctctctctctctctctctctgtttgtgtgtgtgtgttaatttctatgtgcacaatcatgtcaactttatatatgggattttattttgtttttatttattttttgtctttttgagacagggtttctttgtgtagccctggctgtcctggaactcactctgtagaccagactggccttgaactcagaaatccgcctgtctctgcctcccaagtgcttaaaggcgtgcaccaacactgcctggctgggattttatttttaatcttccatattcatttgtcatttatttcttgtttcatcatagcatttttacattgcaaagtttctgggttgtgattaagatgtcccacattgtaagtgaatgtctttcatatttcagagataatttagaagaccctctggatgacactgctaccgtgttccagcagctggagcagctgtgtacagttagcagatgtgaatatgaaaagacgtgtactcttcttgtacagctatttgaccaaaatgcacagaactatcaaaagcttctgcatgctgctccggggctggctgttgacatggcgattcaagaaggtcagtctgtgttagacagttgtgagcagcgtgccatagggaatcattgtcagagtccttcggtaagccaggtgtggtggtgacacctttaatcccagcactctggagcagaggcaggtggatctctgagtttgaggccagtctgtcttgaggtaaactacttttatgtttctctcattgttgtctagtccatttttaaaccactaatcatattaagccatttgatattttggtgacttgactattgacctttaatatttttatgggacacacaggcaacaactcatcatggactcatcaggaacagttgtttaatgatcctcaagcaggcagtgtgatgtcattgtctttgaagtaatattttctcctttttttaatagtagactgaacacttggctaaagtcagcctgtaaaagaagcctaaccagattttatttgtatttattcattagtcttcaccatggcttttaaattatttat

SEQ ID NO: 19745 - DNA, 1184 bp, Mus musculus
atgggaaaattcctttggaagttgacaggaaaccctgttcccatttgattatactcttgcagaatacttgtataatagattttaaggaaattcggaaacattttaatagtcactcaagtatgtcgcatagtgagagatgttagtttttaagtacttactagatttgtaaaatttgctatttgcagagagctttgttatcagtaaaagttaattttatcagggctggagatgtggcttggttggtagcctgcttgcctgacagccacagagatccaggttctgtgctagcagcaggtcttgggtatggcagtaactgtctgtaatagcagcactcagaatgtggaggcaggagaatcaaaagctaaaggtctgtcttagaacataatgaattcaaggctagcctaggctacaagaacaacaaccccagttagttttatctgtaggtactttgctatatgatttcttgtttagaatgctataatgccataatgccattttaaataacatttgctgtgtttctttgtagcattgggagtttgcccccaacagtgttcattacttattaactctgtggcagaggatggtagcatccgttccttttgtgaagtcagctgaaccccacttgttagacacttatgcacctgaaatcacaaaggcctttatcacgtcccgtttggaatctgttgccattgttgtgaggtattgaaatattaaatgttttatttttatctgtctcatcttgtaatttttaaagattttagtaaaatgttaaggttcactgttgctggtgtacagtttgtaagttctgacaattgtgtccagttgtgtagctaccaccgcactggtgatactgagtgtcatgagtataatccccaaacctagagacacttggtccctttttagttagcacacagctctggcaatgactcatctttttattttcctacaatttttgccaattctaggttattgtacagatgaagtctagtgcctttcatttggcatcatatgcctttggaatccttccatgttgtctccggggttccttcctttttattgcagagtaggatcctgtctgtgactgtatccgtgcacccacgtactgttgatgacatttaggctgttcactttgttagcaatgtgaataaactgttgacatcattgttgtgcacaattttatatga

SEQ ID NO: 19746 - DNA, 1144 bp, Mus musculus
gtggtagggttgggaacaacaaacgagctgttggcagcttgtgtgaggtctttctccccaccccatcactttgcccattatctcacagctgtttactggccactgtttcatgtcttgaaatgagtacattcattttatctgaagccctgtcaatgctgctgctttgcctgtgctgccttctagtctattcttcacttggcttaccctttaggtgtgaggcactcttcggttttgagctttttagcatatgtgtaccttctttcagacataactgttaactttgtaaaggagggactcttctcctttatgtgtagttgcgttgtgtaactcattttgtaagtaaataatttgggcagtagggaatgtgcttctcttgcacggtattaagtgagtggtattactgctcagtacctatgcattgcatggatgtatagaagcattatttctgtatctcttttatttgtgtttaattattattttccatttaagtcaaacgtctttctttttttcctctgaagagtttggctgagttggaagtgctgtgtactcatctctacgtagggaccgatctcactgaaagaatagaggctgagaaagcactcttggaactgattgacagcccagaatgtctcagcaagtgtcaacttttactagaacaaggaacagtaagtatgagatgggtggctgaccctgacaggccagtgttgatgatattagcggtggtttagctgcggtactcaaagcttttgccacatcttgttgttgttgttttctgtcagacgggttaagcaggaagaactggaaaagctggggagacatacaggaaacagccacaaagtagaaataggcatatggtgaaatagtttttttcgttcttcttggcctggttttatgtcacattttatatgttgattttagcagtgctgggaatgaaccaaggcctcttacatgctaggggagctctctactgccaagttacatccctagccctagcaattacatttcagaaataaaagaaaaaagaaaaagagaaaaaacaacctgagtatcagggtattcagaagagtgctcctgcttcttcataccttcattgtagatactcagagctgtccactcagcaaccagcagctactgaggagccaac

SEQ ID NO: 19747 - DNA, 1128 bp, Mus musculus
gtgagccatgatgtgactgctaggaattgaacctgggacctctggaagagcagtcagtgctcttaacctctgagccatccctccaaccccttctctaaggagtttttattccatgtgatggctcacaagagttacctgtctcctgctgggatacggtgaccagggtgaaatactgttggattgtgtactgagcaaggcgcaggttttcaagtccacgcaccgagtcattccctctcagccaggagaactccacatcattgccatcgtatccccctggcaaacaagagggagccctggtcagtgcaaggatgctgcagattgagctggtgtgggaaatgctacagtggagaccagcaagacttctctcctggtggcattaagtctagaggagcacaccatgcaaaaagttggccaggagcctcaagcactgaggggtgaaatcctttgctatgcccatttttcattggtgttgagaagtagttctattgtaagcattgctcaaacctggtggatgataaaaatggcttcgttcactactgaacgacacttacaaagcatatgatcacagggacccatgttagattctgcctgtcagggcagtctaagctttgataacgttgtctgggacttcagaagtggtctattcatatttcccattagtataaatgcaaaactaaaacagtctgttaccagccactttatatctgtcaatatttgcttttgaaaaatgttagctttactagtatctgttgatggtactgctaagttaccctttatgagcccttacacaacacatccctcatgatctcacaatcctgtaggatagacatctctgtgcttcttcagatttaagatggactttggtctttacatgtctgaaattgtaattgatcctactattagtttatgtgtgtgaagcagagcttgcaatgtctcctaaaaatatgcttattcactaactattgcaccttagacttgaggaatcattagcccactatatgggaaaactctcgggttctaaggggtttcttaactctctcaggatacagacaagcaagagacaaaactcagtgctgtgccttgctcaggaaagggtagtctcaaagctcatggatggtggtgtaatca

SEQ ID NO: 19748 - DNA, 1131 bp, Mus musculus
gtagttcagtctgatagtcacgttgtggttcagtctgatagtcacgttgtggttcagtctgatagtcacgttgtggttcagcttactgtttgggaggatttgggacgcccaaacaatcgtcacatggtccctcagtctgggaagtatggtgattatcgatgcatattagaaaaacctagagatcccacacaattccttaaaaccacgtaatggcatacactgggaaaatgtacaccccagttcacaaacaagccagggtaacacaatccccatgggctttgctggccagtagaagactccttggaattgtcctgcccctacctgggctccagccccagtatttctgcttctcgagttcctttagaaaaatgataaattgtgacgagtcttaatttgtgtaatcataaggtaagaaaacaacacttgcaggtttgtttggaagctacctaccacaaaggcagagtgggattatcaccttagctgttcctcctaccatcattttccaactagcttccctacttcctcagttgcacagtaaggaatagctggaggctacagtgaatttccattaggacaaggaaaagaaagcttccgaggcctcaggctgcctgaagggaacgaggcatatttagtaacaaatggaaagggggctaatgacgcccaggacttctgcatcagcttctatagggtcctagggttgatttggttttggtagaacaaaagtggttatgtggacaggcatagccattgaatgattcatctggagtcatagaccctctgaggataagtagcctgagagatctgttttcatcaagaagttttctataaaatagaaatactcatgattctatggttatgtatgtctgcgagaggatacactcctgggaatttgacagggaattagctcttggaggctcctaaaagttctgcagcgatgacgattgttcttattttaggctatgtagaccatgccgtgtagtctctatcccaaatgctcagttctgttataacagtgtgacatatgcaaatgactggtcacctctctctgcaatacaactgcatttccagcaatgggtgatgggccagatttggcagatgaattcagcttgctgatcatgacctacctacact

SEQ ID NO: 19749 - DNA, 1162 bp, Mus musculus
atggaggccttggagtagttagtagctattttagcttagtttcttctattgtaagtttacataattcttgtttttataataacaactcttaacaactacctcaaaaattcctgaacttataataattatgtcttgcaagcaagagcaaaggggccccaggatagcacacagtgaccacagaggcacatgttggtctttattaatggatgctagatgttctgtagatgcctatggtctaggcaggtctttgaaaagaatgctcacttcagcttggttcataatggacaacatattttagtatatagctaagcatccactgatagaaaaatatattaaatgctgtatattgaaattatgggataattgtattatagaacatatactacactatattataatgtaaaatataattcattatctagttctataggcatccaagaggatctatatcaaaaataaaattttggaaatggaagtgccagaaaaaaaaatatgttcagatgatccagatgaagttggtttaagaaacaaagggtggtgctcgcttcggcagcacatagactaaaattggaacgatacagagaagattagcatggctcctgcgcaaggatgacatgcaagttcgtgaagtgttccatatttttagcaccctcatagtagcagggggagagggaagggctggtggggttctggaggggaaaccgggaaaggggataacatttgcaatgtaaatacataaaaaatccaaaaagaaaggaagaaagaaggaaagaaagaaagaaagaaagaaagaaagaaagaaagaaagaaagaaagaaagaaagaaagaaagaaagggaagaaagggaagaaagggaagaaagggaagaaagaaagggtgtagggtaagggaagtgactcaatggttaccatgcaagcaggagtgtaggaggaatggcgggcctcattgagaaggaggtcatgacctctgtataaacattggtaaacagtgagtagggctgcaaagccacagaggcaacttccacatgagggccaagctgaagcctgcctgagagcctagagattgatgacacagaccatgacagccaatcaggaactgccacttggagaacatacttgcttgggaccaataggatgcaggctctccccaagaattaaaatg

SEQ ID NO: 19750 - DNA, 1165 bp, Mus musculus
tccaggtctatggtttgatggaaaaatgaaaaaaaagaaagttgattttcacattattttccagaaaagttggggcagccatacttctgggtatattttcacagtgacagcctacaagcttgggagccagaggtacagactgtggtagagactgtgacttgtggattatggacaatctctgcaagtgctacttactgaccgtgaacttgaaacccctccagcaatggatgatgggtgaactgtgctgcccaagggttctctgaatggaacagcacagtgtctgacaagcaggggattcatagccttgctgagaagacactagctttactggggaggctcccatgttacagcctccagtctccttccccatggctgggtttaatgcctacttatgcaatcaaacagtgcatgcagactggaataaactggaaaataggaaacacatgtcactgtgtgcacttaagccctgaagtagggatacatatttatgtatgtgcatgtgtataaacacacacacacacacacacacacacacacacacacacacacacacaccatgcatgtaaatgtgttttcaaagggcaagaacaatgggtttgggctgtgtggtggtcagtagagcagtggtccagtttgctttctccagggcacacctgtactttgtcctggtctcttcttgcagggcatggcctgtctttggttttcttatacacttagttagctgactttgctaaaagtaagacaggaaatgatcttgctttccactcctccgatctgcatctggatgggcccatgactggagataatgtgcagtctggttgcctaacagaactccatgagccatggatcctccaaagaccaccctggtttttaaaatcccccttcctgtgtgcattactaggtatccttgcggcctttaatccccagagtctaatggataactaaattctcagccgcttagagagatgtttgtatctaaatagctattcacaattccttctgtactttagtcatttcttacacttgacgttctcgccccaggacttcattgccccctgtcatcccacctttaccaagtacttcaggcacatgctgctcatttcaacatcagattctagtgggagcagactctgggggctgcagctgttggtggctttgatggtat

SEQ ID NO: 19751 - DNA, 1209 bp, Mus musculus
caatccacactcactctggggtggagagtggcgcaggcccaagagttatgttatcagtgttgggaaacacaaccagaacttgtcacgcaacaagacaaacccagagaagttctggatgatagagggcttattgatggctttcttagcccgtgtggtgaggttagctgaagtgagaatgtggtccttgtcacttccttgtgagctctaaaactgaaccagaaggtggaccatggctctcaacacccgagaaacacttctctaggctgaggtgaaaggagacctaagaggattctctgaaatgtgtccacaacccatggaagtcactgctagatctgtagcagctatagacggaggttccgagatgagagcctggggggactatgatgaaaaccaaggcaaagcaacaacaacaaacacacaaacagaaccagcacagccatgtggtgctaacagcccagaagcaccaggtgttcttaacatcttggcctgcagaatctcctcagtgctcgttgtcttttgtatggtggtttttctgttttgtttcattgaaaagaaagtgaggtcctagactgatgatttgctcaagctaatatgcacatgatggagctgggacgccaacatggttgactccttcattgcttgcatgctaggggcagaagatagggagagtgacagacgtgtggtacagttaccttaactctcttatgaaggctcaggatttggcttttttgtgtctccgtggccactgcataatgaatatgacatccggcagagacgtgttggttatctattaagcttacctgttgtctggcttgcagtaagacccaagcaagctccactttgtcccctcctttcttgccagcaatgataggacataagcccaggtgttcccttcagtgccataactgctctttgtcctgtgctgagctgtgctgagctgcgttgcaggtgagaggcttgaatccaacctcagctgctttcctgtacactcgatagcaggcagaaacagcccaagcaaaaccagacagagaagacctatccatgtcacacttgattgaaagggaattgaattctaccagttcagtctcctctactgaaccttcagctcaggagtgctgggcaagcctgggctcttgctacctctggactcgggagcaaaggcataaacatgtgaacaggccaccgtacagacttgccctctcccctccc

SEQ ID NO: 19752 - DNA, 1137 bp, Mus musculus
ctagtgatttttttttaaataaaagcccatggcatttaatgcataatgttgaattggagctcaggcccaacgttgcattttatatccaaagactgagatgtctgtaccattttgagcacttggtagtactactgagtctgtagagaaactgagtaccttctgggtacacggcctcagtgatggcaatgcctgcataatgttgcatctggtttgagaacattagtctccttttattaatcattgctcctgcctcattaaatctctggcttccacatgccagaaatggtgtgacaacccaggcctggaggactcctcccccccagacaaaggcatcatcgaatcgctggaaaggaggggacgcaaggcagataggcagagcaaactagtgcgtagcgggaaagcctcctgggaaccactaaaggcagaagaatcgccagtaaagatgggagagagttggcgagatggctctggcataagggcacttgccactaaacctgccctccacatgaacactgtgcaccccctgaaataaatgttcagaatttttcaaggagggaaaggtaaggacctgtgttgagagatcagatagcaaagatgggttgacaggtttggttcaaagggcattttgatgtcaaaagtctttaagcctgggagacagatttgcaaaagggggagagaggttaggggaaagtacatctggggtctcggctgctgcagtctggtatctaagggaggttagttaccagcttgcagaatagagggcaaagaggaggagctaatggcttaaggaagggcctgaaggaagccctgtgcagtttgggcctgttgacttggctgagccctcaggatagtaaggtagggaaaataatattgttcacctgtgcattgatatgaggtttattttttgttttgttttcatatttttctgatttacaaatcaatttgaaaccttcttaaagaatttaaggggctggcaaaaatgccagaattcatgtgccttgactctgtctggctgaggttggctcctcacagcaagaaccagaaaaagaaagcaaattgtgtgtgggcagtctggtatgactcccagctgctgaatcagagtttaggcctggagtcagggtcagggcggactgggac

SEQ ID NO: 19753 - DNA, 1148 bp, Mus musculus
ttgtcctttagatcttcaggtagagagacatgattgtgtatgtctcggcatgtgtacaattgtgagcctctacaggaagatatgtccacgtgacttagccttgcccatttccctggtgaattagaaaatggtcattgtcaaattctaggacaagtagggtatcactcagcactgacctctagccaccctcctaaaagctcacagttgccttcgtttcctgtctttgccattatcgctccatggaggcttctactggaatcaacatgggatggaatcccttaatatggaagttatagagtcccttgcctcttggctacaccatctcctcctcccctgtgtctctgcctcagcctctcccgttcataggcttctgctatcaagccattctcacacatggtccattcaccacttacatttgtgtgtttgtgtgacagtttatctgtgcttgaagagataggcaagatgtctgcttttgtgccctatatattctagagagatcaaataatgaaataattcaaatgataagcttaaaggtagatggtagggggatggggaatggagcaaggaaaggagttgaaacaagggtaaaaaatcaaagtgactatcagtaagattgttagagatgggaggtgtgccgtgcaaaggccctaagatgcgagtgtgtctggaataccaggaggccactgtgactgaagcacagaaagcaagggggaggtagtaggagatggggggagatggggggcccaccatgggcagtttaaggactttggttgcaccctggttggtatgggaagaaccacgcagctcacaaaagtggagtcctggtttgttcctccttctggtcttcatcagctcttctctgattctctgcgccagccccagaaggcacaggcttgtctgcaccactcgctgcaagcaagagggctctctgctatccacaccctgtgaggtcaccacacagtggctcccgcagctgcctcctcccagcaccagctaaggggcatcacgctgtagctgtgcacactgctatgccctggaatgggagaacatcttcttctggagagccctggcgcacctctccctctggcttcttccttgttcatctcctgttcctgcttttctttccttgtcctcttggccaagatcct

SEQ ID NO: 19754 - DNA, 1473 bp, Mus musculus
gccattcaggaagagctgatccagaaaccgcagtcattgtctgtcactgggaaccaaaggataaaagcctaattctacttgtgttcattttaaatgtcagaatggtgagctttgccgcatggaaagacctataatgggaagtatccctcactgattgatgtcctcttgtatgtatgatagccagcgttccatcttaaatgcaatacagcctcttgattgttgaacttttctcaatgattttctatttatttgatgcagccaacattgtagtactgtgtgctcagacacaaatcttaaaatctcagaaatgtttgtttatgcaaaataattgattctaaatgtttgtttgtttgttctaaatacttgtttgagtctgttatgtgtgtttagttactagtgagcaggaagcaacatactctcataatttattgtactggcaatcaaagatcattttctgtgacttagaaatgttaagacaatattaagtattaactgtgatagttttataacatatcctcagaaaagcatgtctatatgacctctgcccataagtataattttctctcagatgatgagttgaaatactgtctttaaacatgaacctgaatttttctattgaatccctgaagtttttgcgcatatttggtggcgctacactttctttatctcatgcattaatcagtatatgtgttaaaatgtttactgtttgtaaaattgagggcataatcacatactttggagtctatctaattaagtccttagactgttcaaatggaatatggttagagtgagtgacattctatgctctttctctaccatgtgtatctcaggcccaaatgtgcatttcttatcattagatctgaactcgggaagctgatgtgtaccttccataagcagtagtaatggacagaattagatgctatcaaaaagaatgttttaaagttaggtggctctgggcagcattactaaattacagatggatcaatgtttatggtttttggtcataaaagcatcacagaccaagaatttgtctttctgcttggaatttattcgtgggtttgaattcctgttttttataatgttaaaatgtaacattttggatgccattaatttggtaagttgaatctgtatgggaaatggacctatattaatttctgatatttctggaaataaccttaaagaggttagattgtttacattaaagagtatttcagtgtagtttctgagaccccagtgttcaaagtttccagcagactgtcaagaggttcttgataaagacaggtctctggagccaggtgtggtggcctatgcttttaatctctgcacttggcaggcagaggcaggcgaatctgagttcaagggcagcctggtctacagagtaagttccagaacagccagggctacacagggaaaccctgtttctggggtggtaaaaaaaaaacaaaaacaaaaaacaacacagatttctgtgta

SEQ ID NO: 19755 - DNA, 1146 bp, Mus musculus
ctatttcaaaaatactatatattgtcatcatgtcatctcttgtgtagtatatgggatttttctaataactgatactgataaaatgcttgtaacacatcctaatagttagcaatttccaaactaatgtatttcctttatggaagcaaaattaattccagggacttagtttctaaagtttctgagttttgtgcagtcaattttgaaagagtaccaagagacactttttatctcattgttattttttatacatacaaagagtctttctaaaaattctgataactttcaaatgctaagagcattgtcagccatggttttggtggtagtacatgcacacaaatctaaaacaccacctctcccccaaaaggttgccttttaactagacttctccagtcatctgtatacacacacaggcattgccttcctcggctcctctgaggaggtggaggaggagtggatttctcctgtggttaaagtctttgccaaggcaaggctagtaatatgcatgataattgaaagccagcccctcaagggattctcattatttgcaaatactggactcttccaaggctctaaatggatggcacccttgagtgcaggtgattgctgtgtgttaggcatccactcctaaaaataaagctgttttgtgggtgacattctcgagggagggaagttcatctggctatagtttctaaatatcctttatataactactttgttagaaacaaagttctttcttatttagtttatcatatcttcttttgttgagcactttatctttgttagtgttttgcatttttgaatataattcagaaattctaggttatgcaaagaatttataaagcataattaaaatgagtgtatattactttgcattcaacttcagttttgtggtgtgtgtaaacaaaataacagcaaaacgtttttaaaatactctgataactaaggtgattgcctctaaacgtctatgttgtcttttcccacccaagctcctatgttagagtgcacttcattgtgacagcaatgctggccagctagcttcatgtgtgtcaccagataatctcttgtttgatttttgctttttgagacagggtctctgtgtagttctggctgtcctataactttgttatgtagaccaggtgcctcaaa

SEQ ID NO: 19756 - DNA, 1312 bp, Mus musculus
cattggacacactgtgctgtcgtacatattcagtacatgtgacgttctgctttgaacagtgttttacagtgttctggtcattggcctagcttcttcacgtctctctttagttgttgaccaggacttcggtggccaccgtgagaatgacaccgttgccaggagccagagcaaacagttgctccattcctggcagggctcaagatgacttacacattgcagacctatcatgtgctagagctcatttttagtgcttcatagtgttttagtaattcattattagtacatgtggataagtacttacaaaaccaggaaaaaaagttattgtcattactgcctgtaatagctacgtgtgtaacctcaaaatcatatagggattgttattcttcatttgtacaagatgaaaattcagagatgttgaagtattagctatatttggaattttagtagcccctctctttgacctgtttttctaatcattgtgtggtcacaggagagggtgaacactttaaagctcttctgaaaggattgtatttgtctgacacacggttccagcaccatttacaaaatgaaaatgaaaatggaatcccctgcacataggttggatggattacagtcctacctaataaggcacagaagaccttaagatctctttgtgagctgactggagcagacctgggtctgacccagtgtctttctgaagtcagcgtgggctgatgctgaaatctgcagcttggggatctgactgaactcacaaactagtttgtcttccgaacaaaggcttactgcagctgctgttaattttatgtttaaaagacctggtaaagaatgtaacttccacagaaagcattttcatttttacataacattaccataagtgatgtaaaatagttttgagatctcaattgttttggttgtatgcttcaaaactgtcattgtgactgggtgtcatcaggatatcacagtggctcattcaatacttaattaaccctgcttctaagccatttgaaaattggccagttttttttctgaataaacccttagagtttccagcatttagaagaaaaataattttatgaaatctaacgctcatgctgtagtgtcccatttctgcctgtaatcgctggaccctgcagtgagtgaggttcaaacacttttgtctctttcacccactgtgttggagttaagtgaactccaggcatttaaactgaaatgaaaggtatgcttgttaattcttgagtcctgaagaaatcattcctaggtgttgctgttccagcttagggcttcctttcctcacacacgtcgctcagtgcaa

SEQ ID NO: 19757 - DNA, 1713 bp, Mus musculus
tgtatatgtatgtgtttcctgtattgatcatgctaatgggtcaagcatgattttgtctcctatgtcactcgctgcaaagatatttgactgtgtgtgtgtgtgtgtgtgtgtgtgtgtgtgtgtgttgttaaagatgggactatgtggataggaactcaaaatctcggacccaagctatgtttgtcttgagcctctcaagttgctgggactagaggcatgtatcaccatgttcagggttcatagatttcagatttcacagccagagttcaggcatgctaacagcatttaatagtggccagagctatcactaagtatcctacagtatatagtagaggtgtctctcagtggcagactgtgtgattgggatacatgatgccctgaccctgagcagggctttatcctgtccatacctatgtgttcagtgaggttgaaacacctgttttccatcacagggagaaaatggcatttttcacccggcctcggatgaacatcccagctctctctgcagatgacgtctaaccaccagaaaagtatttcctttgtctcgtgcgcgcgcgtgcagaccaagctgtgaaggctgactgtgactaatgttatttatgaggcattatatgaaggtactgagtcacaagtccccgagcgctcttgttggtttgaagacagattttttttttaaatttcaggttttcttgttattatttaaaaaaaaaaatgacaaagcaaccataacaacaaaaacaaaaaccaaacaaacaaaaaaaccagcattaaaatgacaagattgtatagtttgtatatttaggaatgtatttttgggaaagaatttaaatgaactaaagcagcattaagtggctgctagtcttaaaactgtctagagttttctttttgtacagcaacaactttcagaggtttccctgcaataataaaaaaaaaaaaagttgtatttgaggggcgacaatcctcaaaggaggtcccgcgggtggcacagcacagctagcctgccctggttaacgttattttgtacaataatacaaagacaaggatgtacagtaatcgtgggggaattcgaagactgtccgcggatctttgtgagctgtgatgtgtctttcatgtggccacgtgaccgtgaccggaagcaggtagcctggagctggctgaaccgcccggactggtgacaggccacgcccaggccacgcccatctcagatgcccagtgacgcagctgtgggagtgaggggagggctgcggagaaccgcatttggatctatctctaacaataaagtggccttttaagaaagagcttcttgtcatttgtccctttcacatcttcacttttattatgtccctgatttcactcagctccaaatcctggggggggaaattttgttttcctttttcttttatttttcgagttatacttatttgtccgttagataaaagtgactgctcagctctttgggaacctaaggtctggtggtgtatgtctgtgtttccagaacctgcaaggtggacgcaggagtttgagaccttctcagcagtatgaaaacctgtccttaaaaactgagcctggagagatggctcaggagttaaaggcactggctgctcttcctggagaacagtatttgattccaagcacccatatcgtggctcacagctatatgtaattccagtttccgggatctgagaccctttctggtctctgtgcataccaagt

SEQ ID NO: 19758 - DNA, 1206 bp, Mus musculus
aggcttagggcattttcccataactaataagtggtccaactagtgatagcagtagctagaaacctttaatgagggctaaatatgggccaaatactatgctttatgagtatgcatgtctgcgtgcatgagtgtttttcaaaaccttcagccaccaactcaggaaggagatcataaaattcccttcagagatgtgagcgccccacccagggtcttagagcttgaggtaagacactgttgcctagcatgggattcagtctctcctgcattcttgaccaggctgaaacctgaacgagaggaaagcggtaactgtcaaactctgctgtgaggatgtcctggaggctggtccttcatgtccttaggaaaacaacttgttccccagttcccccaacagtttttcatctctcataccttctcaactcccaggatcgccaacctcaagatccagctggccaaacttgacagtgaggcctggcctggggtgctagactcagagagggaccgactgatcctcatcaatgagaaggaggaacttctgaaggaaatgcgcttcatcagcccccggaaatggacccagggagaggtggagcaactggagatggcccggaggcgacttgagaaggacttacaggcagcccgggacacccagagcaaggcgctgactgagaggtaggtctaggattaagagataagtccccatgggcccaggaaaagtccccatgggcccaggaaaagggagaacatgccagtctgacctgtgagcccagcaggagccaagagtgaggggtcgcctggtgagcgcactcaggtagagatgtcacagctttccagagtggcacattagaaaagatgacatgtccctgaacaccaggaccctggtacttcacacaggaagcacggtgccggaaagtgtgcaggtgcagactctcagaaggatgtctgctcatgcaaggaagccccatagcactttatcgcttggggttttcccgtgttgtaatgatgactctccatcacttacatgagcaacaggtttcacacagtgagcatctctgctttacacacttgcttgtacccaacatcactggggaaagcttcaccctgctcccagacacacacacattgaaaattactgtgtctgtggggagcagagggtcctttgatgcttcctttcttttgttaaatcgtcagaactccggaccatatccttaa

SEQ ID NO: 19759 - DNA, 1189 bp, Mus musculus
tggttcacctacagcatgagctgcagttcaaggagcgtggctttcagacgctgaagaagtaagtctgcccctcccttctcaagacgcctctctcacaattctatttaaatgtttttccaccggcatttacgaaagatgtcatcaccccagggtggaggtaaactgagttatttcaaaccacggagctctttccccagtcttggaagcaagtgttaatcatttctgtgcttgtctcggctctgctaattaactactagactgtcagacgcagaccaagcaaaccctttagtcccacggtccctaaactaagccgctacttcacctagtacccactgaggaaatagcagtctcttttagcagtggaaacattcctagggagtctgtgtgcacggtcccctggggggtggcataaggagattatacactgaatagacagatgtcgttttcatttatagaaatgggcttacggctaagtcaggaatacggctgtttcctgtattctgtattaactgctgtgatcttggtgatggccacgaaaatttgtaaagcctttgctgtgtgccaggaaacacctttaggtgatcctgcgggaggatgtccatctgatctttgtggtaatcccaaaggagtgttttgtctaatattttttttagctataaccacattatatagatgagaaaactgagtcatatactaaatgcttagtaaatatcagcctataattatagcttttatatctttttttaatatgtcttatatgcgtgtaatgtatatatgtcaaatcatatgaaatcaaattctaacttcattccagccaggggttgtactttatgtcccttgttaattttttagtgaacaccagagacaattcagggcaatagggtgaatgcagacattcccaactttgacctatgaagacccagtgtctgtgtgtcactccagaagcttcgaggcatagtttaaggctgttcattgccccgcatcaggagctctacatcagattcttcccactgtcctcagatcctcaacaaatctgtttgaccccattgtcactgtgtagcagcattggaaattcttttcctttggtgagctgacaaccaaaccctaaagacaacccttcccacgttttcctcgcagtttgatagctggccagatgagactcctttgcagcctggttgcccacagtcct

SEQ ID NO: 19760 - DNA, 1123 bp, Mus musculus
ttttatacaaatatatcactgcctgaattttagaaattatgtttatgataaattaatatgggaggaattattggtcaaggttattaatgttttatgcctctgtttctaatttatattcttatgctattatattttatattgctaacagagtacaggatgcccattcatgttttttgaaactgatgagtgcttgtctttccttttacactgagccatagcagatggccttaaacctctattatgcccttaacctattccttcttttggttcttctcagacagagcttggtgttcagtttgaaaactgatcttaagttgtttttttggttgtgtgacaaatcctggtggaattgctttgccatgtagtgagtttaacccatttatatttattggctataatatactcatcaagataaactcatcaatataaaatgacgagtctctgtacatcatgattttgttgtccagtggtgagttctttaggccaccaacacagtaggtccttgtatggctgacacattgctttgggatctttttcagaaaccactcagatcgaggatccaagggtgcaatggcggcgggaacaggagcacatgctgaaggattacctggtggtggctcaggaagctctgagtgcacaaaaggagatctaccaggtgaagcagcagcgcctggagctggcacagcaggagtatcagcagttgcatgccgtctgggagcataagctgggctcccaggttagctgtgagtaccttccattgctggggccattgccagcatccctgactagcacagcagggactatccacactgagtactgtcaatagcttctgtacttaaatctgtctcctatccattccttcttttgttctctagatgtgtgcatatgcattatatgcacatgtatgtgctgatgctggcccccatgcatcagtgtggaggccagcaggactgggtattctgctctatcactcatttctttattaagacaggatccccaactggagtcaggctgtgatctttctatcttcctcttcttcactgtctccccccccccccccccccccgttgctgtagttacaggcacactcagctgtgcttggatttttacatgaatgctgcga

SEQ ID NO: 19761 - DNA, 1337 bp, Mus musculus
ccatctacatggtggcaggtgacgcccactggctggcttctgataatctgcaggtgcacactgtgtgctgccttaatggcagcatgcctcttttttttatagctctgataataaccagttttctggcactagaagaaaactgaaataaagttattaagctttcaagatgctgcttcctttactcatgctctgttttgtttttctttaaagattactgacagtcctgtcataggagcacagcgccccaaaaatgctcagctcgattgctccaaattggagacgttgggcattggccagaggacaccatttcgaactggaatcaaagaatctctctggcctttcctcatcgacaagagatggagacagactgtctttcattagctcatgtgttgtgtatttttttaaatgaaaagtatagtatgtggcactttttcaagaataaaggaaatagttttgtatgagtactccttaattgtgacacatgatccttcaggtaaacaatgctgttgcactaggggaatgttggaccggctgagagcggtcatgactttctgtggattgttttgttttgtctggcttacctcgctatacaagtaatgtaaattatgatctgtaatgtccgagggcgggatgaaacagactgttagactttggatgaaatgcattgttcattcctacagcttcctttcttgctgttgttttgtttgttggctcttgtatattgatagcttcagtgtgtgtagaatctcatgataatcatcggtgttcattacttgctttgcttgagcccagatcaaaatgcttggagaaaagaaaactttatttttgcaactgtaagtatggtttttaaacgcttgattctttaatgtgttatgtatatcagaacctgtatagcctgatgcctacttcatagcactgtgtggcaaacacttgagagagtgcacgtgtgtgtatttttttaatataaatacatatatatgtctctttccttctatcttactaagtgatgtttcatacatgtggttataataatgagccttgtaagtcttttgaccacttctaaataataataaatacttgctagcatgtaacactttggctttattttgtatttgcttcctttttaacataaggactactggatatggtagtacgtgtcttcagtcccaccagaagcaggtagacctctgcctttgagtccagcctggtttaaatatcaactatcaggccagacagggctacctactgggatcttgtttcaagaaaataagtaaatgtgagggctaactgtcaaccaatcactctccaggtttagtttgtagattacatacttgtaa

SEQ ID NO: 19762 - DNA, 2281 bp, Mus musculus
cggaagagcagtcaggtgctcttacccactgagccatctcaccagcccgagaggcttttttcttaacagaaactttgtatattgagtcctaactgtttgaaataccaaatatatattatatgtatatatgtactgtactatatgtgtgtaatatatatgtatattatactatgatatattatacatataattatggtacttctatagtaccatatctaaaactagattagttttagtttataatggcttaggaatttggtttggtttgattttcaaggatttatttccaggcccatgaacatactaggcaagttgtacctgagctacatcgatagcctggctcatctgttagtagttttaatataaaagacttaaagctccttgtcatactctttttcaggcaacccaaactgctgctgagttcagatgcaacttcaagaatcatggaagtatacgtctgaaatacttgttgaagattattttcttcattgttcttgatattatgtttatagtatatattatataatgtatttaatttctactgcctagtcttaggtatatgaaacggtaattcagcatttgttctctgtcttagtcagggtttctgttcctgcataaacatcagaccaagaaacaagctggggaggaaagggtttattcagcttacacttccatactgctgttcatcaccaaaggaagtcaggactggaactcaagcaggtcaggaagtaggagctgatgcagaggccatggagggacattccttactggcttgcttcccctggcttgctcagcttgctttcttacagaacccaagtctaccagcctagagacagcaccaaccacaaggggccctcccacccttgatcaataattgagaaaaatgccttacagttggatctcatgaaggcattttctcacctgaagctcctttctctgtgataactccaggtggtgtcaagttgacacacaaacacattactattaagcctcaacccttactttcttattaatccccatgatcaaaataactttaaaagtcccacagtctttgaaaattcttaaaatttcaatccctttaaaatatccaatctcttttaaaattcaaagtctttttacaattaaaaagtctcttaactgtggtctccactaaaatactttcttccttcaagagggaaaaatatcagggcacagtcacaaacaattaaaagcaaaatcaaactacaacctcaaacgtctgggaccctccaagggcttgggtcacttctctagctctgccctttgtagcacacaacttgtcttctaggctccagatgcctgtactccactgctgctgctgttcttggtagtcatttatggtactggcatctccaaaacactgttgtctttgctgtaactaggcttcaccaatagcctctcataggctctcttcatggtgccaagcctcaaatcctttgcatgaccccttcagtcctgggccatcaactgctactgaggctgcacctttaccagtggccttccatggcctctcacatgccaagcctcagctgctctttatgtcttcaaaaccagtatgactcttaaacataaccaagtccagctgcagctaaggtagaaccttgtctatctctggaacacagcctctttgtgctctcagaaaacacttccctcctatgactaggcaggccttttactcagatctccttgcttatgtctcccaattactaggatttaaggcaagcatcacatggccaggctctcaagcaaatctgaaaaactttacatgtatgatttttagagaatttatcatctgcatatcctctgaatgtgtgtgtaatataaaataaagtaatataaaaactcatacacccaatcagtgattaatttttatttaatgaatttcaatattgcttctggttaagatttaattgtgtctatctttcctcctaattttcccccagaataataaatgatacctttcccaatatatgccaggggtagtgtaacacaccttttatcctagcattctggaggtagaggcagacggataagatcggactacatagcaagtcccaggccagccaagactattgtaggcccttttttctaaacctacgttaatacgtgtactaaaatgctttaaactcctttctagccttccactcatcataaaaggtcaaaggaggatgtggccctgttcagaaacaattctttggtgaatccaatctgctttgtcaggatatcagcagttcagctcacagaatcagcagcagtagtttga

SEQ ID NO: 19763 - DNA, 1503 bp, Mus musculus
tcaagtttgacattgtttcttattttttgacttttttgtttttgttttttgtcaattatgaattcaacttatccttgtaagttttaatattttatgtctttcagaatcctggttttgactttagtggagcagaaatctcagggaactacacgaagggcggaccagatttctcaaaccttgagaaatgactgctattgcttagtgtttctctgtctcgtggatcccggcaggtgctggcaacttaatgcagttgatgaggagaaggatggagcagccagtgtctacagttaaagattgccaagtgtatttcaatatggttgtaaagatcacattcagatatggtttgcacaggaggcagagcagctctaatgtggatagatgataacttttactgctctgcagtaagttttataggctacattttcctaatttcatatttaattgtatttttactacaaaaaacattggagtacaaatcatatgaaatgaaaaaggtgccttcatggaaaaatattttttttgtatgtgtgtgatataaaaataatgttgagtaaatttctgagtaagagttgtataccctttgtctaaatatgcttgtctgttcacggaaaggacagaactggaaattttaagaaaggaaaaaaagtacactgaagtactttggataacttgagttaatgaaaagttctaactggtttggtgctgcctaagtgattatgtcaagaaattgaaaaatgataaacccctaacaacggaagagttaattgcctcttaatgtcagacaacagttgaggcccctgagtataagtcagtggcttcatttcattttaaacattcagacaaggtggtctagaaaaaaagtcttgcatcctctgtgttttttaattcttaaaaaaaaaaaaattgaaatgtgtgaaaagcttatgagtaaaatattaacagattgaaaatcttacacttttttctaataaattgacatgttgtcacctcaatattttactttttcttttcttcaaaaaagtattttctctcaacaatgtaaccattaaagttagaaaatcaacatggacatggtactactgtttaggcctcagacctatgccatctgtgttggcctaatacctacagtgtacttaaaataagaaagtcctgtattcagggtgtgctgctccagcagaggtccggagttcacgtcagcctggaacaagttccctcgttttccttggctttactgcttacatctgttctcatgatagtaccttgctggcatgtggcatctaactcacggtgacattctggccttagttcccagaccctatgattgatagtagtctcctgtgcttggcttagcttttggacttgaaaatgatggaagttttgtctgttgactgttcaggatgaggtctgttgtctacaatattcctgcatccggtaccctgtcatgaattaagaatgtcaccctattgctgatgctgacagcgttgccttggtcagggagtaaga

SEQ ID NO: 19764 - DNA, 3279 bp, Mus musculus
taaggcaaaggtacatattttatatgattaatcctaattacagaaacctatttttgtcattgacatttactttatatttatccttttcagccttctgtgctggcgctatctatccttgcgttggagatccaagcactgaaatacgtagagttaacagaaggagtagaatgtattcagaaacattccaaggtatgccaaggttatagcactggtcctattagcaagctacaagagaaatgtatccactgtacgtgctaaagtagaacaagacgctgtgtattgatctgaagcttacatggttctcccttagttccctttggatgatgtggatattaatgagaatatattactataaatacagtggggcttttttttttaatttatgtacagataagtggccgagatttgaccttctggcaagagcttgtttccaagtgtttaactgaatattcatcaaacaagtgctccaaacctaacggtcagaagttgaaatggattgtgtctggacgcactgcacggcaactgaagcacagttattatagaataactcacctcccaacgattcctgagaccatttgttagttgataaatctggttgttattctctgtatacagaaaattttccagtatgatcattttctgctacaactgaagaattgaaatactatcttcaatataaagaatatgggatgaaaacataaaggaaaagtgaattgttgactggtctagatagagaatactggaaggcattcactgtgtacagtgcgtagcagttttaagagaaaagacatatcaaacccctagatatacgctaatacttttcatcaaaagattagcgtagtagcaaagagaatactttaaactcgaattttaaaagtagttactgaaatagcacttctttaaattacgtaccaccccactgtagcttatttaaagttgcataagcccatgcagaacaacaagcaatgtgacccatatatgaacaaattttaatctgcccatcgactatgaaaatgaagtacaaacctgggtgatggacttacaaagtaatatagggcatgcccatgttaggtttctggaaactgccagagtgtcttaattctatagctagtattttacctctatagcatttggactaatacaaagtaattatatgcatgaaaatataaaattggtctctgatacatacacatttttgacatctaaatttcttaatcatagcaaagatttatctttttatgattaaaaacaattttttccttaatgcatggcagcacatgcctttaatcccagcactagagaggcagagacaggtagatctctgagttcaaagccaggctggtctacacagtgagttccaagacagctagagaccttgtctcaaaaacactcaaaacaaccaaacaccaggggtaaatgttgctgggaagtcagggaagatggtttagaagggaagcctgacaacctgacttcattcttcaggacccacatgatggaaggagagaacgaagaactcccaagttctctcacatatgcacatacctcaccaccccccgcaggaaatacatgatcatgcgtctgagatatcaccagttcacctttagcagctcgcagtttgtaggcagatttctgttaagttgggtctgtgttgtttgcctatgtagcaggattacagcagcagcaaaaacggtccctcaagtctttctgccactctgacctgagtttcctacggtacaggatttactctgagaaacctcagcaccttgccacagtagccttggcagaatggcctcacggttagggaaactcctgattctaagcttgggagagctacgcttagatttgaattcacccaggaagcattcaaatcaaggctaaagacataaatgtgaaataaaactgtgaaccttcattctaaagttcatctgacttcccagatttgatcaatatattcttaggtggtattaaaaatggtaaactgcttaatttaaatctcaaaatttaaattatgaggtttacataaaaaccaacatttcatgaatgcacttttaaggtattaaaaggggtacttaagcggtaaatggtttcttggcacccataaccaagtaatagttaatttacaggtgggatttttttttattgctatgagaattacatttaaaattgtgggtgttttatataaagcagatatcacaagttttgaaaatttgttacctttaatatttcttctagagaataggtgtttgtatccataataaaagaaaaatttgtcagaactgctgcttcaatctaatcccatttgagagaattgtctttactgtcttaataactggatgaattatcactctgaaaatgtatttattgcactaaagttagtttaggcttgataaaacactccagacatttttactacagactgtttctataaaactgccattgcttctaatggagaattttattttaaaagaaataaaattgctgagtttatctgcaaaacctttctctaagtcttatgggacgtaaggagacacctccataattataagagccgttgtgctcagagtctccatgctggcttgaatgtatgatccacactgttaaaacataggcagcagctcagggccctggacagcctgagtcaacctagagtagctggaaccattttgacatgtaatggataagaaaattatccattgagaagctgaacaataaaccaaagaacgggtgtattttatccttaacctctgtaaaccacgttacactgagaacacttcagttcttcctaaaggttgataggcttcagtctgaaaacaatattgatttggagtggacagaagttaactaaccaactaccattatgttttgaatacacctttcaataaaatgattgaaatgcaaccttccttgttttggtttcttttgtggtttaagtattttagcagtattataaaataagctttctttatattgtatattaatcttactaaagtcagatacacagaagcagaaacaaaatctcttagtagtgcagttatcaagctgggaatggtgctacacagttttaattccaactgggaaccagcccggtcctcataggaagctccaggccagccaagcctacatggtgagaccctatctcaaaaaatatagtaaccagcaccagttactttaatttaaaaaacaaaacaaacaaacaaacaaaaacccataggttaagtgtattggttgaatggacctcaaacaatgtattttgtatgcattattgtgaatcaggttttt

SEQ ID NO: 19765 - DNA, 1214 bp, Mus musculus
agaggaggactccatgatcaggaaagtaggatattgaatgggcccaagtcaacagggatggggcagaatcagaatctcaggagtacaatgaatggccagagtggtcagggcctaggaagtatagtgaagtagtgatcatgatatgttaatgaaaatgataatgataacatatattagaggacccattgactattacaggttttcttttcctgcttctatgagggtgctcccacatctccaccaaaatcttttatacctatgttctgcagtctgtcaggttgtaatgctaagtctatccttagttttgtgattccttattatcctcatttttccttgactgtgtaacaacctgaacacattacttttacctacttgtcatttgcatgcaataaacctgcctgctcttcccctgccaggccctaggctcaccccagcagccccctcacttcctcagctggcccagaggaaggacctcacagggtctaggtggcaggggaggaggccctaacccactgcctctgggccctacgtgaatggcagaagccactgtgatgtccgagtaactgtgtcattgtcgtgtgatgctgtgagtgtgtgtgtgtgcagcccccaataaacctgtggtccttcctgaaaaaaaaaaagatggaggatataagggcttaaatacgtatagaatattgagtttaaggttgagggtaagaccttatatttatccctgtaatcacctgtgtcaaatatttatatattcgaaaatcatttattctgcatacactgatgtaatgattatctttaattatcaacttgacacagcctagaatccctagggatgaaactccttgtaactcagtccctggacatgtctgtggggaaatgtattgattgtcctaaagttgtggaaagaataagcctgctgtggatggcaccatttcttaggcatggagtcctgacctgtttgagttgagaattaaacccaagaagaagaagaagcaaacaagcaacaaaataaattattttgtttgcatttatttttctctgctcttgactacatatggggtgtgactagtttatctcaagctactggagtaattgattgtgattgtactgtaaaataaattgcttctcccctgaattgctttgtttcaaagtgtttgaccatagaaatagaaaaaaaattgagctacgttcctgaaatgacttaatgaagaaaacac

SEQ ID NO: 19766 - DNA, 2200 bp, Mus musculus
ctcacagggttggtggagttccttatgttctcttatcagcctacttgagacgactgtcaacagcggttgcagatgttcttaacaactgaagagcgagagagaattctgttaaaagctagaaatatagcccggaagccaacggcggtctacacaactacaaaatgagatcgacatgggattccctttgactcgccccagttgaaactgcaacatggctaaaggtagggagagcttaaaaatctatcgccaggctccgatctccaaggtgcctcaaaacgggcccactaatttggctaaggtaagaggtaatgcaggggccaattgaacctccctcaatgttccttaaaaggcttataaaagccttcaggcggttcactccctttgatcttacccagaagatcagtggccatggcctttcataaggcagtcagctcctgatatcagaaagaaacttcagagattaaaaggtgtattacaaaaaggagacagttatgcgatctagtaaaagaggcagagaaagtgtgtgtaaaaaagaggcgggaggcaaaagaaaaaaaaaacaggagggatcgtagacaagaaagaaatttgccacagtggtaagaaaaaaagaaaagaacggatctagacaggaaacctgggcaactgaagacggagcctcagctaaagaggctcagctgtgtcagactgaagtgacttatttgggatacacccttcgaggtgaaaagcagtggctaaaagaagccagaaaaagactgtaactcagatccccaacccaactacaccaaggcaagtaagagaattcttgagtactgctggccttctacagactctagatacctgggttggcgaccttagctgcccagttgtaccccctaaccaaagaaggggaggtgtctgtgtggaccccagatcaccagaaagcctttaaagagattaaaaaggccctactgatggccagcctatgcctgacctaaccaagcctttcactctttatgtgaaagagagagcaggggtcaccagaggagtccttactcagactttgggactttgaaaaaggccagtgacttacctatccaagaagttacaccctgttgccagtgggtggttttcttgcctgaaagctattgctgccataatctgcttgtcaaggatgctgataagctcactctgggacagcaaatatctgtagtgacatcccacattcttgaaagcattaccaacgctcctgtgacacatcagagctttttgttgtctaaatgagtgaccttcacttcattctacctgctgtcccactgtgtgagactgcacctactcatcattgcgctgacattctggcagaagaaatgatctgaattatcagatcagccttggcctgagggtacgagctggtacactgatgacagtagcctcgaggttaaaggtaagcaaaaggcggggacagcagtatggtggtgaacagaaagcaagtgatctaggccagcagccttcctgagggacgtcggcccagaaagctgaacttgcgactttaagacaagctctataaatggcaaaaaaaaagtctacactgacaacaggtatgcttttgccactgtacgggacaatatacaaagagggctgttgacatctgcagaaaaagacctaagatgctgtggctaaaaaaaaatcagatggcagatctaaccgtcaagcaggtggctcaaagaacaatgatcctggcagtcaagaagtctaaagattattatgacatcagagagaccagctttagatacaccgctgaacactatcaagctatagacagtatttggcttggcctgggggccaagaaattcaaaggtgtggttaggtcctgtgactactatgttacaggactctctgacttggcagaaaaaatagtcaaaagcttcaaggcctgtgctataatgaggtagaatttctaaaagaaatcttcccaaggtaatagacctgcctttgttgcccaggtaaatcagagactggccaagatattagagattggttaaaagttacattgtgcatgcaggccccaaagctcaggacaggtaaaaaaaattaatagaaccattaagggatccttaccaaattgacagcggagactggcgctatgattagatagctctcctaccctttatgctcttcagggataaaaacacccctggacagtttagactgacccccctat

SEQ ID NO: 19767 - DNA, 1972 bp, Mus musculus
gtgtaaagaaagcatctccaataaatggtgctggcctggctggtggtctgtatgtggaataatgaaaatacatacacatttatcaccttccacaaagctcaagtcatagaaaaaggacctcaacataaaacaagatacactggatctatgggaaaaagcctcaaactcgttggcacaggggtaaattttctaaacagaacaccaatgagtcaggctctaagattaacaattggtgattgggacctcatgaaagtgagaagaagcttctagaaggcaaaaggcatcatcaataggacaaatgcacaacctataagctgcaaaaaaaaaaaaaaaaaaaaaaaaaaaaaaaaaagccctcactcgccacagacggcctgcctcgccttgtgctctcctgccgccgccccgcagaaatgcttcgactacccacagtccttcgccagatgagaccagtgtcccgggcactggctcctcatctcactcgggcctatgccaaagatgtaaaatttggtgcggatgctcgagccttaatgcttcaagctgtagaccttttagccgatgctgtagctgttacaatggggccaaagggaagaactgtgattattgaacagagttggggaagtcccaaagtaacaaaagatggtgtcactgttgcaaagtcaattgatttaaaggataaatacaaaaatattggagctaaacttgttcaggatgttgccaataacacaaacgaagaggctggggatggcaccaccacttccactgttctggcacgatctattgccaaggagggctttgagaagatcagcaaaggggctaatccagtggaaatccggagaggtgtgatgttggctgtggatgctgtaattgctgaacttaagaaacagtctaaacctgtgacaacccctgaagaaattgctcaggttgctacaatttctgcaaatggagacaaagacattgggaacatcatttctgatgcaatgaaaaaggttggaagaaagggtgtcatcacagtgaaggatggaaaaaccctgaatgatgagctagaaattattgaaggcatgaagtttgatagaggatatatttccccgtattttattaacacatcaaaaggtcaaaagtgtgaattccaagatgcctatgtcttgttgagtgaaaagaaaatttccagtgttcagtccattgtccctactcttgaaattgctaatgctcatcggaagccattggtcataatcgccgaagacgttgacggagaagctctaagcacgatggttttgaacaggctaaaagttggtcttcaggttgtggcagtcaaagctccaggatttggggacaataggaagaaccagcttaaagatatggctattgctactggtggtgcggtgtttggagaagaggggttgaatctaaatcttgaagatgttcaagctcatgacttaggaaaagttggggaggtcattgtcaccaaagatgatgccatgcttttgaaaggaaaaggtgacaaagctcacattgaaaaacgtattcaagaaatcactgagcagctagacatcacaactagtgaatatgaaaaggaaaagctgaatgagcgacttgctaaactttcagatggagtagctgtgttgaaggttggaggaacaagtgatgttgaagtgaatgaaaaaaaagacagagttactgacgctctcaatgctacaagagcagctgttgaagaaggcattgttctaggagggggctgcgctctgcttcggtgcatcccagccttggattcattaaagcctgctaatgaagaccagaaaataggtatagaaattattaaaagagcacttaaaattcctgcaatgacgattgctaagaatgcaggtgttgaaggatctttgatagttgagaaaattctgcagagttcctcagaagttggttatgacgccaggcttggagattttgtgaacatggtggaaaaagggatcattga

SEQ ID NO: 19768 - DNA, 1147 bp, Mus musculus
aggggtgtgtgctttgggcttcccaaaaggttacctgtcagttgttaaaagaggaagagcctagagttaatgaacccttttttaactgttattaagaactgctggaaatagtttctcggaggatcactctttaataaggaggtaccttttgctaattttacttatagcttaaagaaatattggagacgggataggtcccctgtcttttgaacatttactacccaagtggtgggtttacaaaggaatgttcgcatgactttttctttggcagtgatagagattgagtctcaaaagatttccgagacgatgtttacagttaaatttgttttgactagaaggttgagttcacctacaaacctctgtcttatccagtatattttcaccttttgatttaaaatgttctgggcactgctttaaacaggtaaagaaggtaatctgctttcagtctagagttaacctttttattctcttcttttgcagataggaagtgcagagactcccattcatggctctccattctgtttcctgcaacagcacacacactctggtgtctcacctgtttggaaatggctctgtgtgtttgatgtgtttatgtatttctcttctcttcttttttctctgtactggagattgagcctagagcctctgcatgctaggcaagcatcctgccatctagctacacacccccagcttcctccagagtttctttgacttttgagacatggtgtgggttagttaagttgtccatgcttgccttgagcttgcaatcctcttgcctcagcctctcccaagtactgatatgataagcattcccatcatatccatatcccggcttatgctttactctcaaattccttgacctcctgtaaagttacaggaatttgttcctacctggaaacagctacttaaaatttgcattggaatatggcagggggtggggtggggagtgttatgttggacaactcttcagttgctcagtgtactttgttagtcttcagagtccttgcttttacttattcatttatttgttgactgtctttgggttagtgctttcattagtagctttcattttcataattagaaagctgaatatagattgctttctactcatgtttttaatagcaagagagacactctaatgtgtatg

SEQ ID NO: 19769 - DNA, 1845 bp, Mus musculus
gtattatgtatgaccagaggaaaatgatgacgtctaatatatgggtgcatttactggaaaatgtgcatggttcagtgagtttaataccacatggcatctcatattaatctgtctgataacagatccattttaaataaagccactctggtattgcctagagtaaccatttatttcggttatttctagtttctctctaaatgtagaatcaaaagaagtggagaattttgttactttggagacagcagtagtttattttagattcgtgtatagatgcgtatgaagttgtttacgtttaagaagttgagttacagatatcaactcactagctttcttttgttcttccatttccttcaaaggtttgggccccatgggatccctgtgacagtatttcccaaaagggaatataaggacaaaccggacgccatgcagctccaaagtaccacattccaagaagggatagaagtcaagcaggaagtgaacggtgctgttcccgatgacctctctccagtccctcctcctgagcgcctgtgggcttccaagccacctcctctcttccatgaaggagcaccttaccctccccccttgtttatcagggacacatataaccaatcaatacctcagccgccgcctcggaaaattaagcgacccaaacgaaaaatgtacagggaagaacccacttcaataatgaatgcgattaagctacggcccaggcaagtcctgtgtgataagtgtaaaaacagtgttgttgctgaaaagaaggaaattaggaaaggtagcagtgactcttctaggtatgaagataaaaaacggagaaatgacagtgtagctactgtgaacaaaaaactgaaaactgaccataaagtggatgggaaaaaccaaaacgaaagccagagaaggaacactgtggtgagggtttccagtatcgctcacagcaggggcagagtagtcaaggtttctgctcaggcaaatacatcaaaagctcagttaaataccaagaaagtgctccaaagcaagaacatggatcacgcaaaagctcgggaagtattgaaaattgccaaagaaaaggcacagaagaagcaaagtgaaacctccacttccaaaaccgcccatgcgaaagtccacttcacacgtcggtatcagagtcccagctcaggttctctcccaccccgagtgcggttaaaaccacaaaggtacaggaacgaagaaaatgactcttctctgaagacgggactggagaaaattcggagtggcaagctggcgcctaagccgcagtctcgatgcacctccacccgctcagcaggtgaggccccttcagaaaaaccgagtccctcagaaggcccggaagagtccgccggtgaggttcaggacacaagcagagtgcgtgtgcctggtgagcaggaggaactgcggatgttgggcaaaaagggcagcaaaagcagtatctctgtttacctgaccctaaatcaggagacatctgactcttccagtgcctcagtgtgtagcattgatagcatggatgatttgaaatcctccaactctgagtgtagctcttctgagagcttcgtttttcctcccggctgtatgcacgcaccttctgcctcttccacttctacttccttctcttcaaaggaagagaatagcctccgtaattctttgaaaatgaaaatcttttcaaaaaatgtctctaaatgtatcacaccagatggcaggaccatatgtgtaggggacattgtttgggccaagatatatggcttcccttggtggccagcccgtattcttaccatcactgtaagccggaaagataacggccttttagcccggcaggaggcccgtatctcatggttt

SEQ ID NO: 19770 - DNA, 1873 bp, Mus musculus
tagtttggacaggcctaccaggcatgggatggtgcagagacgaggaattgtttgcatacctaacctttgtgctttctccaaggatgatgtttagcagttcagaagtgagcagaggtgtgtttaaaatggcgctccagtgacacagcagtggccacatgtgctaaggccagtgcttccttcagggtgccagtagacacaagaggaaggtgatctgacatcctgctgagaggatggctaagtgccccgcccacccacaagtacaatgtggatcttttaataaaacagggctgtattatcttgaatatatgtttgcttgttagaacatattaagatgtatttatttgccactagtatttaacattttgtgcacattttcataactacattcgtaccttttcatattttgactcccaagtggataggctagtgttgaacttggaatgaaatcatatactcccaagaactagctcatgattctgagctggacaggcttttattattgcctctccctgactgagtggtgctgttcagaaaaggtgacagcatcattgttgatctgggcctctttccacggccaggagcccctccttctcagtgcaggagattctcacagggttagggagcacttggccctggggaacagtggcaaaaccatccaggaaaacagcctaaacttttggtgcatggaacatgaattcttaacagagatttcagatttccttgtctttgctaaatacatagtatgaaaccccttaatttttcttgtttaatgaatggagaacacatgagaaaatcagatggacctgttagtactacatttttaaagcattttatatttgatggtgccgtaattttaataataaaactgaagatttttagtggcgatactgatttattttttaaaccagaaagataacatcatattgattacttactacaaaaagaaaaaaaaaaaaaaagaaaaagaaaaaaagccaaaagaaaaaagaactaactcactgtactcattcaaagtgacacaagtgacaaatgagcgcttagctcaagaggtcactccctgtgatctttctgtgtgggtgagagtacccaacagcccattgctcaggattaggaaatgctctgggtgagacttttagatcatttactatacctgactgtgatttgatttataactcaagaagaaaagccgggtagtctggagtctagtgagcttaattcagatcctaacactgcacgtgctgggaagtcctgattgcattttacagtgatctctttggagacttcacatcatggcgtcatcgtatcagctgggctcaggaactgtaacagcagggagctgtggagaagatgaatcacagctccaggctctggggtcactctcgtcttagacccccacaccagcagtacctctcacgctcactcaggaaccaggtatctcccaagccatgtggaatcatgcatggatcgtatcaggaagacctctaagctttagaaatttttatttgtagagtgatggaattgaccaaaaaattaaaaaggcaaaagcactgggagagatcaggttgtaagaatctacattttttttttttcctcatggcaaatccttaagggccttttattacaaattagattttcattaaaaaaataaaggatacttggtggtatttaagatctaggcctaccatgttacaacttcatttttattgctttagttgcttaatatttaagctctgcttcatgctaccttttgtctgtattaaaatcttcacaggcctatttcatttgtagacttgaattgtttctcaccttccatctgctcagagttaaatgttaaagaatgttgtgtaacgttatccaataaagtctttgtttt

SEQ ID NO: 19771 - DNA, 1205 bp, Mus musculus
actaaaatgctaaagctaagtctgccataccatatgaggttgatgcctttgggatacaaattttagagtgtagttgaaacttaaagcaataaatgtaatggggtagtacatattttcagatatagttccttttgcacttaaatttcatactttttggttgacatgtacttactataatgagatacactctgaattctaaggagatttggtagtggccttgggtataaaacagatcttacacattttaatattggcttgaagttgaatctagaaatctcatgttacaggactgaaattgaattgatttttataaatgatagaaatgtaatttttttctggttataagattgcagtcctcattgtagataaattttatggaaattcagaaaggttaaggtagtgacagttacctgccctgttagtgtcctgaggtgtcacccagctttttcccgtgtctttgtgttcctttgcttctgcggatacctgtgctgtcccttgcttctggcccctcggctgggggagcatcctccccctgtttggtagctgacctctcacccccgggctgtgtctaaggactcagtcctcttctgcggtctgcactgttcctccctgggtgagtgcggtggtacctggagggattgcatgcacttaccttctgcccttcttaccgccgcagatgtcaaggcatgcagtctggaacttgaaacggtcccagatttcttagaatcctgtgtttccatcaaccttggttcctcaagtagagaccttggttactctgtgtcctgcatcatgtccccgggtcagtgagtggaaaccagcttccagttatgttgcttggcagagagagcaacatggcctcacccagcagtaccagatggtatctggtggttcgtaatcagagtggacatacttcgatactcattgtaaatgataaaatactgaacaaaggattttaataaatcaaagtcccatccatgaaagatactctgtttcagaccagggctctggggctagcgtctcagtgtgcacatgggtgactagacacctcagagccatgtagtgcgtgcgtttgtaggtggaaggctgggtggctgggtgatagatacatttaactctccggtttcataactcactgcttcacagttggcgtgcgccagaaagacaagacttagtgtcctcacctcaagagccggtgatggcaatct

SEQ ID NO: 19772 - DNA, 1167 bp, Mus musculus
tactgccctcgaattatttgtgacatgtcacatttaacaaacactgatgtttgaacacactgtattttaagatacaaatgttgatgtttgtacttcaaaaatagtgacacattaaaattgcaggtcacgtaatactttccaatatttataatgtccccttaataaccaaatttaacaatgcttttacattttgtttctcgtggcttcacacaaggtttacacagccctttacagtctccagttcagttcagtgtctcttagtgcttttgcagagctgtgtaaactatggtcacactagatattagagttttctagtccctcctaagacagtgcttcccaactttcctcatgctgtgaccctttaatatagttcctcatgctgtgatgaccccaaccataaaattattttgttaccactttacaactagttttgctactgttataaattctaatagaaatatatgatatataggctatttgatatgcaacccctgtgaaagggtcatttaacccctgaaggggttgtgacccaaaggttgagaaccactgccctaagagatcttcatcctcatttcccttaagtcccttgaccattcccaggctgccatctgctcccctgctccccgcaatgtagttgtctatgtgagcagagaccaaggcactgggtatccagatctaacactctgccttgagtcgctgaacccattgctcagctaggctggccggctggtgagctggaaacggcttgtctccacccctgcgttgctaggattgcaagacatgcacagccatgtctacatttttatgtgggtgttggagattccagttttgatcctcaggctttcgtggcaagtgatctcatctccctagccgttgttttgtctgtttttgattaatttatcttgaactgtacaagcgtggcctttggtgccgaggtttaagacattggttgatactgaagtattttggctgcttttcctgattcttacccatccctctttcccgcctccctttttttttttgtttgtttgttctgtttttaaagcaatgatgtgcatgcaacctagtgagctgtagccccagtactttttctgtccagtaatgcccactgggtagctttggtgcagtttgttccctgctatgcacccatgcatgggcactgaggta

SEQ ID NO: 19773 - DNA, 1183 bp, Mus musculus
catcacaaatgtgattaaaaactgtagagggttatttattttctgaatcagcctttgggagtaagtattccaagttcatcatgcaaatatgtaattataactagatgaaatgaaaatctgatttaaagtatcgctcaagtctttagacttattcaaaagctgtgataacatccttaatttttttaaaaacatttttgggatgtgtgtgagagtgaggaggggggagagagagagagagagagagagagagagggagagagagagagagagagagagagagaaggagagacactgatgttagaggacactgacactgttttgggagttctcttattccactatggcttggggctctaacataggtcctcaggcttgacaacaagtcaggccccagagcatcctcctcttcctccttgtccctgtcttcctcctcctcctcctcaccatcatcatcaccaccaccatcatcatcttgtccagatgctcagggttaatgctgtctgttccccttccaggtcagttagtggtgtgcaccttgtgctcctgcgttatgaagacgaagcagatctggctcttctcggcacacatgcttcctctgctggctcgcctctgcctcgttcctctggagaccatcgtcatcatcaacaaatttgctatgatttttacaggattggaagtcctgtacttcctagggtctaatctcctagtaccgtataacctcgctaagtctgcataccgggagttagttcaggtaagcgtgctgggcacacgcggctcagtacattcccctgtccacctgtggctgtggggacgctctctccagctcctgttctcatcaggggaggcagtgaaggagcgaatctgcagatgcagagcacttgggttcatgcccctaggctgaacctatgtgactttgacataatcacatctctctactttctatgaaaggaagctgattgtaccacagcactgtgctctcctgctcagggtaactatgagatccagataagctttgggtcaggcaggcgatgtgcgctatgtcttaactattattgtaaagacaacaataagaaaatacctgacgacaatcattgatttctcttctgactctacttctactgtgtcagcagtgtcttccctttgtttacctagcctgtttaacctaggaagctaaacaggttgg

SEQ ID NO: 19774 - DNA, 1181 bp, Mus musculus
ccttgtagaggtgaagtgttttgagagacaaggactggacggatgaggaatgaggaaggtcgggtgggcctgaggagactgaacactgcttctgaaggtgcagcgtctgctctctcagtaactggtcactgtcacccacacacagccttcagtgggtaccaagagttcatgtgttattattttaaactcagggagaatgcttttcttatgatcacatttatcttaatatacatactcttccctccccaggttctgggaacactttttatttacgtcttatttatggttgaggaattccgcaaagagcccgtggaaaacatggatgacgtcatctactacgtgaatggcacttatcgtctgctggagtttgttgtggccctctgtgtggtggcctacggcgtctcagagaccatctttggagagtggactgtgatgggctccatgatcatcttcatccattcctactacaacgtgtggcttcgtgcccagctgggctggaagagtttccttctgcgcagggacgctgtgaataagattaagtctctccctgtcgcgacgcaggagcagctggagaaacacaacgacatctgcgccatctgttaccaggtgacctgctcagggggagtctgctgataggtcaggcggggtagacctcggggccgcagcatgcaccagtcacagtgtaaatttccgggcacaattaatctctggattggaaagggataatggggctcatagattagagtaataaagccctgatataaacatatccattttagttctaagttcagttttaatatagtctttcaagttctaattattattgtttccaacattattgctcacccataaataaaggaaaaacaggttaggtgtattttatattattactgactacacacacagacacagtgttcatgtgtatgtgtgattaaatatatcctagcaaccaggagtcagcaacttcagaaaagtgctgtgccaagattttgactcttcttaatatcttctgggtggggaagaagcatccagacttcatggtgggtgacagaatgctgctctctatcagagactttcagtcctgtggggttcggaaagtggtggtagaagcaggcggaagggtcctattgagggtagacagactgcctgccatccatacagctctggccccagaccgagat

SEQ ID NO: 19775 - DNA, 1674 bp, Mus musculus
agggactgggacccaggaaggttctggggacagtagtgaacacatcaacagaggctcggctagccaggagggggctgctgatgctggagagggtcctcagattccagaaggcgaagtgtgtcctgttgagtctgcctagaggagaagcaggcttggagctctggactgtggagaaggccacccaaggtggagttcacactcagatctgaggagtggatgtaggagaggactaggcaggaacctgacattccgaggatctgctccaggctactcagtggacacacccgctctccaccccacttcatgctgttggagaaattttgcaatgtacactaatcaaaatgtatttatatgttctatgctgatgttttgtagaggtttgccaagaaaacttaacctcagcaacttcaggaatggcccctgatttgcgagggataatgaaatcaggtctgagtgcttgaaaggggctaagaggacgcagatctggaggtcagagtgggaagatgaaggcagaggtggacctggctttccccttcccgtgggacggggtggctctgattggatagtgtgggtaatggccactcccctttccttcagttaattaaaaccaccaaatgatcctggagttttctacagaaccgcaatgaaatcaaagatgtagacgggactcattgactttcctccgagatggaggagcacggtacgtcaggatgtgcctggggaaggggcgggcgtgcactaggccttgcgggtgctctcgtgtcgcctgagactcttaaacctgatgctggagtcctcattattttgatgtatatggaacttttgttaatatattgtatactttgttggctgtgtgaagtaaactaaaactctagtgaacactttggagtccactttaacaaaggagccaaagtgggaggggctttagggaactgataaaggccctgggtgtactgtccaatcctgtgtaatgtttaattcttgcaactgaatcaaaagcagtgttaaattatggcagtgtttgcactctgggaatgagtactggactgtatgaccccactctgcaaacaccacttttgaagctgttaatacactttgcaccctttctttgacaaggatgtgtcatatttaaatttttacattcatcatggctacaggtagaactggggaggggggatgtaatttttttatgggtttttgatatgaaaagaaactagtcatttatttatacaataagcttggctcaaaaaaaagtgtatttcagacttggtattcctactgtggggtgtggttttcctttgtttttagtagcaaatttggatgtagactgacagacatagctgaatgtcttaataaatttaaatttgaagataaccgttgtattcctgtgatgtgtttacgctatgggtgttgtgttgggattggattctcttctgtgcagtttctgttctgaactcccaggacctcacgtgttcccattccacacatgctctacagatggcagaatttgtgagaaggccagaatttgtttgtttgtttgagacatggctttgctgttgtgtgtccttggatggcctagaactctatatggagagcatccgctcagatgagatagatctgcctgcctctgcctctctgcctctctgcctctctgcctctctgcctctctgcctc

SEQ ID NO: 19776 - DNA, 1363 bp, Mus musculus
ttcaaccttcttaatgctgagaccctttaatacagttacttatgttgtggtgacctccagccataaaattattctcattgctacttcgcaagtgtaatttttctatagttatgaatcataatgcaaacatttgttttccaatgttcttcagggacccctgtgacaggatagttcaaccccaaaggtgccaagacccacaggctgaaaaatcactgttttatatataataatagagtataaacagagtctaatatgaaaattctagagagcagcgccttggaggtcccgtggatctgtgtcttgcttcaacagtgtttgaacggaacagacccggggattcccactgtactcgcttccagccgcctttacaagtctctccagtcgcagcctccgggaccatctcctcgctgccttcggctcctaggaccagtctgcaccgtctcttcgcggttagctcctactccggatcagccatgacctctcagattcatcagaattattccaccgaggtggaagctgccctgaaccgcctggtcaacttgcaccttcgggcctcctacacctacctctctctgggcttcttttttgatcgggatgacgtggctctggagggcataggccacttcttctgcgaattggccgaggagaagcgccagggcctggaaactcctggagtttcagaacgatcgcggggggccgtgcactcttccaggatgtgcagaagccatctcaagatgaatgggggtaaaacccaggaggcatggaagctgccttggccctggagaagaacctgaatcaggccctcttggatctgcatgccctgggttctgcccgcgcggaccctcatctctgtgacttcctggaaagccacttcctggataaggaggtgaaactcatcaagaagatgggcaaccatctgaccaacctccgcagggtggcagggccacaaccagcgcagactggcgcgccccagggatctctgggcgagtatctctttgagcgcctcactctcaagcatgactaggaggcctctgtgccttccaaggggctcccccctctgctctgcaccagcccgccctgggacctccacctgaatgaacctctcaagccactaggcagctttgtaaccgccctggagcctctgtcaagtcttggaccaagtaaaaataaagctttttgagacagcaaaaaaaaaaaaaaattctaaaattattttagtggctatactaaaattattctaaatttcattatctaatcaattcttttctgttgtccaactagaccacattcaatgattttagctgtactcattgtccctgaacttgaacagatatgcttattttctgcttttaatctccacact

SEQ ID NO: 19777 - DNA, 1168 bp, Mus musculus
gtcgggttcgccttaaaagcccttacctgcctgtaccttacctgcctgtaccttacctgcctgtaccttacctgcctgtagcttacctgcctgtagcttacagtacgcattttactttcagttcacaagcacttgtgtgtgttcactaatgtgtccactgaagctacttagctatttttattttaagcattgcttactagtcatgctcttagtttttacaatgtgactccacagttgtgtgtgtgtgtgtgtgtgtgcgcgcgcatgagtacatgtgttcctatattatttttcatactcctttatgatatttaataattcctttaagaagaaaaaaatggttaaaaaatgataagttagttgctaaaatgcttagtatttaggaagccatatttgaaattttgtgtaataaaagctgaaaataagtgccagtaccaaggatctagctgtgaaaaatacaataataaagcctctggaaggttttagaagttcactgtgctgcctgtattgatgtgtactgctttcttttaggggtgggaatgggtaggacagtctcctatagtctaggatgcattttaaagcaaatttcagatacagtatcgtgttatctgttctgtaaatgaatttgttctaaaaggagcatggacacaacacaaaagaagttatcttattatttgtgtgcctggtttttaaattttatgtgtgtgggtagggcttgtgtgtgttagtatagcatgaagaccagaagaggatgttggatcccaggagctggaattacagtcagttgtgagcctttctatgtaggtgctggagatagaatcctggtcctctgcaagagcagcaggcacctttaaccactgaaccccacttctccagccctatataatttgtttctaatgttttgattagtagataatttcttctccagatatgccactcttcccttaaaaaaaattctctttctgcttgtttgttattgaagggcctaggttatttgaatttctctcagtctgaattctactgccatcatggtatgtgaatgtccttgtcccctgtatcacctaaaaaatgacaactgtgtctagtcaactgatagattcaagctccagtttgaggaagcaaaactgcttcctagattggaagtatattcttaagacttctggtattt

SEQ ID NO: 19778 - DNA, 1204 bp, Mus musculus
ccacacccccttcttaccttgctttgtggtttgggttttgggagcacatcctgttgtgctggagcctgggctgtcctagagcttgcactctctcctccatctcctgagcatgggcattacagcatagaccacaataccttgctttacttcctatttaagatattgttgttggcttatacttctctaaaatgaagaaccattaagataagaataaaatagtcattgaactcattggatgactttagaaaactggaaagtttttcattagtcttgtgtctgtggagtgtcttttgtattactcctgtagcagtgttcaggggctgtgacatcatcatgaagaaaagctgttgaatctgcattcttgacagtgactgccatggactgcaccatgctgcacttgtgtggccctgtgggagatgtgttttcccttaaggagaccgtccgtattagaaggaagggcactggagccttccgaatggaatgtcctcacttgtttgtctttgttgttgacacagatgagcggtacgatcctgagcccaagtccaaatgggacgaagagtgggataagaacaagagcgcgtttccgttcagtgacaagctgggcgagctgagcgacaagatcgggagcacgatcgacgacaccatcagcaagttccggaggaaagaccgggaggactctccggaaaggtgcaggtgggccgcctctccaccgcttgcctgagggctgcggcctttacacagctgtgtgctttggtttaaattttaggtattgctgttatctgaagtttagactttttaaaaaaaaaaacacattttgttagaggaatctaaatgacacagaaaatctgatcataaagtacagaaggcgctacacaccttttccctttctcacggtttcaagataattgtgttattttgataacatttcttaactgaaaaaccagtattgatactctgttatctacagtttatgctggaggttaccatgtcaaaggctctgtgcagtttagtgaacatgcagtattctccactaacaaatgccacctccttgacaatgccttgtgtaaaaaaagaaaaaaagtggaatcatttatgaagttgccagtcacctggtttcatggtactcggtcagctctaggtgctgtcagtggtgactcttcttccaacctgtctgcaccgtctgtctgtccgtctgtctctctct

SEQ ID NO: 19779 - DNA, 1751 bp, Mus musculus
acatgcttcctgtccggcctcaaactaaccctctcctggggggacccatgcctatgaacatgcccggtgtaatgacgggcaccatgggaatggcccctctggggaacagcgcagggatgagccagggcatggtgggcatgaacatgaacatggggatgtcggcctcggggatgggcttgtcgggcaccatgggaatgggcatgcccagcatggccatgccttctggaactgtgcaacccaagcaagatgcctttgcaaactttgccaactttagcaaataaaaggttgtaacggagcgagtggaagaagactctgtaactgcaataggtgatgttgggatggaagatgctaagcagttcccttttcttttatcagttaattaaataacccacataaagaaccaaaaaggctggtgtttcagaagcgatgcaagagcacttcagatgaggcagtcaggatcggtttccccagtgaagatacgctccaaatggggtgagggtcacgagagcctctctgggtcagagagcccatgtcacagcgtagtctgtgggaggactggcacggatggggctgagtgtgtgtgcttcactctctaactttatacttctttctccctgaggaacttgatttttctgtccctcaatcgccttgtcatgattgggtctgttcctttactaccactctcaagtccatagatgaaatcattaaagttggatgatcagttttttataaaaatatatatttttgtccaaaaaaaaggcatacatatgtgattatggctaaatcagaggtaactggatgtgtgtgcttttgccaagactccagcagtgctgctaactaccatctgagtttccatggatttgacccctcttccgcaggcagctggcagtagctgtgagacttcgcccgtgtctcctgcagttaccctgtgcagaactgggaagcctttcttgggactgctcggcggtttcctttaacagtcggagaaggaagactcgtgtgttgtctgtctgtagcggttgttcactgcctttgcagtgactgacttggcaaagctgtttcctgtgcgtagccttgtagccatcattcaagtcagaaacagtcaaaagagaaaaatatttatttttatcttttttggtgtcttttcaaaaaattgaaaggtaaaactacattaaaaccttaagttaaatgtacatgttaggactcagcaatttcacatttagattttatactgtattcattttgtttgcgttttgagtgtgtaataccgcattagcaatatggttccaatagaagttcgatatatattattaaaggagacctgtagcagtcagagattttattgatttaatgacaaataaaggaaattaattaattttttttcctgctgtgatactgcattaagctcacatgaaaatcatgatgctagagtttggaatgcaaaattaaatgtttcaacctcaagctgggaatattttttaaaataaatactataagtatcaaattattacctcccctactttatgttgaaattttttttattgaattgatacaactttgtttccattgtattcatgatgttctgttctatataacattaaaacattcattaaaaccaacgtgggcccgcctcttttctcatccactagacacgaggccattgggggaaaaataattataatttgggcaaagtaatttttataaataatttaaaattatttaatgacttctctattctctcctatcaggct

SEQ ID NO: 19780 - DNA, 1145 bp, Mus musculus
gcaggccctcactgacgtggatgagacctaccgtaaacctgtcttaggaaaagcatacgaacgggattcttcgctgactctcactagggtaggcagctccccctgacttcctgtgtacccatcctgccttgtagcatagaagccacgatcataagcccactgccttcatcagagtctgagcccctctctcacgctcccagcgtatcccaaaagcgcctgcttcttgcccacgtacaggagccacaggttgcctcttcgaaggctttaatgcctttcagctccgtaacacagagataagggtaccttttatcttgccatcgttatctgaattatgtccagaagttagaaagtgactgctaccttttaaaaaatgtcagtgcaaggcatttacaagatgtccctaaggaatctgacctcgtcctgtgatgacagagttacactgtaggcattaccatggctgatagtggtcactgctttccttgtagctatttgatcggctgaaacttcaagattcctccaaaaaggaagcggattccaaatctgcagttgaggactccaccctgtctcgatactcccaaacatctacttggaaggtggcttcggtatggggacgaggggacactgaccggagctcacacaggcgctcccgctccgtcccttcttccctgcaggcatctgcaagggaggagtccaggtctgagctgtcagggaggactacacggacagaagggtccagtgtgggaggtaccttctccagggccaccaccctttcacggggccagtcccgtaagaaaaagcgaaagcccaaggtggattaccagcaggtattcactcggcacataaatcagattttcattcgaggcgagaatgtcctgctggtccatctggcccagtgagcagctcagcccacgtgacctttgggttgtagaaataaagtgcatgaactgttctctgctatatcctagtctcccacacagtgcgagtcggagtgagtcccgctggtcctgcccatgcagggcacagagctggctcaccctctggaaggacaggtcagcaggactaaccaggcagaagccattcacaggacaggctctgacgggctgtcactggctgctcgagtctccagcgtaagcgcttcactttga

SEQ ID NO: 19781 - DNA, 1152 bp, Mus musculus
tggaagaacagccaatgctcttagcctgtaaggcatagctacagcctccagaaaataggtttttacccgtataaacctattctattctgttaaatttattgtatacacatgagtgtcatgaaaactattctgctcagtctcaggacagcattataatgttatttactataatatctaacatatacaagctacagacctttggactgctgcacagttgttaggagacagtcagtcccttgtcacccaggcatcccgtctggtggacatagtcctaagctcatagaagtaacttagagttgacgaacacaccagcgccccctcctgagcttcaaacttctcatctgtaaaatgagatttttgttcaagttgggcttcaagagccttcctgtgttacctatttaaaggacgctgtctgcgtggcaatgcgaagttcctgcttcaggagagcccctccccccaaaagagtctacagcaggatgcaaagaaacggtctccaaccatgtccttgaagttggggtgaactgttagcttaggtctcaccagttgaggcggcagaaagaagagaagggaggattacaggatggaaattacaggctcctagtcacagcctgtaatttggtggcatacatccataatattttttcctctgtgactcgcccccctgttctgaggactgccattaacctaggggccgtgtctgacaagccttatgtgctgttcaattagagacacttttcttgtgctgaagtcatcttaggagacagactcctgggggctgtggactctagttctcttgccccgcggcaaccttttctaagagaaactccactaacttgttcaagctgattctaagacagagctgaaccagggggcaaaaatcactgtattacaaggtcaccttcaacagcaatgaggaccggggatggagctcagtccgagtacttggctagcatgcgtgagcgaggccctggattcaattccctccctgcaggatataacttagccctggtggtgcacgcctgcaatcccagcactgagaggtggaggagggagggtcagctgctcaaggccatcctcgaatacactctgaggttgagcacaactgggctatatgagaccctgtctcaaaaacaaccaggatgtcaccaacca

SEQ ID NO: 19782 - DNA, 1102 bp, Mus musculus
aagggcttctcctcccattgatgtcccacaagccatccgctgctacacatgcagctggagccatgggtccttccatgtgtactctttggttggtgggaaacctgtcttaatgtacctctcaccctttacctacctcagcttcctcactgaaaagacagaaatgactgttctgtttctcaactgcctttttcatttttaagaaaaacataacggtgtggcctattcatcatctcatggttcagggtgaaagaattctaagttggtgtactgatgaatgtcctggtgaggcagagggcgtgtgtagggttttcatccaagtgaactaagcctcttgagtggcaggcaggacagcaagctgtcggtgtgcttcagctccgctaacgcctccttcttctctgtcaggcaccctttccccaaagtgttcagttggtgtaacaggaaggagctggacaggtatctgcagacaggaggagggatgtgtctctccaacatgccggacactaggacgctgtatggaggccggaggtgtggcaacgggtacctggaagacggtgaagaatgtgactgtggagaagaggaggtaagtgtcaggaccttactagagagagggacgaatctgtattgtcttcagagcttaaggacatttgaaagcacaatgtgacagataagttcctatcaaaaggacaatgcggtccttcctatggaaaggacaaagggacagatttttcccagttgccagcacttcttacacatgactaccgaaggccctctgtgtgtcagaggcagacagtgagtctgccaggtggaccgtttcgatggcctctgcagctgtggtcaggacagtcctatccaggatcagggtggagcccctttgagcagctgctctagccacagaccatgatcccagggcacgtagctctctctcctcctccccagaggagccccagatggcgtctttggccctccagctgcactgaatttatttctggaggccacacagctggatgagctcatgaccatgagcctggtgaggagccctaacccaagctcgtgctgtccagcccggagaagagaagatttgaagggagtgttggaagtactg

SEQ ID NO: 19783 - DNA, 3324 bp, Mus musculus
tagacagcaggggggtggggtggtcaacctgtgtcccctctgagccgttatgccaaaggtcactaaggacatttagaatccccatccatccatccatccatccatccatccatccattcatccatccccagtgttccatgtgtcaccttctccttttccagcatccctatcctatggtgctttggtggtgaactatggcagtcctgacttgctgatgaccatatgctggtgacctacaaatcgggatcctgccatatggggtcgccactggactttctgcactggatctcaagagcgttgagccgagtgggcgtgtatgtgtgtgtgtgtgtgtgtgtgtgtgtgtgtgtgtgtgtgtgtgtgtgtgtgaaagagacagaggcaatgagagagacagacatgcaggcaggccgacagctctgcatgtacttgtgttttacggcctcaagcagaataagggacctcctccttatttctgactcatatctaagtaaggttccccaggacagccacagttgtactgaggggggctgacatgtttggcatcctggctatagtattgtatacacagggccaccagccccgccctagtggtcagctctgaggggggactggtgactctgaacagatcgatgtcaacagccatggtgaaccagatctgggcagggttccccaaactctattcaaccagagttttatcacgcacctcatcgggtctctcctggttgctgccccgaggtgatcgtcatggaaaatgctgagaaggtgggaatgggatggggtggaccttctcttgcttggtgctccgctatttggaacagttcttacacatttgctgggcctggcctctgagaggccatcttccacccccagaaaggtgctaatggcactgcagagggctctctaggggcctccccgccccaacagcaagcagttgttagctcttggaaccctccagaggaagaggcaagcgtttgacttcccctttaccacctgaggcctccttatatctcttcccagagtaagctttgggattgtagacatgtgggagctatgacagacgtggcctggggtagaaagatctcaggaaagcacctttctccttttcagggtgaccgtgctcttcacactctctgaggcctcagtccatgtcctatatcagtttctcttttgtgtgctttaccaagtggccggtgactacaggccaccccgattctcaccacaaagttagaaaccctccactttctgtcccttgaaccatatcagaaaaagacccatttccttgctctttggtaatcacttctgtttttttctttttcattactttgctaccacctccatcccatgacattatactgtgaagtgtaagaggacggggtttttttaaacttggtagaaatgtcggcagctgctctacacacaacttcactcaaggctttgtttccagaggccagctaggctgtcacaggcaggaatcccttcccatctgctttgtgaagggtcccatacaggtgtatctagacttcaaggacagggtttgtctcacaggattgtcacttaggagatgaaagaatattaccacatgaggaggaggggcagttgcaacagaacactttggtcttcctacaccaagtctgtgagggcatccaagactgaatgaaagcgcttttcttatgcatacaatgtgagcaagaacaagaactgtttaaggcacctctgttcccagccactgaagagagacgtcagaagatgttagaataggtcaaagccaaggctctggtgggctgagggaaggtttgtagctgcgtttagtggtatacatctttagtcccagcataggcaggtgaatctcgagtttgaagctagcctggtctaaaaaggaagttccaagactgccagggccacacagaggaaaaaaaaaaccctctagaaaaacaaaaatgaagacaggatctcatgtatcgtagattggcctttaagtcactttaccaaggatgatctttgaactcctgagtacagactgcgggtgtgtgctaccatgctttatgtggccctgggttcaaacacagcccttcatatgtatatagccaaacactctacaactgagctacatcctccagcctaggctgtaaatgttttttggagctagattagctgcctgccaaccttagaactgcaaagccattcctgacctgtaaacctcagctctccatctctataagaggtatagcctgggctaataccgtccaagttacaactccttgcttgctttctgttccttctagccttggtgacttccaccaggaagagaataccccctctctacccctgctccaagacactgtagatgctagtgtcggagtgttctctgtaacgcgacagttccttctgttgcaatagcccccctgcaacactgcaataatccttcagtgtctcccctgggctcaattcacttccttatttgacaaagtggaggtgagacttgtattcttaaaattggaggctagttattttgtcaaatgcatgtaatgaacagacccgaaggaatcctccacacacaagccagggaacaccaactggaaaggtaccccgtcccagggaagcctgctagggagaggttctgtagaatccgagcctagcaccccaaagtcatgcacccagtatcctcttgtatgactgtatatgtctatgtctgggatccagggcaaatgtgaattttcttttgatttgggagattgttcacaggaagtagtcctcccctctcatgtcctcctattgattgtttacaatatttgtacatctatgcaaaatacttgaatgggccatggtgccttgttttttgttgttgttgttatttttttctccttgtttgtatttaattaaaacaaattgtcatgaggaaatgttctctgtttggatggctcttttgtgtgtgaactgtttcggtaatcccactgccaggaccacttaagacatgtgatgtgaacgtctcagaggactcatacagaccaacagccttccagtcggccatgacctgtgccacagtgatgccccggggtttcccatggccagtagtcagggctgcctgctttgtacctgtgctcaagatagtctggtttcattaaatcttggattaccaaaggctttcataatcttttagattctagaacattcttctacactattaactttagaagacagctgagatactctgtgaccaactctcttcactagggggtgtgctttaatgaagaggagagacttagtgtgggtcccgggctgagtgggtaggtgcagggaggccagcttgtgtgcacttaagat

SEQ ID NO: 19784 - DNA, 1139 bp, Mus musculus
tcaatgtcctggtctctcccttttgctcaagctcagtcatggggatgtattaacttctatgtttcagactaaaacacccctgcacagtccccacaaatagcacatcttttaaagagattgcccaagtctccatatagagctagtcatctgacctgcagagaggacatagccctgagctcccaagacacaggaataatagatattcctctaccagcctggggaggacagaagacaggagtaaccatcccctgccccaggaaggtgattgttatccatcaccgtttttttaaccacacagagaagagaagagatgtgcataatctgtactttgccagacagggccatgtaccccagggtggtcatataaattagaatccttaaggatggcacaccagagtgttcctttctggacactaactttgaatctctgggaatagagccagaagacctgcctcttctcagatatatcactgcacaccacatactcagaccttgctgtagattggacaactctactaactctgggtctctctgagcaagagtaggagcatttgtagtgtagggttgtggtttgaaacagaaactgtccagtcctcctgtctggcactgttaattcttagtctgattatttttcaatgaccatagctgtatcccagaggcagattccactttccagatcgtcagctctggctggggatagaatgtgataaacagactttccccgcttagtgtcccctcactgctctgtagagatttgggctgttcataaggccgccttcctggcagctcatcccttctaccctgcactcctgaccccaacagttgaccctctgggaagagtcacattctgctcaagatatttgatcccaataaattgaggtcctcgctttgaggacagagattccatttttgcagcacttgcctgcaaactctggacaacttcaatgctctttcctctctagtggtccttgccccccacccctttgattttttttttaatgtatttaaagatcaagaaaaaagcttagattttaaaatgttttaaaaagaattctgtttcagaaattgtcaaatgtgtaccatatttgtattaagagttgttggggattttttgtacaatgaatttacatttatttatg

SEQ ID NO: 19785 - DNA, 1161 bp, Mus musculus
ggtggagtgagagctttagaagtgtggtgaaccccagagaggctctggctggggcacctactgtgtaggaggaggatgctagagaggatgggtgtcttctccagagaagtcaaactgtttaaggtaatttctcaaacctagagaggctcatcatccaggggtggtagcactcgcctgtcctagcactgagggtctgaggcagcaggactgctctgagttcaaggacagtctggtctacgtggcaagttccagttagccaagactgttatgggagactgtatccccatacacagaagaaaacaaaggaaggaggggagggagggagggaggagtggagatgtcttgcagacgtcatttcaagaggcttagagacatgggtcacaaactaaaaatctggtttcccttcccagttctctttcaaaccttagcttacataaaagaaagacatttgtattgatgttaatgctagtctcatttcttccaagtactgtgccagattcaggtctagctactttcactgtccatcacatagccatggttgattttaatactgaaacagagtcttccgttctttgctaggcctccaaatagacaatactgaaacaatgccttgtttgcccctgatgtaccttgagggtctgtgttgtccaacttggggaccgttgtcatgtgacatctatacagcactgacatgtgagaggacagaagtgggaggtctatagacaaattttcacaaataggaccaactatggagagcaatttaagctttggaaaacggggcatctccttactgttgctcactccctatagtgaggcagtatggccggttggttaccaatctctctagctaaggccaccacctctaaggcatcctggatggcttcagcctctggttcagctttggccctggcccctgagttctttcgtggcagttcctccagggggaacccctgcaggtcttcttccctctgaccaagagctggggtctcctcgggccatcttaccaacccattggcttcctccatttggccggctctgtaagaccaccgaggttcgtgacagcggaggcaccagaactggaggcagatgaaggccagcacagcagtgaagcaggccagcaggatggccatcagcacccaaagagaaatctgggggtccacc

SEQ ID NO: 19786 - DNA, 1202 bp, Mus musculus
tctcgcctgtcccagaaacggctggcctctgtattccacaccgtcacccgtgcagcctgccctccgcggagtcccggagccaaggaggctcccgccggggcctgaggcacaaacttctggggccgggtggacccctgtgcactcaccaggaaggtggccggttgtcaaatgcttatatttttacaagaatatttcttggctctcttcttttccggctggaaccatggaggctgttccagagaagaaaaagaaggttgccactgtgccaggaacccttaagaaaaaggttcctgctgggccaaaaactctcaagaaaaaggttccctctgtgccagaaaccctcaagaaaaagcgaaggaatttcgcagagttgaaggtgaagcgcctgaggaagaagtttgccctgaagacactttgaaaggcaaggaggaagctcatctatgagaaggcaaaacactatcacaaggagtacaggcagatgtaccgcactgagattcggatggccaggatggcaaggaaagctggcaacttctatgtgcccgcagaaccaaagctggcctttgtcatcagaatccgaggtatcaatggagtaagcccaaaggttcgtaaggttctgcagctccttcgtcttcgacagatcttcaatggcacctttgttaagctcaacaaggcttcaattaacatgctgcagattgtggaaccatacattgcatgggggtaccccaacctgaagtcagtaaacgagctcatctacaatcgcggctacggcaaaatcaacaagaagcggattgccttgacagataattccttgattgctcggtctcttggtaagtttggcatcatctgcatggaggatctaattcatgagatctatatagttgggaaacgcttcaaggaagcaaataacttcctgtggcccttcaagttatcttccccacgaggtgggatgaagaaaaagacaactcactttgtagaaggtggagatgctggcaacagggaagaccagataaacaggcttattagacggatgaactaaggtgtcacccattgtatttttgtaatctggtcagttaataaacagtcacagcttggcaaattgaaaaaaaaaagaatatttcttgcagccatatttgaaagacagagaaaatgtacacatacatttttttcctttgagactacatatttgcttgtgatagatagat

SEQ ID NO: 19787 - DNA, 1258 bp, Mus musculus
tgtggaggtaaagctgaagacaaggagtggatccctgtcaccaagctgggctgcctggttaaggacatgaagatcaagtccttggaggagatctacctgttctccctgcccattaaggagtctgagatcattgacttcttcctaggtaagtccctaaaggatgaggttctgaaaattatgccagtgcagaagcagactcgggctggccagcagaccaggttcaagtctttcgtcgctattggggacctacaatggtcacattggtcttggtgttaagtgctccaaggagattgccactgccttccgaggggccatcatcttggccaagctttccatcgaccctgtgcggagagactactgggggaacaagattggcaagccccacactgttccatgcaaagtgacagtggctctgtgctggtgtgtctcatccctgcccccagaggcactggcattgtctctgctcctgtgcccaagaaactcttgatgatggccggtatagatgactgctacacttcagccagaggctgcactgccaccctgggcaactttgctaaggccacctttgatgccatctccaagacttacagttacctgaccccccgacctctggaaagagactgtcttcaccaagtctccttatcaggaattcactggtcatcttgtgaaaacccacaccagagtctctgttcagaggacccaggccccagctgtggctactacataaggattttgtacaagaaaaataaaagaattaagtctgctaaaaaaaaaaaaaagaaaaaagaaaaaagaaaaaaagaaaaagaaaagaaaaaaaaaagaaaagaaaagaaaagaaaagaaaagaaaagaaaagaaaagaaaagaaaagaaaagaaaaagaaattggattccacagaagggtttaaagtagctaagagctggtaggcaaggatcaaagggaaaaggaaagacattctcagcttcaactccagaactaaacatttcattggacacatgaaaacgagactacaatgggcaactctgcagtctggtactattatagaagaaaacccaaggtgaaagttgatataaaggatagtgagattaataattcaagtatggaagatgttgacatactagtcaatagcatacagagattcgtcaatagcatacagggactcaagtgtgtgtgtgtatgtgtgtgtgtgtgtgagagagaaagagagagagaggggggggagagagagagagagagaaggggaagggaggggag

SEQ ID NO: 19788 - DNA, 1438 bp, Mus musculus
caaggaaattacagttagaggtcacaactgtccaaaacctgttctgaagttttatgaagcaaactttcctgcgaatgtcatggacgtgattgcaaggcagaacttcactgaacccactgctattcaagctcagggctggccagttgctctcagtggattggatatggttggagtagctcagactggatctgggaaaacactatcttatttgctgcctgccattgtacacataatccaccagccattcctagagagaggtgatgggcctatttgcttggtgctggcaccaactcgagaactggcacagcaggtgcagcaagtggctgctgaatattgtagagcttgtcgcttgaagtctacttgcatctatggtggtgctcccaaaggaccacagattcgtgatttggaaagaggcgtggaaatctgtattgcaacacctggaagactgattgactttttagagtgtgggaaaaccaatctgagaagaacaacgtaccttgtcctcgatgaagctgataggatgcttgatatgggatttgaaccccagataaggaaaatcgtggatcaaataagacctgataggcaaacactaatgtggagtgcaacttggccaaaagaagtaagacagcttgctgaagatttcctgaaagactatattcatatcaatattggtgcgctggaactgagtgcaaaccataacattctccagattgtggatgtatgtcatgatgtcgaaaaggatgaaaagcttattcttctgatggaagaaatcatgagtgagaaggagaataaaaccattgtttttgttgaaaccaaaagaagatgtgatgaacttaccagaaaaatgaggagagatgggtggcctgccatgggcatccatggtgacaagagtcagcaggaacgtgactgggttctaagtgaattcaaacatggaaaagcttctattctgattgctactgatgtggcctccagagggctagatgtggaagatgtgaaatttgtcatcaattatgactaccctaactcctcagaggattatattcatcgaattggaagaactgctcgcagtaccaaaacaggcacagcatatactttctttacacctaataacataaagcaagcgagcgaccttatctctgtgcttcgggaagctaatcaagcaattaatcccaagttgcttcagttggtcgaagacagaggttcaggtcgttccaggggtagaggaggcatgaaggacgatcgtcgtgacagatactctgcaggcaaaaggggtggatttaatacctttagagacagggaaaactatgacagaggctactctaatctgcttaagagagattttggggctaaaactcagaatgatgtttacagtactgcaaattacaccaatgggagctttggaagtaattttgtatctgctggcatacagaccagtttt

SEQ ID NO: 19789 - DNA, 1060 bp, Mus musculus
ccaaggaactgaacagaagcggaaagggcggagccgcgtctctgccacgtaagggcggagaggccactgtagtttgcttgtgtgccctcagccccacttctgcttccacggcatgctttaatctcccgagaagcctttctaaaaccctggcgcatctggcttcagaatgcatttgtacagcgctgccaaactaggttgcgtggcagaagaaacgacgatacttgagacctactctcccagttcctcccacttctcagtgcagctatctttgagcagcagtgaatcatgggaatccccgccttgctctccgagtatttccggttccggcggaggccgctctttctttttctccacagggtcgtggtggcagccgctgtggtgcttggctctctgagctatccggtgccatccttgtcgctgcggcgaccctcgcatcaactgcagccatgaccgagcagatgacccttcgcgggacccttaagggccacaatggatgggtaacacagatcgccaccacaccgcagttcccggacatgatcctgtctgcgtctcgaggtacgggctgcatgccgggtaaatcacccggtgtcctggggactgcatgagagtctcgtggttaagcaagtggcgcgcgtgttggctcggttcattccccaacccagttgttagttggggcgtgcataccccaacttgggccccaaccgggacgaccctttacacatgaacggaaaccgagacacgtcgcgcaactgtactcacaccccacctcccaaagttggcgattttaaatctctcgcttgcttcctggagatgtgtttaagtagttttacggggctacaagacgggcggagcaatgatgaccccaacatgccatctgagtggctttgctgaaatccagaggctgtttctgagctgttgtcgcctggccctaaactatagacagtgggtaaactttgtagatgccttgttccccacatttccggacttgattgtcccgccctaggttttcttgtaactaatgattttttttctttaatgatgtatcttcatgtgtatttcc

SEQ ID NO: 19790 - DNA, 3634 bp, Mus musculus
caataacggctgcatttatttcagtaactctcaggcgggaaaggctgtctctgctcagcctacatacacccaagtggtgcttctgctgttaattagtctcgggcccggacgatgactaaggttagggttagtttcccagaccctgcatggtagcttgcagtcatctgaaactagttccaggagacctgacacgcacttctgaacaccatagacacaggtagcacacatatgtatgtagggagccactttaaataaaatacattttgaatgtggaacttaagtctcaatcccaggaagtgtggtgcccatagtctcacattacagctgagatctacagctcttgatattgtagagtagtaagcctcttttatttataacttgaagtttctctgtcccgtttactggccccagtgactttaagactgtaaatggtgcacagtaagtaggcttataccaacctttaccaacccttttagacaagaccatcatcatgtggaagctgaccagagatgagaccaactatggcataccacagcgtgctctgagaggtcactcccacttcgttagtgatgttgttatctcctctgatggtcagtttgccctctcgggctcctgggacggaacgctgcgcctctgggatctcacaacgcaagtagctgctttggaatcttggggggaaagtgggcagaactgaggtagattcgccggggtgcagtctccccttggtaattggtccttttgtagagggtaaagcaacatttgggggtgttgttttaaactgggtacctatgaagtgtctcatcttgtacgttgtcttagatgggcatttggcagatgtaatagaggatcctagtgatgacaagacgacattgtcaaccaatcccccacaagggaatgaggacatgtcctgcaattctgaatgggttctctgatacatgtcagacatgacataggctagtagtaggttctaagccacgtgtggactgtgtggggtaatagagcctacggggcaaggatgaagctaggaaaaggctctagctggatggacaaaacctgtctagaaagtgaccaggttctccttcttaggggcaccaccacaaggcgatttgtcggccacaccaaggatgtgttgagcgtggccttctcctctgacaaccggcagattgtctctgggtcccgagacaagaccataaagttatggaatactctgggtgtctgcaagtacacggtccaggtaaagggataagggtggtagggacagcatgttcagggctacctcccgccccctggggacttgggttgtttctgaggtgggttcctcactaggtagtcctggtggcctggagtgatctgactcctaggtgttggggtgaagctgtgtgccaccgactgcctctttagcttttcattgtgtgttgttagtcctgtgactgtctggggttgttttttgttatttttaagctaagcatgctggcttgtgactggcatgggacttacaggcgttggaattttatttaagtacgctgtagctgtcttcagacactccagaagagggcatcagattttgttaaaggatggttgtgagccaccatgtagttgctgggatttgaactcaggacctctggaaagagtagtcagcgctcttaacagctgagccatctcaccagccccagaattttttatttgtttgagaaggggtttctgtgtagatctggctgagatgggtgtgcttttaaactgctggggttaaaaggctagctagaggtggtacttccccctttcattccatattaggttgggccatggaaacccaaaccagggcataaattgggcagggtcttggcacatacgcagatacccagatatctactaaaactgccctaagggttaaatgatcttaagtctctcacctacctcctagagatgtgtatttaaggggctacaagccaggcccaacagtgatgaccacaacatgccatctgagttgctttgctgaaatccagaggctgtttctgagctgtgcctggtcctgtactctatgagtagtgggtgagctctgggggtcatcttaggattcaaatgtcagcgggcttgacctcaggtggctttgccaactgagtggaagactgctgttgtcccacctagggaagtgtggtagagatctgtaatctgggagaaagactgcttccccttaaccttcccctgcatcttctgtaggatgagagtcattcagaatgggtgtcttgtgtccgcttctccccgaacagcagcaaccctatcatcgtctcctgcggatgggacaagctggtcaaggtaagcttcaagcaagggcatagctctgccaaaaatcccaaatgtattcccattcctctcagatagtgatgcattctgatttggaatatttatgaacattagtttggctttggcttcttatggttcatcgcaatactttaggactgtggtttgttgaggctaggattcattctgtatccctttactgacctgtgtcatccaagcacaggtactgtgacctgtcttggtcacccaggtactggaactatagaggcttgcatgacatgcctgttcagtggtcccttaaaagtggtgttcatacctttcctgtttagtgtatacctttatcctggtcacccacagactcctgttttttcaggtgtggaatctggctaactgcaagctaaagaccaaccacattggccacactggctacctgaacacagtgactgtctctccagatggatccctctgtgcttctggaggcaaggtatttgggttttgtcatctttacagagaaagctttttatctggttataagcattattttaaaatatgtagaaaagtataccaaagatgtttatttttatggttggggttttgacacattagaggaaaggacttagagacaggaacactatacaacctgacctaacttcccttttctgtctgcccaggatggccaggctatgctgtgggatctcaatgaaggcaagcacctctacactttagatggtggggacatcatcaatgccttgtgcttcagccccaaccgctactggctctgcgctgccactggccccagcatcaagatctgggtaagtgtgatctgttccatacatggcacattgactgactggcagaaacccagctttctcagtagattccatcatttagttgctatcagcaccaaggggagttcatttttttccccctaaacagtttgcagcactgtgtgacatctgcctaatgaaaagtaatgcctgtgtatatagcagtttatggagtgttctaattgctatgtggtccaaggtaattctcttgtgagagccagtgcaggtggcatctagccaccagatacctattaggagttaagtagctgccatgtatcatgaagaccacagtgtgtatagcattgtagtagaacactcacttagtataaaagagatccaaatttagtccctagcaacaaagagagtccttccctatgctgctagcatccacttggcttcaattctgtaatctttgttacaggatttctggacaactaaatgacaagtagactagactagcctcagagagcacagatagcctgcctctatatcctgagtgtgggattaag

SEQ ID NO: 19791 - DNA, 3634 bp, Mus musculus; identical to SEQ ID NO: 19790

SEQ ID NO: 19792 - DNA, 3634 bp, Mus musculus; identical to SEQ ID NO: 19790

SEQ ID NO: 19793 - DNA, 1076 bp, Mus musculus
tttgtaccttaagcatttgtagcctttccgaggtaagaagtgccctttttagttggtgaagcacattttttgttgctgggggatgggttgtgcacacttgcactaagttgtgcagtcagttaaagttggcaatcctgcctcagtctcccgggtatttcagattatagacctgagctatcaggatctgaggattttttgctggttcagcatagggctattctatatccttgaaagaaaaataactgttagaaatctgaattatataaagtaattcattatttgagtataagtatatacctgtgggtcccactagctggcctcatagctaagcaaacctttctccatagttgtttctgggtgaaacctatgttgccaagcaaggcgttttcacatgtaaccagcctgccagctctcttgaaaggattctaaaagcaatggtatccttacgggctttggtctgttcctcaggacttggagggcaagatcattgtagatgaattgaagcaagaagttatcagcaccagcagcaaggcagagccaccccagtgtacctctttggcatggtctgctgatggccaggtaagtatatttgacaattcagctcagttctccaacttatctcccttgctcttacttaatattttagggataagactgtcagcataaaatgaagtcaaaccaggttaattttgatggactggttatatatagagaatattagataacctatttctgtctagggaaagattatggtatggagtttttaacctggaagcttaaaaatgtctgaatctatatggcaagctgctgcttcctcttaatatatcacgaaaggggtcttaagttctttgaattagagagttcattgttgggtgtgacctgttgtcattcattcatttacagactctgtttgctggctatacagacaacttggtgcgagtatggcaggtaactattggtacccgctaaaagttttatgacaaagtcttagaaataaactggctttctgaaactggcttctatatgtgagtcctggaagctgagtccctggttctactgcaagagcagaccactgg

SEQ ID NO: 19794 - DNA, 1197 bp, Mus musculus
gcgggtggtggtggatggttgcccactgttttgggagcctggattcctcccactgtttgttactgagttgcttcctgctccctcttgaacccaggctgcttctccctctaggagtcaaaaagacctcctagactcctccagctcagtccttcctcacctactttgtctgacaggtctgcatgggtccctgataaccaacagctgcctgatgacctcccctcccgcctagctcagctctggggatgtgtggagataattcctcaactttcctttttcacccccctccatgttttggtgcaagcttcagctaagagctttaggagctgtctaggcaatcaggctgggcaaaagggtagagctgtgtaagtctactttttcttggggaagtaggaacactaaagctttccttccaccccccaatttctacctccatagactggccagaatttagcttcagtgagatctgagatggtcagcatgacaccacatacattacccaataaattattttctctctgcatcttatgtaggagcctaagtcttcttctctgtcaggctcttattcagaagtttctggcctctccatgccttttatttccacttggtaagccctgttagggagcttgagacaggggtctggatcctcgggagaccactgggtataatctatttttctagtaaccccttgccttctgacactaaacagcttttgtcctctgctttggtggctgaggtcaactcatgttcttggggaaaggtgggttgtgttgcaaaaataaaaaaaagtgtttatttgctttttttgtggactcttttaaaagcaaagcagagattgtttttcagacctcaggctccctgttttctgacccaggacaggcctggtctgaatttgtgggctaaattatgcttgcatatgtgagttgatgatgaggcatagtgtggatccaggagaccaaaccaagttgatggatttttgtctaattggtgatgaaatgacatctgatgtgtttacttagctgttactgcttacatgccaggatagtaaacaccagtggtctgctcttgcagtagaaccagggactcagcttccaggactcacatatagaagccagtttcagaaagccagtttatttctaagactttgtcataaaacttttagcgggtaccaatagttacctgccatactcgcaccaagtt

SEQ ID NO: 19795 - DNA, 1242 bp, Mus musculus
gttcgggagtgcttggctgaaacggaacggaatgccaggtcctagcccctggctggtctgaaggcccatctcactaccccgtggagatgagaggctttgtgcaaaatggcagtcatttttctaccacagtcattaagctctgaacccacactcaaaagattgggaggacattttgcagtaactgacgatgtgcattttaagtagttaggaatgacccagctctttttttctttccaaacatttgaaagatgtttgtgaagccacttcacagcaagctattgtttgtccccaaataccagtgtcccctctaacctgcctttggatacgcatcaccccagctgacttcctttccctgagctcacctgcctccgaggagttgagtgcaaaccacagcgcctttgctcagtagctggcccgcctgtgtacagtgtagaccctgcttcatggagcttctctgcctaagcgtttgcatgactgagtgcttggaagtcaatctttaaaatgcacaggttacacatgcagaagaaagagccatctacccaacctcccaagcaccctgcaaatgtccatcctgaggctgtagatctcagttctgtgtttactgtgagcccatcacaacatctggaagaaagcgactgaaactgttgcatctttgtatttattacttgatgtaataaagcttattttcattaaaaaaaaaaaaagaaagagtgtaagaaggttatatggtattgtcatttaaaagacaaatgactcaaaagtgacagctacctgtgagtgctgttgggcatcccaggggattgatggtgttagctatgtttatttcctatctatcaacttagttcctgtctccacatggaagatcactgaaaactgccttatattagttaactgggtgagtgatgggatcttgaggtcccaaagttccagtgtgagctaaataggtcagctggagggagagctgtgaatatcctggcagtccagagcccgggataaggggatggagagacacacttctaataagcccaaaagaaaaaaagaaaatgtaagcagagggactcctagataattctcaaaacgaatttaggatcttttcactctttgccacatcttctctgggtttttaagcctattctggatcctggacttagtgatgtgtagtttctgggacagagcagtgactgagcaatgagcactttgtaggtgtagtttggaagaaagtgtgctaatgcaggtggcccg

SEQ ID NO: 19796 - DNA, 1157 bp, Mus musculus
tctaagaatgtggctggttatcttgggtaaatgatgtcactgagtgctggttttcaggtgcagcctggggtgtagtggggatccccactaagctacttttatgtatctaacaggcattaaaaaaacaaacaaacaaaaaaaccaaaaaactacagtcattacattctcagacctaagttcaggctttctttacatccaggctccacaattattcttgaaatcagatttcctgacctgctcaaattgagatccaaatcaggcccgctgtatttcttaaatttaaataaatgtctgttgaagattttaatacgcatttgttaaattgaagaaagagaaaaagaagaaagaaagaaaagaggagaaagctaggtagctaatgtggagggaggagtgttggcaggtgacaagaagggaatgtaccctgattgtagaggcagcagtgtgtgtggagacatccttcctttttctctctcctcagtggaactcactttggatccagacacagccaacccccgtctcatcttgtccctggatctaaagagcgtacgtctaggacagcgcgcccaggacttgcctaaccatcctcgccgctttgataccaacacccgcgttctggcatcctgtggtttctcctctgggcgacatcactgggaggtggaagtgggctccaaggacggctgggctttcggtgtggcccgggagagcgtgcgtcgcaagggcctcacgccttttacccccgaggagggcgtctgggcaatgcaactcaacaatgggcaatactgggcggtgaccagccccgagaggacacagctcaactgtgggcacttgtcgcgggtgagggtggcgctggaccttgaggtgggagcagtgtccttctatgcagtggaggacatgcgccacctctacaccttccgcgtcaacttccaggagcgagtgttcccccttttctctgtttgttctaccggcacatacttgagaatctggccttgaagagctgtcaggcttactaggaggggacagggcagcggtgtatctcggtgagaccgaggtactttatcttggaccttccttcacacccctacttctgctgcccaagaaggctgccagagagcacaacacaggcgctgaagactgattgagcaaagaggccctgtggg

SEQ ID NO: 19797 - DNA, 1330 bp, Mus musculus
agaaagaacatactgtggatgcttcagtccctcttagaaaggggaacacccttatagaagtagggagatgaggaacgagatgggtgcttccaggaggggaggagccaccaggaaaggggaaaatatttgaaatataaataaagaagaggccagcagaggcagcaagcagagcagccccaaactgagccctctcctgcctgcctgacctctgctcccctccacctgtccccatctctttctcccttccttctccacacccccctcctctgcccactagtggggggggggggcttggcttcctacccgccagtattgatccaccccacacataccccacccctggtctcctgcccttccccttcctgcctgctccccttttctcctcagtggacttgtgcctccagtgaccaaagacttgactactcaaagtccagctccctgtaactgctagacgtggacaccagtgtgattgaaggtttataaactgtcactctcgccatcaagctacttaagcatggaaaggaagttggcagtatcatacaaaagaaaggagaatctgttaagatgcactgcacgagaagactggtgcacttatcaacatctcagaaggaattgtcctgggaatattatcactttgtctcgacagactaatgtcacttcaaagccttgcaatgatcattgacaaactggaagaggacataagcagctctatgaccaatagcacagctgccagtagacccccggttaccttacatctggaggttcctgctagtcagtctctctctctctctctctctctctctctctctctctctctctctctgtctctctggtttttttgagacagtgtttctctgtgtgtcttgtgtggctctcttattggaaaaggtggttgcaagatcaaggaaataagaaataagagagagaacaggggctcaggtccaggtggcaggggatatgctccttaactcaagtgagcaggcaataactattgttggcatttcacaatccatcattgagtatgtgaaacagatctgcatggccatgttggagtccccctgaagggcgtgaccatccagtacaggcccaagccctccagttcttcagtcatctttgcaggtggtcaggcctataccattcaaggacagtgtaccattccacagccagatttgaccaagctgcaccagttggcaatgcaacagtctcatattcccatgacccatggcaacaccagattcagtgcaggtttcgatgcatctgctcaaactacttctcatgatctcaccattccaaatgatttgattggctgcataatcggatgtctgggggc

SEQ ID NO: 19798 - DNA, 1150 bp, Mus musculus
tacagtacactagcagagacagcttcaaggcctttgctaaggccctgggtgtcatggatgacctcaagtctggtgtccccagggctggctaccgtggcattgtcactttccagtttcggggccggcgtgtgcacctggcacccccacagacatggactggctatgatcctagctggaattagcagcacctgcctttccctcctgggtctccttgccgcgtgctgagccgaggcaggcctgcagggcctgggctacaccatcctgccagtgtctccctctcagtgtctccctcttggatctgtagatcttccctttgtgtcctggccagcccccaaatggcattctagtgcacaaatcataggatgagagttatactcctgttgtcaagggagtattgtgtggtatgttcggggcatattgaacaagaaaccactgtgtggtatggggagggttgggcctgttggggccaggtttgtaatgtctccaagggcatctgcagagagcttggcagctccagctctcctcagcaggcctctccaccctgatctggcccctgttagcccatgagccctctttatgtacccatcctccctttctgaaccttccctcagggtggggctggattatggaggaaggaatggatctttggtcagatgagactaacagagggactcactgtcagagttagcgtggattgctgctgccggggcactacctcctggcttctctccctgctgacgtggctcttgtcctggagcagagcagtgcgttgttgggagatggaaagtctatgcgtgggtaccctgtcttcttgcctgtggcccccctcctttctgaaagttagttctctccgcattctttaggaggattcaggggcggcctagtggaagacagtgggctccatgcctctttcccctggggtttgcttcaggggctcctccccgagggcttgctcctggtggcagcagctgagatcaggacatctgtggccctgagccggctctggtcctcggcctttcccagccttcccacatcttcccaggccaagatgcagggggcaggctgaagagaaatttgtgtgtccttgtttgttgcctgatcttagtttcatggaagaaaatggaatctacagaattattttcaaaaataa

SEQ ID NO: 19799 - DNA, 1757 bp, Mus musculus
ttgatcattgcctacaagcatttaatgccatgggattgcctaaacttattaagacagacaatgggccatcttattccagtaaaaactttatttcattctgtaaagaattcggtattaaacataaaactggaattccttacaaccccatgggacaaggaatagttgaacgtgctcatcgcaccttaaaaaattggctttttaagacaaaagagggtcagctatatcccccaaggtcaccaaaggcccaccttgccttcaccttatttgtcctaaatttcttgcacaccgatatcaagggccagtctgcagcggatcgccactggcatccagttacttctaattcttatgcattggtaaaatggaaggaccccctgactaatgaatggaagggtccagatccagttctaatttggggtaggggctcagtttgtgttttttcacgagatgaagatggagcgcggtggctgccagagagattaattcgtcagatgaacacagattctgactcttctggtaagtatcattctaaagactaaaattccttttgtgcttaaaattcagctgagagcaacagctctcaaagctgtttgtgtctccagctactctctgaaccagctcccgacaggaggccggagactagcctcagttttacaatttgcatttgaataaagtacctagacctcccggaaagaagttctgctttcctactttctcactgtctttcaagattttgtctttcaagcaggtaaatcaacattcccgaggcggaccagcggatgtgcatccccgcccccctagagcacacaggtggcagctgttacccccagtctcaagacatttccagcatgtggctttcagtctgagttaaaaatttaggtttacctagagggctagaagagtagatatttctatattaataaagattggtttttattttgatagacaggcttagccccttagctgacctctggcttttcacccttgctgttactgcaaggtgtccttaactcaataggctgtggaaaaaacaggaatgaagaggaacgacttccagctcctattttagccacaaatcgtggtgttactaacgacataattcttgcttaggctttgctaattctgaggttgataattctcctttaggagctgcacagcactcagaactgtgcatactggtttgtgattgtacaaattcagtatgggcaccgcttggtgcagagatacttactacaaggaaaggtccggcttgaccatttctgagtttcctgtgagataaacccggtttgaaagaggttggtaccaaattttggttaaaaataaaaaatattctccggctctacctcgcctccccaaaaggtaccaagagccacatgtgtgggttttacccacgagagaaatcgggtccatgtccacccaagccaaggttaaaagcccactcatctacggatgagaaaatcatttgatcacctcagttaagcgttgccttatttaacttaattaataggggggagagagattggagacgtactattgaaagggcaagcccttcactgcctcccacccaaataaaaaagccaattggccttgtactacaagagccggtcactccttctccctgtttcccacctatcttccaaaaatgcggaggaattcaacttagtgttattttcacatcgttcagtcaaacttagccagagttccaacgccctacttaaaattcaactagaaagttacctaccaagtactaattagcatta

SEQ ID NO: 19800 - DNA, 1172 bp, Mus musculus
catggtagaaggcgccaaagctgataggaggagacctggaagcagcgacagggccctgttcacgcggttcctgatgggcaaaggaagtgcacggcgagccccacttgtccaagaaggtaagaacctggcttccgcttgccagtgcatgtctggcccaggaaagtctctcgattggctttacccagggataacctagcctgaggccctcggtgccagggcttctatgggagaattgtaatgcactctccttcaggagaggaagacaccccagggggtaggaaatgaaattcatcttgggtatcacaggataaacagcaatgtattgcagacagggttggggaggagtacagagccagatagcaggtgcaaaagtgggtgccccggagagcatggaggtagcaggtataacgagggcacgtagtgtctgggggttcaggggcctggccgggagagctatggtcaggattgagttcacaaatgttaaaatttggagctgagatggaagatgaactctggcagagcctcctgagttcccctccttctgtgcagctgaggacctatggctgagcccactgaccatggaagaccttgtatgctacagcttccaagttgcccggggaatggagttcctggcttcccgcaaggtaggtcccttgaccccaccaggaccttttcagaggagaagggtacacctcccttgccatagatatgcacagttgtaattttactccacagtgaccttagtatcaattcaaatctgtcccattttggaggaaactcagcccaaagtgaggaattccctgccccacatctccacactaagaagtgaccatcgaatcagtctggctgagtccctaactcgctgcactgtcctcaatttcctgtgtcctccactaatctctctccaaatgagcaggatgcaggcaggggagggtataccctaggggacctcagagctgtaggctaagatgccaccctggaggttgaagctaaactcattgccacctccctctttccacctctagtgcattcacagagacctggctgctcggaacatcctactgtcagaaagtgacatagtgaagatctgcgactttggcctcgctcgggacatctacaaagaccccgactatgtccgaaagggcagtgtgagtgcaggccatgtgacacag

SEQ ID NO: 19801 - DNA, 2584 bp, Mus musculus
tgaaaatctgaatataggagagtaaggtatggccactagggatttttctcaatgatcatttgaattttcagtctggttatttgataaagggtatagtatgaaagccaggtgctagcaacagacaaattctgagcccagtgtactttatatactgctagacagggactggtgtgtttacaccttttaatttgttacaagtaattttcctgtttcttctctccaatgtgttttgtcatgccttgaaataggaagatgtgtgagcagtgtgctgtttgcacagaaatccacagcactgttttctgaggccagtagtaacatcagagaccgttcttccagactttactccctcttttttcagacttgtttgtaaaatgtagaatttgaatttagcctttatgattgtatatgatccacagaagacctgatttatgaagttttgtactaaaaaaaaaaaaaaagcaaaattgaaaacagttgtattgtaaactaaggctaattttttttaacctgtgtcctgtgttctgaaggccagctggtaacaaagctgcatccgactttctctgcagtgatttgcactgttggggttgttagcccttttgtactactttatttttaaattgagaacattactctttaaatgtaagtttgcttagaccttgggatattttcttggaccagaggcaacttatgtatgaattcctgaatttctatggaaactttctaccaggacagataagctgatctgtaggcatttaatggactgaagatgacagttgacatatgtacattctggtatttttaagtctttaagttttaactttttatgttaaaaaaattacagctgcttaggtacagcttctaagtcctttctgagacattttctgttctgtctccactgtgcctgcctaaatttgttctcaccgagcactgcctgtgcatgcagagaaaatctgtgcatcttttatatttttaaaaactaacatttgtgagaattttatggaaatgcttttgtatgagctgtggcttttccttcctcgttgtgaagcgttggatagcacattctggaacatgttcatgggtcctgggcttgctcaccagacccaagcactgcttcttggtgtccttgcacccagagtgccactatcatgtgtatttcttattctcttaatgtttaaaaaaaaatcattccttttttttaagaagagtaattttctgtttatgaagcagtataaattagatgcattttcaaaacagtttccctaagacaattgtttggatcatttttaaagtgactaaggaattttagtatgtcaaccaagataaaagttatactgtaccctatattttgcccatagtgccattagtagattagagattaaagtcacctttaactttacaaagttaacttgtatatgttctgttctcagtcgttagttctctcaaaatcaaatgaattcagagggaacttgtctggctgcttttgtttcaactgcaggcagtggagcagaaggacgccgtgtggcactaaagtgaactgttgagtgttaacagttttatacagagactgagccattttggatgactcaaaattttatgagaagacatttaattgcttatgctgtttttaagaggaaataaaattacatactgtttaaataaatgaattttttctttttaagaaattctctaaaggtcttgatatcttggaccttgtttttcctttaaggttttttgttttgtttgtttaatcgtaattgtaatgttgggtttgtttgttgtggatttttactttgtttaagttgtgctggcaccaaacacgtccagtttgtaatcaacaggttggtgtagaaccagtacataacttgcaatggctttttgtcctgtcttcccccacccccacccgtctctgtctctgtcttgtaaagtgtgaatatgagatgtactgactcgattttcttaaacactgtgttggtagtgtgcatcatgacaatttccagggaaggtggactgcagtgggtggactgatgggactgaggacccactttccctgtgacctgctaagggcagcacaggtctggagagtgtggtgccaggagaggggaggagcacttactcatctctgcatttgttagtggatgatgtattcctttcatggatactggaactagagtgcacttgttagatgctaaaggtttgagctttacacaaaacatttcatctgtatttgttactgtctacaatatatttgaatttgggggcagcctagtaagatataattgcctgttatgtcttgaaagtacttgttttgcctcttttaggcatactgcattctgtgggtcagtttgaacatctccaccttgtttagatagtgataagttgaacagagagtgtagatttacaagtataatcttcaaaagaaaaatattttgaatctatcaagaaatgttcacaccaaaatagactgatactttgttaagcaaggttttatgttttaaatgctttgtgtccaaaataatttccaagaaactatacttcttaaaatgcataaaactagtctgttttcataatgtagattatttttgaa

SEQ ID NO: 19802 - DNA, 1151 bp, Mus musculus
atttaaagataacacctagtgactgaggatcatgtcccaatgctagtatttgcagagtctacacaagatctgtgttcattctccagttctgaggaaataaacaggccaaagaatttataactggtaaaaagtacatatctaagagaatttagatttaatatgagagactggatttagtacttcaaaaaatagctggcatgagctgtctctatctaggtaggctttagtgctggaagtatcaaactaatgtagaaatcagttcttagctttgttgtgtatcagattcagtgattgggtaggaaattgttagatacgttagattatcttctgaagtttcagttgttttcagacactgtaagaagctgtagaccaatgagcaggttatgtctgttttatttttatctaatatagctggaaaaccacatctgggaacagaaaaacaacttattctcgtggctaatgctcatatgcattgggaccctgagtactcagacgtgaagttggtacaaactatgatgttcctctcagaagtgaagaatattattgataaagcctctcggagcctcaaatccagtgtattgggagaatgtggaactattcctcttgtgttatgtgcagatctgaattctttgccagactctggtgagaaaagtaatattttctatggaatggctactttttgatttacagattttttttttataaagaacctatgtgcatatctgtgcacaagtgcatgtgtgtgtccaggttttcataaggatcaaggaacagctttatgtagttaatcctgccatccaccacctcacgggctctgaaggtagaactcgggtgatcaggcttttgggacaagcaccttcacctgctgagccatctcagcagccctgttacgtattgtttgtttgtttgttttttgataattcagaatttagtctaaaggaaaattcattttgtagtggcagctgtgtacaggttttacaattttttttctataagatgggcaacagggaaaagaccattctgaagtagtagtatagaaacctgtggaagtgatgataggtgttgctcattctctctgtgatctccccttcctgattcctcactccccaccccaccccttttttttgaggctggtttttaaactcaagaaa

SEQ ID NO: 19803 - DNA, 1152 bp, Mus musculus
tacagcaaccctggaggaaactcctcccccaggatgctgccttagaagcacctcctctgtctccagccctagggtcggggcagctcagagagactggtcactggctctcactaaggagctagaggatatgacctcaggctcactagttccctgtcaaatttgcatggtattcaaaaggacccaataggccagtgagatgacttagtggatatatctctgccaacaagcctgaagacctgacgtccagccccagaacccacatgataagtaagaggagagaactcactcctgcaagttgtcctctgacctccacgcatctgccatggcacatacctgcccctcctccacattaaaagataaatgtaaacagaaggggacaggacagagtgtggtcacacccacagacagcagccagggatgacggccctggctgagatgggcacgtgtggtatggaacaggagagcagggacatcagtctcttggagagccctcacctggcgggcagtgacctgctgcagggcattctggcacttggcaaagcaaggatccttcatgatgaccatgatgactggcatctgcttgtcgacgagagcaaggggcccgtgcttcagctctccggctaggataccttctgaatgcatgtaggttatctccttaattttctagggagacacaagttgggatcagtgtcatgctggggaggtgggggctgcaacagagaagacagagagacagagggacagaaggaaactgggagagggggtactcagagggtaagagctgaaggtctcagggcagacaggggcatatatagatgggtcaacagcagccagggatgctccgggccaggagagaggatgggctgctgaccagagcatgaacaaacccagatagtaaccttgcagcccccaggcccaacagtggtgacagctctcttcagtccagtgcacagccacccatccaacccctttgcaagtcacatggtcttcctggttaccatagataatggtggcattgtattctgcttagatatgtccttgttcaattagctggttaaccattctcccaattttagatccttagtcacatctaaaacagttgcttagattgacctatctagtaaatccccatactgtgggctattatttgat

SEQ ID NO: 19804 - DNA, 1833 bp, Mus musculus
ggtttttcaagacagggtttctctgtatacaccctgggctgtcctggctctctagaccaggctggcctcaaacctcacatagaccaggctggcctcaaacctcacagaggtccatctgcttctgcctcctgagtgctgggattaaaggtgtgctccacctccactcatcgaagctttattcttaattgtatatatgtctgtgtggttttgtgtacatgagtacctgagtgcagaaacagcatggtactggcacctgtgagatactcaacaaattgctatgtggtagaggctggccttgaacttctaatcctccggctgtccaggtttgtatctctctgtgcctgctttatggggtgctggagatggaacccatggctctgcatgctaagcaaggacctcatgtgagcatcatcctttaccctcctgtctttctttttaggttgacttccccagaaacctagccaagtctgtcactgtggaatgagaacaggacttctatcacaagactgtcgtcacctgcagtctgattcaagacctgaaccaactgccaagatgccacacgggaaaggaagtgggcctccgtgggcccctcatgcttccagtagagcttgacagctttgacgtgccttgtacccaaagtgctttgcttacagcaaatgctgtttctctgtgtcctgacgtcactgagaagggattgtttacacatggggatcagagcagactttccactactgtgcaatagagataccgctctcttcagagtaactgtgaacctttttttaaccaacactagctagttttaaaagtcgaaatatttataatgacgattgtatagcttttaagttatttttctaatgtgtggctttctgtagccatggtaacgccctagcccatgcctctggactacccagagtgctgtctctggacacactcgtgcaggtgtcattcatctcggtttggggcactggcatgagccctttgtctcctttctctttgttctccctccacaagctgctcctgattcctgtcccctgaaatcaacgcgtcccctctcccctctccctatgtttcctttgagcccagttaaagtctctcctcctttcaatattctcagatggactcaaattccttagctctctgacttctgcttaatcagattatggtttttttcttaagcccaggcagcactttggtcccggctccctgttcatagtaaaccagcctgagatgccccacacaagagggcggtttcgtggggctgccctgctctatttaaaagcgtgcacaatcaatgtactatgcaattttacaataaagacagtgcaactttttttttccgacttgtttgaatttagttaacctccttttccttacatctgagggtctgagcagtgtctggagggggcattctcatcgttagtgatgcagtttagatagcagttggatgtgtctctcccctccacctccccccatggttcattagtgtgttgaatttaatcctcgttgggaggtattttccattgctctagaggctgagaaatccaagatcaagacactagctgttttgatatgtgggagagtttgctttttttgtccctaccagaaagcctttgtactttctcactgtggaagaggcaagtgagctcctagagcttcttttaaaaagcacggattccaccaggtgtggtggcacatgcacagatctctgagttcaaggccaacctggcctacaaaatgcattctagaacagctagacctacatagaaaaaccctgtcttgaaaaccaaccccccctcccactccccccccccactcccctccccccccaccaaa

SEQ ID NO: 19805 - DNA, 3361 bp, Mus musculus
acacttggatgctacgcagacctaaacctcttgtggtaattgtaagataaactcatccattttcttttaaggtctacttgaagtatatcttttaagtaatcaacatggtcttatgtgaccacagggtgtggggggagggtattgtagggaaagtccaagactgttttgaaactgaaccaaagaaggactcaaggaaaaatcctagaagctcaaagtatagttgagcagtcttggttctgttgatcattaggatcaggaaactgcaaggcacaaaatggagaggtagcctgaagccccatgcctggcgtgcaggatgcgtgcctcagattttattccatttggttttcttagcacagatgcagcagtaagtagcaaggctactccttctcagtcgtcatccatcaatgacatctcatccatgtccactgagcacaccctggcctcagacacagacagcagtctcgatgcctcaacaggacccctggaaggctgccggtgatatgtatgttggagacggcgcacttgtctgtgaaggaactctcacttccatggccccgagcgcgtgggagctgatggaaccaaatcgaaaaactccatgttctgcatgtaagaaacacgatgccttgccctgctcagttccagtaggattgcctgcttagactataaaatgaggcagactatgtctgaagaaaaagtacaaaccacactgttagaaattttgttcaagatcatttcaggtgagcaattagaatagctgagtttcttttccagttgtgtggtatctgtggtgacagctcatgtgtaactgtggggactcgtatgcatgtgaccacaaatgcttgcttgaacttgcccatgtagcactttgggaatcagcatttaaatgccaaataatcttgcaggtagttctgcttctagaataatctcttaatcctctttagtaatttggtgtctgtccacaaaaaaatagattatgtgtattaattggccaccgtcatatatcatatcttacccactttatggtatgatttattctatcttttgtatttcagaaggaatataattaaatttatttaataaataaaaatacagctattcttaaatttgtgatgttttaggctgagaattaccactgctctatgtagacactctgtgccctttaaactgcccactgtgggatactttatgtacagctttctgcatgacaaagttcccagttgtattccatgctgcttaagacatctgtcaccttaaatcctgcccacgaatttcctttttcttgttcctttggacatggatctagaatcctccacagaacttcaccttctttatcacaaagcaccccatctcaatagaatgaagcggcaggctcctgaacccactgcctaatgttggcatagagctgacagagtggcttccccagaatggtcattgaatggtgcctccttccctgaacccacccatcctttgctcccctctccttatttaaggtgaaaggtgatggggtctcacagccgttccctctgcagccttccctcctgacttttctttctcactgacagaagccaccccgtccagccagagcgcttggtctcctaggagactgagctcactcactgtgcctgttggctgctgtctttttccattttgtggaggcatttcctttttctaagggaattcctcagatgttctagaagcactcagaagaacacagaagaaatattctagagagtaggggttcattcttgaatattttctgatttaaaactgctcacctgaaattgatactttcagatcctgatctgtaaattactcaagatttgataagaggctgagttctctgtgttgctgcagaaatggagttgggacggtcataccgtggctacctgcgctcagagcattttctcccttgagcttattttgttaacgattcatatcttgtgttcagttactttgggagctatggagtgtgttctaggaggaaacttgatagcttttatgaaaagtaccatctaatatgtgattctgtctgcacccgttgcatcctaatggttggtctgatcattggaacctttaatggacaacattaatctgaaatctgaaataaggattagctttgtatcatatatggatactttcaggtacagagtggaaatgctagtgtgggtgggggctgagacacctgtctatggcttcaggttattgggccctgggagcctgaagtcccacagtgcatcagtcagcatcatgctgtgctcttcctgctgatgcacattctttaaatgacttcccggaaacttaaggaggaaatacagaaaggagctgtatcatctaccctacactgtaaggggagtgtgctatgatagaggctcaccctggtcccacgggcaggagacagctgtgagtggatccaggtgcccccaaagagcggctttctctctccccttactctgcatatccattgagtctgttgtggatggagtctgtgctggtgtgctcagggtcttgtgccaagaccctcttccatccaggcaagtgcacctatgaccggcctcagagccccaaagaaatacctcaccccagtttcagggtcctccctcctgagcctagatttgccagggtcctgggacaatgcgaatggttttgaactaacttctgtaggcaaatgctgatgttggatgaagaactgaaaaatgtgctcaactttttcatcttttctattttatttttgtaatttatattgtacaccctggaagtcactattttggacatgtatttttataaaccgggtaactaatgattatctggaatttgcactaggttagtttttgttgttgttggcttaattttcagccaaaagtggaatgactgccccttccaggtccgggtttccatttcaagcgcaggtctggagggcagacatgtccagccagggtaggagagcggcctcagaacacaggctgctcagtgcctcgagcattgggcctgcagacaaaaccaggctgtgctctcaactttagaacacaaagaccagacccccggtgtgagaaggagaaagccctccattggcccttgctgacagccggggcctgcatctaaagcaaaaaacccaaccctggtttcatctgggctgagtggtgtgtgagtctgtctgctgactcctctgatgtcccatgccgatagtcagtacaggtgtgacctttcagatcgcgtatctcaaaagtggctttgcctaatgttttataataaaatatgtcatgtgctttgattggtggaaaataatacaaactacattttaaaagagaaaatgtacagcatgtccaattcctgtgtgtttcaaagtgacagttgactgtatctc

SEQ ID NO: 19806 - DNA, 1146 bp, Mus musculus
gtgtgtgtgtgtgagagagagagagagagagagagagagagagagagagagagagagagtcagtccaatgtatgcattgtacttagaaataataggtactcagttttctttggtacaagctgacatcttaaggccagtacttaggttagctgggagctgggcgtggtggcgcaggtcttttaatcccagcactcgggaggcagaggcaggtggatttctgagttcgaggccagcctggtctacaaagtgagttccaggacagccagggatacacagagaaaccctgtctcaaacaaacaaacaaacaaacaaacaaaagcaacaacaaaacccccagctggactaaacctatatttctagcttcatggtgacgtttagctttttgcctttcttttccaaatttgatttaaaaaaaaaaatccttcatcatagctaaagagagcagatttcacaagttgaagtattagctctgtcagtttctttttgtgtttctttgcattgctttttaaagctatttgttagtttattgaaagtcattttagcttaaaaaatatgatataagtagttcatgccattttacaacactataataccttttattcagggcacctctcatgtatatggaaccatctaagatgaaaattcagaaaaagcaactaatgttgatagttaaattaaatgctgatagcaatttcttattaccaattactgaaacagtaacttttacaaattttgtaatatttagatgtacaaagtcaatatatcaaaagcaaaccaaaaaggcagttgtactttttgtatgctaggatcagttagacaatgaaaattttaaaataccatttaaaaacatagtattggtggtaaaaactacaaaccattttgtaagaaaggagatgaagtaaacaatgtttttcatattcatggattcagagacagtattctatttatttattaatgtttgttgttgtttttttttttaaagacaaggtttctctagtagtgactgttctgggaaggaagtgctatgtagaccagactagcctaaaactcacagaaatcaacctgcctctgcctcccaagtgctgggattaaaggtgtgcgccatcactgcctggcagcagagcagagagtattcttaatatagca

SEQ ID NO: 19807 - DNA, 1118 bp, Mus musculus
gatgtcctggcttagctgggagtgtgcaggcatgacagactgcagctttttaggtggtcagtgtctaggccccttcctgctcacatctcccagagcttcccaagagatggctcactcaatggtaggatgtcttctttatatgagaaatgtggtcatgggatttatcaggtcagggtaacggggtggggggttgtaagattgatttgttaaagggattggtggtggttatgcagaaagcagggtttgctgagcatcctgccaagctgaatgagcgctttctctgcttactttcaggactccactggcctgtttggaacagagcagcaaggcaccagccctgccctcagtactgcgaaccacaccagagagctcggttttcctaggtggaaactaccaagtcctgttacacaagttaatgccccatcttctaaatgggcacggtttctcctggcacctggaaatagtcctcaagtggatgagaaaccaagtcctctgcaggaggccaccatgctagctgacctggcacaagggactgttgagaacaagactccagtggaaggccacttcagcagagcccctgccattaggcctcctcaagccattcacactaccaccccacaactggacagacctgacaggaagacccgagagcagccaagggacatggggactcctcgagcagatggtaggcctttggctcaagggacccagaaggctccacccttgcaactgcacaacctctttacaaccggagaggactttgatgatgacctgtagccttcactgttctgtgtccctcaatgccagtcctccttgtcacagactggggtgctctggaacaaataacccaacaataaacgtgcctgtcaacagagtcctcttgctgctacactcgtacggatcacagggctggttaaagtgcatatgccattttattacaggttacttacaaaccaagtcagaggaagctacatgggggtcctgtgctttaagcattaacattagacacaaacactaaagagtggccattagaaagggggacagtataagataagatccttcattcggcttcacatgaattctccattccctaggagctgtaggcccctgcctgccac

SEQ ID NO: 19808 - DNA, 1647 bp, Mus musculus
ttttgagatggcgtctcactgttgcccacgatgttcctgcttccagctcttgagtgttgggattacaggcttgagctatcacatctgtcaataaaactttataggaaaacagctgcacttatttgtctacataccttctggctgttttgtacttcagtggcagaactgaacagttgtgaccaggactggagagtctgccaagcaagctgtctgatcctttagcctttgagggtccctataaggctaagcagaggggtggggtcttcctggcaggcaggagctgctctgctgggaatgcagcaggataccttactttcctgtcttgttttggcagaggctgatccccggctgattgagtccctctcccagatgctgtccatgggtttctcggatgaaggcggctggctcaccaggctcctacagaccaagaattacgacatcggggctgctctggacacgatccagtattcgaagcaccctccaccattgtgatagtgctgtggccaagccccaccccctttgtcttgtagttgcatcacgtagagcagcagggcttctatagataggcccagtgtcttggcattcttgtagaatcttcaggtgggaatgtgtgatgccttttcaggcaataggaaagtgcatgaggagagttttgaatgtgcatatgctgacgcctgagaacagacccaggtacccgtggctgagctgagcttcctctgctttccctaggcctggcctctgcagggaactgcagcacacactgcactcccacctgctcttgccgccagcattgcaccagcagtccagaattcctgcctgacaacccgtgtttcctttattaaaagtgattagtacaactgctagttattttcaacaaataaagccattatgttaagaggggactgtccatagtgagtgaaaggtggcaggcaggggcctacagctcctagggaatggagaattcatgtgaagccgaatgaaggatcttatcttatactgtccccctttctaatggccactctttagtgtttgtgtctaatgttaatgcttaaagcacaggacccccatgtagcttcctctgacttggtttgtaagtaacctgtaataaaatggcatatgcactttaaccagccctgtgatccgtacgagtgtagcagcaagaggactctgttgacaggcacgtttattgttgggttatttgttccagagcaccccagtctgtgacaaggaggactggcattgagggacacagaacagtgaaggctacaggtcatcatcaaagtcctctccggttgtaaagaggttgtgcagttgcaagggtggagccttctgggtcccttgagccaaaggcctaccatctgctcgaggagtccccatgtcccttggctgctctcgggtcttcctgtcaggtctgtccagttgtggggtggtagtgtgaatggcttgaggaggcctaatggcaggggctctgctgaagtggccttccactggagtcttgttctcaacagtcccttgtgccaggtcagctagcatggtggcctcctgcagaggacttggtttctcatccacttgaggactatttccaggtgccaggagaaaccgtgcccatttagaagatggggcattaacttgtgtaacaggacttgg

SEQ ID NO: 19809 - DNA, 1172 bp, Mus musculus
tcccagggaccccagccctgccctgtcttcttggtccacacgtgcccaaagtctgcccactgggtttgttgtgagacattccacagggtccccacagggctgaaggaacagggttagtggtactccccactcagagcccttccctgacttcctctctcagggaagatgttcaagtcactggatctgagcctgattgtggagttcatcctcatgttctaccgggacaagcccatagactggctcctggaccacatcctgtgggtgaaagtctgcaaccctgagaaggatgcggtgagcaggggacacttgaagtcagcacagggaaggaaggcaggtccccagctgccagctcacactgtgttcctggctgtgcctctatagcaaggagaggaaactgctggctgaggaaatccccccctcctccccggttatcttgagcccaaccttgagtgtgggctgagccgaaccctaaggcgccaatctgttcacagaaacattgtgatcggcagaaggccaaccttcggatccgcttcaagccgtcccttttccagcatgtgggcactcactcatcactggcgggcaaaatccagaaactgaaggtggggtgtggcgcggtgtggaccgaacgtggtggaggcaggactggagggtggcactcatgtctgttgtacctccccaggataaagactttggaaagcatgctctccggaaggagcacgtgaacccaccggcagaggtgagcacaagcctcaagacgtaccagcatttcaccctggagaaggcctacttgcgggaggatttcttctgggccttcacacctgccgcaggagactttatccggttccgcttcttccagccactgcgccttgagcggtcagtactccctgggaaagaggacagggtgaacaccaattagaggcctcagcatatagtcctgggtctttaggtactccttctataacccctgaggtaactatttgccccatcttaaccccccatgcctcggtttccttactgaacagcactacccataatagtacttcctaccttgtgtggacctaggcaggtagatctttaatacttaatgacacttgttaccacagtcacagggtaagaccctggcttccttgcactgcccatggactgtccaagatggcgcctcacctctccca

SEQ ID NO: 19810 - DNA, 1148 bp, Mus musculus
ctttgccctttagaacccccagtcagagaaggaggcccttcaggaaggccgctcagccactctccggtaccctaggagcccagatggatacctccagattggtgagtagggcgggcctgtgtgggctgggcttttgggtgttgctttcgtgtttacatctaggcaccgcgctcccacaggctccttctacaagggtgtagctgaaggagaagtggatcctgcctttggccccctggaagcactacgtctctccattcagactgactccccggtgtgggtcattttgagtgaggtaagatcagctgggatgggactaagcatctagaccataagaagtcccaagactcctgctcatcctaagcccgactcttccagatctttctgaaaaaggccgactagaaggcttccaagggtgctctgtggccggctctggagcccacggttccgagggtgtcgctgctactgctgctgctgccccagaggaccaggcatatccaccccacctggagggttctgcctggcaggcggctcgggctggcctggggttcaccgctggcccggaggccccagaagctggtgctgctcctgcccgccgggccgcgggagaggcaggcggccccccacactgtgcctgagggccggcctgctgccgcccaaaaagaactgaaccgaaccgtttgcccctggccggtggtcttgagccgggccgttagaagagctttttcttgggtgcccgccgtgtgcggcgcaaacactggaatgcatacactactttatgtgctgtgttttttattcttggatacatttgattttttcacgtaagttcgcatatacttctataagagcgtgacttgtaataaagggttaatgaagtatgtgtctcataggtgaatgttcccagttctagccaggcgtttgcatgttgcctgcctgtatttggcctatcattttgggttcccaaaacttgctggtggtggggatagggagggggaaggctggctcacctgtgctgcgagactattacccacaattggctggctcctggcaggttacttggtgaagatgactttgacctctgtcatgccaaggactaagtcccagaccctcctttaccatgtcaagtgtctgttggcatacctcaacgtaac

SEQ ID NO: 19811 - DNA, 1214 bp, Mus musculus
atctctttccatgggtcccctgtggccgatcgccgcctcccaccctttgagcggcgttggggagcgaccctcccctgcagtgctttcccggaagtccggccagagttacctgagttgcgctgagcgcgcgtatccctggaaatagcggaggcgcgcgaacaggtagaacagtccgcacagggctgcggctcctgcgagagtcgatgcaaggcgacgcggtgagcacgagctcccgccatccgggatcacccccacccccgaagtgtgcccccacgctgccccgcaccttcgtggaagaagatgccggcgacccagagtgtggcgaggaacagcggaaagtactcgctgcagtttaccctgcgaggggtaggctgggtgagcgcgtggttcaccttggctgacacccgaacccgcccggacccgccgcgctcactgggctcggaagacgcgctcgaactcgggagggccagaggtgagcggcggcgacacgtggaaagcccttcgtgcagagatcacctgtagggagaagtaggctgcggccgtgggggtgtgggagtcaggtgtggtgctccgcagatctggagcgggatccgtcccttagttcccctctccttgcctctcactgagcgactctcttctaatgcccttctcccacctgccccatcagtggtgttcaatggagaggccctgtaggcctgagggttgattgactagggtgatgcgcggctgaaacacctgccggtgggaggaaccttagaagactttactcctgaacgatttgacttgcaaagcacaggcaaatgcctacctcccgttctgcaggtctggaccccctgcgtaggcaatggaccagggcaaaattggctgtattctttaaggaacaaggaagcacacgttctgtggctaagggaccctggtttcccctctacagaatcagccagaagggactctgccacaagccagagtcagtctagcttgggtctcagtaccaccacacaatagcataaattcttgtctcagtttctgtttagacatcatggacccagccttaaatctggcagatactgtgctccagatgcgtggagttgggactctcccaacctaagcccatagctattccactagtcactgtattgcactcccaaacagataccagctcccaccacaaggcaggcacctcaagtggcccctcagcagggtggccatccttcacc

SEQ ID NO: 19812 - DNA, 1107 bp, Mus musculus
gaaagacaagagctatgcatagcacaaccaatggagtcccagattactaacctagttcctatgcttgctttccttgagggggagaagcagagctactttcaccacggtgctcaagaaacaaagacagggtgtgggagagcagcactctcttccagaggacccacattcaattctcaaacccacatcggagcttagaaccatctgtaactcttcttccagggtatatgatgctcttttctggtcatcaggcatacacatggtgcacagacacacatgcagataaaacacatatgaagaataaaataaaattaattatctttaaaaggaagcaaagatataggtagagttggggacctcttcaaggtcacattccactgatgtcacttcctcccactaggatcctcctcctccagttctgccacctcccagttgtaccgtacgctatcgaccaacctttagcataggctgggggggttgggggagggggaggatttacgatccaaacgttaacagtaattttgccttttgcattcaagcctgtagctcacaaggactttgcttatgtgtcaggttgaggttgcatttttcccccctaaattttgagcaaaggcttgtgggtggggtggggtggaagtggacacttggaatcgtttgtttagattgaatgtgtgtgaatgtttcagctgcatgtatgtatgtgcaccacacacatccttggcgcctgtggcctgagctgggagtcagatcccctgtaagtggacttgtagagatggtttagagatgctatgtaggtgctgggaatcaaatctgggtcttctgcaaggtcaccaaatgctcccagcagcagctggggctggacatggaacatcgtacatttcccgcaagtgctctaccctgacctgaacccccagcctacaaaagacttaaaaacataattctaagcttaaaatgtgtaagaacgtgacaaagaattgcagtctccctttaaccggagttcttatcttcctaccacagttgacacccaccctgtcccccatctccaggtatgttcttgcaaacatcccccccccctccccgaccattttaggataatttggaggcaaaatg

SEQ ID NO: 19813 - DNA, 1863 bp, Mus musculus
cttgtctgccactcactcttgaggacactgggcccccatggaatccctccatgccctagcatggctaaatgctgaaggtggaggttcagcatgtctgacaacccggatgtacaccgtagaagtgccattcagttgtacacacatctttcctcctccacatcatccccacgacccttctaactcctggcctcttccagccaaaacgggaaaagtggctgacttcactgcattagaagaggaaaagtccaactccttagggagtctgagcctggcacgggcttggggaaagaaggctgcaggcagcctgccgtctaggcatcactttattttttatcctccagacttctgctcctcccacagctgatgacttgcacttttaaagtggttttataacactaacccgtccttgctaaagattgaagtaggttctcttaaaaggtctattgatggacatgtctgagcagagaaaccgtggaatagaatatggtgcgtgggctgctaacagcaagagggagcacttgtcttcatcacaagcaagatgatgagcacagagtgagacctttaacaggatggcggagggaaaggtgtttgctggagtgacttccgtgcagagtggtctatagagaaactacagctctgcccattgtcctggggtcctggaacttcgtccagtgttaagaactgagccaaggagaagcacgagcagccttcgcacctggagggtcagaacgtgcacacactgctaactagtttgcaccggcagtgcctttttcactgagggcacctgtgctctcaggtccttgtccctcatagccatttctcctgccatgtccccccctcccccagcccccagaaactcagttcagctctcagagaagcaggtgaatcataaagtcagtgaagacgccgccctctgattctccccactgtagggggaaggaagggagtgacttcagtgggttctctaccaaaaacagggctaagggctggagatggatccccgttccttgtccagcctcctgctaccgctgcccacctcctgcctccattgcccaggccacactagttggccccagcactctaccttaggcccaggctggccacaggcagtgggcagctcacttgctgcagtgtcatagcaataaaatgtgattcttggggtctgcccagagctgcccatggctttatttatgagtgtggctttgaggagttgggaagaggtaacccacttctctcccatcttctccgagccatgactcaagaagaaaagggtgctcggactctcttatacacatgtgctttgtgtaaataaatgtttacaattttatattgaagatggaataagtgttagagcgtccaactgtatattttttacttttatagattttaaaactgatcctttatatgtgtttggagctatgataagttttatggcaagcagttggtattgttaactttttatgatcatcaaaagtacataaaagtcctattaatccccttactctgcttcccttagctctggtatacaccaaaaagaaatctttactttccttgtgttataaaaataataaaaatattttactagtatggaaatcacaagcatgtttgacttcagtgggacatttgacagctgtcaatttctctgattagcttcactctcttcctgcatgtcttgtgggggctcccttgctggtggcaatgaaggcagagagcaccactggcatgctacaaaagagcagtcctctcactgtggtcagacaagacagatggggaacaacacattctaggcctccaggaagtcaaagtgggactggagagctggggccgatacaaagcaatggtgcactggaaaaaaataattag

SEQ ID NO: 19814 - DNA, 2637 bp, Mus musculus
acatatgatggcccacagctatctgtaattccaatccctggggttctgatgccctcttctggctctgagctcatcaggcatgcacagggtagagatacagatccaggcaaatgcaaattaaataaaagtaaaatcctccaccacagtttttaaaaagttaataggtttagggaaagtacatgttttctgaaaagaaagactaaaatcgaatacctataattccagtacctttccaccaattgaatgacttagtttaaatggttgtggaatttggcaacatttgtttttttaaatacactaacttttatgacttctcttttcaactaataggaggatgaaattttgaacagatcgccaagaaacagaaagccacgaagagagtgaaacaatctttaagaacttgatctgtgatttcctctccctccccttcccctgcaaatgtggtcctaggagagggcctggtgtaccttaggtgggagctcaaaacctcaagatgtcaccatcaacaggttccagtgaatactagcctgtaattttaaacatctagcagtaaataattgcagttgtaatgtaaaggaccctgtttctgtagaaaggaaaacatttaacataatggttgtgaaatgtaacatgaagcaactaactagtgttttgttgtttttaaaattttccaggtttgtctttttttttttccttttccttttttttttttttttagatacaatgatagaatttttgccagtttaaaatcttggcttaatttaatatattcatttgttcatgcagaaataacaccaacattaggaatgctagggagaatgaattgccgtttttataataacttttttaagtttggtattaaagcattcatgtgtctgtcctaaaattgtaatcacgttcaagtgcagttatttgtggttataaatcttgttttgtgtgcttccattagttaattcctcttaaagacacaagagcgattggatggaagcccaaatttatatcaaagttccctttacattgtattgaatagacccaaaaagaactaaaaggagactttgacttggtcatttcacatcagatcataaagtgcagtgttctgttgccctagagactgctccattcacaagcacctttgaagagggaaggagctggcttcatgtagcagttcatactgtacttcccacataggaggtctgacagctcgggtcctctggagcacaaggctttttaaggaatgctggtggtgcctgggtagataattacatcacttgttccactgtgttgacactgttttcctcatggatctcctccattcctagctttctctgctatgcattttcttcacagcgcagcttgcggtccgttgctgaaaattataagctctgcatagtgttggctttactgtgatgacatgtttcttcttttttagctggcccacacctttctagggtccaactacaggatagattacagactttccattagtgtctatttcttttactctgtgtagactttagaaagtctaatcaatccagagatgggccaattcagaattgactataattgaacacctgctaaaagtatttatgggaggattgacacacagcatgagttatttgacttttgtaggatatttaaaatcttcatttgcagttcatgtaacagttgtgtcttaaaattcacataataaagcagtcctgttcaaaaaaaaaattttttttttgtggcttgtagaattttttaaaagtgtatttagggctttttgttttttgtttgtttttttgttttgtttttcatgtggaatgcagatgggtgctagaggagcctctcccacatcactatagtgtaatattattacaccacactgaaatgtattcagaaacagatgtttcaatttcattctttctccagaggtggtccagttgtaccaatgatactattccttgcactgaatatatataaacactcttcagtgtttatattggggaaatactgggaaagaaatatatttgttaaggatgaaggctgtatctgttgtctttataaacactggttcatttcttttgagggtggaatgcatttttcttcctgttcagtgctttatcaccatctgttgtttgtggtcacagtgaccatagctatgtagcggacgtttccaaatgtatagagtgaaataaacagttactagcaagaaatgaatacatgtctgcaggtttctccttgaagcaaacatggggatgattgcttttctagaaatcggtttatctgtttcatcattctacattgacattgttttgtgcctactttatattcacccaggctgtacaatgacaggtttatttatgtcactggtggtggtcattgcctttttgggtccctcttcctccctcaaggttccattgaagctccagcctccttaaatacctgactcgttagtaaatgatcagcagtcttcagctcttaaaaaaagcgtagagggcaggtattgtagctgagtaggtagaactgctaagcgtgtgcaaggttccgtgggtctgattcctggcactgaattaagatagataaaggcccttatattctgattttctatgctggactccttgttgtaaaatgtccatgccagtagtactcttctat

SEQ ID NO: 19815 - DNA, 1145 bp, Mus musculus
ttctattcttatttatctatgactccttccctgcctacactctctcaaacaaaacatcctcaaactgtgcttttaggttctacagcctcagtgtttttcttattcagaccttgtttcatgctgtctccactaacttaggattctatttaaattatttacactttgtcagatccaaagttgtctttctagctttaccctcactactcactgttggagtctatgagtcagcttgtcaagcttagcctgtgcctcctgaccaagtcctagtgcttgttctggttttcatgatacccctcccccttaacttccctctcaatctccctcccatggggcaaatgtgtagagttagaacaatgtctttcacatgtctgcataactgccctctacacaaccttggatagaattttgcctgtaaacattcaggaattgaggggtaatatatttgttacaacataatcatggctcctacacttggcaatatttcagaaacagtccaatgctatggagtacaagaagacggatgctccccagccagatgtgaaggatgaagaagggaaggaagaagagaagaacaagagggatgaagaggaagaagaggagaagcttggtgagcggagtctagaaacctgtcataaaccctgactaacaaaacaagctatagtagattgttcttaaatgatgatataattattgtcagaacttttatgtgaagatctgttcagtagatttattttctgtcttagaagagaaacagaagagtgatgctgaagaagatggtgttactggcagtcaagatgaggaagatagcaagcctaaagcagaggtaagggagggataataaatacttcaggcaacaaagctgacagcgtaaacagtcctgtgacacttatatctcctcactgtcccctcaaaggtatttcttgaataccactgcattttaaactatttttggtttttcaagacagggcttctctgtgtagcccatcgtggcctggaactcagaggtctgcatgcctttgcctcccaaactttttgagacaggctttcatgtagtctacactatcctttcattctgtgtagtcaagggtaatatttattgatcctgtaatctttctgcctccattcctagtatgtgctcatacagg

SEQ ID NO: 19816 - DNA, 1224 bp, Mus musculus
aacatttagctattcggttggccaccaccaattgtgttttgttgaggattagtattgagactgaatccagtgtctcatgcatattaggtgtaagtgctgtgtttctggcctacatccctagcccattttttaaaatcacttctggggaatgggaaatggctttactgactacattccaccatcacttgttgagggtggagtgagctacgcaggaccaggtgttggttcagaataagatcctgcagattggagactgaatttggtagaagtcaagaattcagtataaaaacattactagcatttattgttctgtgcttgtttaaatttggcagttaatgtttatcttctttgatcatataaaatgagtcttacatagattttctttttttgttattatctgaaatgatgttttgaaacttcttttgtctctgcctcacccccaacctactcccctctccaaatcacaaactagggaatctggaaaccaaggaaaataccaaatccagatttctttgaagacctagaaccttttaagatgactcctttcagtgctattggtttggagctctggtccatgacatccgacatcttttttgacaactttatcattagtggtgaccgaagagtagttgatgattgggccaatgatgggtggggcctgaagaaagctgctgatggggctgctgaggttagtgattgttcattaattgtggatttatatccacttttgggggagactgattactttataaaaagcagatttttagtgtttatctttttacttattcagtgtcaaaatatataattgttagactcctattctggctttccaatcctgttatatgtatgtgtatatttgtatctgtttatcattttattttattttattttgtcttcaagacagtttttctgtgtagccctagctgtcttagaacttgctctgtagactgggagggctcaaactcacagggacctacctgcctctgcctccagtgtttcaattaaagttatgtgttattgcacctggcttaagtatgttttaatgcactgaaaatgctgaatcttggttggaattgtgtggaattttcaaataactaatggtgttgttgagttgcgatttggatggccagaaaactggcagaaagataattcttctgtttcctgagtaaggaactttttgcagttattacaagccacagtttgcacctatgcaggtgaaacttc

SEQ ID NO: 19817 - DNA, 1201 bp, Mus musculus
taacttattttattattttttgatagcacttcacagttcagacaggcctttaattcagggttttcctgtctcagtcacccaagtactaactagtacaggtatgcaccagaatactcggtttacatggtatacttagatatgcttttgaatgttgcttttaagtgactgaatctaggaaaatcttttcatctcccagggttcactttcccttttgtataggttgaaaatgcatttgttgttgttgttctgtgatttgaaaccctgattaacaaggaacagactaaggttagtggttttatggaatttaaaatgggaaacagtacatttcacattccattctttatttttctttttctttttttggttttttgagacagggtttctctgtgcagtcctggctctcctggaactcactctgtagaccaggctggcctcgaactcagaaatcctgtgccttccaaatgctgggattacaggcatgcgccagcactgcccggcttcacattccattctttttgcagatagatcatggaagggaagtggttactgtgtttgctgctggtccttggaactgcagctgttgaggctcatgatggacatgatgatgacgcgattgatattgaagatgatcttgatgatgttattgaagaggtagaagattcaaaatctaaatcagatgccagcactcctccatctccaaaggtttgaagcagatcagtccttttctttttgcttttatgagacagggtatcttggctgtctttgaactcactatgtagaccaggctatcttggaactcaaagatctacctgctgggctagagaggtgactcagcgggtaagagtactgactgctcttccagaggtcctgggttcaattcccagcaaccacatgatggctcacaaccatctgtacagctatagtgtactcatatacataaaataaataaataaatctaaaaaaaaaaaaagatctacctgcttataccttctgagtgggggattaaaggtgtatgtaaccattctcagcttaaagtagatccttttatcttttggtttaaaaaaagaaaaattaagccagaggctggggatatatagttacttgcctatttcttaggcactcctccaccccaccccaaaaaggggattgtttttaaaggcaaagcagcttttaaaaaaaaatacttgctaagctttctgac

SEQ ID NO: 19818 - DNA, 1462 bp, Mus musculus
ctcctgagctcagggcgatgactccgcaggaaaggcggtgtctgctacccagagggatttcactcactgcgcaagcacaccgcccgacctctcaccatttgtgatgaaggccataggtcccaggcggggttgggacagagttcctaactcaatgggtcggaaagccgtcttctggatgtccaacacacccgccctgagggactagggcgacccacgcgagaacgcgtgccagatccgtccgccctccgcggcgcgcgcccgcccgtttggtgacggcccgccttcctccttcatacccaatcagcaaccacttcctgcctcgctattgaccaatcaccacgctccacgaagaatagccctagggggcgtatgggaaggcgcttcgagcgatggctgtatctaccaataaattcttagatcttgcgcaaaggggcgggatctgacgttcgttttagccactcaggaacgaggggcggacgcggggttgggcttcgtgcggtggggctcgctcgcgcggcggccgtagccgaggcctcttagttctgcggcacgtgacggtcgggccgcctctgccgctgtctccactgcagcacggggccgggtgtgcgggtgggagaaggtgagggagccgccagtggtccccgggaggctcgaggtgagacgggaagcgtgtgcggggatctcaggcccgggacgagccttgggggactgggcgagcggcgccgtggcggagggggtcgggcgtggctgtaggctcgacgactgaggggtcgggcgggctttcgaatggcgcaggcctgggcggacgcgcagggcagtgaggagagcggccgggttagagaggctagcctgggcagcgccgccggggtcgggaggcgtggcaggtgtcctggggtttcccttgacctctgagaaagctaacaacttcctacggctttgcttctagagctttcttaggccctggccaggcccacccagaggtgggctgagtaatccggtacaggtgtggtattagaattcggcctagtaggtagcccaaatagcagggaaaggtgaagtaaatccagagataagcgttacagattagaaaataacttgcccaaagggaagactggaccatagcatcctgatgagggagtagaatgtactagaacgtgtaccgcttgagaaacttaaggcttaactattaaagcacctgcctattcggtggtggatagatagtaatccagtgtgggtgttcacaggaccttaagagcaggagatacaagcgaaagttcagttagtgaggggaggaaactgaggcctagaagtttgaaatgactggcccaaggtcatacaggtagttctagtcatccagttgggattgtaactgagcactagaccgtttgggttaaaagtcctggttcaagcacctaactgcaattaatcgggggagtgggaatttgggagattttttttttct

SEQ ID NO: 19819 - DNA, 1192 bp, Mus musculus
tgcgcaggcgcccgcttatcatttctcctcagccacgccgaggctttttgtggaggtgagtgactttccgtcttcgactgctgcccgagctctccacggacacctctttgggtgacgattgcttgtcgctgagcttaggttctaacctgaggggccgtggcaggcgcaggctgcccctgggagccgcgagtgtctcgccggcgtggcagcgccgcctaggcctgcaggccgcgccgctttctattgtgtgagatgtctgaggaggcggagcggaagcggcggccgccatttcctcgtctcaaccgtggctgtgggccagggtcttattagcttggcgcctcggccctgggcgcactgggcggctttgggcatcgggtcgctagccgaggccgggttgcatgcttgagtctccggggcccaggcatcctgacgggcgggactcgcatggcggcgcccggtgcccgctgtgcgccgtgaagtgggagggccatttaaatgcctgttttctcagacgcgttcctgacccccacccccaccccgcagccccgcaatctgtgtggacgccaggaccaccgaagggacgatgatgctgggagcagaaggcggagagggcttcgtggtgaaggtccggggcttgccctggtcctgctccgcggatgaagtgcagcgctttttttctggtgagttgaggcgggagttgtcagtggggcccgcggctgggccgggccgggccgggttggggcggggcgggtctcccgggcgccccctagcgagtcgcggccaccagcggtttccccaggcggctcgcgctctgttggccgctgttacgcaatggtaattgcgaaatccgcaccccccccaacccccttggggatgctggtggccctgctgaatttgttttcttttaaaactttttctgtctctatgcatcaatctgtgcattctggagtagtctaagaaaaatttaagtagggaaagatgtgatttcttctcaagtcgtgtaaggttttgtaaaaaggtacttgtagtgttgaccttaccatctgaatttagctgtggtaacagaaaacgatctgtaaatcgagccccaagtatactgcaagcaattgcagggggccgttgccgtccgggtttgagttgaactgcagcttggagcctttagttgttaacattggtcccttttcggatgaat

SEQ ID NO: 19820 - DNA, 1291 bp, Mus musculus
ctttaaacttaaatttccacgttgatcctgaagaatccacttaatggtagcacaagagtctggcaagttggtactgcagagaaaagggtttaattgagatttgtttggagtcgggattccctttcccagacagcatctcaccacttggacagcagccatttgcactcgtatactttttaaattttttcttggaatgctattttattttactgattatttagcatcattcctaacttgtcaaatggatctctttacaggtagccaaggagcagtgaacagcagctactacagtaatggaagccgagcatctatgggcgtgaatggaatgggagggatgtctagcatgtctagtatgagtggtggatggggaatgtaattgattttgatcactgactcttggtcaaaaagaaattttttaaaaaacccctcagtttaacagattttgcaatccatccagccttgtggttttatgcctgctcttaagtgaacattggcgtcgctcaaagaaggctcaatgttgagcatagcagtcacctaggatgatagagcaaagctgagtgaactgtaactgttaaacttaattcctagcttttctctagttactgtaggatgtacgtaagcagtaagtgtatttaggttaaagcagttgaattatgttaaatgttgctcttatacatacattgaacactgttgatgcatgttgaaaaacatgcttttttgtaaaactataggagctgcgtctacaattaaagtgatacatttggcatgtttgttaattctaaatttatttgataacctgtaaggcacgtgagtttaaagctctttttttttatttttaagttaatggagaagttttgagagacaataccattattttttaggatttttggtcttagtgtttgtatgaaattctgaggccttgatttaagtctttcattgtattgtgatttctttttaggtgtattgcgctaagtgaaccttgtcaaataaatcttccttttaaaagctacactctgtctgtgctttagtgtcctgtgaacttgatgttttatttctgccaggtctacctttcttgctaggacaggctggctaggctagctaaagttgctgttcagatgtctttagacttccagtggggcccttgcagaagggttgttttggcctggctgatcatctgaatggtctataacatactctacatgtgcatgaggcttacaagtgccaacattcaacactggctccagcatgggtgaaacatgtgccagagcaaaggtgcaaggcagcttatctg

SEQ ID NO: 19821 - DNA, 1193 bp, Mus musculus
aaaacttcactaaactgttacaccgtttaactaaactgttacactgtgtaactcgttataacactctgttgagttatccacatgtggcagaaaatgcagtgtgagggatccaaagggagtctttcccaccagaaactgttgaactgttgtaaagaaacttaactaaattgttacacagtttaactaaactgttacaccgtttaactaaattgttacaccttgtaactccttatgaaactctgttgagttatccacatgtggtaagccacaagcctatcactaaagaggcagaagcaggaggatcacaagttcaagtcctgcctgaggtacatagtgagccactgttgcacagccatacagaatgtattggcctgatggcatccttcatctttcaggttattatagccctaagatccagcatgtttaaagagtagaaaattatccttttgttgttgttgttaagtttgtgacatgatttgaaatgtattgtcccaaggtcactttccaacagtgagtcgttcttggtgttcttgtttgattcagataacaaaacaggacaccaaggttgaactggagacttataagcagacccggcagggcctggatgaaatgtacagcgatgtgtggaaacagctgaaggaggagaagaaagtccgactggtgagccccagggccttaggaagagtctgtcaactgccctccagatgaaacctgtctacactccacatgcatgcgcacacctgctggcgctcctagaaagccggaaattgccctttttagcttaccctgcaattctgtcatcatttgtgttggtccccattgtctgagtcttccctagaggctgctgggaggccagctctggctccactgtcacaggctcgggcccccttgtctccacgatgtgcattgggagccacaggtccttttccaacctagttcttctgtgtgctttcttgagttgacttcctggaatgcattggggacactgtgtcctgaggtaccaggacagaaagagccatttcagaatcgtggtacctgttccatgatcaagtccaaagtattcagaaactgtagtcttattccctgaggtctcctggtactcagtcacaagctaagcgatcctgcaggccatgggttctgttttctagtttgagacgacctggcttctagaactcgaggctcatgttgccaag

SEQ ID NO: 19822 - DNA, 1194 bp, Mus musculus
cttctataactacttaaattctcaaagccagcgacagcccagatggaggtatcgctttggtatgtttccgtgtgtggttgcctttttattacacagcttttaatattttttttccttgtagtgctgacgactgaatccagggccttgtgcatgctcaggaggtgctctcccactgagctgtgtctgcagcccttaggatttcagtataaagttgcagatgaatattttatattagacaatctactcattaccttaatattttataactaccctagacctagttccttttatctttgacttatcccactggtttgtcactttagaattactccaggagcattaatcagacccttctgtctgagcaaaatattagaattaagcaggcattcagcacttaattgacttcttttgtctcatcagtagttgtatgtgtttaaatgtatttgcaggaaaaataagacttgaagggagcctctgagtgtcttcttgtccctagtgagcatgctcagtgcccagtgtttgattcacaaatgccatttgcctccagagggactcaggcctcctggaagaagtgaacagtggcacgtttgcagtgagaggggaaggcaagtgcacagagaggatagttctgtgttaggacatcattttagggttattgatatgagtagacacagggactaacttgaaggtgcatcctttgatcaaactttaagacacttcaaacaaaatactcatgacagggttggatataatattttctaaaggttatggggggaaaagctttttataacatttgaagaaaagcatcctttaaatatatacaaagcaataacaaaagccttttagcaactgtcattgtcattaaatctagcaaaaagttgattgatggtaaagcctatttcatgaaagacaattaaggaacatttcctcatcccgagagtacagctctgagtcgcaagagacacatctgctttcatcctgagatctggcaggcagaagtcccctcctgagcagcagccactgtagcttctcatgaggccgcagaagcacattttactatttatgacatactgccaaaaccagttagcgagcatctatggaaatctcttctctagacatacctttctgcttacaaagaattgagagtaacatgttagattatatggtaatctagagtttgagacattggagatg

SEQ ID NO: 19823 - DNA, 1160 bp, Mus musculus
gggaaatctgatttgggcatcacaaaattcacattgaatggacaatgtgatagtgattaactggacagccaaaaaatctgattcacccagttctaaccgcccatgagccctttatctagtaatgagagatttggaatatacaaagtctgtaggatctatattatccaaaatgcccaacacgaagattcagtgaatttttttttgctgttgtatttgctatggagatgcttttatttcatagtatttttggggtgttttaggttaaagttttctacctctgactcttactgtccttcaaatccctgaattactaactcttaaaatgtaagctagttgctactgggtggcagataaattgtgcatattttaatgccatagcatgctgttttgagttctcagctaatagtcattaaactgttgttaaataaatttactctatttagatgacaatgtgacttaaatataatctctaattatctaggaatcaaatacatatctttgtgtcttattggagagtcatagaaatttaaatacagatgaattgaacactaattgtgctggacagtattatgtcaacttgattgtcaactaaagtcatctaagaagagggaatctcaattaagaaaatgcctttataagattgggccataggcatacctacagggcattttcctaattagtgattgataggggaggatccagccatttgtgggtggtgccatcccttggctgatggtcctgagttctatacagaaagcaggctgagcaagcagcactcctcatggcatcagctcctgcctctaggttcctgccttgtttagttcctgtcctgactttctttggtgatgaaaagtgatatagacatgtaagccaaataaaccttttcctccacgagttgccttggtcatggtatttcctcacagcaatagaaaccctaagacactaatagacataggaattcacaaattaataaaacatttgcaattctaaacctactcagaaccaccactggaatagtttatacagcatgataatattaggattattaagcacctattgactgagtcctaagagataaatatgtgggaaaatccctgcaggctttctggatggcagggacggtttagtccaagaagagacaaggcatcattcataacgat

SEQ ID NO: 19824 - DNA, 1158 bp, Mus musculus
cagtcagttatgaaaggatctacctatgctttaaagaacatgctaatagacagaagagggacatgggctcttaagcccatgtggtggtttgaatgaaaatggcccccataggctcataggggttggtagtattgggaggtgtggccctgttggagtaggtctggccttagagcaagtgtgtcactcaggcatgggctttggggtttcagatgctcaagtcaggcccagtctctctcttcctgtgcctgggaaaccagatgtagaactctcagcctcctctccagcaccatgtctacttgtgtacaaccatgcttccttcccatcataatgattatggattaaacctctgaactgtaatccagctcaaattaaatattttcctttataagaattgccacagtcatggtatctcttcacagcaataaaaccctaactaagacacacagataaacttttcttcccctacactatatcaggactgtgcttattgccacattaaggtaactagcacactgaactggtgataagacacatggagtttgatgaaaattggttctaggtttgtggcaggaatgtggaagagtttgaaggttcatgttagagaagcctgagaatgtcatcaatgtctttctttatatataatttatttatttatgtatttaatatttattactttttttctgtgcattgctgttttgcctgtctgtatatttgtatgagggtgtcaggacccctggagctggagttacagatggttgtgaaccactatgtgggtgctggaatattaagcccaggtcctttggaagagtagttggttctcttaaccactgagtcacccccttgtcccccatcattaatgtcttaatgggacattctggtgaggatgcagaatactgtaattccagtagtcatctagacagtaagcactgtgctaatgagacgtcacatgagaacggagactctatataaactgggaagagaagccatgttgcattatgacaaagggcttgtgtatattctgcacgtgtcctgaaactttgatggaggtttccagttcaaaagccatgaagctgctggatgaacttcgaaggcaacgtagccttcaggctgtagcatggttaccgcagactacttttaaccaggttgacattgagaatt

SEQ ID NO: 19825 - DNA, 1236 bp, Mus musculus
tttttctcttgtaggaaacgcaagtatttccaccataaccagctagattgggacgagcatagttcagctgggagatatgttaggagacgctgcaagccgttaaaggtaaagaaaaaaagataaatgattaagtaacatcttcagccatgtcttcatttaacaaggccatccctcacctctaggaatttatgctgtgtcatgacgaagagcatgagaagctgtttgacctggttcgaagaatgttggagtatgacccagcgagaaggatcaccttggatgaagcattgcagcaccctttctttgacttattaaaaaggaaatgagtgggagtcaggggtcttctgtgtacttctctaggagcagttacttccagactgtgtcagtcaactaaaccttctaatatttttgtaaacattaaattattttgtacagttaagtgtaaatactgtatgttttgtatcaatagcataactaccttgttaagtatggtgttgataatgaatgcaatacaagagttacaatgaattttccttttgatgttaattgccactttaaaggcttttagaatgccctttgtgtccagtgataaacgtgattggtcccatcttttgtacatgaaggttgactctgaagtgatttttttttttcctcaagtaaaaggaaatcttgaccactttgtgattgagtattctttatacaccttagatgtagaacttttcatgacaaaggtgggtttgggttttttgtttttggattttttttgtaattgataattgaacagccagcattctgggtgggcagattttaaaacccaaaactcaaaaaaattagcttggtaaagtttcattaaattttaagttttctgttcttttgggtgatatccatgggccctcgtgaaaagacatcccattagtccatgacagagtttaatcaggcaaaaatcttaattttatattacacacagatttgagctgtatctgtctatatttcaaaccacaaattatgtggagctttcttctgcgtaacaagtagtaaagccaggctttcctcttgctgtcttagaggcagttttcccagtatagcaaggctaggaacttcctgaagactatatatatatagctgcatgtcctaagagttctacataaagaatatctagatgtctcatgcagttcacatgtcagcatatgccaccttcaggacaattggggtgtgagaacatttctgaaggcgctgttt

SEQ ID NO: 19826 - DNA, 1084 bp, Mus musculus
tttatgaactctgtttgtcttcctgggtcttcaacttagccaggtagcaagatacctagagagaactggtctagccctgtctccttgcctctagacaccaggcatgtcagtggtacatgggtaaacccccctcccaaatcttttgaaaagctaaacaagccaatggacaatggtttggggatttgacagtgttggcacatgccttcaatacctgcactcagaaaggagatgcttttggatctctgattttgaggccagcctggtctgcagatttaattcctgaatgacagctaaggctacacagagaaaccctgtcttaaaagggaaagaagtaggacctagtgaggggcaagcatttaatgtcggcaacattcaagaggcagaggcaggtggctggtccacataggtccagcccaaacagtttttagtgagaccctgtttcaaaatgtgtgtgtgcatatattccatatgggtgcagaaatgaaatgccaacctaaccttggatgtggatgttaacaggagacatccatcttggttttggggacaatctctcactaggacctcgggctatacttagagactatgctggctgtgtagcaagcccaggaacccagtcactgccttccttgttctgagattacaggcctgtgccacaaagcttggcttttttttgttttttttgtttttttaatatgggttcttggtcctcctgtttgcagggcaaactgctttatggactgaactctcttgtccttcatggatttgtttgattttgtcttttgtgtgtttgactgtgttaggaaggaggagaacaagatacaacctaagggatgtagcttagtggcagagtatttgggcgttagcactgccctgatgtattaagatgtttcttgtgattctgaaatcaaacaaaccaagggctttgtacttgctaaacatgtgctgtactactgagctacaatttgagcctacaaacatcattgtagacagataaatataaacatttccatgcattgaacaggatgttcagtgccctgaagttattcaactgtattgtaagtgcctcacagccaggttagtaaga

SEQ ID NO: 19827 - DNA, 2081 bp, Mus musculus
ggcaggttaggtagtgcaggggccattggcagcaggggctttggagtcagacaggcctggcacaggcactggagctactgaatgaagctctagcttagccttctcagtaaggtgtaagaagctggtgttgctgtgtagtgttaatttattctgaggatgtgtggcaagcgcctggcactgggtaaatgtatagttaaagtagtagccacaacgttgttcttattcctaggtcagggtagtacaaattacggaaagagccagcgacgtggtggtcatcagaataactacaagccatactgagaggcagcaggagcggccgagtgacgaccgcacacgctttgtttggacgcggagtgaacacaattatgtaccaaatttaacttggcaaacttttatggcctgtcccatgtgcatcttatttaaaatttcccccagaaatcactctcctgtttactattccagagctctagttgtaggcagcgtgtggcgtctcagaggccagagcggcactagggggctgattttattaccaggttaccctgttctagatcaggagggtctatttcctgttgccgctctgcagcctggacctgtggaccctggttgtaaagagtaaaactgtatcttaggaaaccagtgtcacctttttcaccttttaattttatattatttgtgtcatacatttccagtaatggaagtgttaattttactgtactttttggtaccttttgggaatctaatgtattgtaaggtattttacacgtgtcctgattttgccacgacctggatattgaagctatccaagcttttgaaataaaaatgaaaaacaaaacccccaagcctgggtaaatgtgggatgctctgtgagaccttgcccagtgttggagatgccaggtctcctgtagcaaagcagaggtcctttagttatcccatctgatctttttagctgcccttttgtgcccattgtctccatagcagagaccatcttgccatgtattatatatattccatgttcttagtttcagtcaagtacaagttgaaatgttggggatctgctgatggaggtggggccaagtctggcttacctggggggtgcttgatcctcagggtttcacaacttcttactttttcttccatgtctggaaaatgatcacagatcgtttctttttccccccaagacagggtttctctgtagccctggttaggttatcctggaactctgtagaccaggctggccttgaactcagaaatccacctggctctgcctcccaagtgctgggattaaaggcgtgcgccaccacgcctggcctaccctcagtttctaagatgcttgggatagtttagagattggcttatgtctcatcatttccctagcacagatggtccctttgtaagcccagtcaccactcactgttctgtacacatagaaccctctaagaaatgtatcaattccaaaacgcagtaggggtggctaacaagcaggaataggaagggatccttggtagcttgttttttgtctgttgggatctgagctttgtataacaaccactttggtgtatagtcatttctagttcggtagttttcttaaataaattgagggagaccttgggctgttcttgaccttgagtgatttaaaggttatggggaggatttgactctagccagccagccattttagccactcacatgtgagggtgcccctatcttgaagataaaatgaagctcctgtcattaacagtttcttttggttttttgagacaggatttctttgtttgatggcccttggctgtcttggaactttatagaccaggctgggattgaggatgtgtgccatcgctgctggggtgaacatgaaggcatcttgcattttaaaaaagataaggtgtaggtagcccaggattatcttgagcatgtgatctcccccattctacctaccaaattttgggatcataggtggtgatgcccatgtttagtcagtgcaagttgctactggttacaaaggccatcctttctgatctaatggatacttgttataagatccctggcgcatgctgggaggctctagttacacaagggctgat

SEQ ID NO: 19828 - DNA, 1104 bp, Mus musculus
acctaacctgcctcccctaggaggaagtagatagggcctccctctcctacttactgtagtcgtagccggggccgtagccgtaatagccatagggcgagtagtcgtagccgccatagcccggcccgtagccctgctggtagccgtagccctggttccagtagttgccgtagccctgattccaactctgactctgacctgtgggggggagcagggcacaggggcccatggaccatttagcacacgcaggagctaggatggaggaaatcctgccctttgggtggcggggttattactatggcaactcaaaagccaagaggctactgttctggtacagagggccctaggcccagccttataatccagaagggccaagatgccagttaacttcacttgtcaatacagaaagctttacactcactcaaatcaccctctgatcacctccgccctctgatcacttccaccctcccttggcagctttgccttgaaaaagatgcagttcaggctttggagttagaggggcctgggatggagggagctgagctaagcgcctggcacagctttgcctttctgcccacagctatgtgtgtaccaagactcaggacagccacaaagctaagcataacccagtgtcaccaccattctctcccagtgcaatgcaaatatcccattggcctggggcccccaagctgcacaaatgagaaagataaggctccttcattccatgaagccatgagccatagcagcacaagcatacagcctccacccaaggaaaccattccaaccccacttcacacccagccacccacccacacttcacagagcaccaaaggcaatccccaagacaggcacagaaagctctctgcaggcaggcaaagtcttcatccagctcccacttacctccaccactgcctcggttccctcgattgcgatttcctctgcccccagagccatactgctgttgctgatacacctctttgggctgggcaaccttgatttcacactaaaagccaagaggacactaggtcaagtcctgtggaacaagctcaggactggaagggtgggcaggaggccactaaggtgtttactcttcttttcacagaagat

SEQ ID NO: 19829 - DNA, 1224 bp, Mus musculus
aggatgccgaggtttaggagcaggctgtgctgaaggcctccgatgaccgcagcactccgtagattagagcactccaagattaggctcctttctccgggcgaccttggatttaggggacttcctccggctcattctcctcttttgggaggccggggttgctagtgtagaataggatgtagggataggatgacagactgccgtgtaccccgggcagctggggacattggacgtgctcgcccggtgaccggaaccgtagacagttctccgactcgcgcgcgttctaaaatgaggacaaagcccgcccggatctagagcgcgcgcgcagaagcagccaataagatgctaggacaatggtgagtggcggttcgctttgcccaatgagagtatccgttgttacgaggtggtgcccggcttcggcattataaagagctccacgagttggcattgtcaggcggtggcaccgcgcgggacggagttaaggtcttctttatcggcagtgtacggcggcggccgagcggagcgatagtcagtggctgcggacgagccctcgggggtgcgagcgtgaccgcggccaagcccgcgcgtcgccttctgcggcgagtagggcctcgcggcgtcatcggcggcgaggtgagcggcccggccgcgggcggtgggcgggagctcggggagcgccgcggggcctgacgcgctgtcgccgctcgttgcagtagccgctgcggcctggccgaccatgtcggacgcggctgaggagcagcccatggagacgacgggcgccaccgagaacggacacgaggccgcccccgaaggcgaggccccggtcgagcccagcgcggctgccgcggcccccgcggcctcggccgggtctgggggcgggaccacgaccgcaccgagcgggaaccagaacggcgcggagggcgaccagatcaacgccagcaagaacgaggaggacgcggggtaggtgcggccgcgggccgccgcctttgttctggggccgtcttttgttggcgccacgcggcggggggaggggcgggcggcccgcggagctgtgcctgcctggcgcgcttgccgcctggcccgggcgcggttacgcgcctcggagtttgcaggagtttgcggggtcgactgtgaggccgatctgggccgctcgcgcggtgcttgggctacttcgggcctcggggcgggcggccccggaagaggaaaagcggcggatcgcgaatcggg

SEQ ID NO: 19830 - DNA, 1101 bp, Mus musculus
aaggagttagaccataaggtgagatacaattattacctatacagtggcctacctgcatgcatgcctgcagaagagcaatagacattaggatagatggtcatgggccaccatgtggttgctgggaattgaacttaggacctctggaagagtgaccagtgctctgaactcctgagccatctttccagcctacaatatttaaaaaaataaaaattataaaaccaatcagtgatactatttgtgtgtgtgtgtgtgtgtgtgtgtgtgtgtgtgtgtgtgtgtgtgtgagagagagagagagagagagagagagagagagagagagagagagagagagggagggagatgcaccaggggttccaacctcactttatcaacactgctttaccactgactgacaactgttttcaaggtcagctttatatagagaccaggctcaaaaaaacgtgggggagagtgactggagaccttctgtgccaagcagagccatgcttgtgatgtagtcagaaggccagagcccaggaacagccgccttcccacctgcctccatgttcccaacagcctgtagatgccctcctctgcacattagagggcttggcagctctgtggctccttgaggaatggcccagagctctgccttccctcaactgtcatcccattgtcttgtagagatccaggtgatgatgggcagtctggtgtacctgcggctgggcttggagaagtcaccctactgccacctcttagacaacagccactgggcggagatctgtgagacctttactcgggatgcatgctccctcctgggactttcagtggagtccccacttagtgtcaggtacatcccagcctcctgaggtcagcataaggggacaggcagggagggcaacaagtgtgctgatccttccctgtgcttccacagacctaagctggctcaccatctttccttgagatagacactgcttgtctttacagtcagggcccatcttgcctgcacggttcccttgggaaactacactactcagtcatccagccaccctctcacaacctccctaagacagcattcccctgcatgaagagtgctgagtcactgcttcatctctgcac

SEQ ID NO: 19831 - DNA, 1177 bp, Mus musculus
catgcacccttatcactgggtcacttgtcctgtcttgtcactcccagaaaataacaagccctgagcacataggtgcccagtacagattctcccaaggtcttgaaggagttttggaaacgccatcctaacacagtacgcttgactatgctggctcctttgaattgaggcctggggacaggaagcaggagagcctttacccagtgaacagtctgggcagctctcgttttagtttttaacaccgggtcttgctctctagcctagattaatctggaagtcataatcctgcctctgcttctatagtgctgagattacagatcagatgtgcccccaccatgtctagcttctgtaaagatcaagacaatgtttaatctctatggagctcctccgttcaccttcccaaaatttgtcgcttagccatccttccatcccgggagcccagagcccatattcttttctatagcaccaacggttttgcaatgaaccacaggttttctctgtttgtttgtttgtttgtttgtttgtttgtttgtttgtttgtttgtttttgaggtagggtgtctctacatagccctggatatcctggatatcactatgtagacctgtttggcctcagactcagagattcacctgcctccacctccctagtgttgggactaaaggcttgcacaaccacacctggcaatttttcttcttttttgagatggaggtcccatgcacctcaggatggacttaaacatagcttgtggctaacagaagacctcaaacttctgatccttctgcagctacctctcgagtgctgggattaaagaggtttgccaccatgcccagccctggtaccggggattgagtccagagccttgtacatgcgcagcaagcactctactaactgagttacacctccagtttcttcctgtaagagaaatgctgtgtaggcgtgtgtgcctgattgtgtgtatgtgcctcatgtccatgcagtacccaagttagccagagttacaggcagctttaaatggcttgatgtgggtgctgggaaccaaactcagtttctctgtaagagcagcaggtgcttaatcgccgtgcacctctcccgccccagctttcctcatcttcatctgtctaaggatatcttaattagtagaccaacaaagatcttttaggagggcagagagagatgtct

SEQ ID NO: 19832 - DNA, 1281 bp, Mus musculus
tggacacgcaaactttatatgccccagtacaggggaacgccagggccataaaaggggagtgggtgggtaggggagagggggtgggtggctatgggggacttttggtatagcattgcaaatgtaaatgagcaaaatacctaataaaaaatggaaaaaaaaaaaaaaaaagagtggccagtcctttaaaccactgagccatctttacagcccctagacatagctggttatatgatcagaattaccctaagtatcacagtaaatcagtagcctatgaaaagaatctgaggtttattctactgcatctaacacacatgatcattgctgccttttatctctaagggaggagagtcttatgaaagcagccttccttcagagcttggtagaagacagaacagagtctgcactgtcatattatgaattcctcctgcacatacagcagcaagtgaacaagtgaggagtcgctggcggagttcctgaggatgcagtacctttctttcctccttaagattgtgaacaaatgtgatgatgattaagatgtttcactgtgatttcaactaactatagcaaagaaaggaccacagccgagagtcagatgtgcaactccaaaatactgtatttttcaaatcaaatagatgtctacacaattggaaacctttttttttccctttgctgccaactatgtttgagttgttatggattgagatgagacaatattgcagaggcaaagaacattttataaaataaagacttctgtgttctgcatttctatttctcatttttttatttttatgagtttttggctgctacatttaaaaacgtcacaagactaagtgttttagggacgtttcaagtctatcaataatgatcttttttaaattggaaaatccaaaagtcagtagactgtagaaaagctggaatccatccctttacatatctgtttttgccccgcccgcccccccccccacttcattttgtagggaaggaaaaggatcatgttaactgaaattggagtacactagctctggtcctgcttgggaagaatataaagtaaattgtcaagctttaacatctgtcagtattttctctacttgaacaaagtcactttaatttgaggtgaaaactaattaggtggttttctgctgttttattctgccgtgaataaaatttgagctgtcttcataaatatatcaggactggcaatgataataggagctggttctgttggttcgctgagtgggtttttgtttggtccatttctgctgtggttgatagagttaaagt

SEQ ID NO: 19833 - DNA, 1190 bp, Mus musculus
taaaactactgaactgtgtacattaaaatggtacattttatgctatgttggttatttcagctttttaaagggggggccaaatctccaaagaaaatgcctgggtgtgccatacatgtgcacatgcgtgtgttcatgcgtatgtgtgtgtactaaatatgaaatcaaaatgctggtctcagagagacagctcagccagcaaaggactagctgctatgcttgataacctaagttcaatccctggaacccacatgacagaggagagaaccaactccggtacattgtcctctgacctccacatgtgtgtgcattgtgtacacaggtgtccctctcccctcaaattaagtgaatatatgtaacaatgataaacttttaaagataaaataaaatgctggtatatactgccagtgtcctccaaaaagatttctgaaaatgtttctcactattacttaagagatgcccacttgcccctcagcatcactgagtgctctgtcttctctaagctgtttattctctgataaaggagtaggatgaaatagccataagtaagcacataacaatcatggtggtaattttctattctaggtctttccattcatactttccatgggaacttcttcgtccgttctacagacttactgtctcttcccaatgtcaacccagatgctgggtatgcggtccagatgtcagtagaagagagtctcactgacactcagctggtttccttccagtcagcactcttatatacatcaagcaaaggtaatggtttgtttgcatttattatcacaaaaaacatgacacctaccctcttgagtttttgatacaaaatttctatgttctgctctggctggcctggaactaactgtatagaccgggctagcctcagacccatagaaattcacctgcctgtacctcccaagtcctgagattaaaggcgtgcgccactacacccagctgagacctagcctctcaacagatgtgtagccctggtactgaaaccccacctacctctctcctgcccacctatgggctatgggcatccttactcaccagctggggctaacttggaggggtaaggtgacatagcatcacttgggtctacatgagaatttcctcagccctgggtacaaccaggactagtatttagcattacaatacatagcaacataccttacctcaaaaattctcctttt

SEQ ID NO: 19834 - DNA, 1099 bp, Mus musculus
ggtttgcttttggttttgaagtcttggaaccagatgtggggatgatccatgcctaacaaccccagcacgggaggctctgcagatgctcattagccagagcattggttgcctttacagaggccctaggctggctcatgagacacatcaggtagctcacaaccatcattccagcaccaagagatttgatgccctttctagtctctgggcactgcatgtatgtgcttcacaaacatacatgcaggcaaaacacccatacatataaaataaaataaatctttaaaaaaaagacaagccagtcattaggaggctgaggtagaaggatcctgagttcaaaattaatagttagactttgtctcaagagactggagaaagaaggctgagagtagagctgagctggcagtgttggcccatctaaagctctgggtctgtacctccagttccccagaaccgtaaaccaggcgtgacagcttgcactcaggaggtagtggcaagaggatcagccttcagggtcattgtcagccagttacatgagtatatctgtgctgtaagaggccctgtttcagacagacagacaggcaggcaggcagacagactaaagaactggagtgatgactccatggctaagagtgtgctgcttttacaaaggacctgagttcaagtcccagcacccacgtagttctcaaaactgctatagctctagcttcaggggatccaatgtctcctggtctctaccattgccacatacgtatggtgaacatacatgcactcataggcacacacacattcacataaataagtaaatcttaaaagttagattgtggggctggtgagatggctcagtgggtaagagcacccgactgcttttccgaaggtccgaagttcaaatcccagcaaccacatggtggctcacaaccacccgtaatgagatctgactccctcttctggagtgtctgaagacagctacagtgtacttacatataataaataaataaatctaaaaaaaaaaaaaaaaaaaaagttagattgttcacccctggcaatgggcaaagagacaccttgtttgtggtgttgatcttatatcagtcaggggcagagcaga

SEQ ID NO: 19835 - DNA, 1161 bp, Mus musculus
ttcttaactgctgagccagctctccagcccctattttgtttgttttttgtttttaaacagtctctctacacagctctggctgccctggaactatgttaaccaggtgagctccgcctcccaagagctgggattacaggcatgcactaccatacttgacctggctttttttattttttgagacagggtctcatgtaggccaggctgaccttaaacttgctgtagagctaagaattgcctgactttctggttctgctgcctttatctctcacatgttgggattgtaggtgtggtaaatttgggttctatttaggttttaatatagatttaagcacagacattaaagagggtcacttagggaaggacagcgcacatgcactcaggaattctagaattctcaagttgtatttcaagcatcttaataataactatgtgtaactttaagtcatgtcaaatataaagtaattttcatgttccatgtctgatgtcactctgactgattatagctcttattctgcaggattgtataaaaagtctggtaaactggtattccttggattggataatgccgggaaaacaactttgctacacatgctgaaagatgacaggctcgggcagcacgtcccaacgctacatcccagtaagtgtttcttccctgtgagtgatgctgagtcatagctcctgcctcaaagtgttttgattttggacttttgatggctaaggtgtgagattgtttatcctgttcctaaaatagctgggtaagtagtaattgacctggttcccagagcacaaattaagaactagaagcaatgctcagacctttctatccctgcacttagctataccatgagcccagcctatgctatagagtaagaaacgacagagccagtagcagaaagaaacacaaggttaatttttatatgtaatgtcacagtgaaaagattataaaccaggcagataacagcttaaaaataaagtcagccgaaggatgtgcgtggtggcacacacctttaaccccagcagttggaagaaaaggcaggtgggtctgtgtattcaaggccaccttggtcttcatagcaaagtctgtgtcagccaaggctccatggtgacatcccaacgagttgtcttctggcatacacatgtgcgtgcgtgtggcacgcacac

SEQ ID NO: 19836 - DNA, 1199 bp, Mus musculus
ttatcattgacaccctctgttctgaaggagaatctgcaatatgctgagagtagaacttttattccaggagacctcaacataacagctctcttctcttccagggtagtgtgtcactgaaggagctgaacgcccggcctctggaagtgttcatgtgcagtgtgctaaaaaggcagggctatggagaaggcttccgctggatggcgcagtacatcgattagcagcggccggcccacacacttccagccctcagagatccatcccccaacatgcataacttgaattcaatagacttttgttggtttcagaataggtgtttttagattattaatatatctacctgagtgggaattgcaaactgattcaagtttgaatatcacaatgttagctttctaattccacacagatagtttttacagtttctaaccccacatcaatccatcaccgtttataaagatcagcttcccatcagtacatttgaagcactttttaacgatgtgaaactacaaatataaaccatatttaaaagctcatcatgtgaaacttttatgtactttttggaaatagtttttcaattttagattgtctgcctatcttgtgtacagttaaaatccgcttatcagtgattgcatgatgccttacggtttccaagactactttttcttatgcaaacgtcatgcaataaaacaaactccaacatttgactcagtgttgggcagctgtttcctttgaatgtgtcttgtggctagtgtgctctgaaaatcgaggatttaatgttgtacatatgagagggtggttgatggacaagaggattccttcagagcgtctagaatggtgcggaaacccccagaggccttctgcttaccacacagcaggtgagttctgaagccgccattgtctttaccaatcatgcaacctgccattactaccatggccggacgctttctgtggcctgtcctctgtaggtccagcctttcgtaaaaacaaaacaaaacaaaacaaaaaccacagctgtagcctgtggtgcaggctttgtggtctgatgctgactttagcaactctgtgatactttgtcaaaagtagtgacaagtgaccagactgtccacattaagtcactcccagggctctttctatggagtgggactcccaaggggagctgtccagcttagagtcctgtgtgtcaggaggagagcagtagctcg

SEQ ID NO: 19837 - DNA, 2026 bp, Mus musculus
atggactccgagggcgtggggtgggctccaaggatcctgggcatccggatggcatcggctaccacatagacttagtctgcctgcccgtctcggtagtagtgacaactcagtcgacgtcggcatcccccgccccgtctcttgtttactgcctctgaacagaccttcctctcacctgtgctttgagtcacttcgggtcgcaatttcatctgctgaactgcctggtggtctgacctgtgggacacgaagggcatgggggcttaaagaacaatcaaacgctgcagggggagggagggaagcccagttgttgtctgtgaccccttcagtagaccgagcccacggcagtcttcatccagcagctgtctccactcctaagatgtccatcaggctgcagggaggatgcggatgtcccataacctctccctagttcctcccaggccacactgtctcgggtgtagatggttttgccacactatgaccaaggcaccttttccaggcctgaggcaatgcccactcttgccctcacccacaacccctctctagagagggagaaaggactctgtgactcgttctggctaacgtaccccttccacctcatttcctcatcacaggatacaggctaatgtgcaaggaaagtatttttctgtatcataagtgtattttgaaacaagtaaaagaaagatagaatgctcgtttactttattaaatgggctctgattttgtgaaaggcgagagagtgagttaagggcctcaggtttgttggagaagccaaccacccaggttcccgggcatgggtgtcggactgtgtgcgtgcgtgtagcagagtgctgtgcaggtgtatgtgcaatgcatgggtaccctatgaaacttgttggggtttctagagattcaactgcctgattctacaggaatatggcagcaggttagactttgggtttcctcaccgttgtcatgtaaggtcaccctttgcccatacctgaagctctgcataacaatccgtgatctctgtagtaagacccttgaggccactctcccgtgcccttggcccagctggccacattggccaaagagccagaagtgttggagtcggggacctttggttgttctttaagccgcttcctgctgccttctcccaaggatgcacgcttgtgctccatccaaatcatttggggatggtggtggggaaggtgatatgaatgtcacaggaggagacaccttctgtctttgtttcaaagaaagtgatgtgccatttgttaatatacaagagaaatattgaaaaaatatattgaaaagagcaattttaaattatttttggcttatgttgcaatatttattttcttgtattagagaagatttctttgtagagaaaaatgtatttttcattaccgcaaagacctatttctcctttttgtacattgtccttgttcgcgacccttaacgagcaatagaatgttcggtcacccctgcgtggccagtgcccactgtgccctgcatgattgtgttgctgctgctgctgctgcatagtttctggccccgtcccgtcctgctcactcactggggcatccggattgccggcccccaccagggtctgtgtctaaggagcccacagcactcctcatgtgttggcaaactcggttaataaagcaatgttctctgtgctggctgccatgacgttctgttgtgttaggtggctaagagacctagaaatcccatcgcgtgcctccgacagtatgctcggcaagagtcccgagttccagtggcgcttgcaaaccttcagcgcacaccactggctacaccttagagggagggaatgtcgtgatcttcagggttagcccctggcattcagggtcagcgaggagatggttacctgagatcaagcctccagtaaagtaccatatcaaaggtcgggtgcagagagaatggctctgagggagtggcaccattccttcctgtagtaggtagtaccttgaccacatactgctaaggtgctctacccacccaacctctcggtggaaactccaggaaccga

SEQ ID NO: 19838 - DNA, 2257 bp, Mus musculus
gaggctggcgggcggcaggcttagatagcacttaagtatttccgttatcattttaaattgtgaacacttatagacagcaagccacaagtcagggcagtaaggctctggcttccaaatggatcatgtggtcagtgtgtggctgcattttctgtatgtagtaaaatattaataatttctgagtagacttgccatctgggtcgcacataaatattccatcactgctttatttgaatgtgtgaagataaacttgattcatgggactcggtggctgtgtaactttttcttttctttttttttttcttcagcatcaaagctaaggcagatctccacatttccaccctggggacagacttagaaaggaggccagggtgaagatgactgaacattggcagctctcaagattcctggcatttgcagcatagaggcagctagactggaagaggacggggcccatagcttcaaagacatcttcattcttccaggattgctgtaaaatacaaatgcatatttatgtatttatacatggcgaactctcagaaatttcatcaggattgtccaagccaaactttgtttgaaatgccttttatgttgatataataatgacaggtgatacattttataatttgattctttttaaaacagagtacctgtaaatacagttcttgttttgccgtaccccacccatgtttgtcctgagccaaggcagatcctctgtgtccttatttctacctgaaccccctgtacacttgtacctcaccactgatggccaccaaaggaccgtgcactaaccagctgtgtcactggagcacccccactgctgggctcagggacctttgtgtaggaaatggtaatcatgtcgcaggcttgaagtagcagagctagcgcataggtaggaggcaatgtacaaaaaagcatccagcctcattttacagctcactgaggctagagatgtagctcagtgctagagtgcgtgcttagcgtgctcgaggtcctgggttgggtccctagtatttcaaagagaggaaaaaatagatttaaaaatcactggaagcatatatggttttgttcaaccaaccagatggtttctaggcactagatgcccatgtgccagcattgtttatttgtttgttttgtttctagaaggctttcacacttgaagaactaactgccttgcataccgcgtctggattgcagtgcggtcctgcattccacctgaccccgcttctggttccctgtatttagtcaccataagataactgagcagtgggcagctgtggagcagtgtacacagcaggactcatcaacggcaggcccattgtggccagaaagacagtggggtctgccttagcttcatctactggatacaggacacccagaagctggggccactggtgtttggcgtcagagcagtggggcacattgtttgtggcttgaaataaaagccacatttttatgtggattctgttccagtccccagtgaccattgattcgataccttggacaagcttctccaggcaatgagtgactgcctgtcagagggaagtggcaaggtggtgactggtgaagggcagagctctgggctcagtgagctagagccttgtcttctcagatgcggcctggccttcatccattctaatcatctgcagactcgtgaggcttaaaaacaaaatgcactttgcatggattgttgattttactttctgtctacaacccccaataaaacagcttttccattgaatgaagttaggttcaagttgtgtgatttcttcccgtaaacctccagtttacttattcatgttggtatttggacaactggaatccggaagtgaagctgcccgctgtcatggcatcatgggcccagcgtggctctgttctctgtcccctcagccttctcttcgttttttcattttcttcatttccttagctaagctgcctacctaccttctcatttttatagcctagtagctgactcagctgtgaagttagaattgtagtctttatgtatccctttcctagcctgaagtagagtgagatcaatcagagggacttgaaggcacctccaaggcatgtccaggagaggacttagaaaagcgtgtatcaggccacggggagtgagtacacgaggtccagagccgaagtgttcatgctggtgatgctctgcccagagagctgctctctgcaatattcctgagaggttaactgctcagaatacacatggatctttagagacaatagttccagaccttagaaaccacat

SEQ ID NO: 19839 - DNA, 1173 bp, Mus musculus
cctggtctgctcatccttcatcgttgttgtgtataatttacctcccagtagaaaggctagcaagttttaagtgccacgggttttaaggattctgcagagaaaaaaagaaaaagtccttcagtttagaacctacaaaagcttgtgtatcttgattaatgtactttttattgcatggtgtgaactaagttattgctgcataaatttgtaatatatcctgtttgtatttttttccaagtgtataatgttggtgtggagttttcatgacagaatatacacattttgtaaatctgtacttttttcaaatattgaatgccttatttttgaattctttagatttttaaattggagaaaagcacttaaagttttttatatatgaatattacgtgtaaagctgttaaaatacataacttcagtgcaagagactttgtcacttatttcctcacctgtgcaagagggactgcgaagtctctgccaggtgagagcctcatttccaactgcagaaggtcactcttctgtttatcaagaaagtctgcaaattcgattctaaaaccaattctgatctccggctttattttgaatgtacttctgtaagttcagttgagtaactatagacttactggtctggttctgtccagctctgtatttgggccacttgttaatgtgcgtttctcatgtaaactgtaccttttgtgacttcacaattggcacctccaccacgagcagagctgacttcctctgctgtgtggcagcaccttcacaggcttttgattaaaaagaaagtaaaaccatcaccatttaccaaacaccgtgccgcagtattagcaatggccggttgcgctggtttgagcaaggcagagatttggaaggaatcttggtgtaacttgaatatttgcaaactaccttttaatgcagctgcgcgctacctgtttattctggaactgttgagcaccagggcctgccgagttgcttctcacctcctcagttgtatccaagttgtactgcatcttagtttactggatagatttaaaacacagtattgtagaaagctaatacaaagctatcctatgccttcaaatagtatagaaaatggaaaatatacaagtaaattctgttgaaccacttgtgcagtctctctagtagttgaaacagcaattgcagtgagcctgagtttct

SEQ ID NO: 19840 - DNA, 1131 bp, Mus musculus
cacacccagcttgctccacactttaattagttgacatatgagatctaatccacagcttgcctttttggagggcagaggtctctttttgctcaggctgatccacagaagactgtctcttcccaaatgctgcagatccaggcatgttccaccatgcctattcacaacctgttttcttgtcatatgtccacattctcacaagtgagacttacttgtgcccatgtagtatcttggggagaagtaaagtgattgcttagaaaaccatagggacctccaggaactgccaggcaaagaccctgtacctgtgtcgttccattcaagaaagaggtgcagtaactgtgggttcatgtgtctagggaggctgacagagctgtactgatttgagaagagcaaaaaaaaaatgttaatgttgtccatctttgtgagtctttttgcctactgctccactcatctctggggaatgtcatactacatcactgaaccttgttcatatctgattctcactacttctctgtctatcctgctttccctctgtccatctgtccaatccctgtgtgtctctaatccccacccctgtcatagtccacttctgatcccatgtctcatgtatttaagataggatctacatatgagagtgaggtttttattttattttattttttaaacttaggaattattttttttcctttttaaggtttatttatttattatatgtaagtacactgtagctgtcatcacacactccaggcagaagaggacgtcagatctcattatggatggttgtgagccaccatgtggctgctgggatttgaactcaggacctttggaagagcagtcagtgctcttgaccactgagccatctctccagccccagaagagtgactgttaacccttagcttgctcattaccctgtattttccttcccacctcagaactttactcttttattccctccctgctaagcgtatgtgagtaaccacaggaataaggtttgggcctagcggcaggggacagtggttagtagtagaacacttatccagcatgcccaacttctgagcaccacaaaaacctgatgatagtggatctgggagctgggaagtggtggcgcacacttttaatcctagttgtaggaga

SEQ ID NO: 19841 - DNA, 1133 bp, Mus musculus
gtcatagagggcttctgcctagaggcagctgctgaaccacagcagtgaatggagacagagcattcataaagggagagctctgcagggataccaaggcaggcttgttcttgggtggacttcagaagcttgactgcagtcatcgtcatcagcattgccagcctgccttcaaactgccccacagcccaggtctttgtccttcaacttttctttcccttgcaaagccagatgtgtttcgcaatgcattgcctcgacctggcaccctagctcctttcccagtttcccttacagctttccttggtttcctacagatttccttggcaaatctcctgaattacgggttctcactttcgatccgtttatcagactatggaggccaatacattggtgccaagaaaaataaatgttaagctgggatctgagtctggctgacacaccttggggtggacagaatgaacatcattctgattgtcacatgagccataaatagatcctggcacaaactggagcttacaaagtatttcataaatgatgactgaagggtgttgtattagagaggaattctgtgttgggtgtgatcaagaggcctgcgaaagactgaaaggagaaagagaagatccacagagacagagctgacgccctcggaattctgctggcccttgccaagggacaagtgactgaaagctcttttgaagatttatgtgtgtgggtctgtgcatgcaggtgttattggaggcctgaagagggtgtcagaccccctcgttctggagttacaggtagttttaagccatccaacatgggtgctgggaactaaattcagggtccctgcaaagagtagcaggcttccttaagtgtcaaatcatctctccagttccagactcaaaggagttgaggccaaagccagtggccttggagttttatggaatctcagcagaacaccaaatagctgtacagtgttcggggtcggggtgggaggtgtaattgttagagttgtagaacttcagaggctctgaatgcccagcacaccagaggagggaaagcccagaactcagaaacacagaatggggacatctaggtggatgtatgcaaggatgctgatgcagcagctcttggtttctgtgggcttttgaaggagc

SEQ ID NO: 19842 - DNA, 1145 bp, Mus musculus
agcgccttagggttgcctttagtcatcaggctggcagagcccagaccacatctgagaggtatcacccagaggccttccagaaacaccaggtcacaaggaataaaaacctcgcctacacggactgctcatgcgccgagaccgcgcaggcgccctgcggagcctgggacgccaggattaaccagcactgcgcttgctcggactcgcttcttcccttcccccgccgccctcccagcgggaggaccacgccccaagagcgaagccacttccttcggcagccaactccgctgcgcttgcgccccggctccacggtgcgcagctctgggtcccggccccactccgtcgccctccccgcggctccctgacgctggcgtgacgtcaccacgccgggcggccgccattacagaaagccgagtcccgagctagggcgagcggaggaggaggcacagcggccggcggccgagcactgcggagcgagccagcgggccggcgccagcgcccagcagccgcctggggccgcagaaagcaccccgggagagcggcggcggcgtgtgcgtgtggcccgggtgcgggcggcggcgcgggagcagcgcggagcggcagccggttcgggcgggcggcatcatggacgagaagttgttcaccaaggagctggaccagtggatcgagcagctgaacgagtgcaagcagctctccgagtcccaggtcaagagcctctgcgagaaggtgagctgctctcggccgcgggtgcggcctctgcccgggcccgcctatcaggaggccgcggggacggtgcaacatggcggcacggaggccagacccccgaacctagcagcccggcgcccggcgctgcctgcggcgactcgcgagggacccggcgccccccgcctcccgcgcgctgattggatggcgccgccaccgcggcctaaaatggcgccgcgcgccggactccgggcttcggagcctccgggccgaacccggcccgaccctgggaagtggggcggccgggaccctcggtggcccggcgagggactggctgggctttgcgcccgggaacgggttccggactcatggagtcaaagcattgcgcttgcactcgggcttgcttcgtggagcgggcgctgcccacagggtcccccacagcaggg

SEQ ID NO: 19843 - DNA, 1163 bp, Mus musculus
tatttattagtttaaaaggctctttggcagtttccatagcagtagttaaaatattaaggacatgttagaatgtttttattatactttggcatagtcactgttgttgattgtagatacaaagcaagggcttggaatggttaagtggctgatatggagggctggagttaggttgcttggggtaatgacttctaatcccagcgtccccgtcttgctttcagagccctgttgaggtagtaatgatgaaaagcgcatgtgggttgggcagcatggactgtgttcttggtgattctgtaacctgaagcattgtcttcctgctgctgctgccaggtccattcaatccatctgatgatggagttgtcccactcttggaaacagtgattctttcattttcatgtggctaacttcatttgtccctcaaataagacaggtgtgatgaaaatggcaggtcattttgtcagtcacatagtataaatcataaggagagactaaattataaaacattctaataaaggtaggtgattttgttgttgttgccaggtatttataaaatgctgttcttttaatttctgaagcctccacacacctatgagtttgttctgtgtgcgcctggcatagagtgggattgcatcttggattaactgaatgagaagtatgttctcgtgctgattcctaggtcctccttttgttcttgtaattctctgcttaagtaaagctgaatgttgtgtagtggcaagaatgatgggccctggaaaccagacctgctagtgtatggagtctcagctatttagaggttgaggtagaaggattgattgcatgttcaaaactagccacatagttttgagactctgtctcaaaataaatgaatagaaagctagggatgtatagttcagccatataccacctgcctggcttgcacaaagcccagccacagaaagagggagtgacccatcctgtaggaatgagtgagacaacattcatttctatattcagtctggtaagtcaacatttgtcatgtcagagttaacagtgaagtgtctttttagtgtgtagaaaataagcaccaagttgagagttgagtcttaagggcgctaaggggaccagcactttgttgctactgtgactttctcttattatttcttcttcttcttcttcttcttcttctt

SEQ ID NO: 19844 - DNA, 1148 bp, Mus musculus
cataactaaatttagtaaaggtcagaaaaaagtatgatttttatttcacacaagatggtgcagggggtttggtcttaattgagatattggtaagcattttataaacctttaattaaaaatgcttataatcatcaggctgtggtagcccatgcctttaatctcagagctcaagaggcagaggcaggtggatctccttgagctgaagaacagccagggctacacagagaaacccacccttgagaaacagcaacagcagttttaaaaagtttatcatctaatttcagttcattgaagtttagagatgtgcactctcagcccctcctcctctcagttggaactctggatttacctatagaaagttgtatgaagtgtcttgctttttgttttttttggaaagagctggcatctgttgtcgttttctttaggttcgttaccgagagcgcatcaccatactccgagggaatcacgagagcagacagatcacacaggtttatgggttctacgacgagtgtttaaggaaatacggaaatgcaaatgtttggaaatacttcacagacctttttgactatcttcctctcactgccttggtggatgggcaggtgtgtgtaccataaaactcacttctgggtttcttcctgtttccaataattgttttcttggtgtttagcaggcagtgattttccatttggggatacattactaaatactgataagttcttttctaggtgctgaactgtcaggataagatcatggggtggaaaatgtaacctattcagctttgggggctctttgtagaggggtctgggagatggaaggcattgtttaccagtgtgagggggactgtcaggctctggagggactgtgggtaagctagaaaaacactctttagaaggaacctcagggatggtggttggtcaggaacaggaatagatactgtactctgtagttggtattaggtcgaacaatagccagttattcagggtccatcctcatcgaaacagagcctagaactgatgtagctaaatggtgtcagctcctgtctaatgtgtagtccaaagagttcagtttctcttaggtgtaattagcacttgtaatcaatctttttagatcttctgtctacacggtggtctgtcaccatccatagacac

SEQ ID NO: 19845 - DNA, 2381 bp, Mus musculus
gagtgaggccagcttggtctatatacagagtttcaggggctatatcaagaagccatgactcaaacaaaacaaagcagagagaagtgtgtgggcccttgcttgttgcttatgctcaattagctttcttcattcttaaacagatgaaggctctctgcctagggaatggtaacagccacggtgggcgtggtgttcttacatcaattaagatggtcttccacagacatgctcacaggtcaacctgatttatataagtctagtcctcagttagaactgttcccaggtaatggttctcttgtgtctggttaacagctaaaactaaccatgtgtttgtagcccaagctggtctagaactgtgattttcttgcctcagtttcccaagtggtaatgttagagctgtgccccaatatacctaggtctattaaagttgggttctattcttttaaaatgtactgaagttggatggggaagaaaatttgaaaatttggaagatgttagttttgttaactacatggtatcttctggagtagtaacactgagtcttccttgtttttcagcttgcagtttgacccagcacctcgtagaggcgagccacatgtcactcgtcgtaccccagactacttcctgtaatgaaaatgtaaacttgtacagtattgccatgaaccgtatattgacctaatggaaatgggaagagcaacagtaactccaaagtgtcagaaaatagttaacattcaaaaacttgttttcacacggaccaaaagatgtgccatataaaatacaaagcctcttgtcatcaacagccgtgaccactttagaatgaaccagttcattgcatgctgacgcgacattgttggtcaagaatccagtttctggcatagcgctatttgtagttacttttgctttcttgagagactgcagatataggattaaacattaacacccgtgagtccagttgacttcacttagctgtagcttactcagcatgactgtagatgaggatagcaaacaatcattggagcttaatgaacatttttaaataagtaccaaggcctcccctcttgttgtgtttctttcagggataccattaatttaattgtatgatttgtctgcactcagtttctccccttctcaaatctcagccccgcgttgttctttgttactgtcagaaaacctggtgagttgttttgaacagaactgtttccctcctgtaagatgatgttactgcacaagtcaccgcagtgttttcataataaacttgagaactgagaaagtcaggtttgaattgtatcagtgggcacgactggtgctgtttattaacaagataaatctattgatcaatttcagaatttgtagaatcccaggtaaagaaaaataaagatcaaggccactgtgtaacctctctggcaactccttggtgttcttcagaagaacttggggacctgtttgtctgacataccgcagtttgtcttgttgctggcctgcgcttgtgaaaggaaatctgtgctgttttagtgggacttggttgttaaaccatagaacttgagagttatgtttttaggattttacttaaaatggcatgttttcaggtagaacttaacaaactaaatgatgtgtctaattagtgtagtttctggttacaaatatattgctatgtatatttcatggactctttaaaatgattgacagaacggtaagttcttaaccaacatttgtatatttcttgtcaagtcatgtgatcttagagttagttaaacttgtctggataaggtgttagaaccttagcttgtgttccttacctggtaaagcagtgaagccgagtagaagcaatgctgatgtgggctgatgtttgcgccaggtccgagaatggtgcctgagtgccaagctcagcgagtaatgggtttcccttctattctttgacttggcttaaaaccgaagacagttcttcttgtggggactgaatatttgctattttaagctatctgggcaaacatgaggatgcttgatcattactgtgtgagtgtagtaaataaatgtttccttgctttgtactgtgttgaatttggaaccaacagtgaagttacagtattgccctgtataaaaaaaaaaaaaaaaaaaaaaaaaacaagccagtttgtgagttaattttctaaatcaaaaaaaaccctaggccaggtactggtggcgcacacctttaatcccagcacttgggaggcagaggcaggcgcatttctgagtttgaggccagcctggtctacagagtgagttccaggacagccagggctacacagagaaaccctgtctcaaaaaaccttagtttttctaggtgtcttctttttattctgagttcgaagaaacacattctccagcctgttatttgtgctact

SEQ ID NO: 19846 - DNA, 1148 bp, Mus musculus
gggtaactggcttttactgtgttcctggaaacagccaattttttgtttgtttgttttttgagacagggtttctctgtatagccctggctgtcctggagctcactttgtagaccaggctggcctcaaactcagaaatccgcctgtctctgcctcccgagtgctgggattgaaggcgtgcaccaccacacccagcgtaacagccaataatttataggcttaattttgaagtggattttattctcctgacctaaacctttttttttttccctataatctcataattctttgactgcttttacattttatagacttaaatcttttgggttaatttttccacaattgtgtctatgttaaaaataacctctgcaaggttgtaaatgtgtttgaccatgccccttgccagtctctatatggtagaactgtaaagataccgtgtcattgtgacattttcatacgtgtgtgtggtatactgtgatgcatcaccatttttctcatttccattctgtaccttgattgtatggattgcttttgttttgagacaggatcatcttttgtagcttggctgatctctgttcaaatcagccaagctacataatgagagaaaacaaaacttgagaaagagaaaacttgcctctgtccaagtgctgggattaaaggtgtgggccaccaccgtccagcaatcttacttgacagagtagaacttttaaagggttcgttttgctttctttcttatttctgtcttctggttgagctttacacgcctttggggtatataggtcagtcacatgttggagactgttcaaggtgcaacctttttaggacgtacctcgaagttgtcatgaagtgttgggttacgttgagggatcttgtacctagatccctctttgctgcttcaatgatgagtgtaccttgatatattgtgtactgtggggcagtgggccgtgaaaggtagcctggtggtcccctttgagctaaggctacctttgatagtccactgccccacggtgcatgcattggtgtttttcggtaggtctccctgtcctggagtttctgttgtggctataggatggatgccaagcagtgggtcttgagccccatgcccctttctactttctagccattcccacttggatcccagtcattgggtt

SEQ ID NO: 19847 - DNA, 2681 bp, Mus musculus
acgcgcagtgaggccttgtctcaaaataaagtaaaacctggggaaaaattgtgaatatttgaaaattcagtaatttatttttaagccaaaggaaaattttacattagtatttctaattgaatttaaataaaacaacttaaaatttaggataaagctaaagcagtgtataagaagaaagctagtgccgggcagtggtgccgcacacctgcctttaatcccagcactggggaggcagacgcaggtggatttctgagttcgaggacggccagggctacacagagaaaccctgtcttgaaacaacaacaaaaaacccaaaaaccaaagaagaaagctagtgaaaggtgaaactacattgaaaataatcagtattacagggcagagaatttcataagagttcattaaacggggtatcattttaagctcaatttgatgtaaattgttaaccttaaatattcagtacatatgactaaaaaacctgctattaattacaggctgcaaactacttagacatcaaaggtttgcttgatgtcacatgcaagactgtggccaatatgattaaggggaaaactcctgaggagattcgtaaaaccttcaatatcaaaaatgactttactgaagaggaagaggcccaggtaggtagcacacaacccatcttcaattgctttttaaaaagaaactggaacccaataccaagacaagaaaaaaagcccatcagaaagtcttggtcttgtgctgcttacccgagaacacctttaaaatttccttgataccagtggggcgtggtggcaaatgccctttatctcccagtacttgggaagctgaggtagattgtgagttccagggctacatagagaaacctgtcttagagaacaaaagaactaataacaacaaaagtcttgatacaaaggcataatgtgcatctgtctctggatctaagcagttaggtgagagagttcttgaagactttaattttaattcatgagtatgatcatggtgcccagaagagagcatcagatttcttgaagttggagctacaggtggttgtgagctgtgggtgggggtgggataggaattatgtcctccaggataacagttttaacctgagttatgttcagcttgctactgttcttttagaaacataagaaaaatggattttgaactaaagaggttcttcattatcagattctttttttttttaaacctgtgatatttgtataggttgtaaactgttggctttagaaatcagggcctgataatagaagagtggatgagttgggtgtgcttgccagcttagaaagtgggactagagctttcagttgacatctgctgttcaatgttagaaagttagtcatcaggtctgcttttacttagcctaatattttcccagctttccattttcctttctcatatgacataggctattgatgatacagtataggtagtgcttagccatctcaggaaagacaactcaaggtataccttctgtctcttctaggtacgcaaagagaaccaatggtgtgaagagaagtgaactgctgtgcctgtcactgtaacactagaagggttgttccaaatgctagttgcactgctctgtttataattgttaatattagagatcagtagacaaacatcgccttgtcttcactgcatgtgtagttccagtccagatcagacctgtggctgagtttcttctgtgagcagaagtttccttttccccccattactctgaataaaaccgaactatgggttctctgcggaaagtggcattttgggctttccctttctgtaaagtgatttctgcctctagttcattgtccagttaacttcagtgagcctttcaaagttgacattgtaaataaaacaacttaagaaaagtatgctgaaatagaattaacaaaacatgatacttgttcatgaatcggaaactggaatagggcagcttgaagttaaccatgtgggtgtcttccaacctctatgctgctggtaagcttgagtgcagctgggctctcttaattggatctgaggccttgttttttctttttttttttcttttttttttttttaatcttctcagctttgaatatgttgcctagagatttagtttactacccagtttgtggttttggagtgggaactgtaactcaacaatttgttagcttttcaattaaaaaagacacttacttcatgtggtatgtcatctttttatcatcattgttcccaggtggagaaacactacttgcatgtaaaaattaatttaaccttttaacattaaagtgtatggtaaaactcagaaaacagccatcctaagtgcaagatgcttttcaataaaaagtagtacaataggtagtaaacagttgcttttgtggatgtaaatgtgtttcttaatgaattaaggttttttttttttaaagatttgtttattatacataagaacactgtagctatcttcagacacaccagaagaaggcatcaggtctcattacagatggttgtgagcaactatgtggttgctgggatttgcactcatgatctcttaccctctgagccatctagccagcccatttggttattttttaattgtagagaatcttgctgaatggttgtagatagtacccacatcttttttaatcccagcacttgtaaggtcagcctggtttacaaaggaaattctagaaagccca

SEQ ID NO: 19848 - DNA, 1594 bp, Mus musculus
gctgtaggtcagatgggttggactgatctcttcagctgcctaccctacaaatgcttctcctgccctctgccacaccctccccatgccaatacttcttggaccaagaatacctggtttgtcacacaaaataactctgtggtcaaccagccacaagtctaaacaataatgcttctctcttaaaccgagaagttctgtttacaaaaaccagctgctgttcataagctgggccggaggaagcggctccctgtgttctcaggcgcttgcaagaggagggactaggatacgtttaggcctttcaaccttggcaccaactacctactggtgggcaatagtcagctttcatttcaatctttcccaagaagctcaccagcattaacaactagtcaatatagttggcctaaacccagtgtgcacccttcctatcaggctcttcccagttccatttccagctcatctgagtcagctcctgggcagctgtgagagggcaaaccccaaacccccaacagccagagcctatcagcattgagaaccggccagcttcagtttctctgtggggctgcaggaagaaatgttactactaaagcaaggaacccataaaacctctctgtggtggacatggttccttgccacattctagaaactctttttgagccaaacttaaccctgagccttgaaaaacaagttttttgtttgtttgttttaactttttttttttcattctcgctgtagatagcctgaatccaaagaaaaccaaaaggggttatccaagtattccacacaaaaacaaaacaaaaaaccctttagtgttcctactttagtcactcatttctcaatccaaagatcatgtttctaacgtagtgttgaaagtcttgagaaagtctggccaagtgtggtagtgtgcacctataaccccagcacttgcgagatagaggcagggggacctctgtgaattccaagacaaccagggctgtatagaagaccttttctcaaaaagaaaaactgttgtatccaaaatatttttgtattgtaatgcattaccatagaaaagcttttttaacaatgagaataaagaatctttttacttggtttttcaaagtctgactgagtagctgtttgagttaacggtgaggtggcctaacactgctgctcttgcagagaaccggagtttgttcccagcacctgcatggcagctctcagcagtgcctactaatgctcttctctctctcacaaaacctgaagtgtatcccttagtatgaacaaagattccaagactgccaatctgcaaaagccaaaaatcacaatcagtgtctctcgacagacaggggcttggtcctgacaccacagctgagctcacattccaagctctgcctttaatccggacagtacaatcacgcaggccagcctactccccaacacccttgggcaccaatgagctagcgagcagctgccattctgatactgaacagtccaacctcaagtgtactcaggatctactgtcctctaaggacagaaagaagaaaagcacttcaaacttatttaaagaaaaatacgcagtccagtcttaaaatttattgtcataaaagccctacacaaa

SEQ ID NO: 19849 - DNA, 1227 bp, Mus musculus
aagcaaaacaaaacagaaaacagaaaccaaaaacccacaactgcaaaccacctaaaaacaaacaaaaaacagtctctaaagagatgatgttaggctggggggtgtagctcagttggtaggacctagtcggcaggcacaaagccctgcctggggttaatccctgagttcaaggccagcttggggctacattagaccctgtctcaaaaacagttacaaacgtggtttgagtagttggcctcagactgaaaacctgtctttagcccgggtgggcccatcatctgttgtgtagtgtactctttgcttgtttttggtggtagtggggcttgagctatatccacaggcgctcctttctttccacactcacttggtgaagtcatgtggaagggcagtgctcttaactgctgcatcatctttcaacttgaacctaccctgtggcacctgcagctcttgagcacctcttgtttcagcctcctaagtagtagggactacaggcttgtgcgaccaaagcttaatagggtttgctcttgtcagaggtttgtacccatcgactgccgctgctccatttggtacccaggccctcaggctggaggacgtctgttacttgttgggggcctttgcctcagcagagctgggaagggtgtgagcttgggtccttcctgccagaaggctgctcttgtggcctgtcccacccatggagactgcctccctggactgcacccagattctgccttagagccagagccaaccgggtgacacagccttccctcgaggccctgactctacagccagaactccctggagatcagaggaagcagacacgctgtcaaataaatacgcttcctcctcaacccctctccccccattaaaacagccgcctccctctccaaggacagggaagctgtctgggccccacactgtctgtctgcttccagatgacgtgtgtatagcagagactccaggcctgggtgggcaggtccaggccctagggaacagtgggtgtgggctcaggatgttcatggggaggttgcccaaaccccactaagtgtgagcaggcctgggggccaatggtggtacatcactgccttcaagcaggctttcctgtaagggcagcgggttgtggtggcctgtcgacctctctgggtctcagtatcttctcgtcaatgggtgggaatcctggcccctgcaggattcttgaggttcagatagggatacattggaaaggtctgt

SEQ ID NO: 19850 - DNA, 1143 bp, Mus musculus
ttgtttttttgttttttgaaacagggtttctctgtatagccttggctgtcctggaacccactttgtaaaccaggctagcctcgaactcagaaatcctcttgcctctgcctcccaagcgctgggattaaaggcgtgcgccactgctgcctggctttttttttttttaattacttatttatctttattttttttgagacattgtctatccacatggccctggttgccctagaactcactctgtagactaggctggccttgaactcacagagctccacctgtctctacctgagtgctgagattaaaggtgtatggcaccacctatgtttgtaatgtttcattattatttaggaaacatttctggtgttgattgatacagatacaggtatctagcaattgttggagggaaggggtgtgttgctctgtcagtagtagctccctctgaggctggaggcaacatggaagctgggtggtttcctgttcagactttagggcccccaagggaagaaggaagctgtcttccaacaaagacctttccagtaggtttccttgggtagcagacctctcactcctctgtatttccagtatgtaattgaactgtagaagtagttctgcctggacacgttggggactctctgttgcttaagggcctggaccaagggcagactggactgtaggctaaggtctctatctctctctcctttaaggaatttaccagctcaggctctgccaacacggaaaccaccaaagtgaacggcagcctggaaaccaagtacagatggactgagtatgggctgacgtttacagagaagtggaacacagacaacaccctgggcactgagatcactgtggaagaccaggtaagagctccctgcctgctggaagtcctggctcctctagttcccattgagacatcctgggtcctgtctttggttaacctgtgccacctttctcttatttgcagcttgctcgtggactgaagctcacctttgattcgtcattctcgccgaacactgggtaaggttctccttacccacgaggatattctgagatgttatgggccctggaagtccattacagcaaaggatttttgggctgacatcatgccaaaggtagcctcttagctgggaggctggagggtggaag

SEQ ID NO: 19851 - DNA, 1749 bp, Mus musculus
agcagcggatggcacactcattgtaatgggactgcaggaggctggaagggagggggattcggaagtacgttccagcagggtctctgctctgtgtgccagtgatggccgttgcatgtgttgattcgaggatagcagcaggtcaggttgtattacagagcacaccttgaagggtcgcctcgcttggccactgctgactgcacctggaacagattctgaccttgattctgaccttgatgctaacctctcttctctttcctttgtctcttgcccctttctccctcctccgtcctctgtcacccctccctcccacacctctgtctcaactccccacaggtatcaaactgacgttgtcagccctgctcgatggcaagaacgtcaatgcgggtggccacaagcttggcctaggactggaatttcaagcataaatgaatattgtacaatcgtttaattttaaactattttgcagcatagctaccttcagaatttagtgtaccttttaatgttgtatgttggggatgcgagagttgataaataccacgttagacctccaggctaaggatgactcggctttaaggtgtttaccatttcagaggtacagcagaaaccccattccagaaagggtcctttttagctgtaggcgtgggttggggaggagcccctgtagagatgccaggctacaagtggaaagctgggaacatgtgggtcctttgtaaatctgtatccagtccccagatgaaattgtgacttcccgagcatcgaaccctggtgtccagatcctatctgctcggaagcatgtacacacctgcgtgaaagggatgtttttagactgatcctcacaccctgttcccatcgtgccctgttcccatcctagcccatcacttaacctgttttacaccaaaagtagtctttagggtgtggttagctatttcttttgtgccattttagggtggagagggtgggcgtgatggagccagtcattcaggacttaattcttccttgtgttgtggtgtggttttctttcttcttcttcttttttttttttaattccttctttcgccattgcaccagagtatgaaatagcttccgggttctccggctctgagctgggcggtgattgtggtcacaccctgacaacactagggatctcaactgactcctcttgtagcctcaccactattttttagcagtttaatgggtacattatagagtcttccattttgtgtggaattagctcctccccttcaaatgctgtaattaacatcacttaaaataaaacttgaataaaatactgaaacctcatcctcttgttgtttttgttaaaatacgaaatggccagggcattggtttggatttgtgctgtgctcctttgtggtgtctatcaataaatctaacctgatggtagaaaagaacacttgggaggctggagaggtgactcgggggtttatagtgtttcctgcgcctgtagacctgaagcgctcacaacttcctataactatgggtttggggtatctgattccctcttctggtctccttaggtacccacacacatgtgacgcacaaataaaaataaatcttaaaagcacttagggttgatgtagtggcacatctcagtaccttggagattagcacaatgagatcagtgaggaggaaggttgcggggttcaggagagcccacccttagttgaggcactgctggcattgatgactgttgggtgagagtcagttttctttgggggtgtatgcagctgc

SEQ ID NO: 19852 - DNA, 1736 bp, Mus musculus
gctgccccccagatgctgtttccggtcctttattctacgtctctagttgagatagggccccactcagtagtccgggctggcctcaaaccgccggtcttactgcctcagcttctcaagtgctggtaccacaggtgtggcagtgcacccacttccaaatctcatattttcaaacacattttttttgtgtgtatggtccccaattttaatgtacaaagatattgcaatacaatgctttgctttaaaataacatttcccccctctctttcaaagctgctttaaggacagtgaagtgggttcaattagtgaaggcacttgctgcctaccctgacagcctgagttcagcccccagggcctccgtggtagaaggcaataatcttagaggttgtcctctgacctccacatgtggaccatggcatctgtgcacctatgcacatgcttacacacatggtaaataaatgtagttaaaaagaacccacttggggtgttttaggcacttgacacacacagtgtaagatgatgtagttgctgcttcatggtcacggtaaacttgtgtagggattctggcaaaagagactgcagttcccagtgagcacaggtgaaatgttaggtagattccaggtttggtttggattactgaatgacgagtagggtagaagctggtagagtatttaacccatgaccagggactgtgtgtcagcacttgattttagcatgagctccaaggttcagacgacaagcagagtgtaagacaggtcagaggtttctcagtttgtttcttgatcacagtaagttggaggagactctagagcccattgtcacttgcgtgagactgtgtcttggtcctgcagttaaagcagtaattggggaaagttcacacagacctgtttaacagtgaccttcattcagacttgcctccctccagcccccagccactgggattatttgccgtatttcatggtagcctgccttttcagagttgatcagaatgtaaatgtgtgatttgaatcatgcttggctaccaagcttctttacaactttgcagaaagcatcgtctttactgcgagctcagtaaagcctgggcgggtaggcgggccggcagccacgctccctgtggacacggaagcagcagcgttgacttcccccgtcagggacagttgactgtccgagggaagggcactgtggtgaaataaacctgaactgttttattgcagtagtttttttcatatctgaaattgtattatttaatattttgaataagattttaagaaataaatggtaaaggtataaatctgcttctgttagtgtgttctttacaatgctgacttgagtgcttacagaagagctgtgctggccgggaggaagtgagcctcagccagttgttcctaggcctgctcagcctcggagctcggaagccacttacacttctgacttgtttttagaaccagtttgatactgggtcctgacatctgctatcattagcataccaggatggcaagaaagacttgtaggacatcaccgtgtactttccaggttggctccctgttatgtgtgagctgcccaaatcaggagggtcagccccggtgacctgggcctctcgctgacctcctgctgatggtgttcactgttgaaggtgctgccttaaatagcctcctacttgatcatacacagtcagaaaatgctgccagggtttagcaggcaccttagcagctgggcaagggggcccacaatccacattt

SEQ ID NO: 19853 - DNA, 1148 bp, Mus musculus
catgggaaatgaagttgttctcatattttaatcaaggacatgtgatctgtggtaggaagagcagcctcccgtataaattgtgtggtgggtcatcgctcattcatctacctttggagtgattcatggctctctaaggtaataaaatatctccctgaaatacaaagatctgtccaggcaaataaaaacctgacgtagttactgtatggtgttttctagggagctgtaactgtgatagccagctcaatgagaactaagtgggaaacccaaatacaggccaagctgccaagaagaggcgaatccccactgcgggagtttgtgccaggcactgcttggggctcataaactgtatggactgtccgtgtgaggggacttgaaatgggcaaacaggctggcttcttggcatggatacacaagacctgccaaacttcttctggccccagatcttccaatagccactgacctagtgccaggctctgtgaatatcctctctctctctctctctctctctctctctctctctctctctctctctctctctctccccctcatcttttgaggcaaggttttacaaatcccaggctaaccttgaactcctaatttccttgcctccacctctatctcccaagtatcagaattacacacataggctacctggctcagctggacatgtccctcacagaatcttttgattcttctggggaggtgaggtttgtttggggacaacatgagcatatgaccagttagcaagataaactaagaatcaaagaagagagagaagaggcaccaggtacccagtctgggtcaggactctaaccccgagtgtcctcctattgccattattcccttggggagggtggagacccctagctggccgctctcggcatccttgacagctagccgtttgatttatgttctggtctttccaatgtctgggaacccattgcttgtcccaggaagcctgtgggggcaattcctattggttgagttgagctttcagtcacagatataatcccgcccttggctcaggttccttaagtctggccaacagcctcctgggtatttgctcacagtacaccggtctcgcacctgatgcatgcacacagctcctcagctctctccatggtgagcaccccagctttattcagaag

SEQ ID NO: 19854 - DNA, 1170 bp, Mus musculus
tctgacctccatacaaatgctatggcatgtagtcccatccatacgtatgaatacacacacacacacacacacacacacacacacaccctctcctccctcttgtcttttccttggtatcccatcaacaagacttagtgtttgttgccgttctatctgtccccggcctagtctaataaacatttatattgtttccacaactgaaatctttctgtatatttccatctgacttcaggttttgtacttaattctatatttcttatgtgacctctgcagagaaaagtcatcgtagcaccacaacaaagcaacagcttggcttacagtgccatgccctctttcaatccaagagaaggggatcccactcagtggctaagggcatttgctagacttggtttccagcttccacaggccagttcacaactgcctgtaactctggttttagaggagctgatgccctcttctgatatccatagatgttgtacacatatgatacacatgcatgcactcaggcacatacataaactatatatacatatatatgtacatatatatatataatatatttttttcagagagggggtaggcattaaattattctataaatgagtgattataattgggataagagctgtgaagcagatgaacagggggtcctgggcacccaatagtcttaggaaatcagaaagattcttagctattaatgctcagggctgaaagctgaggcctggctgaccaggcagagccctggagaagagcagcaggggagttggccaagagctcaggcaggaggaagtggaaaggaaaagccaaccgcacaggcaggaggaggaaatatctgaaacaaggtaacacaggagatgtggcaaggactgcatgagtggctatggtctaggatagggggcttcgaatgagagaattgacaagcaggtttcaatcatggatatggctggaaagagtaggtgtgcagttctgtgtggtcattctattgtacagaatagggatagatgagtggctatgaggagctgagtcaggaggccaccactataatctagatgacccattctggaggattgggataagatagatggagaactgccggtcagtatctatgctcttctgtgtttgaggagcacgctgttgaaccccagtgcctcactggcaatggggaaagga

SEQ ID NO: 19855 - DNA, 2471 bp, Mus musculus
taggtattggggtttacttagcatgtcatataaaatttgtttcatttataagaaactatagttttctttaccattctaggagctgacaagtatttgcagtcctataatttcaaaacccaaacccaaagtggaacccccaaaggaggaaccaaaacatgctgagcagaatggaccagtggatggccaaggagacaacccaggctcccaggctgctgagcacggtgcagacacagctgtgccttctgatggcgacaagaagcttcctgagatggacattgattgattccaacacttgtttatattaaaacagactattataaagctttaagttgtcaactttgttctgaatatcaactagagcaagcaaatactggagatttcttagtcagtttttaggggacctcgggggtggggtatataggtaatatacagagcattttgacttctaaatagttagatccagagatgaagtgcactgttctctcttcattacggtcctgtttaagagcccagctagtctatctgagctctcgcctccatccttgttttaatcatgcttctacaaggtgaagtgtgtttggggaaactgagctctaacaaaagccgcgacagccaccaggcaggcttttccttatacatgacagaagttcgtattacgccttggaaggtctaggtggagatcaccaccagcattctctgcctgtggggttgtggggctggtgctttctccatttctgagggtcaggatggccaagcatggattaacactaggagagtgcagagcgcagcagagcctgctctcatccctctatccccagcccagtcttcctcctccatccttaagcagtataaatgctatgtgccctcttcacttagagcgagctttagtgtgtcaagggactctgctttcctgtacttcctaaaagtacattcactaatactgaagcatcaaagtgtagtttaaccttaaggttgggttgtaaataacacagttgggtgtaggcatggtaaatctgagcagtccatccttagtatggtggaaagatttgtaccctgacccgctcgagtggtggtagatgtatgtaaattagaagtttgaatgggacaggatgagagttcgaggctctttgtttggtatcttttgtgttaatgtgtcttgaatctgccaatctgtatgttaaaacagctgacagattgtaaagctattgcactgcgttgccctggacaagtctgaaattggtataaaagacaaggtgcccaaggtcacaagaacacctcattgccgactgaagccagtgtcagggcaccacatactcctggggccagtctacaggaaagagatgttctgcaaacaagggtggatgcctgcagtagaggtcagagctggttacctgccttagttacaagtgtcggttatgttctgggtctttgtaatcgctgatctctgtaacagagcctctgtttatttttgcttgttggaaatagggttcaaccatgcatagttagaatcactatgcatctgtctgtccacacaggaagtgctatagctctcaagtgctctagaggcagttggaaaggaaggaatgcatgcttatgtgagcagctggactcccgctcagtacaggcctggaaccccaggccaaatgtatgctctgcttccttgagtgctgtaagagttcccactggccttgctctgaggccaagagctttttcaaatgcaggctgcaggattaagccagctcttatgcaactgactgtccttaatgaagaactcataaacatttgtgtgtgggggtgggggtgggagggtttgggtgctgggatgggggtgaatttgaagtttaagattaaaagctagaaatcagatggtctgcttctgctatgtctgtagaccgattggatgtatgtggaggctggccagatggcaactgatgacttgtgtgcaaacaagtgtttatccgggttgcattatccaaactggtttgttaaaaactctaggtcacattcttacactaagaaaaacagttaacatgagacaaagtttaggaaaaactaataaaagaaacctgtcttaacttgaatggttttcttaattttcttaagtgggctgtttgtgtgtgtgtgtgtgtgtgtgtgtgtgtgtgtgtgtaggggacttacttgagtagttatatatgtgggtgggtgggtaggggcaggctgggggagactgtcaacagaataagctggcctgaatgcagtccatcatcctgccttagctgcttgcctgtgtgcttattttggagccctctgcccctgagaatagcaatccagtgttcttggtatagtaatcttctgcgaggctggcctttagatttgatggtagaaggtagatggcacagagtattaacataagtgccaggactgagtagggccagaatctgctaggaactgatgcctggctagttggggacatgccctgtggtgaggca

SEQ ID NO: 19856 - DNA, 1205 bp, Mus musculus
gtgtatgcatacatacaaagtcttaagaatgtaattttttttaagatttatttattattattattcattagtacactgtagctatcttcagatgcaccagaagagggtgtcagatctcattttgggtggttgtgagccaccatgtggtttctgggatttgaactcaggacctttggaagagcagtcaatgctcttaaccactgagccatctcgccagcccaagaatgtaatttttaaaaagaaagatgaagcagtgcatttgagtaggtacagagacgaggtgggtaggacacaggaacccaatccctaatgaccaccattatgcttaactcctgaatgtagtgttctacatataacagactcactctttagtttctagatatgatacgtatgagttacatcattagttaactaaggccaaatcagtttttgatatttgatctagtttaaaatattaagttagcctgtgtggttttgttcttcatagtttttgtttctttagacatctcaagctggatcaaaagataaaaagacggaccaaccacctcaagcaaagaaggcaaaagtgaagaccagcactgtggacctgcccattgagagccagctgctctggcagctggaccgggagatgctcggcctgtacacagagaatgaggtacgtttggactttaagtcagtgcttttaattcagttcctgatgttgtattgatctccaacagtaaactatttccttgctccttcattaactgtgattttgcttctgttaggaattggaatgtaaatatctgatatgcagggtgtctgatctgactcctgtaaaagggtttgatagtgctttagggtttctgccagtttggactattattggtaaaagcagatttaagttgtaagctatggctctttatgttcttttgtgtgtgatagtaacttgacgtctacattgctatctcttgtcaagtggctttttgttttgtttttgttttattttatttaagatagggtctctccttggctgacctagaactcactatgtaattcatgctggcctggccagagatctgtctgcctctgcctcccaagtgttgagattaaaggcgtgtgccactctgcctgacacagaactctgtcccccaaagtaataactaaccctttcccatgccccctccctttttttttttagtttgaaacaggccctccccccccac

SEQ ID NO: 19857 - DNA, 1133 bp, Mus musculus
ttgtgtattttagctgcatgtatggctgtgtaccatgtgtctgcctagtatatgaggagaccagaaagagaacattagttgtaagataacatgtgggtgttgggaatcaaacccatgtcatttagaagagcatccagtgctcttaacttccgagtcatctctctatgaacctgcaaataacagctgacaaggaggagaaactaggactgttgagtaattacaaacctaggatacatgtgtcaaaggtgttcagaatgtcataaatttttgtctgaggaaagcgcttgccatacaagccagaagacctgggttcagaccctcagccaatgtaaagctagggtgagatgggaggtggagggtcagggctccccagaagcttccaggctgaaagcctggactgggtagcagcaaaaagcagagattgctgtctcagatcagggggagttcctcttacctcagcacacttgagacaccccccccccaaataacaaagaaagattggaatattttaaaaagaaaaagagccttatgaagttttgtgttttttgtccttttcttcttcctagtgactgtgaagtcttccccaaaaaccatgctgctcctttctccaaagtcctcaccttctacagaaaggaacctttcactcttgaggcctactatagttctcctcaggatttgccctatccagatcctgctataggtgagtagaattgaactgaaatcataacaaaaattgcctgtacttagagcactaaagggaaaaaaaatagactattcagaaatgtaggcgcttgaggccacaaaagcaaacatcttctgccctttgtacttgctgtagaggcagtcggatggttatttaatggaggcttgacttttgcagcagtgttcctgggttgagtgcacattgtgggtcattgcttaaggtgattctgatgtcagttggattctaatatagggttacaagatttgcacagaaaccactagattgtttacagcatcagtttattgttgattttggaaccaagttgaccagtctttacaaatagagaacatttacaatttggaaataatatcacttgacagagaaaccaagagttgtaaagatctgtgcagtggatgaacagccaggagca

SEQ ID NO: 19858 - DNA, 1284 bp, Mus musculus
gatgccggtctggaactcagaggcttgtggcagttgtcttgcctcatcctttggaagttgagccatgccttttcagagtgtgttcgtggtgtttcctctcatccccccaaagaaagaaaaaagtttatttagtatattacctggacagtgatgaaaaggactgcctgtttcatagtgtagcgttagcaagtattaatgtgcagcatcctttttttcaccctgatgaacacattttctggcctttaggaaatagatgatggccaggtggtggtagcacatgcctttaatcccagcactctgtgagttctatgccaacctggtctacagggtaaattctaggacagctagggctacacagagaagccttatgtgaaaaaccaacaaaaataaaagtaataaaaataagagtgtatgtatcatggtaaattttacaattggttaattttttgattatcctctttttctttgaaggttttggccacagcttttgatacaacattgggaggcagaaaatttgatgaggtgttggtaaatcacttctgtgaagaatttggaaagaaatacaagctagacataaaatctaaaattcgtgctttattacgactgtctcaagagtgtgagaaactcaagaaattgatgagtgcgaatgcttcagacctccctttgagcattgagtgttttatgaatgatattgatgtgtccggaactatgaataggtaaccatgttcttaatgttaaatgagcaatgacctttattttgtttaactgattaatgaaaccatggtggttaacatgttaaaaattacaagccatttagaacccagttttcatttaaaagttgtatctagtggttctagtaatggagactgaaacttttattctggtaactttaatgtttctgaaagtcactagttaattcaaatatgtattagacacaaatgactgggaaaactagtgaactgttttaatgcagaaataggatgaatttaacttaggcaccaatttaaaaaatgttctttttgagtagttcaggatcatttgagggcagtatcccttttatacagcactgcaagaattctgggtaactgacatttaaggttatttcagaaacactcagtgttattgttgcctgattgtgttgcttggatgagggagtgagatgttcttttggctgtgaactcctggtggaattcaggcaagactaatgacttgtttggagaagtgtgcctgagtgacccttaaaaaatttgagatggtatttattgttgaccagtgttcaagtat

SEQ ID NO: 19859 - DNA, 1192 bp, Mus musculus
cttgtgtctcagttagggttggagggagatggttgctcagtcaagctcttcaaagttaagagaggttctgttttggatcttagctgctgggtggggctaagggtagaaggatgggttatccaaggcagagctttatcatgaaacatttcctgagacctggtcatcatttattctttaacccagtaaacatttattgtgactgtgtgggttctggggcaaaaccacctgtgtcctggttggggagacgtctaatgtgaacacagtgtacagtccacacagtatccgatggcgaggcagtctctcctagcagtcctgtttatggcaggagggatggtttgccttcggatcaggtcattgcctcaaggtttgctttacgttgtgattgtcttttgctaaatgtcatgtatattaaacaaaaaggtaacattcttcgtaaagataacgttcttcagtcccctcctgagatactgccccattgactaggacatgaagtggactaaaattggatccttttgttttgttgcaggttacatatatggaagaagagaggaattttaccacggaacaagtgactgccatgcttttgtcgaaactgaaggagacagcagagagtgttcttaagaagcctgtggtagactgtgttgtctcggtgagttgtggtagactgctgtgttgtctcggtgagttgggctcgagctgccttaagaactagagaggaaaactgtttttactgcaagtacaaattgttactgtgttgtgtggtcgtggtgttttgagacgttcctgctttgacacagtcttgctgtatagtccaggctgcctcagtagttaatgtttctgcttctgtctcccatgtgtttgggattgtagtatgataccatgctcagaaatctagttttcattttctttggttttcttcctttttctttttctagttttggagacaggatctcactgtgtagtgtgggctggcctgagcttgctgtgtagaccaacgtggtcttgcacttggctgccattcttctccctgtgcctcttgcctgtgctggaattccaggcatggctcagcttgcctggctgaaaggatcaccaccaccacgctgcccactcacccagtattttttcagtacctagtgtagtgcttagggacagggtagctacttgattgaatgaattgaatgttagatgtctg

SEQ ID NO: 19860 - DNA, 2525 bp, Mus musculus
ttcttttgcccctatcttcagatcaccacaactaacagtgtgcaccaccaccacccagctaaaacacgtatttgaaacaaatcaagagctgtgaatcacactactattcacttcataattttataaaaataataaattgggcttggttttgtttttttttttggttgtttgggttttttttttggttgtttggttgtttgttttttcgagacagggtttctctgtatagccctggctatcctggaactcactttgtagaccaggctggcctcgaactcagaaatctgtctgcctctgtctcccaagttgctgggattaaaggcgtgtgccaccacgcccggctttggactttttgttttttgttttttttgtttttttccgagacaaggtttctctgtatagccctggctgtcctggagctcactttgtagaccaggctggtctcgaactcagaaattcgcctgcctctgcctcccgagtgctgggattaaaggcatgcgccaccatgcccggctttggacttgtttttttaatgttgatgttttcagcaaatagctgtatatgtatcttgattctttcagctctacagattttcaaacaatctaataaatagtggtagttcagttagggttttttgttttgatttccttttttaagataacatcacccattttccaggcctaaaactcactatgtggccaggcatgaccttgaatttgtgatccttcctagtgcagagaataggttaccaagtcaatttatttgttgatgggggttgaacccaatccagggctacatgcatgccatttaagcactctagcatctgggcttcatccccagccctggttatttagtcttggttttgttttaatgcaatccttagactttcttttatattttagaatgttatcttcatatacatttttgtgggttttttaattttcatatacttttaattaataattttttttactatgagaaatgtatatgtggactgagagtatatgtggtagagtattcacccagtgtgtgagagatagtgctcacccagcgtgtaaacggttctagttttttgttggtgtgtgtgtgtatgtatatttagtgattacttgtggatgttaactttaatataaaaagtaagacttatctttaaaaatacctcttctgtctgaagattataaagtgagtttggaagatattttgtttcacattatactaattttatattttactttttcctttcctttttgttttttgtttgtagactagcaaagaagataagttatcaagtcggattcagagcatgcttggaaactacgatgaaatgaaggattacataggagacagatcgataccaaagcttgttgcaattcccaagcctgcagtaccaacgaccacagacgagaaagcaaacccaaatttttttgagcagagacatggaggatctcatcagagtagcaaatggactcctgtaggccccgcccccagcacctctcagtctcagaaacgctcctctgccctgcagagtggacacagcagccaacggagtggtgcaggagggagtggcgccagcagcagtggccagaggcatgaccgtgactcctacagcagtagcaggaaaaaaggccagcacggctcagagcactccaaatctcgatcctcaagccctggaaaaccccaggctgtttcttcattaagttctagtcattccaggtctcatgggaatgatcaccatagcaaggaacatcagcgctccaaatcacctcgggaccctgatgccaactgggattctccttcccgcggacctttttcaagtgggcaacattcaagtcagtctttcccaccttctttgatgtcaaaatctagttcaatgttacagaaacccactgcctatgtacggcccatggatggacaggagtctgtggaaccaaagctgtcctctgagcactacagcagccagtctcatggtaatagcatgactgagctgaagcccagcagcaaagcacatctcaccaagctgaaaattccttcccgacctttggatgtaagtctcacacttagtgttcagcattgtgtctgaaaaaaagtaattcatagaaatttcagtgagttgcacctgtctttttgctttaatagtaagaagtataaaaattttaaaagcttaagaagaaaaggtttaaataacaacttgggaattgaccatgaatccatattgctgtgcactttccttcttgtataataaagaaaatattcagtttctttttttttttaagatttatttatttatttgtttatttatttaatgtacactgttatactctcttcagacacaccagaagaggtcatcagatcccatttcagatggatgtgagccaccatgtggttgctgagaattgaactcaggatctctggaagagcagtcagtgctcttacccgctgagccatctttccagccccattcatagtttttcaagtattaaaatgaaaagtcaaattataggctaaaagtaagatttatcaatagc

SEQ ID NO: 19861 - DNA, 1115 bp, Mus musculus
ctttttttaaatgtatgtttgtgtgtatatacatttatgggtagatacacacacccattcatgtgtgtagagagtagagagagacagctaatgtcttcttcctctatggctttctgaattactcccggatgtaggctttctctgaatctcaaactcactctttttctgagaggctagtaggcagcaagcctcagtgatctgttgtcatcacagccatcctcctgtgtgtgtgtgtgtgtgtgtgtgtgtgtgtgtgtgtgtgtgtgtgtatgtgtgtgtgtgtgtgtgtgtttgtgtgtgtgtgtgtgtgtgtgtgtgcacgcgtgcactcgcgcacaatggagacagaactcaggcccatgaaaacaagctgtcttttctgttcttgagtatatcagtaagttttttttttctcctaggaagcttttaatgaaaatgccaaaatttctttatttagttgttgatgattatgtaagttatttccacttttaggctgttaaatatctataaatattattgtatatattgtagacttattttttttttctcccgggtaaatgctagtgatggtgaaaagaattgctgaattgtgtggtaaatatatattacacttggaagatactaagcactgttctttagagtaattgtaacactcttgctttaccccttcctaccactcaacagtgtgtggtagtcagtccacttgttctgtctgtgcctccagcttagaattgttgatctatttgtttttactcattttagcaggtgtattagaggtatgttattcttatcttaatttatacttcctttaagactggtcatattgaactatcttttttcttgtgtttattgggcattcctctatgggttacataattccatatgtttggagtcagaagtgtttcagactttaaattttaaaggtgctttaaaaattttgaaagacttccatataggatatgggcttcttgaactgaagtatgaacataacattgattaatgttttgtatagaccttatacatatatcttgaaggtaattttgtgcatctttattttattggcattttgactgtatccatcacataaggttaggtaactgtatatgtcatataag

SEQ ID NO: 19862 - DNA, 1104 bp, Mus musculus
agaaatcctgtctagaaaaacataaaaacaaaacagaaaaaaaaaaaaagtcaccaatgtgattaataacatgagactatgaaaacaaggactgaggccagtgaaatggcttattaggttaaggtgtttgctaccaagtttgataacctgagtttgattcctgggacctatatggtggaagaagaaaactgactcccaaaggttgtcctttttttagccctgcctgtcgtggatcttactatgtaatctggctttgaactcagagatctgcttgcttctgcctcccaagcactgggattaaaagtgtgcgccaccactgcctggctcacaaatcatcctttttttttttttaagatttatttattatttatttgtaagtacactgtagctgtcttcagacaccagtagagggtgcttggctgttttgtttgtttaaatagggcctcactacagagcccaggctgacctggaccacaatgtcctcctgcttctgctacctctgggattcaagtattaccatgcctccctccccaccccctgttatagaactcttaacttatagatgttttggcttgaataatctatatgtatgttattcttttcttgtacttgacatttattgagcttggaatttgatttatagtttctaccaagttagtaaaacctttgcagttatttgcagcgctcatattcttttctgttttcttccttcttcctgcttcaaggactggtattacataatgcagtcttttcttttgttgccccattttatattgttttattgctatactgtaaggttctgcagtatcttatatgctcttggtctcagttaatgtaatatgatctcagatatggttcacacttctaaatttctgtttttatttgtttaacatagtcaagttctattccaagcattaaatttgacagccattcttgttgatgacaacctttttcaaaaagtttttagtttgtttgcttgcgttttagacagggtcttcttactatgtaagaaatacacctgcatctgcgtcccaagtgctaggattagagatgataccacacctatccataaacctttttaatagagagctatagcaaaatgat

SEQ ID NO: 19863 - DNA, 2797 bp, Mus musculus
cttaatgaatgtttttaattttctagaattctttgctgaactggacaaagtgatgggccctctcatctttaatgcaagcatcatgacagatctggctcgttacacccggcagggactgcattggcttcggcaggatgccaagctgatatcttgaactgaacatactctcgttgcctctgatttttttccacaacactgtgtcacatcacaaaggaaaactgccataacacaccacctagtcgacactaagaatgaggaatggttttctcctctttggtttatgttgttgtttctataacccaaagctatcatatcaattgaccctttgaagagtcccaatgtgacaagtatttaaatgcttctaaaccttcagtacatcagcaagatggttttagtaattggaattccagttgcaattcataaataatcaagtaaaattctatttattttcattttttttcaagttcccagattggagcttgtttaaagcttagtatttctgcctataaatttattctgttaatatttagcataaacttaatgtaggcattttatttatatattttgggagctgtgttacttaatgtcttctaagataagagttggcttgtccaagacaggacttgttctctctacagctactcacctatgttctttcaagtcttactacagttttattattgtaggatttatgcttggtattaaggatgctcttccacatgtgaaaagtcatttaaacatgagaagacggcattctgcatgggtgcagaaatggagtgggtctggtttagtatgcattatttcaaaactgtgaatgtgtgttagtaacactagcaatcacaaggtgactacattgcatctaatgcattacaaaaaagcagatagatttgctggggaagcactgaatggcttcataaaggacaatcttaaactatgagtttgttaaaaccttatattcttttttgttttactcatttgacacttgattgaaacagagtaaattactcctaaaaacagtgatccagtttctgaaggctgcagcctgtattcattgctaatgtttgaaggttaaagtctgtggatttcccctatggtggagagattgtgatgctcagatctgacagttcaggaactggagcttgaaaggaggtgtcccaatgtctaatgtggagaaaattaatttctctttccaaagatcctcatcaatgatgtatgcttttgacaggatcagaaaactcacagtagcagctgagcatggttttgtatatctgtaatcccaacactggggagggatatcaggagggtcaggaggtcagaatcatcctcaagctacagaaagctagacagtgagtttggggctagcctgagctacacaatcccttgtcacattaaagaaagaaaatgtatactaggaaagtaccaaacttggctcattgtgagctttcttggaaagggggagatgatagagacagggcttaggaagccagctctgtaacagttccttatcaaactactgttcccgcaaggtgcgcatagcagtgaagggcgaggatgtctctcttcctctatacttctttttagtgaccccgtcatgtctggtgtgccttaaatcttaactttaaatgataactctatggattgtttacagataaagttttatgctgggaccagattagccatgcatggttggtcctctacaataataatttcaaatcctctttgattttaaatcttcttttagagtcacattaagactccttcagaaaagctagtactttggtacctgatttagtgtaatcaattgggtataatgctgcttcaaaaaatggcttttccttctcattccaaaaatccatccaattagggagaaaaatcccctgttagcagatgattgttgagacttgaatggaaaggaggaagaggggatagcaaccttcacgcagcagtgtcgcaaatcctctctgactccttcaccacctgtttctgaagatagtgaactttgtcctgcagtctcatatctacagagcttaactgctttgtgtctcattatttttacatagtgttgagggttgatacctatagcttatgctgaattgaacatttttcccttggagaaattgcctctgtaccttcctactttaatcgtagtgtatttacggaatgcttcttcagaggccatcggttcctctcttgtgctagtaacctccatggtctaacagctgtgtgtcctgtccttgcctcttctctctcactctggcttctccatttcagggaggccttagaagtagagcaagcaccctctccctgtgctttcagccccgctgctgcagttcggggctctgctttccagctctgggctgtgtgcagcgcattctagtgcgcctctgacgtcatgctaaagcagagtttcctacgtgttcatggtgctgctttaagatgttttccctttaaaactgtcagttcttggagaatgaaatggttgaacctttcattgtggaggattttcctcaccacatagaaatgggcaatggatcaaaatctgatcctaagcgattgcatttttgatgtcatagtgtgtgagaatacactctgtgtctcttctcagatgttttgtctcagtcatgtccagcacataccttggactcctttacaagtgaccatccctccctctcggtaggtgccctcagtgttttttagccatttaaagctgatttgacaagtggctacaaacttagtctgaaacttgtattcactctatagttagtaatagaaatagcaactattgttaatgctcagt

SEQ ID NO: 19864 - DNA, 2171 bp, Mus musculus
tttgtatttaacagctgaaactttggtacgttgacggttatcgagtgagcttgcattgtgtagccagggcctacagaggctcttgtcaggaatacaagcactgcctggagctggtgctcagaggagcttctagtgcaaccaggaatagctccgtggggtgatgcctagctcaattgagaagggggatgctgtacactcttctaggtatgagggtatgcgactttggatcttaaaattatgtacacatacacactttatatatatgtacgtatgtatgtatgaaaacatggaattagtttgtcaaaaatgtgtgtgtttagtattttagcttagtgcaactatttccacattatttattaaattgatctaagacactttgttcttggcaccttgaatattaacattcaaggatgcaatgtgtattcctttagattgttaaagcttaattactatgatttgtagtaaattaacttttgaaatatatttgagcccttctgtagtataatagggctcttacagggtgggaaagattttaattttccaatagctaattgaacaaaatggcttcattgtatattttgatttataggagtctgtaaggtgtctgggtcccaaggacatctactgaggatgactgttttaggtgggtggaatggtgtttagactataccttagtgacttggaaagccagagcacctagttcaaatccggactcctataactcattcctctaggatgtggaatacaaatcccatccagcttcacatttcaattagagaggcagacttcttttccagtaatattgtacacctagtgttgctatgagtaaaatcagtaggaaaaatactgagaaggtctgggaagacgcactgactaggccagcggtcacatttgtaaatgtacctttcccataccttccagtggaggcattcagctgcgacttttcagaccctaaaaccaagccagggaggaggaacacatgtttaaggttagagaaggccaggagtgcgggtgcataccctgaggcaaaggccatcctttgctagatagagaacctgagatgctgagacccattggtgaaccagtgtggtagtgcatgctttaattctagcacttggactgtcagtttgagaccagcatgctctacacagagagaccctgggagaaagcaaagtgtagtaagaggatgccattctgcagaactcgtgttaattacatgaaccccatggttaactaaaaagaacttactgttcccagagccagggaatagaaaagaagctacacttctcttgtaaatggtatttagaacaaggtgttcgggtaaagtctcaactagtcagaggtttcagcagcttaaattgctaatatttaagaagttgattttcaggaatgtctgcctgtgcctctctccttgctgccattgatcagctcagcaggaatcatcatctttaaacgtggagaaagctctcagatgagcgtggacaagctcccacccagaagtcctaatgatacttggttttgactgtgctgcttctgtgttaggtttcttctcagcttttagccactggggttttctgcctgttctgtacctctctagaagatgtcgacttggaagtgctgcctttcacaccagtgccatggtgtccatatagttgagcttgttgctgatccagaggtgtcccctttatgctcacacctggcacatcactgacatgagcattcaacagtacatgggtgagggtagaggtggggctagccaacagccctggctcaattggcagggcctgcaaaggccccacttgagggccagacactaggttggtaagcacagttagggaaatttctacctaacctccgttttgaatgattctgagaaattttatatatggaggatggaaatgcttatatatttattgaagatctttttatttgaaattaaaatcatttggtaaataatggtttgatatttggggagggttttggagggaagtaacatggttgataaattacaggcctgatgactcccctgaagggcgctgttgctgatggagagagaggcctttatcttgtacatgatccaatctttgtcttaggtttcttttatccaaaatatctaggcatctgacactttcaaccaaaatttcaattatatactgtgatttttatttgtt

SEQ ID NO: 19865 - DNA, 1174 bp, Mus musculus
gatccctgagttcatggacagccaggcttacacagagaaagaaaccctttctccaaaaccaaacaaacagttgaagctagggacagtagaaggacaggcagaattggttgaaagtcagaaaggaggacatggactgacagaggtgggtggatctcttgtttgaggtctgtctgtccactcaaggaggccatatcaaaaaaggaaaaaaaaaaaaaaaagccagagagctggggcactggtggttgtggtacaggtgcctgttcatgtaaatgacccagtgtggttcctcccagcacccacatggtggctcacagccatctatataactccagttccagggcacctaacatcttcttgcccccagggagctacatgcatatgtatgatcagacatgcatgtaaacccctcccccccccacacacacaataataataaaatagaaactttttaaaatgtctgtactcatggcttcctctcttgatccctacagcgtttgtagtggtctacctgatctacacatggggcaaccaggagtttgagcagtcgaaaaggaagaatccagccatgtatgaaaatgacaagtagacggcctgcacctgggtgacagtcccctgcctctgaaagacccttctctgggagaggaatccacactgtagtcttgaagacaataaactacttatggacttccctttgtgactttgtgtgcttagtttgagacaaggtctcactgtgtgtccctgactggcctgcgtctcctgagaaatctgcctgcctctgcctgctatgtcatggcgatcaccaccatgcccagcacaacgttgttttggcaatatgcaagttcatgacaatccctttctcagcacaagccctgcaggggctgtggtagctatgcatagcgtggaacctggagtgcagggtcccaaccctctgctcccatcacatccttaaggtctagggacaacactgtaatcagggtgtcaggtggacttgctagacacagatgaacttttaactcggcagcctttgaagtaagcattctaatccctttgctgatgaggaatcagagtttaagtactttgcccagaatcatatgactgagttggtagagccaggtaccagtgtgtgatcttaaaagcaagccatgctgccttccttaggtagggaaggccttcc

SEQ ID NO: 19866 - DNA, 1149 bp, Mus musculus
ggaccgcctcttggaacacccaggtgctcctaagccacgcccatcaccctaatccgcgccccatgcacctataggccccgccccgtgcacctctcgacgggggaccttacggacgtatccacctaagatccccagggtggctaataagccccgcccacttgcttggcacccctcccaccaagccaccattcctcttcaagccccgccccttggcaacatcaacctctcccgtgcgttcactacttaccgtaagcccacaagcacctctataagccccacccacgtgtcgctagaagcgcctctaagctccgcccagccctcttggtactggtcctttccggctacacgaaggtcaggccacgcccactcaggtcaactgacaattttttttttgagtctcccccttgagatcgaaagaaaatggtagttcccggaaatgacttcacgttctctaggctcggcttccgctcctcccggaagtgacgggcgaaagccggctcagagctctggaggtagaggtgaccgatcctgggggtcggtgttaggccgtgggaggtttttcgcgagactgagccacgcgtctatcttctgtcccagggccgccgtcaccatgggccgcgagtttgggaacctggcgcggatacggcacgtgatctcctacagcttgtcgccctttgagcagcgcgccttcccaagctatttcagcaaaggcatccccaacgtgctgcgccgcactcgcgagcgcatcctgcgcgtggcgccgcgtgagtgcggggcgggcggggtacagccgcgcacctctccttccgacgccctcgcggggcagacgtggaggagttcttatcatatcgaaatgactggcctaaggtcacttgggtgactccaacggctccctctgaggtcatcgctggccactatctgtgatgaaaggctgatgcaatcagtgtcttgtgttagatgtgcggccgattttgctgtcggtttcatggcattgtgaatatccgtgaaggtgcacttaaatttgatggagaggttgaggcccgatcttgctgtagaagccaggctggccttaaacttgagattttactgccctctcctcgggactgttggctggaattgtaggcatgcgccagcacaacagtacttttt

SEQ ID NO: 19867 - DNA, 3537 bp, Mus musculus
ggcccactgggatagggtgggccaggcatgcatttggggagtggatgcttttcatggccatttagtgaaatggctttggttggtttgtacccattctttaaattttaatcaatttttgcgaaattacttcccaatcagattttgaccctcagcccgggacgccacaaactgaagcgagttccctgctttgctcgtcacaaatgccaaactgactgctctttcccagtgcccagtgctgtcttttgcttctgtttgatttggtctgcgtatcttttaatgtgtctgttttgttttgtttgtttcgtttttatttttcagttaaagcacgcacagacatacatgtcgagagcggactttaggctttcatgtgttaaaccgcttgagttacaccttgtgacccttctcccataacatggtgtgaggacggactgggagccggtacagactccagtgtttacagctttgccatgtccccacctgctggcctcaggctgcctgggcctggccagctatccttctctatgcaaatgcgtcaaagccatgactgctggaacccaaaactgacaaggtttattttttccagagccggtggctggtcttccatttacagtgtcactattccttgatggagcagttatgtgcccgctctggtgatggccccagccagtgatgctaggcctaattgttcatcatcaagccggcgactcatgtggtgcctgccctaggcgtggcctgcggtctggcagatccgtgctacagaattcgcctggttcctctctattttaatttttctaacctagagcttaatttcaataactttttcaacagttctaaatttttatttttggcaccagtataaagacaaataatatctatcgctcccattattttcataagtaacacagattccctgatttttttttttaaaaaactaaaaagatctctaaaccttcttacatagaaagcatccctataatctatagggagaggcggggaataaagtgcctattctgccagtgtctgggacttctttatggacagaaggggaccctgatgagaccacgcccggcgtttttactgtgaatgtaaatggaacagcagccccagacccttgtctctgccctagaggtgctacctgtgacagggaccaagtgcatgtgtgttcagtgtttgactccaaaacagctgcctgctccctcagtgtgctcggtggggagagggccgtcacgtcaaggtcattgttactgcttccctggctgagtcacagggcagggaaataaagaagtctggagtgttaggacggtttgagagggaaggagagagagaagaaagacgaaccacttgagactgagactgtcccctccagctgtgctgtacttccaggtgcgcactttaaagaaagtggccaccaggtgtgatggtgcagtcctatagtaaccgagcttgcactcgggaggtaggaagccagaggccagcctcaaggtggccatgtcgaggtgaggccagcttgggctatccgagacgctgtcagccattttgctctgttcctggtagtgtgcagacctcggggttgagaacggggtgaagatgaatgtccttagtgttggtgcagcaccagcctgggctctgggctcctcaccgagactcagaggccacactgatttgtgctgcatccagacccccgtctccctccccaccaccattccttgcttcctgcccagcccgcttcacttctcccgggaccatcctgatatggcggttcattcagaatgacctggaggggaaggtgggtgggcgttctctaaggcacaacaccccaaaggccgactgtacccatgagaggtgcctcacagcaggagactaagatctgttgatgctctgaggaaaactcccccatgaccagggtggattctggcttcaaggctggacacctgaactatttacaaagacagttttaagaatatgaaattaagttcagggccccggaagcttcttgagcgacatagccagtccgcctctggtcatggcagaactgatgctggactttggtatctgaggcagaggtgaactgcaggccagtggctcctcttggggaaattgtgtatgtattcacttaggtcaaagcctgaccttcgagcaacctctcctagccaatatattattccagagaccaggatgacctagcaggcaggtccactggttgtataaaagacaggattgcaggctcacaatccatgcagagaactctgaagccagcaaattgtaccaccatcccccgctgctcaccaaacatgggcgtactggaaggctgttatactcagtgcccgcctttgacctaaagctggccagcatccctggggaaacctgacttgcaatttctagagtttaagatcttcccatcggctgtggcaagctcttcccctgtgtggaattttgttatctttatttagctgaggttaaattaatctctgttgtgcaagaaaaacatgaagcttgcccctcgagggatctactcctgtttttcccgtcatctgttggcttcaggaggactgccataaagtcccattgacatttactcttatgtctttctctggtcattctgttttgtggtacaatcaccgtgtaagttatggtctaaacctgtccttttgagagagaaaaagatactgttgataatcctgtcagctccttaggcacttcggaggctgaggcaggagaatcaaaaattcaaggccacttagcaagaccccatgtcaaaattatatatatatatataatgtatatatatacaatatgctggacatgtgactcatggctagagaatgtgtctagcatgatcggggactaagttctcaccccagcactaaataaataaaaccaagtcaacagccatcaagcagatatatcccaggccgcccaggatgtgtgtcctcccttgtggtgggaggcatgaattctgacccctgtgactgtgcagcctgaccccgcatatgttcctgtgtgtttgtgtggtctccccttgtttggggctcatactgggtaagaggcccaggatagccagcttgcttctctgttatgttaccatgcatttctaaaaccactccagctgttaatctgtttgcgcctccatccatggacttgtttctgttcttttccatccactttgtactcatttgttttcattaaattttgcatttattttgagtttttcatggtgtcatttttgggcagtagcttcgctgcttcaggtttcttgagcctattgatgtcctgtagccgtggcggcatgcagcctacttccgtggtgacctttgtggaggtagacctgccagaattctgtttcccactgaatcccgctgcagggacctgtgaatgcttgcgggctggagcaatcacaggaggaaaactgcagtctgtggctcttgagttatacggcccaagactgggacaaggtacacattacccccgaggagtttacagctttgttaaggaagcttggcttgagatagctctctatgtgttctcagctcttgtaat

SEQ ID NO: 19868 - DNA, 2355 bp, Mus musculus
tcaccactctagaatgccgtgcgtgttctcgtgcttgctctcggtgacctactctgaaaaaatgggtagcagtcaaactttgccatggtcaatcatgggcagtgttggtccattcgtggacccacgccacagaactgctgccagttcagtctcttgggaaaaatcactcaccttgcacttttttcttctcttaacagaaagcgttctgcaaagcctgagaccgtaattgattctttacttcagtaaatgtacagaattaaagttaaaataataaaaagagtgctgtcccatgcctggagagaactccttaattaagacacgaggacaactgtatggttcacataatggaagctgtaaagcatggagagagactggaaatagcaattttcctaatatcttttagactctttaagtgtctgtaacatgtaagtgcgccgcagctcatggtcgttgggcatggcgcactgtgtctgtcacactgctctgcaggaagtaagggttccgttgttgtacgtgaatgtgcgtttcttagctatgtattcaactaccgtggctctagacaagcagaatctcagactagaaccaagtctgtcttgtttgcacacaacatatagcagatcaccttgtcctgtgtcctgtgtcctgtgtcctgtgccagtctgggctgcccatctaagcagtgacttgattctgtacctgcctgacctgtctaaatgcagtccaactttacactcatcctgactgcatctaagtgtgcaatgactaccttgattgatctcctgtggaaaactataaaatctgacagctctgcaggcttacattctgaagatgcagtttgtgtgctcgcctgtgcaccctccacttctgtagctctgactccacattcagccattgttgttactaagttggctccccacttctcctgaagccagcattagccacttacccttgctcacacacacattctaaaacattccctggacatacagcttacaaacacttccttgtctgaattttaagtttgatggaaataactataaaaaatgagaccaggggttggggatttagctcagtggtaaagtgcttgcctagcaagcccaaggccctgggttcggtcctcagctccggaaaaaagaaaaaagaaaaaaaaaaaaataaaaaaaaaaaaataaaaaaaaaaaataaaaaatgagaccagtctcatttttcagaaaatgaaacaaagtaaaaaaaaaaaaaccttttaattttctttattgtatatataaattttatatataaaaatactcttctggatttcttgcattgattaatccagttagatggaattcctctacataaaaacgttaatactcactgtatagtagggtaacttgtaatagagaagttttggttttgttgtttacgtatataattttttgaaggtcatgtgcttcctaaacccaagtttgaagttatacaatcaactctgagctattgattccaaaagttttgagacttcccacgtgaggataaattaaattgctatgattttaacaagtttggataaatactgacttacagctacattgctctgtgtggctgcggatgactgatcagaggggcatccctggcgagaggtggaaaacatggccggacagttttaggctctcctgaattagagccctgagtatcctggatgtgcaggctgctggtgttagcatggcgtgcggcagcatcttctattgtgagtgtggcctgctgtgactcaatgagctctgtgtgtgtgtgtgtgtgtgtgtcttgcaaaggctcatgtgagctgagcatcttggtgacgtcaaatttcgcaatgatgtaaatttacatgttagtaattagaagaatctatatgccttcattttaaaagtccatgtttctatcatttagcagttcagttggcctagaaggaatatctgctgtgaattaagctaaaacatgagagaaattaaatctagttaaatcagtaacacaagtaactccataaaactaacaatttagaagcttctctaagcatcttgacttagtaattttatttgcttgcttgtttttttgagacagggtctctgtgttagcccaggctggcctgggactcgtcgtaatccttctgcctcagcctcccaggtgctgagaatgcagatgcatgttatcataccaagccatatgtttattaaagcattgatgttaaaactctaatcaggtggacattgttcattttctgaaaaaccaaattcgattctcaccaggtggggaggtctgttgaagaaggtaggaagcccacttctgccacagccatgctgtggctgcttctcatggactctgtcttcatctgcaaat

SEQ ID NO: 19869 - DNA, 1410 bp, Mus musculus
tgtgctgtcatttggagtttctggaggagtcgtgggctgagtcgttgtaagtttcagatgttcgttagatagttgagtgtgtttggatgcccagctgtccacaggctgctgggtcaatcagtttagaagagatctggactgcagacaaacactgccgagcatcagcatagaggctgctggagcaggagttctgggcctgctcacattcgagggcctgtccactgagccatctctccagccccttgttttctctgaggatgtagctctgagggtccacacagccatgttccccactaactgcataaagagtcatgcattcaggtagtatattgatgcacatcttatcatgtctcaggggctccttgtgggatcaagctcctactgcccactgtggggtctgggggtggggctggtttaccagttggctctcaccctggctgactgctttcatctgaagccagttcaggtttggaagagatctacctgttctccctgacattaaggagtctgagatcaatgactttttcctgggtgcatccctaaaagatggaaatcatgccagtgcagaagcagactcgggctggccagcagaccaggctcaaggcatttgtcgctattggggactacaatggtcatgttggtcttggtgttaagtgctccaaggaggttgtcactgtcatccaaggggccatcttggccaagctttccattgtccctgtgtggagaggctactgggggaacaagattggcaagccccacactgttccatgcaaggtgacaggccgctgtggctctgtgctggtgcgtctcatccctgcccccagaggcactggcattgtctctgctcttgtgcccaagaagctactgatgatggccggtatagatgactgctacacttcagtcagaggctgcactgccaccctgggcaacttggccaagagcacctttgatgccacctctaagacctacagctgcctgaccccaacctctggaaagagaccatgctcaccaagtctccttatcaggaattcactgatcatcttgtgaaaacccacaccagagtctatgttcagaggacccagactccagctgtgactaccacataagggtttttatacaagaaaaataaatgaactaagactttttaaaaaaaagttagactgagttatattgtgatattattgaggtcctaggaattaaaaaggaaaacgtcatagcttaatagtgttaactgacaaggtttattgtgctggttggtttgtgtgtgtgtttccaacacaacccagaattgtctatgaagagggaccttcagttgaggaacagcctccaacagactggcctgtgggcaagtcagtgaggcattttcttgattcatgatggatgctcaagaatccagctcactgtgggtgg

SEQ ID NO: 19870 - DNA, 1205 bp, Mus musculus
gtggatggacagcctgctgggcaactctgtgaggctgccgccctctattcaggccattccttgtgcaccatagtttgggtctctgacccgttcttgccctcctgagtgagttaggccttggcatcatggtggctgtgatacaaaaaaagctagactcctgtgggccccttgacacatggcaaagcatagtcccactgcaaacaggggaccatcctccttgggtcagtgggctctcagggcttaggaggcagagtctgagttttcttgtgaggtgaagctggccctgactcctaggaagatggattggggggtctgaggtgtaaggcagaggccatggacaggagtcatcttctagctttttaaaagccttgttgcatagagagggtcttatcgctgggctggccctgaggggaatagaccagcgcccacagaagagcatagcactggccctagagctggctctgtactaggagacaattgcactaaatgagtcctattcccaaagaactgctgcccttcccaaccgagccctgggatggttcccaagccagtgaaatgtgaagggaaaaaaaatggggtcctgtgaaggttggctcccttagcctcagagggaatctgcctcactacctgctccagctgtggggctcaggaaaaaaaaatggcactttctctgtggactttgccacatttctgatcagaggtgtacactaacatttctccccagtctaggcctttgcatttatttatatagtgccttgcctggtgcctgctgtctcctcaggccttggcagtcctcagcaggcccagggaaaaggggggttgtgagcgccttggcgtgactcttgactatctattagaaacgccacctaactgctaaatggtgtttggtcatgtggtggacctgtgtaaatatgtatatttgtctttttataaaaatttaagttgtttacagcgtgtggctttttatttagaaatcagaattggtcttactttttaaggaaacctcctgatgggagtcttttgctggctttctgcctgggcttcagctgagcattgacatgcgtcgatcacgaatctttccagttatggtcaagaagaagatggcaggaggagggggcgtcatgccacagggacatgctcatttatactcatttgccacggaagggagtttttattttaatttttcacttcatgtgcctgaatgt

SEQ ID NO: 19871 - DNA, 1152 bp, Mus musculus
tttggttccatgaaaatacattatcccaacatcaattttgtatgtaactattgtgctgatatgtggaaacatcttcaataaatgaagagatgtactttttgtacatctgtccttctgaaagataaccattaatccagatccttgggtaatccttagatggaggagggtggtagtggtgatggtggtggtggtggtggtggttgggtttctttattttttgttgggttttttgatccccaagagttagattgggggtcagaggaccacccagatgttgagagcattggcaggtcttgaagggcctgggttcaatttccagcagctacatagatgctcacaacctaaccccagttttaggggatctaatcccctcctctcgcctccaaggacaccaaacatgcatacagtgcccagacatatacccaggcaaagtacctgtacacataaaataaaatgaaatgaaaaaatgtaactcaaaaaaaagttagatgacttggctggtgacctttcaccttctcaacaggtaaatgtgctcgctgacaagcagaataaactgagttcattccactgtactcaactggctgatggaaagaatcagctcccgtaggttatcctctgatctctacatggatgcactccaataaataaaaatgaaagaaaatgtaaaacaaaaaagtcagaaatgtgaactggggtgttccgcaatagtagaacatgggcctagaactaggtttctggccctgataccacacaggaaagactcaggttgtccttcatggctgtgtcagccgatgacagtaataaaacagtgcacacacttactgggcatgtttgttaacacattgcaggtttggcccatttctttttttttttttttagtttgtttattttatttgtatgagtaagtacactgtagctgtcttcagacacactggaggagggcatcagatgcccattacagatggctgtgagccaccatgtggtggctgggaattgaattcaggacctctgaaagaacagtcagtgctcttaaccactgagccatctctccagcctggcccatttctttataaatattttgctcctgaatgttacctacatgtgactgttttatgttcatcaaaatacatgtgtgattgtatagagtatatg

SEQ ID NO: 19872 - DNA, 1131 bp, Mus musculus
tgggggataacaactggactgtaaaaaaaaaaaagattaaagataatttaaaaaaaaataaaaaagagcatacaccatgtaagggtgatttaacaacggtaaagcaataaacataatacagtaactgttgggggctgttgtggagctagaaggtctgagagataggccaagaagatggactttgcttgcttggttggccaaggagagatgcacagtgggtggtagagtggggtgagggttatgtttccatagccatggattgaaggtatttataggccaatgggaaagatcctgtggagagggggaggaggaggaggaggaggaggaggaggaggaggaggaggaggaggaggaggaggaggaccactccggacagagaagtgggcgggcatggggaggatctgaggatctgggcaaactgtactttctgtggcatagcagatgcagaaaggtttgtgcatggtttcaactgggctcttggctggtagctgccacagacacggacaagtggccaggtagtattttctgagttgtttctgtgtgtctgtctttcctagtctgggccgtctgcctggtccatgccattatagggaaatccacaccaaactccaggcacagtcccacaggccgggcatctccgttctgggctctgctccctgatgagattctcagactgcttcccctcattcatggagaagcaagcttacagggcaggcgtgggaacctgctcagctgccagagcatccttcagttcagatcgaggtcggttgcttccctgtcttcttgactgtgtgtgtctcagacagagctggttgaggtgtccaatctcattggcctgtgttataagccataggttggccctaggatgagatgctccaggctacgccaacttctcacatttacagaagagccgaagcctggctagcctgagcccctcagagaagcagttaggctttggagatgggtcatctggagagatgaggtgcgctgacatctcagacccttgtcttttccctccctccactcccctcccaggatactcaattcccgatcttagtgacgccagcctcctgcaatttgccggtggtaatggatgtgggggtggtgggaccacagagggctggagcaggc

SEQ ID NO: 19873 - DNA, 1213 bp, Mus musculus
taagaatgtgcccagtgcattttcctgtgaggtaactcagacaaaggttacgttcttgattggagattctatgtcacctgattcagatactgaacttcggagtcaggctgtggtggatcagattaacagacatcacagcgaaccactaaaggaagacagaggagtggctgataagcatcaagaaagtaaaataactaaggaccaatctgaagactctgacacacagaacatagtttctggagagtcctgtgagcttccttgttggagtcattcagatccagaaagcatgagcttgtttgatgaatattttaatgatgattcaattgaaaccaggactattgatgatgttccagttaaaacaagtacagatagtaaagagtattgctgtatgttggagtatccaaaaagattgtatacaaaaactaacaaacagaaaagtgaactttgtaaatgtatagaaacagttcatcaagattcatgtaatgcctgctttcctcagcaggaccagaggaattccctctccattcttgtcccccatggggataaagagagttcagacaaaaaaaatgctgtaggaactgaatgggacattccaagaaatgaaagttcagatagtgcccttggagatagtgagagtgaagacacaggcccggacataaggagacaagctggcggttactgtggaggggaccaggaagactggacagaagaggatgagataccttttcctgggtaagtagaaagctcccttctgaagcagccctgctaacgcatgcactagtctttgctttagccagtctctagagattggggcaactaactttaaaaagagcttagggctccaagatggctctgcagtaaaaagcctcatgatctgagtttgatccctgaaactcaaggtggagagagagaactgactcccaagggttgcccaaagtaatgattaataaaataattttaacgttattatactggctaaaatctcttttactcagaaggaggattaaagactattccccacatcgtcctttctggaggcatcaaagacattaaagaatagaagtgaatgccggggctgggggcagtggtgacgtacacctttaatcccaacacttgggaggcagaggcaggcggatttctgagttcgaggccagcctggtctacagagtgagttccaggacagcccgggctacacagagaaaccctgtctgga

SEQ ID NO: 19874 - DNA, 2862 bp, Mus musculus
aattgtacagcatgccctctttgaatcattgtggaatgatgtattttcaagacatttccattacttgtagcatatattatagaaacttttggttaaaagcttacacagactattattttattactagtaaattgtatttcttgcacatccgtccctagatgaataacaggtcaactgtggtgctttcctgtgtctgttccctggctgctttgcatttagaagcatccattcctttgagtctgtggtgctactgttggtgaaattttccaggtgttgttatctttagctccttgcccttttgcttttgtctaggataagcaccatagtgctgaggttcactggccatggaggagtgactattgcctctaagattcatagtttggatacagaaagcctcaactgagttgtcttttctttatttcaggattgaatccagtgaccttcctcttctggctgcggtagcaagcacccactctccatacgttgctcagatactcctttaacatgtctagaggctaactttgtttaaagttgaatagaaaccaaggagacaggcgctgtatctgtggagctgttgctgttctgtgatgtttgttttgtgcattacgctttaggtgaacgcatcaccctgcgctgcggtctgtgtagaccaaatgactttttatttttaactggacatctgagcagtggtagatttttcaactaagtgaaactaaatcaaaataattgggggtatgtagaggggtggaatttgcaaaagccaaagtgtaacttagaattttctgtgaatatacaggaatttcatacaaactctataaaatgtcacaactcatgaatagcaatagttgtctcatgatcaaatgtcagaaatcttcaattcactgatttttaatttttaattctatggtacagaaatctacaagaccttgatttgtttgttgttttgcaattcagatcaacttatttctagttatttaagtattttttttattaaaaacaactgttaattatgagaaactcagaatgagtgaagatgtcatgtgcccatcccaagtgtacatatgtatctatttttttaaaaaagcaggggtagaaatacaatattgataaaaatgcctttttaaaaaaatattttttcatctagtattgtatataatgttgaaatactaccttctgatgatttttctgtttcacgcattctaaaatgtatttaagccaatctttttgaggctcaaggttctagattccctaaggatactactttttaccatttgttttctaagaataagctaattcttatcaatatttacatattaatttaataaataaaaattaagattaaaaagtgcaccaaagcaatggcaaaaatactgtattttttaaatatgctcaggtggccacaaacttcagtatcgaccattataaacccatatgagcagaatatttcctaacaatcctcaatttacactagtagaagtaatatctttaaaaactgttctttctttaagtgttcctttctttcaaatgttgattgcttttcaaagctttccccttatctgtcattgtctttgtatatagtgcagattgttgcttgtaagaaaggctaataaggaaccaaactcttgtaagtaatgtaaataaaaaggtgggtagatcatgttttcaatatactctactacctcagtttacttgaatactgaattagagcttactctctgcttgtgtgggctaagatatacataatgctagaattaaagttggtttctgttttcattgactaattctaaattgtttagctcaaaaaaaaaaaagagagaaagaaaggaaaaaagaaagaaaagaagaaaggaaggaagaaagaaagaaagaaagaaaaacatacccccccccaaaaaaaatcctacccacgtgttcggttactgaataattttattataacatatccattcttgctatttaaatttttcagtaattaatgaaaaatttctgtggtttatagtcttcagaatcttgaatttatgtgtctggttacatttatcttgctctttatgtgtgttcaagagaattccaactagaaaagaataaatagaatgttttaatggaacataaaccccaaatttagggtatctacagttggccttggttctgtttgttggttccagttagtacctgggtctcccatggatgacttggtgccaaagggtttttttatagatgtggagattttgggggtttttgttttgtttttgatgtccttgtaacccatttgttagtggaattgctctgttgtattctgttgaaattcagtgagtagatttctgttagaatttagaatctgggaaagctacgggccattgtacattattttttgattgtggctcagaataatatgtatagcaggtagataatgttttgggatgttttcttgaacatggaacttttcatagttctatttgaaatctgtcattacttagaaattctagtctttaataagtgaatggcttgtgcacctaatattctcaaaactcagctttgctggaaaggtctatagtttcttaaaaactcgctagtccttataggattcctgagtttgtaatacttttatcatcatattctttacttactcaaagcccaaggaatgagctgctacttcactacagtgtggctgtgataaatgtgaaaagagttttggcctgtttaaaataatttttcaactacttaatggtacagacaaatatgtgctgcataataaaaatacctgtttattgttacaggaaattaaaaagggatcttttatattataggattaaaactaattttctgtatatgttaactaattgatttaattttaagtatcttgca

SEQ ID NO: 19875 - DNA, 1196 bp, Mus musculus
attaaactgtcttttaccttattatatacaatgactattttaaattttttaaacgtgttgtgatttttaaaagcttatatatagtttaaaatctttgctgctagattttcttttacattttgaatgagtgcatagtgctctattataacaatatgccacaattaactaatttggaactcagtatttgttcatgtgtactttttatagactatatcagtgtcctgtcatcacttgcatacagtatacactgatcaatccaaccttttatatatctccgtcaatactctccctaatctcttgttaatcacattttgcttagattgactgtctgtccatgtttctgcgtgggtatgtgaaggtacattcacctgtagtgtgtgtgccctatagaagctagaatccaaatttaagtatatccctctgatgagctataccttaacttttgagaaagtctttcagtgaacctataactcaccattttggttagattgactagccaacgaaacactgagatccaagtttctgtatatatgtatgtacctgtaccattattacctttatagtgatggggactctaactcggaacctatgcattctttgcctgctgaaccgtcaacactgccccaaattggttttttcttggcttcgccttgagagaatgcattgtctttctatatctgattgtacagttaatgtaattcagatccttccttcatgcttcatttgacaggattcgtctttatgtcagaataataactgcattttgaacatatactacattttgtctttgtccattcattggtgggttcatgcatcaactcgagtacaccaaggatgggagttgctctttagcatgtttcattttcttttagataggctgttactttattgccagggctgcctttgaatttgtgatacacacacaaggggaaggaagggagtagaagggcagaggtatcaccacatccaactatgctcagctttttataggtgtttttatactgtcttccataatagttcttctaattacaactcatctatagagggtgagagtgtcttttacctgtacatctttgtcagcattttgtggttttggtttgtctgtattttacagttgacttattggtggctatgatgatatcatattataattttgatttattgaataattatgctctatgtcttaagattatatt

SEQ ID NO: 19876 - DNA, 1210 bp, Mus musculus
gcaaatccctatcctgtctgtgaatctatccttctaaagctgctaataaaggcattgatgttttgccatgttctcaaggtcagccagaaccacttgctgaggcttagcctccaaagttctatcagagagatccacttctagagcctaagatccagtccatgaaaagtgcagagacaatacaagtaacacaagtactgtttggttcctttttaaagagtaaaagtgcatggtgaaatccgttcacccacttttcttctcctgacaaccaaacttcgacctgcttacagtaatttctagttctaggcagagaagcatgcctaatttgggtggagtataaaactaccttgtaactcagggaataatggtgctattagctgcaactcagaaactcattcattggcaagaaatatgagcaagtattgatgtctcagacctttacatacatcaaagacagccagcttggtacatcttcctagaacagagactactgagtacatgaacttgacccagggttattttattctgtagaattgcttgctgctgtgcctgttcattattctcatcttcccttttttcctaacagtgcgtatagtgctagaaagacagtactgaacaaaagtatatacttatttgctgccatcatcacaagtcacagccataaatatccctattgtaaatacagcttattttcctatggaaattcagcatttgtttattctgtcgtgtcattgttcttttttagcatctttcctgaagtaagcattgtcctggagatgtgagctcttcccttagataagacagaaggaggaagtgcttacatatgcatgtcatatgtacatatcttagctagaatgtatttgctattagcaaatcacagaacaaagattgaggtgtttaatcatatggacatttaaatacttttctctttaaaataaagttaatataaaactgagaaaataggctgcagaggagatgacatagtaggtgaaggaagtatttgttacacaagagtttaatacctagcatttgtatttacaaaaaattagtggctgctgctacactgcacagcagtcaccatctcaaggctggagaaatagagagtaggggttctcactggctactcagtttagtggaatcaaggagctccaggttcattgaaagactatatctcaaaagataggtggagaaccgttgaagatacctaactctg

SEQ ID NO: 19877 - DNA, 1213 bp, Mus musculus
aatggaggggacttcatcctggaaaggacatcctttgtgacctcctggacatggcactcttaactatataattcaaatcagtgactgcttactaaaaaaatgtacttttcacatttttacaaattaagtataacattttgtatatatatatttaaaggttttgatttgctttttaatgtaaaggcaaataagagttcataaacttctgtaattacaaaaaaagccaaagccattgaaagtgcactgaccatgacagctttgctacagagcagtcatgttaccaaccgccttttcaagtttgtacttttcccttacgctctcttcctgtttttctgtccaatcacttgagagtcagaacagttccaaatgtaacagtattgtgtcttcccacagaatgcctgtctctaggaagcataatggctgaagattcccctggggagacagtaacccggaagccttagacttgagcccaggtgccgagcagtgcagtgaggcgcagccttactggccctttgagtgtcagctgccactttacagccatgcttcactaatctggcctatgaactaactgtgctggtttctgattgtgaatctttttattcacctacttgcagattgttttcatgtccaaaacaaaagaaatatttttgctatatccacctttgtaatccaagtttgagtactcattgtcaccattttctatccattgctccagaaaaatgtgctgtctgcacagcttctgtctatccaccaggtcttcagacagatggacccttgcctgccttggtccttaaaggtgtacattaaatgtctttcacagagagttaagatctgtggctttgaacctgcattgtgtagctgccttgattttaatcaagctttatctgtgagtgttcagaccaactgatcacattgatcagaataaaaaccaaatgctttgtagtttgatgtgtatgagtccctgaaaaaaatcatgtctgcctttttttttactttgttaggtgactagagcaagggaagccttaaagcccatgattgctccagttctaagcccccatttgtccttgttctaagtgtgcaacattactaaacagactagtgcccagcacctgccaagactgtcaaagcaggagacttttagtgcagagttttgccaaataataaatttcaacaaaatctcagagtaaaccattaagagattagtgaatccagc

SEQ ID NO: 19878 - DNA, 2190 bp, Mus musculus
ttacagatattccaaatgggttctggtccgactagagcagtgaaaggaaagcctgcgttcagaggcggttgcttggctgtaaatgttcagtgtatttatttgagagtaaggacctgtgattgtgagcagatatagcctgtatctgagtgttgtgaagcccattcagtttctcagcatcttcgtcctgttagctcttctttacgtacctgttgctgttttctatttagtcatttggtgtcaaattgtttccactagctgtgtgttgaaattctggcctctgctaccagctgtgacttgcagagtccttggccttccagtgttccacttactgtggaggctgtggcagcttccaacagccacctgctgcctggctgattcacagtgatcagccctcacagtgacactctgtggttagtaagaggcctttgctcaggtcccattctgttcctcttccctgctgagtataggtagctggatcctgcggtccactttgcttactatctaactgcctttgattgattgattgattgattgattagcatttgtgcagaatatggatcttaactgagattagagtgctgaaggcatgtaggtccttgtctagagaagctgtgttcttttctgcctttgcctgcccctgtcctgagaatgctgactgaagagccactgaaggctgacgcaggcaaagctgaaagcatttctcctatatttcttctgaacataacttagcagtagggtggaacactggatgacctgattctttgattttgcaattcttaccgttcttaggtgtcaatcctgagcacagagaatttctctgtcaaggagaaccattttctcactgttgtctttcatttaccgtatggacactgcactctagagtctgtcattctgcttagccagggtgaggttcctgccagggcactgctgtgtgcagactctttctgtataacagacagggatttcttggcatcattggcactgatagatgggacagcacagggagacattgtcccctcccccatcactgtttgctgctccaaggccagtcattaataagccaaaggctcctgaagcccctgatggtcctggcagcctctgacctctcagcacagtgagacattgtacacagtgcaccgcctggtgccctggagggttccaataaggtcaagagaatgtacagagtaacctggtacatggtgtttatggaggcctaaggatgccggcaaaggtgcagggagacatacttcccacctccccacatgggattgtaaaccttgggaactcctttgttcccccagtcacacatctcatttttaaattggagctaataggattttgtacccagaatttattatatagttaatacttctctgaaatacatggtaacaactagtaagcaagagataccgcagattgcagcagtgtgctgggcacagcttctccagtgggcctggagagtttgtccattagcttccctgtggtcattaaatggagctgctagggtagagcagtggcctgatctgctcagtgacttgtgctcagcaccagaagacaagatggacgtatttttataatctaagcatactttttttgtacattgtgttcattcttgaataaagtgagctcactgttggcttgtagatattaaaaaaaggaaagtattgattttgattcaataaatgttttcttttagtctttgtttggatttttcttctaataaaatttcactcaccttatatagagaatcttctagcattctccactgacagcccatgggtgcagacaacttgtcactcttttgtttaaaagtttttttaagccgggcagtggtggctcacacctttgatcccagcacttaggaggcaggtgggtttctgagttcgaggccagcctggtctacagagtgaattccaggacagccagggctacacagagaaaccttttctcagagaacaaaacaaaaaaacaaacaaaaaaacccgttttttaaaaatgtaagctgggcaaagtggtacaggcctacctacagtctgagaggtcacaggattgtgtgttcatgtgtcatggcaaccttgaagactcagttacagcctggtgtgcagccagtgtggtggcacacacctttaatccaggcactcagaggcaggcggatctctgggtttgaggcagcctgtattacagagtgag

SEQ ID NO: 19879 - DNA, 1219 bp, Mus musculus
tgatctgttagttactgtgggtagtctgaaaacaaaggactcagtgactatcagcatgtctttatggaacttaagtatggcaatcataatgttttaattggtgatttttaaataaaatgcttttaaaccagtttatagttttagaatattccctgaaagcaagcatttttatttttcactattaaaacttgacccctcatggtcaagccataacttaaacaaaattgttaagtcactgagtttatgaaattttgacttgcagtaattgcctttagataacatcactcttacttcagatttcaaaggctgagcgactccaagaacactgcaggtgcctcattctcttctcctcctcttcctagacctgctgccgtctctgaaccaaagctgttctttccttcccactgacctggaaccagtgtctgtagaaacggaagcagagaaaagaaacaatcagacatccctttcaatcaacttgagacatttgactccagggacggaggcacggtgaaataaagttattttggcgacattcctcgctctgagggcgcacgttgtggagcttcctgtctgaagacttggagccctcggtggtgctcgctcaggcctcggactgagagcatgagtgaattctggttgtgtttcaactgctgtattgcagagcagcctcagcctgtaagtatctgtgggtcattggctctcaaactgagcatggggaccctggcagcaactgcagttctaggaccgtaagcatccatcaaaaagaacaacaacaacatcaaaaagcccagaaacaaacaaacactgggcttggtggcacccacctgtaatccagtacttgggcaggcagaagctggggtttgaatctgaggccagcctggtctacagagaaagtttagggctagccaatgctatatggaaagctcttgccttaaaaaaaaaaaaaaagcaaaacaaaggatagtgtatttcgaagataaactaggtttcaagaattgtgctaggagcctagtacggtgaatgcctttagtccagcacttgggaggcagaggcaggcagatcttagagtttgaagccagttccagagcagttagaggtacatggtaaggttgctcccacccatggtgggggattgttgtaagccccactgtgcatcacagaggagacagtagttcatagcactgactggtgcaggagggggcgggggggggggagctaa

SEQ ID NO: 19880 - DNA, 1105 bp, Mus musculus
agccagtgcctttacccactgtcttgtcagccttatctgtggccttttaattcagtttatttatttatttgcttatttacttatttatttatttatttatttatttatttattggtctttcaagacagggtttctctgtgtagctctggctgtcctggaactcactctgtaaaccaggctggcttcaaactcagaaatctgcctgcctctgcctcccaaatgctaggattaaaggcgtgcgccaccactgcctttttaaagtgtccattggatactatgaatttaactcattttctagtatattccttataccaagattgtacagaagaaataagtaaaagacttcctttgatctaattaaatctcaaaatattcttagtttcgacatctctatttctaatatctagacttggtcttacatccctgatcttaaggaaggctcccctttgtttctatgtcagcttgacaagggtttcttgggtaaatgaaggagtgtttgtttcaaggtctgtatttaaattatgccaaaactctgaatttcccttccccttagtcttgaatgtttgcctcctgcatgaactgtgaggtccaggattgtttgctctgcagctgatcaggttgtgagttgagcagtcatctccacagacattgtcttttcagaagtacctgcagtgccatcccagcaggactagagtcctcctagcatggaggaaatcaaagggaagaattttcaaaaatgttagcgtaaagaatacttaactcatgataaaaaataacacttttttgggggtggggcgggacttgggtttttttctgagacagggtttctctgtatagccctggctgtcctggaactcactctatagaccaggctggctttgaactcaagaaatccgctggcctctgcctcctaagtgctgggattaaaggcatgtgccaccacacccggcaaaatagcactttttaaagtagtaacactggtgagaataaaggagaattttgtgttacctttacataatttaattttagaagggcagggttttaatttgattagtttccagagttctattagctggcaagataatcatttatagatggcaaagtt

SEQ ID NO: 19881 - DNA, 1176 bp, Mus musculus
ttccacatgtattttactatttaaaagctaccaaagctgtcatagctatttattcaagagcagctatgttatagtctgagtataaaaaactatccttacaagttaatatttatttctgtgaattatatctaaaatatagttgttgctgcccatttttggtgaagtctaaatgttttcaaaacatggtgctagatttatcagatattttaaagataagatttgctgctgaagagactgcttaatagttaagagcactggctgtctttaagaggatcttggtgcaggttccagcacccacatggcagcatacaacattctgtaattcaaactccaagggatctgaggccttcttctggtttctgtgggtaccaggcatacgcagtgcacatgcatacatttaggtaaaacactcatacgcataaaataaaaataagtatctttaaaaagaacaagcaacattttaggtttatttttaataacgttaggttttaaattgccagattattttcatataaatttcctgtgattgttgattgttctagaatgcttttaggtaatacaatttgttaaacatatttttttaacactgacatagctgtaaaagctgtcattaagccgtaattccgtaacttcttggccacctgacattaggttatacctgggtttttgttttttatcctgttttaagaagtatttcagtgaagacttttaatgcacatgttttttttttttttttttttttcctttctcttgagttctttatagattactaattgtgaaaattcaggttgctttcataaaaacactgaaattcacatatatggcttgccagtgccttagttatgtttctgtttctgtgctgagacaccaccttcaaagcaacttacagaagagtttgtttggggcacatggcttcagaaggttagagtttaagacagggtcgtggatggaaaggaactggtggctggagcagcagctgacacacaacaggaggcagagggcaaactgggagtgacactagtcttttgaaaccttaaagcctgcccccattgacacacctccttgaacaaggtcacacctcttaatcctttccaaacagttccatcttcaggggaacaagtattcaaacttgagcctgtgggggctattctcatttcagtcccctcagacattttt

SEQ ID NO: 19882 - DNA, 1153 bp, Mus musculus
agatccatgacatccgctggaactttgagaagttcctggtggggccagatggcataccggttatgcgctggtaccaccggaccacagtcagcaacgtcaagatggacatcctgtcttacatgaggcggcaggcagccctgagcgccagggggaagtaactgatgcccccaccctacccctaccccctgcccatcatgcaagggccgaggaggggctcttcaggaaggaagccacattcccagtcattctacccccaccccagattctctttcttattacataaaagacaagcctggcacaactgtgtgtctgaaccactgtggacacgtgacaattgtcccagtgtgtgcatggctacacagccacgtatctgcctgcttgaaacccagggatggtccatctgtgtttacggcttggcacaacaccctcatatttttttcagctttctgttccaaatgagcccaaaggaaacacaagttctaggtccaatggttctgctcaaacctgaacatcattcttggggccagcatctcccacatgcccacactacacaccaccagcctccttcttccttcctgaaggaccctcctgagcccccaagcccatcccacagtgctcctgagaccagccaagacaactgtgagcgcgatggccgtgtaccccaggtcaggggtggtgtctctatgaaggaggggcccgaagcccttgtgggcgggcctcccctgagcccgtctgtggtgccagcccttagtgcattcaggcttaggctcccaggcagggacactacccccgcgcctctggaggacatgctatcctctcactctgtccactggtatctcaacacccccatctgcccagtaaaggtctttctgcagcagttcagcctacttggaattttctcaatggtagctcccttgcgaggtgggggactgtggctggagacaagggagggtgaaggaagggagggaggtacacagggtggacctctgcagtccacactgcagccctgctcagcttctagaatctgtgacccagttcccatcggctggtcctcacccaccttccccagggcattgagggctgagagagggtgtcgtttctgaaggatggcaactaaagcttacccaagtcctttgcccgggatcttcccacc

SEQ ID NO: 19883 - DNA, 1172 bp, Mus musculus
taaccttcagtgctgagaggatcgccctgtcaggatgctctgtgttttgtctcctgggaccatatgcatctcgtcctgttctgtccctgaggactgagacatgactgagagcaggcgaggttccctcgctcagaaaggtttcagcgcgcagtcatgggctgataacttaccttttccattaaagtctgtctacgccagctcaggagtacaccaactcctgctggaagcttgtaggctacttggagaaacctgagcacttgatacacctccagagatcagccctggccactcctagtcctttgtggtaggaaagggacgtgcaattggagactgattctgcttttttttttaattagaatgtgatgctgataggacacaggccgagcattcagttgcccagagctcactagcaggtcctagagccctgggttacagtgagaaaatcccagttgtaggcctggctctgccactctgccatgtactgactgggctgctatgagcaagttctctgtcaggatacatcattgtctcagcctgagggaaccgtagctccctgtggctctgctctctgattccctgaagtattggggtttgggaggaatctgctgggtgattccttgcctgaacttgggggttgtggttgggggtaggaagtgggtgggtgggtggggggaactgctgggtgagtctgtgaactattttagaggaggggatccggaggtgatgaagagtgtgaacatttggggtagatcaggatatatagaaatgaggtccacagaaccctggggtcttgcagggggccttgggcaggagaaggttgggaggcctagttaacgcctgtctatgagccaggattgaaaggtcccactgagatccttaggactgctgtgggtatgaccagggctgtggcttcagtagcagtgttctagagggaatggagagagcagtactgaactactctgcccaggctgttctctcttcgtttactaggttggggttctctgcagtattagagctgtgattcttagaaacatggtgtttggtcctctcccaggcacagccccctaaggagagcctccctgagctcaggaagcagtgcattacagttagagacaccctctctgccttccctcctgtcagttttgctgtgcaatgaaggacggaagtgatat

SEQ ID NO: 19884 - DNA, 1173 bp, Mus musculus
tgtggttctgacccttccagctctcctggaagtgggtcagggatgggggcgggggggaggggtccactctcctgccccaagcatactcctagctgctccccagccatagtgagttcaaaatcacagcatcccttcatctgcatgcttggtattgttggttgatcagtgagtgtaggtcgttttctgtcctcaaaccggacctctctagttccatcatgtagccccggatctagtccagggaaaggcatgaagagctgcttactctcagcagcccaaggcctgcttaggtctgctggctgtatgtctaccagtgtctgtctctgttttgggcaaggtgttggtgtctccctgtaggaaggtcccttgctgaatggtggcttctgtataggtggctgcctcctactgtgctcgggtgaatggagagtttgggggtttggtctgatggtgtgtatacaaatgctaaattctgacccccaagatctagctgttcccagatgagggaattctcacatacaccagcctttgttgtataaaccttgctccccaatttaaaactattggttaaataaaagtggctacagccaattactggggaaaatagaagtaggtggaacttctgttactgggcttggggtagcagggagggatggacagatggacagaatggaagaactgtggatagaatgggagaacagcagaagaggaggttgccataaggagatggagactcaagagtctaagttatgggacagtttggtcactttctgtgtgactttgtcagtaggtagaaactttagcgaagcagggaccaagcccacatttgtgccaggctccttcaagaagcagcaagggctgaggtccgatacacatccatgtcaaggcccagagcctgaagggagcctggcccctcccccacctcttgtcttcccccccaaggccatggtgggggtcattgccctgtccagtctcctatgaacccttgcttgttagtccctgcatgccagtgtgccacctggccttggctgggtgtctctgggagacagtagcagagatcttagaagtgtggggttagcactctggcaccgtgcacagcagtgatggctggtctggctgggtgctttaaacacagcctcttgggaggtaggttaagttcctctggctctgggccttgaa

SEQ ID NO: 19885 - DNA, 1201 bp, Mus musculus
ggaagcctcagggctggctgcacatgaggatatggggtggcagatggggtcttaactgcccccaaaggaaaggaagcactggtgcctagcagctcagcagggcctgaccctcaagggcagactcctggggggtcacaagtgtgtctggcgaggtctctctagccttgatacagcagctgtgtcggtgactgagatgccgagtgtcatgtctaggccgatggctgctaggatgctgggatgtttagatcggaatgattactttctcactctgctttctctctgccttgccagggtgacacctctggagacttcatgaaggctttgcttgctctgtgtggcggagaggactaaagctcctgacctcagagggccccctctaccaagcagtggccaactgcaccagctgccgccgtgacctgaccaagccattgctccagcttcaggatctaaggaagacgcaaggggtggggttggactgtccatccagctggggcactctctagccattgagggtcccaggcggtcccttctgttatccctcccgctcatggctaaggggctggtgaaccacggccatatactgcattcaactctgatccccttctacctactcctccgcccgccctggtttccatccctccacataaccctgcctgacttgagctttgtcacatctcaagacataccaaacctctgtctatgaaatgagtgatgtgtgtgctttaaagggcgggctgtggtgcctggtgccaggcaagcattctgggataatagagatgacagattaatttgactgacgggtgatcatccccggctgtcaccgtccaatctgataaaagtaccaagctaggaatttccacatccaggtttcattttgtatctatgacacccttggcctcagaccttgggcccaccccttcccttctctagactcagttttgttatctacaaaacaagacactaaaatagctttggctccccttctaacactgaccttctagactgagtgggcatctcagccccttgaaccgtattcattcttttaaaagggaagaaacagggctagggagatggtcacttaagcaagtcccgaataagcatgaggacctgagtttaatttccaaaacccatacaggccaggcatggtgacacacccctttaatctcgcactaaggaggcagggaggcaagcagatctctgc

SEQ ID NO: 19886 - DNA, 2169 bp, Mus musculus
ctagagctaccgagctggctgagcacaggcaactaccgcatccagagtatcttgagcagtggtgggaagcgcctgggctgcatcaagattgctgcctctctcaagggcagataacctggcagcagccaccacagaatgaaggggcaccagcacggcaggcctcttcttctgtgttccggtgcccaggcctgcctgcctctaactctatcctcctacggttctctaccctctctggaaatcattgcaacctgacctgagggaggatggaccaggcccaacatctgatgggctgtaagccatgctcctttgcacccctaccaactttctaagaatttctttcgtatccaaaacagtcaaggaatgggaaccaacatgtttgggaatcctaaggtcaaaactggcccaacctggacctcctggagttatgctcaccccacttctttgttttagtcaccaactttaaaaccaggataaccgtattaatttctcattccatcctgagcctctcttcctgcaaagaggtctaggtagtcagtcttgggtccctctattaacttctgtgattaactgcattctctttgcaacttaacttgtcaacactggggctgacagatcctgaagaggcagggtggtgtgtgacagaaacctgtgagagttattgttgggcatgctccagtaacccttggcaaagcacaggtacctgtagggccaagccgaagacctagggaggcacagcaatcacttctgggagcgatgcccatttttcctttttcctttttttttttttttttttttggtatgatgccttcaagaatgggatggcattccttatacctgacaagaaacaaccaaaaaaaccaatagcacatgtgctctggtgccaggtggccagggtctggaatggcatatctagttctaaagaggtgcagtcccctgcaagttccatgtaaggaatgttgccagatatttgcaacatttttcttccttaggccccaaacccagccgtttatatgaaattgtagaatttttaactattggaaacaaatggtttttttatatatacttactatgcaggccaaaggggccccacggactcacccagggacataatctggctcccaggtggctgcttttcctcacatctgttcatcttctcaatctcaagttatctggccgcatctcttcccccttcaaggtcaagtccttggtgcctggcctcaaagagggctcagcctgcactagagcaggtctacatggcttctgagagctgggcactgtgccaacttccgagccatcaccaccagagtagaggggttcacactggagtagatcccacctagcagccaccacgtggaacaggggtcctgtgaagagagtgggtcccacatcaggttgcaccatgacaacttcctgagcctcctcggacagcccaggttctggactagaagactggtctggcaataaatctttttaacttgctgtgtgggctccttttcttggctgtgtgcttcattgagcatggctgcatgtttgggagtctgtgatgggctgtggctgtggaagggctcagtgggtggtccaggggagtccaggcatctctggccatgggtgcttgtgttcatctcagcagcagccggggcttccgccttgctctgtttgggcctgaacgcccagggttgctttcagatcccttagcctagttttctgccattcaaccttaaagctttccactacatatttttttcttttggttttgtgtgcatgtgcatgcatgtgagagagaaagaggagagagaggaggctagaagacaaccttgggtatcattccttgggtgctttccattttttgtgttaagtcagggtctcattaacttggaactgctatgcaaaccatgctgtctggtcagagagtcctgggtatccacctgcccccacctcacatcccactattactgggattataaatgtgttcatggttctggggacccgaactctggtcctcaaatttgtaaggcaaatctgctactgagaggcagggtctcattctatctagtctaggctgacctcaaactcctctgtacataggacaagcatgaccatgtccttatgctttcaggattacaggcctgtaccaccacgcctagttctcttgatttgtagtctgcactc

SEQ ID NO: 19887 - DNA, 1100 bp, Mus musculus
cgcgcgcaaaggagatgggggccatctacaccgcatacaaggtgtagatagatggtcattaaaaacaaaagaaatgttggtcgttctctagttttccacactgtggagacctcacctgtggaaaccgccatcttgtttttgtcatttatctgctaatttcctgccttgagtggagctatgcaaaaagcaaccactaggcggcagcaatagccagcttttggcagaaggtagtctctgcccgctgaggctttggttatttccttttcctgaccatgatggggaacactgtgctcaaggcagcatcaagatggagggggccagggccagtcacaatgctcagataaaatgtcaccatctatgttacagataagtgtgttgaactttctaaaccactaagtcttagcccaactcagaaatccagcagtgaacaagaaaaacatagggtcatgcctatgggccaggggcagcagacagagacatcattggagtcgtttttttacttctgaattcttgcaatgaacatcttctgttacctgtcgggcaccaagcataatacagggctcttatataatagtttgggtaaaggtgttataaaaacaagagcttatataacattgtagctttgtgtacccaacagtagagtctacgggtcatctcctgagtcttgaccttgtaacttgccatggtcaacagtaaaagtgttacaaatggaaattcgatgatggcttccaccctgagactgccttctctttctgctttgtggagctgatttttctttaaagtgtgtgtgtgtgcatgtgtgtgcaccagagagaatgttaagtcccctggagctggagttacaggcagttgtaaaacacttagttcctcagcaagcactcttaaccactggggaatctctccagccctgctttccacatcatggatctgagaacaccaagtgaaatggagtgtgtgacatcgtgcccagtctcctggaggataggggaccatatggaatagaaacgactcatcatgatcgaatgccacaccaagatcaaccagcctgtttctagacacacgtgtgaagccatatggacaacgtccgcagtaaagttgac

SEQ ID NO: 19888 - DNA, 3335 bp, Mus musculus
tttccagacagggtctcatgtcaccagagttggctttgaacttgcttgctgtgtagtcaaggatgacgatgggctctcagttctcctaccgttgcctcaagtatggaggttactagcatgagctgccactcccagctggctcagagacctcaagcagatcatgtgagcatgcaccgcctctggaagccccatgcttctgtggacttccattcatgagactgactccatatgggcactcggaagtactcgtgtatacaaggctaaggacggggcgcagttcctcttcatagacactacgcacaagggtcattgtttacagttcctggggagagagcagaatccctgccttgccccaagctgcctctgtatcctgggcttccaaggaaccactaaacactaactgtggcccatacctgcccctattatgcctctcacagagtcacctggcttctaggtcagtcatcttagggtgtgcctttagaggccactgagagtccatgacttgccactgctcccctgttgatgtcaggattcccaaaggacagctgttggctctccatctctgggttatgtgtgtgtgtgtgtgtgtgtgtgtgtgtgtgtgtgtgtgtgtgtgtgatagtgaacacgtgtgcatgcacacatatgcacactacagagcggtttgtgtctcctctctggttaccaggctcttaactacagataggatttgccttgaaactcgagttagagaaagaagcaagaatttatcagagtgctgcttttgtgtttgacagaagctagtggcccaaccttgcagccaagccccttctcgctgttctgtccagagcctgctgcgtgacttctaggtcacaggatgggaaggatggtttctggctacagcagccactgtccttagcagcgttgctaggagtagccattgctgtcttggccccgaggagagcaatgcttttttccctttctggcatcagcatccccacaggtgcttatgtggcctggttccagctgggactcacagacgccttgctttctgaagtctcaggctggaaagtgaccaaagtaggtttagacgctggccagcaacccaactgtgggccaggctctctcttagaagccacctgagcttggcttcctgggtgggaagaaagtctattctgaacttttacaggcgctcctacccaggtctagacccattgtccaaggccagctactcttcagggcccctggcctgacacggtgtggtgtgccttctgtagcatttggctgagggcagcttccttggtaccttggtatggcccacatcttttgacctcttgctatactcctgaggtactgtcagtttggtgacctgactctttgagcaaggtcagggcctttctggatggacaccaggaagctgctaagcacatagtgccaggcgccacacacagcccaggcgcccacaggagccctgagtcagagccctcctgacccctcccactgtcagtttggagccagatggcccccggtgggaaaacagataaatgggagcttgggcagaacaatatagacaaggcttgtggaaactaagcctgaatccagatgccccagaggcagacatgccccatccttgccagcccattccttgtctgtacccaaagtcagaggccagttatcgaaaacttgaatgtgagcacttgctgggaagcatgtgatctagcccgagcaacccaccgtgcccttagctgtggcatcacttgtgctgctgtctgggtcgggagaggtagaggttagcttaggcccacctgtctcacctcactagccacacctatgggcaggtgctcctgtctgctctcttcccctggaagtcttgtgctaagtgtgatcagtggtctgaagctagatcccagagcctgtccttaggctgtctcatcctcagatttctccctcccgtcagtgtctgctctttggattccattgtttcacttgatccttccaggaagtgcagagctcagatcatgtttacagcactcactacccccttctaatgcccgcccgcccacctgcctgcccgacaagggctctggacaagggtttgctttccctgctagccagccccagccaccattcccactggcacactgaggctttctggggcctgatatgggaaccagacagagtggtcggacgtggcaatcaggagggtggcgccaagctggcttgagaatttaattttccaaagtacattacaaatcagataccattaggggaaagcgggccatgtggctcatctttgaaactgtggtcaatacttgaaggcactttagtcctgctggccgcgccagcttccgtctggccggtgtcttctttttctgtgtgtcccgagccattcactggtcagagacattaaaccgtgctcataagcagttatcaaaaaaaagcagcagaaaatgaggctggaaggagcctggtgtttaccctgttctttggtttaaatcaagccgatgttgaagaagctggaattttttttttatgaataataaaatcccacgtctatatcgtaaagctgtcagtatatgttgaaatcaaggaacgagagaactgccctacagagagtcttaacagccagacagtaccgtgtgctggcgcctacctggatgtgcattgcgtacacgcgtggggcatgtcagagcttcagatgtgcattgcgaacatgcatgggtcatgtcatagcttcagatgtgcattgtgtacatgtgtgggtcatgtcagagcttctaggtctcatttgggttgcacatatggatcttgtgttaaatttccacttcaataaatgaattttattttttatttttgagaggttgcaaactgtgtctttgttttcacacttcagggaaaaaaaatcactgagttaggacaatctgacaaagggacaggggtctgagaaagggaaagcaaccctgtttccctaaaccacttcgatattctcccgaaatcctgggtcgccttctgcatataccagtgggtagttttagggatcagcttggtttttcagtcaaatatgagcctgggtgtttgcaaatgttaacatttagagcagttgacaaagtaaagattacccttgctagtgtgggtggcttcatcacatccaaaagttcttaaaccgtggcctccctgaggaggaatcctatctccagaccacaagaccagcttctcagcttccacacttgagtggagaccagccctaggaactgtacacctgtcagccacagctaagctagttctcctttgaaatttgtttctatattctctctctctctctctctctctctctctctctctctcacacacacaca

SEQ ID NO: 19889 - DNA, 1918 bp, Mus musculus
ttccctgtcagatgggctaggaaactgaggctcagagtagggtcgtgtggtggtgtcttgggtctctcctgcaggaccatggcagagctgtgggtaaagccaggatcccagccctgggctcctactaccggcttcccatactggactgttgttctcccacactcacacccttccctactcttccctgccaggtacctgtcccacactgagctggccccactgcgcgctcccctcatccccatggaacattgcaccacacgtttctttgagacctgtgacctagacaacgacaagtacattgccctggaggaatgggccggctgctttggcatcaaggagcgtgagtgtttgggcttaagaatggaaagaagtgtccttgagggatgggatgttgtcccttcccctctggtggcccatttccctctcctgctcccactcccactgccccccttctcttcccgaccagcccccctcctgttttcaagtggtagagccttattttaaccacgccccttcttcctttgcagaggacatcaacaaggatctggtgatctaagttcacgcctcctgctgcagtcctgaactctctccctctgatgtgtcccccctcccattacccccttgtttaaaatgtttggatggttggctgttccgcctggggataaggtgctaacatagatttaactgaatacattaacggtgctaaaaaaaaaaaaaaaacaaagtaagaaagaaactagaacccaagtcacagcattttcccacataactctgaggccatggcccatccacagcctcctggtcccctgcactacccagtgtctcactggctgtgttggaaacggagttgcataagctcaccgtccacaagcacgaggagatatctctagctttcatttctgttttgcatttgactcttaacactcacccagactctgtgcttatttcattttgggggatgtgggctttttcccctggtggtttggagttaggcagagggaagttacagacacaggtacaaaatttgggtaaagatgctgtgagacctgaggacccaccagtcagaacccacatggcaagtcttagtagcctaggtcaaggaaagacagaataatccagagctgtggcacacatgacagactcccagcagcccgggaccttgctgtcttctcgactcttagggcgtttctttccatgtttggctgttggttttagttttggtgagccatgggtgggccagaacatcactcaactgcaattgggctttcaggttcttgccgggagctctaggcactgggaggctgtttcaggaaagtgagactcaagaggaagacagaaaaggttgtaacgtagaggaagtgagactggtgaattggtttgatttttttcacatctagatggctgtcataaagtttctagcatgttccccctcacctctccccaccccctgccacttgaaaccttctactaatcaagagaaacttccaagccaacggaatggtcagatctcacaggctgagaaattgttcccctccaagcatttcatgaaaaagctgcttctcattaaccatgcaaactctcacagcaatgtgaagagcttgacaagtctttcaaaataaaaagtaacaacttagaaacggctgtcctgtcccgggtgatggtatgtgtgtcttactctccggtgcttcgttttcaggtgtgcacaaacatggccatacttgtgcacagaagcaaacactccattgtgcttttatacacacacacatattcacacactcagacagggaagatatggctcctgtgagcactaatttaacacatgaagaagccagttcctgggctgggatgtagctcagttgataaagtgcttacccaatatgaacaaagcccaggttcgatcgtcagcgcaacctaagct

SEQ ID NO: 19890 - DNA, 1189 bp, Mus musculus
atagtgtcctcctcttcctctttctcctccccctcctactccccctctattctcactcttccagttctagtgtctataaaagaatcataccacttactggctttctgaagtaattaatatatataatatagtaatacaacaatatgtagtataacaatatatattatacttatgaggattcattttgttattatcgttaccaaacatcaccatagcccaggttggctgtaagtgaatacctagcccaggatgactcttaaactcatagcaatctttctgccttagcttctcaagggttgggtttgcagaagtgagctgccacacctggcttatggttttgttttgtggtgctaggtgttgaatccagggcctgtgtatacaatgtatgtgctctgtcactgagcctcaaacccaagacctaaagaaaggatcctggggtctagtggccctggcgagacacccagaaggtggagcagtttagggaatacccttgtgaagactggatcaccctgtcccttaagccaactctgtgtcatcatgtttagttgcacaatgtgtaggcagaggtagggagctctgagctggaacatcggcctcctggagcggacccctgacctctgacctctgtgctgtgaaagaagtcctttcctgccgtggtcctcagtttggagctcagataactgttgactttagctccttgagcagcaaaaaattatcctctgaaactccatttcagagcttcttctgagagtagcttgtggagctatgctaagatttgcctggagcaaagaaagcctctctcccctagggccttcacacccatgacctcatcaccttagtgaatcctgagcagaaggaaatgaatgcttctcttttcaagctagaaaaatactgcagaaaagggaacatgagggttgcaggatgggtcaggttgatggcctctgacatccctggcacacactcccacatgcaaataagtgaataattgtaatttacttgctacgtactatcttgtagctttaattttatttgtgtgtgtgtgtgtgtgtgtgtgtgtgtgtgtgtgcgcgcgcgcatgccacttgtgtacagagaccataagagagggcttcagattccctgagagtgggaattacagtggtaactgtaacatccaacatggttcgggaaactcaggtctctggaagag

SEQ ID NO: 19891 - DNA, 1096 bp, Mus musculus
gggaaaaaagagtccttggttaacttaactgccatgtatgtagtttctttggaaggttggcttctgtttgctgatttggtttggcccatttcaagaataagggataggtgaacttgtgcgtgctcacagaggccactaggctcattagaacctttgatgctggagttaaaggcagttgtgagctatcctgtgctggtgctgggatctgagtgagcactaagtgttcttgatcacagagccatctcccaacctgccccttgagtttgctgtttgggtgtgtgtattaaactgtatcactgtttcttaaagaatgaggtatgcttacttgtgtttgtactgttctttggaattagtcataagtatgtaggtgtgtttattgcagtatggagaattgaacccagggccttgttcatgctggttagacactctgccactgagccacaagcccagttcaaacactgttgcgataagttagttccatggatccctttggctattttcttagctaaggacaactatctatctggctttactttgcaggtattgaaaatggcgttgagacattttcctcagtactacatggtgctttttaaaacagttgacctgttttattaaaattgctttttagatctttttctgggtggtttcaaattcattctgcaacccagggtggccttgaactcaggatcctcctgctggggctcactcagaactgggattacaattgtgaacgtcttccgcctggatttctgtgttgacttcctgattattatacagagtatgactgttagtctggtaaaccgggccttagtcctgttattgtggtgtagtaagtgttggttttcagttttgggagtgatgcttttaaggtttttattttatttttattttattttcctttagtgtcctgtggtataagcaagctcagccagttcctcgttgatgttgccaatcttatattttacatagaaggcaacagttaagtctctttttgtcttatgctatggtgagttctttgtagatgggcccaggagagaattattctttccagactctgtcctcatagtccagcacccacctttgcttgttacttact

SEQ ID NO: 19892 - DNA, 1111 bp, Mus musculus
tatgttcaggtcttgccattgtaaagtcacatagttgttgtatctggtttataaattgtgactaatcttgggatcctgtataaacgtgctgctctttatcagttttgcataccataattctttttcatttgaggttcttggctgaatggtgacagatgggaatgtctgatactatccaccactcttgtgttcatttattggcattatcttataaggatccccttaccctaccattcatttctagtatatttactgagttatgattcattaataattgtttaacatatcctcatgtcctgggtcttgttagtgggaacccttcatgctggcctgttttggtgtgggcatggcatgcatggtttatgtccttgtgttgaccctggccctgatcaagccccactagctgatggttccattcatgatgcttgtctgtagttgggtttctgaaggtaccacaggtggatgatgagggatggcatctgctgtgccttctccagagagaagggcaagaaagctgcatagatacggaatcagctcatacgggcttcatctgaaaaattttatttaggatagtattttgtcttttttttcctccagagctgaggactgaacccagtgccttgcacttgctaggcaagtgctctaccactgagctaaatccccaagcccttaggatagtaaaatactatccctgtcttaaaaaaaaaacaagcccatttggatgtttctgttttgacatagaactgcattatgtagctcagattgtcctggacatcacagtgacgtcctgtgtcagtcatcctcattagtgctggaattgcaaatattctagcctcaccattgagggtgtaggcaggatttagagtaagattccagctttaaaaaatatgtgtatgtgtatattttgtctatgtgtatgggtattttgtctgcatgcatgtagtgccctccgagtctacaagagggcagtgggttccctggacctggacgtacagatggtagtgagtcgctgtgtgggtgttggaattgagccggtccccagcaaaaacagccagtgctctaaaccactaggccatctgtccagcctggtaattccaccttttgagaagct

SEQ ID NO: 19893 - DNA, 1111 bp, Mus musculus
ttaactcgagttgcaggaatcatgtttttggtgcactgtatactcttaaaaacatgtatacacttaaaaacatgtagacatataaaaatactatttttaagaggacagttttggcctacatgacaaaaacccttgtttaaaattttctcatgacctcaaataatgagtgtgatgttgtcttagttttttatgttcctgataggccactgagccacgattgttccagatgtcagtgctcagtgttcaatcaagtgtttatcaaggtgtggtcaaacctgttcatgctaggctgagagtgaagatgtgttttacggaagacctacttactgaggtcaggtatcaggagggagaacaaggccagggacagcgttccttggcagctggtatgggaatataaccactgttcttggtcataactgatgtcttctcttccagaactcctggtgcatggagtttgttaaagattgatttatctacgtgttatatgtatgtgggtgttctgtgtgcatgtgcttctgcacatcagaaaagggcattggatcacataggcagtcaggaccccagaaagaaagatcttagccactaagccacttctccagtccccttgtgtatttctatggggcttgtgtgtggttaaagccacagatgatgacatttactatattttgagactgacttgccttacttggcttgctgggcctgtgctaggcctcagagagtttgatctttctctagcccattcaatacaagggttttgtgatacatatattaataagctaattaacattaactgaaaaccacttgattctgttttgatcattatatttatcagaatttagccatcaacctcttgtcctgagactctctggagtcattagatggctcagagtatctgggtgagtcccagagacaggtcaaattttccattccatgacagcaatgacttggaggagcatttagaggagcctgtagtggaaccagaaccggagccagagccggagccggagccggaacctgtgtccgacattcaagaggacaagcctgaggctgcattggaagaagctgctcccgacgatgtgcagaagagcacttccccggccccggctgatgt

SEQ ID NO: 19894 - DNA, 2222 bp, Mus musculus
ttgcaggactctaggaattttgtttaagtcagtttcatggtgtttttacttgagaggtaccagtattttgcctaagtatgtgagaaggttttattctcaacgctgtggaggcatctgtatcatggtgtttcctgaagtttgctttggttattagtccagtgatactcatgcttcagggctgtttacatcagcacttttctgcttcttgcatggttcaccatatctgcatgcaccagtcacacagatgttttctgagctcagcactttgtgagaactagttggtggaaagctgcttgctcagtagggtgactttgctcacgtttgatagtcacggtcaggcgctgatctgagtgtctgctttccttggtcctcacacagcccatcatgttccgaggcgcggtccgcctgaatgtggaagagaagaagactcgagctgccagagaaggcgaccgcagggataaccgccttcggggacctggaggcccccgtggtgggccgagtggtgggatgagaggccctccccgcggaggcatggtgcagaaaccaggctttggcgtgggcagggggattacaactccaaggcagtgaattgcttggctctgatctccacacagcacacagccccggctcctgcagaatggtgaattcctttaaccagcgtttggtgtctcggaatagtctattataaactgcttgagtttgtacaattttcatttcgcttgtgttcatggtgtgtgctcccaaccccctttcctcccctgaccccttagtccttcattcccagttttccggaatgatactttaggaggaatagattgtaaagagggaagactgaccttcctgctcacgctgcgtatacagactggactttcacggccattccccagaggagcgcgtctcggcttcactgacagcggaggtttcgttattgggagacacaggatttgataaacattttggaagcaggaaaaatcaagtcacgactcctttctggtgtggaaaaattgccttttggcacctggcgctgggtccctgctggtgtggctaactgaataaaaggtggttgcagacctttgttcttttgacatgtgattaccaaacaactctaagcctccatttttaccattggattttaaattgtgatgtagcctgtcaatgtctagaacacagctaaggacttttgttgacctgttagaaatttttttttttttgaggtagagtttttcatgttttatttgtatttgtaaaaaaaagaaaaagaaaaaaaaagaaaaaagaaaaaaggacaaaaaattcccacaagaaaacaaacccccaaatctgataacaaaaaccaagcaaaactgtgccttctatttatctttgattccggtcggtcctggcaattgtttaaagaaaagtaataaagattctagatttgttttcagattcaaagtatgtgggggaactgtagaatttttttgatcacgtgtatgtgtcgtgttaacattgttctgccttatcctaaaatcacgccccagactgggatgctgctgaggaaggtgcttctgtgaggccggtgacctcagtggctctgtgcgccacgctctgctctgctgtctgtcagggttcctgctgggccagaagagaaatttggttgagtatcggacttggctaacgtgctctagggtctgcatttttttctttaaatcatagccatatggtaaattttctattttgttacggttctcttttactgatggacacgcagtgggtgtttcttggaaaaaggccaatttttattaaaatatttctggaagaaaacttcatctggcaatgtagactgctaaaactcacttcccagtgttgtgtgttgagtgctgtgtgtgacatgggtgaaggttttgttcacacgagcctctgtggacaagtccctattagtctgtagacaaccagagagtgtgtgtgtgtgtgtgtgtgtgtgtgtgtgtgtgtgtgtgtgtgtgtgtgtgtcttcatacatgggcgtaccacaagcatgcttgtgaaagtcaggacaatttgggagccaggccttatattccactgtttgaaacgggcccataagccacaaacttctatgggctcctgtgagtctccaagtgagtcttctatggcctctcgctgtaagggcacagggatttcaggcatgtgccaccatgtctggctttcctgtggcttctggcgattagtcaggtcttcat

SEQ ID NO: 19895 - DNA, 2432 bp, Mus musculus
cgaagcaagttccagtcccaccaaggttgcatagtgtgattgtcaaaaccccacattacttctgagaaaagtccaagtggtacccaatggcagaggcctgtatagtctcagacgctagaggcctcagtcacaggaagatctttcaagttctaggctagtctggcccataaaatattctctaaaagtctcagtaactcgggtaggtctaaaagtgattttcacaactgagtactaagttgtgcatttagaaaagaagttcttcttagtcaggagtattaacctgatgaggtgattaatatttgcagtgcaaggtgagggggtgtcatgggagcatggcaatgacccacattctcttgagaacaagggtaacaatgatctgagaaatagagcaacccgtgggtgggttgggatatgaaaggcccattctcttctacctcaaataaatgtgtagcagtacagctctgtgtgtgtgtgtgtgtgtgctctcgcgctcgtgcatgctcgggtgtgcatgtatagggatgtagcagtattgcttgtgactggttagggagttgcttcagccctgcttcccagcagcgagcagcactggggtgggagtgtgctttggaagggcacaggcctgaacttggcagcacattttgcactgctggaaatctggatgtcagtgacaccatgtgaaacctaaacctcagagcttaagaggcactcgtggccacacaagaaagcacaggctttttccagaagtgcctgaccctcaaccttctcatgtcaaattaagatgcgatttgtagggaagactcagtagatattaaattaagatttgatttgtagggaagactcagtagatggttgttaatgagcttaagacctaggacttgtgatgggtattttagccaagtgagtcttcgtgttttatgtgtacgtgtttgggtgaatgttggccatgtgtgtaggtgcctgaggatgcctgtggccccttggagctggagttacaggtgagtgagccctcctacacaggtgctgggaatcgaacttatgtcctggaagagcagcaagatactcttaggcaggagtccctgttgtcagacctgttggaagtaagtaaatcttaaccaagactttgatttgctgtcactgggaggtggcattcctgtgctttgccagctcagctgccgccttggagcagtggggactggagagttgaaacaagggcctgtggcgaatgtttagtcctggtgctcaggagaccaaggtgagaggactgaatccaaaaccagcctcgattacaaagcctggctcaaggacaatacagcaaaacaagtgaacccacttagttaggttttatgtctgccttgaattatgacccagtaataaggggaagagatggtgagaagcagttgagcaatcagggcttccaggagcaggcagggcctcgggcaatacctacggtattgagccaaggagcccatttcctgtccagtgcctagggtggaattgcccccccgaagacccaggtggcattcagaacatagtagcacccctgcttagtgagcttagttgccctctacagagctgccccccccccctcaggggatgagtttactgtcttagcaagctgcattttatgagctatggggaaggggacaggtggttctgtgtgtgtgcaggagctgtccaccatggttttttgcttttttttttttgagacgtctcactgtgtattcctaactgttctggaacttgctgcgtagcttaacctctttttaactcacagaggtttgccttcctctgcctgccaaatgctggtatttaaggcgtgtgccaccacaccaggctctaccttgattttttttttttttaataaggcttctcacctgttactctgattaagctgtgattaagtcagtgagctccagaaacccacccatctgcctccgtgtgacaccatgtgtgttctacagactgaattcgggtcctcactttacagagcagtttctccagagaccaggtttctgtgtgtcctggaacttgctctgtagacaaggctggcctcactctcagaggcccacctgtctctgcctggtgggattaaaggcatgcaccaacacctcttggctgctaatgtgatgttttaatacctaaaactgccactttctctgaggtcctttggcactctgtattctgtgcgttggtatttttgccccaggggcagtgttttgggtggaaacatgccctgttgccaggctatgtatgtgccatgtatgtattacgaactcactgttccttttcatttgactcacacttgtggaatgacgagtccccatgatactcccgggtgttctgagaccttagcttcacgtgccttctcctccttgcacatgtgcctgtgtgccccacctctctctcatgctgggttttgtcaagacctg

SEQ ID NO: 19896 - DNA, 1476 bp, Mus musculus
tattttctccttcctgtgattttaacgtttttctttttggtgacttctcaatctcgccaggcctcaaacagcgcctcttacattcaagatgccttccaactcctcctgcctgtgctgcagatctctctcatcgagagcaagacagagtcatccacgtgtgagccacagtccagagacctctgacagaaccctgaggagcagagaagagtcctactgagatggtgatagccaagaaatctgactttgctcagggagccctgcagccagagcgaggcatagtactacgtgtgtgaaaggccagcagggcgcaggctcacaggggtgcttgcttctctgcgtagctgatgcgctctgctgctcacactgctcttccagccttataagtaataaattattaaaaaaaaaaaaagaaagaaagaaagaagaaaaaccaaatgtatttcaggaaagtcagcaggatattctggcaaaaatgctggactttcttagctcagaaaacactatagactgttatggatgtcatttgcagccagtggtaaaattgttaagcaggagagaacaaaacctcagtttggtgtcctggggtttatgacattcgtcgtagcctgggctttctcctttccagaataaagcctgtggcttctagagaactgagactacattagccctaagtgagatggccggacagggctgtctagatgtttcgcatggagtagaaactcgtagccgtgtgtatgaaccacagggaaatgccctttggcttcaaatgcctctcttcccagtagaccatgcagtctgcaggtgctctgagtctcttcaggctgcattgtgcatgccctgcctgaggctgcactcatgcaggcacatctttcagctgccaactccagagcaggagggaggagtcttttggtgatggggttttgtggagtcctgtgaagatgttcacttacagcaggatgtagcctcccaagtcccctcattgttcctctgttgtcgtgtgtttgttactgtgcttggagaggagctcacctgccgtccgtactctcgagccctcctcgcagttttcagcagttcaaagctattttggtatccaggccttttgaaaatgttcattaactttgtgatttttagtggctccggcaactttggagagccctgttctttatctttgaaaaccattacaataaaatataattatacctactttataagcgtggtatttaatagcgtggtaaatacctaaatatctagaattaaaatattttacttcaataatgtccattttcataaaaggcttaaaaatgaagcatttgagaagcaagggtattctgagaataaggccctgactggtgtgtgagggaactttgaaaatgcgcacactgctatgactccagctgcagcccactcctcagacaccagtcttcttgttttctgctcagaagccttgctggttatttgtcgtcgggaggaatccca

SEQ ID NO: 19897 - DNA, 1198 bp, Mus musculus
agacaagctacagtaattttatgaaaaggcaaataaggtcttttctgtaatttttttcttcatttctgttggatttattaggtggaaaatggttggtttctgataacttcctaaatatcaccagcgtagcctttgatgaccgtgggctctatacatgtatcatcacttctccagctcgtgcctcctactccgtcaccctccgtgtgatcttcacctctggagacatgagtgtctactatatggttgtctgcctgatcgccttcacaatcacactcatcctgaacgtcactcggctgtgcctgatgagcacccacctccgcaagactgagaaggccatcaatgagttcttcaggaccgagggggctgagaaactccagaaggcctttgagattgccaagcgcatccccatcatcacctcagccaaaaccctcgagctggccaaggtcacacagtttaagaccatggagtttgcccgatatattgaggaactggccagaagtgtccctctcccgccccttattctgaactgccgggcctttgttgaggaaatgtttgaagctgtccgagtggatgaccctgatgacatgggagagagaattaaagagagacctgctttggacgctcaaagtggcatctatgtgattaacccagagctaggccgaagcaactctcctggtggagattcagatgatggttctctaagcgagcaagggcaggagatagcagtacaggtgtctgtccaccttcagtcagagaccaaaagcattgggacagattctcaagacagtagtcatttcagcccacccagtgaccctgcatctgcagagggcagcattcaccacagagtgagcatatgacaactgacagcttgcccagtgctcaggaaaagagcctgctatgagaatataacataaaatgaccagggtcttcccgttaaccttaaacacaccacagcatgaattgccaaagtcattgtgaaagggcagcatttttctgatatttggtcattttccttaaggttgctggagtgatgtgtgttaagattgaaaggtgcctgggcctgagtaagacttctctggtcacagtttttctttggctcatgtgtgacacattgaagcctgagtttccccatcagtagaatcagtgatttgttctccttgagttgggacttcaaccaaaacttcttacctactgcacc

SEQ ID NO: 19898 - DNA, 1146 bp, Mus musculus
gattttaagtgaggcaccacttagttacacagatctagaaagtaaaaatcactctcacggggtgtggtagcacacatctttaattccagcactagagagacaaagatgggcagatccctgagttccaggcgcaaatccaggagagccagagctacactgagaaaccctgtctcaaaaaaaaaaaaaaaaacaaaaaaagaggacgaggagaagaaaaccactctctccatgagaagtgtatgtattcttcttgggagtacatcctttttagcttaccaagacctttagtccatcgaggctggccttgatgttcccaggggaaaatgtaattggtgttttgtgaacaagaactgtgtcaagtcacctctctggaaattcatcagtttagatactttttaataatgtctcaggctctctctttttagacgtactaaattcccaggtgggctctgtgtaggtctcgaactgcagaatccgcttcagtgccccatgtccctcaacctggtgctaacggtgattcgcctcttcttgtcctgctgagactcagtgtcagtgttttgggtcttcggatgcatccttttgagtgagggctcttttgtagcctttctcgaagctcctacctgaaatcggatgagagcactgtgctcagtgcataattatattaaaacgggcaatccagacctaaggggggaaatgataaggggtggtgctgcccacctcatccgggtgcagtgagcactgaagctggccagcccttcctgctggctgagagtgacgtgacagattgtaaatagtcttaacaatcgtttcctccactgcaggaagctcgtgccatagatttttaacctcatggccgtggagctcattgtgatgcttcactgcatttggcttctgattgtgggagatctgcttgagctcgaaggtcctgagggaaatgtaaagtgtcaaacaaacagaggacagcaggagattcaaactgtaaccagtgagctcagtgcctgcctttgtcgggctcatcacctccactctagacaatgtgaacgaatcagtgtgcacttttatcaagtggcatatggataatatggtaatactgccttttctgtctctcaggctgtttccatggaaacttccagggccaaacaaaag

SEQ ID NO: 19899 - DNA, 4841 bp, Mus musculus
cacctggcagagtgagaaacaagtgagattctctggttttggtcgtctaggtagaagtggacgacggtgtttgtagacgatggggtgatggggttttctgaaatgcgcgcgtctgtatttgcagctgtccttttgggccgtaaggaccggaggactgtggtcggcagacgtgctaagaggaccacaggctgtggccctgggggacgccctgggaggtaaggagagtcagggacgcctggccgtctccggatcggtcagagggaccgagttctgttgaagcggaagcttccccctccaacatcgtctaattcttttgcctgcttgtggaggacaagaaagggtcgagtgtgtctagatttgttggtttctgttttatgtgtttttgtgtacgtgtttagagctatgtgaaaatctagagaaacaaaggtaattctcataggtgctttataccctgactagagatagtttacacctgagatgtgagaaaatgggttttgagaaaagcagtactctccgactatctggagataatttggtaataaaaaaataaaataaaataaaataaacagtattaattggtctttagaaccctgcacctgtagttaggaatctagtgtggctagagaagccctgctaggcactgattataaatgctgttcttatagggaccagcagcttctcaaagttctatggtaagggaacagatggctgtttttcctacaaaaattggattcatcaggtgacaaggtgctcctcttttgaaattacagctagaaaaattaagaattttgtttggtttaaatgagcaaatgtatatggccatttcatttttgtttctaaatagtttcaaaagtataaatatgttttatatgtcttggttatagattagtggctcataagttattggttatgattaaaaatttgtaacattggtaacaaaaagttgacttaaaactggtaactctgggttagagtaatttagaactacaacatgcaacatgagacaacccatgggaacaggtctctaaagatacgcctgaattgggtaatattctgtgtaattcttatcctagaaatctgatttataaaagataagatttagggtagtgtctttgagatatattggcggctacaccttcttgtgtttgtgtgcaggaacagacagccaaactttgtagcaagtaatgtttttagagttcatttttaaagaaaatagattgtttacactgttaaaattgagttttgcttctcaaaattgtggttgtgctctcatgttacaagagaaattgaaggcttctcctaaattggagcaaccagctaaatcggctcctctaaaatctataaagcctcctgagtggcctagtccataaccttccccttatccacagcctcgaccccagccgccaagggaaccccaaacccctcggggcgttgagaggcggaccgctgtgagtacatggatccacagggacctgcagagcagagtccgggcggactctggtggacccactcaaactttaaacccttcagtactggtcattttcctctgctggtatttataactagaaaactaaccaccccctttctcaggatccccaacgcctcacagggttggcggagttccttatgttctctcatcagcctacttgggattactgtcaacagcggttacagatgcctttaacaaccgaagagcaagagagaattctgttagaggctagaaaaatagcctgggagccaacgggcggtctacacagctacaaaatgagatcgacatgggattccctttgactcgccccagttgaaactgcaacatggctaaaggtagggagagcttaaaaatctattaccaggctccggtctccaaggtgcctcaaaacgggcccactaatttggctaaggtaagaggtaatgcaggggccgatcgaaccttcctctgtgttccttgaaaggcttatggaagccttcaggcggttcactccctttgatcttacctcggaagcccaaaaggcctcagtggccatggcctttcataaggcagtcagctcccgatatcagaaagaaacttcagagattaaaaggtgtattacaaaaaggagacagttatgcgatctagtaaaagaggcagagaaagtgtgtgtgtgagagagagagaggcaggaggcaaaagaaagagaaaacaggagggatagtagacaagaaaaaaatttgccacagtggtaggagaaaaaaaaaaaaaaaaaaagacaggatctagacagaaaacctgggcaactaaagaccgagcctcagctaaagaggctcagctgtgtcagactgaagtgacttatttgggatacacccttcgaggtggaaagcagtggctaaaagaagccagaaaaagactgtaactcagatccccaccccaactacaccaaggcaagtaagagaattcttgggtactgctggcttctacagactctaaatacctgggttggcgaccgtagctgcccagttgtaccccctaaccaaaaaagggaggtgtttgtgtggaccccagatcaccagaaagcctttaaagagattaaaaaggccctactgatggccagcctatgcctgacctaaccaagcctttcactctttatgtaaaagagagagcaggggtcaccagaggagtccttactcagactttgggactttgaaaaaggccagtgacttacctatccaagaagttacaccctgttgccagcgggtggttttcttgcctgaaagctattgctgccataatctgcttgtcaaggatgctgataagctcactctgagacagcaaataactgtagtggcatcccacactcttgaaagcattaccaacgctcctgtgacacatcagagctttttgttgtctaaatgagtgatcttcgcttcattccacctgctgtcccactgcgtgagactgcacctactcatcactgcgctgacattctggcaaaagaaatgatctgaaggatcagatcagccttggtctgaggacagtagcctcgaggttaaaggtaagcagaaggcggggacagcagtatggtggtgaacagaaagcaagtgatctaggccagcagccttcctgagggatgtcggcccagaaagctgaacttgtgactttaagacaagctctataaatggcaaagaaaagtctacactgacaacaggtatgcttttgccactgtacggggcaatatacaaagagggctgttgacatctacagaaaaagacctaagatgctgtggctaaaaaaattcaggtggcagatctaaccgccaatcaggaggcccaaggagcagtgatcctggcagtcaaggagccctaaagattattatgacatcagagagaccagctttagatacgtcgctgagcactatcaagttatggacagtatttgacttggcctgggggccaaaaaaattcaaaggtgtggttaggtcctttgactgctatgttacaggactctgacttggcagaggaaatagtcaaaagcttcaaggactgtgctatgatgaggtagaatttctaaaagaaatcttcccaaggtaatagacctgcctttgttgcccaggtaaatcagggactggccaagatattagagatcggttaaaagttacattgtgcacgcaggccccaaagctcaggacaggtaaaaaaaattaatagaaccattaagggatccttaccaaattgacagcggagactggcgctatgattagatagctctcctaccctttatgctcttcagggatagaaacacccctggacagtttagactgacccccctataaattactctacagggggcccccctccactggtaaaaatagcctctgtgcatagtgctgacatgctgctttcccagcctttgttctctaggctcaaggtgctccagtgagtgagacagcgagcgaaaaagcagctccaggaggcctactcaaaaaaagaagacctgctacattagacgtctccacgcagaaaaccttgagactccggtggaaaggcccttatcttgtactcttgacgaccctactttctacctttatgggaccccttttgattttgcttctgcttttaattataggtccatgtgtgttaaatagacaagtcacctttattaaaacagaaattagtgcagtgtggcttttagttttaagacaacagtaccatgccctaaagtaaaggatcaagtatgtcaaaaaaaaaattgtgtctagttctaagattagaactactaacaagtagaaggggggaatgaaagtataacaacataaaaacagaattctaggcctttaggcccaggcttgggaatgtggcctttgtaaaggtatgctaatcataaaagagatagcgacattcctctacccacccgcttcctgggttcaaagagtgctcattcaaagaaagtcaccctggccattaccagaacctgcaatgcaaatgtgctattgttaggggctcttagaagctgtcttgagagttaacaattaccaggtattccttgtgactcttgtaactttacacttccttgtgactcttaactggtatctttggtatcttccaacaaagccctccccacttccttgagtttcggtttcttcctttaaatacccccttacccagctactcggggcgccacagtcctctacccctgcgtggtgtatgaccgtgggcccgagagcgctcttaaataaaaatcctcttgcaatttgcaacaagaccgttttctcgttggtgattttggggtgtcgcctctcctgagtcagaacgtgggggagtcctcacgttgtgggtctttcattagaaccttactagttaacttcggc

SEQ ID NO: 19900 - DNA, 1102 bp, Mus musculus
gaagaggcacctggttttcagagagcctgaatccggcctccgttggtggttttcggtggctagaccgcaagacaacccgattccacataagcgagaaacttccttggtttttaactcgtgaacggaacctggatgactgccttgttctatatagtatcgacccatggaagaaatcctccactggcctccggagaagggtgcaccctccgcctgccccgggtggccatgctttaattataagaacattaccttttacctcctggtcaatttgtttccctcgtgtgctcagatcagaggcttagtgggaagcttgcccataaaataccaccccaacaagtattgaccgggtcaggggcaggatgataaatagattagccctcctggagagctcatagcctcagttccctcctcccctcctcctctgcttccctcctcccctctctcaatctaccccccacccccttgcaccttgtctgtcctgctcccacctcctggagagattggagagattccaggacagcctgtctcctgataacctctgcccccccccccccccacacgatgtcgatgtcgggggtaacatgctagccctgttgcctccctgtgtttatgttggggctggactgtgtgtgtgtgtgaaatctgaggctgggggatgggagcctctggctcccttctctgtggaattgtcatcaaagtctgttaggtctctctcagcggccatccctagcccctgctgtgcatgtcccctcctctctcagggtagaaaatgggatggtggagaaggtggagagggctcccccacccccaccttgcctctgaatgaggcaacatcagtaaaggggaacaaacagggtgataaactttgacctctgtccatgagggctcagcagctaggtgggcccggtctccatcttgaccctgtcactgtcaaggaatgggaggctggacagtttaagaatcctcagtgcatctctctgtaatggagatgatagtttccagcttcacgggcttctgaggataagtggggccgtgtctggcaggctggacagctcagaacccagtgttctgagacccttctctcttgcaggcatgctgttca

SEQ ID NO: 19901 - DNA, 1193 bp, Mus musculus
cattcatcatgaggtgacaggagacgctgggccttgcttccttgttgctgtcatggctcctgtgttcccccactgacaaccttcctgttctgtaggacaagacgctgtaccaccctgtgagcggcagctgcatggactgcagcgagagtgaccacagggtcttcatgaacacctgcaatccctcctccctcacccagcagtggctctttgaacacaccaactcgacggtcttagagaatttcaacaagaactgagtccttagaccttgacaaacccctcaggttcctgtggagctcataaaccttcctcctgtgggagaagaggcatcggtgggcaccaaggtgctgggttcttgaaggactgacatggtggggccacggggagaacagaccataccaatggctctccaagaaggcggagcctgctcacatcatagcagagctcaccagcctgtcagcatgttccctaagtgttaggaatcgcctgggcagccttgagccatgaggttgcccttgcagacaggacagtgccctagaaaggaaggtggtatcggccttgggacagcttaaacctgtgtgccagctgctggcaaggaagtctgcctgttcttgagggaactgctagaattgcccagcttctgtgttggtccagggcaatgagaggccattgggacttccgagtgctccatagctagcactggccagcaaccaggcgaggggccccttcctctgcagccagatgtaaaggatgtctcccctggctctctgggtatttcagatgcccgttctagtttcagggctacctgggcaccaggtcgtcagggctagttcagccggctaagtagacctccagaccgaacagctcccagccaatgcttccaaagccctttctccgtgcttttccttggcggctccctgccttggagaggaaccggtgctgtgagggatcacctccagagtctcctggggggtggcttcccccagataatgactgctgtggttccaacctcacagaaccctggagtttctggaaagttctgtggttctgttgaaagcatagatgagccatggcacgtgtgggcatataacgcaagcagccaggtgtcaggcaacccctgacccaagcagaggcggtagggcaccagaagcttcggtccaacccaatgccgtcacagccacagcctcgtgaggtgt

SEQ ID NO: 19902 - DNA, 1176 bp, Mus musculus
ggtgagttccaggacaagaaggactatgtagagagaagctgtctcagaaaataaaaacaaacaacaaaaatcaaacaaccccaccccccaccaagcccgaacaacagtaacaaagtaaccccctttcctatgatttaaggttacatggatagtgggatgtcagaaggggaattgtagtgaatcacccttctatccaatcaactgacaacacagcaatgatcccacatcatcccagcccgagaaaaactcagggttggtgccggtgctgagcagctactggccaggaggtatttctgtcttcttccttcctgtttggagggctggagttattttcagtgattctgcctttggggacagatggaaaattagtatagatcttgagtgtcaggttgcttattatgagtaccatagctgtgggcatctgatgggtcaggcctttggctcagacattggtgggagtgggagtgtggccatcagaacctagacgctgtaatggttactctttcctgtctcctcagctggatgtcagatccctgggaggatatgagaggatgtttccagaaacaccgaactaaaaaggaacgtccaaccctgaatgtggaggacatcctcctctgggctgggctcccagactgagtaagaagaaaataagttgagctcgccccccccccccccagcgctgtagatacagtgtgaccagttaccagccaaccccctgttgcggtgcctttttctttttctttttttttcttccctaccactatgaactgttcactcttaagctgagagctaaaataaactcttccttttgtccagcatcttgtctcagtgattagcaacaaatacagaggggctggggaggggagggggctgggggacctgcaggagtggaagcctgcctagttagtgtgctgctcagagtctggtggtagagctggtcagtggggtgtgtaagaagctgagagaggatggctggatgctggggaacaggcgctgttttggagtttaaggcttctggggccagctgtgtggtcagttcttattggatgagtggctagatggatgagggtaatgacccgacctctgtaaccaagagggagtgcggtccggtcctgtggcttggattactgactctagattcagtctggggtgggatcctggcttcgcctctcagcc

SEQ ID NO: 19903 - DNA, 1145 bp, Mus musculus
tccctggcctcccatctccctgcctagtcatggccaagaacccactgccttcaagaaaggcccaagcctggcttagggagcagcagggattattgagagagtagtgcttatctaggctgcttgtattttcatatcaccggccatgcctgcctccctcacacatgcatgcgcgtgcgcacacacgcgcgcacacacacacactcatctgtgatggctcagcatggtctctctacttggtgcttcttgacagaactggaatttcaagcccagaagtggtatggcttcctgtctctgatccagcctggtgtggttcttcaatacaccctgaaggggtcacatggagacacccttagcctgccattcatttggggcttgaaaatttttacaacacaaatgatcagaattctctcatctcatggaactaactgagagagagagagagagagagagagagagagagagagagagagagagagagagagagagagagagagagaaatggtaaaccaaaattccaggtggggattgtgactctgtgaaggaacttggcttctgtgtcctgcatgtttctgccataagtagctatactcataatagcctctcatagagcaaagctttaatgtgcatgcgtgtgtttgtgtgtgtgtgtgtttgcacacttcctgttaatattttaccaagtgactgcctggtttgtggtggcaggatagcttgtccactgcagcaggtggtccctggcatagtcccaaagaagttgcctcattgataccatctgaaagctctctgtggtccaagggatccaaaggttgcaaagagtcttgagtcctcccgtccagcttctccattggtgctgacattctgcctatacccatcccagccaagaagcagtctgcacctggtcacctccaaggacagagagctcactacctcctagggaagactgttctgttgttagcttctggcttttccaggctctctaagttggggggccatgtgggcagagtctctcaatgggcaaaggacccagtcttagcattgtctcacacattgtatcctttttgcaaaagggaacagctggatacaatgtgttttcacgccccctgacccctcagtatgggtctattggtcttggttccatgttggaa

SEQ ID NO: 19904 - DNA, 1365 bp, Mus musculus
cccgagccgccccgggccgggggcggggggacgcaggcggcggaccgaggtccgccaggccggctaggcgcgccggagccttctgcccggcgcgccactcagcgtcagcccgtccgcgccgctccgcgtccgcgcggcccgggctccggcgccccgccagcggcctcgagcggggcccgcggcgcgcccggcccctccgcgcagatggccactcaagtggagccgctgctgccggcgggcgccccgctgctgcaggccgaggagcacggcctggcgaggaagaagccggcgcccgacgcccaggccgagtcgggcccgggtgacggcggcggagagcccgacggcggcgtccgcaggccgcggcccgcctgcgccaggcctggccgcgacggcgcggagcgcgagagcccgcggccacccgcagctgcggaagccccagcggggagcgacggcgaggacggcggccggcgtgacttcgtggaggcaccgccgcccaaggtgaacccgtggacgaagcacgcgccgccgccggccgcggtgaacggacagccgcctccaggtgggtctgcgcggcgcggcactggcccgcgcagtgacgcgggcgtttccctcggagcggggctaccggggccgcagcggttggtggcaacggcatgcctcgggcctagcttggcggactgggccgggcggggccgctcgtgtgccctgtgctccctatgcgtctcggcgcctcgagagtgcgtgttcagagaacatgtgtcatggctccgagctgggcctggctttgaactttgcaactttgcgcttcggggagccgggtgaagcgtggggagcgcgggcccctgcgtgcccgggagccggttgcggcccgcggcgacgcgaggggcgtgtgtggcggcgagggagtggccgcgccggtgcggggcgggcgggtgacagttgggcgccatgcgccgtgccaggactgttcgcagcgctcgccggccggagctgcgcgcggggctcccctcccccgctgagtccgggtgggaggtggctcgggaatcctagccgggcgcgatcggcgtgggcatctagtggcgcaccactcgggcacagcctccgcttgggtactcctgggtgtttgatagtgagcatggcccttgagtttgatcgtcggagtcctggtacttttaactttaaaaaatgaaaaaaaaaaaaaaaaccaaaaccaaaaacttgctatggagcttaggtgtggttgcctaacctaagctgggcaccgaggaagtcggagctagccgctttcaggttccagagtgctggaaagtgtaggcctagccctgggggaaaccagcacgttggttgccctttcgatttctctta

SEQ ID NO: 19905 - DNA, 1099 bp, Mus musculus
catacaggcttcgctgtaatcccaacacctgggaggcagaggcaggcggatttctttgaatttgaggctagctaagacagccagaactatgttagagaccctgtctcaaaagacccaccctcagaaaaaaagtctataaactagctctctaagcgtaggggtatccaactttgcttttaaaaaactaaaaggacagtgtgtaaagctatgctgaattaattgcctctgatactgggtgagggccatggtctgcactactggctgtctacttgcaacccactgctaggccctgtaggccctcacatttgcatccttcatgaggcttcctcccagcatgaggcctgtgagtccagatactgtgcttcaccataaaaaggaagggaagccaaggagtagccttgtagacacttgagaggagagcaagtgtggtgaagacctgatactaagagcattgtggcctgcggccctggagcaaagctgaggatgaacttgccaaggaaattgttgtgttagtcaggctccaggtagcctttccatttctgtcccctccgctggactgggtatataaatagcatcattggtttcagtctgttaaagccccctgttatcttgtaggcgtgaggaggactatacagggttaactctcacaatggaaaggggaaagaaagatcctgagtagaagccttgtaaagtgtgatcctgtttagggaagggagccaaggctccttgggaatttctctggacagaggctcctcctggcagtgctgttctgtcctccctgtagtagggaaggtaggaaatgatgtaggggaattgaaagatcagctgctagctcagctgtgcatctcactgaaagacttgagcgactttactgaatttccccacttcctttcctgcttcctgtgaatggaagtggttgagtcacaaggtctttcaagactttcccattaggattaagtttgctatatcaattgaatcagaagttaagaccctggttgttgagatcttatttagagactcagatgggaccagctttcttcttcagagctacactaagtaaggcagtgggactcttagggatgtgtgtatgtgtgtgtgg

SEQ ID NO: 19906 - DNA, 4463 bp, Mus musculus
tgcatggtggggtgcacatggtagtgccttaggctctgaacagctgattgtttttctttgttcccacagaaccttctgctccagccaaggtggtgagggcagctgctcctaaaccgcgtaagggcagcaaggtaaggatgggggggggggggtcttctgtgcctgcctgtgggtgattcttgttcttgttctagtaagcacttctagcccttctgtaaagagcatggaagcattttatgagtgccagtacatggtgtctgagtgtacacactgatgtggccccaatctctaaaaggaactagagcttgggtgtggagcgaaacggcaggcagagtaaccctgcggccttcatagactataccttgcaggttggtgattttggagatgcagtcaactggcctacacctggagagatagcccacaaaagtgtgcaggtgagtgtgagaagggaggggttggcagggtcaggtattctttatacaaactttgtccaagagccataaacctcaactttcttgatttttgaaaaggacaatagtatacttctgaagtcccatctattcaaaagaaggttaaagaaggatgactatgcttattccaagagttcaaggccatcctgtgtaacgtaggacaccaacttccttcaattctgaacaaacaaatgaaggctatttatataagatgggtggcagtaaaataattaggaattaccattatgtgagcctttgcctggtttcagtggtggctcagtgggtttaggaaacagctgtgttacagttttccaaagcccatatttttctattactgtgtcaagtttgtctatgagtaattgaaaaaaaagatattagttgaggcaccgactccagtttgggggagtgtgtttagctcccttagactccatcagaagagactcttgatcagttctgttcctctcagcacttttgttctgagctagtaggtcccttatggtagaccaacatcttttctatctcatagatttaggtagctagagaaatcagttgttcgtccttgatggctggtattgtcatgtcttgtggtagtatcatttgagtatgaaagttaggccttagggtatatctagtgtagcctgccctcataccttcccagtgaccgcatgtgtccttgcctcctgtagccacagtcccacaagcctcagcctgctcgtaagttgccacctaagaaggacatgaaggagcaagagaaaggagatggaagtgatagtaaggagagcccaaaaacaaagtcggatgaatcgggggaggaaaagaatggggatgaggactgccagcgaggcgggcagaagaagaaaggtaagtggcatggtcaggaccggggaagtatgcctttcagaactttgaaatgacctaagtttgagctgttggaggatctgcaggccaggtgtagctgtgtgctcagccttagtgtgtcttctcttaagcaggcttttatattgctgtttctaaaacctgctgaaatgacacaggcctgactgctttctctcagacagacctactctgtctgctgactaggcttgaagtggcagttctaaactcattcagctgcagcctctgcagcctagatggttccctgcttcctctcactccacctagaacggccccacaaaattgtcacaggcagtgatgtggcacatgtgtgaagggagcctggaaagttagtttttattcagggctccagaaagtgagtcttacacctagaaccgctggcctccttattttcgagatttaaacaataaaacagaggtctggtgtttggaaagatgtgcctatggctaccaaatgagtagttaagcaagaatttggagggaaggaaaaagccatgtctgaggggcctgctatgcctcactgacatgcttatgccgtccctcagggagcaaacacaagtgggttccattgcaaatagacatgaagcccgaagtacccagagagaaattggcctcccgtcccactcgcccacaggaaccaagacatacacccgctgtccgtggggagatgaaaggtatgcacggtctgctatggagggtctggatgaggaggatactctgaggatttaccttgtgttcctccttactataggatctgaacctgccacctacatgcctgtatctgtggccccacccaccccagcctggcaaccagagaccaaagtggagcctgcctggcacgaccaggatgagacatcgagtgtgaagagtgatggggctggtggggctcgggcttccttccgtggccgtggacgggggcgtggtcgtggacggggccgtggacggggtggcactcgaagtacgtgaggctcctttgggctccgggatgtccaagggagtgcggcatggggagtaggcgaaattcttctctccctctaatgatgcccgtatctcctgtagcccactttgactaccagtttggctaccgaaagtttgatggtacagaggggccccgcacccacaagtatatgaacaacatcacttactactttgacaatgtcagcagcaatgagatttacagtatggaccaggagctgctcaaggattatatcaaacgccagatgtgagtgtgcaagcttttctgggggccatgctggaatggggcccagagcagggtctaatgcatgaccattggagtagccctgttgaagtgaaagatggctttctgtactttcacagaattctgttcattaccacttaggaaagtagagactaccactaacaggcaagcaccctggctcccttctgtgttcccatggtcacgaagcagcgtgtcagcagcatggtgaatgctgtcaagcatctcctttaaccatcactgtagccaggctttttcctgtttgtaggccttgttcttatctcatgactgttgcaggcctgacatagatgacttggatttcctgtccctattttataggagaacaagcagtccagtaattcatccaaagtcaccgctagtgagtcacaaagcacaggcttaatgctgtttctgtctggctattattttttgctcttattcatactgaagtgctggctcgcagaccaaaggagaacccatataaagaagcaggtagtagagtaagagggttagtgttttagtagcagaatagtgttggacctgagtttcaaaagaggattagtttgttgggctcacctgtgatagctgaaagactgggtgatttgactcaaagcaatagtacatcatttcttttcagcctttaagccagtgattttcaaactttctaatgctgggactctttaatacagttcttccttgtgttatggtgacctccaaccataaaattattcttgttgctactttataactgtagttttgctactgttatgaatcataatgtaaatatttatgttctctagtggtcttaggtgacccgtgtgtaagggacacaccccaggtgtcacaacccacaggttgaaagacagctgccttaagctgtccagcaggagaagagtgaagtcaggaatgtgaggttgtggggacggagagggagcagggaaggcccatagcccctcagtgatgccttttttcccctccacttagtgaatattacttcagcgtggacaatttagagcgagacttcttcctgagacggaaaatggatgctgatggcttccttcccatcacccttattgcttcctttcaccgtgtacaggccctaaccactgacatttcactcatctttgcggtatgtctcttcctggggatgatggtgggaaaataagatcctcattgtgagtcctgagttgatgggtaaaccctgacagagttcccactaactgtttctactgagtcccaaggtgccaccatgttacatacagcaagcacctcaccaacttcagcaagagtcagctatagctgatctgcctgtgtacccttcatctgcttttcctaggtcttcctagagacaatctagctagcctttagtagctacaacatcattatcacttctacaaatagaacaggtctataacatcatcagttaccccctttcagattctcctcaactcctgctaaatgttgttaaaaaggggttttaaagattagagtccagggctggagaggtggctcagtggttaagagcatggactgctcttccagaggtcctgagttcagttcccagcaactacatggtggctcacagccgtctgtaatgagatctgatgccctcttctgatgtgtctaaagacagctatggtgtgttcatataaataaataaataaataaataaataaataaataaataaataaataaataaataaataaataaatcttttaagtgctttggaaaaaaaattagagtccagatcagatctgtgtattgtcttgtatttccggctatccttttattcttccttgctaatcatttgtagggtagactaggtcatgtatcctatacatgcctacatgtctcatgggac

SEQ ID NO: 19907 - DNA, 1261 bp, Mus musculus
cctggctctccccgtgcagtcaccccagtgccaacaaaaacagaggaggtcagcaacctgaagacccttcccaagggcctgtctgccagcctcccagatctggattctgagagctggattgaagtgaagaaaaggcctcgaccctcaccagcacgccccaaggtaggtgaggcatggcttagtcctgagggtctaagctgaaaacctaggtggtcctgggttttctagtgtagggatgctaatgtcgtctcttttctattctttgggaaccattctcaggatacccaagtcagttcgtgtgtggcttttccacaagataaggccatggggctttgtaggtgtttgatttttcaggtcctttcccggactctgggtagtggagaggggtacaagttttctgtaatggtggcaagtggctttgggaagttggcaaggtgtcagtttgtctcaagatgaatgtgggaaggagtatgcgttttgactaatggtaggatcaccactcttgaggttctttgacctcaaagtgaaatcactggctcctttctggaccacattaataccttctacctctgtagactcagctccctcctcagagacctttggtctgggccttgtagagccttgtagagcggcctcagcgcttaccttggtgcttgtgttctgtataattctgtgcttctgtaggtgttttacccatatgactggctctcccatctcctttccttcctgtgtctgctcattcccagaatatgttcactgttcttggcctcagccaagagaaatgtagcaccttccaaggcccaggcatgcaattaactgcacaagctctgggaaagatgggagggagtcaagggagccccattcctcctgtatggtgtatcttgaaccttaaaagaaacgatttgacgtttctgtaggatatgaccagtccatcagaggattgcctcttggatgtgggagacatacttctggtgtcaggcttatttggtgtgtcaccactaaaatgtttcaaaaataagtgaaaggcttttggaacaagttgtcttttttgcctagaccactctgctcttgcctttatcctttagtgacctgttctagcaggcttttcctaacatatccaactcagcacagcaccatttttgtgtgttccctagacctatttagagcctttgttgaaccacactacagatggctgctgttcattttctccttctgagctgtgaagtttcttaagtactgggtcattcaggctttcatacag

SEQ ID NO: 19908 - DNA, 2028 bp, Mus musculus
tggcaagagaaaatgtatttgtatacagtgtaaagagcatgtgggatgactgactgacctatctaaccactcatgtttgtcacacagttggctagagccttgtggaagataaaataaagattgcactattatctttaaaaaggtcttaagaacccttcttagtggaaaatggagaaaaaagaggcacttcgggagacatttcttgtcagtttttggagtagctgtgtttggtgctgggtgggcctaaaggtgaacatgtgcaacgaacaagcagcagtgtaggaaaaaactcaggatgggcagtctgcagcaagttccttggtggttgttgcccaaatggtcccctgccagggaagaggagcatggtcagcactaagtgagatcagtacctgggctgagagatggtagtggagactagaatcctgtgtgtttggatggggaagctattctcaccagtttcctgccagtcttgattcctgagcagccagagcatcttgctgactaacagcttcccactacctcacatctgcagcaagaagtggaaaacttcaagaaagtgaatatgattagtcgggaacagtttgacactctgacccctgagccccctgtggatcctaaccaggaggttcctcctgggccacctcggttccaacaaggtgaggggacgggcacctacaacccagtgtgggtgagaggtattaagctctagccaaaaatttccctgcacattgaccctactctgcctctgcagttcctactgatgccctggccaacaagctgtttggtgctcccgagccatctaccattgcccgttctctaccaaccactgtcccagagtctccaaactaccgaaatgccaggactccccgcacaccccggaccccccagctcaaagactctagtcagacaccacggttttaccctgtggtgaaagaaggacggaccctagatgccaaggtgaggtggtcagctgggtggagtcttgcatattttactgcctggtctgagccaacaaagggccaggatcccctcaggcagcatccttaggctgagagctcataaagtagacttgagtataggcatggcctacagaggctgaaggagtgcagaccagatgagagacctcaggcacattttcctgcttctccgtctcacctgtgagataattggaaatttctttcatcaggttgggggtgtaatattagtggtattgcccttgtctagtgcacaaagccttgtgttcaacctccagttgtacccaaataagaaaatgcctttgtaaaatgggatgtaccatttgcatactaagggcggcttgatatacatcagcataatagatgtataagataactaattctggtttcatctttacagatgcctcgaaaaagaaagacaaggcacagctcgaacccccccttggaaagtcatgtgggctgggtgatggattctcgggagcacaggcccaggactgcttctattaggtactgtggccagggcattcaggctgcctgtggcacatgacacttaccacctgaatctaaatccatacaacagtgtgggaagcgtagcctaaggtctgggaactggaggcttcttgtgttttgttctttttcttttatttttagaaaggtgacctggagctgttatgtagaccagcctcccttgaacacacagagattcatctgctcactagtctctctagtgctgagagtaaagcatggctaccatacctggctgtccatagattcccaccatgtctggctgtaaagacatgcagtcatagccacacagaacccaatttgaggttacttgggcagtgaaactctgctagttagaccctgtggactcaggtgctcagtggtagttgcacatctgccaagactgggttctgaccccagcaccatagctcactgactcaactactaactgtgggactcagatacttcttacatttaattttgccaaatctactttaaaacacgtcaccagtctgtgaactcagcttcccacaaagatggcagatattag

SEQ ID NO: 19909 - DNA, 3562 bp, Mus musculus
accacaagcgacacccagtggtagcaggaggcagcggagagggcaggaagcggtgcccttcccagtcttccagcaggcctgccactgggatcagccaaccccctacgacacctactggccaggccactcgagaagatgccaaatggacaagccagcactcggacacactgactttgcgaaagtgaatggcctgaagccccctggggtttgtgatagaggggtggggtggttgaggatctgtggggtgcccagaagagcgaacaagagaagggacagacctagagtactaagaatgggcctttgcgctaagtagcagtgtataccatttgggctattagcggtgctcctgggcaggagcctccaagtaccccatccctcctgtcaccatgacttccatcataacttctaaggggggaggggaaggggggagattttatatatatatatatatatatatacatatatatatatcaagttttaaattattgatagtttgtctggattaccaaaatcactctttagcccttcctgcggctattatgccgacctgtctcccctgcctcttcccgcttccctcaagccaactatgcagcccaccagaaggctctggcggtgcccatgggccccagaagcaccagccccttgatcacctggggtttgccatcaccgtgtccctgctgttccacatgcccttctgccacctctgggggaaggaaaccaaaggatctcagtgggggtgggagcttcagcctctcccctcgccccctcgccccaccccagagacgctgctcacaccagaagagactattgaaagatgattcattttattttttctctgacctttccatccttgggaaaacagaaaaacaaaacaaaaaaacaaaaaaaaaacaaaaacgaaaataaaaaagaaagaaagaagaaagaaaaaaaaaagacaaaatcgaccactttaaaaaaaaaaaaaagacaaaaaaccagagcccacctactccatagaaagtgatgtctttccccctccttggaatttttcttctgttctgtttttggaaataatatttttttaaaagttgccttattgtggagcgggaacctgaactaatgcccaaatgcctgttttccttgagcctccggaagagctccacctgcccgggatgtccctggacttggactgactagaactttcctcgagactgagttgcatgtacggggcctcctacctggaggcaagagttggggcagttctatcagagctgtgcccaggacacccctgctgttgcattgtctgaagccaatgtcctgtgtctgcacactgttgccactgtccttgttgtgcttgctgtcgcctctccaggcccactcagctctgctccgccccgccccgcccagccaagccctgggaaaccccaaggccaagtttgcttcagactgttgtaaacataattggtcttgcctggtacacacttgtcctcagtgtgcacatctccccaactccagaacaaggggttgaacacccactgatgtccacagcttaggtctgtgtctaaccttaacgacctttgacctcaaggaggtggagaaaaggtaccattctctaagggtctggtgttgtctttccatcttattaccaccaccccctgcaagccatctctgcccaccctctcattggccctgcctgggatcaagggggtgagaggaaccaagggctggggaatcctaccgtttggtgaagccccatggcaggaaggtatatgtggacatagagtatacctgacttctcttcaaaagccagactgcctgagctgcacttgagatgccagaggagtggctggaggctgctgtcaccaggagctgaggagggtaatgaaggactgagcacacaggctgggagacttcatgctaaccctacacttggacctaggtggcacaagggggtgtggtctttttgctagcttaactgaaatttgtgtgaccctcctcatcgcccagttcctctattgtcccaaaagttgggactgggacacagcatcccaggctgacaagagcttgccttctgtctttgggcaccttgttactttgagctcatgccttgccccactctgtcctcccggtgcttaggatgtgggaatcccttgtcagctcctgtgactcacttgtcgcaaacaaataagggaacaggatcatctgctgctgggatctgaggccttctcctaagtctggtacctgccctatggtgcaccttcaccaaacagtgggctccctgcttccctttctcctctcctctcctcactcagccctctactgtatatccagcaccacagaacctcagggcttgaggcccagcatcagggaaggtggtttccatctaggctatccagactagggttgccattctctcccagatcctcccagaccctctgagggaagaagcccctctggggtgggaaggcaaggctatcatctcaacacaggctgaggaggggtgggagtgtgtgtgtgtgtgtgtgtgtgtgtgtgtgtgtgtgtattttttgtgacatgttaagagttgatgttgcggagtagtttacatcttcaccttctgaagacacttgaatttaggaccgatgtatctgtgacaagtatgccaggagtgggggtggggcaccagagcaagccacttccccatcaccatcttcccatggaatccaagacctaagacagacagcctgccaaatggaaccgccttcatcctctgcctgtgcagggttagacatccacctggccccagcaaggggcagatggtggtttgcaaacctgtgagcctcagagcagatttgctactcggagggaaggctgcctggccctgctccagcctggaccgcaggttcagacaggtgctgagccccgggtcaagttgttcaatgtttttgttctgtagctccttcccactcctttttgatgacatttacaaaagaaggcaagctgcttggaaggtctggacatgagggaaagggcattgaggacaaggctaatggtggggagtgctagaggcttgggttcccctgtcccctggatgggaccccagagtctcttgtcacagggcccctaggttttccccagctcccaccctctcctccagccatggttacggcagaggcagaagaaaactttgagcccagttctcacaggaaaggaaaactctcatgggctttgcagagaaggttccacctacgctcatatattgtctttaccatgtgctaggatatcacatcaacaggacaagaaaaatgtaaaatacttgaatgagcttgtattataacattaatattattgagagtgtctgcttcccaggctgaagtgattcattcattattctggtcctgctctagtcctttgtaattggtggtaattattatgcttttctttttaatacaaaaaaaatgtataaaaataaaaacttgaaaaggcaaaacactggctggtctcccatctgggacactactgttgggtgtgacagagaagcctggtgtgtatccccagatggaggttcccaccccctacatgagcatgactagagtac

SEQ ID NO: 19910 - DNA, 2093 bp, Mus musculus
gaggtggcacttgtggccagggctgtgctcagcatcttgtgattgcactggacagctcctgcccagatagtaaggttgagttgcttgctgagtgcttggtcccctcctgcctcagcttctcgggtgctggattatgtgtgtgccagcacacctggctttcaggacttcatgactgaggaaccatgatggaatggagctgaagtgacttggcaagcctgagtccttagtcactcactcccttgcttggcagggtggtgactccacacagcagcagcccaaggcttcagcactgacaagtcataagaatgccaagtctgtttaggatgcagagccgggatgtgtacaatggagcagaaaacgtctgaggggatgtttggtatctttgttgagttactgtccagtgtgctgtgtcagggcatgagaagctgggagctggcatgactcctggctccattctcagatggttttgtcctgttctgcagctattctttgaggacagtattgacgatgccaagtattgtgggcgcctctatggcctgggcacaggggtggcccagaagcagaatgaggatgtggactgtgcccaggagaagatgagcatcttggccatgatcaacaacatgcagcagtgatggtgcgtgcaccgtgcggtccgtgcaccatgccgcctgtgacctgcatctgctccaagcagagactttggctttttgtttaaagatgcctttattttagatccaggaggggtttgctctgaatttgtaaacaagtcttcctcgtcctcatgcccccacccctctgctgcctcctgccaccagcatccatggccccatggacacttttttaaatctccaggatgtctgaaacaaaccagtaaaatgtctatgactcttacatgttgtcattcttcttcttttggctttgctgctctgatgaagttgctcagatgagctgtggctgccagagaacaaggtgtatgttcttgggaagcaggtctatgccagtgggctgttttgccttgtttgtgcttcttcaggacagagcagtcctgatgatacagtaattgatggcagacagttctgtctccttcccagttgttaggctgcccccctgagcctcaccttgttcaccttggttttccgatgatgagcttccctagacagatcatgctccacgtccacggtgttctcagcaccgtgatctgtcagctgtgctctcttagcctccagcctgagctctcaagaggtggtagagctaagctctggaggtggagtcttaggaagacccaggagtgactgagcaggacagtaaagggattctcctcagaacccattgagtcctccaccccacagttgtgcttggaagcctgttgactgtgcttaaggttaggcatttaggaagcacactgctttttaaacgaccacagaaagaaaggacaattgtaagaagtaaaaacttatttggaaggcagagacagacggcagcagctcacttaggcaggaatggtcttaccttttaaaagcttgtgggaaactgaatttgaaatgacaaaatgtcaagtattaaagctggtatttaagatgcttgtaaatattatttatgtttttaattttgtaaaataaagattgctttttaaccattggcatgaagtgtggtctttgctagctagaatctgactgacgtctggcaggattggttcacctaagagccctggaaggtattgagggagcacacatgtaattcacaactaactattcacttcacaccctgctggctgttgggccttacgaggacagtagagcagctctaatcgtattctccctggctactcacatatagtgcattatagtcagtgggattctgcaggaaacactgaacttaagacttcctgatttagcttccccacccgccttttctgctggcacaaaaatgtaagtcatgggacccttctagagtttgagtcagggtcttgttccctaggccagccctgacctccaagccatcctcctgaatggcaagcagtgtaggcctctaccaccacactcaacaaatctagaattctggttggcagcagagtggttctcagtaaaggtgcc

SEQ ID NO: 19911 - DNA, 1133 bp, Mus musculus
atctttgggcagcaagagattttcccaactggaaatcctcgggacatacatcttgagatacttgtatatatctagctttgggatttaaaaaatgctaagtcccccaaaagaaaatactgtccagatgagggtgaaacttgaatccactcacacaatagagcctgcctggtgcctcccaagtggcttcctgtgatggagggaaaagccagcagggtcactagacccctgccaagactgtctcaagccttacatgtgaactcaaggaagatgcattggtctgaaaggcaagagtcttgacaaagctgtgagtgggcatgactatatggaagactggatagctccaagtagcttcatctatagagatggggaacgttggttccctccacttaaagagcattggtaaactacaaactcatctttgtggtttgctgaaacaagtacctgttgggagtaatcctgcacactgcatgcctctttcttctgaggaagactcagaggcaggagggattcaaattcaagtccagcctaggcagtgaagcgagatcttccctcaaaatagtcaataatctaagagactagagagagggcttgggttaagagcactggttgcatttccacaggatctgggtggttttaaccccacaagaaacctaaagtaaaactatccaataggagaattaaaatggcaactgttttcttcttatgtgctcttttctttatcaacttgctagtacttgaatattatcatttctgtatccctaattataagaaccacaagaccctgaaaagcaaaggcattcactcaaggttctagcaggaagtgtgtattactcctttgtgtgtgtgtgtgtgtgggggggggggggggggaggggtggtattatccctttctaaggtgatttggtctagacctccattccagtacccacaccagcacctcgcagcactatccactcttactggctgcctcatgccctggctctgttctcagcatctccctacccctccctccgacagtgactgcattccttgcctgtcactgccttatcccatgtggattctggcccggctgctgccaccttaactgacttactcattccttaaccgcagctgaatttttttttttaccaaaa

SEQ ID NO: 19912 - DNA, 1158 bp, Mus musculus
gggctccactaaaacagtttcttccttcaagagggaaaatatcagggcacagccacaatcaaaagcaaaagtcaatctccaaccgtccaatgtcagggtccaacttaagatcttctgggctcctccaagggcttgggtcacttctccagccatgccctttgtagcacacgcgtcatcctctaggctccagacagcagacactgtcaggataccctcattatatgcttaaaataaccacaagaaagcatgtactgactcccaggtaccccatgaagagtgggaagacatgagtagaatggatgggctcccagggttgagctctggtggaggatgcagctgtcttcaggtgcagtgcaggaaggtgtgtgagcctgtcagaagagtgctgtgggctccagacgagctcaccaggatgcttctgattcacagtgtattttatctatttttaattttattgtgttctttgtagggaaaaaatgtattgaactagagaaaaaacgactctctcaatttaagccaaagcttaaaaagaagaaaaaacctaccttgcgactgcctgtaaagcaggattcatccgttggcaatgaagatgagagtgtaaaggagaactctggacctgctgagaacggcttgtcggaccaggatggtgaggaggaagcccaggagccagagctgcctccctctcctgtaggtaggtgcttaggaaacactgtccgtgctggtgtcttcatacagcaagtccttcctcagttgtgtagcctctgtgtcaaatgaacctttgcaaactgtgttagcgttgtttaaagggagtgtggttggtgttgatttttaagatttatttttgtttcatgtgtatgagtgttgcctgaatctatatctgtgtaccacaagagtgcagtacccacagaagccaggagagagcattgggtcccttagaagtggaattatggacaggtgtgagctgccacatgggtgctaggaactgaacccaggttctttgtaaaaggaaccagtgcttttaacttctgagccatctctccatctctttaaaaggttaaagctctaaacgcctctttgacgtgttacaggtgtagtggatggttgttctcttagtgaaaacctaagaaggatgtcttagtcactgttctgttgccatga

SEQ ID NO: 19913 - DNA, 1227 bp, Mus musculus
cgaggttttctttcataggaggggaaggagacaggccttccctcaccttgtacagctgtggaggggaaggcgttgtgctacagcataacccctggaagctcagtggagaggccttcgacatcaacaaactcgtgagggacaccaactccattagagtaagtcccagtggttgaagtctactcagcctctggttttctgtgttactcactcaaggccatctgtaatgaagcctgtcatgcttggccaggcttctcagttgcttaggttattggtgagtctgtgggttgcctgctatcccttacaagtcattttcactgagtaaagcaaaggactaagtgaaggagagcagctaaactgcaatagaaatgataaaaatcttccatagcctcactgtaggcgtcttctttgttttgtttttagatgtttctttttgagacagggttcactatatgtagtcatggatggcatggaactcactatgtagaccagctggcctcaaaatcagagctgcacctgcctttgcttcctaagggctgggagtaaagataagccttggaagctgagcactcggctgactgtgactatgtggttgtgctcgggcctcgtctgctcttttcttttgaagcccaggctggcttcaaattcctgatcctcctcagcctcccaagtgctgggattacagggctgggcgtacactcaatcacacatgtccgcccatacactcaatcacacatgtccacccatgcagaaactcttgggtcttctgcctagatcacaccaaatcacgttttaactttgtgtcagtggatttgtacgactcaactaggtttgttctttctccccgcgcccccaggatctaatgtaactcagactagcttcaaatttggttcctagctccacatcccaaatgctacgattattagagttgtacaccacgatgcctggcgtctacaactgtccttaagttagatcataaatgttgagggtttgtaggttttgaggtttttgattgtttgttttgagattttatttattttattaagtatgtgagtacactgtagctgtcttcagacacaccagaagagggcatgggatcccattacagatggttatgagccaccatgtggttgctgggaattgaacttaggacctctgttaagtgctcttaaccgctgagccatctttttaaccccacattgagatttctttacccttgaaaatgatcag

SEQ ID NO: 19914 - DNA, 1163 bp, Mus musculus
gctgagggaaagataccctaggctgaggtagatagagctcagtcatagtgcagttgtctagcatgtgcaaagcagcacatacagccactgtagagggaaaggcccgtgcttcacagttagtaaggccttctgacctcaagtatagggagggccagggggatggtacagtgtaggtggtcagggtagacctaagaagagcatagcagctcagatttgagcaggatgcaggagccatcctgtgccacccacaatccatggtgtgaccaggtcccataagaaggacttattcattgggaagtccaggtaggagctccagctgccaggtagtgcagctcagtggtggaacacttgtctattatatgctgggtcctgggtcagggccccaaactgaagaaaatagaaaacaaacaaacaaacaaacaaacaagaaaccccctaagaaccctttttcctcaacaggaaaatgaggcctgtgtatttccaaagcagatttaggagaaaatcccacattctatgcattcatagcggtagcaagagactgtagcacatatgaatgtgggtcatcatgctcacatcaaccatattctgtcctgacagacaaggttggataaatgacaagtgttaattggagtggcattttgtacagggaactctgtggacattgcaacgatggtgtgcaaggaagtgagtgggtgggcatccagaggggacaggtgaggcagttaatggtcagggtggtaggacagctgtgcttcttagggcataggtgaggatgaggccagaacggtggcccggacggggaaaacaagggtggatgagaaacccgcctgctcacccagttccagtcagtctccctgggaaggcatccatgcttttgcctcttttgtctctcttgtcacccactttctagcaccacaagaagtaccagcatatccaccagaagtcgttctgctgccctgagccagcttgtgggaagtccttcaactttaaaaagcacctgaaggagcatgtgaaactccacagcggtgagtgtgggacccccccgcccccttcagctgtcctggggaggactcaaatcccttggtccttgtgtgccttataagcccttgtctgcttgagtttgtaactaggtccttggtagcctgaccctagtgaaatgccta

SEQ ID NO: 19915 - DNA, 2605 bp, Mus musculus
gcaaaggtaaatgagaagggtgggaggttggaatgggggaaaccagccagctggggaggaagagtggagagagaggggggagccagaggggtgaagacctgggaggagggctcgctggggctcaggtcaggagggacattcagaggacagtagggctggagagagtattgcagttcagaggtgctgaaggtgtccaggggctctggggtaggaagtctaacctcagggacaagtgctgagtgggtcagaagacatctcatagcttacctatttttttctgcaggagcacaaggccaaggtgacagaactggagcagcaggtggcgcaggccaagacccgctactcggtggccctgcgtaatctggagcagatcagtgagcagattcatgccaggcgccggggtttgcccccgcaccccctgggcccacggcgatcctcccctgttggggctgaagctggacctgagggcattgaggatggggacagtgggattgaaggggcagagggcgggggcctagaggagggcagcagccttgggcctggcccaggcccagatacggacacgctaagcttattgagtctgcgcactgtggcctctgacctgcagaagtgtgactcagtggagcacctgcgtggcctctcggaccatgccagtctagatggccaagagctgggagcccagagccggggacgccggggaagtgacatcggagttcgagggggtcggcaccagcgcagtgtcagcctgtagctctgtggccagagctagcttgatttctaccatgggcaatcagggcccacaggccttccctcctcaagtcctgtctgccccagatcctggtctgcagccttccttgggcaggatcagctgtctcagtcctgtgtccccagctttctcaccgttccttctctcaggaggcagctctctctttgccttacccacctagaaggcttgctctctggccctgtctcttctccccgtgctggcactcgagtctctgatgctctcttgatttcctattctgacctgacttctatctgtctggctttttccctcagggaacttggtctagaagacgcaggaggtcatgtgagaacatgagcatcctagcccaagtggttggacaggctttcacccgttgattcctggccctgtcttcccagaaggcgtgccctagatatgctgctgagtccccggcagcctgtgctcttgtcctgtcccagcttgcctgtgagcaatgtgtacaatgtccatgtgcctctggaagacaccaccttctgtcagtgcacctcttgtgaccttagccgctgtgctgtgtgtccttcattcagtgtcaggtgggggagttgaaccctgttatcaacacaggcatttgggccaactccaaatggcccctgcctgtgtgatgtgtctccagttgggctgagcccttacaattgccaaggtgctagtgggtcccaatggggtctatgctggagggttagagatgggagattctcaaggctgagaccttgccatccctccttctccatgtgtggcgctgggcttgctttttcttggtagaggttgaactggagcttggcaccctcctacagggtggcattagagaacttggtgctcaattgctctctattgctcttcctcacaccagatggtacctacgccaggaacctttggagagcgcttaagcatgggtgcaaagcctcctttcttttatgagaggaattgacttgaagtgaggggttccagcctcaaagagcagctctgggtgctggtgttcctgggctgtgtgaagggaaaccacacctgatctgggtgccttggaggagttgacctcctgtcccatcaggaggatgaggagagcgcgtgcccagggctgggagaagagtgcccgttgtctcgcatgggatctcccaattttcaggttttaggatggtcacaatgaaaacctgtgggtttgaggtggctgttcaggcagcacagaaacgaggaggacatgactgtgcgagtgcatgtgctggtgcgtgtgggaaagggtcagtcctggttttatttaaataaaatagtttatgtaacagtgatgtttactgtctgttaaaagagacatgggggtgagatagggagctcttcagaccatgcagtcaaggaatcaagatagtacacaccaactgagaagaggggagagaggtgccagcttttggtggtcacacccaagctaagtggacaaggctggggagccagtgcccagaaggctgtgttctacagtaatgaatgccaggggtggccctgctgcagagggcctgcagggtggagtggccacggttaggacacatagtatcctgggtgtgtctgcacataaactttaagaaaggagagggatcaaagtagggacacttggttattaaaaacagtgtgatgctgaaccttgaatttccagtagacagtggtttctgtccactgcagtatcaggacatagtcacagagagtgactcccgagttggagcacatctggttataggtgtgagaggccagagtctatttagacacggatgggagacacctgtgaaacatccagtaaatcaggttcccggaagccctagaggt

SEQ ID NO: 19916 - DNA, 1978 bp, Mus musculus
tcatctcattccccgagtcttggaccaacaccagaggcaacctgcttggaagtcagcctgagcttgtaatggggcatcggctgccacctgtaactgaggtattcccttcccacatacccatcagctgtttggggcctatacaacctcagagacacaggctttggacccctcttagatgggttgtcaagtcaccttggctctgtgtgcattgtacgcaggatagcagcactctgtcttactgtctatacctgtgtatctcccttcattttctcttgtctccctgtctttcccctttgtctgtttgtcccttctctgcagtgatgatgctggcccagcaggctggccccctggagcacgaggcagaaggaaccaccttctacagctggcctgcagcacccctacctacatccctcaggcctctgcctggcaccacccttcatcctggacagatccccatctccatcaacacttgacagcctgggatgaagcatcagaggtgccccgctggccatgcacatagttccattgttcagcagtgtttttcattttctttggggcatgaatgtgctcgggcttgtacctgttccaaatagagacctaccagtcctgggattcctttcccagtgtgtgccagccctgcctgggaccacttggcagctcggaagcccctgcttcttgttttgccatggctcagcttagtgtggcattcgttctagtatccaggaaccaagcctcacacctttcccattggtgcccgtgacagggttggctcactagacatccctcagcaaggttctgaggcgcaccagttacagtcagcctgtgtgtgttagtgccagagaatagggatgcaggaggtcctggggtttggctgggacctgagtgttaatgcagtattcctcacccaccagaggacctctttcctcactttgggtctcactgtgccaggtcctgggagccgccttctgcttcgcttcccagcctctcttcctcccagcttgtgcccctttgggtgtcgctggcatccccaaagtgatttctcctccttcccacctctgatggaagggacctccttccctgcagaagagcagcagggtggcatccccaggccgccgggtgcttcacttcgctgtagttttggcttttgctcacctcatattttctccaataggtgaatttcacaaaacttgtgacgtagcggtagtgtggttgcctgcagcatcgtgtgtgtagataactagtccaagaaacaaaacccggcagagtggacagacacaggtcaggggccaaagacatagatgtatttaggtttcgggtaacaatgttctgtccccagaaggccccagccttggatgtagtgaccggcctcaacttgactcgcaggtgggctgggttttcagtgctgaataaagtggtttgctccagcctctctgtttccatacctcctagtctttgtctacacagctgcttcccccttccctgaccaggttccaaggactttgatacctttgaaagcaagataaggagactgtcactaagatattccaggatggggtgtgggtgtgggtgtgtgtcatcccaaacccagcgttggctgtgggcattgcatctgggaagcaggatccatggatggatagaaggaccaagaggagacatcgtggtgagaggactctggcttagcccaccagacagggtctgcagagggctggccagctgcgcagatgcacccagggtggaaggtaacagactggtcacattcatacccagggtgactgggtgcccaggctgtagcatccttgatccttgagtcatgcagatggcaggcagcgagagcagccctgagtagtgtgctcctcagtgacagaacgtggtctctgttggggaccagaatgaacattaaactgatagactagcaggtgtggagaaggtctaggccacctggtggtagctcagaaacaagcaataggtttgtccctca

SEQ ID NO: 19917 - DNA, 1102 bp, Mus musculus
gaaacttccctctgctttacacatgtgtgtgtattttccaaactaagcagttctccatcaggcccagtcccccaagactgacctacttcagatgctacttgtgagccccagggaatgcccctatctctgtctccttgctcttactccagtcctcacaacccctatctagttaatgttatgtgatttgctgggtggctcacaaaacccaggaatccttttgcttagttttaacagttaaagaagctgcagttaaggaagagatggtgggtaaggctgcaggaaggcatgaagccctcctgcactcgctgcgaggactgtcccttcagctcactgtcccttggacctgacctttgaggaacttttagggatgttctgttctgtgggcatagtatgtcagatgcttgtctgcaaacttgccccctgactcctgtcttctccctggagccaatgaatgaggctgaagttccttctgtcgcacagctggtttatggtggccagcaccatcctgaagcgatcaacaagaccccacctgagccaccttagaaacataagttcaagtgtgatgtcaggggactcttaggattggcaaagcagatttttaggtcttctctggagccaggaatgaactctgctgttaagtcttggttgtccaggggctgctgcccttgcttctagacagaggtcgactgtatgtggaccatgccaggcccagaggtaggtagaccagaaatcagccgggactgtggtctgggaggaaacagcacccttcctcctgagcagctctgtgttaccctgggagccaccagaatgctgtggggcctagggtacagctgcaacccaaacccacagtcttctgctggagattgaaagaaagagcagatgtggggagtggtcatggtgggggcagaagatgatccggggctacatgagacccttcaagaaggtaaatgaaaatgcagtcagagccctgagaccagaagcagagatgcagggctgctttctagagttaagatagagctaggggttctctcccagggaagggaagttctccactaggggtacttacttaagcctgaggctccaacagccacgtggactgcca

SEQ ID NO: 19918 - DNA, 1301 bp, Mus musculus
gaggggaagcaagagtactgtccagccctggccatcctaccacagtgacggcaacagtagccatagccagatagcaggttgttaacagtggggcaagcccagcaggggccgaagtcccagtgttcctgaatctgtctcttgcctcaccccaggcaaggagcctggcttgtttgacctggtgatcatcaatgacgacctggataaagcctatgcaaccctgaagcaggcgctctctgaggtaggcccttcccatctaccctgtcttggggaagtcccctgcacaagccatcctgtgaacgcagcaaaccctgtgttgccggggctcacaccctgctgtgttgtaagcagccctggctttgccagttgccagaatggtcaagtacaggtgcaaagccggagtccctgggaacccagggaggatatgagccctagccctccctggttccctgcctctcctgactttctgtttcccttcttccttggcaggaaatcaagaaagcacagggaactggccacgcctgaaggcctgcttcattccacagagtgatgtctgtggtctaaatttgcctggaggtgggggaaactttgccagggcaccaaggacttgtagtagacttccactgtggagtagaaggagctaccctttgtctgaccacaaggtggctctgcaccgtgggctgactcactggctgaatgactccaaagagtacccatatctaatctccctggactatttgtgttcctttccttgttccttctgctggagcgggactgacctcttaataaagtaattactgaattatagtgtcacagccctccatactgggcttatggcctctggctttctgcccctccatggtcagcccagatgaaggctgctaagggggctctgcataggtgtctagtggcccttgtccctgcccgcatccagggtccactagtcatcagaatgctggctagggttgctcgtgttcacttcttcccctgggagtcaggcaactgggacaatcagtatgggctggaatcgtctcagccctagacaacctagtgctgctgtctctttgaggtatttctgagccatttggggactcagagggacagataccacttgccaggaacaaaagtgcccagctgcaggggaagagctaaggtcataatgctggccctggagctgtgggtgctgtgtgttcttggccttgggtataggcagccaacccaaggaagggcaggtgagccctgtgagggctgcaggcaggcagagtcctgggccttctgtaaagatcgcaaattttgagctctag

SEQ ID NO: 19919 - DNA, 1235 bp, Mus musculus
tgtcacccagagcatggaagagtgaatccatgtttctttggtgactttatctgtccctctgttccgtgaaggtttgccattatttaacttagtttcaacagtgacccgggacctttggagttagcattcttggctttccagaaagcaaggggccggcccctcctggtgtcactaaggttttgtagtgtccccttccaccgagattccttcacacgagagttatcaggtgggatagcacagccgcctttttgaggagctattgcgcaggcgcacgtggcactaggatgaaggatgcgccagagaagccctgaacgccctttagaaagaggatcttgattgataaggccctcggatacgcagtgcgcaggcgcacgggcacgttagcgagagcgcaggcgcgcgcgggggcgcgagagtgacgtcacggcgtgcgtccggagtgctgcgggaagtccgactagagaccgcgggtactgaaggctgtgcagtggctccagcgccatgttcggctccaatcgcggtggcgtgcgtggcggacaagaccagttcaattgggaggacgtgaagactgacaagcagagggagaactacttgggcaactcgctgatggcgccagtaggccgctggcagaagggccgcgacctcacctggtacgcgaaggaccgcgcgccgtgtaccggcccgagccgtgaggaagagctggcagccgtgcgcgaggcggagcgtgaggcgctgctggccgcactgtaagtgcctggtctgcggggcgaccgcaagccccgagggcgggatctgggtggccctggggcggggctggatgtgggcggggcacaggaaagaaggggaccgaggggccagacccttgatgagcattcctgacctttgctcgcagtggttacaagaacgtgaggaaacagcccaccggcctgagcaaggaggtgagtctgagatatgggttcgaggtccgcggggtggttgggggggggtgggggggtccgtctgtctcggcctagaacctcctatcttaccctgctttcgcaggacttcgtggagatctgcaaacgggaaggaggagaccccgaggagaagggcgtggaccggctcctgggcttgggcagcgccaggttaggctagttggggagtccagggtaggcctgggcggtgattgagaactgtcctcaaatgctctgtcccctgcagtggctccgcgggccgtgtggcgctatcccgagaag

SEQ ID NO: 19920 - DNA, 1668 bp, Mus musculus
gttctcttggtgtttgccaacaagcaggtaggcaccagcaaggtccttccctgaaggaaaacctgtatcagggaagaaagaggaggggtgaaaggctacccagggttattggctgtttgtggtccctgccactaattcttccttttcctcaggacctccccaatgccatgaatgcggccgaaatcacagacaagctggggctgcactctctacgccacaggaactggtacattcaggccacctgtgccaccagcggggacgggctctatgaaggactagattggctgtctaatcagctccggaaccagaagtgaaccagacccctccctccccctcacttcctcttctccgccctcagctttcctctcatgtggcaaacgtgcgactctgtggtcctgagtgccagaagctgtctccatgggttggtcacagtgtgcatcgcaccgtgctgtacatgtgcagacgcagcctgcagccaggtttttatttaatgtaaatagtttctgtttccactgaggcagtttctggtactcctatgcaatattacttagcttttttattgtaaaaagagaatcaactcaactgtcagtactgagaagggatttgggtgtaggggcacctggcctccgggagccattgggctgtagactggtgtcggtatccatttggtggttggtttttaacccaaactcagtgcattttttaaaaatagttaaaaatacaggacaagaacacttgaacacacagaacggagactatgcctagtgtaggttttgcagttaatggcctgaatgctagatatcagatcacctgtttcgctgtgggaacaggagagaaggtgatgaacaaaccaccatccgctgcatggtcacagtagagcccccgtgactcgcctgtctttgggtcacctgcattccatagcattgtgcttgtacttgtgctcacacggttacctagggtaggctgggagccattgtggggtgcagggcctggcttgtacttggtgtgtgcaaggcccaatggcagcctgcatacccagcctactcttgggcccacttggacgcgctggcaggaggcctgggtctcaccagcaggagtgcgtgcaaggtgggagggtcggtccattacagacccacatcctggagcacccccatctccatgtgtgaagtagcttcctccctcagcctgcaagggtccgatttgccatcgaaagacgacctctacttttttcttttgtattttgataaacactgaagaagctggagctgttaaatttatcttggggaaatctcagaactggtttatttggtgtcgtggaacctcttaccgctttcaatacacaattagtaatcaactgttttgtatacttgttttcagttttcatttcgacaagcactgtaattatagctgttagaataaagtctcttaactatttgatgggcttgtgtgtcagtgccaccactgccaggcttcttcctgagattgagagcccttttcatgctataggaaacagggaaacaggtgccctttaagccctagtgtaatctggtaagatctggatgtcttgacgtgcttctttcctttcctttctgtgacagactggggcagctggccttggagtgcttatctctgggtaggtgtgaccactagaagatccaaagtttatca

SEQ ID NO: 19921 - DNA, 1158 bp, Mus musculus
ctgaaagacctgagtaggatcagagggtggggactttgaacccagccctcagcttctagggctaaaggttgagtgggtcatcagtggtcagtgtctcatcagtcatgtccacagcatccctagaagacccattcagaggatcctatgtgcttagggaggtgagggctggttcttcttagaagttggtggttttctgagtaatacgagcttctaggggaactccaaaccaaggaggacctctggaaccctgctttctaggtgctggccatcagagtggtactacaacctgggcttgcatctgcaccaatgtagggacatcttgggagacagaaccccacccttgggacctaatatgatcttgaggcagacatttgtcagagctgaactgaattaaggacattcttcctctggtgttcactgataaggacccttttagggtcccagaatcctgtactgactaggacatgagagtagaggtaaaatatgtagtttgttttgttttctgggaaagtatgaaacccagttaggaattacttctttgcttgagtatctaagaccattgtccacgagcaagaaagaggtcagggccagcaggtaggtatatatgctctcaagagctctggggcagcgtagcctgtggcactgtaatgggaacatgagcccttgtgccctgtgtagttagtgctgtaatcctggtcttcacatgatagctggcctctgggtgttagtaacagagccgattatgtgaggcctggcgagaggcccgaaacccaggtgtgtgcccatgaagttgcctctcctacctccagctgggaagtgctggtgatgcacatccccagcccacacagacctatggaaactgcgcatcctgggcagagccaccccagaagaaaacaggaaaggattggaattggcaccctggggaggggaggggaggtggaaacactgcacagtctcatttctctctctgaatttctagagcataccctgcagcaaggctgtggtgtttgctcgaaacatcctcagacagcatgcctgagcctcccagggtggggatgggaacttctgagggagtggaaagagggtctgctacagagcaggagggcaggtaatggaaaaagccagtcttgccgcccccgctcggacacactgccccac

SEQ ID NO: 19922 - DNA, 1160 bp, Mus musculus
tactggaaggactacatccaagggagttactcctcttcgcggggctgcctctacctcaaggactggcatctgtgcaggtaataagacaggacggcgcatggccattgggcacttaccctaagcagctagtgcagccagtccaggtggagcacgcccactgcactcagaggggctacctctacagcagagttctaatgtgtatcacagaactgatgcgaagatgtggggagatcaacatagcgagccaggtagactattatggggaaggtaagtctttcgtacatcttgtatgggtacaggcggcctggtgtctccttcctcttctgtatttttgagctggtatctcagatcctctggggctgtcctctctgcaaccccactgagaggacgcttgttccttctacgattgctctggggattcttgccatcccctgggccattctaagctctctaaagggacaagtgacctttccgcaaccactcttgtcccactttggaaacccctttactctttaaagacacattcaatactctcccttatcagcttccacttttctcacacagcatcttgtgacagctttacttaggagatttttgacgtcttgctggagcaagaatgcattgcagtcagtagaaactacttcaaaatttgaattatggtgtcttcccaggctagctatatatggtctgttcatctcccacccttctctctcaatgatggacagggtcaagaagccataacctccatctaaacccccggatctactaaaatgatcacacctttacagtgtgctctgttgctgtgctaagctacggtagtcatgcacttaggcacactgttgtgttttccttttggaactgggaatgctaaggttgtgagcatataaacacatactgttagtatgttttgacatttatggtattttcagcttggacatgtcagtacgtaaggccatcataagccgaggcgctccctacatctcaggagtttgggctgtccctaagacccagctcacgtgatgctctctttgggaagagcattacccttttccatggtgaccctgcgactgtgtgttttcctctacctgacgtccctttcacaagtacagaccattgtactcagacccccagcaaaaggcacagtgtaacattgagtgaac

SEQ ID NO: 19923 - DNA, 1186 bp, Mus musculus
tcctttggtgatgaacaacagtgtggaaatgtaagctgaataagccctttcctccccaacttgcttcttggtcatgatgtttgtgcaggagtagaaaccttgactaagacatagacccatataccatccttaaggtggttttctgtttagctggtgaagaaaaaaaagccattgagacatggagaaataaatatgcagaagtctatgatccctagtcatcagggctgatgctgaagatgcggaaggaaagtagagcagaacatacaaagtatatgctatataaattatatagattagtatataaaaaataagccagtgatagaaacaaacaggggcaatggggggagggggagggggaccagggaaagcccacccccaactgaaactgaatcacctacaagagcacactgtacaaataacatacagaccccaatttgctggctagtggaaacattgagcctctgacttttctacccatctatggcccacctcccttcttggaagtattctttcatattaacctgtctctgtagccctagacatgtgtcagtgtacaattccttgtagggtgcctcgagactctaaactttgcctagaactgagcacagtctgtgtgcattcatctttgcttcataagcagtgtgcatgcacatcctgatagttcaaagcacaacagttcataaaagcagttgtacaattatgtagttaacacaggcatccacatgtgttcacaggaattacaggctggtgcagtggtaggtgttccggcagcatctaccattacgtgttctacaggatactggcaactatccctggcctcaccccaggacaagcataggtgatgccataggccatgatcctttacaactgtgagaacttcttccctgggacccaagcatgcaggtacatgggattgtaggaacagtggctcaagttttgatgtcacaggatgccatggaaccctcaccaggtcctgtgaaatgaggccctggtgtgtgacatgggtaagcccagaatatctaagttttgaaacataaacggtaccttccttaaataagagctgaagaaggtatcagggcatatagcattctgtgtctgtgtctgtgtgtgtgtgtgtgtgtgtatggcttttcaagacagggtttctctgtgtagtcctggctgtcctggaactcactttgtagac

SEQ ID NO: 19924 - DNA, 1208 bp, Mus musculus
tccactggcaagtctcagagattctggacaggtacaggtctaattctgctcagctgcttgttgaggctcgagttcaacctaatccatccaaacatgtccccacagcccatccccctcaccactgtgcagtgtgtatgcaatttgtgtggaaggaaaacctgctctctctggcctgccaacatcagttttgccaaagctgttgggagcagcattgctcagtgcttgtcaaagatggtgttagtgtaggaatctcatgtatggctcaggattgtccacttcgaacaccagaggactttgtatttcccttgcttcccaatgaagaattgagagataaatacaggcgctacctctttaaggactatgtggagagccattgccaactccagctgtgccccggtgcagactgccccatggttatccgggtacaggagcctagagcccgccgagtgcagtgcaatcggtgcaacgaggtcttctgtttcaagtgtcgacagatgtatcatgcccccacagactgcaccacaatctggaaatggctcaccaagtgtgcagacaactccgaaacagctaactacactagtgctcacactaaagactgtcccaagtgcaacatctgcatcgagaagaatggaggctgtaatcacatgcaatgctccaagtgtaagcacgacttctgctggatgtgtctaggagactggaagacgcatggtagtgagtactatgaatgtagtcggtacaaggagaatcctgacactgtcaaccagagtcagcaagcacaggccagggaggccctcaagaagtacttgttctattttgagaggtgggaaaatcacaacaaaagcttgcagctggaggcacaaacataccagcggattcatgagaagattcaggagagggttatgaacaacctgggaacttggattgactggcagtacctacagaatgccgccaagctcttagccaagtgtcgatataccctgcagtacacctatccatatgcatactacatggaatccggtcccaggaagaagctgtttgaataccagcaggctcagctggaagctgagatcgaaaacctttcatggaaagttgagcgtgcagacagctacgacagaggggacttagaaaaccagatgcacatagcagagcagcagagaagaaccctgctaaaggattttcaagacacctaaactgggctgtggctgtgc

SEQ ID NO: 19925 - DNA, 1721 bp, Mus musculus
agggatggggtgaatacagtagggagctggccaaaagcctgcactgacgtctcctcagaagtcagcctgggtttagtcagggtgtcagccaggggagcatcccacagatccaccgacggccaggccactggccatcaggaggtcacattttgaaagttaatgaatttatccccacatcttctttgtgccccaagacccttcagaaatgtgtgctggaagttgcctgtcaccactcacattccttcccgtcctgtctaggagctgagagccaggccctcaaggctcttctgggcaagccctgccctggaacagaagcttctgtgaagtcgtccttcatgggtagagattccaaggcatttatttagcttcctagcgctgtcgtcactagtactaaacataggctcttctaacagcacacagcattgtcacagttatggaatttgcaaagctaggtccggtgtcagtgggctggttctttccgaggctagaagggggaatgaatcattctgggcctgatggtcactgacacttgtctgtccccggggacttgtacaaccatctctccatctttgccttcatctccgctgtgtcagtctccaagcttaccttttatacaaggatcccagtcttgggttggggctcaccctgtctactgtagcagagccccaccttcatctggagtggccatttccaaatacagtcacatcctgaggtactaggagtcaggacctcaacactggggtttgagtggacatagccacaactccagttaatcccatggtgctgttgctgttcctgcctcagatgaaccaatgcaaccttgaggcagccattcctttgaatgttgagctcagttgtctgctttcagggctgctgtcctctgccagggagaatcttcatccatggcctttaagttcagagcctgagagtctgggagttgttgttgctaggaaacctcaagcaaccaaacacgtggtcccacactgccctggcacactggtgttggccaggctcagtgtggctgtgactggacctgagagctgcaggcagccagtgggctgtaacggctctcagcagataggaggtttgggaaatgagttcaaggcctctggtgctctctgtcctgattttcacatgaagaagcctctagtccagacccaatcaaagactcttaagactttggaacagagtttctttttctgctcagtgcatcacccagaaatagtaaatgcaataaaaccatttggtcacaccttggagaagaaataaactgtggaagctcttagtttctaaatagttttcttctatccttgtgtctggagagggaggcgttgggtctctgtggtcaagggagggaagccttgctcacggagaccagggttttctatttatcctgtcgcctgagcttcagttacccagggagggacatggtgctcttcacctgtgtacttgtcagctaataaccaaacttgcaagggttaataaaggaggtgtccgaagcatgcaccagatacggtcagggagccctcactgctgaccagagcccgccagggcatcaccataactggaatgtcatttctacctatgctagcagcccggtagaagctcaaatcctaggtttcttcctctcaggagtaagtaggagttacctgttttgaggaacagtggcaaacctccactaaacgtcctgtccttactgggtcaccttagtgttcatctcc

SEQ ID NO: 19926 - DNA, 1200 bp, Mus musculus
ggccaggcagtgagcggccctgcctgggcttttccggaatcccgagagcccaactcggtgactccgtttaccttttctccgagtgttccaaagtgtgggtcaagtggagagaccgtgatatactgtgcccctggtgtgtttgctggattgtgtatgtgatagtcgggctgaaagcctggcggtgactgcctcctctctcatgaccaggaagggccacaatgtcactatgtgtaccactgccttaaggagaatctggagaaaacaagggataggctcagacggaacactagtagcttttttttttttagccacatttttaggtactaaaatataattacataactacccccttcccttccctccagccccttttactcacacacacacacacacacacacttatgcacgcacctgcacacttaactatataacaagaacttaaaaattttttttgagatttaaatttttaataacatgtatacctgtgtagatatctttgtgtgagtctatgcccttgggtgcggtgcccatggaggctcgaagagggtgtgggaaacacttacaggactttgtggacagagggaaaagtagtgtgtactctcaaccaaccactcagctgcttctgcagcccctgtgttggaccaggtgcgtgtaaggcttgtcataaagcactgtatggggaagaggcacagtcttagctgcaactctgacactgagctgtacccccaggcctagcattggtggttttaaatacaagtcttactttaacgctctgagttccttctgtacctgggagtttttgtccttgccagcacagagtgaaagtttctgtccctggcagagtgacattgttccacggtggtcttgcataacttcccttgcatatttttttttcctccagttcaatttgtgaagacctcaagaacagagacggtgacttcgactccaaagcttcaagattgtggcctgctggggctattatcctccaggaggacctgtccatcaaaggtatcacaaaccttggttacacatagatgcctgtggcctccttgttctcctggggtactgggaatgccagtgtcctgttgaatcgccaccacttttctcccaaatgccctgccttctttactgccacatgttaggggactcctcatggagtgatggcttgtgggaagggtcatctttctttcggttcccatg

SEQ ID NO: 19927 - DNA, 2075 bp, Mus musculus
gtaatgtgttgatagctctatctggtggtctgttggggattccccttgtcttaaagcagtaagttcataaagacaaaggaatgagacatgcacattccatatataggaagaatgataggtgcccaggtttccagtcctccacccaagtgtttcgtggttttgtctgaagaaccaaccctaagctagaactgagctatgacacatggtcttgtttctctttattattttcccctttctcacccaagtacatttttacaggaaaaagcaaatcccagtcacactacttctccagggattctctcagggcttctgccctcgcatgcccactaatctcaggatccctcgcctgcacctgctactgaagcccactacgcctgctgcaccaacacctaactgctccttcctctctgtctccaccagagtctgaaggaaggcctgacggtgcaggagcgcttgaagctctttgaatccagggacttgaagaaagattagctgcatccattccactgacacatccttcccagctggtggcagcacaagccaagcgtggttttcatcttcacctgtgcatctcattgttgctgtcattaactgtggggatggatgcatgagagactgctgtggggtgcttgctccagtccctccctgtcaattccaacttcctgttgtctttatcacagcttttttcccatggtattctcagattagtcacgcgcaagcagtagagtgggacggtttccccgctgatacctgagcagcccccttgtcctcccagcacactcactgtcagtattaaggcacagcagcctgttaataagctagccctgcctcagagtgcacatgtggggacctgccagtggctctgctctgccgcacacagcggagcaccacccttgatggtcagagcagagccaccgaatgttgtaggctggcctgatttctgaggggcctaggaaagtgtccagcctggcccacttccttttgatgtgggagggggacagcattttgtacctggccactgatgcagcttagaaccatacccagataatccggcaaatccttcacaacctggaaaatgttgaaagcaaccattcctattttggttttttattaaatcttgcacaaaagccccggcccctctcattccttcctccgctcgtgcctcccttgctgtgctaatcctggtcttctggtggcccggaagagtgacttgcagcctgaagcttcagacttgtcaagtgtgatgggtcctcaaagtcctctggaggggaacattgctggggtttaatctgtctgaaaagaagctgccatgctgcttggcagggtgaggagaagcccgtgtgcaaagacagactgtcaggactggtgatagcagcagtgtgtgctcaggaccctcgttagtctgggctctggaagggtcccttgaattgtctgcttctcatggagccattgacagggagcctgtgctaactctgcttttctagctgaacaggacctgaaactacccaaagcagtctgcagcattttctttaaaaaacaaaccaacaaaaacatttttctctattctcataagaaaacattcatactgtaagatgcagcacacaggagtccccatgtcagatgggagaggcaatagcctcatagctagatatgcgatctggcttcttagtcctggcttgttagtgttaagtgggtcagatggatggtctctgagcgtacaaattcaactcatgagtcccctaaaggttctacatgagttgacgtacaaggtctagctggcctaatagacaggcaggtcgaaacttcaagataacggatttgttacataccaaagtgtgccactgaccagcaggcaagccctgggctccccttttcacacgtttttaagttccactctggcacatgctcagtggtcatttatgttttcagcattatgggcaagtcagacctgttaaaacaagctttgagctcagagtgggctagccttcaggagcctggggttgtgcgttgaggactcctgttctctcatacggtttccttgcagctatcctgctgcccttgggaccctctggccc

SEQ ID NO: 19928 - DNA, 1178 bp, Mus musculus
caagggggtgaacacccactgggagtccaaggagccaagtggggcgagggggaaatacacggaaccctctggatcagcagaaccattctgtgaggcattgctagactgctgccaagagagcagagcgggagaatcttggaaggtggggtggcagtaaggctcggtgggagccatccctgaagaggccctcttctccaccctttgtattcaggtgtttgaggcagagcagtttggatgtccacagcgtgcccagaggatgaacactgccttcacgcccttcctgcaccagaggaacggcaacgctgcccgctctctgacctccttgaccagtgatgacaacttgtgggcgtgtctgcacacttcctttgcctggtaatgaattctaggtcttgacacctgtgagccattagaacaacccaaagtcacccatctgcctcccagtggggcgggcctgagtgcctctgtaggtctgctccaacgcagagagttctcttgtctgtctcctcaccggatggagacacttcgaggtagagctcagttcgcactgacacaaagaccatttctgtgtgaagaccatcaagtctcctctctgaagatggcagcaggcctctcccgagccggtagctggtgctttgggctcaggtctgggaggttttgctggggggcagccgtcagctggtgtctggagtgaaggtctggtgtgcgggtgcgctatgaacaaggagctcctgttcctctgactgatgggtcttaggaaatagaacctgcagcgcctcagccccgaacctgcagcgcctcagcccctagtgtagcagggatgtattgcaccttctagagtttgctgttgcctatgaaccacatttgtcagctgatgagcatctaggctgggtccgttccttggccattgggaatagagctgcagtaaatgggtatttaaggatctctgctgtggtgccttggagtccttcaggaaatgcccgggaatggtgtagtgggtatggatttggaggaacctccccactggtttccaaggtggctgtaccagctgacgtgctcccccctgccccccaacagtacatacgtccctgtttactttgtcctcgccagcacctgttgttcttggttttcaatttattatactttatgtgtatgagtgctttgcctatatgtatgtatgt

SEQ ID NO: 19929 - DNA, 1173 bp, Mus musculus
ggctttttcagaaatgttaactaaagagggaagactgatcctgaatatggtggtactgtcagtgtactgggggtccgggtggagaataagaggggaaaggagctgagcaacagcctgcgcctctctccttcctgactgcggaccgtgtcgccagccttatgttcctgccgccatggaccacatgggtcgtgatggatcacatccccttgaaagtgagccgaagtaaactgcatcttccttgagttgcttggtcatgggatgtaacgatcacaggcacacatgggcacgtgcagaatgggggagagactggtgggtgcttagagcccggggtgggggagcagaagggcaaagattctgatgagcttatgaaaagttccaaaatttacctgttgtctacatgaaggatgttgacacacacgtctatgtcatttcttttctcccagagctcagctttgacccagagctctaggcttgcaaagaatgttctctgaccatgagccgagtcctctcagcctcaagtacgcactttaagcaagacagtgacacggtttgggaatcgtcacacatcgctgttctggtgtggtggtacaggcatgtaattatctcagtttcttgaatggctgaggcaggaggattgtttaaataaaacaattgcaagatggctcagcaggtagaaacacttgctgccaagattgacaaacctgaggttgactactggcattcacattgaaaagagaatcaactactgcaagtttccctctggtctctatagtcatatatatattattttatctttctagtgttttgttttgttttgttttgttttttgagacaggctttccctgttatgtggctctggctgtcctggaacttgcaatctggcaccaaactcacagagatctacctgtctctgcctcccaaatgctgagattaaaggtgtatatttataataaataaatatctttaaaaagggcttctgatctcccatgtggctccacccctctcccgtccttcagatggccccacccaacccctgacagccaaagcagctgtgtccctgggatgcatgcacagatcggcaggactgcagaaagcctgcggtcgggagccagggagctgtgcatcagcagtccagtcttcgtctgactgttttcctctatgcctgtggttctc

SEQ ID NO: 19930 - DNA, 1199 bp, Mus musculus
tagaagttaaccccacccttgtctttgcccccaggtgtccttgccagttaaatgggtaggctgccagggtcactaggtggcataacagccagtcagccagcatactctgattaatgaggtagtagaaacctggagggaggtctctattggttcatctcaagaccctgtcctggctgtccagggaacattgtgcagctcatgtcaccctttgagttgacttcttgaatctgaagctcttggtgctttatagcttgttaccagcttgaggcggatcctgctaatatctctggcacataggaccactgaagctattggggagaagcagaatgcccagagccacttgacaggacagctgacagtccatcagaatggagttcagatccaggcctgtagtttctcctaaactagggttctggaggtgggatgtatcaggtgctcaataaatgcacatggctacctggatgactagggtagtgagcagtgcactttccttcccagcttcctattgcaggaattggatagccaataaacaaactcagactcaggtcttccaggcagagaagagttccctgcagactggggaggatccaattcgcctccatataccatgtaccatggaggtactgtgagatagggctggtttctgatcaagcccataaacatgtaaagaactgtttgattgtatgcttgtaacaattggagagggaacatgcctcttaacttttataatatggaggctcagctgcaactcagaaagcatgagctgtgcttctagggctcagtgatagggacagagattgctatgactccagtctttgctgggcacatactattcatgttagaggcatataagtgctaggattttggtcacacccccattttacaggttgaaagccattaagatcatggggttgggtcttagagttttcttaatacattttatttatttattgtatgtgtacatgtatgtatgtatctatctatgtatgcatgtgtgtggaggtctgaggacagcctgtgagggttggttctctcttcttttttttgtttttgttttttgtttttttgtttttcaagacagggtttcttgtatagccctggctgtcctggaactcactttgtagaccaggctggccttgaactcagaaattcgcctgcctctgcctcccgagtgctggaattaaagtcatgtgccacca

SEQ ID NO: 19931 - DNA, 1113 bp, Mus musculus
aaggattgcagtgtacccatgtctgagcttctgggagtatcccagaagtacaagtgtgtggggagtactgactattccctacttagcaatctccagatcccctcgcccagcaccttaccttgcccacaggacctagctttatgtgttgcagggagagcagagcttggctgtgtggacaaaggtgacatagccaggcttgcttctacccaagggagagtaaacacctcatcttagtgcatgcagatacgatactaaatagactattctcacctttctaatttcctaaaccccaaagcgctgtgattgagcttcttaacagttggcactgagcagctacaggttgctagtcttgttgatttgtactgtctctggattgagagagtgcttccacttctcggcatccccagaatgtaagacccctaggaaaatcgggaaaggtttacagtaggtatagatacatcttagatgtttgtatagttggtggacacatttccatgctgttctgagccaaggttctaaagggtggtgtggttctactatacatcaaatagtttttatcatgctgtgtgtgtaggctgtggttcttaaagtcaggacatggtgtaggggcctctcatccttactatcccttcctgccccacaccctcctacattcctgtctcaggcaagattctctagcccagtggttctcagccttcctaatgctgtaaccctttcatacagttcctcatgtggtgactccaaccataaaattatttttcttgctacataactaatttttttactgttatgagttgtaatgttaatatctgatatgcagaatatctgatacataacccctgtgaaagggttgtttactcccaaagggcttgcaaactatacattcttagttcctgggacaagaggacccagcagatggccgagaggtctccaggagccagagagacaagggaaggagaagcctgtacaatctctttccaggacatcttggaggaaatgggtctcagttccttcagcgtgtgagccaaggcgggaggctttgccttggtgcttccagacaggagctggaatggttccagagccaggatgtctctagagacaacatggagagca

SEQ ID NO: 19932 - DNA, 1099 bp, Mus musculus
ttcgttctctgctcttaaataccttcccatttcatggctgttcagagagtaatcagccagcttcccacttgggctcaggaagtttgtccaggcggcccctaaattagcagggtctgccagctccccctgtctgagggtggtgcttctcttgtgtcagagcagccaccagcatggcacagatggacgctctcctgtaatgacagcagccacagatccagcacttctccaactcaagaacccggaaaatcaaaatcagagcactgcacaggaacatctaagcctcgatgagtttgtagcttccttcccacaacagccatgcatatttggaagagtgctgtaggatgagattcagtctacaggtgaataaaagatctgtagaatccactcatgccaagaagtcctgacagagtggcttggccatgcaacacttctctccccagaagaccagtgttctgaaatttcatgcccagtgcacctgtttctaccttcaggaaccactctgtgtccccagccggaagcccagcttgcagcacagccctcggggctcccaaagactgaaatctggaacagcctttctgttatttggagccatttccagaagtggaaatgagaagagaccttggaagggtagttcaagaagtaacacctctggtggctccaggtctcttcaaacaataccagtttctggtggggaacaaggttcaatagtaaaatgggaagaactttccagatctgagggaggcatagcccaatgtgtaccattcccctagtaccttgtttctgctgaggtaccagtcctcttcttgctcctaacctaccttggctcccaggcccctcccatctagagccccctgggatatcaacctctgtctgtttcttccaggtgctctggcctgctaggcctctttacttacctgcgtgctactgctggcctcctgaggcctctctcctgaggacgaacccaaccaaaagcccagcccctcaaaagctgggatttttttgttttgttttgtctagctgacttaagcctcaagagattggtctcagccttcctagtgtggggaccctttaatacccttcatgttgtggcgtttccctg

SEQ ID NO: 19933 - DNA, 1236 bp, Mus musculus
gtttcaggctagcggggagctggagccgcctcgcaccgccactccgcgcagggtgggagggagcgagggaggcgaggggacgagcgccggctccccgcccccatcccacccggttccgatatttagctgaaaggcacgcggctcctaatcggccctttccaggctgagatgtagcggcgctctgcccgcgcaagggcgggggccgggcccggggaggcgcagagtccggagcctgcgagcgaggtgaggagcccgcgtcctcggctgctggagcgggcgggcgggcgcgcatcgccgaggcagatatagaaaggggggcaggttaaaaataaccctcttcggctgggaagctcgcgcgcactctctcgcctcgttcggtgccagaggactccaggggaggtggcgttggggagggcagcgcgggattcccctcctccgccgccgggcggggtgctgcctgcacgccgcggctgcacgtgtgcggggccgcgcgcccaagcccctcggtccggcccgcggcgatctccccagcctcacgcttctggctgccgcccctcccgcacccagagcggctgtaggaagcgctcctttattcattatttacgagcgttaataggtttggggcgcgcggactgggggcggaggcgaggacgccgcggggaccccagcgttcggggaagggtgcggacctgcgggaaggtctacggggcgggggtggggagagctcacacgcaatttcgccggcgcgcacttagccgaacggggcgaagggactataggcccccactttcctccctgcacggcccttgcagccgcgtccctgacgcagctctggcctcatttatcatcatctttggtcaagtggagtgtgcaaggaacagctgcttcactcggctgacttccgagggcggctacagcgggaatcaggaaaatgaatgatggaggctggggggccgcccccaggtccgggtgcaggcgggagggaggcggggagcatcttggctgcctttgcctcgtggcaagcgcagcgcccccttcctctctgggcgcccacagtccctgcggatctgtggcttaggacgggcgggtgtgccggaggtcgccgtgaccttgctggggtcagtgggttgggctgcggaggaggcgtcgcggcgtctttggtggccctctccggattggcggaaggccgggagacaaggagggggaggggaataccaatggaaggtgaaattttac

SEQ ID NO: 19934 - DNA, 1123 bp, Mus musculus
gacttcagcccggggctgtttgaagacccctctgtggcctttgccaccactgacccgaagaaaacaagcagtcccctgtccttcggcaccaagcctttgctagggactgccactcctgaccccaccacagcagcatttgactgctttccagatacacccactgccagctcggtggatggtgccaacccctttgcctggccagaggagaacctgggcgatgcttgtcctcgttggggcctccaccctggtgagcttaccaagggcttggaacagggtgcaaaagcctcggacggcgtgggcaaggcagatgcacacgaggcctctgcttgcatgggcttccaggaggatcatgccatcgggaagccagcagccgcactgtccggggacttcaaacagcaggaggcagagggggtgaaagaggaggtgggtgggttgctgcagtgccccgaggtggccaaggccaaccagtggctggaggagagccgccattgctgttcctccactgacttcggggacctgccactgttgccgccccctggcaggaaggaggacctggaagctgaagaggagtactcttctctgtgtgaactgctggggagccctgagcagaggcccagcctgcaggacccgttgtccccaaaggccccgctgatgtgcaccaaggaggaggcagaggaggcgctggacaccaaggctggctgggtctctccatgtcacctctctggggagcctgctgtcctactgggcccctctgtgggtgcccaatcaaaggttcagagctggtttgaatcttctctgtcacacatgaagccgggagaagaagggccagagatggagagggctccaggtagttccggcacctcacaaggctccttggccccgaagcctaacaagcctgctgtacctgaggggcccattgctaagaaagagcctgtgccacggggtaagagcttacggagccggcgagtacaccgggggctgcctgaggcggaagactctccgtgcagggtgccagcacttcccaaagacctcttgctcccagagtcttgcacagggcctccacagggacaggccgagggggctggagccccaggccgggggctgtcagaagggctccccagaa

SEQ ID NO: 19935 - DNA, 1103 bp, Mus musculus
ccttgtctgctgcctctgccaaaacccggccaatttcaaggaccttggggacctctgtggcccctactaccctgaacactgcctccccaaaaagaagccaaaactcaaggagaaggcgcggctggagggcaccttggaggaggcctctctgcctctcgagagaacactcaaaggcctggaatgttcggccagcaccacggctgccgcccctaccacagccactatcactacccccacggccctggggagactgtccaggcccgatggcccagctgaccctgccaagcagggccccctgcgcaccagtgcccggggcctgtcacggcggctgcagagttgctattgctgtgatggtcagggggacgggggtgaggaggtggcccaggctgacaagagccgcaaacatgaatgcagcaaagaggcccctacagaacctggtggggacacccaggaacactgggtccatgaggcctgtgctgtgtggaccagcggggtgtacctggtggccgggaagctctttgggctgcaggaggccatgaaggtagctgtggacatggtaagaggctagagcagctggggtgggctagggcagtgtgaagtaccaacaggctggcagaagtgtctccagggctctattgtgggctacttgtgcccatagccaaagagtacagcctccagccctggggtctcttgggggagtatggaggcaagttgaagcacacccggggctacagcagagcacattcatccatcttgccccaaggtatgtgctacagtttctatgttccactgggcccagtggagcatactgctcacacatactaccccacaccggagttgctgggtcccagcaagacagaggccttccagagttgaatgccaagatggcctggtctcccctgaactgggacatagggggtagcttctaaacaacatgtggctaaagtgtgggacactggtcctgggcaaccctggcttacctggccaccggagccctgaagcgcagacctccagttttaagtcatcccttcagagaactgcagcatgtactgcccccagccttgctcctgcctcccctgtggggcaaggtcacaggacctagc

SEQ ID NO: 19936 - DNA, 1239 bp, Mus musculus
ggggatgacagtttttgaggcagtcataggaaagaagctgagcccccctgtgtgcccagcccaagtggagaaagcagccagactgggagttccacgtggaagagctcagctactttgtcctgcacatggggtgtgggctcggccagacctaagcctccctccctttgatgtgatctgtgcaggcactacagctgagctggagccacggcccacatggcgggagcacaccgaggccctgctgttggcatcctgctatctgccccctgccttcctgtcggctcctgggcagcgaatgagcatgctggccgaggcggcacgcaccgtagagaagcttggcgatcaccggctactgctggactgccagcagatgctcctgcgcctgggcggcggaaccaccgtcacttccagctagaccccaaagctttcccttgaggacctttgtcattggctgtggtcttccagagggtgagcctgacaagcaatcaggaccatgccgacctctagtggcagatctggaaattgcagaggctgcactggcccgatggcaccctcttgctctgtaggcaccttagtggcttttccctagctgaggctcaccctgggagacctgtacatagtgtagatccggctgggcctggctccagggcaggcccatgtactactttgacttttgcaaactttattttcataggttgagaaattttgtacagaatattaaaaaatgaaattatttataacttcagttttgtttatctgggtaggcagatgtctgcctcagctgattgctatctttcctggcttgtcctttgggaagccggacttcccatctgttgtaaggtgtatttgctggcttggtgatgctatgttgagccaccttggccctctgatctcatggctcataacccttgaggggccttgatggtctcagttgttcctttgccttccagccctccaccaggtaataaccccgtatatccagaaacacacacagttccctagtcatctctgtgcaccagcataggcgaaggatcagggcccattagtgagtagactgggaaccctgtttgtgtcccccggccccttccctctactcccaaccccttagggaatctggtcggcatccacaggccgcacacttccaaaacaatcgtggtatctttattgacttttttttttctgaatgcaatgactgttttttttttttttaactcttaaggaaaataaacatcttttagaaac

SEQ ID NO: 19937 - DNA, 1196 bp, Mus musculus
gcttggcctcccagcagccgctgccagcctcagcagcccctagaacaaacactgtgacctcacaggtccagcaggtcccagtgagtgggtctgaccaggaaggtggggggtggggacgcctggcttggatgctgctcgcttacagcttggcccctcccatccaggttgtactgcagccacacttcatcaaggcagactcactgctgctgacagctgtgaagacagatgcaggagccaccgtgaagactgcaggcatcagcaccctggctcctggcacagccgtgcaggcaggtcccctgcaggtagatggctcaggcacaagggagactatggggggggggggagggttggctgcgcatgtgtctgtccacctggtgagatgcatctgaccccacagaccctggtgagtggagggaccatcttggccacagtacctttggttgtggacacagacaaactgcccatccaccgactcgcagctggcagcaaggccctaggctcagctcagagccgtggtgagaagcgcacagcccacaatgccattgagaagcgctaccggtcttctatcaatgacaagattgtggagctcaaagacctggtggtgggcactgaagcaaaggtacggccaaaggcctgcgagactcaggtcagggtgaccagggaagaaatggggcacatcagccagccggggatgggattaggtcagtcctcgtcacttagtcatatgcatcaacttgtctgggtctaggcagtcccgtttgcggagttaggtcttatcaagggcagcctggataaagaaagctggtctatgcattgagggggcgtggtgatgaagcacagaaatcctgtcctggaggaactgactccctaggggagtagtgggaattgcagcggctggctcccatgttcggggaagaaaccaggaccagtgaaagttgtggttgtgaactgggtggtcaaggaaggtctcaccgtagagagctgagggtgtagggaatgtgaggtggagacagcaggggccgcagctgggagacaccgttgtgagtattcacagggtgacttttatctctgccctgtggagtgggtactgtcaggagacagcagcataggagagttgtagtcagaaggaaccgtcccgtccagaggccccgaggcagctgtgacgcagagcggctcttacctgctctcgtacctgt

SEQ ID NO: 19938 - DNA, 1197 bp, Mus musculus
ttgttctgtgtcccctctgccctactgcctgttaggacctgttcctctactgagaactggacctcctgagtgtgtgaggcatgcccttgttttacagattgagaaatggaagctcaactggggcagagcagggctgtccacgttgtagactgagtatgtgttcttttaacaagccatcctggtggagagggagcagcaagggcgggagaggtgtcttggatggcctcctgccttcgagcaagtgctcagagttcaccatgcagtacagagggcacctgcatggttgcaggactgagcagcggatgcctcaggacggtgggattaaaggttcccttcgtccatggcaggaattcagcccagaaatggaggttgctcatttgatagagacctgaatttgatccctaaaatactaggtgcaatggggctcacttgcagtgcctgcattccccaggttgtctgtcagtctccagggtcatgagggggtgggttggggaagtactgcatacgtatggacacgtgtgttcacattaaacaaacgggacaggccaaggtagagagttcagtggtggagtatgtgctgatcatgtgcattctctgctccactctggcacacacaaaaacccaccaacccacggatataaaacacactaagagaggggccattgagcattctcagggaagatcttggttcttgggtgggatttgaattttccttccttgtgaggtaaggttccatcagactgctcagctggacgcttacccttcttttgttttgtttttgtttgttttttgaaaggatctcactctgtagccctggctgacttggaactcactgtatagaccagactggccttgaacttacagagatccacttgcccctgcctcccaagtactgggattaaagttgtgtgtcacaagccgtctggctggacttggattctcgaggatagtctccctagtagctgagaccccagcgttgctaggcatagcatagcatagacaaagtttttgtctgttctgttctttgattccaagccttagggagaagggggcccaggaagaaggccttgcctggtgtaggcacttggtacacgctgagtaggtgaatgagtgaacgcacaaatgtggccctgctgtgtgctatgctggggatgttaggagatgttggtgagaggcaagagccttgaagaggacagt

SEQ ID NO: 19939 - DNA, 1973 bp, Mus musculus
cccaacatggatagcctacacttatggagtacttggtgttaggttgagaattgcattgaatccttccgacaggcccagctggaagacatacttttatcttacaagtaagagaccaaaaacagagggtaaatgacatgtccaagtcttgcagccacagcaagacagaactcagacccaggctgttggctcaagagcctggacctctggctcccaaggctggacgaagaggtgagattgaggcaggggctggggagccatgtagctgtctccttcaacccagagcagcattggacataagactggaaagtggcaaggagagccagtcccactggccatctccagcctgcttttctcaccctctgtcatatgactcctctgtgagcttgccacctttatatctgaagatgatgctgtgcccagagcatcaagtcctgctctggctgtgacctcagagaagatccagaggagctgtcttctccttgctcctggtgtccggtcactggaggctggcaaagggagcctgtgatagggaccactgtgcattgagggcagagaaggcaaatggaggtagtgctgctctgagactggctggtcactctaggagccctggggagcccaaggcctgtgacagccagctccccaacagtctgttggctcaaggtgtatacatagcttaggtccagcgtggcttactaggaagctctcctgggttccaattccccctctctgtcctggtcttacactgtatctgtttatgttccagtattgtgtgactctccccagggagaggtgtctacgaatctgatagggcgctgttacagagtgaagaaacgattccattcaagttgagcttcatgaaccaatgaatgtattggtgtcttaatcagtgttctgttgctgtgaagagacagtatgactacagcaactcttataaaggaaagctttgaactggggctggcttacaatttcagaggtttaggccattgttaccatgactggaatgtgtggcggcacacaggcagacatggtgctggagaagtggctgagagctctccatccagatccataggtggagaaagggagacacttagctttcgaagtcctagagcccagtctcagtgacacatacacttcttccaaccaagccacacccccagtccctctcaagtagcgccactttccaacgaccaatcattcagtggggttgtgcagactcccaaacagctgtgtcactgccaggtcttaactccagcgtagtgacaacctttggaaagttgcatctagagccctaaccccacacacccacccaggaatacaccttctgcctcctgtatactctgacctcccaaggttccacgcagctgagtggcgaggggacacagtggttagaatctctggtcaaaggttctatagccctccccctcctgccaagagaagccgttgctatctttatagacctagttatcacttagttatcgctgcttttcagcttgctttgttgcactctgggacagcattctgtagggcaggatcatggaggcaggagctgatgcagaggccacggaagggtgctgcttactggcgtgctaacccctccctggcttgcttagcctgctttcttatagaacccaggactgtcagcccagggatggcccaccccacccacaacgggctggaccctccctcacatcaatcactaagcaaatgctctacccgcttgcccatctagggaggcattttctcagtcaaggttccctcctctagcttgtgtcaagttgacacaaaactagccagcacagtcgagtaacccttcttgcttggtccccatgtccagagcccctcagggataaagagtaagagcacactgggagacatagcgtcctcacgtccaccctgtctaatgggcagtggagagctctccgttgtgctgtcgctcttagggaaattacctcaccctctctgaaatacagttt

SEQ ID NO: 19940 - DNA, 1197 bp, Mus musculus
aggactctcccctgtaatgacacagacaagcaggaaagaaccttcgcttcatctggctgggtgcacttgcacccatccatacttaccggatccccctgatctgagcacggggcgaccagatgtgaagcgctgaatgcagcagtatattcatcagggtggatattaatgccctgggcttccgtttccatttcttaacaaagatagaagtaaaactgttcttatagtagagtggttagtacggacatgcatttgctttgggatgagaagtcatgttgaatgacccgtgttgggcagcccgattactctgaaagcagctctctctcttattctttaaagctctaaggacaaagagtctctgccttcctttttgccccttggcttttgttacaaatgatgtaggacagggagctgacaaggacatcatgggaggtcagagcaattctgactcctcacagtagggggcaactttagacaaaatggaagatttgaggagttgagacccccacctgactcctatttatttacttatatttttaagatggggtttcccttgtagctctggctgtcctggaacttgctctgtagaccaggctggctcaaactcagagatctgcctgcctctgtctccccacttgtgtgccaccaccacctgggtggactctttttttttgagacaaggtttcactgtgtagcctgtagccctgataacctatatatatgagatatatatatgagagatagtatatatgttttgaatatatatgtttgaatatatatgttttattctttgggaatttcatatatatatatatatgtatatatatatatatatatatatatatatatatatatatatatatatacatacacacacacacatgcacaaacacacacatatatatgtgtgtgtgtcacaaactgtcacagtccagtttgtgctgcccatacagtcatgggtgtggacagtcatgggtgtggacagtcatggatgtggggccatccactggaacactgagaaaaggccacacccttagaagaagtgactctccctctcactgccattctctgtcagtagctcttcagccaggggtgggggcttgttgggagcacccccatggtgaaaagttgtgcatgtcttatgcaagcagctgtgactactgtgtttgtgggtgcagctgccatgccatgagcagaaga

SEQ ID NO: 19941 - DNA, 1177 bp, Mus musculus
gaaatcacctcacgtgcgggttgggcctctgccaataagtggtgtcatctcaaaggtggactgggcatccttgtcacgaggcctctgcctgacgctggtgccacctcaccctacaaggaggctcccccgaggtgccgattggacttagagaggtccccggcatccctgcccatcagggcccagcctttcaagtctctccccagaagtagtgtccatgctagtctgcttacccttgcgtattgggagatgtcactgcgagtactcttccccaggtatctcgctgcctttgctcccagggcctctgtctcccggagcctttgtggaatggaactctttcttccgtccttgtccctgctcattggtaccaatggctctgaggctgggcactttcccagaaaatgccccatgctgcacgacttctaatttgagctgcaactcagtcaggctgtaggagggactgggatgggggaggccctcggggaaagtgactggcttggcagggggatggcgtggcggcagaatctcctaggcctcctaggaaagaagggaggcagggctgctttgttgataagcagtccattggatcccggaaacttggactccagtagtgactttgccagggacgctcctcctgaccttgtgcgctttatattttgacgttctcttgtctgccacacggggtatttggagataagatgtggtgggactcttcaagttctaaagttctgaatcttccttgttgatattaagcgtctccttacattgcctcttgctctcccactacataaagtggtagtagagtaatcagagcagctgtcagtagtgtaaggagttagaggcgggccgcatgctgcataaggaatggcactggccgctgtgaagtttccttacagaagaaaacactggcagaccagggaatagtccagtggtagagcattaacttagcacacacaaaatcctggatttgatctaggatccagcactgcaagtaatgaataataaagcaatttggcctttcatccaaggtgggagcttatgccaacagatcagtcaaaagtgctgactagctttaaaaacaaacaaacttggggctggagaactggctcaccggttaaagacattggctgttaatccagattcaggccctggcactgcatagtggctcacaactggctgt

SEQ ID NO: 19942 - DNA, 1241 bp, Mus musculus
aacagcgtaacttgtattctgctttgactgtagagaattcagagtttacttgtagtagacaatactggtaagagacccgaacatagccagtgaggtcaaagagaagttttttcctctggcaaagtcttcaaaaccctagagcctcttcactatctaagcagctaaattcaggtttatgtccatagcctgttgacagatcagtagatctaacagttgttttgttgtgttgattttgtcaaagtattagaaaaacgtatagcaagattggttacctctgagaggtgaaaataggcaggaagcaagagagcaatcacacctttgggaagcctgaggtcctaggttccattagcaggaccaaggtaaaatgctcactcagtgtctctgtggagcttagtgggagggaaatcactcaacatgtgtggagccctgggttcagagccaggcatactaccaacaaacaacaaacaaaccagaaatgcacgtttaatgtcttgttgcttttgctataggaatatccaacccttacaaccttctttgaaggagaaataataagcaaaaaacaccctttcttaactcggaagtgggacgcagatgaagacgtggatcggaaacactgggtgagtaaggctgtgtgctctgccctggcagtagaagacatctggagatggcaggcctgaaccccgggccttgtccccaggaggagttactcagaacttattcctacacaagccatagttgctccaggtctagcaacccttttcttaacttatcaggtaataagaacaatccttcagttcctcacagttttgtgtggctgttagaacccaggcaatctcccctgttctgcccatcttttatctactgttcctttctagtcagctctgtatagtggaaccccatggagcaggtagcagttgcccctcgtgtctggatggtctgcagtagagctgtggttgatgaacccctgcaaaggcaaagtgtgttgcatctttctgttcatcccagtagactgagggtaggccttacctattccatccagaccctcctgagaaattcagattcctgtcctgagtgctccatgtgcagtttcctcattctcaacactgagtatgtcaaaataactcagttactgccctggggtcttttccctggtttatgttttggtctttacccaagtcttacatcttcacagtttcggtttttttgtcctgtcacaccagcctttgacttagattgtgggg

SEQ ID NO: 19943 - DNA, 1239 bp, Mus musculus
caaaaaaaaaaaaaaaagaaagaaagaaaagaaaaaaggaaagtcacatactcccttgtccaacaccattttgttttgtaagctatgtattctaggctggcgttgaatccctgtgtagctgaacataacactgtgctcttgatcctcctatctccagccttcccagtgctgggacttaccttgacagtcctcgcccatccgtatttttgttttgttgtgtttgagacagggtctcattatgtagttctggctggcctggaactatgtagacaaggtaggccttgaactcagagagatctctacttcctgaggtttgggattaaaggtgtgtgccaccatgcccagcgccactctatatttctttgctgaagtcccactagtccatttttactttatatgttctgatggggtactctagaactgtgcccattctcaccctttagaccttatccactggctgtgtttactgggcacacaatcaagtagctctttgtccatctagctgtcctctcatgagctcagacacccacctttccttgtatggatcactgagactcttctttctgttgtttttagggcaagtttctggctttttatcagtatgcaaaatcatttaattcagacgactttgattatgaagaactgaaaaatggggattatgtcttcatgaggtggaaggtaagattctgcccaggccatctcccgaaacacccatatgccagattctagagcacccacacacacttcttcttgcaggttatgccctccccacagggaccctccatgctggttgcttaatgccgtgtcttcatgacagggtacctacatacttgtaagcaccagtggtgtggtagctgcagagcacaccttagtaaactggttatgctgtttagtgggcagcaggcatatttatgccagtaggcaccgctgaccagtatcctcttttttcacccaagaatcctgtgagcctccaggctgagtcatccaagtgttctggggactcagggaaactgcttgaacctagtcatcactgcgtcctgttcctgccaggagcttaaatgtcatcagaatgactgctctccaaccacatcctctaccaagggcttctgcttcccacagctcaggaaatgaggagccaggagtggagcatgagcccttgactccctctagggtttcaatggattggtctttgcctgagagtcctatgcctctcgtggcaatatgctgtctacaaccaca

SEQ ID NO: 19944 - DNA, 3741 bp, Mus musculus
tctatctatctcatgcatgcacaaaataaaaagaaaacaaaaatttagcaaaattgaggtttgatgccacatatgtttaatcctagcactgaggtgtcagaagtagatggatcacagtgagtctgaggccagcctggtctacatggggaattccaggccagctacagctacatagtaggaccgtccctttatgtaactggaaatggtttagcacctcaatctgaatataattggcggggactctaggtagagttctccagttgcctttgttcaggattcctaagaaaactcttctattctgtctctcctctattacaggtatcagtccctcaacctgacccatgttcctgaacacagtgcacccatctatgagttccggtgacagaggttcagaacagtggccaaataaaactgaacttggcaacaaagagctttgcgaggaaattatgtacctgccagaaccaggagaggtgtgttcctgtttgttcacgagcagacttcatcagaaagcatgaatgttaacctacaggatccaaggagcatggccaacctgcaggcaggcagagggagctgttcacctcccaccctccttcctctcagtggcattgtggtcaccatctgtttctgaacaaccttaaatgcactttccttcctgcacagctaacttctgcatcactgaaatgccatctttcctcggcctgcctctagccaagtggaaggtcagctcctgggtcaccttagccttggtgctcagtggtctccacccaggccctactccttcctcagttgcttgtttggtagcccaaggaaagggagagcccagcatcttgtgccccagagctctatgtgagttgcctgggcccagcatataccaccaatgagatgagatggggtccctggtgggcctcattgacctttgattccagttgatgtcttgtagggccctgtgtgttaacaatgcaagactagcacatggctgtcgggttttctgggcctgctgttggggatcactaaatttaaggcttccagatccctggtaggagtagatcccaaactgctttctcagtacatttgctccaaacttctgaacttgagggcaatactaaataaaagagttttttattacaaaattattatttttatggtacctttaacaaggaccctatggcaaatgcacaattattccgaattacatttatcgttttcacattgaaaacagcaaatgttgacgtagtgacttttatatctatgtctatatgtatatttaatcaaccagcagttttgaaacaggtcatcctggtacagaagttttgcagcattgcttaaatcacagtgctaaacacaggaactgtttccgggccggctgagcatttgcgcctcctccttttgctactcaaaacatcagtgtgtcatgacaaccttttccaaaggcagagggggcccccattctccggaaaggatgactgaaatgttgtcatggcgtgggcaggaagaaatgcactcaaataactcgaggctcatgtgccaaagtgtgagagaggggagtggtttggtttggtttggtttggtttttctaaatgtttaaaaagcttaatagattggcatcagttgtagtccacaatattgtcaggactttggggaattctggtggtttacaggtccaaacacaaggggaaaagctttaaaataaatacagcatcagggctgggagtgcagctgaccaagcactagcttgtcacatatgaggaaggacctggcttccatttccagtgctggaaaaagggaacaccaaggggtagcaggttggctgctgttgtattgtgctgtgtgttactaatactgaatatctgggaaccttaagagagcagaagtggggaaagaaaccagcaggtacttggcaatatccatagccccaaaacttacccagtcagtaaagctggggctcagaaaccataacaatacatcatcccaagacttaggtagaagaaaagaatccacatccatcgctagggctgaatcagtggttccttacccttgagaagcagcctgggtacggcagtgcacctcgaggcccagctgctcagaagcctgagcccaggagaaagggtcagtctaaggtgaacctaaacttcatctgacatcaaaactcaactgaatatgagatggccggctctggtcagaagcacctggcttacaccacaggccaccatcgcttcacttaagctgaggggcagcactggagagtgaaggaggcagaaagactgactgctggcttttccctgcagcacctgctcctctggctttccaccatgctattgaaccattgtgtgctgggcaggtatcattcagcagtggatggagtcaccctgaagctagggctcgtgtgtagctctagtagcacgtcagtgaacagcctctcctctaaactgggcaggccaggtcggagcataggggttccccctacaccccccttttgttcctttgatctctttgtcttcagggtctcactttgtaactctagctggcctggagctcactttgtagatcaggctgaccttgaactcactgagatccacctgactactcagagcgagtactaggactaaaggtgtgagccaccacaccctgctttttttttttttttttttcttagctagggaagtgttccagctctacttagaaagatgagggaaggatgcctttagcagacagacttcagacctacctgaagacttgctgcttagaagtctgcccctgaacactgggcaggaataaacatgttccacttcttagtaactcctagctggtggacagtgacttcttttccttttctgtccctggaggacctctgggacttgtctccattggtagctctttaaccagctgctcagtggcttgcatgcctctggtcctgtgtgcaatatctttgcctggcacttgtatctaacattgaaaaataggtgcagactgcaaatgtcctactgttctctactccaacgagccaacccccaggcagggactagaggtctggctgctcttctcttaccctccactcagaaggctccactgctgtggccagctgtggccctctcgttccctgctttaccagtctacccacctatctcctttaagatggcctagcatgtcagctgcagtccaaaagtaagtagacaaagcctcatgttaagtagacagtcagggtggactggccctgttagcagtgttggagtcagattccagtggaacaaaggggtttctcaatgtcttttgctttcagaagcagggaattcatattccctttaaggccttgaatggattttttttcctcataaaatagtcactgataagctaatttttaaaaagaaatgccattacgtatgttacattgtggtttaaaattactaacaagttctgggaaagaaaatacttgattttgaatcttaaatgttttttaaaaattagatttgaatgggcgcaaagtacaaatattttgtttctttatggaagacctgtggaaagggtttgaagatttgcaatgggagaattattttgcagagctatcaatgtctaaataatttttgaaaaaaaaaaaccaataaaggtatttaagcagtgtgtgtccaatttgtaagtcaaaacattccactaggagaaatctgttcctttgtgactggagcaggaaccagcaggtcaagcctaggtttaatcaggtgaatggctgggccgtgtgctgcttcagca

SEQ ID NO: 19945 - DNA, 1574 bp, Mus musculus
gaggaggaagccccgctgtagctggtgctgcatgaccgaccgcggctgaggttcgaccccttcccggcccctctacgcctacccctttggtcccttgagccacgcatgggggcctggcactgaggaccctcgcttccctttcgggtccctttcgggtcccctgagagccatgccggaccgccgcggaggaccctagagttgagttggcgggggccatggcggccgccagcggctacaccgacctgcgggagaagctcaagtccatgacgtcccgggacaactacaaggcgggcagtcgggaggccgccgccgctgcggccgccgccgtggctgccgctgccgctgccgcggccgccgctgagccttacccggcgtccgggaccaccaagcggaaataccaggaggactcggaccccgagcgcagcgactacgaggagcatcagttgcagaaggaggaagaggcgcgcaaggtgaagagcggcatccggcagatccggctcttcagtcaggatgagtgctccaagatcgaggcccgcatcgatgaggtggtgtcccgcgccgagaagggcctgtacaacgagcacacggtggaccgggcccccctgcgcaacaagtacttcttcggcgagggctacacgtacggggcccagctgcagaagcgcgggccgggccaggagcgcctctacccgccgggcgacgtcgacgagatcccggactgggtgcatcagctggtgatccagaagctggtggagcaccgcgtcatccccgagggcttcgtcaacagcgcggtcatcaacgactaccagcccggcggctgcatcgtgtcccacgttgaccccatccacatcttcgagcgccccatcgtgtccgtgtctttcttcagcgactcggcactttgcttcggctgcaagttccagttcaagcccatccgggtgtcggaacctgtgctttctctgccggtgcgcagggggagcgtgactgtgctcaggtaacacacctgggaggaggggctggccctgcaccctgccgcctaaaagtgtccacccggttccggggaagccacagctggcgggagccggttcttattatggttctgactcgccttttttctttttgcgtgcaaaccataggaagcttgtgtctgaaactcatagcaggataagactaatgtggaattgtgtacctgcaggcaggtttgaagtggccatagtagcttatctgagaattcatctgaaagcatctttctgaagactagcataggagttcgagttctatgaatgtggtctccttgtcttgcattttgttttatcgttttgggggtggggatggggtgagggtctcaggtcgcccaggctagccttcaaccttctacacaaaggaggatgatcttgaatgtctgattctcctgtcttggcctcccaggtgctgagattacagatgtgcactggccagttttttttgttgttgttgttgttgttgttgttgttgttgtttttttttttttttttttttttttttggtggtgcctagagaatgaacacaaggcttcatgttttccttttggtttaaagcaa

SEQ ID NO: 19946 - DNA, 4893 bp, Mus musculus
gacagggactggcccctgtcacttagtgggcaggccccactgttatcagtgcatcttgattgagatctactgagtcaagcagcccaattcaaggatggggcttctgaagtcccctttagtgactgtaagactagaaccctccttctggcttctcaagtaacagcttgtccctcttgtttgcaggccccggatcctggaaatggacaaagaagaaaaccggcggtctgtgctcctgcccacacaccggcggagggggagttttagctctgagaactattggcgcaaatcctatgagtcctcggaagattgcccagaggcagccagcagccccacccgcaaggtgaagatgaggagacactgaggctctgtgccctcttgggactctggctaatcctgatgtagctaccccatcttctgttccgtttgagtgttttttttctttgttattttggtcctatatacgttttccttgctttgttgaccattaaggctaaagagcgaattggtaaaagacctgggttcttttgttcttggctttcctccttgatggaaaaagctgttggcttctgtagagaattgttcacaccagagtagccagtagagacaatggggacagctgtcttcaagtggaagtttattgaaacacacaaaatgttttggttatgaaattctagtttgggctttaaaatgtaaatctttgtagtgttttaaacaaaaactattcttttgccagccttttcttccactgatgctcatgcttggatgaggtctcttggagccatacaggtcctgcattgggtctgctgtgcccatacatctcacctgctgtccaggctctggaatctcatgcaaataccctgttccccactgttcaagtttgctgcgtatggggcttaaacagtgccatccccccgccatcccatttctgagtccccaggttttctgcatgccctctggcttgctctgcccaccaatcctggatggtcaaggaactagcacaatggttctgacctcttttgctaagagcatgcctgtttgctgggttgctcctgttaggcatatgtgtgtgattgtatggaactgttagacttgctgcagtgggtcatttgtaggaattgtttctagctagaggaactgattggcttccaatctagcatttgggttatgggaacttggggtgtgtggtagggcttcatttcttttgttctgaggtgtttctcctccctttagtctctttctcctcatttgaccatcttgggcctcttttcccatatcatctccctaagaagatgtgcctgctctgtccacatatagcatatatccaaggccagaagtcagacctgcatattggattaatactttctcagtcttggggccgggcctgggggctgggaaaggaacttctaaaaataatagaaaaaaaaatacaaaggtaaagtctttgagagtttctgcctatttagatcctggaaggtggggttcattaggattgactttggcagccaggccaggactgagcctgctgaaaacagaggccttctaagcagccatgccaccaccactctaagtacacaaaggtctggctctcgggcctcagtggctgcagaggtgtgggagcacccagtcatcaggaagtctctttggggtcagatcctttgccagtgtggagccctcaagttgagactgcataactaaagcagtcacagatcttctgtggtttggggtttttgttttgttttgttttcttgttttttactgctcttttccaaaaaatgatttgtagttgtgtgtgcagcactttgccctaatatgtgtgtgctctacaataaaaaccaaatctaatatattttgaaacagttgtctgatgctgtggtgagagaaagcctgactttggtttttcccttaatttattttcttgaccttccaactggatttggagaaagctaatttattgcccaccagtcctctgaagattggtcactgacaccccttgattgatggctaaaggtggacttgtgtttgcccactgccctctccccttcaaggagggtggccagggatacacctcatggaattctagaagatacagtctctccctggcttggtagagaagctgcaggccagtacaaacacaggtggagctggagcagggacagaggagctcaggtagaggacgtggccattcttgtactcagcagctaggctcttggcctccctgggtgtagaacattggtagataaagcaggtaggataggatgagattgggactcagtgggctcctccagtccactggggtccctaatgtggatcccagggtattgccaactgtcagcagctctccagctctgctccagtgatctgagccaatttgctcaaattgccactgtgaatcttggtcaagccatttcattgcccatagaatgactggccaacagtttgaaaagcagtggtaggtctagaagggtcagggcctctgtatgaactgtgcagtggactgggatgacactagaactgagaggaagcaccaaatgtcatcccagctgtgatgttgcagaagggcagatcccaatccatgcttgggtggctcttcctagggacaagggatggaagagattttgataccagtgatctaggcttcagtctgtcctgggatagtgcccccagtccttatgaagtaatagccttaagcaagtctctcagagtcccacacctgactctgaatctttcttgttctagccatggcactgggcctagagctttgtttggcccctgactcagtcttcatgtttataaagtagttttctaacagcaactggatgtaccagccctacccacctaagatctcattccattcctttaaccttgttgtgtgaagagtgttctgtaggccaggctcaggatgggaaacagacctgtatatgacatgcttacatgcatgtaaaggtgttctataatgtataggaaggcagtagagcccattaactgtaagtgtaaataacatgtacagtgtgcttgtaaatctctgtagttagttgttgcccacagaacattttaattggctttctgtttaagtgtggaattcattatctacctgtggttataattcacacaccatgtgagggagatgcattttaccagtttctcttagttttctatggctgccaaaacattaccacaaacttgagagcttaaagcaaaagaaatttgctaggtatggtggtgcgtgcctctaattccagcacaggctgaggcagaaggatcaaaagtttaaggcctgcctgggccttgtctcaaaaagcaaagcagccaggcatggtgcttgtctgtaatgccagcaggagtgtcgcaggtttgaggccagtttagtctacatagggagcttgaggacagcctaggctacattgtgagaccctgtctcaacaacaaagatatagactgttttgtgctctccttaagactttggtaggaagcctattcctgcctcttgcggcttggtatggctctaaccactctagttgcaagtactctagattcatagtcacatggcctctttttgtatgctacatttcagtgcctctctgcaccccaccgtgtgtgtgtgtgtgtgtgtgtgtgtgtgtgtgtgtgtgtgtgtgtgtgtgtgtgtgtatagaaaggatagaaagggtctcactctagctcaggccatccttgaaatagcaatcttgccactgcatccagccttttctgtctgtcttagttgggcatttgtctttggatatagggactcccatatactccacagctgcatagctccacttcctttttttttttttttttttttttttttttttttttttttttgacagtgctagggatggaacccagcgcctctccagtgttaagcaaggactctaccactgatccacaccctaactcccacctactccttataaaaataaagtatatgccttccagaaactagaacctgagaaccttgggggccgacatgcagcttacgatgctgctctttcttcagaaattgttactaaatctgtggcctattgattcctcaaagaaattgtattaatttcgattgaaatttcttagcctcagcactattttaaaatttaatctggatgatgataattactccattgcttgcttgtatttttttctgtagtgctggggattaggtgagggccttgtgcattctaggccttgtaaatgttacctatgccccagcagctcattgctttcttaagtttaaacctatgctgtccaatctggaaccactggactccggcttttgagcacttgaaatatggctagtttcaattgagatatgctttatacaccagaatttgaagttagtattaaaaagaatgtaaaatatataattgataactttatattgattacatgttgaaatactattttggacatactgagttaaataaaatacattatttaaattaatttcacctgtttgagttttttttttttttttttttttttttaacttgactgtggtctgtctggtgtgggctcatgcacatgcaggcaggtgcctgaggacccagaagagagaatagcaccccagggagctaggattaacagactaagctgtcccatgtggttgctggagatcattaaaactcttgtttctgtttggaatctggcttttcagttattgtttgtctgctgggaatcgcataggattggatagatagcttacctaacgtgtgttcaatcccagcaccatccacacagacaacgcagaccctaggtaacaataaatacactggtaatgcccgcactgggaaaacatgcagaagagcacgggttctgggtgaaaagaacagtaaatgcggtgaacaacaaaaagccttactttggaatatcagtaccttt

SEQ ID NO: 19947 - DNA, 1623 bp, Mus musculus
gggatgtcaccgtggaatatgtgaaggattttctggggtgaggccagctgctctcccaagccgccatccccagggcaactaggggtcttcttaccccagcccttctgattactgccctccccagctctcctgaggactctgagaagaacctgcggaacctggaggcagatgatgcttgtcgggcctacacccttctgattaaatgaggtgctgtggggcagcctggccttaccacacagcagctgccatccctcactccagctggaaccctgcaggcttctctaatggtgtcattcctcgaagcctagctgccttcctctggctgtcaggcataggggatccacagtcatgaaagggcctggcctggcagcactgaaatcctgtgcatttagaaggccacctctgaccctgtgggtgtaggagttgatgcttatccagtccacagagcccatttcacaggagagtcactgaggctgataggtcctgcctattgagccagcacatggaccttatgtgcccctaccgtatcttgctatggacccagcctagctggagactggagctctctggaccttagtagctagtgcctctgcagcctacattgggcatagataactaaccataccctcttctacttggtaccctcctagctccccagcaagcccatcttgggccatcactgaaaggggctgcctaccccgcaggcaggcatgacctgggtttgctccccttagtcgtcaccatctgtcggtcttgccttgccccttaacacggacccgctgactgatgctgggccctgaacacatcccagcctcaagctcagccggaggggtgcgagcatccttttgcactccatactgtacttcctttctcctcaagcagagtatttttctaacgcctggactgagctggccagtcatttctaaagcagttttggtacttgctcctggcctgtgtgtattgtgtgctcctgtgactagagactgctgggcgtcatgactgaagtcagtcagaggtgtgtgtgtgcgtgtgtgtgcacgtgtgtgtgcggcagtgaggatgggcttccctgtagatgccaccttcggcttttctgtctttttttaaaaactagttgttttaatattaaaagtactgattttttaatattgaaaataaaagcatttaatatcttttaaactacatctgcacacatgtggacacactggtggggcttggggctgtgtgctgcttgcaggctgtggctagctgaagcaggtacgaggagtcctcctcttcctcactggagtctgaggtcataggtactgcttaggctggggcttggcggaacgtgctccaggcgtggaagcagcgggtgaaggcgcgctgctcattacctttgcggaccaggcgcaggcgacgtggccgctcatgttctttagagcgtgtgtgctggatgtatacctggtaagaaaaacaatgggcctgggtagtcctctaaggcctgctggactgaccactgtgccccttcctcaacgtctatccaggatgagggagggacaagtggctcctgaaaccgtcaggctggcttcagtaatctcttacctggcaagccttcagactcagtttgatctccacttggct

SEQ ID NO: 19948 - DNA, 1631 bp, Mus musculus
ggctgctgctgcagctggtgagtggaatgcgctctcgcccaggagcaagggcacttctctgcttccccctctgcacactgggtaccagggtggggttgccctcgggctgtatgtccagtagccaacccagtggctcagatgattgcattccctgaagtagggagcgggtccaaggaccccttggctcgcaagatgcggctacggaggcgcaaggactcagcacaggatgtccaggccaagcaagtgctaaagggcatgtcagatgttgcccaggagaaaaacaaaaaccaagaggtaagtcaggtcagggctgggctggactctcagaaggaagaggggccctgagcagagaatggctaatgcaaaggccctgtggtgagggcaggaagaggccagtcttagtgtctcagtagagtcactgctcctctgtccccaggaaagcatagatgcccgggcaccagggggaaaggtacgacgctgggaccagggcctggagaagccacgccttgactactcggagttctttacggaggatgtgggccagctgcctggtttgaccatctggcaaattgagaactttgtgcctgttctggtggaagaagccttccatggcaagttctacgaggctgactgctacattgtgctcaaggtggggctggctcctagtgttctgcatggtgtgacgcagtgaggctgggggatgggagttgatgcagctgtggctgtgcatgtagcctggaaggccagcaaagccctcatggctgattacttggtctcctcagaccttcctggatgacagcggctccctgaactgggagatctactactggattggtggggaggccacacttgacaagaaagcctgttccgccattcatgcagtcaatctgcgcaactacctgggtgctgagtgccgtactgttcgagaggagatgggtgacgagagtgaggagttcctgcaggtgcagccagagatacacacagaagggaactcgggccacatgtacagaggtggggcagggggctaaggccaaaggtagtataacaagagacctcagacagcaaggtgaggtctggagagcctaaggtggtcagagctgagcgggagggagtggcaggttgctttaaaggagatagacaggttaaggaatgtagctgtgagatagggctgggaccaatagctgttagagtaattactggctcggggttataggcagagccaaacctaaaaataaaccacaaaaccagtcggcaaactgacttacctctgctaccagctgggctccctttagagagatagcaggcagctggagcgtttactttaggcctcccccccaccccccaggtttgcaagcttccataaacactgtccagactgtccttcatttgggacagttttgtgcagccctgtgctccagtatatacctcatcctgtttagaataactgtaggtttgcacacacgcttcagctgtataaactaccaagtctggcaggtacttggtggaggagggaacaactcaatgatgaaccatcctcacacacataggtgtttgacaatgacatctcctacattgaaggcggaacagccagtggcttctatactgtggaagatacacactatgttaccagg

SEQ ID NO: 19949 - DNA, 1207 bp, Mus musculus
ctttattttagccagagtggagggggagtgacatcacctaagcccacacgtgggcatgtgcctgggtgatggtgatcaagagtctcaaacccagagactctgggttgctgacatctgagtgtggctggcctcccctggctgaccgctttcagtgccagccacattaatggcccttagccgtctggggttcatttagggacttgggctcaggccaccatcaccagcaatgaactcacaaagaataagatgtggcttttgatttcctaggcttcacctaggccaagactgttttttttgtttttttgtttttttttttttttcaaaaaaaagaaaatgttcttgggtgggtaacagccccaggtctcctggaggcactccgagggggtcagctggaggacagctgcttagctgctgaaggacagtggcttcctgatggtggtgcatttgtttttctgattgggtcctcaggccttgaagctgaagttgactccctcgagggctccctgccttataccccagggaaggaaggtctcgttctcttctgcttggttttctctatgggccacgaattacctctgggagaacaacttcctcactggggggctgaactctgtgctgtctatgcaaggcaatcccatagaggctgctcctagacctcactgcagggtagaggatacgctcctctcagaggcctgtgtgcagacctgtcctctgcagcgtgccaaaatattcatgatagatgtgtgtcctcaccttgcaccctggtccaggtggcatggctggaggagggagactgtctcccctacaaggggggctttctattttaggtaccacccccttaaacacactgaaacaaagccatgccttgaagatgtgaataaaaggagaaagaactgtgtatatgtgtaattcttgctggcaggagatggtcttggttgtaggtcattgcttggagcttcacacgtcttgtggctggatgtgaggtttgagagtcctcttggaaatgtaaaataatattttcaagctgatgagatgactgtaccctcatctgcttccagctataaacagggccgagacctcctgccattcgcacttgggaaaacagttgttgggtctcagcctgagaggccatcatgtgtagcctcagtaacaactgaggcctcacctaccatacaccagccaattgagggacactgcccagtctttt

SEQ ID NO: 19950 - DNA, 1170 bp, Mus musculus
gtgtcaatcgaagagaaaggtttgaacattagagagcctcaaaggatgtttccagtgtcgaggagaaatttttgagagttgagtcgtgttctccaagtgtgggtctcagattttagcatcattctcttgtcaggctacttgttaaagacacagattttagttaggggtggtagtacgtgtctgtgatcctagctattaagaagctgatgctagaatttgaggctagcctggcctacatacaaagctcttgtctggaaaaaatatactatctcagcatggtgctctgaaccagctaacttcctggacaaggatcagctgcgcattatcttgtaccactcactggcttccttcggaagctagagttatggaagctggtgatcgcagcattgggaatgtagaggcaggagtgtcacgaattcaaggacagcctggactatatgaggctatgtctcaaaccaaaggaaaatatattatttatgtttttgtagttttttgagacaagattttgctatgtagccctggctggtctggaactcacatggatgaggctgacctggaccacagatctttacagagatctcacagcgatcttcctgtctctgcctttcacacaccttgtgctcctgttcgtttccttcttttggttgtttttggtttgttttgatttgatttaaaatactttctacataacaactccactacttgagatccacctggcagacccaggaaccctcccttgggcagtgtctccctcgtgacttgatgtctgtagctgaagagacagggccacacccgcctgaagatgaattaggagcttgtgttgttctctgactcacaagaagcttcatccttctgtctctgttgacaggagctagagaaactggcatctcggaaattgagaataaatgccaaagaaaccatgaggatcgcggaaaagctctatacacaagggtaaatataagagctcacagagcaatctgaaccactccctcccctgtcctccctgctaggagcgcagtccaaggcttgcacacagtaggcttgcacacagtagcacactaccattgtgctaaaccctactcttgactgctcagcaattctcccgcaggcagcacatttagggtttttgttgcctgtcggaatcctacgtctgtggtcagtgagtaccta

SEQ ID NO: 19951 - DNA, 3523 bp, Mus musculus
cctggtcccctggtggccatcatcatgacctccctgggattcctgttgcagctgctcgtgtgcatggaatgcttcttgtaatcttgaaaatgtgagaccttttaaaaaaaactttcctccctaaacaagagaggagttctggttggtactgctgcttttaaatttgctccaaaaagctgcagtaaattagacctggatcagcagcctggtgtatgcatcagttagatgctgtgtccctgccctcaggtctgtcagcaggtcacactactgaggtctcagaaggaacctgtggaagccaagtaaccaaagatggctggcagcatgtcactcttgggtcacattccttgcctaggactttgacacaaagttgcagcctgttggtcctggtcaagagggtatgggattttgcttctgagcctgtgacaaaaccagaaagatggcactgccttcactagtttgtgtctgttacatgcattacagacacctttgtggctgtagtttctcctcatgggctccctcatctgctattgcttcttagtgttctagatgctaccgttgactggttggctaagttccctttcctcaggtctccaaggatgaatgtgctagagtttaagagccaggtagggaggtgatcagttgctgggactactgcctaacatggtgaatactgtgtgcccctgtattgagaaaggcagcagccatgcctggccttctggatactgaaagtatacacacacacatcttggcattcagccacagagtggctcagaagacaaagtcaagactggtggggagtgggcagaacagttttgtgtggcagaaatggtgaacaggttcctctcttgaatggctccttactaagactgacaagggtttgaactccatttacagttttgggtttttttttttaaacaggatctcatataaccctgaactcttgacccttctgccttgacattgcaactgctagaattatagttgtttgccactagaaccagtgtctagatttagactttggttttaaaattttgttgtgttgatttaaaaggattaattaatgctgaaaccatgcttccccttagaggttaccaatccttggggctgagttcagatagaggcagttaattctctgttcctttgttttagaggactggaatcttctaaaagtagtacatgtgtacaccttgatgttgtagagacttatgcagcaggactcaagttttcagttggtcatggggcatagtggcacacacctttaatcccagtacttaagagaagaggcaggtagatgtctgcaaccttgaggccaccctgatctgcatgatgaacctcaggccagccaagactatgatactgtctcaaaaaagaagcttccatttgaagtgtttctcaagtacgaggctagtaaagatttttgttgttctgttgagacagtctcatatagcccaagccgacactgaactctgtgtgtagctaaggatggctttgaacttctgatcctcctgcctccacgtgctgaggttgcatgcctgccatgagttttacagatcaatccagggcttcatacacactaggcagacactaaaccacctgagctctatccctagcctggctaatttagtaaaataactattaaggctaccccacagatgacagagctcctcactactatcattttgagccctggcactaaaactggtaagctgttggtttaaactggactgccaagcagttgttactgcagtagctaaagttgctctgaaatttggaactggactgtggttgtgacctgtccatcctgatctggcctttgtttttagatcaggtacaatatttaaaatacaaatgatttcaactttatctaaattagttaccatttcataaccctggaaggccaggagacctcccttctcctttgccaagaatcaaagccagcagttgagctctgtggtcctggaggcatagcttctagaacatcttgtatgcatcttggccatccatctgctacgttaagtccatgccattcccccagcctgaatattgcatattggaccagtgtcctgtgccaccgccatggtttgtctgagatagttgggtggtgttagctctcctaatgatggatgatgtatcagacattcgaggcctttggaggaatcaaatcctcatggcagtgaggccatccaagctactttttacttccctagaaagctcttaagaaagtgccttggcttgaactttaaaactaagccagctttctggcttcactctaacactgttatcaaactggaatctttaagggaggcattgcagaaaggagagggaattgggtttcttttgctcagaaagcaaagcttcccttgagtttaacatactgtttctctaagtccttggcccactaagatctggttctgttaaagctttgggaaggaagaaagaggaacaaagatgtagcagtggaaaaagagcatctcacagggccctaactggggccagctgtctttaggtaggcaggaagcacagtggccccacagagatgaggggaccaatatcctaaccacaccacaagcaaactgacaccatggcaacagtaataacaatgggccagctcccagggagccctggccaaattctcttatgctggacagctggagctacaagctggacagagcacacagcagttgcagtacagacagtctgttaacttgttttctaagaagctattttattactgcatgttcccaccgtctgtaaatctgtcccagccgtgctgcagtcacagtactggaactagagcactgcggatgtgatcatgtcccacaggcattgtgcgcaaaagcttagaataaatgccaaataaataatatgaggagtgtactttttaagatattaatttatttgagttcagatatttttaaaatataaaaactggttgtattttttaaaaatataattcttgtagacattctgtgggtaaaaatttgattgtccatattaaaaagttactgatggtttgcaattcagcaatgtacaaataaagactctttcagaaggtggcatctgggttcctaattgtaggaaggagctgcttatctcaggcaggtggaatataaagcctttggcctctgctgattcttaaaccaggaggggattcatacccatggagacagccaattgtacaagacttttttgtctttgtgtcctaggcatgaacccagggcgtcacaaatacggaatatgtatattatctctaagtgacactccctagcccttctattacattaagttgctgactgtaattttttttctttaaaacaaaattctctgtgtatcaccattctgcctgatgtatgcctgtacttcatgtgtgcccggtgtcctcagaacccagaagagggcattgattctctggaactgaagttacaggtggttgtgattcaccatgcgactgagaatcaagccgaggtcctaagccaagtgcagagacgtcatcccagccctaacactaacttcttgcttatac

SEQ ID NO: 19952 - DNA, 2393 bp, Mus musculus
gcctgaaactcccagctggcctcaaatccacttgcctctgcctgcctagtgctgggattgattaaaatcatgtgataccacgcctgtcccagaggagcctcttaaaatcggcttcagaagggcctgagaatgtggctcagtggtagaacatttacctaggtcatttgttaacagaataggaaaaactgagtgctcttccacctgtgtgggcctctgtcatgtcatggtccaggcagtctgagctccagaagctgctggatgcttaaagaagccaagggatttgtagaccagagtggctttgttgtcctatccccagctctgaccaatggctgggtcttaggtactaaacacaggtatacatgcctttgtttacaccctctgctgtttataagagctcctgccctcttccaggttagatttggaacatgtctgctgacctctcttcatagcagcaggttctttccctgtgtggccaacctccagtactccattctgttcatctgtttccaggtggctctgataatcacttgatcctaatggatctgcgttctaagggtactgatggtggaagggctgagaaggtactagaagcctgttctatcgcctgcaacaagaatacctgcccaggtgagactcctccgtgcttttcccttccacagtcatcctgtctgcatttctgttagccactgttggagttgatgaaagtattcagcttaggagacagacagacagaccatggtaggggaagaacagaaaaggctattgagtggcactgctggtaagagaggcagaggctctttaaaaacaagtagcatttcttatatcaggccctgacagatgttaggacgctgaagaacccagggccacaccacaaaggactacttataggttaatacagtggcccatccacttctttatcctcaatccttagtttttaaggcagttgcctccttagtagatcaaactaggatccacagaccaggatctgtgaccaactgttcttttaaaatactgtgtgcatatggtggtgtattaggcacagctcagagctttgtctgtcttgaaggtgacaagagcgcgttacggcccagtggactgcgactggggactccagcattgacatcccgaggacttttggaagaagacttccaaaaagtagcacactttatccacaggggtaaggatgagatgttgcaagttcactatcttgcttaagtatgtatggagtttctgatgtgttttagtacctaagacccagccattggtcagagctgggggataggactacaaagccactctggtctacaaatccctcttttatgaggtttataaataatgtcactgccaagggacacatcccagaatcacctgaggggaccattgacacctatgagttatggcaggatatatgaaggatatgtgaaagaagtcccacatgacactgtcttttgcacagggatagagttgacactgcagattcagagccacatggccacgaaggccacactgaaagagttcaaagagaagctggcaggagatgagaagatccagagtgctgtggcaactctccgggaagaagtggagaactttgcttccaacttctcactacctggccttcctgacttctgacaggaacagcctgtgtttgccaagagggtaggattgttccgggaccctgtgaaccctgtgccctcttgaggctgagaagtggaccactgagctgtaccatgctttctttggtgggtgtttctgtttacctgttttcaaatattttgggaacaggttattaaggacttgaaatttgaaacgttatgtagccattagatctcctcgctcatgcatgtgaggcaaagctattaaagattccagaattgtcctttctgcttactcggtgggtcctgtagcaggtaagcaaatgttcacttcacccttgtgtttcccactcttccttttctgttgcccagataccagaggagcattgagttttctgtcttaagtttgaggttagaaactaggtaagtgtataagcaagaagttagtgttagggctgggatgacgtctctgcacttggcttaggacctcggcttgattctcagtcgcatggtgaatcacaaccacctgtaacttcagttccagagaatcaatgccctcttctgggttctgaggacaccgggcacacatgaagtacaggcatacatcaggcagaatggtgatacacagagaattttgttttaaagaaaaaaaattacagtcagcaacttaatgtaatagaagggctagggagtgtcacttagagataatatacatattccgtatttgtgacgccctgggttcatgcctaggacacaaagacaaaaaagtcttgtacaattggctgtctccatgggtatgaa

SEQ ID NO: 19953 - DNA, 1170 bp, Mus musculus
agggctagacagaaaaaccctgtctcaaaaaaccaaaaaaaaaaaaaaaaaaaaagatctatttatgtcaggcatggtagcacatacttttaatcctagaactctggaggcagatcccctggacacttgtgcattagttactggaaactgaacccgaaccaggctcgatccccaatcctatccaggtcttctggatcacaaaacactcctacaatcagcaatactgcccaaaagtcccaggtcccaaggtaaggaaccgcccagtcccctcctccttcccaccccctccagttcagagctctttttttttttttttttttccgtcaggctttgccctgctctgagcgcgggcgaatcgcgcgtgggcagctgggggcgggctctacctggatgctcccactgattgggccgctgtaggggcggggcgggaccaggctgcgctggggagagtttagtggagctccggcctctgcgcgccaagtttgggtttcccccggacgtggtgtgtcacgtggtggggaggctggttcccggagcacgtgctgggctgttaggacagcccgctgcggggttccggctggaggtgttgctgtggtcactttccgcgcgctctccaggaattcggcgatccacttgcctctgcctccctagtgctgggattaaaggcgtgcgccaccacaacgcgtttagtccctttcataaagaccggaggaacagacgtttacggccagctcccgaaaccaagtgaactggaggccaccctgcaccaagggttggaaccttttcacaaaatccacgctcctaatacaaggtatgtaatttctaatctttgcgattgtttctttttgttttgtttgaggtgtgagtgtcacacatgctgtcctcgaacttgatgtgtagccaaggatgaccttgaacttctaatggttctgcctccacctcaccagtaagagctatcgctctcggttcatgtggtgctgggatggaaccccttggtttatacatgttaacgaagcttccgaggtttgtctgtaatcactgcttttgatttactagtacaaccctgattatctgcagtgcgttactctatctaggggacaggttggcttgtagcgttcttagcccagtgcctctatttcaaggtctggaagttaggtgacctttggttag

SEQ ID NO: 19954 - DNA, 1577 bp, Mus musculus
agtttgggatgggggctggagagatggctcagtggttaagagcactgactgctcttccaaagtcctgagtttcaattcccagcaaccacatggtggctcacacccatctgtaatgggatttgatgccctcttctggtgtgtctgaaggcagctatagtgtacctatatacataaaataatctttaaaaagaagaaggagaagaagaagaagaagaagaagaagaagaaggagaagaagaagaagaagaagaagaagaagaagaagaagaagaagaagaagaagaagaagaagaagaagaagaagaaggagaagaagaagaaatagagaaatagtagaatagtttgggacggtaaacattgtcccctaaacttggaagttacacaaaaatcccagacccaagcacctggaacctcaacccggatgtctcctcctatgtatacttctgtgcaaaggagactgtgcatggggtggagtttgacttcatacctgacgtcaagggagcagtgctggtctgtgtgacatgtcctcaaacttctcatccaagccagtgggtgtttccaagtttggtgtgattttcgctggtgctcagaagaatgttggctctgccggggtgacagtggtgattgtctgggatgacctgctgggactctccctcagagagtgcccttcagtccatgactacaaagtacaggctgggaacaactctttgtataacacacctccgtgtttcagcatctgcgtcatgggcatggtcctggaatggatcaagaacaatggtggggcagcagccatggagaagctcagctgcatcaaatcccaaatgatttatgaaatcattgataattcttagggattttatgtatgtccagtggaacgccagaatagaagcaggatgaacataacatttctcattggcaacaccaaaggagatgaaacgatttcttgatcaggcagtagaactcaacatgatctccttgaagggcacaggtcagtgggaggcatccgtgcctctctgtataacgctgtcacaaccgaagacggtgagaagctggctgcctccatgaagaattttttggagatgcatcagctgtgaacatgaccagccacgctctgcctgtgagcagcacacagcatttagagtaacttgggattgactacagaaacttaacagacacggatttttttccaaatacatgcttattacagattcctttctcaaagaataatgactaaacattggggcccttcagagctgaggaaactcccagctaatggccaccttcattctcaagtgacctggtaacattttgaaagcttttctgttgctcttctaatgaattcagcctgtcggccatctttgctgcccccttctctaggtggattgaaggacttgcttggactttctcctgctggttccaactggttattattaggagcatagcacaaggaggttgagaggccctatgggctggatcgacagcagtgagtttgctgggttctgcagctgttggttaaagtcaacagcgactctcgagcgttttggatctgtatactgctattcccataaagagatagg

SEQ ID NO: 19955 - DNA, 1111 bp, Mus musculus
ttacgtcatcagctggcatgagaagcaaaggtcatggccagagtgtctgagtatgcaggtcacatgaatccttggtcccctcacttttagagtgaggcctcagtagctcttaagttgcctatcagtgtctccccaaaccagcctcaacggtttgatgttctctcctgggatgactgagtgtgctgttgcatggcttatcattttattcagtggagagggaagaatggtagctggacgtgacccttctcaaagtgccagccaacgggtgtcagggtagggggcagtatgcgtatggctgttcactaggaacatgctgggggctttgtaactttatgccaccagggactaggctgcagccctgggatagttattgctggcaatgactgattcccccctggcaatgtgatctactatgaacactaaagggtccttcctcctccctggcaggagggtagatggtatctgtggaagatgagaggtcacccatgatctgtatccacatttcacccacagttcttgagccatctaggacaaggtgtgggccatggtaaataagtcacccggtctggtcacatactcaccttctttctcccaaggaacttaaaagcctacaacactgaccttaggctattgcagcgatttttaagcacctatcatggtctagagagaagtacaaggcattggagagatggctcagtggttagagagtcctggctgctcttgtaggggatgcagattcaattcccagcactcacatggcagtttagaactgcctatgacttcagtcctagaaaatctgatgccctctcctggcctccacgggcatcagacatgtcacatggtaatagcaggcatgtacacagacagaacccatacatataaaacaggaaaaggggaaagtatccttatttgcaaatgattcttctacatgactagacttcaccagaaaaataaaacttgacattctcagcaaggggacgggataaagaccttgacaaagaaaactttagaacattcaagaaagacaccaaagacactcgaagatgggaagacctccattcttaggggctggaagaattaatattgtgaaaatagcaatcttgggatgggt

SEQ ID NO: 19956 - DNA, 1181 bp, Mus musculus
cctgcctcttcaccccattggcactgcccctggattactcccactacatctccctgcccgctggtgtgctgagcctggcctgctgtaccctctatgggatctcctggcagtttgacccttgctgcaagtaccaggtggagtatgatgcctataaactgtcccgcctgcctctgcacacgctcacctcctccacaccagtggtgctggttcggaaggacgacctgcacagaaagagactgcacaacacaatagccctggctgccctggtgtactgtgtaaagaaggtttatgagctctacgccgtatgactgcaggagagggggacgagaagcagaaccacgaggcccacaggactcagatcccgacagcagcactgggttttctctgtgaagcagcagcgcctgggaaagtgtttggtttaatacttgttatttttttaagcaaaaataacagatcatgggtgtgccaggggtttcttcagctcattacactaagatgtctatttccataacccaggagtggctcccaggctgtggaagtctgactgagcagtggagtatggataggagccaatgctactttctgaggggtgtgaacttgctgtgggggtgtcttaagtgtattgtttaactataccattcagaagccaaccggaagctattgaccattaaaattatgagaatttcaacttctgttctcttttctgcctgtacctgtagccgctgctgtgtgtgagatgggcaagtgctgcagacacaccctgctgtgcctccttgcagcagagtggctctagagctaacatcctgccagaaagaatgcataataggaatagctaccctggcttctggcctgctagtctagcccagtcatgttcccccttagccatgctgtttgttaccactggtgatgatgatgcactgtttaagatatagcaggataaggtggccttggtttccctgtggctcacctgggagcatcacacccagaagcccttctccaaagactgacagagagcacagaaatctctgctgttactatgtagccctgagttcatcccagtaccccaggctgtgggaggcgcctctgcccagggcaatgaatcttacaaggtttggttttgagaggactttcttgctgtactggaacttgctgtgtagaacaggcacaggcctggaactcag

SEQ ID NO: 19957 - DNA, 1864 bp, Mus musculus
atctggaccagaaagccatgcatcctggctgggaggtcttaagttcagaacccttgggcctcactcaccactgcagtcatgggcacagacccttatggtccccacactcagcatctccctacctcctgcacctctggctcttacccggttcttgatgctcctcttccagcctcctagagttctaggataacccagcatactcctcactactgcctccctcctctgccaccccattctgtctgacagggactcttcggggtccagagaaacccctgggcctctaggaagacattgctgactgctctgacagctgcggtggcagtgtgtccacaatacagtacttgaatgagggccctgagtcatgtggacccaagaagagtggctgggcttcctccgtgggcttgtctcaagttcctgcagggtggcctgagcattcctcactgccttggcagccttaaagtcccactgactgtgccccggaggcttcatagccttgcggtgtagcaataactatatctctgcctcttcctcctggccaatactgcccaactgggccactctggtgctatcccatctgcctccccctacccctcaacacctgttccacgtcctgagtcactccaagagcctggttaggcactggcactctagacatcatgttccttcaataggtctgtgcagtgctcagacctcaccctaggctttctcttccttgcccagtctacacaggcagtaactcatgtgcctttcctactctgaacctgccaccagtagtatctgggccaaggctggtcttgggacctgcatcccctcacttttctgacttttgaatacattgcatgatcctgttggtcactgacaaaagactaaggcacagtgaggtcaggggcccccagagcgaagaaatagggcaagataggttgtgtaggaagtggttctccctggtgcccagcctatttgttggtcctccaatgcctgcatagttggacagctccactgcggggagtctaggctccaaaggctgccagagcctgactgaggtctcctagcacaacagtgccaacaagcttcgggatcccagcccaggtctggggaactttgccatctgtatccctccatactacctgaacctcagagttttaccctagaggccacactcctcattgctgggcaacagctttacagggattcctagaagtcatggtgccatactagcctctgattcgtgagctgctctttgccctcaagttggtcattcagggttcctgacagaactgttggtaagcacaggagcagtgcaagtgttccaagatgggagcacgtggaatctgctcatgcagtcctccttacacgggacctaacccacaagggccagggtagctagtggaccgagtgcaaggcacagcagtcaggctctgtggtctcaccccctccttaattctcatgcaattcccaagagacaccacttactgggcctgtcctgcagttgaagggacagggtcagattaagtgggtcaccagcctgcaacccacacaactagacagcccaggatctaaacccagtccctgacccctcggtagtccccagcttgtgtattgtggtcagatgtctacttgggaaacaaatgacctcagtaatacatagataacatttctagaagtttccttactcctttgaagggctgaaatgaggatctgtcttgagttgcaaggtacacatggccagcattcagaagtctggcttatgaacaggagcactcccctggagcacctggccactcacctgttgttcctcagatcaggacttgggctggttcgagtcctcccacatgtccttttactagtctcagggtcctgcttccag

SEQ ID NO: 19958 - DNA, 1189 bp, Mus musculus
gccgtggccgtacaccctgtgtgctgcaggtccacggcttcatggcagcctttctcttctccattgagacacagaccaccattggctacgggctacgctgtgtgactgaagagtgcccggtggctgtcttcatggtggtggcgcagtccattgtgggctgcatcattgactccttcatgattggtgccatcatggccaagatggcacggcccaagaagcgcgcacagactctgcttttcagccataatgccgtggtggctctgcgtgacggcaagctctgcctcatgtggcgcgtgggcaacctgcgtaagagtcacatcgtggaggcccatgtgcgggcccagctcatcaagcccagggtcacagaggagggtgagtacatcccactggaccagattgacatcgatgtcggctttgacaagggcctagaccgtatcttcctggtatcacccatcaccatcttgcacgagattgatgaggccagcccactgtttggcattagccgtcaggaccttgagacagacgactttgagattgtggtcatcctggagggcatggtagaggccacagccatgaccacacaggctcgcagttcctacctggctaacgagatcctgtggggccaccgctttgagccagtgctcttcgaagagaagaaccagtacaagattgactattcacacttccacaagacctacgaggtgccatctacaccccgctgcagcgccaaggacctggtggagaacaagttcctcctgcccagcgccaactctttctgctatgagaacgagctggccttcctgagcagagatgaggaggacgaggtggctaccgaccgggatggccgcagccctcagcccgagcatgactttgacagactgcaggccagcagcgctgcccttgaacggccctacagacgggagtcggagatttgaatgcccttggcttagatgcagcaccaccctgaccacaataggtcccatgtcccttgggggcctgcgtttgagcagagcaggccgaaagcctcgggtcacagactcagtagcatcttagtctttttcatgttttttcgcagtagcttgggaaagttggcgggagcgtggatggccaaaatgactggctcacggcctcggaggctgatgtatacccatgggcaaggaggtgacttcttggggtagggttgctcagg

SEQ ID NO: 19959 - DNA, 2337 bp, Mus musculus
accctgccatcccacctgcctccttgaaaatgagcccgtcaaagctgtagagtgggcagagatgatgccagagggcagagtgcttgcagcagcagccctctggcatgaagggcagagggtatgtctcttctttctaaaattgtaagatagccccaggcccaggttgaggccacccacaggctacaaatacatctgtcctacagataacttagcatcaactgcatgtggaaacatcggctcagacgttccctttgttttctagaaataggtgtcgtcttacctctaccccatttgctctttttccacggtggtgagtttcctaaacgtgatagtagtgaagtgaatgattatcaagttatacggaattctagatgattctctcccctctgagagcgtgtcttgctcttttgatcagtgttgtttccttgccctgtgccctgccttccttctcaaacggctggtggccaggcagatatcagagtccctggtatcttgatctttgcagtagattccttggtggctccattgacccaatcctcccatgtttcttcttggtctttttgcctgcccagggaggtttagtgactgtgtgagatttgaagctgaggtccagttggagactgcattgcatagtgtcacccgcttgcctccattctgtgttcactatagtttcagttacagccagaataggaaggctccattaccagttctcctggcagggtcattcatgaagtttattgtaagatattttgcatgtatctctggacaagcctaggctgtccacttctgagcaactggaatctagggtcttggtgtttctcctcataccactgcctttccagtggtgcttacccaggagcctgttggcacccacccaggagttgcccatcagaacaggcaactatttcctaagagccaggctctgagccgtagacccatagcaggtaacacgtgcatcgtgtttgcataacaagtacggctgtgatttaaattacatataattatgtgtacagatactttttttttttttttttttactatttgaaaataagattttgttttttcacttacaggctataaaagagcagtacagggcccagcccagctccttagctagcgaattgcgatggaatgacatagctgtggcaaaactaagcggccgctgctcaatcggtgtgaaaatcactcgaggtcaggggcagcagaaactttgtcacgtggtaacagttgccctgttcttctctagtgtgtttctatttctgcatttaagtaaagaacagacttgaagcatgttttagaaaaatcctcttttgagtacagctgagcctagattctcagacatggaccatgtttgtgggactctactgtggagatgccccagggtcagcatgttgtatttgtgaacaagtccacatgaaaaacttcactgcagttgccacgggaaccagagctccaagcttcctgaaggtctgcctccttgacactccagtgaatggggcatccagaacaggggagatgagcaggtgtgctggccaggcctgcctcctctgtccccacagaacacgacccatttcttcctatatttggggcactaaggaggacagcagctgttttctgtcaatgtgactttaaccttttatatccgaaagcattctccttcaccatggttttaacattctaaacacttcactctgtacctgtagcaaggtctgccaactctatggctgccgcacatgcatctggccctccctctctgtcctggggtcctcagcgtgctgtctccactggacaggcatgtgtggatggctaaggaacagtttatttgagcaatgggcttggttctttcagttgcccctctggatagcaaggcaggaaaagggttcctcatcctagaaccacctagtatatgtgctcagatggtcacagaagtgcatctcaccacagggctgcattgcctacccctctcttccatacactgctggcgccagcttgacaggagactaaagtcctcttcaaatggcctcagtgagagagtagggcattgggatggattctgcagttcctctctttaccccagaagtcccctcaagctgggcactacctgagtgtcctacaccatgtgaacctgagtgctgttgtattcggctcagtgtgtatgcttttccttgtgtaaaatcattgttctttttgacaagtggtttgtttcatttattatagctttgaaataaaaaatcgtgagggaaaaaaaatccaatgattgtactgtggttaggagttttattaccaagacatttatgtcacttttctttcccttgtcattttgaggggctatttgac

SEQ ID NO: 19960 - DNA, 1465 bp, Mus musculus
ttccagctgacctctgttatcttgagagctgaggctaggtcctcccagctactgttaggcattgaggtactaaaactgcaggtgggtatgtccatctcatccattgtggcttgagaccggccttcaggagtccgctctccatttaaacatcctttcttattcatagcgcaccacccaaagtctgtgtgtttgtgacagtctgtggggactgtcccagtgcctttgtgatgacctaaactgcactgagtctcttgccaagaagcaatgctttttttgtgaaggccactcagagcatcttgcagtcacagctgttcctgagcctgaggccagaagattccctaacccaggactttgaagccaacctaggcaacatgatggggaccctccccattcttcataaaaatcccctcaagatcctcaagttgaatgttttgtagatcttcaaggataagccttctgcttattctcctagcacaatgcaaggaaattttactttttaaatcttagagagattcctacagatctataaagcatggagccattcctgtagtgaagggggggttattataccccagggcttcagaactcacaggacagggattgctggagaacactgcgagctgtggagcacacttaagggatgggatggtcagaggcgctcccgagcaagcggggcatcattctcccttagatcctagtgtggctaagcagggatgtggcagagagatctgtgtggatctggcttcctgctgctggggcctggctgggcccaaagctccaagcctcactgccttcctggggtcctaattaactcggcctactcaatgagaacgtaacatgcttattgaatgtatagccgtgtttgctgagtaacctgtcccaccgttgaggctatctgaagtgtattgtatgaaggaagtatcaagaacaaatcattggcccgttatagcaaatagttgcttaagtagcagttgtcatagactaatcataaaatattttgcacaaaatttcaatgttgaacttgcacttactgttgttatagtaaattataaatcacagcttctagctaggccaaaatacttactctactgatcttcaaaataaatgtatttcataaattattgtgtgttaattttgacctcagaaatggagatatgatgcaaagttcctttgtaaatccatttttcctttctatccctcaaggatgtcgtttgctaacattggttgtcatgcttttttatttgaaattttctcagacctcacattctgttctgtgagtatgtgatggtcattgtgccatgtgtcaccactgagcctagagctgtgtccaccagtcacaggcccgaaaacaaccgagaatttggatcagcgccatctgccatcctgaggctgtgtgaccagacaagctgggctttacagctctgctcacaccgtagcaccgctgtaaaggagagcaccacagagc

SEQ ID NO: 19961 - DNA, 1179 bp, Mus musculus
acaacttttttcttgaattaactttctcctagcaacaatcacaaataataaccaccaccatctgtacatatgaaagtaagaatcctttcaagctactcactaagaccccttttccccacagtgtgtcctgagagccatggagaaattatgatgacggatcttgaaaaaaaagacgagactcagttggaccagccgatgaaccagcaacaagctttgcctatccgtccaaaggacagcaataaactgtctgggaaacagttggccttacggagaggactcctgctcctaggggtagtcttagtcttggtgggtgggattttagtgagagtctatatcagaattgaataatgtgggaatgccatcaatccagcaacttgggtgctcctcagtctgtgaagttaatgctgaacaaatccaccccacattgaaacatcagggctggggatactgcagacagcaatatgttcagcatgttctgggccctctaacataagttctctctctctctctctctctctctctctgtatgtgtctctctttgggtgtgtgtttgagagagacagagagagggagacacccccccaagagatataaacagaaagacaaagagacatagatgagacagaggcagaggagatgctctggagtggacaatgcctgcaatatacttacctaccaaataccagtattcgaaacattgtaccaaccggaatgttgattttgcacccctgggattgcagggagtcacctggagactctagctcactgccactgtccccatgtttccaaaggatagtgtcacacattgtgaacccaggaaaagctccccgttcaaaaacagtctcttctgaatgcgtgtcacttttgcatcaatgttaaagttgagcccctggaaagtgaatcactgtttaagtctgggcccacgtgcagttttgaacatagagacaattcagagccagtcattatagttaacagaattcaactgtgcccatgggaattatgaactgagaattcaaaaattttgtttctctaataaataaggtaaacaccatatagtgcaatgtgggggagactatgggggagtattaattcatctgccactgtcaaacatgcactgctgtctactgtcttcattccgggctggaattcctatttcttctgcctattgttttctatgct

SEQ ID NO: 19962 - DNA, 1223 bp, Mus musculus
ccagctcttcccaggcaaaaactacgtgcaccagttacagctgatcatgatggtgttgggaactccgtcaccagctgtgattcaggctgtgggggctgaaagggtgcgagcctatatccagagcctgccaccaaggcaacctgtgccttgggagacagtatacccaggtgctgaccgccaggccctctccctgctgggacgcatgttgcgatttgaacccagtgcccgaatctcagctgctgctgcccttcgccaccccttcctggctaagtaccatgaccctgatgatgagcctgattgcgccccaccttttgactttgcttttgaccgtgaagcccttaccagggagcgcattaaggaggccattgtggctgagattgaggacttccatgcacgacgggagggcatccgccaacaaatccgcttccagccttctctgcagcctgtggctagtgagcctgtgtgtccagatgttgagatgcccagtccctgggctccaagtggagactgtgccatggagtcgcctcctccagcactgccaccatgctctgatcctgcacctgacaccgttgatctgactctgcagcctgccccgccggccagtgagcttgctccaccaaaaagagagggtgccatctccgacaataccaaagcagccctcaaagctgccctgctcaagtccctaaggagcaggctcagaggtggtgtgtgggcccagcagctgagtgggtagtggagtggtagacagggattctgggacagatctgtaagccattacctttcccttgtccaacttttctgcagatgggcccagtgcacccttggaggcgcctgagcctcgaaagcccgtgacagctcaggaacgccagcgagaacgagaagagaagcgcaggaggcgacaagagagagccaaggagcgggagaagcgacgacaagagagagaacgcaaggagaggggggctggtaccttggggggcccctctactgaccctctggctggactggtgctcagtgacaatgaccgaagcctgctagagcggtggactcgcatggctaggcctcctgcccctgcccctgccccagcgccagcaccagcgccagcaccgtcctctgcccagcccactagtactcctactggccccgtatctcagtctactggtcctctacagcctgcaggctctattccgggtcctgcctcccagcctgtttgcccaccccctggc

SEQ ID NO: 19963 - DNA, 1099 bp, Mus musculus
tgaaagagtggttgttacaatccagaccttcaggctgtgggtagggtggcctcactgtcctagtcgggcccctgtgtctcttcctaagtgctcagcactactgaggtctggaaaggaggtgttaccagtgttgctcaagattctgggatgctgtctagcccagaacttggacagtcacattgtgtgtgccccacccccagttatcttcagggtgtggacaaggtaaagctctggccccacttgacactgactgttgggaagtggttgtgcattttttattttcctttgactcaatgtgagtccaaggtgaacactcctaccagtgtggagctttaagctgactgagcgcaaccctgccctgtggctctgtgcttgtgcacgtttgcacagtttgttgagtacagtttcatatttgagtttgcaaaattatctaatagtctttttttggctaatatttttataacgtggttcttatttaactgtctagttttgatagaattgaccaagtctggctgaattaaggtcttggcatgtattattttagtggtctaatttctcttatttatggttttaactgtaagaaaactttaaaagaagagatatttggatgacaaaaatatgccttatggaaaactaagcaaattctttataggaaaaaaaaaaacggaatttgattacacaaaaaagaattttattaaaacaaaacaaaaacttccaacaataacaaaccccgcagcctctagttgcctttttcctttcttcaactcttttgatgaattatcagtcagttgactctgcagcatttttgccgagattggagaggctttttgctactagtatattggcatcttaaggttaaaaggaaaaacaacgcatgattgtgacttgccagtttttatcaactaatccctttttgtacctggaatgcagggattgccagggacttccatttactgcaggccagaaatgtggctggctgccccaccatcatgctcaggttaatgagattgtgtgaaaatgggggtgattctatacatgtgggctcagaggtcatcagggatggtcccctagctgagtcatggcagagactggcccagat

SEQ ID NO: 19964 - DNA, 1178 bp, Mus musculus
ccatcccctatcccccttactttgctaggttatgacatagaggtgaccaggatgtggctctactttggacaaacttaccaggccaggcatactagttgtatcacctgatgtggtgccacagggccctgatgatagatgttgccgtcatgagactagggagggtggggagccagaaagagacaaagagacagaaagagccagccccctctccctcctttaggttgggtactgagtgctgctagccaggaaaccaaaggcaggtaaagagggatgatgatgagtaatcatggtctgggccaatgccagagctattctgagagagtttgggagccctgagaactcttaaaacttgtgggcatgtgacaaaaggaccttggtgtagtggatccctggcttctctgggaagcggggatgttagtggagctttgggattggagcagctcaatttccaagttattcaggagttagcccagaaggcctgtgctgtggtgagaactaatattatgcttagtatgtggatatttgctttgactgtaaccaagtgaaaccattccttctctttgtcttaacagccaggctcccactcccagcagactaccttgttggatttaatggatgccctccccagctcaggccctgttacacagaaaactgagccctggagtgcaggagcctctgctaaccagaccaacccctggggtggaacagtggctccttcgaacattactgacccgtggccatcgtttggtaaatagattgcttttttttttcctgggcttgcctgtttgatggggagaggtgctttctttctcttagctggctcatttcttactgcctcatcccatgtgtcagaaacaacctgttcctgttgtaggcagcatgtcagttcttggaattgcacccagctcaagctcaagaagtcataatacatacacagagaaaaacctaaagacatgagctggacatgagatgtgcttaccactactaccactactagtgaagagaggacatatttgctgctattcttattacttaaaataataagtctagtgagttttatttctgagttttgcttattggtaaatgtgagagaattttttgtctgatttaaaacaggaacttggcagaattaatctattgtgggtgattttcctggcacatgaaatttcttaattgct

SEQ ID NO: 19965 - DNA, 1157 bp, Mus musculus
acctcagccacccctggtggccgtgttcctgtcaggattattctgctgcgtcctcccttcccagaagactggaagggtctgactagaaagagacaggagtgtgagaataggccctggtgctgcctccactgtaggattggatcggacctggctcttccctagaccctggccgttctgtctgtgaaatgggtacaggcgttgaagtctgggaagggtcccctgggtcctgccccctgctgtctagatcctagattcacctggacagggaacagtggggtcccatcatactctcttggttgtgtgatgctgagcttatgctccctgtactgctggccaatcttagctcccctctgaggcagcccctgtctgccctctcccaaccctcccccaaccttaggctgggaggagcctcccctgggctccagctgcataccagaggcctgtagcatcacgcctgggagggatgagagcaagtgtggcctccagagggtgaggctgggtggggttgggcctcagtcagaggatcttccagcagatcctcgtgcccaccctgacaaggactaacccctgacaagtcccaggggcatcatgtatcataccttcccaagttactattggaggacacagaggaagctgaggtgtcaggtgctggccctgaactaggtctacatttatgtcttccagccagggcttacaaatggagacccagagaagttatgtttcttgcccagggccacacagcaagaagaaagaggagccaagtttcatgatgcccgattgaccccacatctttcttgtcagatccctgccttcacactctggagtccgggcctaccacttggctcctggagaataaaggcagcttaatgaggcatttattaaataccaactatatgccaagcgctgaacaggcactttacctgctctgtgtaatccttgctacagctccataaagtaggtgtggcctccattgtccgcagaaggaatccaaggtttggtggggctcggagagggtgagcaacttgcccaaagcctcggaaccgagaactagaggatctgggctgcaggctctaactgcatcccatagtggacccactaggtctcgctccctgcttgcttcgctcaggcagtgaaagcatgctcacaggcttctggac

SEQ ID NO: 19966 - DNA, 1189 bp, Mus musculus
tcccatgaggacgctttgccctaagtgaagtttggaggcacaaggggcctagaagaagctactgtgggtgttggaaactgtgggctggtatcagtacctggcaaggctgaagactacagcctcttgaggaacagctaccaaattgtcctttcatagactctatagacatagcaggatgctccagccagcttatacaggctccactggactgtgagcagagctctagggtgcataatagcaggtgcttcagcaagggcatcagaaaggacaggttttgataacttatccaccaccccatttcatagatgtggaaagtgaggggcctaagatgggaggtggctagtaccaggccttgaacactgcaggagtttcagggccacagctcctgtctcccaggtagatgaaattccctgagaattgtgaaatcacaacactccttgttgagctctcagggtcacagatgaaccaggccatccaaacggaattaattagttggttgtgaggcatggtgcttctgggtcctctcttgtgctgattgcagcatttgtgaggatataggggtaatggcactgatgttaggaattgtgaaccgtagacatcccaggccggggagagtctgtttcagcctctgtcaactgactgcctctacattcctgtctacaaagccaatataacctaaggtctcaggagctctcaaggaacctttgtgacctgaccatggataggccgagatgtgaggtgctgggcaatggtgggaaatctcccagcattaccgcacataccaaagcactgtgcacaccaccatttccaatgtcatctcagactctaggagcaccaggcggctctcctctccaatattagctgatagctgtttagtctttctttcaccatcctagggacagcatccaacgccagagtcagccatgggaccctgtcagggatccaccttggggcatgggccctaacaagtccaccttggcagcctgtgacttctgggccaggtccctgtcctgctggggcacatctcaatctgccatggtgcccacagcttggaaccagccgtgacggatctggggtgcaatgggctggagagcctccagggatccgtgtgccagccaggtcaggcttctttccagcacagtgcatgaagctgtttgcctgcctaggagtggcctaaccaaggggatgt

SEQ ID NO: 19967 - DNA, 1210 bp, Mus musculus
acacctagcctccatgtgcacctacattcattcacattgcacatacaggggtgtgtgtgtgtgtatgttatttaaaatgtgtgtgtgtgtagtttaaaatgaaaacactttgtagctgaaataaacactcaacaaagacttggcccttcagactggtatagctctaagtgatagccaccaaaactcagcctgatacccagatttttctttttcttcttttggcaaagagcagcctttgttccttctacttaactgctagtttggtgagtgtttagtctaagtactatttatgattccatggtagatgagaaaataagattaacatgtagaaacccttggagttgcatctaaaacatgctgggctcaggtgtctttcagtggtagagtgcatgcttagcacacatggggctctaggttttacctcagcaccagtaaatcaaatatgaactagtttttttgtggtcttttttgttatttaacttgggtccttttggacccatgattcaactcctctaccaccaagagccctactgggcatcaccactcttccataccttcctaatttctccactctctgaggattagccactgtaccaccccactcacctgctatgagtttgggcgtttggtcacgtgttgaacaaggtgtgcacagcttgtctgatcagcaaggctgtttctgaacagcacaaaaatagagtgcagggttgttcttggcctcagggtgctttgcagaactttgggacatgttaattcttagaggctagaaacgggaagagttatgtaagtctatcacatgcacgtgataggaaattatgactttggaaaagcctagctgagaatcgaactactccatgaagtggtggactttatgaatctctcttattgataataataaccagtataattgatcacttaggatgtgctaagcactgtctctgattcttatgacttaaaaggtgagtactcgtttcttttttatgttaataagtgacactgaagctggaagaacagaggactgtaggatcacacagccagggacaagccagtagcttaagttttcttaaccctttgacatctgctatactactcagtagtgagtcctggcatccattatagcagtatggaaacactggcagacacttggcttatttatcaccttttggtacaacaataagctacgccatatgcaaagactgtgtatgaggaa

SEQ ID NO: 19968 - DNA, 1141 bp, Mus musculus
attaatcacctctgtccttggggaaagtcttgaatgaacagaaaatttatttcattgcaatattgattgtacagaggcacactgttcaacagaagaagcaaaaaggctgtgtataagtttttggtactatgtaccatctctgttattctgaagtattcatgtacttaaaccatattctatttaattgtgtttgattttaaatatatatatatatgaattatatttaaaatggtgtcaacttcctgctttcagggcatttctggctctcctgttgaagtatattgacccttcctaatatttccacttgttttacaaaactccagaacataatccccaattggacatagccttgtgtttgggtgtagacatagacatgaggttttaattagtgtatgtgctgttgtggctcttctgttcctttaacaaagcatttctctccatttcatatcgcttcaaactttaagtgaaaagcaacataaagacatagagtcaaacgtgattctgagtgtcctctgcctttgcatgcttcagggtaaaaaatctgtaatgctctcggctgtttaaactagtgggtttgttaaaatactttctagtgatttctttgtgcattttgtgcttctgaggtcaagatgtcagtatttgtaagctatgtctaaggggaaagagtaaacctgagattggttttgttttctgctctgcctgctctgagatacaggagcagaagaatccaaatcaataagaccaattgtatgttagatccttgtacttacttaaaattagcacaagattcacctaacattgatcacctacctacccacgtgctacaggctctgtgcaatgtatccacaaaatgattccctgacagggtttttaagtctaaggaagcagttggacttcattcttattattccattgttgtcagctagcagattgttaacagtcaacctactaaggagaaaatgacagcattgtaattggcttgtcttcatcattcctacctgaaaagcaggtgtcagccacatccagtgaagtgcactgaaaggcaacagacttctctagtttgattccagtacctgttggggcttttttgagatgtaaattgtttagagtactagagcttttgttttcagctgtttgagac

SEQ ID NO: 19969 - DNA, 1134 bp, Mus musculus
tccttgtaatttttaaaatatttctttttagtttcatgtctgtgtttgggttgtatacctgggtgaagatgccgatcgaggctggaggtgttctatctccctggagcttgagctacagggagttgtgagccacctgacgtgggttctgcgaaccaaactcaggtctgagccatctcttcagcccacatgccttattatttatcttagggaagtcaattcagaattaaaatcagtatgtggtaaagactaccaacctgtcactatgtaatgtccatgaaaagtgtgggcgggcaacaacacttgattttagtggcagcgaaaactgtacaaaaggctagaagtgtaacagagagaagtagaagtgatggtgatgttgctattagtgataggcttgtaggtaaagctattcaaagaaattttactagatgtatttgattttcgtctttaaaatgttgttcctctttcaggtctttttgcctggttttctgtccagcaatctttattacaaatatttgaatgatctcatccattcagttcgaggagatgaatttcttggagggaatgtttccctggctgctcacggctctgtctgccttcctgaggagtctcactcaggtggttccgatggctccactgctcaggtattagccaatgtcactctatcaatgggatgggaggcatagagagcctctcctccaaatgccagcagtagatcccattcgtatgttttaagtagtagatagaagaaaataaaatcagcttatttgtaaactctagtcagactgtaaatagtaattaggcttctactatattgtaaagtattatgttctgtcataaaagctgttcatctgttggacaacatgcctttttgttttagtgacaaagtatgtgtgtgtacatgctcaaaagtgcagaggacaggtcagccttggatgttactcctcagacattattcaccttggtttttgacatagggtctctcactggccctgacttaacattaggttaggttggctgaccagcaaggcctaggaatctgccagcctctacctccccagttgacactcttgcatggcttttggattgacctgactgtgttgacagtgacgtatacggagaagctgggtcagatgg

SEQ ID NO: 19970 - DNA, 1214 bp, Mus musculus
tgacacttaataagattgcacacaaacacacacaaagataactcagtagtactcaaggagatacaaagcaaaatagcaagttagaatattaaaatatattcagcgtttgctaatttgaacatcaagttgggcagagggaaatggccagtcctcgttgtaaatggtgtgaatgagtgaagcctgttgtggacagcagtcagtttagaagttctgtctgattctatgttagaaatgctggtagactgtgtgtagatagaacattattaccaaatgtctgactcatttccttctgttgtttaggcagatcctgtctggactatcagactcaagagaccaaatccagtctttcaaagacccttgaacaagtcttgcgtgacactgttgtccttccatatttccttcagtttatggaacttcggagaatggagcacctggtgaaattttggttagaggctgaaagttttcactctacaacgtggtcccgaataagagcacacagtctaaacacagtgaaacagagttcactggctgagcctgtctctccatctaaaagacatgagactccagcatcttctgtaactgaggctcttgacaggaggttgggggattctagctcagccccactgcttgtgactcaatcagaaggaactgacctgagtagtagaactcagaaccctcagaaccacttgctgctttcccaggaaggccacagtgcccgttctctccatcgtgaggtggccagaacaggaagtcatcagattcccaccgactcccaggactcctcctccagacttgcagtaggcagtagaaacagttgctcttctccactgagagaactgtcagaaaaactaatgaaaagtaagtgatgtctcccaacgctgtcaggaccgtaggtggtccccctggtttacacatctaggaggatttgagggttgagtgagtcagggtgtgaaaagggagcaggaaggagagcttgggtgtcgttgttgcagtgtgtaaccagctgaccagagcggcagggcagtcagtgtgctgcttttttgtacgtttggaagggaagctgttgaccaaggggagtctccaggtctcggtcctcggaactgtctaactgcacctcgtaggttaatttgtttttcattttatttttttagattgccattagatatcatttattgagttctgtactaagtatatatttggatttcatttgtcat

SEQ ID NO: 19971 - DNA, 1135 bp, Mus musculus
tctggggctcaccaattagttttgctacctacccaaatcagtgagctgtaagtgagagacactgtcttaaaaataagatgtgtggtgtcaggagggaactgagtccccagggttttcctctgacctccacatccatgccatgacacacatatgagtaaataaacacacacacacacacacacacacacacacacacacacacacacacacacacacacagtgtaaatggaaaagaaatgtatccaagttgaagttctagagcaaaataatatgtacagaattgttgttttctacaaagttgtcttttcacacaagcctaccgtgtgggtctaggtcatttggatccaggatccttacgggttcttaagccatagtggcaggtcattgtcccactggagctctaattctggaagactgtgttgacatcactgtgaactcaccctcgagaaatgacatctgaaccaccattctgtcagggatgtgtgaagacgaaggtggacacatgcaggctgaaccttaagatgctatgctaagtgaagtcagccagtcacagaaggacacatactgtatagcagacaggatgagtagaaggtagaacgagcatcgattcagaagaatgcataaaaatgtattacatatggagcaacgagtcaggatagttattacagcagcacttagaacagaaaggcctggcagcaacaggagcagctctgagcattcttagtgagccgtcttgtgctgtcacaggagaatgaagtgcactctggggagggaagagcgaaggtcagttgtttgtcaggtgatgggtactgttctgagcgtgttatctgttgcaggtacatttactcttgattacagtcctgtgttttacatactgtaatccttttatgttactatggtaaaatgcctgataagaagcaacttaaaggagaaagggttggcttgggctcacagtttgagaagatacagtcagtccattgtgatgtccacagccacaggcagctcacagtggtgggaatatgtagctagggtcccttacctcctcacacctctatggagtgagaattcagaggaatgggcatgccgctgcctagctgacactctctctctctctctctctctctctctctctctc

SEQ ID NO: 19972 - DNA, 3011 bp, Mus musculus
ctaaaagttctgggtatttgccacattctaagagctgtatttatgatttccactggaaagtcactagcatggctaagcttctctgattacagcttaatgttcagtagttccctacttgaattctccaaggagacatgtgctatgacatcacagacttatcacccctacccaaggcatcagcagaccgttttactaaagcagcatcctgtcttgttccatcctgtaaagactgcattgaatgctaacgacagtgaaaacctcatttttcttttgtcaggttctactcagttcccttacaaccctctgaccatacggatgctcagcagtacaccacctacacagatcgcatgcgccccatctgccatcacccaagcagctccacatcaacagaaccgcatctgggagagggagcctgccccgctcctctcagcgcagtatgagacactgtctgatagtgacgactgagctgtgcgtgggagagcgctctggctttggtttttattgaagatttaaaaaaaaaaaaagaaaattattctgccctcccatgatttgtgcccagagacttctcaggagagccagggccatggatgaggaagaaatgatggaaattcatttggaaaatcaaatgggaaaaaacaaacaaaaaaactgcctctaatacaggcacttcaatggattataacagtggcgggttgaagtgtagagtttttttaaagtggacaattcttgttcttacatctgtttgtaaagaaaaccatgatgtctttaaatcaatcttctgtaaatagatgacttttttgcagtgtatccccttgctgtagtatctggtgtacttaaatttaaatcagcgaatcaactggggagaatttttaaaattctttgtgtatctttttaaccccagcctctaaacctcacacagcccagttccacagtgctggctgtcatgggcattgtacttttgtttcctctaaattcagctttcccagtgatgtttaaatcttgtggaaatatttaggtttttaacacataccctgtcataaagcctgtatgaggtcagaagacaggagcaacacaactgtcatattgtgagttccagtgcaggcttggctttcattggtagcactgaaaaaaattactgcatgggtatgttatagttcagttttaaagtttaaaggcttttttgaggcatacctcaatgtttatgcacactggtaatttaaccacgccccctaagtattctgcatttgatgcagcccaacaaagcttctttctgttctgaaataaattttgactatcctgtccatagctacagtacatcatttgtgacgtaaagagtcttcgtttctcaggtttcaaacaattagtatacatgcttttctttagatacagaattggcggagttaaaaagagaacactgtatagaactttctgtcttccaggcttgtttttatgctgcatcgtgaactgaccgttgagcacagtcctctgcatcagtgcccattctctgctcctagggaacagattcttaaggtgcaagtaatttaaagactgaattttaaactaattatggcactgtaggatcacctttattcattaagaattgcttgctgtgattcagatttgttctcctatggcttccttccactgcataaagatgcttagtagtgtgtgtgtgtgtgtgtggggggggggggtaatgccactaagaactagaagggagagggagggcttcaggaggtctgagtctctagaaccactgcccaagcacctcttagcatctatctacaccacaggtttctgatcacttttttatagatgaaggtgcaggctaggcatttgtccatataactcagcaagtaagaaagacagacatttgagatcttaaactttagctatgcatcatagcacacacctttaatcccagcactcaggaggcagaggcaggcggatcactaagagtacaaggctagtctggattacaagatgagttctggaccagccagaacaggattcttatcacttgtaaagtcattacctttacaatagtcacaaacataatgaagactaagtgttctgattagatttactgctgaaagtgtccccctgccaagttatagtcacataagtctagatcttattagtaagtcactttgtcaactagcccaaaaaatgatgatgatgatgattggccctgtcttactgtgtcagtcaatcgagcttggtcacctactcttgtagctcctcctgcagactgcttgtgctatctgtgttcacgacaacacaacatgaagtccagaatcgtttcttacttcagaacagaacagaaccccacagtttacctagagaggtggaggccggcttaccgacgcgggcagcagcaagtactgagtctgcgacctcagctgcaaatcaaggcgggccagcactatatctgtaacacatgcacatgcaactaaatcaaggtcttccagcagaggtaatattctgacaattttccagtctacttagtgagaaattttatactacactttaaattttcatatgctgtgattgtcttacaaacacttaagccctgaaaaccctagtaacatggtctagtttaaaactttaatatgaaattaaatgtaaattgtttaaagttgtaatcagtaaaaggagatgagtccctttgtctcactgccttttttataatagtgcaaacgaatgctgctgggaacatacacagactgtgtccccagccacaggacatgaggtcagtcaccatggaacattaaaaagcctaacagctaacttgggtaactctggaattgtgaaaaagtaaaaaacattttcaaagcaaaggtaactgaactcttacctggttattcatggttagcgggaagatcacatgtggttaggaagtgaatggtaaatgaactcaaacagaatgtggggctctccccacacaacacagactctgcggtagctcttagctctgaggacttggaccttagtatgtctgtctagtaact

SEQ ID NO: 19973 - DNA, 1142 bp, Mus musculus
acttaaaccctacatccatgaatctgaaagatgatggttaatttttttcattgctcttagtgaaattattttatttatcatctaaaatatttacataatgaggctaggcaaatggcctaccactaatccatactcagggagccctgtagttttagaatagaatgtgcatcatgagccatatgaaaatggctgataattggggaaaagaggtaggaagatatgtgtgcttatttttacatttaaaaaatacatatgtatggttggagtgtacgtaaactaaaggttatgccaaaaaggacaagacctgaagataaattaggccttttctcatgcatgtgggtgttgatggataggtgattgaaggttcacaactactactattttaagaatggtagaattgattggggtaggaaataccatcatttataagattataagttaaatgcagatgttaagtcagaggtggcctcagaccgagtacaacctaaaatgttgcattttctaccccagcaggcctggaaaatctccagagaggagtcatatcccatcagagccctatgagcccatctccccaccccaaggccctgctgtgcatgagaagcaggacagcatgttgctcttgtcacagaggggagtggaccctgctgagcaaaggtaagcaggatgcacacatgtctttgccccaactccttttaggtgcagactgtgcctgaggctttgcctaaatcactgcctctcttctctttttggctcttataaaggataagactcggggaagactaggagtactttttcccctgcacacagagcacagtgccttccttgtatattttctttttaccacgttgacctgaattacagagcagtcctcatttgtccccagagttagctgagacacaatgtgcagaacacagttgctagcgtggcatttgcattccttcagggccaggcttacaaagcttcatttcctgctgtctctcccttacgttatattctctgttgtcttttctctcagttcattttcttcaaaagaacagttttcttggtatttaatacactagagacaggatttgatggtggccaaaccttgtacagagaggaaagtccagttttaagccaggtctgactctgctggtgaattt

SEQ ID NO: 19974 - DNA, 1190 bp, Mus musculus
aataaggctgctatgaacatagtggagcatgtgtctttcttactagttggaacatcttctggatatatgcccaggagaggtattgcggtatcctcctgtagtactatgtccaattttctgaggaaccgccagactgatttccagagtggttgtaccatcagcttttcttgtacacacagtttgaggtgactaatttgggagtgtgtgtattggagggttcatgggctcagattgatgtccccacagcagagtataattgccatgaggcagacaaaacaccttagaaggaacagtatctatacgacgttgctaccatgtattgtttgtttcctcttagggcacaccaataaaatttgacaacaactcaggtcaatcagctatcaaacacaatgtgaagtccttaatcacagggcctagcaaactaccccgtggaatgctggaaattgtaccagagaacataaaagtagtagaacggggaaaatatgaggatgtgaaagcaggcgagccagtgcgagcccggcacacgtcagtggtgagctctggcccctccgttctcaggtctacacttcacgaagctcccaaagcacagctgagcccgggactctatgatgacagcagcgctcgcaggactcctgtgagctaccagaacaccatatccagaggctcccccatgatgaacagaacttctgatggtatggcttttgttaccaactctgattactttgtaacagtttttacctccaacaaatacaaaatagcaaattattagctctagatgtctcaagatgcacagggtgtatggatgaactagggaagcaacccagttagtgaagggcagtctccagaagccatgtgtctaagttggctcgggctgagcatggtgatgtctgcatgtgatcccagcacgggggaggggaagtgggtgagttctctggggctcagtatgtacattttgagatcttaccagttagaccagtgttttcaaccatgggctatgactccaccgtggaatacaaatcatttaccctgaatagcagatgtttacattataattcacaatatggtagtaaaatcacaactataaagtaggcaccacaatgtgaggaactgtattaaagggtaacagcattaggaagggtgagaagcctgaggctgtgtggtgaagagttgaatggttaggaggagtgcac

SEQ ID NO: 19975 - DNA, 1224 bp, Mus musculus
acctttagagcatgttggcttggccagaagctgctcttacttccctgatgtcaccacaggagtcaagttcatcgtaacaagtgctttcaagcatggtttctgtcagcacctgaaacctgttcattatcagatttttatgctgtatcattatctttaaggtgctgaaaatagttctgatacagaaagtgctccctctccttcaccagttgaagctgccaagtccagtgaagacagcagtgaaaatgctgcttctcgaggaaacaccgagcctgtggctgagcttgaggccaccactgaccctgcaccctgtgcatctccctcttcagcagttccaaccacaaaaccagcagaaagggaaagcgtggaggcccaggtgaccgacagcgccagtgctgagaccgcagagccgatggacgtagaccatgaggagtgcggtgccgagggcagttctgttcttgatccaccagcccctaccaaagccgactccgtggacccagaaatgcaggtaccagaaaatactgcgtctaaaggtgaaggggatgccaaggaaagagacttggagagcaccagtgagaagacagaggctagagatgaagacgtggtagtggctgaacagatcgagaggcctgagccacagtcagacgacgactccagtgccacttgcagtgcggatgagggtgtggatggagagccagagaggcagaggtgagactgaccttgtttcttctctactgttctctggctctgtcagaacagttctgtccacagaggtgcctgtaagagactggcaagctcctagcagtccatggttttaatattgagcaattgtgtggctttggtgtttgttgtttttaaatgacacaaatgataaatatcttctatatctgtattgttacatatagtctgtgatagggagggggcaggctgatattcagccaacagagttaggaataacaccacaaacaaattgtggatcctaacatttggcagcagtggtggatggtgaagaggtagaaatgaagagccttggctttaactctgggtttgtctaagttggttggacttccaaagatagtttgtctagcccactgttatatattaaagagaatgctccaaggataaatgttggtgttaaaatgttttgaaaatgttattatttggggagtttgggggacaggcatttgttatgagatcagattgggcttgaacttgataattagccca

SEQ ID NO: 19976 - DNA, 1183 bp, Mus musculus
tggtacttaaaattgctgtaataagtacatttttatgtattatctcactaaactaaaatataagaaagagattctagttgttactattttatgaaactaaggcacaggaaggtacagggccatagtgctgtgggtagcagaactagtggttcttgttccagagcctttcctctgttcattgagtcaagttacgtttttataggccctcttttttggtttttcgagacaggcttttacaggcccctcttataagctagtaacaagtagtagttttaagtgaattctctgtaattcatgtaattcagtgtaaatatcttagaaataattataaaagacatgctatgatgtatgacattgtcattaagttgcagatttttttacctgttaaagtctatatctccttaaaattttagtttgaatattatcccaactaaactgcatttattttttgcagaataatgagaagcaaatgcgtcagctttctgtgattccacctatgatgtttgatgcagaacaaagaagggtcaaattcatcaatatgaatgggctgatggaggatccaatgaaggtttataaagacagacagtttatgaatgtttggactgaccatgaaaaggagatctttaaggacaagtaattttaactgttaaattattgttttatagaagttattaaaagtgtttggcttttacttgagagtgaactctttccacaaagctttcattccagtttggccttggagtaaatgctgtgagtaatagataaacttatcttcctttaagcttggaggtaggataatggttaacagaaatgggcatctggaatcattttaggaaagattccttaacttgggtgcagtacaggttaattttgggaggctcgttataggacagatttctgtgccttacaataaccatggattcaggtaggtagtttcctttaaacatttagcaataaaagaatgtggtggtgtgtgcatttaattccagcccttcagagacagaggcaggcagttctatgattttgaggccagtctacacagtgagctctaggacagtcagggttacatagtaagaccctgtttcaaaaaacaaaccaaaccaaaaaaaaaacaaaatttaaaaactatcctttaaaaactcggccatttaaaaattctttctatcagaggctggagagatgg

SEQ ID NO: 19977 - DNA, 1225 bp, Mus musculus
atgtagttcataattaaagtcatctatttaagaattttttctgtgagatattgccatggtcttgagaccctttaagaggacattaggctgaactcataaaatacattttgatttagaactacttagctgtttaatgtttttaaaaggaggataccagatataatttcgttggctattttcagtgatttacccccaaagcttcagtttgtgttttgtcttctcccctcaatgtaagctgggaagctgcactgtttgatgattttctgtcctccacattgcttgtgttagactgtgctgagatgggttactgactagctgacttcacttaagttcttagtaaacattgaacattttatttactaggtgacatttatttttgagtagcatataattgcaataagaataaattggcagctgggcatggtggcgcacacctttaatcccagcacttgggaggcagaggcaggcggatttctgagttcgaggccagcctggtctacagagtgagttccaggacagccagggcttcagagaaaccctgtctcaaaaaacaaaacaaaaccaaaaaaacaaaaacaaacaaaacaaaaaaggaagaagaataaattggcatgtggtgacggtcctactgtatgttacatttgaaatactcagatgcacacattttcaaaaagctttcagtagctagtcaccaatctttgctttgtatgaaataccaagtgtgccttttaaaaattctgtctcttgactgctttgtcatactgccagctactgattgtctatgcatatttgagtgaagccagtgttgtcgttagtcctgagtgacagataatccatgaatttatttctactttcattgactttgtatttatgtctgaataatcaacttacagttatttctggaagtaggtggggtataaatatttatatatttgaaacctgcatgatgttgttttagaagatcacagtgcttccaacttaaaaagtggtgatgttacattaagacatgtgagaaaatcttctgtcttgtcagattgttgctccatagagtctgttgtatcatatctgtggaagagaaatcttctgttttgagcagaagtcacctctttgtaaatatgttggtgtgcattctcctttcacgagggaagtacctgctaaaggtttcttttcccttttacttccctttctcagtatattcaaagatgcttgtatcatcagaattctt

SEQ ID NO: 19978 - DNA, 1209 bp, Mus musculus
gaaaagtcaaaactcagaaagagaaaagaggtacaagtccatagacaaaacaaaattcttagaactcatcataaaaccaagatttatgaataaacatttatctaaaaaatatgcatatatacccattaagcacatgcaaaaacactcaacattatcattaaggagaatattactaaggaaatgcaaactaaaatcacagcatgacattagtgctaagagagctattaaaaaaagaaactagccaggcactggtggtgctcgcctttaatcccagcaatcgggaggcagaggcaggcggatttctgagtttgaggccagcctggtctacagagctagttctaggacagccagggctacacagagaaccctgtctctaacctttccaccccttcttccccacaaaaagctgacttctgcaagttgttctctgacctccacccgtgacatgtgctttatgtgatcagagcaggcaaacacacatacgaataaacattaaaaagttttcattcctgtttttctattgctttatgtttttaaaacaatgtttttattttattactgatttttttttttttttaatttggctttttgagacagggcttctctgtcctggactccctttgtagacttaggttgaccttgaactcacagagatctgctggcctcttgctcccttgtgctgggattaaaggtgtgtgccatcatgcctagctattatttgattttatcctaagtttttgtagaaaatcttttttttttttttttttttttgtagaatcttccttggtagcccaaactgccctcacactgctggtacccttgtcttagccttctagctattggaatttgtgctgtgagccattatgcctgattgcaaatattttagtaataaaggaattttgagttgagttttattcacaaagaaatgtttgttagtcttgtagtttttcctccttttaatctgttagttttaaaaggcccacgcacccctaggtttagctttatttgtgccacattatttattttcttaaaaaataaatttaattcaacagtacttatatgcggatttaagtttgtgaaagcaataagttataattttttttttcgagacaggctcatgtatataactcagactagctttgaagctcagttcctcagaccagtggttctcagccttcctaacgctgtggttctttaaatacagttcct

SEQ ID NO: 19979 - DNA, 1237 bp, Mus musculus
ggtggctcagtggttgagagcacttgctcttgcagaggacccaggtttggtttccagcttgcacgtccttgctcatagctatgattgactccagttctggggatcgactctgtcttctggattcttcagggaccaggcatgcatgtgatgcacttacatgtatatgcaggcaagcactcatccacataaaataaaaatattttaaaaatccaacctatgtgtgtatgttgacactggagtgggcaagtagccagctgtatataggttctggggatctgaactcaggcccttgtgcttgcatggcaagtgacagccctttaacatggactttttggatctctttttgtaacttagttttacaaataaaaatcttgtattaagcttttcatttctgtattagtctttctcttcatcccaaagagatactctgttagaaatgttaatactattcgggtgacattcaggtgtgtctaaccttttgacattgtacatgactttgttatctacaaatgtgttgtgcttcatgcgtggctatcctgggatgcatattgtgggcatgctgaatattgttctggaataggtagagtgggcagcaattcattttggaagtaagtatgacctttcgctcactctgatgtctaataggggtgttagcaaaggtttaaatgtcacttaacaattttcagatggtttttgctttgtttttatttttattttttggaatgtattaggcctcaagaaaggagaactggatatgaacagtttcactcaggaccctcaccggtggatcatgattccttggagtccaagcgcccacgcctggagccagtttctgatgcccatttccagcgtgttagtgctgcggttttacctttagttcactcgctgccagaaggcttgaggtcgtctgcagatgctaagaaggtaaatgtttgttttcttgttccgtggaacttaggtttgtaatgtttttgtaaccaattttaggcagagtgcctaaaagagaagccaacattctcacagcctctaaaaggttagtgttatgggagtaaaggtgttaggtaaaactgcaaaccacagactaagtgcttcagatttcaaaattggtggtacctttgacttttgaggagttcaataattttcatacattgtttgctgctttgtacaatgtggccagagatactgaagactcagttttgtcgtatttatcttacttgtgtggtggcagggaggcttc

SEQ ID NO: 19980 - DNA, 1151 bp, Mus musculus
ccacatagtaaaaggagggaatcaactctcaccggttgtcttcagatctctactaaatgctgtggcatgtgtacagcctacacttacctccacaataaattaaattaatgtaaaacagtttaaataaggggttagagagatggctcagtggttaagtgtgcttgctgctcttccagaggactgaagttgtgttttttggactcctgtctataattccagctccagagcttctaacaccttcttttggactctgaaggcatctactgcatgtgtgcatacataaacagagactcacatatacataaaggaacaaaatctcactagatagaaattattaaaatgatgaaaaattgtctcagtaaagggttgaaattgtcattgctatttgttttcatactaactggttcttaattacttggtttaacttcataatgctgttcttatttgtggttaatagttaactgacaattattttaataccaggaatttgcagttcctgactaccgctcttctcatattgaagttagccaggcatcacagcttttacagcagcagcagcagcagcagcagcttcgaagacgaccttccttgctttcagaatttcacccgggttctgacaggtaatggaatttcttttatttttctgcttaggattaattgaattatataatttatttatatttttaatttttaaaaaaggtttatttatttataatatgtgagtacactgtagctgtcttcagacattccagtagaaggcatcagatctcattacagatggttgtgagccaccatatggttgctgggatttgaacttaggaccttcggaagagcagtcagtgcccttaacagctgagccatctcttcagccatatattttcagttttttttttttttttttaactaagaaagctacatctgtcatttcagttgtgttttgagctcttacgggttttctttgaactctcgatcctccttttcaatctcccatgtgctggtggattacaggacttggctgcaacatctggctcacatctgtttttttgtttttgttttttgttgttgttccattaaaattctatggttaagtttttaatgaaaatgtgtttgttttactttgtttgtatattgggggcatgtatcataatggt

SEQ ID NO: 19981 - DNA, 1330 bp, Mus musculus
cagaagagggcatcagatctcattacagatggttgtgagccaccatgtggttgctgggatttgaactcaggaccttctgaagagcagtcggcgctcttaaccactgagccatctcgccagcccatatatactttttttaaaaagaaaaagaaagaaatggaaagaaaatacaaacattattctgatagtgaaatattgaaccagtacaaaataaataaaatatgggaagctgggtgtagtagtatatgcctttaatcccagcattcagaagacagagacttgtggatatctctaagtttgtggccagcctggtcaacatagtgagttccaggacatccagagctacataatgagtttctttaaaaagtaaaaaaataacctcaaatagttattctaataggatggatagtgataaaaccacgtttacataaagcagtatacccacatgtaaaaatctacatgataatgaacaaatagtgttcttagcctgctttgtttgggggaagaagtgtatttccatagccacaggtgtaagcaagcagagctttgcccatgcctgtggagcctgtctctgaagagtccttttgtactgtgttcctgcactgagccctctgcaaggccgattcgctgattagcaacgacacagaagttgaaaggctgcatgtccagaaccaagttatattggggtgtccttagacaccttgcaaactgtctgctccccacttctgtatctgacctagcatctttgtgaccgttgggtaaacacttgggaatatagaagcagctgcctagttcccaccaaccaaaggctagggattctttcagatagcatctgaggcgtccagctgagatgccttccttccctgtgatccacctacctgatgttcccactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtgtgtgtgagaagtgcccatgtgtgactgtg

SEQ ID NO: 19982 - DNA, 1221 bp, Mus musculus
agtgttctaccactgagctctgcccccatgcctcagtgtagttttgagtgctgtgtagcattggttgtccttcactcggggcatcagctcttcatgtgggaggtgaggaccctaagccagggcgctgatggtgtaggccgactagagcgatgttagtaatcagtgggccacaagtcatccttacgagctgccgctgaggtagctcccgtgtgggataatggtgcttgctggtgagggcttgtctgacacattctctggtcttacccacacttggaacccctctctctgttccacttgccccaggaatcgccccccactgcctggacgaaggcactgtgcggagtgtggtcactgaggagttcaatggcagtgactgggaacgagccatgaaggagcacaagaccatcaagaacatgtcaaaggagtgagcagggcagtagccctgtaggttgcatgggtgtgtgtcgctgtgcaggcctgcctgggctaccatctccactccccatgtctctgaggttcactccagccaccatttctttaggcagctctgccttaacccaggtttcgtgtaagaaacttaaccttctcccttcctaccaatttttgtgtgatcttttagaaaataaatatttctgacattaatgctattactatgacatatttctttgaactttgacttttccttcggaggcttatcacttcagatcagagtaacaaagcgggccctattaagatgcctgcagccacactgagaagagaccagactcaaacagcacttacaaccagagactgaatgattacagttcgtgtgagttgtgaaaacatggactctgggtgcacagggtgcacagggctagtccaggaggcctgggagcctgtggcatgtggttttagtttattccttagctactcatgtatttgattatttctgacacagtgggctctttgttggcagtttttttctttttcctctcccctacccccaatagtttcatcatgtagcccaggctggcctgtgtatgcctgcctctgccccctgcgtgctaggttataagcatgcactactgtgcctgcccacatttttttttaaataaggtaaaccaggctccttgtttgttttgattttctgtcgtcaaggtttgggggaagccacatgacaggaaaataaagggacagagagagacacacggagccaatgaaaagactgcaggggaggagtcc

SEQ ID NO: 19983 - DNA, 1181 bp, Mus musculus
gtgcttggctttttctgtatatggctttgttatgcggtaatacagttaaaaggactttggccagaagccaaacagatgagattgcttgatctttggctttcagccttcgaaatgtgagataaacaatggccctttctttataaagtatccagccttgggtgttttatttttatagcaataaaattagactaatataagcaatacttgtgagaaggcgagggtggtggtggtggcggcatctgggtgttgctgtggggaaagagggctcctgtcttacctatgatttgataattagatgtgaaaggggatagggtcagctgagaactggggatggagacagagatattaggggacatttaagttgcagttactgtgtaaggaggcaaaagaaactaacagactgactaaaatggttgcgatatcccgtgtcttcatggaaaggaaggggcagtcattgcaggacatagaaaattagaaattagggtataagagagtccacgactttatttcttcaaacttctggttttgaggtattgaagggcatctaaggcttggacagttgcgttccagaccctggtagtggggtcagagcttgggcctagcagatacctcccaaagaccctgcttaatgataaagaggattcagacattttgatggctcctgtgatgggtctatagagagaccagtgtcttccactctatgtccgtatcagataacacaagcaaagcattgtcctaaccccaaggttgctcaggcacaatctctaggaaccaactcagaactctgtttgctagccttggcttaggtcagtatctcagttatgaagtttagagaaaacagatgctataacaggtgaaggtaggacccagaatcaggtttcctacagtgtcatgactgggtgttgtctgttaactctgggcattggtggagggacggtcatgcccatgtactatgttaaagtgttagtcatagaaggggggtggggacaggaaataattccttaatgaaagatgaaagggtaggaataaaactgtgagagaaagaatgagagacaagtgggaaccaaatggagacagcagactcccttctttctcttccacctttgaggctgtagaatgggtcaggcagggcaatcacttctcttcctcattctgagagaggtcagagacagagaggcatg

SEQ ID NO: 19984 - DNA, 1235 bp, Mus musculus
tcccacacctcgaacaccagtactgctgtctaggggggagggaggccctgaggttcaaaacaaggcagagtaggctaggcatgcctgttggtttgacataggatgagggaggggtaacttgagattagtagttggcatgcagattttgttcaacactgagctttcagattagcaaacctgtaaatccgttatttgagcactgatatgttttaaagtccatgcttcctgaagatgcgctatttctttagctcagtggtagagctcaaggctctgggttcagttctcagcttaaaaaacaaaaaaacaagaaacaaacaaaaactacaaaaataaggagcttataatttctatagatacattttgatttcttttgtaaatttcagaattatatcttgtataagtagcacaaaattaaatgtacatgtaaatgtatttcctgtaaagaaattaacttaagtcaaaattctacttgaatcttgaaaacactgtgctaagtgaaggtgttggccacaggagacaaaatattgcatgattttactttcatggagtgtccataatgggtgaattggtagaggcaggagatgattggttgcttagctccgagggggttgggaagaacagagggatgattgccagtggggacagatttgctttttggagtaatattgattgtggtgatggtcacacaactgaatagattaaaaagcatttaatttacaaaaaccccatacatacgtgtatgatgatgtgtgcatgtactcccggaggcaaggacgggaagagtatgaagttgagggtggcctgagctacctagtgagatcctatttgtcataagggcagggggaggaaaagaaagagacaaaactgtatggcgactttgtcttcatgcttgaagtgatttctcaccttggggctcttgtggcatgattagataatctaagctggtaaggtctggctaggtgctttgatagtttatactcaatgaggtgtcagagtcagttcatgtactatgttttcttgtaacggtataacctagtgtagtggtgggcacttgagggtaagctgctggcttcctcctccccttatctcatggttgtgggttgctggctcttgcagtgaagtgtaacggagctgctgtgccttgcttttaggcaccccgtggcatccttcttccatctgttcttccgggtcagtgcggttgtggtctatctcctttgcgagctgctcagtagcag

SEQ ID NO: 19985 - DNA, 1722 bp, Mus musculus
ctggtccacttgttgtgtatgctttagtattttgggattttctttttgtttgttcggtgtggtttttttgagacattgtgtacccttggatggcctggaccttgctatgcagaccaaccgggctggcctaggagatccacctgctagctaggattcgaggtgtgtgtcagcacatctgactgtagtgtttttagttgggagggactttggctattgaaccttggtaaaatattactgttttatctcatggaatctgtcaacactttaatatgacaagctggatatctgagtgggtgatggaatccacaggttttcttttacattgtgtctactttttaagcataaaaattattataataaggtattgaaaataatgtcatgaaggagctggcacggtgatagatgcagttttccttggtctggtactgtgagctccatggtatgtgaagtgaaataatgttgatattaagaggtagtttttttctctattgcagaacactggagatggtcagacttcgtgagtaaagatgaagactgtcatggactctgggagcaatggacacgattcttagtgtttagagctcagtctgttgcagagtggggtgtgtttgttacttagaagcttatttaaaagaaggaaaccccatggggccaggaagtctgtgtgtctggaaacagtgtcaggtgtgccttgggtgtctgtctggatagatggtcctgtagcagcagcaagtcctttgcacgtgtgagtggaccttcgcatcctgacccatagactgtaggaatgggtgttcagtctgtctcaaattctgtgtttgcatagcattcctgtacatggtttttggggtaagttttgattcagtggtaagggtgaacatgttggtttatgtatgagttagaaacagttattaattttaatgtgttctgtatggtaaagttccttatcttagacttgtataagcaagtaaaagctaaatttgggcactaatgttaactgatttctaaaattttggttttagttggtaatgagtcattcactcaaggtccatttggcataagtgggacctttgtagttgtggtggatatacaggggctgctgttgctgtgtttctttgtgaccatagatctctctggaactatctaaaatctcttagtggtcttttcgttaagttaatgaaatactaccttttaataagaatatcattcttatgaaataatgagagtaattacttaagtacttggcatagtaaatgcctataaaacattgtatgaatttattttttcttttataatggggatattgtaaatcacatatttgtattaaggttatttcctaagacaaagcaatatactatagactaaaccaaatgtaaactattgtaggcagctggattcttttgtagtattgtaaattttgttggaatctttatattatgtcatgaatacacttgtccattgttggcacattttaaatgtcttgtttattaagtatctttattagagtgtagcttggcaggtgtatagctttatatttatataaaactgctgtttacaaagcattagatgtgtggtcccatttagtcatggcactgtgatacctttgaggggacacaacctcaggagcatctgtggaatctaaagcaggatgaggctggggaagaaaatcacactccaaagtcattgtcttcctttggatgggtttgctaagttcttgtatgccat

SEQ ID NO: 19986 - DNA, 1209 bp, Mus musculus
atcatccaagaccacacctcaaaacaggataacaggcactggctggtctgtgctgctatttctctgcctcggtagttctctgagctcttgggcatttactcttctattttgccatcacaggaaggtcttcaatgtggaccaagagcctttgattagtgtttgtaatcctgtgtctttggttataagttgcaagaagctgctgggttaagggtctcaggagctgtggatggtgcctctcccgtcttttgaaaataaaaacatccagtgattctgcagtttcatttttatgaaagataaataaatctgtacacatacacacacacacacacacacacacacacacacacacacacactaagcgttgctagaagttggtgaatggaagaaagcaccatctcatcatttagtctggggactcagcttttggtgccacatagaccattttagtcagaatgataactgaagactggaatagcttcagacttcctcccccgaatcctgagccagtagagggcagcacagatacctcaccttaatctcctgccctggtctttggtccctcatcttactgccttgcacttgtttttcttgctcctttcctgggaggctaccctagactctttcctaagcctggtgcatacaaatgccgagagcgccatatgtccctcgttctgatgggccgaatagcatttatatcttttaagttggctgtggtagcacacgcctgtactctcagcactcaggaagctgagacagtaggattgtgagtttaaagacatggagctaggtacatagtgagaccttgtctcaaagtaagtaatgtaaaaaaaaatgtaatgaaataatgtcaaagtctctgaactgaggaatatcttacatatggacacgtgcgctagttgttttattgctgtgggaaaacacggtgaccaaaagtgatttatggaagggtttattttggcttttggtgaggagagagagagagagagagagagagagagagagagagagagagagagagagagagagaaagaagaagaagaagaagaagaagaagaagaagaagaagaagaagaagaaggagaagaaggtgaagaaggagaagaaggagaagaaggagaagaagaaagcatgatacaggtgtccagagcagggacctaagagcttacttctcatttgcacagcgaagcacagcagagcagagaggggaaa

SEQ ID NO: 19987 - DNA, 1165 bp, Mus musculus
catgttacaggctttcagcaacttctaagcagttcactgaggacaatagagtttgggccttaagccacttgaaagtgaccccgcacacacacacacacacacacacacacacacacacacacacacacacacacagcattctgctgctctttagtcaatatagtctgtagaatattattctgtttgggattggattttacttctactagataccgggggaagacttcaaactatggtcccagccccctggtgttccgtgataacgtggattaccgagcattcgaatgcttctaaaccactgcatttctcttccagcaagactcacggaaaacattggactccctctgatactgcttgaaaaacacaacccgtggccagcctacgtcgcttacatctccccggcagtaacccgaatcaccgaaaaaggctgggccagggacctagagtacatttatgctgctgagaaaaacggcaagccagtaaagcgcagcaaacatagtgccgtgctgctgaagaggaggaagccgtccaagccctcagaactcatgctgaaagagaccctgtcagagaccatgctacccacgtgggaatgctccaccatatatgtgagtcccacatttgtcccagaacctgcacaactccaaatggatgtcagagaggggcccacatcaaactacaacaagatcattttctccaagaggcctgcgatgaggaaacttccatttggcttactacaggccagcaaggagatgcataccaaagattagcaaagagccctgtagccatcacctgagaataacaacagttactctccatttgctacaaattacatcatgtccttgaaacttgaagttgttcttgtttatacagaggttgtcagacagagatgttatcagaaagtggtctgggggagtatttggatagacaaccccaacactggagtctgttgaagtgggacagctatagattctgagggtctaactgtaggcatgtttatccacatccagacagcagacagaaaccacagcagtgactttagcagtcataacttaaaaggctctttaaccaggcaacttaagagggcagaaaggtaaaagaaaccagttaccaacagagggtcgcccctgtgtgaaaccagttctgttcctggatgtattgagtgtta

SEQ ID NO: 19988 - DNA, 1231 bp, Mus musculus
aaaagagaggagtactggataggctaaggcaacagaatcatgccagtcttctgaaaggtgtgggcctcctccatcctcctccattccccctccatcctcctccatccccctccatcctcctccatccccctccatccccctccatgcccctccatcctctaccatcctccaccatccctccatcctcctctattctcctccatcctcctccatcctcctccatcccccatcctctaccatcctccaccatccctccatcctcctccattctcctccatcctcctccatcctcctccaccccccatcctcttccatcctcctccatcccccatccccctccatcctcctccatcctcctccatcctcctccatcctcctccatccccctatcccctccatcctcttccatcctcctctatcctcctccatcccctccatcctcctccatcctcctccatcccctccatcctcctccatcctcctccatcctcctccatcctcctccatccccctatcccctccatgccctgccatccttttccatcctcctccatcctcctccatcctcctccatcctcctctatcctcctccgtcatctacatcctcctccatcctcctccatcctcctccatcccctccatccccctccatcctcctccatcctcttccatcctacttcattctcctccatcccctccatcctcttccatcctcctccatctcccatccccctccatcctcctccatcctcttccatcctacttcatcctctaccctcctcctccatcctcctccatcctcctccaccctcctctatcctcctccatcatctacatcctcctccatcctcttctatccccctccatccccctccatgccctgccatccttttccatcctcctccatcctcctccatcctccccatcctcctccatcctcctccatcctcctccatcctcctccatcctcctctatcctcctccatcatctacatcctcctccatcctcctccatcccctccatccccctccaccctcctccatcctcctccatcctcctccatcctcctccatcctcctccatcctcctccatcctcctctatcctcctccatcatctacatcctcctccatcctcctccatcctcctccatcctcctccatcctcctccatcctcctccatcctcctctatcctcctccatcatctacatcctcctccatcctcctcca

SEQ ID NO: 19989 - DNA, 1307 bp, Mus musculus
caaacactgagccacattccccagcccatttcacagtcatttgctcattttcttctgtccatactcagcacggtgtacattgaggccaaccccacactgtcagcagaatcccctggctggcaggtgtgtggagacgcctgcacgcaaggtgctcacccgcctgtgcttttctgtgcagaaggctgtttgacatcagaacaaggctcactcccctcacgtacagcagaaccttgctcccagccagaggcagttgtcaaaggccttcaccaaggcttgctggctgctcccggagtctgatgtgacacatgaagtagaagagcaaaaagagttcagagaatggtacatagccaagtgggggaagggaggggagagatgtgtgagccttcctgttctctttccaagctggacacctttttgtttttttaaattcagtcgtttattttttttaattattattattattatttgcttgagaatataacaaaaacaagacatactgaggtagaaggaagtcatttagtcatgaacactgaagtgagttaggagtctgttctgggtcaaatccttggatctgagcagatgtcgataattagtggtgatggagcagggtgaggttttcagtgttagtcaaataaatcaaacaacatgtgcacctctttggtcaggctccactgcttgtagtccctggatgattggatgctgcatctgcccaagatgccgctccatcatcatgtgatagtcgttacacacagggcctcttctcggaggagttagggaacatggagaattaagccttaggtctgtctcttccttcactggccatctgcaagcccactgagtgtcacttctgagctgctaggctgctaggagacagacaccagttcatgtcctggcagtttgtcctgctacatgtttggtattttttaaattttttaattttttctccagtttataggaaagctatggcatattcctggtgtactttatttctgaaaagtttcatttctttccttgtttgaaaacaaaaaagaaaagttttttttccccccgtgtttgtttgtttttttttttgaattcctatccatggaaagccttctctctggggatgtttgcatgtaggtctgtgctcgtttactctgtagcacctacaaaggtaacttcaggcagagtgactatggaataaagtctgcattgagtggtggagagatgttctggggggaggggactcttggggagttcttctcagtgatgaatgcacttcagtctttgggagaaacccaggtgtagatcatgcctggctgctctcc

SEQ ID NO: 19990 - DNA, 1185 bp, Mus musculus
ttggtttggtttggtttggtttggttggtctggtctggtctggtttggtttttgaaacagatgagtgcagcaggctatgtacttgaaatggtcacgatttcttgggttaaaaaatattaaaatgtgcccaaactttgtgttctctttatttcagaaaccttttctggaattcgtcataattatatgctgttgatatagctttagttatttctattttacttttatttgcctgtcttttcttttttttttttttttaaaaaaaaggtctagctatgtcactataaggggatttaaacacactgtacagggtccttctaccactgtctcccggggctagtattagcaatttgccaccttatacagcttctgcattttaagcctctactatgcaaaacacagtatttcaaatatttcatttttgttagtttatgtgtatgtggctatgtgcatgtgagtacagatgactagggaagacagaagtggcacatctcctagtgctagagttacaggtgactgtaatctgcctaacctgggtgcaagaagatgaactcagtccctctggaagagcaacacatgctcttgacttctgagccatctctccagctccaggatgtttgaaaggaacattacccagctttttgaaaaaaaaacccagtagttcagcactactatttacttggtatgtacagccagattatatcatagaattaatagtcaagtattatttttaatggatcatttttcttcttgctattttaagcacccagatggttctctgaaatagttctttcctttgcctggccactgtggtgtgtcccaacgttgtgggttttttccataagatactctagtgaaaaagtcttggctaaaactaaaggaaaattgcctcatcaccagaacacccaggagcagttggcacagctttcaaacaggaatctacgttaccatcaggaaccagctcaaatgttcatagcatgccgtacagaagaagctagtctgtaaaatatggggaaatcatttgattatgcttaaaatcatgtgcctccagaaaatattatccactgtttggaggatgttatttgtttcaaatagggtttcttattgttattgcttttgacacagagtctcccagtgtatttatactagcctggaactcactatgtagaccaagtgggccttacagag

SEQ ID NO: 19991 - DNA, 1188 bp, Mus musculus
acttgtgctagtcagttaccaaatgtcatttcactttgttatatggcaagtgtccaggagctgtagtagcagagttgactaaagaagagactctgccatctgaagaactaaacaatatgatgatggtgttttgagaaatctttccttggggagatggaaacagtgcctactctctcatcataaggtcctaatcaaaaaccaaaggatggttccaccaaagttcagcctagggagccattgtttttattgggttgcttatagagcatgggtgagggggctaccggcaggagtaggaggggatatcaaagcagctgcacttgcaagtttgtacccagtgtagatgatggcttccccatagccatgaaagggcacctttcccggccttattactctagtatctctaagcctgaggccatatgcagttaaggcagaatagcaaacaaatggttgtgaggagtggctggatcaggtgagagtccaagtcctccccaacccctctgggagggaatgccagcagctatcaagctggatcctgatggactcttgcaagcaggcactgccagtctagtgaagatagaggctgtttcattccgagcactgcattctataaccgatgagaacagtttgcttcagatttagagatccatggccaaacactaggcagagattggggaagcccatggaagaggaagaaggattgtaggagccagagaggtcataaaaacatggctggaagaatcagctaaccagggctcataggaattcatagagactgaaccgacaatcagggtgcctgcatgggtcttatcaaggtcctctctatgttatggttgtatagcttagtgttcttatggaatgcataacagtgggagtagaggatgtctctgattcgtttgcctgctcttgggacccctttcctcctactgtgttgcgttgtccagccttaatatgaggggatgtgctagtcttattgtaacttgttatgctatgtttgcttgataacacatgggaagcctacccttttctgaagtgagatggaggaggagtggatctggctaagaggggaggttggggtgggtgggtgggagaggaaactgtggtcaggatgtaatataggggagaagaataaaagaaaaaagtgctgtcataaaacacaatataacattgtagaacagtggaaagagattg

SEQ ID NO: 19992 - DNA, 1121 bp, Mus musculus
ggagttgccaaggctgtctctgaggacccaagtgtttatccaagttggcccatggtctccatgctttcattagaaactccactttcttcttctaaatagttgacttaaagctccaggtaagctgaggagagctggatcgaatctaatgtttaacaaatcttcctggttcctgagccatttagggaatgtccccctcggctgttgggctgtgttttagttacggctgtcttgcgttcgcatatgcccatggagctcaatgacaaatgttactcttcaggaaccaacatcagggtggccatgctctgggcacagtcttttttagaatgaagacaatgggaagtaagacagactagcgaactaagggttaagacacacaggatctcagccagctttgtgtcatggaaactttagaaccaagtgcaatgggaagtcactggggaacttaggggatttctcagggccccccgccccaaggctacaattccatggagcatctcagaagacagcagtggggaatttggatggtttgtctctttttctcccgtatctgggtgtctgctgtctatctctaatctcttggtttgtctcgtctctctgtctgtctgttagttgctcataaacatgcagacccctcttcggggcttgtgaatttccagcattggttcttgtgaccatgtaaaacgctgctgttttatttctgggacttgtcaccattttaactacattaaatgtggtttagtaagactcatattctgttctgattttagatgctcctaactttttttttttcagaatacacagacttcattcaagaaatacacagactcattcaagagctttttaacttgacttgttcagtaatttggctaaaatgagcatgcaagttcctttctaagaaccggggtgggtgcaagttttctcaaatctttgtacttctgagcatcacgtcatcctgaccctgcttcaggtgaagtgaagcttagctgagcataaaagtgattttcttttcttttaaacttttacgatgcttgggcacttaatgtagtctagagctccatccttaactctcttccccagtgggcgcctaactgggttttccctttctacatgcatgtctctga

SEQ ID NO: 19993 - DNA, 1146 bp, Mus musculus
tgcctgttctatgtcttctgcatcaatgccattctggaatatctagagtaaagccagttggtgcctgtcttctacagccctgacaagtcagtgctcctggattgtggagaaggcacttttgggcagttgtgccgtcattacggacagcaaatagaccgagtcttatgcagcctcacggctgtgtttgtgtcccacctgcacgccgaccaccacacggtgagtgagcatgtgggggtgccttccccttgggcttctttccctctagtaccaaacttttgagttgactcagcgtttcttgctgaataaaacttgtttcacacacagcctgtccagcaggaccatccagatctggattttttaggcttcctaggtcttaccccattgcccgccttctaacacagcctgaaatgtttcagtcactagtcagcatgtgccacccacctgtgacacaggatcagtgagataggaaccacttacagggagggacttgagccctaagctgtggggatgacgactgagactggcttatcacctgtgctcccctccccagggcttgctgaatatcttgctgcagagagagcatgcgttggtaagtgaggcacctgactgacattgttaattgcctgcttcattattggctgtacctaccactaattatttcttaccatttttactggaaagtccccttattcaactgtacagagatctttttttcaggcatctctggggaaacccttccagcccttgcttgtggtggctcctacccagctcagggcctggctgcagcagtatcacaaccactgccaggagattctgcaccacgtcaggtgagcatcatgtgtactgggcgggtgccaggctgttgccttctactactgcctccttcctgaccccagctgactgggtggcagccgaagtcctggcagctctgcccttggagcataagtatcccagttctcactgctgctgtgcactgccatgactgtggccactgtctctgcagctgacagatccagggtcaagtgcaccagcagctgctagcacagacatccaagccaggtggcacaggatagggatggcccagcctcactttcagggaaggatgagaaggagtcctgacagatgctgcctgtcacctgcagcgtt

SEQ ID NO: 19994 - DNA, 1255 bp, Mus musculus
aacctttcaggccacccttagtcacagctccaaagtactcagcttcagacatccacttctgacagctttactttccccgtgtgatgacggcttcctctactccacgctgacaatctgaactgaggatttgaacataagtgaccctacgtaggtctccatgttcccaaacacattagggatcttagagcactttcgcattcaggcaccccgcttagtaggtgtgtggggcctgactctcctcttctggaggttacagctgactagcaataattctgtttcccaaagcaggtggagagggtggtactgggcacctagcccacagcgtggcctgcgtggctcaccagcagaccctgctcatccttctcaccacgtcccatgcagccctggggcaagggcgcaggaagcctgttcatactttgggattaagggaataaaacagatctgggccatgcatgcacagtcagtttaaagtttgttcctctgaaaatagatatacctatacatgatatatttgtatatatgaaatctatatttgtttaatttgagccattcaatctaaacctatgtacaggtgtacaatggaaaattctaaatgcttagttatttttcccagcagtgtgaactcacccgtctctgagagtgggatctgcagactcgaccttacagctttgctcacttcctggcaagggcagtccagtccccaaatttgtaacggagcctgggggttgaaggttatctttacatatatgtacaaactgttgtcaagagtaatgttattaaaatagatttattaaccctgagcttggcacatggtcttgtttcggtgaaggctgcggggcagtcacaacatcctgtgctgcctcatgaggaagtgagcagagcgccgccaggccagggaaggcaggccaagtcctcgccagggaaggcaggccaagtcctcgccagggaaggcaggccaagtcctcgccgtgtcacactcgcgctcctaaagtgtttgccacgctctcctgggtggggagaacacgcacatgttagagtcgactttgaacatccttccaagtttcagtcactaacctgctttcaggttccaacaggcatctagcccaaggtgacatttcttcatactttcatagtgattgtcactcatcatggaccaagagcacaacaggctcacaggcacgggagatgcggcctcactgggtaacccagcccacagaagaccccacactgaagcaggattccaaacttgagcttt

SEQ ID NO: 19995 - DNA, 1164 bp, Mus musculus
cttcctctctctgcttcttggcaaccatcttcctccaccaactgatggtgccacactgttcttctgcgacaagtgccttgtcataggcctaaaagcaatggatagggctgacttgacaagaacttggatttctgaactgaacccaaaggaatctttttttttttttgagttcctttatttcaggtgttataacagtggaaagctggcgcctgaagtctgtgaattagagagagtgtaatggatgctgatatacagtggactctgctaatgtagctggtacagtgagttagatacacagaaagatctctgaagcacaacatggcgagaaggccaggttgcagagtgggaacctgaatacggagaagaagaaatgaacatgcatgacctgaacctgcatgcttgtgcgtgtatgtatagatgtgcgcaaagccccaaacaggatggagagactgtgagggttattccaggggatggtttgctgccagctcaccactgcctgccacatctcccctgcatcagtgagccctccagaacctttgcaaaggtcaagtgcgttctccaagtctgtcctttgtccattattactttgtcttttcttcctctgctgtggcagtttaagaactttgtcccagaactttctttttccttgtgacttttgaatggtgagccctgcctgggaaggccttcctcaccatttctatacatgctagctgtgtacctcttgacttttttccttcccttagtgccttactatcttgcaactaattattaagcccatctcggcatttgtttttctgtgtggtctgagtgatggaaggcatccaagtagatacctactttcttcaacaccatctatccagcaatcagcgggtccagttgtgagcattctaaagccacgcacacacacatccttggaatgctcattacggtttgcctagcattgggatggactgtctctctggttatagtagtctcaggaagtgatctgttgaggttgaacatttgaaaaaacacttgtgtaatgaagtatctggatttatcctggcaccaaatgaaaggcactattgtcccacagaagcataaacaacaaagtgtggacataagctgggccagggggtgtgccttaaaaatgccctgtttgttgtagagctcaggcaaggtctt

SEQ ID NO: 19996 - DNA, 1142 bp, Mus musculus
ggcagtccaggcatcggccagtggtcccggccggccgggcatgaggctgcacaggctctaggaacagtggtccccggccgggcatgaggctgcacaggctctaggaacttttttttttttttttttggttatttgagacaggacttctctttatagccctggctgctctaggaacttttggcatagctggcatttctgctctggccgaagccactgaggaccctttgcctgaagcgacggcttgtccttcagtaggtctctgaaagccatcaggcaatcaataggaccagaggggaaaagtcagaacaagtctagattagtcatcacctgcttttgcaaaagctggctgtgatttggacttctcagatcaatgcaggcttctgcagcctctttctatgagaggcagcaggcttctccagaccagagactccccttaagttcttcagtagagagagtcctgggagcccaggcaggccctcttgctgaggtgtggcttttgtgctagcagaccacactgagccactcatgacagactggcagagggacagagaaggccctttgcccttggttctccatgccccttactctacaggcctgtcccgtctcccctcagatggcctgcctgttctctgcagtcagcaagaggcagcctcactttcttggagaattctctcagcccagaccttctgcaagtcattgtgagggagcctttttttttttcccttgagcagcaattaatcacctcccctcccacttttttccaccagaggaattcatcaacactgattggtaattttttaataatggtgataagaagcattgttttcttgtggctgtttaaaaaagtaaattagtagccatgtgactaaaacagtaatttgtggttatttgttttagagggatctgtaagcatcccttttattagtagtcaagagcagattatttccaatgctatttctgtggtgatgggaaatagggaggttatggtctggctcagtgctgagagctctctgagctcagagagcaggttctggggacacagagaggatctgtcactcctccattcagggacccctgacccttgccgagttggggaggctgtgatgtctagcaaatcgaaactctcctttctgtccaggaag

SEQ ID NO: 19997 - DNA, 2977 bp, Mus musculus
gtccacatccatccactgaaatgttcatgcgatgagtgccgttcttatgatatattgaagctgtgtgtgattgggagcttatagtactgtattgtatagacattgagaagcactgacgtagggctctgatacaaatgtttgacgctttctctgttcaattttctcgcagaaacatccctttattttgatgtatgaagaacgtactgtagaggtcgcatgctatgtttgtaaaatcctggatcagatgccagccactcccagctcgcccatgtatgtcgactgataccgctgctacatcagactctagaaaaaagggctgaggggaagcaagacgtaaagagttttcatcctgtatcacagtgtttttattgctcgcccagacaccatgtgcaataagactggtgttcgtttccatcatgtctgtatacttctgtcatctagactgtgcatccctgtaatacctgactgatcacagtgttagtgctggtcagagagacctcatcctgctcttttgtgatgaacatattcatgacgcgtggaagtcagtacgatcaagttgttgactgtgattagatcacaccttaattcatttctagactcaaaacctggagacgcagctactggaatggtgttttgtgagacttccaaggctggaaagacacagtcatggatgtactgtctgagcatagagaacccgggcttgagtgagaagagcttgcacagccagtgagacacattgccttctgcagctgggagacagaggaaggattccctttcttcaccaagtgcaatagatttcctcatctgataggctgttgctttaccgtcacacgcgatgtgctcagccaaattccctactcaaaatatcatgttaaattagaatttatctttaccaaaaaccatgttgctttcagagaggtcaacattaaaatactgagacaggacagaatgtgttctttgtccttttccagccctgctcttctctgggaagatacaggagtctgccacctgtcatagaagggtgctgccaacttgatgctctacctgccaccaaccaccaggactgaaggaaggaaacagtactgagggcaaagtttacagatgtttttgattctggcattttgtccagaacagcttgtagcagctatagattcccccttggccccaagcctgggacttgagccatcgtaactcactaacagggagaattagctagtagcaatgtgccttgatgaagatttcctgcaggcagcaaaacaccaaatcacaacgctttgcttctcgacatcatgggccaggtcctcagtttctaactctttcccttccccacagttcgttgtcgccatgcggcttttgctcagtctagtattctgccttgtttttcacattgggaaccctaacattaccagggatgctacttaccacaatttgtaaccctgaatctctcctgtgctctggtgttcagaaagctgagacagctgggcccagttgatgttgtacgtgagaaagaggcagtctgttggagaggcatacttgagcaggataaagatcctaaatggcagcctttcagataggcatgtctgacacctgctgaggcctctaccagttcactctctcccttggaagtggaattctacccacctaaaccccccaaaaaagacaaaacgaaaagaagccacttcatcttatgtgccgctgcttgtcttcagcccattagccaggtactgagcgtcaggctctgcatagcagttaagcagcactggtagtggtctgccgtgcaggggatgcctgctatgcaggtgatgccctcccaggatctattcctggtgggcactgctgtgtctcccccagagtggcactcaaagtactatcaaacaataaaaggaaaatggtgctgtttgaagttacatcccttctctttggaggatttaaaaatgatctatcttttggtccacttgcctaattttcccattttccacccctggccccctacccttagattctctgtgttccacaaggagacatcatgagatgtcttccttaagctgcaccaagccattgtcctccgttgttcccaggactcaagaggaatttgtttctctgctgtcagcttcctgtctggctcagtatagcctcactctgccgttatgcaaatggagatcaaagtaattctgactgtccaggagctatctcactttctgctgtgtgggcggccacataaaaaggcaattttagtgtattaatcatagattattataaactataaacttaagggcaaggaatttattacaatgtatctttattaaaacaaaagggtgtatagtgttcacaaactgtgaaaatagtgtaagaactgtacattgtgagctctggttatttttctcttgtaccatatgaaagtatataaaaattatcaaaaagctgatgtgcagggatattgccttatttgtctgtaaaaatgtagctcagtaacataactgcttcttggagctttggaatattttatcctgtattcttgtttgaatccttcctctatttaagacatagccatggagcccacatgtttatggaatagtctaccctttgcctgcaggtcagttgtaataaatctaggttgtgatgatggtcttgtaatctgattttctgcagtcataccccgagaaagaaattcaagaaaaaatgacattaaatcatctgtgcatttcatatacaggagagttatctccttccagaagtttctggttcttttctttattcgtcccctccctctgcttcttccctgatgtaacagtgtggcacagcttgcttttttcttttagcagctgtggtgcagtcttttcaagctcgcacttgggtgtctggacctactgtggttgtagaatgctgcaggaagcaggttcagttctacctgtatcagcgttgacaggtgtgaccttaggcctggtgtggccagccaggctcctgatgctgagactcc

SEQ ID NO: 19998 - DNA, 1157 bp, Mus musculus
tccccattccagtcctcatcttttctgtcctggactgtttcccatctcaatctagtgaatgaagatgctgctaggtagttaagaaggctgttgttgcattgcatgctagagcctatacaattctgagatgatggttaaaaatatatttgtgtgaaggagcctacaattagtcatgtgaaaacttctatactctgattttctttgtatttgcatgtgggcataattctcagagcctcagagagttattgtgtaagcctcaccaccattagtgaatgtgtgacttagagtcctgtgcccttaaaagaatttctgagtgcttttttgttgtgtgatcaaacttacaattataaagtataaggaaacatgataattttctagcctggttaatattgtgaggtttagtaattttcagtactacggaaaaggttttactccagtttctaaaactattctgtttgcatgacatctgttgttattcttttccagagaattcggtcaactgtggatgaaaaagaacaaaaacaacttctcatggatttggatgtagtaatgcggagtagtgattgcccatacattgttcagttctatggtgcactcttcagagaggtatggggaaacggcttgggttttagctggtaaatgcatatctaacttggatgagtaagaggaggtaggattaattctacattaataacaaagttgcctcttgttatagtacagaaccatcctcgttaacttgcaggttctttctgcttgggattgttttggaatgccactgaagtttagacttaaagcttcttatagtaacatctatctagccatatgtaaatatttctgtgtctttgtggttgctgcttctgactgccattggttttttttcctttatgttttctattaaggatgtgacacagctctgtgtcagtacttcaatgtagatttttaagaattattttgtttaatttggtggggggggcggttagtaatgaaatgtgtgttatggtttttaaaaaatacatttttcctaaaatagactttgtcactttcccccttgcctttcctcccactagcctcctttataagtgtatttcattacagtttgttctttttttgtcccacccacctgtccttccctcattcccttcctccttctggctgat

SEQ ID NO: 19999 - DNA, 1149 bp, Mus musculus
caggctgaagcacagttgtctgtccctggcctcagaagaaaccgactcctgacacccccatcattgattgccagtctctagaaccttaagaaaacaattattttctgttaaatcagtcagctgcagtgaaccagtatagtccattccttagttgtgagccaccatgtggttactgagaattgaactcggaactgctgaaagagcggtcagtgttctttaaccactgagcaatctctccagccaccctgttcagagacgtttaagacattaagtagccatttaatgtctttatctcagggttctgcatcggtcactctatatcatactgtaactgtgtgtatactgcgctaaggtcaaggaagaagcaagtagagtagggttcagtgtagaccagaacaaatgcaacaacctgcttgttagggtttttctttgtaaaaccaggattgcattaggaaggcatcagatggtgggagcacaaaccagacgtgcacagctccagcaggacttggtgtgattggtttcaattgaagcagacacaaagccccttccagagtgagatgccttgaactatgtagtggcttacatacctggaagtgtaggatgtatcctgccactgtctacaatctacacctcaaaacacatcagaagaattcctatgagtggccttgaaagaaagcatgtctggggtgtaagacttcaactcttagcaacgtgctctagcttagcacaatagcaagggcaggctaccccaggtgagagagggacaaagagactgaagaaggcagagctctcagcaaagtttaacaaacccaaagggaagagaatggtttattacttattgcaaacatcaccacccataatttccataatttccctacttgttctatgcaagagtcatcattaatgggtattattctgagacaaaattccattgttttaatttttactattgatcactagtaatgccatgttttccatctataatttacttgttattcttcttttttgaactatgcacttatgttcttgggctttttctgaagttattcatatataatttctttctggactcataatcatttcttatccattggtgttagtatttatgtttttggtgaagcctagtgatgactgtatgtgttctgcctt

SEQ ID NO: 20000 - DNA, 1167 bp, Mus musculus
catctggacctccacctcctaaaggctgcacaactttaagatagcatcatgagctgagtagtaagagatcaaataggaacttgcggggaaacatttcacatctagcctataacacccaagtcagtgatagaagagctcatgaggggggagggggtcatgcatgcctgaaagcctccatctcccagatctggtattcctagtgctggcttcagggggacttggctatttttcctcctatttctcaatctccctccccagggtgctgtaacacagacctcacatccctagggcatggtgggacacaggacacagtttggaagccgtcgcttctccatgtccatgttgatgctgctatcggctgcagtgagtggcaggacttgggtagctgggatgcacggttcttctgggtggcttctctgctttattattagtcttgtggaaatgatttcgcaaggagcagtagaaggtgtaaattatgcttcattgggaatcatgaaaaaaattatgtctgcagctagagctacaaacgaggagctgtgtgagacacaggcagggttagcacccacacaggcagctgtgtgcccaattaccagtgagctacctgtctgttactctctgtcatttgtagggagaaggcaaacagccatgtttataggctgcaccccatgagagaaggctaacgggagtggtttgaaggtctctgacatcccaggagcaggtacaggctctcctttaacccggtccttagcaacattctcttatatgactactggaccaaggacctcaggctgcaggcagccatcaacagtgtcctccctgtgttttcatcttatccttaaaatgtcttcttatggcctgaagtgtcaacgccttctcgtctgggccttgtgcagacacggtccctgagcaaatgtcacctggcctccctgctccccagtctcctcttctgtactgggaagatccagaccacttgagagctttgtgcttgtctcagtggttggtccgtctaaaggctcttcccttcacgcttacctgggcatcatggtacacttgtggcctgagtgtctctacctggccctcagtgtggagtgctgaagcactggggcctttaggaggtagagcttgatgggatgttgttaggctattgggggtgctaaccttggaaag

SEQ ID NO: 20001 - DNA, 1178 bp, Mus musculus
gtgtgtgtgtgtgtgtgtgtgtgtgtgtgtgtgctttctgtatgcttcaggtttatctctctgtgttaggatttcattccctttgacttctgaatgatgttccagttggggtgtctaggctgcattccgtctaatcactcatcagttgatgcgtttattgggtcatctctactttttggcctttaggaatgacacagctgtggacatatgctttcaatcctcttagacaaatacctggagtggaactgctggatcatatggtaagggtgtgtaacctgtgaggacttgccaggctgctttccaagaccgctgtaccatttgatatccacagcaggggtctaggaggcttccaactcctccacagccttgccaatatttgttattatctgtgtttcttcaccattgctgttgctagtgggtgtggcatgtcatccattttggttttgctttcccacgaagactcatggtgatgggtattatcttacgggcttgttggacattcacatgtcttccttcaaaaaagttctattcagagcctttgccaataaaaatatttctttattcattcattgatttgcttgttcatctatctgtctgtctgtctgtctgtctgtctgctgtgtgtgtgttgtggggggaggggttggtgtctaaggaggccagaagaagacatggatcctttggaactggagttacaggtggttgtgaactgctgagatgatcaaacccatgtcctctagaggggcaattgctgagccacctctccagctccaaataatgtctatatcaaggaacctagtgagtctatctcccccctccctcttttgagacagggtctcactatgtattgctagctgacctgaaacttattgtgtagatcatgctggccttgaactcatgaagatccacctgcttctgactcctgagtgttggggttaaagcatgacaggcatgcttttgccaatttgtaaaatttgggttaaaaaaaaaatgaatgtcttcagaattgagttgtaagtaatctttatatactgaagataaaagtcatttttcagaggggcagagagatggcttggcagttaaaaacatcttctgctcctataaaggacataagcttgcttcccagcacccacagggtgggtctccactgtctgtaatgtcacttctaggagatctga

SEQ ID NO: 20002 - DNA, 1161 bp, Mus musculus
cagctgtgtgcatgttcaaagacttcaggggtggagtctcacaaagtcttgtttgacacatgcccccccccccgcccctcaacactgtcgcacccttgaccagcactcctctgtgctgacttcaggccctgtgtgacaacagtaagagctgggttttgttattctctagaatggctccagctgtgggtgtgcacaatgagggaggaactgctttcccccttactgtcattggtcagtggagcagattctcatggctgtaggtagttgctacacaggaagcgaaggaactttggggagtcacaaggtgagtgggtaggggggtgaagaattctagctggaaacttgtacgggggtgaggggggacattttttctcatctttcccacagatgactctgtatttgacctgtctatcttctccaagggcaaaaatcctctaaatgccactcacatctttcagtctcacaatgcacatcacggatagcttactaatcttggaccttctggcagcccatccacagaaccatctctcatggttgttagcaagatgcctaacacactcaagcaaactaagcactgtcactttcctttctgaaccatctcagccaaaaaggccaccatgaggacatctcaccaacctgtgctcagcatgaactgtgacatcagcctttgatagtaggacattatttcttgatttccttattaaaagaaaaaaatgggtgctagtggtaatttgctttgtggcttagcaacctagtttgtgagtgatggtcaagctccaagtcttgtcatacacagggggttgggtatcacagtgtagctcatgactttgttccctcaccccacccccaatccaaaaggttcagagtcccccgagatgacacttcctccagcataaccccagttggctgacgtgagcctattccatctgaggccattctctctttggttcctttctaatctatccacacatgcctttcccttctttgatcccctcccttccattgttcattcatgaagagttttgttagagacaagcaatctgtaatccctcacctgaagaccgcagactgcagctctgtcatgcgaggaagcgctcaagtgtcctgtgcgaacccctcgcctcttcctgagatagacttggctctccctcttggatactc

SEQ ID NO: 20003 - DNA, 1411 bp, Mus musculus
aatttattgaacattggcccttgggtatagcttgacccttcccagaatctgttttgccatctgccatttgagggtgcttgttctaaacagcctttgagggttttaccccctgtgtctcttccctccccattgcctatttgcaccctatgcatgtggtcatatgtaagctggatcatctccacagctgtgaccagaaatcctcacgaagggcacatttctaggtagacccaaatggaactaaatcatgtcacaagctgagagaattactgagttcctctcaggacccctgaagaagctataagtcagtaccagtagcttcagggtctgtcgtaggagcgaggacaactgtaaacacagggtccgctgatcaagtccttcttgctcattgcagtttgatttgccagcagtcatactgagactagcttgatcctacacctgttagacagtggcagagataggcccaagctaagtggaggccaggccaggctgagggtggggccctctgggacctagtcctctaagctgtctttgttagatactgctgagtgaaaggtggaccgagaaggctcttgtgaagctccaggtagacgggaatgttcctcggttcaggtgagagccagatctagagagtcagaacccgggggtcttgagataggaggcaaagcagctatggaagggcttttgctggttaatcatttctgaggtgaaagaccttcttctcagggggcaggctccaccaggaatggaggatcaatcgctgtaatattctagtgttgagtgtagctcttggggtctgaactatggaggcttggttggggaatgtggatgcccttagatccttttctgggtgataatagggatgtgggccttttgtgtttaaggagagtttctaatagggctgtgctggtagagtgtgaagggccagagtcacagtatggcaccgaggcagaagggaagagctgagactggccctgccctgcttctcagtctgttccacatcctaaggtcacaccctgtcaggacttcttcgtactcacctgtcccttcctgcagcttccttgacagacaggttcttggacccaggcaccaacattccaagggacaccagccaacctgggtgagggcccgactctgtatgtcttcccttccctgggggggggggggggcgggaagagatgtccgaagcattcccttgcaacccgagcacatcagcgaaccccacgaaagtggaattttctaacaaaataaacttgctcatttggtccgttttctgtaacttttgctaaacactttatacatttttaatgttgaaaagcagtgtctcctgccagaactcctcacccaggatgaatgtgtttactccacgctgtatatctttccatgctccggctgcctggaccagtaaataaaa

SEQ ID NO: 20004 - DNA, 1154 bp, Mus musculus
tgacttactgctgcagaataattggtttctgtttgcaaagaacattatcacagcaaagcccagaaaacagaaaggcctgtctgtgagagggtttctgaggctaggttggaaggcggctgcagggggaaggagggagggatgtgaaaaatcacatttcctagaaggcaattagctaataattaattttttagcatgctcccatcgcggacttgtccttgtgtgatatatagacagggatgccggcttcctgctgcatcctttgattcctcgtggaaatgttaatgagactaaagcagttaaggagctctttagacaacacggtgctgtggggaaggccggaatgaaattcagaccctctgaggacttctctgacacacaagaagtccctttgtttcctgttttataaaccagaggcatgtctaaaattgcggggaaagtgagagggggctgaggcctggcgccggggcctggctttctatatttaaaaagaggaaaaattgttcgctagttatccgtgcctgggtttgataggcagtctagggtgtttttgaagttctgagggaagggtctctgaagatgtaagcgggatctgtctttcacttagacttaattaagaaacttgctggctttgtctgtagggggcccattacgcacaagctgcagccccctctgaataggggctcagcctggaaagtgtatacaagccaggccgcctttgtgttgtgttgccaaactggaggcaggagcaagtgggagcctggctctgccagaggccagcctgttgttcatacatgtgaaccaggtcccaaccaacgctgcagcaagtgtctgcccattccctgggggacctagaactaacgaaccttttaggaaagaaacatcaagaggctgaggggagagagggttggccttattctccggtgtccctttttagtcctggtgatgggccacagagctaaacagtatcagcagccagagctaggagtgtaagccagaggtggccagggcctggtagtggtgcggcagtctcagccacccacccccatcacttgatcctccagcccagggcacaattttgcctggtcactgttcttgtaaccctgagaataatttccccctggtgggctactgtggcctgccctatttagaacaaa

SEQ ID NO: 20005 - DNA, 3700 bp, Mus musculus
aagagcagcctggtgatccagtggcgggacacatgggcacggcggctgcgcaagttccagcaacgggagaagaagggcaagtgcaagaaggcctagcgcggaggtggcgcgggctccaggagggcgggcagggcgctggcaaaggctggcagccttggacttggccgtcaggggtttttttgggagggtgggggcggggcgaagtcgaagtggggcggggccctcagcggctccgccccagccccaccctcacacccctggctgcgctcttatgcgcatggcagaaagcaccctgtattgacaggccaggccctggagaaatgaggacaagacatagctacctcacggcgctccttccagaacagagatgcgcttccctagggctaggtgggggtcgccgtggaggggttagggaggtcctgagaggcgggaacagaatggcacagtggtctacagtcgctgtgtttgatggttattgaagggggatgtaagaactgtgaatttttgggcctgcagcctgggcaggggcaaccaatccaccaccagacactagtcacgcccccctcctttctccatcacccgctgtctaggaattcccacaggactccagactctgacaacaggtccctatgttagagggcccgatgacactgggatcagccagctttggtctccactgccacctgctgggctggtctcctgggtggagttcaccatctgtagggaggggagagttctcctggggcctgctctactccagtggggctggcccaggctcctggcccatcagagggcctagggcctaaggaccctgaagtcaagccgggtggtcactgcctctgctggagctgcctgtggaaggaggcattgcaaaccaaaacctcccagagagtttccttgctggaaacttggaaacagccctttttatgacattttccaggggagggggaggggtactggcgggggtttagggcagtgacactatttgtgtaatgacatcagctcccacaaggcctcacagcaatgtcaacagctggagagggcctggttaagtctggaatgccagcggctgtctaggcagtttgaaccaggcttgggggaaggggcttgcctgagtcagggtagggtcgctgctcagcaaggtgcctggcgtccaagctggagggcaaggccaggaatggtcaggttcttggggtccaagcattctgtgactgcttcctgctgccgccctcactgctggctccccagaaaagggacatagactccttggttaagaaacccactctagctcccagctgtcttggtctagcctgggcagtctggtctattcctttctggctgccttctttgtggaggtccccaggccctcctgtatgcctagctctcttttctcttagagacttaatgtcctcacgcaggcagctccaagcttcccttctggttgcttcccaggcccctttagcctttccctgcctccctgtactcgggcctctagcctcgcgccccgcacactggatgagaggcctggccctctcagtcaggaaattggtttcatttctcctgcccacttggctgccctgaagggccatatgagggatgaagctcagcccctcagtgacacggctccctctgcttctccacttctgcccacatcaccactgccacttactgagcaccctcttggtgccaggcactttacccatatgctcctggcctgttttcaccacaaacctgcgaggcagggattcactcttgtcttcgtgttcaccagtaaaaagacatgtccacgtgcccaaggtcacaccagcaccggtactcagactctgacctcaccacagttgcacatcagcagttagccctcttgacactcccacagtaggcgagggttgggtgggatagtggttaccactgagacccaggcagcttgtctctagagaactctgaggatatgagcctggagtatggtctgggacagacccagcaacacctcctgaggaggcatcgggagtggcggggaatgaggaatggactccctagtggaaagccgcaagatccaggaagacaggcatggccatctgagagggcctggagaggtggcttagctgcttccctagccggaggaagactaaggcttcagagggaggctggcatgagcacacagacctaccctggcaagggtcaggtggcttccctggtccaagcttgagattgagggcaaggtccactatccaggagagccagtatggtttgttgggtaccatctgtagcaaataacatccagctgtacagcaggggtctcatttctgtaccagcatgtctaatgctctggccagcttccacccttgaaccctggagtccagtctcacctggtatccagcgaagtctcttaactagacttcccccacgcccctgctaagcaacagagacgtcttgttagaaatctaccaaggcctcctgccctgccctctgtggcctgctcaatgggggctacattaaatagccaaaatgagccaagttgtggataaggtcattgctgagggagcagggtttgtcacagccaccacctctgtggaccagaatccagcccacctctcctctgcctgagagccagccttagggaggcagctgtctcctacccaccctagggaggagatggaaagggggaagaagacatcctctttgtacagttaggaaggggtgcaaaatggaagtaggtttttgagtttgagagtgtattaacagagttgtgatatgtaggtctttgaagaaaaccataccaggttagtcacttaccagtcaagatttcccagctgtccctttgcttaccatttgggtagtctggtcccctgtcaccagaatgcctcctttgctgacacacagtggcacaaaggtatgtggtgaaggtgatgacatgctcctaggtacagctgtgagctgtggtttctggccagagcttctgtcccagaaagcagggcaggaggcaggaccatccggctccttcagatgggagggagggtcagatgccaagggcaaagcctagggaggctggggtggcctctccgagggccttagggactttctagaactctgcctcagtggttacatacaggcagtgggtacaggctgtcttagaattgcccctgagctggaacaagactgaaatgaggagacccttcaggactgacctggggaatggttcctttagggtctcaacacttgaaggactccatccaggaaacctagagagtgggcaagataggctcactaatgggccgtggttcacagacagatattcctgtggaccagagccatgccataccccaggggtatcaaaattgtctttgtggggccttgcccctgccaaaaactaagccagcctcacctcttgtgtcagcggacttccttcccctttccctgatctgggtacacccccccggcctccctcctgtgtcaccgattctgctcacacagaattgtaaatgtttagttgtgaccatgacatattgtttgggccagtgttcctttccaatgcatactaatatattatggttattatatatgaatatatttaatgacatggagaaagttgtggattttctttctttttctttctttttttttttaaagtttttttgttgttagagttgtaatggacccagacggaacttgtaacgtgggccctacatgatagaactaaatc

SEQ ID NO: 20006 - DNA, 1199 bp, Mus musculus
ctccggggaactggattataaaacagctttatctgtggatgcacaaggatggatattttgtgagccggttttcttttttttccccctctttctttcagaagcgactaacatgccttgggttttctgtagcatcttttattatggggagacaagaggtcttggggtccttttgaaccgatgaagacttaagccttatacttaagagagtagcatgcagcgtttcgcctgtcttctagaagcctcggaaggccaagtgttggtttgggtggccctggaaccggcagtttagaccgtcattcacaggtggttgtcaggttgagtcctgaaggcagaccacaaacccccaccaagaaccaggcattgtccgaggtactctctgtgtgctttgttcaattaatcagattgccacaaggaacagaagcctttcaaaaacagatgttgctgccaccaaagggcagtttgtatacacagggaccaagtggggactcgtctgcagggcacattggagagagcagggggtatcagaggcatttgtttctgaggctgatcacataaaagccgtgtcctattataaatgactcccggggactgttgcactgaatggagctgggaagaagtgagctgcccaggccagtgtgctagacaggaacagagctgtctgctggcgtgagactggactgctgggtgggaatgaccttactactcccatgttcttaccctgatttcaaaatgtatctttattgtaaactcagaactaggtttcccatttctttgtttacttttggtttttgatacaaggtcaccccagggaacctgggcagcctgaaacttgtctgtaatctatgtgccttctgagtgctgggactgtaaacatgaaccagccacaaatggattagaaatacattttaatttgcttttgttcttttctttctttctttctttctttctttctttctttctttctttctttcttttttttttttttttgagctggttggtggtggcacatgtctttaatcccagcacttggaaggcagaggcagtttgaggccagcctgctctacagagggagtttcaggacagccaaggctacacaaagaaactctgtctcaaaaaacaataacaataacaacaacaacaaattttttttgtttaagtgtaagtgtgtgtgtgtgtgtgtgtgtgcgcgcgcgcgtgcg

SEQ ID NO: 20007 - DNA, 2205 bp, Mus musculus
ggggggggcggcacaggatgatggggtaggaaagctaccccccaaggccgtgacgccccagacggggtagaaggtggagagtgagccttgtttagaacccagcagcctcatgttcctgtgcatttctctcccaggcggggcggtccaatcagcttttcttcaagccgatctggccggcgccagctgcacattgagggggcatcgctagagctgtcagatgacgacacagaaagtaagaccagtgatgtcaatgacacacagccaccccaatcagaataggcacaggaggtcagaggtgatgctgaggacaggccagaactcatcccagcaccagtctgcttgagccctgcactcactgctcgggaatggcaagctcccagattccttccaggaaagtcaactgtgtcttaaggctttgcggcctgcgcagactatatcctgcttcagactagatacaattgcccctttttatatatacacctccacaagacatgcgtattaaacagattgtctcatcgttgcatctattttccatgtattcatcaagagaccattttatgacacattaagaagaaagaacctttttgaaacaaactccaggccctttgttgccagtggctgggcctaagggttgccccgggaccgtgctcagctgctctgcatgccctgtcctactgacaggtaccttagttctgtgttcatgtggccctgacccttccttcaaccacacctggtctcttagaacattgtgaacctaacctgcacttgtgtctctcatttcctgtgaatagtgatcactgtctcagtgagcaaactgggagaggggctttggcggcttaggggtgggtttggattggggaagcagcatccatttggggttctcctgcccatctcccaaggggtgaccctgcccctcaaattcatggtgtccccaccgtctcaatgtgaatagtctcagagctctgtgcacagagaggacagtggccacaacacataaggtgccccgggtggcagccatcacagtaacttccaggtggtctcctgagtgtctggcttgataatgccctcaattcaggagtgagcctctgtgacccttggggtgctcgcagaaggcctctccaagcagtcaagccctcttgcaaattcagccactgctttgagcccaaaacgggaatattagttttatgtcggaggtgtgttccaagtttgtcaatgaggctatagcctcaagaagatgccatctgcctgaatgttgacatgccagcgggcgtgtgacccttcattttccctttcccttcctttggacagtgttacaatgaacacttagcattctgtttttggttgatagttgagcaaactgacattacagaaagtgccttagacactacagtactaagacaatgttaaatatattatttgcctctataacaacttaatgtattaagttctgactgtgcttcatatcatgtacctctctagtgaagtagatgcgcaaacattcagtgacagcaaatcagtgttagtgacaagccccgaccgtggcgatgtgctggaaaacacggaccttttgggttaaaagctttaacatctgtgaggaagaactggtcacatgggtttggaatctttgatttcccctgtatgaattgtactggctgttgaccaccagacacctgactgcaaatatcttttcttgtattcccatatttctagacaatgatttttgtaagacaataaatttattcattatagatatttgcgcctgctctgtttacttggaggaaaaagcacccgttgagaacaaacagacctcaataaacaagaataatcatgtgaccatggactctgcttccgcaccttctgttcttggtttcccatctgtggtctgactggagggggaatcacacacctgaaccaagcacaccagggtgggggtctcccaaaaacagcaaacagccaacacctgaaggcaggggacaatgtacaagtgtttggcccagtcactgaagactagactaggttagaccatttttaaggaatcccagaagtttgggattgcatgtctgtaccagagaagtgtaggaaacaaatggggaggagccgctggctccccacaagcaacctttctggtatctactgtctgggattgtaaagaaaccctaggaagcatgaagtgagcacacacaccctaggtgtatttaggcctct

SEQ ID NO: 20008 - DNA, 1189 bp, Mus musculus
tggtcaccccacagggcagtaaatggctttgatccagctcctcctcctcctgggctgggctcctcacgcccatcgtcagcaccgggtatgctgcctctcagtgtgtgagtgcccggcctccaggtggggcccctgccctcttccagcagcccaggacacctacgcctcgtccctcggtgcctgggtccagccctgtgcccctctgtccgcctcttcaccgctggcagagggcaggctgcatgcagtggcggctgctgggccctgcccagccccaggactctgcgcgatatcaatactggctattttctcttctcgccgtagtgccgttggtttcacatgattgcacttttgtgggtcacaagtgatacatacgtgtattactcgatcactggatgtggaagtacccattcatcacatctgcctcatagcccccatctttgctgtgctgataggatttagttgtgtttaggacattgcagatcttctagaagtttcccctcaatcaggttgataagaccttctaagcttctgccaagcatcttcagtgctcacaatcatgtgtcccctagcctcacccctgcagttcaggcctgtttctgtcagagtcaggaacatctctgaattatggaacattgtctgtaccttctgactttatgtaagcagtccattccattgcttgtttctcaaagcagcgagatacctgtctgagctgcaggaggcaggggcagccgggacatgggcacttcagggccgagcctctgtgttgccttctcctctgtcctcagactcaggaggcaggtggcaatctcctcgccagcattccaggccctcagttcaatgacatctctcagagcatttttgttttctcctctgaaggtccatccagttgcattgggaagggttgaggggcctgattctggggctggctaatgccagctctcgggggcagactggctaggtgtttgtcccttgcaccctatgattattctcatgctgcacttactgtttacatttgttttattgtacataggtttgtaaacattattgcctaagatatttgtatataacttgggctttgtagcttttatttattcagactcatatggcatgttaattaatgacttacgatggtgtcctactctgggcagctgtataggatcatcatgtggttaaaagaagatacttccct

SEQ ID NO: 20009 - DNA, 1279 bp, Mus musculus
aaattaaagtcctgtgccacaatgcacgccccatgtaaggtgtcttttaatgtacatgagtacactgttgctctcttcagatactaccagaagagagcatctgatccaatcacagatggttgtgagccaccgtgtggtcactgggagttgaactcaggacctttaacagaaagaacattttctgtatgtaacattgtagtggtttttgggtttggtttttgctttccaccactagctcagttttcaaggaaaatgcagtggtcagttcttggtctctggtccttagtgcagcaagtgataagattagactagctggataaactctgagcttctgctccaaagctgcatcatcatttgtattttagaaagagacatttaggtatctactaccctgggttcagggaatggaaagtgggacctgtaattgggcctacgttgttgcttaaagcttagggctgcttctttttgtgcaggtcgttatcaccaggctaaagctggacaaggaccgcaagaagatcctggagaggaaagccaagtcccgacaagtaggaaaggagaagggcaaatacaaggaagaaacgatcgagaagatgcaggagtagagacatctcgtgcacggctttcattaaagactgcttaagtagtcctgtcttgtgtggtgttttccaagtaccttgttttctgtggcttactctgcttctgtgtcagtctttggggtctggaaaggacagccaccctcagatggtctgatagcactatgacaagttatgtggaatcaggagctatgatgaatttaaaccttggaatggcccttatttataggaatagccagttgaaaatattcctaatcgactggtacctggaaaggacccttaagagtcagttctcccaccttgtgagtcttacaggttgtttggtcttggaggctggtaccatctcatagggcctaaaatattgggagaaccctgacatttatttgtacctgtgtgtgtgcatctgtatatcaaatccctgcagtgtctacagaagccagaagagggcaccagatccccttgaattaaattgttgggtccccagacttgagcttagttcctctgaaggagcagctggccagctctccaactctggaaaaacatgtgttgtctcaccggagaaaacctggctgctgagatttcaatacagtgagaattttattactggtgataagattttatttccctgtgctaatgttggatcagtgctataactgagttgcaggcagcagtgggcacatcagaaa

SEQ ID NO: 20010 - DNA, 1279 bp, Mus musculus; identical to SEQ ID NO: 20009

SEQ ID NO: 20011 - DNA, 1315 bp, Mus musculus
ctaagccagacagaagaggggtccagtcgtcaggagaacgcccagaaggctctgggtgctgtgagcaaggtgggcaggagggaagctgcggagggaagaggtgccaagtgacagaggggaatgggagggaatatgctgcgatgggtgactggatgcttctcaccagatcattgagcgctgcagcgctgaggtggggcgcatgaagcagacggaagagctgatacggctcacccaaaggttgcgcttccacaaagtcaaggttagtccagcccagactctccatttagcctttactcaccatgctaccctgaggctagagcatctctctctctctctctctctctctctctctctctctctctctctccctccctccctccctccctccctccctccctctctctctctctctctctctcttttttttctttctcccaggctctacccctggtctcctggtcacggcgcctggaattgcagggggagctgaccgagctggggtgtcggagggggggtgtgctcttcacctcccgtccacgcttcactcccctctgcctactgctcttcagtgacctgctgcttatcactcagcccaagaggtgggtcctgcgtgggaggggagggagcctgaaccggagtggtgaagaggcatctagcaggacccctgctctcctctgaacgccctcttccctgggcagtgggcagcggctgcaggttctggactatgcccatcgctccctggtgcaggcccagcaggttcctgacccatctggaccccctactttccgcctctcgcttctcagcaaccaccagggccgccccacccacaggctactccaagcggcctcactgtgagtcacgtctatagaaagcactcttgggggctggggatgtggtttagttgtagagagcttgcctagagtgctgaggattcaatcctcagcagccaaagaaaacaaaccagtatggtagccttacctttattctctgagcactgggaagacagggatagatagggggaccatgaatttgaggccatcttgggcagcctcatcaaaacaagcaaacaagccactcttaggaccctcagactctgtattctatttcttttctctctgttgctcttacttaccaggagtgtatctcttaggccaaccatgaatcctccccaccccctctgttcaccactagatcagacatgcagcgctggctgggagccttccccaccccaggtccccttccctgttccccagacaccatctatgaggactgtggtaagcatctctcaaagggaggagggaacaaaatgtgagtc

SEQ ID NO: 20012 - DNA, 3262 bp, Mus musculus
ctgcggtgacctttaatccacaggccagggaagagctgggccgattccgaaggcggccggacaccttcagcctgggcgtgtgtaatggctgtcagctgctggctcttctgggctgggtgggaagtgatcccagtgaagagcaagctgagccaggccaggactcccagccaacacagccgggcctcctgctccgccacaatctgtctgggcggttcgagtcccgatgggccaccgtacgtgtggagccggggccagccctgatgctccgagggatggaaggctctgtgctgcccgtgtggagtgctcacggggaaggtcaggctgggaaggcaggggagggtttgcaagctggggctggggctgggcctgaaggaacttggccttcactctcttctccttcacttccaggctacatggcattttcttctcctgaactccaagccaagatcgaggccaagggcctggttcctctgcactgggcagacgatgatgggaaccccacagagcagtaccctctgaaccccaatggatctccagggggcatagctggtatctgttcccaagatggccgacacctggcactcatgccgcaccctgagcgggctgtaaggctttggcagtgggcatggcgaccctctccctttgatgttcttcccacctccccgtggctgcagctcttcatcaatgctaggaactggacccaggaggacagctgctgaggaggccgcatgaccaccctggcccacagctcaccctttgactccgttgccttctttccccattgctttcaggagtatcccatgtgatttccaaaagcatcttagcaagaaccaaaatgctgggatgacctcagctgcattgctcattttagccttgcccctgcaagagctgctttcagctcttgagtttaacatggatcttcagcaagcggctcaggctccgaggacagctgacaggcagaggggtgggcagagatttactggcagccctcccgggatcatcgccttgtgatccttcattctcttggttagagctctgagtgagctctcacatcctcgttttctttggctttgtgagatcggctttcagtctatagcccaggctggccctaaactcagaattcttttgcgttaccccgggtgagttgccaaggcgcttggcattggcttagggtctaggaataatgtacatcagtccctcccagcctctgcccagctgaaaagagcagctttccggatcccttttcagacatgcactgctagttgttaggaatcattgcttctgtccatgctcaaggcgctgacctgtgcctatctcagatcacattcctgattcttgcttctcttaatttagcagccaccttacagtagttgataccttccttcttagagcagagagccctggagcttgttttttgttgttttggcttttcaagacagggttgggtttttgtttttgtttttgttttttgggtttttttgttttgttttgtttttatgtgtgtatagccctggctgtcctggaacttatgttgtagaccggctggcctcgcactcagagatccatctgagtgctggggttaaggcatgtgcgactactgcctggccattcatttttcttcttgttgcttgatcagtagtggtgcctgacattggtactgacctaatggagtttgtagtcttttttttttttttttttttttttttttggtttggtttggtttcaggcaaggtctctctgtgtagccctggctgtcctggaactcactttgtagaccaggctggcctcgaactcagaaatccacctgcctctgcctcccgagtgctgggattaaaggcatgcgccaccacgcccggcttgtttgtagtcttaataggattgaaataataatagctccttagcttgtactgccaacctaaataggtgctgggtaacttatgtgtctatcataaagattaaggtatttgagaggtgtttcccagttaacaaagcaaagtttagtgataaactgtctatgattggttccaacttaaaatgaacagcaaggcgccctacccacccagctacatctgcctgtgaagatcctgcagtcacagatcacgtcttggtagtagctgttgtaccgacagccaccttcatcatccgttgcttcctacttacttgtacggtagactcgggtagccccctaagaagctcgatgtcatgattaaaggagtttccttataaaaacagactagcatgttggatttctaaatatttcagggtttgggggaatgcagaacacttgtgcttctgcagaagtagcaccccaagaaggtactaatggtgaataggtgttaagctgcaggttgtatgtccatctgagtattagaacacttgcctagtatctgtgtttcctgagtttgattcccgtccagcaccaccaaaggaagatatttggagatgggaagtcagatctttctccgttttgcattgcaaagtaacttttcctaactagagtgattctaaggattttgtttgtattttcgagacccatatgatgttctggctggctttgaactcatagctgagagtaatcttgaaatcctggtcttctaccaagtgctgtgttctgacctaagtaccattttggacatgtgaacattccctttgatgctgtggaagaatatatattttgcttatggtggtacatgccttttatcccaacacttaggagataggggcaggtggatctttgtaagttcaaggccagcctagtgagttccaggctagtcaggacactgtctcaaatttatatatttaaagtatttatgaaagtatttttgtaagcctgagtaggcaagatggcttagtgcagaagttttcaaccttcctaatgctgtaaccctgtaatacagttcctcatgttattgtgggcacaaccataaagttttggttgctattttataactgtagttttgctgctattaaaaatcataatgtaaatgtctgttttccgatggccttagaccccaagaggatcgtgacccacaggttgagaaccgctggcttagtgggtgggggtatttgctatcaagcttaatgctttgagttcagcccctggaactcacgtggtgacagggaagaaccaactctgcagttgtgatggcttacttgatgcgccatggcacatgcgcacaagcacacacacctgttagcacacatgtagacaggtgtgtggtacttgatgcgccatggcacatgtgcacaagcacacacctgt

SEQ ID NO: 20013 - DNA, 1178 bp, Mus musculus
ctgtcttgagctgccgtcccactttgctttcttaggtcatttgctttatgtgcctttgagccccgggcagcaccggctgggaggaacggctctagcccagtgtttctcccagcttggggagcaccctcctgatctagaccttcccgagaaccttgtgcgtgcctttcatatcacccaggggctgctgaaaggtgagcgtggccctggtacgtgggggcgggggggggggggtgaacaagtgagtgatgtgccttcaggccaaacccttctctcccgtgagtgcccgccttctcacactccctggctctctagatgctctggagccttaggcttgccctgagatggctgaatttttccttgttcctccagaatgccgtctttgctcaggccatgatgtcagcgatggggggcttgtcacctgccttctagagatggcctttgctgggaactgtgggatagaggtagatgtacctgcccctgggatccatggtgagttgcttgggctgtctcctctacttgtagattttctggtataaagaatgtggtatctctgaccctatctcctgagtcttggctgaatcctccatttctatcttcatgttctgaactttggccgtctacgacctctcatagtccctggtgcatcttccatgagctcctcctccagaacccatctcacccgagtcatccggactcacccctttttccagcattgcctgtgctgtttgcggaagagcccggtctggtgttggaggtacaggaggcagatgtggccggagtacggcagaggtacgagagtgctggcctacggtgtctggaactgggccacacaggcgaggctggaccccaggccatggtgaggaagccagggagaatgtagtgttaccgtgagcctgtcagcaaataccactcacggggacacactttctccttcatgggtctccccactgcaggcccgaatatcagtgaataaggctgtggtagtagaggagcctgttggggagttaagagccctctgggaggaaacaagtttccagctggacctactgcaggcagagccacgctgtgtgatagaggagaaacagggcctgaaggagcggacagggcccagctactacctgccgcccacctttcctgtggcctctgtgccctgtaaacctggtaagggagcgtgcaca

SEQ ID NO: 20014 - DNA, 1178 bp, Mus musculus; identical to SEQ ID NO: 20013

SEQ ID NO: 20015 - DNA, 1207 bp, Mus musculus
ttctttgttccatccttctctctgcctaggaagtcatacgaatattttccctgggcgggcaaatgtcctgaaagctgaactagctcccaagtgtactctagagccagcagcttacactcggagagcttgagtctccacttccgtggcttagggactgactgtaggacttaacgcatctcagtaagcactgtgccattgaacagcttttcttttgtaacatgatgtggctaagtttcccatactgggtttctgtatgggtctatgtacctgagtgcagcgccaatggaggcatcggggccccctagaactagagtctcaggcaggtgtgagcctgacatgggtacaaggaaccaaacttggaattatttctccatcttctgattaatttttgaaagcaggtgtccttggcatccagtctgaaaccagaggccagtggtgtgttgggtcgatagcagtgggcaagatctaccttcccaactgattcttgccaaggccttcagattataaccatctgactctttcctcaggctgaatttctcgactccagcatcgaccaacattgtttctgtgtgccaggcagccgggctgagggctgtggatcgggtagagaccacccgacgttaccgactttcggtaaggtgtgggcattgtggtaggagatcaagaggagcgagtgggccagagattagatcctgaactcgagcagagtcatgggagaagcagggggaaagctcttggcttttggcctgtcctgtatgcttaggaggtttggttgtttgctgcttgaaggtacctgtgaagggagaatcggccagcctgactaaccagacttatctgtgcatccttttagtctgaacaaagacgctgcatgggtctgagtgtgcatagctcagtggtgggaattcacctcctatatacaaaccctggccttgatctctgcactagaacagaaaagtggtgcaatgtggtagtagtgaggtgaatagcttggaggtccagagcgagtcctttttctcttttcttcagccttgtcttttgttttcttatgactggatcttcccaacaccagtttaccgaccaccctacagctgaaatggaagccatctctctggccgccttgcacgaccggatgacagagcagcactaccctgaccccatccagagcttctctcctcagagcattccagccccactcaagggctccatc

SEQ ID NO: 20016 - DNA, 1168 bp, Mus musculus
gggaagggcctttggccgatgggcagcattatggttaagggcgggggtctcatgtttaatgttacctccctctgcctaagccagatccctgctcagatggtgtggcaccgagtcctccggcctggcagggcctatgtactgacaaaattgcaagtaaccaagacccggattcacctttcctgtatttggacaaccattccatcttcaactctgaagcctctgagaccaggttatgtgcaagagctggagctggacttagagttctcgaaagctgaccttaaaccaccaccccagcccaccagctccaaagacagcagagggcaagaaggtcttgtccgggcttccaaagtcttgcattatttggtgagtgcaaggtactgatcttagaggttgtgacacctgcaatgtgagcctcctaaggaggaggaaatagtggcagcggacctctgtttcctgtgcagggaacagtcactgctgtgttgcatgagtctgccggcctctacattctagatgggcagctgattctctgcctcgcataccagaagatccatggcctcaggcgggttattcgaccaggggtctgtctggaggtatgtcagaaatcggatggcgatgagaagatgctcagttcatgggagatggtgggtgacctcggagagagtgggttttggtaggaaatgagataggcaacactggggagtttctcttggaacctatggtggagaaacagtagccatctccccaggggttaagctctgcccttgtcttgtcttgtcttgtcttgtcttgtcttgtcttgtcttgtcttgtcttgttccagacagggattttccaaagtttagttgttgtgagccacccatagtgggtactagaactgaacttgagtcctattcaagagtaatacttttcttttaactgctgagccatctctccagcctttaggtagttttttgtcttgtttgttttgagacagggtctcacttggaagccttggccaatctgagacttgctatgtaaactaagttggtctaaacctcaaatccccttcctctgatctggagtgctgcagttacaagcatgtttttttttttttgtttttgttttttttgttttagatcacagtagctcaaactggcctcaagcctctgtgtagccaaaaatggccctt

SEQ ID NO: 20017 - DNA, 1203 bp, Mus musculus
cgtgtcaggaacttggctttgtggcacacagaggaaggaaggttctggatggagcccacccgagtctctggccgttgagagcaaggatcagaaggtaagctgggactccaggttcctagggcctgacctcccatatgtaccctgtgttccacaccggagttcgatgctgtgctgtccttcctcataggtcttcctcatctttcttggctcttcagttcgatggtttccgttcttgtacccaaaccaagtctaccgactcgtggcttccggcccctcagtgagtgtgttcctcttgcacatcagaaagctagttgggttggactctggagcagacatgcgcgtgctgggtcccctaggtctcctggaataggcagaatttagggggactgaatcgtctgtctgtaaggacccctttcttcaccaggctctaggaagaagtcagcacgggaggacttaggcctaggcacatgctgaggcaattgtcttcatgtttcctagcagacaccagtgttcgagacagagggctcagctggcacctctcgacgtcctctggaactggctgactgtggatcttgcctcactgtccaagaggagtggaccctggagcttgggagctctcaggacatacctaatgtactggaggtccctagaacactgcccgagtcctcactggcccagctgctcggtgacaagtaagtattgtccattacctctggtcctcttggctgtgctctgctctgcgctggctgggctgagccagcagtgtgtgtgttctgtgtgatgtcagtgtgagagggggttctctttcagtctttcttgtcactgcaggaatagtcacaagtagtgtctcctactctctcgctcctcaccgaactgttgttattgttgagccagggtcttgtcttttggctggttttgaagttgctatgtagctgactttgattccgacccagctgagcagatgtcctcacagttaaggaaaagctttagcaataaaaggaaacaggaacagaaaatgcagggaagaaggtggcagtgtagagaaggacctgcgtgcactgcgtgcggtcggtagtaagtacagaggcgtggaacttcatagaagattctctaagcgagaacaagtgaaaatgtttcctgtgtgaaaaactctactggattgtgtttttattactaaaactgaatataagccagacatggtgg

SEQ ID NO: 20018 - DNA, 1183 bp, Mus musculus
tactctatatattttatttatatataattattattttctacctccccccagggtatctctgtgtaactctggctgaccaggaactcgctttgtagaccaggctagtctcgaagtcacgaatccacgtgcctcggcctcccgagtgctggggttaaaggcgtgcgccccaccaccgcccaatttaaatatttaattttttataactagaaaaaggagcgtgcacatcttgggacacagtttcaaactagtaaaaagaagcctcttaggccacaccttcgttctgtttcaatgactacatcacaaaaaacgtagccaatgagagtgggctgagtggcggctcagccaatggacctagagcgggagattcgaaagcgtccgggtcgcggggtaaaccggttctccgtgtgcgagcgcctagtggcgtaggctgcggctttgcggggaactgcgggggctgcagtggtccacggggctgatcgggttccgttgggcggatccacgtgcccgctatccgcctggaaggagaggtgcaggagtacccccgaccttggctgcgtgctgactcgcttccttctgcccgcccaggcttgcactccccggggatctgcctctgcatctcttgccttcgctgttgtttccctctctgtccagctcccctcccgctctcgccctggagaatggctcagaaggagaacgcctacccgtggccctacggctcaaagacggtaaggtcctggccacattccccgccccacgtcccccggaagaagagtccatgaagatagaggctggccttgcaaatggccggactctaagcgtttccgacgtgtgggcctcaagaatttgcttgcaaaactcagtctgatcacttgcagtcttaccgtagcagatgttgccaacctgaatctgagggcttccgtagagctgagcctgctcgtcacgtacaataatagttgggactgagcaaacatcatcgtgctttcgggtcgtgaatctcactctcgagtctgaaaaaattaactacacaggaaatagattatagaatagaaggttacggtttaaaaggttccgaatgatctaaatatttatgtacggccctgggtatgaaaccccagagcttccaagttttgatgtaccatccatactacactccagctttggaatgtatcgtactgagcggtgg

SEQ ID NO: 20019 - DNA, 1233 bp, Mus musculus
aggagactgcagcagacccaggcccaggtggatgaggtgagtgtgtgtgtgtgtctgtgtctgtgtctatgtctatgtatgtcaaagatgcaagatgatgggctggcaaataggtgtgggagcccatcttgggttgaaggtaaagacagtttatgcttgtgggtttggtcggagacctgcctcatcccctttctgtctccctgttagcatgcacttggaagggctgcaggatgaatcagttgagctagcctggggtgtgccagctggggcaggtgtgctctggtgataggcggatccaggccctatagatagagggtgttgctgagacatctgagcgctatggtagcggcatgaccctgatgtgtgctccttgcatgtcccctaggtgtgctaggcatgttctgtgtatgtccttggcatgttagcctggaaacatcggggtgcatgttccacttgtgccacgatgggcacatgttcaagaagtgccctccttgaggcatgccttggcacacccccctgcctcgtggacccctccctcaggtggtggacatcatgagggtgaatgtggacaaggtcctggagcgggaccagaagttgtcggagctggatgaccgtgcagatgccctccaggcaggggcctcccagtttgaaacaagtgcagccaagctcaagcgcaaatactggtggaaaaacctcaaggtaaaggggaggagatggggacaggttgggaggggcagtggggaagtagggtgtcactgtgtcattcacctccctctcactcttagatgatgatcatcttgggagtgatctgcgccatcatcctcatcatcatcatcggtgagtggggccagaggccagggcccctcccctggggaggtagaggctttccctggggagcctgggctttgaaggtcactaacctagtttttactctgcaaccaaaacacactttgctgctattggcagttctgactcatttagagcccaaaacttgagtgttgtatagccctgctttccctggttatgggtcaatccggttaagattttgggactaggaataccgggtggggtcctggtgttcgtctaggaaccctttgagcctaaaagctccatctggggattctaaaacgggagtaggagacaggaaagggtgaggtctcgaacaccaaccaccaggataccacttactccactgtttgaaagctaccgtcacatacccagtgcattaaaggt

SEQ ID NO: 20020 - DNA, 1195 bp, Mus musculus
ccaggctgctctggaccccaaggtttcctcctcccaacccctctagtctagtttgcttcccttaccccgtttcccacacctcttgtaccctcctctccctcccccagctggtgtgtaagtgtcttggagttcagtgtgttatgatggaccaataattctgccactcggggtctctccctacattcctgctccccagttttcatgtggggcactcaactgacattcccagggggtctcgctccctcccatctgcctgatctgctgcctcctcccatcaggagaactgggggccgaccacaatctggttctttgaggaggggtggctccagtgtgtgggggtcatcactgccttggggaggagtgggacaaaacagaatccccctaattcctgcctgaagtctctggcctcatccttgctagaggttcgactgaaaactttcctccccagtctggggggggggtattacccccatcactgcccagctcctctgactgcccccctgtattcagggtgggggtactagtcactgccaatatgtgttgggacttgctggaggatggggatcctcgtccttctccagggctgttgagcccagagagagagagtgtgagagagaaagcaagctatttccttgttgagtacaatgatagaggaaggatctaatctttttaaatggcacagttttagggatctgagggtacagccccttaacctgccttggggggggttgttccccaaactcttgccccccacacaccaggttttctgtgtggaggggaaccaaggagatctaaactgtggtgtgaaagggtaggagagatgctgggggtgggggtgcttgtgttttagacccccaatattatcccagtgtcccctgccttccttcttcccctgccccatgcccccaattctgtggcgcatccagattgtgaaaatgtacaataaacgtgtaatgagtaaccatatggtgtccaaaatctttttcttaatcagtaataagaatattggattttcagatatggagtggttgaaagattctttggtaagagctggctggcctgttgcaggaggccctgaccttgggccctggcaaagtgtaattcccgaagtggccacagggggcaccagcagacgagaatcagaagtatcactaaagaaagtacctgatgtctaagaggcaggtgaactctgcag

SEQ ID NO: 20021 - DNA, 1255 bp, Mus musculus
actgacccgaatttcttttgttgctgtatatttcaaacccgaaatgaggactcaccgaggcgctaaacgacattgtaaagaagcgaaacaaatggtcccaaagacacagagatttacaacaaaacaagtttatttagtgagatcaaatctgggaaccgagcaagtctgagcttggtagcttacgcaagaagcagcccgagctttgcactgctggggagctcaaatttcgttagtctccctctctgtttctcgcacctgcatccacccttcctgtcacctagctcatgcgctttccatacactacatttcattccgctgacctgaggctgtcacctctagctcctatgacgctccgccccatctccttgcacacggacacacacacactctctctctctcacacacacactctctctctctctctcactcacactctctctctctctctctctctctctctctctctctctctctctctgtctctctgtctctctgtctctctgtctctctctctgtctctctctctctccctcccacgctacccctttttttcctatactggtgtccgtaagccggaaggaggcgccgcccgccatgtggctctgtggcgcaatggatagcgcattggacttctagtgacgagaaagcgattcaaaggttgtgggttcgaatcccaccagagtcggttttattactcattttaatcttttcttggcttttaaaaaatttaaagacccacaaataaagttcagctccaacctcagtctgtcgctccgctctttacttacctgtctcccccagggcttgggccgtggagagcaggcctaaaggtgggagaagggtatgggcaagtaggcgtggcgccaatataaaggcaggcccctggctaggggacacaccgggatttaataacgattttattccatgcactagggactcgggaagggactgggactggactagggtagagagagtacaatgctacacacagggaagtgggacagggaaaagggatgggaaaatatatatttatatagatactctaatatagaccacatctcacccgcgcgctgagcccgcgcgccccgctgccctcctcgcccggatccctctcctgccctctgactggagtctctacaccacccccaatccccgccccagcccccaaaagctcagggccaaggtctccaaaacgcgggcggtgggagtgacggggccttgggcgccccgtcttgtctgtaaggcggtggcggtg

SEQ ID NO: 20022 - DNA, 1126 bp, Mus musculus
ttgtctcggtttcagcacccggctgcttgggccttttgctttggagcctgtggcaccgtcatagtggatcaaagtgctccctgttctcagtatacccctcccacagcccttaacctaaatcctaacagttctgttcctcctccaaagcaccataacctgggaaccaagcaggcaacacatggctttaggggacatttaagatcctaaccataatagaaccaaccccagagtctccaaagccagagtgtccacggagcaaagagagactgacacactgaggtcagggcccacgagaacccctgggcagttcagaatattatcctgatcctaaagataacagagcagtatctgttttggttaaaaatgaaattgaggttggttttgtttttgttttttttggtttttttttgttgttgttgttgttttgtttttttttttgttttgttttttttgagacagggtttctctatatagccctggctatcctggagctcactttgtagaccaggctggcctcgaactcagaaatccgcctgcctctgcctcccgagtgctgggaaattgaggtgagggggaggagggctgaaaagatgactgagcagtgaaggtacacgctgtgcttataaaggaccccattctcttctgagggtcttcaggcagctcacaccccaccactccactccctgggggagcatctgacaccctctttttgcctcagcaggcacctccatgagcatgtatgcacacacaacaaacagaaggacacacacacacagggacagacataattttaagtaaaataatttaaaactttttcatcctcctgtgggttggctgggagtccctctgttctttcacttggtctccttcatgtgtctgtattcactgagcaggttgacagagcaagaatattccagacatcttcattaggatgtcaggcactcagcactcgcctccagtgcttgtgtctaaccctacttccttctgtggtggtctcagggcatccttccagcaggcagatgtgcactgctgtggccttctgtggtggtctcagggcatccttccagcaggcagatgtgcactgctgtggccttctgtggtggtctcaggcatccttccagcaggc

SEQ ID NO: 20023 - DNA, 1112 bp, Mus musculus
agcctcccaggcctttcttgtagtatcacctccacctcctgccaaagtgggggattagccttgcccggcctttaggaacttctatgagatcatcaaagaggaggggaaccttgttacaaagatgaaaatagcgggaggaggaagggaaggggggggggctgcatggcacttttcctccctcttccaaatggagggtacaacagctacaagtgagagagagcgagctgattgctgttcactggctcggttacctcctgtgtgtcagcatcttgcagtaggaactgttctcctccccagggaccaaggaccaccccacagagtaagggttgggtgattctccctcaagccaaagaggagctccccagcctgttctaggtgacctagaaagggtggggggaacacagagggccaggcatggggcagacccccacgctggggctcaggtttctaggggacgaaatcctccctcttcaaggcctggatacagactaaatttgagtaggtcaggccagggacctagtcaggagcctgtcttgcctgtgggaccgagcaacacagtggatatcaggctagggagattcgggcacattccccctccaaggaggggccagggagtggcagtttgcatggggaacccccatatcctccttgccgcctttcccagtctttctctcccactcctggtctgtcccaatcccttcttctgtatcaggttatcggttgtacatataaattatactttcctttctgcgtgctgtcatttttgcctggggaggggaattttttgtgtggaggtaaagtaaggatgactgctttgtactgtttcatcttaataggttccctgggggccccttgcattgttgttgttttttgttttgttttttttttttgagacagggtttctctgtgtagccctggctgtcctgaaactcactttgtagaccaggctggcctcaaactcagaaatccgcctgcctctgcctcccaagtgctgggattaaaggcgtgcgccaccaccgcccagctactaatcccttttctactttgtgacttttctgcatttttatctcttgaatcattcaccagaataagacctttttccagtattaagc

SEQ ID NO: 20024 - DNA, 1099 bp, Mus musculus
gggagtctggattggggtgggagaggcaagcagtggtggccagatgtcagggtggaaaaatctctgctttcccctcttactaggctgtttgtgtgattatagtgagatgcatgaagttggacagctttatagaggaaatgggtttatttgggttcatggttttagaggttccaggtcagcagctgcatctggggggtgactttcttgcttgcagagtccttgcttgcattgtcacatggtgaaatgcagagagcatgcatgtagatcctcccctctctcttcttaagagccaccaggcttcaactatggggtctcgccccatgaccttatctagccctggttatcttctttaagccccacctgtgagcactgaggttggattccgttcctgccagtttattactttaccctgggcgttaagtttcaacatgtgaccctttagagagtacttaggtcacagccaaaccatagcactgcgccttcactcacagctactccagctccaagtgagaagggagatggtgtgaggacaccgctggacaaggatgacactgagaaccaggaagagaagccagagaagaacagcaaagtgggggaaaagatggaggcagaggtgtgtgcacacctggttctctctgaggagatggagtggaaagtctggagggatcttggcatcagggtgcctaggaactctctagctcaccttgactcttctgtcctccaccaggtcgattctcccagcccagccccatcactgggagaacggctagaacacaggaaaattctcttagaggatgaagcaccaggggtacctggagagacagagcctgaacctggatacagaggagacagggagaagtctggtgggtgtattataccactgatgatggggatttgagttttggggttccctcttctgcacttggggtgagagtaacagcctctcttcatatcttctgactcttcccacagcctcagagccaacaccaggagaaaggggggaggagaagccattggatgtacaggaacacagggagaggacggagggggaaacaggggatttgggcaagagaggtaatgggtggaaggcctggatgcc

SEQ ID NO: 20025 - DNA, 1680 bp, Mus musculus
cgatggtggtatcacgggcgccctcaggcaggaggccattgatcgcttcaatggtgaggaggaaatacggtgctatctagggacatggagggcctgagaacacctgccgtgtccttaggatgggagacggggcggggacgctggaaacttagactagcagttagaatgtagtggttgatagagcatccagcaaccaggggtaaactcggcctcttacttctcacatcccagcccctggtgcccaacagttctgcttcctcctgtccacccgagctggtggcctgggcatcaacttggccactgctgacactgtcatcatcttcgattctgactggaacccccataatgacatccaggtgggaacctgcatcctgcatcccctgtaacattcagcaagttgacatgggttcttgaaggacgttgtcctgctcagggatgggtcttagagagaagacctttcccgaccctgtgtcagcttctgtcactctcctggctgacctccgttttctcctgcccctgtaggccttcagcagagcccatcggattggccaggccaacaaagtgatgatttaccggtttgtgacccgagcctctgtggaagaacgaatcacacaggtggctaagagaaagatgatgctgacacacctagtggtgcggccaggcctgggctccaaggctggctccatgtccaagcaggagctggacgacatcctcaaatttggcaccgaggagctattcaaagatgaaaatgagggtgaggtagtccctgggaacccccaccctccaaaaaaaaaaaaaagctctcaaaaaacaacccccccaaaccctcaaaaaaccaaacttctctcagcctgtaaagggcaaatcccttcttcctaatagtgctgagagaagggacagccacctaaggaaataaggcaaaagacactaagatgtgggcccccagggagcagtctcttcctccagggcccagtgagggagaaggaaaggcatctcacccatcccagctacactgtgcttgagtttctggccaacacctcaggtcctcttctgtctctgccaggagagaataaggaggaggatagcagtgtgatccactatgacaatgaagccatcgctcgactgctggaccgtaaccaggatgcgactgaggacacggatgtgcagaacatgaacgaatacctcagctccttcaaggtggcacagtatgtcgtgcgtgaagaagacaaggtgagaggcttggggaccacaccctatctccaaggccatctctgaagggcagtgagtgcctttcactactttttgaagtaggagtgttctcttgcactcatatttttgatttatcctctcatcctggtccccagcaaaaagcagcagtgtacctcagacagtttatcattttgatagatgagactggactttggaaaggcacctagacacagaaagttcttgtggtcacagactggtgcttctgagtctatgggagtgagcaaggggagcgaggggaggcttagaggaggagccagaacactgcaaggaagaggtggtaggaagaatgtgcagcgtccagaaactgcatgctgggtccgaaagcttcaggcaggatttggccagtgcaggagacagggattgggatgcagccctgggacgagttgggaaggaggctgccagacttccctc

SEQ ID NO: 20026 - DNA, 1185 bp, Mus musculus
ggagaggaggaagttgacggctacgagacggatcaccaggattactgtgaggtgtgccagcagggcggggaaattattctgtgcgacacctgcccccgtgcctaccacctcgtctgccttgaccccgagcttgaccgggctcctgagggcaagtggagctgcccccactgtgtgagtacctgctgccctcactgccctgcctgcctcttttcctcttgctttctgctgtggttttctgggcctctcagcagtactcaagtgcctaggatcctaactgggtcctttctttaaccccttactcccagagtcattaagtttgaaaagtcggagtatcctgggtggtaggtcccaggagacttatgcacatctggggctcagtcgtcctggttttcctgtctctccttctcttcttctgtctgtgtctgactgcatctgacctcctaggagaaggagggggtgcagtgggaggccaaggaggaggaggaagagtatgaggaggaaggggaggagggagagaaggaggaagaggatgaccacatggagtactgccgagtgtgcaaggacggcggggagctcctgtgctgtgacgcttgcatctcctcctaccacatccattgtctgaaccccccactgcctgacattcccaatggcgaatggctgtgcccacgatgcacagtaagtggaatcacatcctcccagcgccaccgttcacccatttctgaggcccagataccaaccagctcgtccttcctcagccccgaccctgtgctgtacctttgtcctacctaacaaagggctctcttcccctccttctttcccctttctctaatgcaccatcctgaagtgtcctgtgctgaagggccgtgttcagaagatcttgcattggcgatggggggagccacctgtggcagtgccagcaccgcagcaggcagacgggaacccagacgtcccaccccctcgtcctcttcaaggcagatcagagcgagagttctttgtcaagtgggtgggactgtcctactggcactgttcctgggccaaggagcttcaggtacaaaggcttttcctttgcctcggcctcggctccagctcccaggcacccgctctgtcctctgggtatccagctccttcgtcatcctaggagttagaggctgtttcttctctctccctctgtgccccaacagctgg

SEQ ID NO: 20027 - DNA, 1174 bp, Mus musculus
tagaatcagaccctatctcaaagaaggaaggaagaaaggaaggaaggcaaaaaggatctttacacccaaaaagaaacattacacccaggtgtggtgccgtagacctacagtacctagctacttaggaagccgacctgaatgctcaggtttggaacacccaggtagcacagtgagaccttgtttctgagcaagcagggaaccttagctgactctccccccttataactgtcctttctactcactgactcctgtcacttgacactgttagagggactgtggaaccagctgttgaccaacagtttcctggccacaatagagataggaaaagctctgctgagccagttctgcagtgtgctctctgctggaacctgctgctacgctgctctctggccctttcagcaagtttagtaatttcatcatttcctggacaaggtctctcttctccctctccctacctccccccttccccgcccccaacagggtttctctgtgtagccctggaactcactctgtagaccaggctggactcaaactcagagatctgcctgcctctgctctgcgtctcttccttccttcctttctgtcttctctctctctctctttcttctctctctctctctcttgcatatgcatatgtgtatgttcacaggcatatgacacagcatagggaggaaggatcagaggacagcttttgggaatcagttttcctatcatgtaagtcctgggggttgaatttaggtcaccaagttgtcataaaagttaccttacctgctgggcagtggtggcgcacgcctttaatcccagcacttgggatgcagaggcaggcagatttctgagttcgaggccagcctggtctacagattgagttccagggctacacagagaaaccctgtctcaaaaaaaaaaaaaaaaaaaagaccttacctcactggcccctgattatctgtaatgttataatattctacatagtacattttagttttgttaaatgtataagaaatgtctttacggcttttttcatcgtagcttaaacctcctcacacacgatcaggaaagcatttgctgcatctcattcttgttcatttaaaactatttttctaatttcaagtggaagggttgctatcaaccactgagcccctctccaacccctaaaccatttttttagatagaattt

SEQ ID NO: 20028 - DNA, 1065 bp, Mus musculus
gtggggctcaaactccggatttcagcgatttcttaatctgctgatgctgaagtcgttcacttagtcccatgcaacctaagagtccataaattgtttggatccatcaatcgtgatatttagtaagctcataaatgatcttatttaaactatttgagagccaaagccgtttcttccatgacatcctgagggaatgctctggggtgtgctcatttgaccaagcttgtctcttttccaggacatcccacttgtagattattttcctgggatggggtgggggtgtgtctcatgtcgggggtgtgtgactcattatgtagccctggctcgccaggactcagaggtcacttgcctgttcacaacttcttgttagacacacactcctttccctgtatacccaagcactcatcagctccatctctttggaatccgtccttttgtctaacagaataaccatctttggtactgggaaacttcctgatgcccattttctacttctgccttcacaaacttaagtatcttactttctgcctcggatcttcagtgggtttctcgtgcttttggaataaagccctaaattcaagaagccttgcgcaagtcaggccctgccttcctcgccccctcacagtccttgtcctgcaagccgtgaggtctcctcctgcctcagttagcagagaagctgttctcagcccaccacacccttctgctttgcaccttgagaatcctaactagtcagttttttttctttgtcttttttggccccactttagcagtatgcattttctctatgttcttattatcactttaaaactgtgtagacagagccgggcagtggtggagcacgcctttaatcccagcactcaggaggcagaggcaggcagatttctgagttcaaggccagcctggtctacagagtgagttccaggataggcagggctacacagagaaaccttgccttgaaaaaacaaaaaaacaaacaaaaacaaaacccacaaaaaacaaactgtgtagactgggtgaaaatggctggctggctgctagattgtaagctcatgagggcagaaacctcat

SEQ ID NO: 20029 - DNA, 4727 bp, Mus musculus
agcggtgaacatacggtggaggtccgtacccaagtacagcagccctcagacgagaactgggacctgacaggtaccagacaaatctggccctgtgagagctcccgttcccacaccaccatcgctaaatacgcacagtaccaggcctcgtccttccaggagtcactgcaggtgaggatcaggcacaagagggagtaagggtgctgggcttactgggtcagggcttcaggaagtcactgacccacgtacctgtgtgaccaagcaggaggagagggagagtgaggatgaggaatccgaggaaccagacagcactacaggaacctctcccaggtgaagtacaagtttgtccctccctgcttctctctctctcctcccttggctcgccatcaacctgtctgtgatttttgccccagcagcagtgcaccggaccccaagaaccatcacatcatcaagtttggcactaacatcgacctgtctgatgccaagaggtcagtgaggctagaccagtgaaactgggatgcaaccctgctaggtactggtctgggacaccctcttaatttcgtcggcattcctgtgtccacaggtggaagccacagctacaggagctgctgaaactgcccgccttcatgcgggtaacatccacaggcaacatgctcagccacgtgggccacaccatcctgggcatgaacaccgtgcagctatacatgaaggtccctggcagccgaacgccaggtgtgctttccactgcgcatgcgtactgtgctggctgcgcgcactcttaggccttagccaatgagggcaaagggcgtggttgtcgctccttgctcgcctgcatcagaccttctgtgacgttctatctccctctgcaggccaccaagagaataacaatttctgctcagtcaacatcaacattggccctggggactgcgagtggttcgcggtacatgagcactattgggagaccatcagcgccttctgcgaccggtgcgcatcaccccttgcaagtcaccctatcacctcgggtccttgggtttcccacctgaccctgtgactgccctctccacaggcatggtgtggactacttgactggttcctggtggccaatcttggatgacctctatgcgtccaatattcctgtttaccgcttcgtgcagcgccctggagaccttgtgtggattaatgcagggactgtacattgggtgcaggctaccggctggtgcaacaacattgcctggaacgtggggcccctcaccggtaagaggctggggtcgggtcatcatggggtacgtatgaggagcgaaccctggaggggaaaactgggtctggagaatcagagtctgagggaagaaggggccgggggctggttgagacccctgcatgacttcctctggcctacagcctatcagtaccagctggccctggagcgatatgagtggaacgaggtgaagaacgtcaagtccattgtgcccatgattcatgtgtcctggaacgtcgctcgaacggtcaagatcagcgatcctgacttgttcaagatgatcaagtgagacccctgtttggttaccagcccgtcccacctggcttgttccccacccttgttcttcctggctccccattcttcccctgcgtctgcagcatgtccttaagaccttaagtgtcactgtgctggggacatgacagaagccctgctctcatctcatagccgttgtttcctgtggtccaaacacacacacaaaaccttgaaatgtcaagtgtgacatattcaagacgggaaatgcaactcagaaacgaaaagaaagggagggttgcccagggaagtccgtggggctagggtctctggagctccacccctgcccatctgccatcctccagccttggcaccccgctggagccttgtctcaacacccaccctttgggtcttgctcaggttctgcctcctgcagtcaatgaagcactgtcaggtacagcgggagagcctggtgcgggcagggaagaagatcgcttaccaaggccgtgtcaaagacgagcctgcctactactgcaacgaatgcgacgtaagtgtgcaagctcttccccctgcctggaagagacctaacagtagtagtgacttcttagtgacagccgctttctcctggccaggtggaggtgttcaacatcctgttcgttacaagtgagaatggcagccgaaacacgtacctggtgcactgcgagggctgtgcgcgccgtcgcagcgcgggcctacagggcgtggtggtgctagagcagtaccgcacggaggagctggcgcaggcctacgatgccttcacactggtgagagcgagcgcctgggctccagagggggcgcgggagcggccggtccccatccgcccaccactgaagctgcccactttctccccgcaggctcccgccagcacgtctcgatgaggccggacgccccgctcgcccgcccacgctgggcgcggcggggccaccagcacacgcctgggctggacctaggtcccgcctctggccgggaagggggtcgggcccagcccttccaccctattggcagctcccctcacttaatttattaagaaaaaaaaaatgttttttttttaacaaatacgaggaaaaaaaaaggaaaaaaaatgggagacggggagggggctggcagcctctcgcccaccagcgcctcccctcaccgactttggcctttctagcaacagacacaaggaccaggctccggcggcggcgggggtcacatacgggttccctcaagcctgcccgccgcgcgcccgcccgccgcccgccggcgcagacgttcgcggctcgttgtgtacatagacgttcggcagccgaggtttttaatgagattctctctatgggctttacccctacccctggacctcctttttttttttttttttttttttttttttacttccaatgctagctgtgatccctgtatatgtctcttgtttattcacttggttatgattcgtatttttgttctttttgttttttggtttttaatttataacagtcccactcacctctatttattcattttttttttctctttttttgggaaaacccgacctcttacatccccaagccatccctcctgcctctttgggaggcccactcctgggccttccctgcgccccagtatgtccgggcttggcccgtctgtctccgcccgcccgcggctccagccgggctctcatggtgctcaaacctgctcccctcccctacgtcctgcactttcttggaccagtacccccactcccgacccaaccccgaccccacctgagggtgagcgactcctgtactgtaggggaagaagtgggaactgaaatggtattttgtaaaaaaaataaataaataaaataaaaagttttaaagaactatgaggaaaagaaaccctgtcctccccagcctcggccattttaaaaacattggacacacacacacacacacacacacacaccttttttaaggcgtgaaacatcccagggcagggcctctctggggcagggacaccctggggtgattttctctggggctttattttcattttcttagttcggtttttttcccccccgctggggctgcggaggggtgggggggtttacagtcccgccccctcgcactgcactgtctctctgccccaggggcagaggggggcttcccattcctaccctattttcggtgatttttgtgtgagaatattattaaaaataaaagcaggaaaaaaaaaaaagagacccttgtgttttgatgatggctgtgaagcatatcagttgaagggtcgaggagctaaggggagggcgatgcagcctccggaggtggggagcccctcctcagaggagcctgtggaatgtccagacccacagtctgccccttaggatggggatgcctaatcccagagccgcattccaggataaggtagtggggggcggggtgcagagagactgccccgggggaggggcaggaaagagggctataaggactgcagtcgtgtggggcgggaaccaaccaggccatggcggaggtccccggagcccagcgccccgttctcgctggcggcccagagcctcgggatcccctagattgctgggcctgtgcagtgctagtaacggctcagaatctgctggtggctgttttcaatctcctcttgctggcactggtgctggggaccatcttgctacctgctgtcatcatgttaggcttcggctttctctgccactcccaggtaagcataccaaggggtatgcgtgagtggtgtgtgggcggcgggggtgggggggtgtctgagccactgcatccccacttgggctgtttcctcctgggcagagtggcccattctgatgtctcttatccgcacagtttctgcgctctcaggcacccctttgcacctcgcatctgcgggacccaggcttcacagccctgttggtcactggattcctactgctcgtgccgttgcttgtccttgccctggctacctaccgccgcctctgcctgcgcctccgcctggccgactgcctcgtgccctacagccgagccctctacaggcgccggcgcatcccacagccgaagcaaatcccagtctcaccaggttctcggtctgttcccacaccgggaaaggtctgggtctgaggtgcttagagtcaagaatcctgtcgattgccctcctggtctctcaaggacttgaaacaagcccaggggtgtactgcccaagccggttccttacc

SEQ ID NO: 20030 - DNA, 4727 bp, Mus musculus; identical to SEQ ID NO: 20029

SEQ ID NO: 20031 - DNA, 1134 bp, Mus musculus
gtcagcacagagccaaggtcctgcctcccctggagcaagtctggaatttgctgcaccttgaggtgagtgaggctgagtaagtgactgagagaagggggtcacatgcagctggctatgctcatgccaccatggctctctctttttttttttagcacaaacggaactatggggctaagcgagggggccctccagtgaagagatctgctgaaccccccgtggtccagcctatgcctcctgcagccctctcaggcccctcaggagaggagggccttagccctggaggcaagcgcaggagaggctgcagctctgaacaggtagggaggttgtacatgggtcagcaggcagagtggatgccctggggcaaggagtaggattttcactttctcttctcttctaggctggccttcccccaggtctgccactccctccaccacccccacccccaccgcctccaccaccaccaccaccccctccaccaccaccgctgcctggcctggctattagccccccatttcagctgactaagccagggctgtggaataccctgcatggagatgcttggggccccgagcgcaagggttcagcgccgccagagcgccaggtgagccccttgtcagtacctgttaccttttccccttgtgaattctgtctttcccttgctcactgtaacctcgatcatctcccttaggagcagcggcactcgatgcctcattcatatccatacccagctcccgcctactccgctcatccgcccagccatcggctggtccccaacacaccccttggtccaggtccccgacccccaggagcagagagccatggctgcctgcctgccacccgtccccccggaagtgaccttagagagagcagagttcagaggtcgcggatggactccagcgtttcaccagcagcatctaccgcctgcgtgccttacgccccttcccggccccctggcctccccggcaccagcagcagcagcagcagcagcagtagcagtaacaacactggtcttcggggtgtggagccaagcccaggcattgtatgttatgacattgggctgaaggtgggtgacattgtctgaggggccacaatagcacactgacctcccctttctccacttgcagcctggcgctg

SEQ ID NO: 20032 - DNA, 1446 bp, Mus musculus
cactctcagtcttagcttgctgttactgccctgagggctaccagtttctgatcagagatgtggaccctaggtgggaaccttggggtcacatcggggtcaccctagggtgagcttgtctgaccggccctgccgcccctcctcctgaggccgctcagtgcccggctaaccttactcctattggttcctgctaggctgttactgaggcggagacaagggtgatgattggctttctgtggatagagaagtcttgtgattggctaaatttctgaagctcttgaagctgtgagaggacgctcccacggaggctgggtaagcaggcgcgcggtaggtcgccctagtggcccaggattgggagcctgtcaaacagtgcagtggctgggttgttaaccgtcgctgactccccgctatttgtgccatattcctattacccacttgcgcgattctaggggctcttgatgctgatgtctgtcctggcgccttgccctcagtcttcctgcactgacagttcagatcagcctttgggccctcgctgtgttggcaacttcagtacactcttttcttctctctgtagaattggttgcagaaggccagagactgtcacctggaaacagtgggcactattgttaagggcagttggagctggaccatcgtgccagagagctggggcagggggccgtgccccatctccagggctcctggggccactgctgacctggtaagggaaagattggaacaggtttggctgaaaacatggctgaaggtttttgcttccctgttagagcatgatctcttgtcgctgatttaggctggatgcatcgggcagtggaccctccaggggcccgctctgcacgggaagcctttgcccttgggggcttgagctgtgctggggcttggagctcctgcccaccccatcctcctccccgaagctcatggctgcccggaggcaggtgagaatgtggctttatctccaggcatttctctcccagtcttctctgtccattgctgtcattttccacgagtttctgttctgttgtgggtccagatgccagtctcatctgctcttccctctgactactccattctagggggaagcgtgattctggcagtacctaacagagcctttctctttacagatgctctgccagcgttgggcagcccccactctcagctcctttacccccatctcatggcagtagctccgggcaccctaacaaaccctattatgctcctgggtaagtgggggattccaaagttctaggattggagggaaattggggccttaaaggtttccccaagcctgatgatccccaattccttccactctgtaggacacccaccccaagaccccttcacgggaagttggaatccctacatggctgtgtccaggcattgctccgggagccagcgcagccagggttgtgggaacagcttggacagttgtatgaa

SEQ ID NO: 20033 - DNA, 1182 bp, Mus musculus
cctgtccagaagggtccagcctctagcatcttttctccagaaggtcctagccaatccagttttctcagctcgctgctgaccactgttccttaagggccttgcttaggtcagaaataacacttccctgggggcagtgtcatcagcaggcacaaaagcttgcagtgcattgcatcatggaggccagaggcctaagtctctggggcagggggaaagatgggggctggaaggccaggaaatggagaggccaggtagagagcccgtgtgtctgggtcctggagaaaacactggtccccaaggagtgagtctgaggtgagggttgactgaggcctaactcctgctatcaacacctgagtcttggccctagacttgtagtaatatacctagctctttgtatctaaggattaggagggaagagagtgggcccctgtcacctccttgggccacatggaggaaggaggtgatggggaaacaggatatggttttggaggtgacatggagggagcctgctgcagaggctacttcctagctcaggcccagtcacagctcttgcggaggaagaaggctcctccctgttgggcccgttcatcttgtctgaccacctgtgccgcttgccagaacctgcctacaccagcctaagggaactggaagggtcagagtccaaaaggtggtgttgactatctggtgtcttgttagggttggaggtagcagaactgaaggcctagggtccacatgccctgggggcaggaactaaggttgcttgacagtagatgtcccctgtagctgggcctgagccagaatatcagtctagtcagaaaagggcgacgtgggttggtactgaggtgccaccctatgcttccttactacctgaaccaggctgcttcctaaaggaaaggttggaagatggcttttttccaggttgccatggaaaccgaatctcccatctcatctgacctctagagcctggtttctcaatgagggggaccaggaaggaagggaactcctctatcttgggagatcccatctctaactgaaattgttttcttttaggttcccccaggcaccatgtcagcctcatagcaggacccaccccacgacttctgctgtagcccataggacccaccccacttctgctgtaacccactgctggagtgcttgttccatgagacagtccacttccaactc

SEQ ID NO: 20034 - DNA, 1174 bp, Mus musculus
gaactcaggacattcagaggagcagtcagtgctcttgaccactgagccatctctctagcccgttgcaggcagttcttacaatcagaaagaaacattgaaacccctttaactccctgagtctcacattgcatgtttgcaaattctgaccatgtaaggattaaatagagcatgcacagaaactgcccagcacacaggaactactcagtgcacacaagttccaacctctagccaacctgttagctgtcttgtctgatggaaagttctggccaaaagtcatgacactgtcgctcaggtcccccatgcaccccctatttcgggtgccacctttgctactaaagcattttcgggaagggtgtgttgggctgtggtctagtggcctgggacacctctcttgctgtagtgacgctgcctctctctcccgctccacagagtggagcctggggctgctttgacgagtttaaccgcatcaacattgaggtgttgtccgtggtggcccagcagatcctgtccatcctatctgccttgactgccaacctcacacgtttctattttgagggctttgaaataaatctggtgtggtcttgtgggatcttcatcaccatgaatcctggtaggtgggaggaacgcggtgacactgggcgagggggcaggagaagcaggcgtctgggataagtattgtgtcctttttccctctctgcaccaaagcctttatctaagaagtatttaactaaagatgactgtgttcatctgtggtctattaatgtgccaaaatccccaaggagtatttagcttaaaggaggaaaggggagctttggttccatggtctctgccatggacaactgttggcgagggcaaggcaggctgtcctggtggtcagggagaatagggcggctccggatgaccagggagaaaagaggcggagggagggagagagggagggataggcatagatgggagaaggaaggacaaagagagagacagaaaggagggagacatttgttggttcatgggtttactccagtgattgacttctttcaagtaggccacaccttctaaagtttctgtagcttttggtctgtgagacatcctctgatgaggtccagaccctcgttatctaatcacttccagcaggctccgcctctggacctgctgcttgaggaacaaagcctttaag

SEQ ID NO: 20035 - DNA, 1150 bp, Mus musculus
tcacctgtagtgaggtagggagcgacttcacctggatcctgtgtcttcccccaggccggctctgagtataccaccatccactacaagtacatgtgtaatagctcctgcatggggggcatgaaccgccgacctatccttaccatcatcacactggaagactccaggtaggaaggcgcgtggtaggttaggttagcctgtttcttccccagcttctgcctgtttctgttccacgagtcccgccccctaccacatgcccaacgctctttggttcctaccctatctacctaaatgaagtctcctcctctgtttcctcttgggcttagggacgtctcttatctgtggcttctcggggttcctgtaactggacctttggctgcagatatgacaagaggggttgggaacaggtgggggcctagtttacacacagtcaggatggggcccagctttcttactgccttgtgctggtccttttcttgtcccggatagtgggaaccttctgggacgggacagctttgaggttcgtgtttgtgcctgccctgggagagaccgccgtacagaagaagaaaatttccgcaaaaaggaagtcctttgccctgaactgcccccagggagcgcaaagagaggtacgcaggcgggaccaaggaggcggaggagcctgttgagcttcaccccaaagtcacctcttgctctctccttccacagcgctgcccacctgcacaagcgcctctcccccgcaaaagaaaaaaccacttgatggagagtatttcaccctcaaggtaccaaggctggagagtcgcatgccagagacaagctgtacccattattgcctctgtctctcgcatgtataaaatagtgttattagcaggttgccaggtctttttcagtggctttatctctagccgtgacattagcttgagagctcatgctctgaggctgtgcctcctccgacagtggttctcagtgtaactaacttgacaacaccaacttacaccataagacaggtgctcctccactggggatgggaacatgtcctaggaaactcaccataaattgaaaataacacacgacaaaaatgtgtttagaggcaggcctggtggcacctgcctgtaattacagcactgaagagggtggttcaaagctggcaagaaaa

SEQ ID NO: 20036 - DNA, 1410 bp, Mus musculus
caccctacgagaactgacttcttgactttttaggctctgttaaggggtatgagggacaaggtatggtgtcatgctcctataatctcagcagtaaggaagacaaagtcaggaggatttggggaagtttgaagccttcataaactatataaaactttaggccagctagggctagctacaatagcaagaccctgtctcatggtgatggtgatgatggtggtggtggtgacagttgtgataataatggcagtggtggtgatgatgatggtggtggtgatgatggtgatggtgaaagggaggataaactgattctcagaagtattccagtgtgttctgtgaatatccctacccatagtagaagccatcttaaattcctttttttcagcctccagcctagagccttccaagccttgatcaaggaggaaagcccaaactgctagctcccatcacttcatccctccccttttctgtcttcctatagctacctgaagaccaagaagggccagtctacttcccgccataaaaaaacaatggtcaagaaagtggggcctgactcagactgactgcctctgcatcccgtccccatcaccagcctccccctctccttgctgtcttatgacttcagggctgagacacaatcctcccggtcccttctgctgccttttttaccttgtagctagggctcagccccctctctgagtagtggttcctggcccaagttggggaataggttgatagttgtcaggtctctgctggcccagcgaaattctatccagccagttgttggaccctggcacctacaatgaaatctcaccctaccccacaccctgtaagattctatcttgggccctcatagggtccatatcctccagggcctactttccttccattctgcaaagcctgtctgcatttatccaccccccaccctgtctccctcttttttttttttttacccctttttatatatcaatttcctattttacaataaaattttgttatcacttatatggttttgagaggttgatatcagcataagctgtctgggcccccaggggcaggatgaatttgggaggtacccacctgagtccaggcagtctgttggagtcaggggtggggaacttgggttccagaagaggaacaaagccggggactgggtcagtctgtgggctgcatgacaacaagagagcagggtgactccattcataacttgggaaccaactgtccctcctccctcctgccaggactggcacatggtccttacccacccctacttctagggttgggctcctgctgtcctctggggagcctctcaccaaggattaagggatttaaatgtctgatatagcaaacctgagcctctggagtgaccatctgctccacaagaaaggatcagggtgcctgggttccacaggg

SEQ ID NO: 20037 - DNA, 1831 bp, Mus musculus
ttcttgggaaagacgccaaggtaccagaggcttacgtttttttcttctcctggcccaggtaaactatactcagcctttggtggctgtaaagttcctgaatgtgacccccaacgtggaggtgaatgttgaatgccgcatcaacgctgccaatattgccacagacgatgagcgggacaagttcgctggccgtgtggccttcaaactccggatcaacaaaacctgaggctccccacccccacccgcccacactctcctgtggatgcttctggaatgtccttgaccctgcctgatccctccctcacccaccccaaaggtattttttataatagagctatgacttgtctgagcctcacaccctttcctcaacttctctacctagcctgatgcccacacaatttccaacatcttccaaccttagcttagccagagacagagaggagtcgggagttttctagttcgggaaccggagttgtcactcagcgacagaggacttgcctagcaagcacgagggcctcagcattgttggaggttttctagtttgagtttatgaatgagatgcccttacagctcctgtttcagtttctactcccatccccttagaggtacaggaaatggtctcatccacccagcctctaccccacagatccctcgaacccgtttcagccacttgcttcccaggggtgaacactgtccttcttccttttacaaggttctagccactttcctttcatctcttcacacttctgtcaccatagccagtatcttggtggctttgacttctggttcctccagcagttctgccctctcctctccctgatccctctccctctgaaaagctgccatttgtagctcagtacaagttggttctgtggccttttccgtccttcctgatacatcctgcttctcccccaactgtgactccaaaggatgactggaagagaagtctttaattcttctagaaaattctctagtaggcttagacttttaacttcttcctggtccctcctgtcatccaaacggctcctactcaggcgggcttgacctgctctgaatatccactttgttttttaactgatggctcccttcccccactggccttcccagaatatctttcaaattctccttcccagggagctctgtgggggaggggccgctgtcttggctctatccccagcagccaccttggaaacgtcagctggctggggggactccctaagcccagatctacccacccccatcctctctctggctactccttgcaagttgctaactggtcactaaggtcttccctttctgcatgccagcctgaaagcgtcagacaccctcctccagctcagctctgagtttctttgctccgcctccttcaaactcttttgcctttaaaaaacaaacaaacaaacaaacaaccctatgacatccctagaatgttgcgaaagagccccctgctccaagttttcgtccatcagagcagcatattcctctagtctctctgcttctctttaatcctttccaatctcctcttcaccgcagcccccacgtcccaccctcaagtggctccttccctctttcctcccgctggatctgtgtctcttccctttgggtatccaggtcttcctgccccttcatcttcccagtggtctccttctgcagttatttaatgcctgtgtcagatctactgtaaaaagagggtaaagtacaataaactgagagcgattatatatataaatgtatatcatacacagagccctgtgtgtgcttgtctttttctgagaatttggaagagctctgagaaacaactggagggtggatttgggtgatactgggttatgca

SEQ ID NO: 20038 - DNA, 1212 bp, Mus musculus
gggcgagagacagacagacagacagacagatcttgctacctgagtcctctgaggtgataagaatttggctgagagtgctgcgcagttaccaggttgcatccagatccttgtgctctgagacggctctaacttcgagttccgatacggcaggaacagatgctgccttttcaggaccgtgcagggttgagaagttggaaatgcattagccgcagaatgacagtggcctattcttggagttgtcacaacaactacagtttaggtctcttgtggcctccaaaaggtcagacttcactgtgccccaggaggagtctgggagtcagggctggagctggaccctgcctgtttccagcttgtttcctttagctcccaggggaaggctctaagatatcctgtcgctccttggcctatccccgtacacagcttgagaggaaggaggaagagaggggttggtggaagatgtgggagctgctgactctagttcctctatcctagccttcatcctcctcttctacctcgtcttctatggtttcctcacggccatgttcagcctcaccatgtgggtaatgctgcagaccgtctctgaccatacccccaagtaccaggatcgactggccacaccaggtgagagaagagtagttttccccttaccggtcactggaactactgtgtccttaaggcctcacaaggaacgtatagttctttccaggagttggagtggggagttcttgaacttggccttccttcccatgccctgcagccgggagtcatgtgatttggagacgtggcagatgccacaggagattgctctcccaggaaggcagtttcagatctttgcccccacctgaccctggtgttcttcatatctgtccatttcccttgatgtgtttctcttcatcttatgtgactctctagtcttctctcctgttggctctaggcttgatgattcgacccaagactgagaaccttgatgtcattgtcaacattagtgacactgaaagctggggtcagcatgttcagaagctcaacaagttcttggaacgtgagtgtggggctagtccaggaccttgggggaaggaatccaggaccctggaagtgagacatttggcctctgaccttctctgtctgcctcccacctcctagcttacaacgactccatccaagcacagaagaatgatgtctgccgtccagggcgatattatgagcaacctgata

SEQ ID NO: 20039 - DNA, 2322 bp, Mus musculus
gaaggagaagacagtggccacctgactccccagcctcttccttttgtttcactagtgctaaaggatccagacagcaatccttacagcctcttggacacatctgaaccagagcctccagttgattcggagcctggtgaacctcctccagcaagtgcccgtcgtcgccgttcccgccgccgccgtactgatgaagacaggactgtcatggacggaggcctggagtctgatggtcctaacatgacagagaatggcctgggtgaggggctagcctggagaattcttagaggtgtgattaagaatgaagtatggccgggcgtggtgttgcacgcctttattcccagcacttgggaggcagaggcaggcagatttttgagttcgaggccagcctggtctacagagcaagttccaggacagccagggctatacagagaaaccctgtctggaaaaaccaaaaaaaaaaaaaaaatgaagtatgagagggtgggtgaatgactcttctttactccacagaagatgaatcaagaccccagagacgaaatcgcagccgccgccgccgtaatcgtggtaaccggactgatgggtccatcagtggagaccgccaaccaggtcagctgacatacagaattggagcctttctggaactaagatgaaatgtctcattggctgggaaaccagggttggattcattgggaaccatgaaatcccgaagttcctgaaagtcttgatcctgtgtctttcctagtgactgtggctgactatatctcacgggcagagtctcagagccgccagcggcccctggaacgcacgaaaccctcagaggattctctttcaggacagaaggtaggcaatcaagatacagcctaccccactttgttgttgttgtttgtttgtttgtttggggcagggacacagaaaactttgcaaagaaagttgaattgactgtatgtgatggagttcaggctaagctgagggtagagcagagccggcacaaacagaagacagggctggtggtgattgagcacaggggggtgagggacctggcctccacgtgtgtctgtagtgagaaggaaggcgtgcctgcatctgctgtactcatcagctgcttcctttttgttttcctcctgcttcctctgtagggtgactctgtcagcaagcttcccaagggcccctcagagaatggggagctctctgcccccttggagttgggtagtttggtgaatggagtttcataaaacctccggtccacatccctcctttctccatctcgcttgctgcccaccaccatggccctcatgggtccaactgacctgcgctggagctgctcttatctacgggggaggggggtggcacagcagcttgggtcccccccaacctccaggagctagtggaggggtgtgtaacagggtcatacccctccctcttgtccaccctacccccagggtgagggagcctccccttccctttcagactggatgtgcctttatcctctaatgccccgacctctgaacacccccattctccgcctgttggtgggggtgctccttgacccacccagatttgacagttcaggggggctcccctgctatccctcctcccatcctgtaccccccatttctggggcctcatcactgtggaagacggggatagtgagggtattcgtgggtgggaggcatggggaaggttttggaatagaaccaggggtatgtatgaaggggggtgacaaggtctcccaggggagttgggaggaaataaccttgtctggtggatgagaaggcgtatttatttttcactgtacagtatttaaaaagagaataaaaaaatccaaatggccttgtgtttcccatgttgcctttgtccccagtctgggctgtttaaatctctagggctgaccggcattggtccctggctctcgttctatagcctttattatcagctcctcgttctgtgtcaggaagatgatattctgggaatggctgcatccttaattctccgtggccagaggaccgtgcttcagaccttgctgtttcttccctcccttggttgttgagagttgggccactcctgagccctgagtcacaggaggataggccaggctccgtgaagctggagctgttcctggtagaagctgagagtctgagcaggctgtttaatccgattatctggggcctggggcacaggctgggccttcagcagagaggaaaatagggtttcctcaccatagcctctagaactcaggagggcaggttgtatttctggcctggtgtcactctagctctagaatccatgtcactgacctcagcttttaggggcctcaagggtaaa

SEQ ID NO: 20040 - DNA, 1399 bp, Mus musculus
aagtatcaatgtctcctctagttgcttcaggcagccactaactaccgcaacggacacacaggccagctttcagccattacagtgtttatgctgtttgggggctccttggcccgaatcttcacttctgttcaggtgagtgcaccttctgcccactagagggcactaaaacctcattctctgctgagtcttggaacttttctagatctgtgctctctcataacaggaaactggagaccccctcatggctggagtctttgtggtctcttctctctgcaatggcctcattgctgcccaggtcctcttctactggaacgcaaaggctccccacaaacagaaaaaggagcaatagagctgagctcgcttctagaacaattccatttccactcatcctcagagtcctccccacatgacttgatctgcgggtgcagtgtaagcaccctccattcctctaactgcagcctcctgagccagggttgtgggagcagtaaagcttgtgtaggccctgccttcactcactcacttccccagatccctccttgtgagcagctggtttactggagcagatgctctggccctgtccacttaccttccttttggaccaaggacagagcctagaaaactgtggttggaagctagtggctgcttccctgtgctgcccgggtgggatggtctattggagcccagttctgggggtgagggagagtgactcagataagggccctggggttgggtggggaggttcctgccgaggcaggtcctggcggaagggtgtgtgaaggcgctggttgctgctgtagggagagaatacaaatgggacaataaaagactccgaaacatggttttaattgtacaaaattgtgtttagtgtgcattctggttccttggagatctgtaggggtctgtggggttggccctgggcgtccctgccagttaaaggtgggttactggcatgggggctccagcaagggaagtattatatggagtggaagagtctggggataggtaaggggagaaagagggtcttagctccccctggagcctgggatcactctgagggaaggtgcatggtaagggggcctccggtctgcagtgggaagagctgtaaaaagaaacatggggtctggaggttagtcttcttgaatcgattgggcagtgtcctcaactcttcgtgggggactggtctgaccagtttgcagcagacagggttagagcttgccattcagccagccttgctgggtacagcaggcatggaatgggaccctagggtgacttaaagaacaaggtagttctgttggggcatgctcagcaggcggcttgcgtgctgcacggctgtttgcctcctggggcagcaggccaggaaggagcaacaggatgggcttggtctctccttgcccccagg

SEQ ID NO: 20041 - DNA, 1207 bp, Mus musculus
atttattgattcaggaaacaaacacaaaattctgaataaaattacttggaaactgcctgtttgggcttcttgtttctttcccttccctcctacctgctagtgtggatcacctgcccccatactagttgattactgaatttgccatgttgcttcctgcaataccaaatgacccacattactaacatttggtaatttgcctcagtgttaggcacaagacatgagtgaaacttgctgcattaagacttaaactggctgggtatggtggcgcaagcctttaatcccagcattctgccggaggcagaagcaggtggatttctgagttcgaggctagcctggtctacaaaagtgagttccaggacagccaaggctacacaaaatacctgtcttgaaaaaccaaaaaaaaaaaattcaactggttggttaggcctagcccagatgatgtaggtgtcaactcaccttggggatgtagggagatggttgttctgtagctcttcctgtcctgcaactaaataaataggctaagctgacctcttacatctgccttcggcctcctgtgctaggattggagtgcatgggtggggttgcatttcttaccaatgaggaaagggcttcccatttctctgctgcattgtaagctcccaagtagagcaagttttgcttaggtaagttccgtgtgagtcagctgcctcattctcacgaggtaaccaaggctttgtaccgcccactgagaacgtcactgccaatcacagcctaattgtgaaaaccaatggcttgagtgggttgctaaagctgaggtgtctgagtcaggtttggggtgggattattttagttaagggaagtgaggcttttcatttcctcttccaagagaaggcaaaggggattggattgaggaaggaactggtgtagcctagctggtctgagcatctctgccatgcggctccctgtgtgtctgatcttgctaggaccgcttataggtaaggagaaatgggaggtgggggagggagggctcatgggcaggagcctgcacctgggtggccaaccaatctcttactgaaagcccaaggaacagaggaagactgtcctcacaaaaaggccgttactctcctgccatccttcacgatgacacctacagccacagaaagcacagccagccctacgaccagccacaggcccaccaccaccagtcacggaaatgtcacagttcaca

SEQ ID NO: 20042 - DNA, 1207 bp, Mus musculus; identical to SEQ ID NO: 20041

SEQ ID NO: 20043 - DNA, 1219 bp, Mus musculus
atcacacacattgttggtataaggctatgttcataatcccagcctttggatttggaatgtggtagtagggtggagagtgatttctaagcctttgtagagctggcctggtgtttttttacaaggctgcatgtaggggtggggaaattactgtgaacctgtgtggtgggattcagcactgccatttgtggttgtagtgctgggattgagagagaattacgtgggtaccgcccgagttaatgtagatgttcttctgcattcagatacaaaaggtggttatggcattaggagactacatgggtgcctcttgtcatgcctgcattgggggcaccaatgtgcgtgctgaggtgcagaagctgcagatggaagctccccatatcatcgtgggtacccctggccgggtgtttgacatgcttaaccggagatacctgtgtgagtaccatgtaacagttggtgggcattcccacatgtcattttcttggatgcaagttttcctttagtttagaactgagttgctctgtgatgaaccccatgcgtgtcatctgagcctggcttccctgttgttaccttagcccaggtagtgttctacttaccagggcttttgcctggcttatcagggaagctttgggcaaaggatcagtccttgtattctgagagcagacatctgccctttgactgccctcttaccaagagatttccatgtatttcacatttgtctgatcactatgtgttggtgttttttcttctgccttctagcccccaaatacatcaagatgttcgtactggatgaagcagatgaaatgttaagccgagggttcaaggatcagatctatgacatattccagaagctcaacagcaacacacaggtggacaaatggcgaggttgataggacacaaggggcttggttgtgatctgaggaatgtacagtgccctcatcatggctgctgttttccccattaggtagttttgttgtctgctacaatgccttctgatgtccttgaggtgaccaagaaatttatgagagaccctattcggattcttgtcaagaaggaagaattgaccctggagggtatccgccaattctacatcaatgtggaacgagaggtgaggcccagtgcaggaggcagacctggtagtaagttgttgagtgtaacccctgacttctgaatctccaggagtggaagcttgacacattgtgtgacttgtatgagacgctgacca

SEQ ID NO: 20044 - DNA, 1210 bp, Mus musculus
acccaagtacaccccaactagtccttcctacagtcccagctcaccagagtacaccccagcttctcccaaatactcacctacaagccctaaatattcacccacttctcccaagtattctcctaccagccccacttactcacctaccaccccaaaatattctccaacctccccgacatactcaccaacctctccagtctataccccgacctctcccaagtactccccaaccagccctacctactcgcccacttctcccaagtactcgcccaccagtcccacctactcacccacctctcccaagggctccacctactctcccacttctcctggctactcacccactagccccacctacagcctcaccagcccagccatcagcccagatgacagcgatgaggagaactgagcgaacagggcgaagagctggttagggtcagacaacctcggtggcctgtgtgtcacttccctcacctcacaggctgtgaccctaccctgggtcccttgtacataactccttgtgacaaaaccctctggaagttctggaccccatttttgataggcttttttgtcttgtcctctactcatgctgtcttggactcactgacccagctgcagggttttgttaccctgccagtcccctgcctcactccaccatgaaggtctctgctttcctgtgacttgattgggatacaggcatttaactttggaaggctagtttggtgcctgctctgggtcatacacctgatctggaagaacaaagcttaagctgcctttgttattttttgaaattgaaataaagtttactaattttgaccaaaagtctgtatgtgtactgactgcttaattgaggctcagagaggcaaaaattccaagctcactgagccttcttgaaaaactacgggggctggtgagatggctgagcaggtaagagcactgactgctcttccaaaggtcatgagttcaaatcccagcaaccacgcggtggctcacagccatccataacgagatctgatgcccttttctggagtgtctgaagtcagctacagtgtacttacatgaaaggaaggaaggaaggaaggaaggaaagaaaagaaaactacagaagatgctagtgcagaagaagcaaaaataatttgcctaaatcctaccatcaggaagcatgtctttgtttttgtttgtttgtttgcggggaggggggcatgtttgttat

SEQ ID NO: 20045 - DNA, 1103 bp, Mus musculus
ttaataattcttagtctttacagaggacccaggtttcattcccaactccagacacataattgaacacagacatacacacaaacaaacactcacaaacaaaaagtaaaaatatattaatgtcataaaagctaagggctttagtgaagacaaggaagcaattctttcttggccaattgtagtttggggagggaacagaggaaatcacaggcttactgacctcactcttgttgcaggaggaagaggtggtggataaaatggatgatgatgtcttcctgcgatgcattgagtccaacatgctgacagatatgaccctgcagggtatcgagcagatcagcaaggtcagcatccgttctactctggccacctgcccgcctgctcttgcccctactcagcctgactagagcttgcctcgtctctccaggtgtacatgcacttacctcagacagacaacaagaagaagatcatcatcacagaggatggggagttcaaggccctgcaggaatggatcttagagacggatggtgtgagcctgatgcgggtgctgagtgagaaggatgtagaccctgtgcgcaccacgtccaatgatattgtggagatcttcacggtgagagcccacagagcatgatgcctaagtctctctaggaactccccgctcatggtttccatgcttaggctttctgtctggatccattggttttttagtttgggatggactgcccccgatatcctccctgccagtctgggtagtgaccggatcagggagatgaactgagctaacttggtgtgacttcctttcaactctggcaggtactgggcattgaggctgtgcggaaggctctggagcgagaactgtaccatgtcatctcctttgatggttcttatgtcaattatcggcatttggcgctcctgtgtgacactatgacatgccgtggccacttgatggccatcactcgtcatggggtcaaccgccaggacactggaccgctcatgaaatgctcctttgaggaaacggtactgacaaccttttcccggcctggtttttagagatagataggacttcactgggcctttcctagccttagactcttagtaatccccaggaa

SEQ ID NO: 20046 - DNA, 1100 bp, Mus musculus
caagatcaacatctcccaggcaagatgcttcattttccagatatgtggcctataccagagtttgtaaagaggatggtatgtacatgttttggtgtgaggaaagatggaaaaaatagtagggaattgtcaccaccaccaccactgctgcagtgtcatggcttgaaacaagattcactcacgtgtaaaagaccttttttaaaacaaaacaaaacatggttttgctgtgtagcccaggttgagtgtgaactttgtatctttctgcctcctctttccaactttaggtttcaggcatgcactatttctgccataaattcatacttttaatgctaggggaaatcatatgcagcctttccccccccttaggtcattgctgttgtcgggcagcagaatgtagagggcaagcggatcccatttggattcaagcatcggactcttcctcactttatcaaggatgattatggtcctgagagccgaggctttgtagaaaattcatacttggctggtctcacacccactgagttcttcttccatgccatgggaggacgagaaggtctcattgacacggctgttaagactgctgagactggtgaggccttttctgagctcttgtggagatgggaatggggattctccatctaaaggtgaattttggtctctgcattttgagctttgtcatgcttttacctcaggtctttcaattaattccctttcccagggtatattcagcgaaggctgataaagtccatggagtcggtgatggtgaaatatgatgcaactgtgaggaactccatcaaccaggtggtacagctgcgctatggagaggacggcctggcaggggagagtgttgagttccagaatctggctacacttaaaccttctaataaagcttttgagaagaagtaagaaagcgggaaaacagatgattcacacccctgggtcttagtgccttccctgagttacaggattccctttagaaggtgacctcatacagtttgcagcagacgtacttgacttttagcaccatcgtttctccacccatttgaaatagatgctgcatgggaaaagagtggatatagaggcagatttgaagtctccctatg

SEQ ID NO: 20047 - DNA, 1149 bp, Mus musculus
tccacggtacctctgaggtcactcaggcagtcaggagtagaaaactagggctgggaatgtaagtcaggaatacagctcccttagcacacctgaggccctgggttcactcctcagtcacacacacacacacacacacacacacacacacacacacacacacaaaacatagaagtggggctggagaaatggctcagcaattaagagcactggcttttcttccaaatggacccgggattcaaatcccagcacccagatggcaactcacaatttccgtctgtaattccaattgcagggaatatgataccctggcacagatatacatggaggcagaacaccaatgtaagtaaaattttaaacatttaaaaagcaaacaaataaaaaaaaaaaccatagaaatataagaatatgttttcgtttaaaccccagatgtggggacatggggatgctttgcagcagctgactatgatttgcctcatgctctagcagaggtgtggttttgccagctgcagatagtttctgcagttgtgcgatgtttggaattctgggaacttttcagagggtatataaatgctagagctctgataggtggggtggtggttattggtcattcaggggggtggagggttacggcttgttagaaacaaaaaggaagaaattagattcagagatgttttatctttctctcttccctctgtcttctttttttgtttgtttgtttgttttgttttgtttttgtttttcgagacggagtttctctgtgtagccttggctgtcctggaactcactttgtagatcaggctggcctcgaactcagaaatccacctgcctctgcctcccaagtgctgggattaaaggcatgtgccaccatgccccgcccctctgtcttctttctctcctatctagtggcagggggtgagaagggagctggggttggggagggatagagggtgggaaaaagaagaactcacaaagtagctaagaccctttgcaagagaaacagcaaggacagacaaagaactttaaaattcacagaaccaccaaactcatcctttcaaatgtttgtttgtttctttgtttgtctgtttaatgtgtatgagtatcttgcctgaatgcatgtttatgtgccacataccatctgctgccaatgga

SEQ ID NO: 20048 - DNA, 1150 bp, Mus musculus
tgtggcttctttggggctaacctaactttgagcaccaggtatgaagcactccatagagaatggagaagatactctactttctccctgacaaccccttactagggcttctcctagattagaccaaatagccagataaatggatggggtttgatgtgtgggtaagcccaggatttgaacatcacctccatctttacctttatcccttctctgatgtcactgtcctcaccgatcactccagatggtttcaaaggaaccatctttctcttctggtgggctttggggtatccccaccaactttgcctccaaaatagcaccttataccccatctttgactcagtcccccacacccaaagatcccagcctaggaatggggtgcagggattttaaatagtccctaatccctaatttgcactagttaaccctggtcaggggacctatgtttccttccagtagggactatagacaaatgtttgttcttaattccctttgaaaaatggggcctccctgatgtgtgattagatggatatttccaatatacccatctcccctcccccacaaagaaagaaccagctcacaaagggagagccagtttgggcaagcaaatttgatgtgggagttagaggagtatgacttcaaaaggagaaagactgttttaaccaaatgacagtctttctctcagctactgttttctggggccaagatggctgccctctgacctgctgtggagagggcaagatcatggcttttggagggaggtgagtttgggaaggccaggagcatcctcctgccccctcctagcctccaagtatatagaaagggggaggtttttgacaggcttcctgaatgttaaccacggagggggtcactccacccctcctctgtctctttgcacttttcttggtcttggctacagcctgagtgaagaatttcctactgaatgtaccaagttccagtttttaagggtttggaaaaagtttcaaacagggaaaaatggagagaaaaaaaaagaaaaagaaaaaaaatcactaaaaactcccgtaaatcttgtttctggcactttagaaaaactgcaaaaaatacataataaagaatacatatatatatatctacacacaaattatatatataaatatatctatatatacagcgg

SEQ ID NO: 20049 - DNA, 1180 bp, Mus musculus
ttctctcatcaaggaagctgaaataggaagcctgctgtgagttcagggtcagcctgggctacatggtgactccaggccatcttgggctacataagactttgtataaaaggtaccatatgtctttaatctcagaactcaggaggcagaggcaggatgaactgtttgagatgcagtcagtcaggtctacatagcaagttccaagccatccagaggtgcacagtgagacccagtctcaaatagctaaataaattgaagggataaaaaggaaaacaaacaaacaaactacagcttccagtaggcactactttgaaacaacggaaagggtgtgtaggcaccgctgcacctgtatcgtggaacacaaactacaactcccagggtaacaacatctcagcagggtgagaggcgtgactgaacgaactctcacaggaggcggaaccagtccggagccacccagacagcttccagaaagggcgtggacatgtgaccaccaggaagttacctgtagaatcttttatgttgctttctgtccaccacctttgaagctaccccttcatcggaaagccgcggaccaataagcccttctcaaaaagaggtaaagggaggtgggcaaaggctcgtggtaaagattggctattgtattcccaggagggaccaaatagcctttttttttttttttaacctgctgagtcaggtgaaccgatttaccgtggggcaacctgcttagaaaaaaccgaaggcaatagtcatttgttcatcaggaagactaaatacagatcacatcatctccaagacccacttgtggcctgtctgtaacccttgatctgcctcagagggaggggaaaactggacaagtttggggccgcaaaagaaaggcctgccaaagctaactgcaccaaacgctagcgaagcatggcttccaccgtctgggggggtgccccctggtggggaccaccgcccccagccccagcccggcctctcacagacatagatttctgctcgggcgcccagctgcaggagctcactcagttaattcaggagctccgtgttcaggagagttggagtgaagggcccaagcctggagctgatcttctccgagccaaggattttgtcttcgctctactcggtaagtgtgggaatttgcaaaccccagcctcgccatttcctgccccgactttgaacc

SEQ ID NO: 20050 - DNA, 3238 bp, Mus musculus
aacaaggtggccttctggctggagctcgtgccccacctgcacaacctgcacacagagctcttcaccaccaccactcgcctgcctccctatgccacacgctggccacctcgcacacctggtcctggcacttccggcacacgccgtcctcccccacctgccactctgccacctgagtctgatattgacctaggcccaagggcctatgaccgcttccccggtgactcgagggactactccacggagctaagcgtgactgtggcagtgggtgcctccctcctcttcctcaacatccttgcctttgccgccctctattacaagcgggaccggcgccaggagctgcggtgccggaggcttagcccaccaggaggctcaggctcaggtgtgcctggtgggggccccctgcttcccactgctggccgtgagctacccccggaggaggagctagtatcgctgcagctgaagcggggtggtggtgttggggcggaccctgctgaggccctgcgccctgcctgtccacccgactataccctggccttgcgccgggcaccggacgatgtgcctctcttggcccccggggccctaaccctgctgcctagtggcctggggcccccgcccccgcccccacccccttctctccatccctttgggcccttcccacccccaccccctactgctaccagccacaacaacacgctaccccatccccactccaccactcgggtatagggggcggctttgggaggtctgcctccctagccctcccagcccaggccacttgaaggcagggaggaggacttggcaccgggctttgcccccgtggatttgtcagacttcgtggagcagtgttaaggtggacatgggattcctcactgggaagagagtttttcccatgcagagagccccattatctcctctggacctgggccttcgaacacctggggggtattttttgccctccgttgggacaccagtcttcggtgtgtggaaatgtggaagtccttttgcccatgtgaagacatgctttcctcagggggggggggtgttttcccatgtgcagggtgaggtttgtttggtttttttgtttttggttggttggttgggtttttttttgtttttgttttattcgggggggggggttgtttgtttgtttgtttgttttgccgccctggacacatgtttgcctcctccaagaatttctgcggggatttgtatcccatgccttcgtcttctcctccccgtccaactccctggagaccctggaagtgatgtgtgcacatccggtgacccttggccaccagacaatacagggaggtacctggggagcagctaggaaatcacaggccccctggaccccgctccccacccacccctgaatagcatgtttctcccccatggcacaaggcaggtgaagcccgtgctccctggaagccctcaccttccacagacaacagagatttcctgctagaggaaagggggaatctctgtgcatcccagcgctgcctggaaacttaccttcccacggcccaggacgcatttcatcgaatggaaacatgttcttgcatgtggatgtgtgtttcccaggcagagggtcctgcgccccccagcactcccctgccctctcccacacctcaggtccagcgcacacttcctccttgcatagcaggtgggagcagacttctaatggacagaagccacgtgggaagtagagacttggagggagacgccgaggtgggaggatggggggcatggcacatgtcacacaagaggccatgcatgtttaacctaagccctcaagggggcctgaggacagccttttcctcagtccttgagatcattgctcatccgtgccaaactgggtagatgggttgggagactctcaaaatgtgccaaggatcccctacgttctagtccagggaagggaaacgccaggagcaggtggcagctaaggtggtcccccgcaaccctcccacttgtgtctcacccccatgtcatttctccttctctgccttggttcctctttctccatcactggctccttctttgatgctctctccccatctcagggtcagaccagccttctctctttaccttctttaacctgtctcccctccctggttggttgagttgaagaagaagaaagaaagctgaggagagggggaagggaggagtcagggaaaaaggttacatggacaggctggggaagagaatgaggtcagccgtaccaaggagcagatggaggggctgtgggggacagggcagacaccagcaggaagattttgaaaggaaatatggggagcagctgcctagaggtctttggatttggacctcttggggaaaagaacgctgtcaggaagggttttaagggacaccagtggaggtgtggctgaatcttcatgtattgtttggctttctgagggatgttagtgccaaacttgtataggagtggggtgctgtcttccactgacacccaggtccagaatccttggtcttgagcccctgtcctttctccatcccccatggaaatgtagttcttttctggccctttcccctgcctggtctagcaactcttggaacagccatgccttccaaaagctatcaacctgggccctgagccctgtaagcagatgccccagagctggggtgtgagagaggggctgggggaccccacgatacagccacggactccaatgcccggcccctttccaaataatcccatgcccccaccccaaccctttgcggctctgtacacatttttaaacctggcaaaagatgaagagaatattgtaaatataaaagtttaactgttggttgtgttgtctcctgtcgtgttagaaggtaggtggagggtggagagggtacccagctctggttgtacctgtcttgttagaagggggtgggaagaagtgcccaacccttttcagaaaataactcttaagatctgaggagaaatggcaaagggaaaagtctccatcctgacgggattggatggttaagatagagaccaggatgggattggatggttaacatagagaccaggatggacaaatagtcagaaacacttataatcatagcattcaggccactgcggggggtggggtggggcaggaactcaagaccagcctgagctaaatacgagatcccatctttaaaataaaagtgctggctgggcagtgttggcacatgcctttaatcccagcacacgggaggcagaggcaggctgatctcttgagtttgaggc

SEQ ID NO: 20051 - DNA, 1485 bp, Mus musculus
tagggcggggaggagaccaagcccccagggaccctaaggcctggcacccctcacccacagactagggtgccatgtggagctgaggcccaagcctgagtctgaggagatgccagggcctcccagcacctccagccctagtcccggccttagtccgctctcaccaggagcaggaaggagacttgtgtgtgtggagcagccctgaggagggccacttcctacctttggcctctgttgggcttcttggaaagtgtgtccaacatttggtggagtgcttggacccatgctggccagtgatgaggagggaccttcctctaggcttagctggggagggagggagggaggggaatccggtcttgccccccgccagggatgttagtgacaagtcccctgagctccaggctggtcctcagaaggtctgggagctccaaagtgctgcttctggtctgactgtgtccttgtccccgatctcccggcccacctgccacccccttccctcgcagatatccgggactctgggaagaaaccggtcatgctgtttctacacggcggctcctacatggaaggcaccgggaacatgtttgacggctcagtcctggctgcctatggcaatgtcatcgtagtcacactcaactaccgtcttggggtgctcggtgagggtgggcagccaactcttggggggcaaggtctgggaagcagtcctggtgggcagggtcctcccaagtacgctgatagacttacgctgcattaagcccctggctgagaggcaaggatgctgtgacacctccagggagtacccttcttctacccctaggttttctcagcactggtgaccaggctgcaaaaggcaactatgggctcctggaccagatccaggccctgcgctggctcagtgaaaacattgcccactttggaggtgaccctgaacgcatcactatctttgggtctggtgcaggggcctcctgtgtcaacttgctgatcctttcccaccactcagaaggtaccagcagcctcctcacctgccttcccttcccaaagcctggaccctaccaatcctctccttcctttggctgataacagcctagcctgaggtctgcctgtcccaccaggactgttccagaaggccattgctcaaagtggtactgccatttccagctggtctgtcaactaccagccgctcaagtacacgcggctgctggcggccaaagtgggctgtgaccgagaagacagcactgaagctgtggagtgtctgcgccggaagtcttcccgggagctagtggaccaggatgtacagcctgcccggtatgggggtgggagagggctgggtccaggtctctgctttcctaactggttccaaggaggttgaggtgagaggttcttggaggcaatctaactgggcaaggagaagtgggcttcagaaacccctagtggctgttggttagcagccctccttatgtggaggtcaccataccacatagatcaagcaca

SEQ ID NO: 20052 - DNA, 1213 bp, Mus musculus
ggttgggggagtcgggcctgggctggaatggaagagcaaggcagagggatcgggaggaggggggagcaagatgtggcagacagagatgaagagagaaaatgggggagagagtaatagaaaaaaggagagagagagagagcacttgagggagaaaatcagagaaggtatttggaggagagagcgatgagaaacaccaaggagacagaaatgagaaaagactgaggggtgagagactgaaggcaagagctggagcaagccagttaaggccaaggaaagatgctccaagggaccctgttcggaggagaaagatgggggggggggggctctagtgggaggggaagagagaaaagctagttagaggagaggaggcaaggggcccaaagtaccttaagggaaaggggtgactgaggcaggacatgatgggagaagagggaagagatagcaaggcccagcctggcataggaaaaagagattgggggggggtcaactacaacccccccttcagctgatgggagaacaggagcctaaaaggacctgaaaaggggagggcatgactgggtgtgagtggtgaggactcctgtgtcctcatctctggaataaattgacacctgcagagagccacccgcgggctggcgcctggctctgaaaagcccagcgtcagcaaacagtcctgaaggggggggtgccaagggggggcttactgaaatgacctgggtgtctgccctgcctacctttttactggtcctgttcctgctgcctgggtaccagggcagcagtaatactggggactggcaagggggagggggactgggaaggggagggggtgctcctggggtgagaagatatctgaggtttgcctcaggacataggtcaaaatgctgtgcaaagaagacctcagccagggtccaaggctcttccagattaggtgggggggtgtcagtaagcttatttgagaagccaacctcagtactgcttctcttatcccccctccccatctgccaaagacctggtcagtagggttaggctctgatggggctaagcaggatggggggaggggcatgtctcttaggattctctgttcgcctagactaccctcccctcatatatacatatttcttcctctctgataagattgggtgaaactagcgttctgactcttgtccctgtcctccctctcacggcccgaagggactcagcaaccaagcaagcccct

SEQ ID NO: 20053 - DNA, 1233 bp, Mus musculus
aagagtgctggggaggagttagctgagcaggccaggggaggagagtactacatacacaatagttggtgctaagccagtcacggtgaacagtatttcccagaaaacagcaaggcctgggtggagggggcagaattagcagtcatggaccttgggagccttactcttctctcgtttctgcttggctaacagattccgggacccaaaatcccagcggacacaccaggctcaggtggcctttcaggtgtgtgtgcgccctggctcctatactcctggccctccctctgcggccctcagagaacttcctgaccagcacttcagcccatcggaacttgagtgggtcactaaggagaagggagccacactcctctatgccctgctggtacgagtggaataaggggtgacataccactactccaagcacagccgggcctcaagcccaggactcttgaatgacgactgcctccacctcattcccgtgactgagagcatgtccagtgctgtcctggcaaggaggagcacgtaggcaggctttgatttagagcaggtgtgaagcacatctctacattcagggcccagcacactccctctgctgagagggagcccagctcgtctcggggtccccccttcatgcactgacttggggaacatgactccctattattaccctcccccatatcacttaatttatttccgtttttgtttctggttactgtgaatcccaaaggagtctctctgtgcccacatgaagctgctttttccgtggccactgggcgccatggggagggagtgggtaaaaggaagggctgcccgaggacgctgtgggcctctgtacagttgttactgactctgatttctaaggagccaataaatactgtcttcagagcatctgcctccgcctctgtctcccgcggcctcgcgagtgaagagttctaggggctttatcatcccaggccgctctgtaaatccacatggagtttggacatcccggcacccgtctctaagcgcttccgccttccctttcctccaatcggctgtgccgtttgccgtcgtgactccggaaggatttatcctggccgccggatatgacgtagaggccaaggcgcgccgaaggcctcggagaaagcgccgacaaggcgggttgcgggggttggcgccagggctacgagggaggggcgggggcgcggagcctaagaccctcgcacgcgccccggcgctgaggcagagaccccggag

SEQ ID NO: 20054 - DNA, 1555 bp, Mus musculus
gagggagctggtaaaggctgtggagtgaaggaagttgctgtcactgtagttggtctgtccattctcttatacttaacctacttgtacctgcttttaacttctcccagctgattggcatccaggatgggtacctatccctgctccaggacagtggggaggtacgagaggaccttcgtctgcctgaaggagaccttggcaaggagattgagcagaagtatgactgtggagaagagatcctggtacgatgccccctccttgctttgtatgctgctttgatccttaattcgaagtctttcagttaaggcatctctggactgtcattttgcttttccagatcacagtgctgtctgccatgacagaggaggcagctgttgcaatcaaggccatggcaaaataaccggcttccaggtgagagaacgcaccccccactgtccccacacttactgttgaagttacatcctatatcttaaacatgatttctttctcttgcccagggtggcggtggtggcagcagtgatccatgagcctacagaggcccctcccccagccaggttctgctctggctgggcccttggctggactcctattcaaatttatttgacgttttattttggttttcctcaccccctcaaactgtcggggagaccctgcccttcacctagctcccttggccaggaatgagggagccatggccttggtgaaactccctgcctcttctctcgcagccctgatgggggaaagggagttgggtactgcttgtggtttaggttcccctctcctttttttctttttaattcaatttggaatcagaaagctggattctggtaaatggtcttgtgccctttatcctactcatccccgatctggtcccctgttctccatagtccttcacccccaagcaccactgtacagactggggaccagccccttccctgcctgtgtctcttcccaaacccctgtaggggtggtgagaagaggagggggggaggggacacgatccctcctcaggcatctgggaaggccttgcccccacgggctttaccctttcctgtgggctctctccctgacacatttgttaaaaatcaaacctgaataaaactacaagtttaatatgaagcccccaactcagttgtttatttgttgattgaaaggtacttttagaatctagaaatgctgagacttcatagtagcctttgtggtttaggcagttggataggaagcaaataaacagcactcaggcatgatggtgggtacattttgtacattttattggtttggggcacataagaccccagcctgagggatggagggtgggctggagctctctggtggttacttgtgatagaatcttgggttctggctgtgttggatgaaagggagtcgggggccaggttggctggtggtggcaaagcctgactggtaatgataagagttttatcagtgggtaggtattccagcactcagcacaagggggaggggacagttacagtaagaggttagtctttccctggtagtatatgtaggtttgattgccagccttaccttccctgctgct

SEQ ID NO: 20055 - DNA, 1111 bp, Mus musculus
ccaaagaggccttgtggtttcctgtaccaatgactggcttgtgtgtggacagggtgggggggtggtgtaacaactgggtggggccttgtcctccgtctccacccctccattagccccgcccttcagctggctcattgctgctcacctaattatagtcctggcagagtgtggggaagagggggtggttggtttcagtggcgagtaacacctgagtcctactcgctcccgggaagtagccctttcctcatctctgggatttggcatcccaactcccaggaggcttcctttccctagccacaactttagatgtcattgtgggggcccaggggatccccagctgttttacccccaatactcaagctcttcaatatgtttgactccagtttcaaagcaggaaatgcaactttatttaggtgggtaatgaatgaaggggaagtggatcagtgttttagggaggaatgggatagatcagcgatctcatttaacctccatcgttactgaccctagttctcttcttggctttagttggaatcgaagcctcttaaaatggcagatgatttggacttcgagacaggagatgcaggggcctcagccaccttcccaatgcagtgctcagcattacgtaagaatggttttgtggtgctcaaaggccggccatgtaagatcgtcgagatgtctacttcgaagactggcaagcatggccatgccaaggttagaatcacctctcaacatcttgccttccctgcagctcccacacccctaggactctgggcagtgaactgttggctctagtcttgaccccttttgctgttttccttttgttcagcacccagttttttgctccaatttaaaactaaactgttcccagtttcttctgtagggtacctgtcatgctatgtttttttcctccctctttgtgctagttttcttttggtttgtatattcagtttcttattcttgaccttgggctccttgtccaggatttctccagtcaaggacccctcctcccaaggcagcattcttggggtgctccagtctgcattctctaatcactgctgctgctccttcaaattctggcttcccctttggggttgtgataaatctcaatgtc

SEQ ID NO: 20056 - DNA, 1168 bp, Mus musculus
cacctgaatcctcaggccccgccccaagccactgaattaatccgcctcggggcggggcggggcctgggcactcagttttgacccgctcccaggtgattctgatgctagtttgagaaccactgctgtggtggaagtgctcggtgggatcgaggtaagaagcacagcacgtttcacccactttgcaacttgagatgttcttcagcctgttttgctcctgagttcctactgcctccatgtcttgaagtccttgaggggtacagtggggaggaaggacatcttggggatagcggctccctcagacctctagctcttgactttgccctactaatatatctctgtcttgtggagctgtgctccaggccctccccctccccctttgaccattttcatgctctgccctccagccctagactccaataaaatgtcaccaagagtggagttgggtggaggctgaagctggtccaagggatcctggctttgctgccctcacctttctcatgacttttccccccaaccagacagctattaagagaaacaaccccaggaagtttctgcggagtgttggagatggggagactgtggagtttgatgtcgtggaaggagagaaggtttgggtgctgctgtggggtggagttggccagaactgtgggagggtggcctggaggtcagccgaagctctggccctcctgggaccagctctgcctctgcctgtgaacgctagagctgctctaggacatgtcctaaagaacccatccctgtcaccagccagtaacatgtgggtttcttctctttagttcaccaagcacttccatgtctgttttctacacgggaccccagccctaacaggaccctcagtcagtcctctggaatgaaggagggacagtggctctctctatctcatcctgtcctgtctttacactctggggggaatgtggcagttatttctaaggacaagttgtttcttctcagatgggtacaaactctttctgctgcccctcgggggaggggacaaaggaggagtggttttgaggagtgatagggtagaggacttgggcctgaagaagtgggacaccagtgatctggcaggtttgtaagtactgtgtgtgtgtgtgttgtcagaacaggttctgattgctccccctctacctccccagggtgcagaagctgc

SEQ ID NO: 20057 - DNA, 2018 bp, Mus musculus
cactgtgtgaaagtggtatcaagttctgttctgtccagtgagactccgttgtgctagtgttgtgagggtgtcaactataaggtatttcaccaacaccagttactgtcatttcaggttcactgctgatgtccgatcggtgctgagccgaaaccttcaccaacataggctctggtgacagctgctccccctccacctgagttggggtggaggggaaagggagggagagttcttgggacaccgtctgttgccctgtccaatgtgaggactgcctgggcagagtctgcccctcccacccctctgccctgggagccctacactccacttatggagtctggatggacacatgggccagaccgtgaagcagcctcactctgggttcacactccgtggaaatgccagactgggacaggcgaaggcctagaggagccgaaacagtctggtgaagaggcaggactggccagagtgacagacatatcccagaggctcaaaagaagccaattcaactttgttgtgatttgatttttttaaaaactcttatacaaaactgatctaattcttcactcctgctccaagggctgggctgtgggtggggactggggtttcgggccactggatcctcctcagacttgtcccccccttacttttcctcattttttttctttccccaatcccccatacctgtaatcggctcctttcttctttcctcttttaaaccatgcattataactttgaaaccaaagctgccctagacccttctctgatgtttttggaaatggagggaactttgttgacatctgctctgtccttgaagcagagggagaagatgctgtttggagttggggggaagtgggatttagcacagggataaagtagtttatgttcagtgttcggcaggaaaggccccactgactggatggagtccctgatggacagtggaccaacaactttaaagtaggatatagaaggctaaagagggaaaactctagaaccctggaagggcatacagctggagaaaggctgggcttgtctgggaagttgacgtggacaggctaagagggcgctgcctacgaggtgttggcactccagcagtaacctggggcggaaccctctttcctggcacctcctctccagagccgggactacttttcgccacccgccacgtgattctccgcccttttctgaggtcacatgattttatctacactcagaaatgtgttcctccgctctggtgtagtccttatctttggggcttttgcagtttctcttggttcacataagcctgagccttgagcattccctgggtgtctgcaaacctctttcctttctgtcttatggtgtccatatccacagcttgggtactactttgttttggtgtcaacggccaccttcagcgtagaaacacgtctcatgaaatcctagacttgtaattgtctgcctttccccaacgtaatttccgagaactgcagaactaaatctcatgactgccactgggtaccagtttcgtcctcaactttgtactgtgggaaagggtttttcagttcactcgaaacaacagcaaccttatctgcgatgtcatatgtgtaacccacaagttgattccaaagcagttacgctgaaggcgtaagaggaccaggctacgggttgcgctagcaagctgagctagtggcgtatgttagcaggcggggccggtccgatggtcgggggcggggttgatgaatagggaagtggcgcaaattcgtggatcgctccgccaagtctgttcgtcgaagccgcctccgccgccgccccctgtcccggccccccccctgggttccctcagcccagctcggtccagcccggttctcgggagaatgaagttcgtgtacaaagaggagcatccgttcgagaagcgccgctctgagggcgagaaaatccgaaagaaatacccagaccgggtcccggtaaggacagtagccagggcccaggctagcgtcgctgacgctgtcgccacaggctatgcttgagtctgggaaagctga

SEQ ID NO: 20058 - DNA, 2018 bp, Mus musculus; identical to SEQ ID NO: 20057

SEQ ID NO: 20059 - DNA, 1139 bp, Mus musculus
agcccagcttgtttttgtttttgtttttgtttgttttgttttgttttgttttgttttgttttttgagacatagtctttctgtgtagccctggctgttctggagctcactctgtagaccaggctggtttctaactcacagagttctgcctgcctctgcctccagagcattgggattgaaggtgtgcaccactaccacccagtccaagtcagcctttcctataggagagagataaaataggaatgattgcttttcttttattccttctgtactagggaccacgtttagtgcctactgttgcttacagatgatctgtatcttcaaatctattttgagtccggttcttaagttgccttggtagcctttacctttcggccctttcctgcatctgaaattaccaggcaatgcttaaagtggttcttgaggaattgaggtattggtggtgaatggttgagtaacgagttcccttaacctccccccccccttttgcatttacttcaggaacaccatgaagaagacttctttctatacattgcctacagtgatgaaagcgtctatggtctgtgaagctgctgtacctgaggtggggggttccattctacgaagagaggtggcgctccttccttgacatccagttcctccttcaggctcaaacaccacctcctttcttcaggacctgcacttaatgtttgaggctgtctctccagtccctctcagcaggaggggtaatggtagatacagcctccatacatctctttctccccttgtttaccctccattcccactctgatttagacttcttgattgtcgatctctgtcacatccgatgattgttttggtttctattccctttctaactgcccatcgggctcagaaccccaataatcccttcctttcactatcttctttttggggggtaggtggaagggattgacattggatgggggaggtaggaggcacatcaataaaaaggaaaccaccgagctgaattgaatttgccctgtgtcattccacctcctggttttttgtttcaagtatcgtgaacttcagtagtgggaaaggggaaggattgaggtatagatcagtgaaatagaaacgcgttgttgatgttggtaatttcctgttttttagtgagtggaat

SEQ ID NO: 20060 - DNA, 1172 bp, Mus musculus
aatagaaagttgggaccaggaggtggggctggctttggggtgcttcggagacctcgaccagctcctggggatggggaaaagcggtctcgaatcaagaagagcaagaagcggaagttgaaaaaggcagatcggggagatagactcccacctcctggccctcctagggctcctcccagtgatacagactctgaagaggaggaggaagaggaagaagaggaagatgatgaggaagagatgacagtggggggtggagtcccagcccctgtgctcccaacaccccctgaggcccccaggccccctgttacagtgcactctgaaggtgctccccctactgacagtgaaggcaaagatgtgggcagcacagaaacaagccaagatggagatgctagctccagtgaaggcgagatgcgggtcatggatgaggacatcatggtagaatcaggtgagaagttgggctgcccggggtggggagcagaggtgatagctttgggggctcttaggagttgacgccttgaagcagaacactaaagagatttgtcttttccaggtgacgactcctgggatctgatcacgtgttactgcagaaagccctttgcggggcggcccatgattgagtgcagcctctgtgggacgtggatccacctctcctgtgctaagattaagaagaccaacgttcccgacttcttttattgccagaaatgcaaggaacttcggccagaggcccggcggttagggggtctccccaaatctggagaaccctgacatcactaaggctggaacttgtgacattacttgggaactgagcctcagggtccccagccttcccttggagtgaggaggctgtccccacttgagggccacaattcccaagggagacgtatttggaaatgagtgtcttctactctgtccttcctgctccatggacttgaagttgaccccattacagttgggtcggggaggctggatctgtagacagaatctctgtccagtcaaccctgtacccttttcacttgcaggtccagggctcaaactgggatgtaatgggatagttgtctataaaactgtagtgtaaatacagcactcccctcatgtttcttctctctcccgtttactttcttttacaccggatgtatttttaatttggggctcccccatttgagcgaggttgctca

SEQ ID NO: 20061 - DNA, 1211 bp, Mus musculus
agagggctgctctctacaaagtagttgggtggcagcacgcagggtcctagtttcaatccccagcgcgagagacagagacacagaaaggcatgtacttaggagcagtcttgcaagccacgtttccatggctacccaagcccaccagcttagatgtggcctcttccaatattttgccttcctgctccttggtctacctctgtaaaatggttaccatgatagaattcatttggtatgcttcttgggaagactaataggagttaaagtgctttagcatggtgtctgatgcatagaacttgcatattggatgctctgaatggctgacatttccctgctcgctcgccaccttcaggaacggtcctcagaacatatacaacctgtacgagcaagtcagctacaactgtttcatcgccgcgggcctctacctcctcctcggaggcttctccttctgccaagttcgtctcaacaagcgcaaggaatacatggtgcgctagagcgcggtccgcctctccctccccagcccccttctctatttaaagactccgcagactccgtcccactcatctggcgtcctttgggacttgtgaccctagcgagacgtcatccctggccctgcaaaactgcgcccagcctctggaggagaccgagggtgaccgcgccccgttctgaactacaataaaaagaagcggttccccctaagcttgctgtctgtgctttcagggaggggcgggcccgggctggaaggggctgagaccggcctcatcgaggagtccggaccctccgacggaagtggaatgaagctagccggaagtgaagcaacgtcttccacctcgtcttcctccgcgcggcgaggccccttgagtgactggggagaggtcgggtctcggccaatcagctgcagggagggcgggacttcctgcgcgggagcccgagcggccggctgccgggctctccgtggtttccagctcgcgtggtggtggtggcggcggagcgtctccgtgaggaggtgcgcggggccatgacgtcagcgtccaccaaggttcgacctccctcgcggactgcgctccctggcggccacgggagggtgggccccctgcctggctcccggctggtgcgcgctgggcggggggcgggcggatccgaggctggggtgggacggcgcgctgccggccccccgtaatgctgctccgcccccaggttggagagatcttctc

SEQ ID NO: 20062 - DNA, 1211 bp, Mus musculus; identical to SEQ ID NO: 20061

SEQ ID NO: 20063 - DNA, 1898 bp, Mus musculus
tagtggatgccgtgatgttaggtgactctccttcgggtagtcttactacctgctatctctctcattgtccaaggtgaggccagtcctcctcagtgtatacatgtagtaaattaccagcattatctatcatccccattttatactgggggaagaaactgagggtaaatgccttgcccagggtagacagtaacagaactggatgctccctgctaggctgtgtgcccttgccttcctgtctgcctttgacacaccattctcttctcaggcctcagtcggaccatccttatgtgcgggcctctcatcaaggaggagactcacagggttagttagtagggaccgatcctgatggaggggaggggccactgttctgtgcattgggagtgtttaccccaaaggtggatccactgaaagctgggaacgaggcactggctttgaaggtgatgtttctagactcacactattttcttttcagagacttcatgatctagtcctgcccctggtcatgagtgtccagcagggtgaggtcctgggcagctctccttacaacagttcctgctgtcgcctcgggctctaccgcctgctgctggctttattgctggcaccttcccctcggtgccctcctcctcttgcctgtgccctgaaagctttctctcttggccaatgggaagatagtcttgaggtaattgctgacttgagtcagatctgatcctgggttctcttgttctgatgcttgcttcgtgagaccctgtgttcctgacattcttgcctctccttccttcctttctcaggtctcctctttttgctcagaagctctggtgacctgtgctgctctgacacacccccgagtacctcctctacagagctcaggccctgcctgccccactcctgcccccgtccctcctcctgaggccccatcttcattcagggccccggccttccatcctccaggccccatgccctccataggtgctgtgccatccacaggcccattaccctcagcaggccccattcccacagtaggctctatggcgtccacaggccaagtgccctctcgccctggacctccagcaacagccaaccatttaggcctctctgtcccaggcctggtatctgttccacccaggctccttcctggccctgaaaaccaccgtgcaggctccggtgaggatcctgtccttgctcctagtgggacccctccgcctagcatacctccagatgaaacttttggggggagagtacctaggccagcctttgtccactacgataaggaggaggcatctgatgtagagatctccttggaaagcgactctgatgacagtgtggtgattgtacctgaggggcttccctccctgccacctgcaccaccctcaggcactcctccccctgcggctcctgccggcccaccaacagcctcacctcctgtgccagctaaggaggattctgaagaactgcctgcaaccccagggcctccacccccacccccacccccacccccaccggcctctggtcctgtgacacttcctccaccccagctggtccctgaagggactcctggagggggaggacccacagccatggaagaagatttgacagttattaatatcaacagcagtgatgaagaggaggaggaggaagaggaagaggaggaagaagatgaagatgaggaagaagaagactttgaggaagaggaagaagatgaagaagaatattttgaagaggaagaagaggaagaagagtttgaggaggaatttgaggaggaagaaggtgaattagaagaggaagaagaagaggaggaagaagagttagatgaggtagaagatgtggagtttggttcagcaggggaggtggaagaaggtggacctccacccccaacactgccacctgctctgccaccttca

SEQ ID NO: 20064 - DNA, 1118 bp, Mus musculus
ttggtatcagtagcaagaatattgtgagtggattttgccttcctttgcattgtagtcttgcttaagaccctggccacttggacaatacccagctgtcatctctgaaagtgtccctgaggcatatgcaagtgtcgtggactccctcacacagggtagagccacctgtggtcagggcagacagtgctggttggggatgagccaaggcgtcgttaaagggctcactcatggtcaagctctcctacaggatgggagatgggagatgggcttgggttgagctgggccagggagttggttcatgttatataatctgatatacctgctatgtttctgtctttcttttccatcttactgttgctgaatttcctccagaacttgcttggagatggtcccctcaggttgctgctgctgccttctctgcaccttgaggccttggacttgctctctgccctgatccttgcgtaagtaaacttggtcatggtgtggagaagggaacgaacatactggaaatgaaggccaccgttccgtcctctgcccctaggtgtggaagtcgacttttgcgttttggtgccctgatcagccggctgcttccccaggttctcaatgcctggagcactgggagggatactctagctccaggccaggagaggccttacaggtgattgtccacgagggcggatagagtggagagggtggatgagaacatcaggggccccggggctctggcatgtcagctctcgttcataccctgctttccttattccttctccagcaccattcggaccaaagtgtatgctatcttagagctatgggtgcaggtttgtggggcctcagcaggtatgcttcagggaggagcctctggagaagccttgctcacccacctgctcagtgacatctcccctccagctgatgctcttaaggttagtgagaccttggctcctgttcccctggctcctgtgcctatttcctgactgactgtcctgacttcctgtttgcctgtacatgtgactgtgtttccttttaccacaagctatgcagtaccaggggaagctctgatggaggtttgcaaagtgggaagccaagtgctcctaagaagctcaagctcgatatgggggaagctt

SEQ ID NO: 20065 - DNA, 1197 bp, Mus musculus
gaaggaggttctttctcccagtaaggaggcttagaaccagagctcatgtgctgggtctctaccccagaaacatactgttaatggctgtcatcaccccatggatgcatcatgtctataggaaagtcaaacctcaggtagaaggactgctatggacactcggcattgttccatggcctcttcctttctcccctcctccagggaaagctggcttcctttttcctgtctcgattggattccctgaaccctcagctccaacaggtaaagggaagggagaggcactaagtacggggatctggtctgaggcatcgtttacagcttattcttagctgttaattgcacagcatttggaccctcttttcaatttcttcctcctaacacacacaattactggctttcgtactcttagggattctgcctcactgttacttgaacttgttgagctttgttttctgggccattagtggggtgggagacccatggccaagctagtccctctctgaccagctttctgcccttctgcagctggcctgcgagtgttactccaggttgccctcgttaggtgctggcttttcccagggactgaagcacacagagaactgggaacaggagctgcacagcctgctgacctcactgcacagcttactggggtccctgtttgaggaaacagagcctggtagggaacagggctgtagtctggagatgggttggagagcgtggcaggagggaacaagtgtggtccacagaggccgggcagtgggtttctgggtgacatggatgagaacataagtgggtaatctagcataaatgaaagagtgggggctggagaggggttcagtggtgaaggacactggctgttcttccagaggactgggaattgattctcagcacccacatggcagctcgtacaaagggaaaaggagggatgggagaaaggcagagtgtataggtggttgtattgctgcccagctcctgtgcagagtgaaggccctggaatagagatgctgctttcccactcagaagatggtaacacccatgtcctcctccagcttcggcagaggttttcaggcctggcccgttgcctggggctcatgctcaggtgtgtggctattgaagggaacgggcttggggctggaaggtgcggtgggtgtgtggagtcagctagggtgactgctctgagggtctctttgttctggttct

SEQ ID NO: 20066 - DNA, 1120 bp, Mus musculus
agccccatgaccacatcacccttcccagaccccagtcaggtgagtgccacccacacgctgagccccgcagagaggagctgagccagggtcagtggagaagtgatggtcctttcagcgcccatccacccaccccttctctgcccttcagccccccgggaaacagacgtgcctgtggataccaacctcatcgaattcgataccaagtaagaaacaccccctgccttcttcattgatcctctaggatagagattcccatgccattcagatccacccccctaccttgtgggtcgtttcctcctgcttatagaggctgtggctactgccctgggtctcctgtgaacccctctgggtcttttaccgcttaagtgcttgactctaggatggggtgggaggaaggcagagtgggaggcccaaggaagggtcagaagcttttattacatctcctcctcactctcaccaagctatgccacagacgatgacatcgtgtttgaggactttgcccggctccggctgaagggaatgaaggatgatgactgtgatgaccagttttgctaggacgaggggctgggagaggtaggggcgggcaggactcaggtcccacggccctcgagggtgggagggtcccagcctctcctccttccccgtctgtccgtctgtccacccgagatacacactggacccatcacttgttgaaagtgggcattaatcttctgacttcagctcgctgccccagccccgctccctagggcggcaagctgtgtacacacctaaagttttgggaagggaacagtgaacgcaaggagtgaatgtagagaaaaggtgtagaaagaacgcccatgtttggcctcacaccaactcgcccccagtcaccacttctgcctcccaatccttgaagacgagactttggggaggggtgagcaaggccatttctttgtttctgagcatagggaagaaataaaccttttaataggcatgaatgtgtatgtgttctgtcagcggagtttaaggggtgtccagtgtacccatccatgatgcttttttctacatctgcagggtaccttacttgggttatcaataaatgtttgctggatgactgtgctatgccagtgttccaaggtaa

SEQ ID NO: 20067 - DNA, 1171 bp, Mus musculus
agctaccgaacgttgttcccagaaacttgtgaggccatatttgcttggggactaagaagacagacatcgctaagaggcttccagagtctttactccagctgctactgtttactgacatctgtggtgtgctgggcatatcctaaaactctaggaagtattcgctgtggtccctatttcatagatgaggttcacacagtggttaagctttttcttttttttttttttttgttgttgttgttgttgccttagaacactgagttaccagtcaactaatgtagatcaaacttgggaaagatgtgagaccagagaaataatactgcccggttgtgggtggtaaagagaggcagtaccccattgattgatctgacttgtaggtggccacagggcagccgcatgagggctccagctactcttccaggaaggactgtcaaatggctctaaagcgagtagactacgcccgcctcaagattagtgatgtggcgagaacctgtgagcagatgctggagaactgagttcggatgatccagagtgtgccctgcaccagagaccgtaggatggggagcagtgcatcatacacgtgccctactggtcagggcagacgaggaccacaaggcagaaaggagaactgaagaatccaaagccccagtgtacacacatctcttctgactcttccagcaagacggccctgttttccactatgcaagatcagacagaggtcagaggtcaactcccaacccacttcctcatgtgcaccctgccctggagtttcagaagacttggcccaataaaaataaatgtgttcttataagcacacacagtggctcacacctgtaggcccggtacttgggaagtagaggtgggaagattgctgtagtttgagaccaacctgggctaagtacatagagggaccctccttcaaaaggggaagttatgttcctcattggaagaaacaaaacaggaactaagtgttttaataataaaagctgtatttttttataaagctaagagtctctctctcgctctctctctcatatgtatgaggctccaagagactgaggactcgagtcctgtctacacagcatcagcccagtctatatagcatcagcgtggcggctgtgaggaggggagtgagaaagcccaggcttcagtgtggggttggagaacagctgat

SEQ ID NO: 20068 - DNA, 1157 bp, Mus musculus
tccaccctttctggtcttcccctgcagagcctggtggcacaccgggtcccactgaagccatatgcagcacctgtaccccgatcccagtccctgcaggaccagccgactcgaaacctggctgccttcccagcctcccacgaccctgaccctgctgctgtccctacacccactgccacacccagtgcccgaggagctgtcatccgccagaattcagaccccacctctgaagggccagggcctagcccaaaccctccatcctgggttcggcctgataatgaggctccacctaaggtaagtataaccctaaaaaacaagaatataagagttcagggtaggaggaagaaatcaaggcagccacggagatactgcctgtaagggtagaaagacagaagtgactgcaggaatgggaaatggccaagcatctaagggccacccttacctcagcatggccatttttcaacattacagcctagacatattgagtaacttgtctgaacccatttgtttctctgtgagtgctgaggactgcgttcctcagattgacagtggaatggagtgtgtgctgtgcctacacaagaccgacagagcctgttacccgtctttctctccaggttccacagaggacctcttctatcgccactgcccttaacaccagtggggccggagggtcccggccagctcaggctgtccgtgccaggtacacagcaccagggtgcgctcatgtggcagcctagggagtaagagatatagggactttgccaggttatctgcataggggtggggcaagccccaaatcaggcacctcatcccctccctgtgccaccacgacccgccccggcaccctgtgctccctccacagacctcgcagtaactccgcctggcaaatctatctgcagaggcgggcagagcggggcacccccaagcctcccgggcccccagctcagccccctggcccgcccaacgcctctaggtaatggagttgccccctgacttactctcacctctcacttctgccgcctgcttctctggtgatggcgccccctgcagtgcagcttgacacacacagctctgtgtgagcacagctctgatgtgaactctctcccttcacagtaaccctgacctcaggaggagtgaccctggctgggagcgctcagaca

SEQ ID NO: 20069 - DNA, 2109 bp, Mus musculus
aaaggttctctgggatgtctagactcacacacagactagtctcctgccctaataaactttttgaacttaattagagagcccccggggtcagcttccttatcttggggcatagctacctggacccaaactccaggttacccggagacccaggcgtccgggctcctaacaacgcctgcagaacctttgaccaaataaggacaaagttacttctcctcccttcctaccccctcccttcccctctttgcttctgcttttcctgaagggctgttctgagcatccaaaggctccccctcgatcattgatcgatttctggtacccagcatttgctttccctattaagcatgaacatctaagacttcagaggaatactttttcctccttgacccatttaccagactttaggaccatgatcggtctctgcaatacccacagtactgggttttccccccaacttttggtggtgtggatgaagcaccctcaactccagctccacagtacataagaggacaagttatgcaggtgcactaacttaatgaggtgattaattcttttagccagctgaggttggtgtcctggtaggcaaagaccggtcaagttttttcgtcaatgggctgacacttgggggccagaaatgttctgtgatccgggactcactgctgcaagacggggaatttacaatggatcttcgtaccaagagcaccggaggagcccccaccttcaatgtcactgtcaccatgactgccaagagtgagtttgactgattctctagctttgaaatccttttgttagtcactttatgtgtcctcagtgtcaaggctgcataacagtatttactctgctggttatgggaaccgtggatggtcctttgggttctgactctggctccccagcttgtaaagaaactaaaacttatattacctcttaagtcccttcttgctttgagcttttttgagattagtttgcttagggcagttgggatcttaagtcagcatttggctctaatctccagttctgtaaagacttgagaggtaggaagcgcatcacagccgttcctagccacctacagcctggaagtttaggacctctaaattttgcctttttctttactactcttaaagctcttttttttttttccttctttgaaaagctctattgttttaggatgactgacagcctgcctgtgtataagggggggagggctggttaggagggctgaggttaggttacaacccccggggccagacagctgctgaacagctggcagggttgaattgtgacacctgggtcctagcttcctttttctttcctccagcgctagtcctgctgatgggcaaagaaggtgtccacggtggtttgatcaacaagaaatgttatgaaatggcctctcacctgcggcgttcccagtactgacctcatctgtcccttccccccaccgttccctttggcttttgcacccccttctttccatacacacacataccattattttttgggccattaccccatttcccttattgctgccaaaaccacatgggctgggggctggggctggatggacagacacctccccctacccataccccctcctgtgtgtgtttggaaaatttttgtttttgggtttcattttttgttttttggtcttttttttttttttttttttctgaataaaaaaagattctactaacaaggacctgtgttggtttgcacttggcattagttgggagacaagcacagtgacccacctcaattaggtacctgcttcttggctgtgtccagaatgaactcttatttccagtcttatttccttttctaagccccaaggactaaactaagtaggcattcttctgtgtacttagtcatgtgacctaggcccctctatagtggtatttccattttcaggtccagttgaattagtatgtaatggaacatagccatccagaccagagaatgggtccaagcctgcgggtgaggcagggccacttgagtcatcctgtgtaggtggggctcccctccctgagtcatagcaaatgcagctagggctctccccgacaagttcatcctatgaggtgattatttttccagaatttcacctgtgtaaagatgatctta

SEQ ID NO: 20070 - DNA, 1105 bp, Mus musculus
tcttttttttttttttttctttttctttccctgcttcctctggcttcctccttctatagccaagtggtattcaggatgaatcggagcgagccctaaccttaacctctcctgccaccaccactctatatagcctttggcgtggctttccatcgaactcggcaaattttgcaaagtggggggagggttttttaaaaattgcatttgcaaaagttcgctatctggcccggcggggggggggggaggatggagggagggaatggggcgcaggccccgccccgccgccctttgcaaataaaaatctagaggggggggggaggagcaggaagtggcggtgcgagggctgctgcacagctaacagagccgcgttccggacggcagcgcgtgccccgagctctctgccttcccccgcccgccagcccgagcccgagcccgcgatcccagcaacagcccgcagagcagccccagcagcagcgccatggccgggtggaacgcctacatcgacagccttatggcggacgggacctgtcaggacgcggccatcgtaggctacaaggactcgccctccgtctgggccgccgtccccgggaagaccttcgttagcattacggtactgcgaggctcgtgcggtcccgagcagtgaccggccttagaccctctgggggactggggtgggggcgggcgcaggcgagcgagggcagcgggaggccgtgatccggtcctctcccatcggcggggcgaatggcggctgcgtgagactggctccctctgtggttccccgggctctacgcccctcggcggcggcgcccatctcgcccgccgccccgctttctgcgaccgggcgttacatccggggcccagggcggggaggggcgcggcggccggtgcggcggcccacttccgcctcctccagggcggggcgggcacgcgctgcagttttagcccgggattatgattgataaggggctccggagcctggactccccttcgggccgaatgctcgctctccctccaccattgttccccctgacgctgatgggagcgccaggcgcgtggccttgggcccgggccggacctcggtagccaccctgcccctcccagctccgtt

SEQ ID NO: 20071 - DNA, 1205 bp, Mus musculus
tgtgtgtgtgtctctctttctgtgtgtgtgtgtctgtgtctcacgcgcgcggagtctgggggtgggatgggatggaggtgggaaatggaagggtgggagtcagggggtctttccaggaagggactgctggggaaaaaatgtatcatcccttctcttctccctattctgtccactccaggttccgggagccttacccacaaatgcagtagcacgaaacaccgcatcatctctcccaaagtggagccccgagctttagccctggcttctatatcccactccaagccccccgaacccccaccactgatagctccacttcctccagagctccccaaggcacacacctccccatcttcctcctcttcttcctcctcctcctcaggatttgcagaacccctagaaatcaggcctagccctcctacctctcgagggggttcatcaagaggaggcactgctatcctcctcctaacaggactagagcagcgcgctgggggcctgacacccaccaggcacttggctccgcaggctgagcctagacctcctgtgagcttggccgtggttgtaggttctgagccttctgccccaccggctcctcccagccctgcctttgaccctgatcgttttctcaacagcccccaaaggggccagacatacggagggggccaaggagtaaacccagacttccccgaggcagagggcactcacactccctgtcctgccctggaacctgcagctgccctggagccccaggcggctgctcgaggtctcgctccacagttgggagcaaacgggagaagaggaaacaaattctttatccaagatgatgatagtggggaggaactcaagggtccgggaacggtgccgccggtaccttcatcccctccttcatccccgtcctccccaaccgccttgccgccatcaggcagggcaacgagaggagaagccttgttcggaggctctgctggcagcagcagcgagctcgagcccttcagtctttcgtcattcccagacctcatgggagaactcatcagtgatgaagctccaggtgtccctgcccccgccccccagctctctcctgcgctaaatgccatcacagacttctccccagagtggtcctacccagaggtgagtcagctgccaccgcttctccccttagttctcagacttttcaaaatgaatgttgttaacccttatccccacggcctgtg

SEQ ID NO: 20072 - DNA, 1137 bp, Mus musculus
tttgtaagaccccactcccacccccagttcctctgttcccttctctctgtccctcaaccatgacttaaagcctgctggaatttggaagggatgggaagaaggtgggggtagggagggaatgaagaggaactggtggaaagattgggattcctgcaaaggaactgaacagaggaagagttggggagcagactagccctccccccaccccagcctgtctcctggcagtgtctctatggctgctacgttcactcttccatcgtccccacattccaccggcgctgctattggctgctccaggtaagaacagagaagtcagccagatttctggttctttgaggaaaatgggttctcaaaagatgaagtgaaatagattctgagtgggaaaagcagaaaggaaattagggatagaacatgatataaattgggggtgactagaattggggtgatgctcagaagaacgtgaggaccaggaggctaagcccctgagtcctagaccccatggctctctgtgtgcctttgtgcccccagaaccccgacatcgtccttgtgcactacctgaacgtcccagccctggaggattgtggaaagggctgtagccccatcttttgttccatcagtagcgaccgtcgagaatggctgaagtggtcacgtgaggagctcttgggacagctgaagcccatgtgtaaggaacaagcagggatgaactctaagggagagagagagtgtggtacttcccaaagcactggggttctgtgcccaaaccccacgggtaactctttctctctaagccaggagggcactttcctgtttggatactggacacagagcgtgtgcagtctaagatgtggactatggagaggggagtgagagacagctgtgggctgtatgtctgaacaggtttaagttcagcaagtcggaggtttggaggaaccatcaaggtgctttggaagtctcacgtcttttccccaaatctcctctagttcatggcatcaagtggagctgtgggaatggggcagaggaattctccgtggaacagttggtgcaacagatcttggacacccacccaaccaagccagcacccagaactcatgcttgtctctgcagtgggggccttggtaagtgacccccatactctgg

SEQ ID NO: 20073 - DNA, 1160 bp, Mus musculus
gggatagaccagaatgatcagaaagagtgggggcaggaaggtgctgggagaagagatgtagatgtggagtcttgctttctcttgcttctctgggacatgggaagaggatgcctttgcttccagcagctcaccagaggaagcaggtgttccctggggtccacacctggatacgcaggtgctccctggggtccacacctggataagcaggtgctccctagggtacacacctggatcagcaggtgctccctggggttctcacctggataagcaggtgctctctggggtccacacctggatcagcaggtgctccctggggtcctcacctggataagcaggtgctcctggatcagtgagaggcacactgactcttgactgtttcagttttggggtggtagagtagggtggcaggttccctagaatcaagggcaggatctgtgcttgggcctgggcatgtttttgctgctgcaggtgagcaagtctactcttccatttccaggaaacaggattgtaatgggcaagaaccatgttttccgcttcaatcacccggagcaggcgcggctggaacgagaacgtggggtccccccgcccccaggacctccctcggagcctgtggactggaactttgctcagaaggagctgctggagcagcaaggcatagacatcaagctggagatggagaagaggtgcggggcagctcccacaggtcccaccaacctctgggagcctagtattctcctgtgggtgatcctcacagcttctccttcctgtctcaccccaggctgcaggacttggagaatcagtaccggaaagagaaggaagaggctgaccttctgctggagcagcagcggctggtgagggacacgtgggggccaacagagcctgggcaggtgggcagaccaacagtgaagctggcatcatctcagcctagctttgctgttggtgtcctgggtggcacctagaaggacaagtcaggagaggaaggggaaggggaagaaaccattgccctattcagggagtgagcacttggccctgctgatgacactccctggactgcagaggtctgggccccttgagatcacttcgagtaccatccttcatggaagattgttccttagatggacctcatcccgagagtaatacacagtcatttgctgcataat

SEQ ID NO: 20074 - DNA, 1163 bp, Mus musculus
gaagctttgttctgaagaacatgcatgtcatttgccagaacctagggccaaatattatcagatatcaataatctatattcgaaaagacaactattgtactgtctcatctcgtatatggaatctagggtgtttgtgtgtgtgtgtctgtgtctgtgtatgagagagagagagagagagagagagagcgagagagagagagagagaagacaggtgggtaaaggaagagtgaggagagtgaaatgagggcgacggctggtgctaatgcagtcaagtacctgatggaccggaaagaaatggagttttgaaggccattattttgtaaatataacaaatgcatgttaataaaaattcaaagaaaaaaccctgaagaaaaggattgatactcaatctcatgaatgctaataaagtgtgtactatagttgttatactaattttagcaaataggtagaccagggtttcttagaaaagccataaattagtaaattgttgcgtttaattctttgtaatcataggcccaagaggatgctgaaaagcttcgttctgtcgtgatgcccatggagaaggaaattgcagctctgaaagataaactgacagaagctgaagacaagattaaagagctggaggcctcaaaggttgtgagatgctcttacccatctgctccaatgccgggaacaaaattaggatcacttaagaagcggtgctgggaagtcatttagccttgtgtcttaagaatcttattttttgttttaaattcagaaaagcaaaatgaaagcaaaccccctctatcataatctggcctttggttatttaaactctcagtgatgatgcttattcatgaatgaagactgctgttcagtggcttattttatccaagtgagactcaacctcaattttctcttattctttcccccccccgaaccaccccttcttggtttactgaaacagagttggtctgtgtagccctgtctgtcctggaactcgctttgtacaccaggctggtcttgaactcaagagatgtgcccacctctgcctcctgagtgttgggattaaaggtgtgcactaccactgcctggccctcctttttcttttaacaagttatcttttttggtttattcttgtaagacagggtttcatgtagcccaggctgaccttgaacttgccgt

SEQ ID NO: 20075 - DNA, 1228 bp, Mus musculus
acgtgtgtttgttccttgagtatgagacagaattattttgttttggctgataagtggtaattttggtgcccttcaggtacataatgctggaaataagcttggtagacgttgtgatatgtgttccaattatgaaaaacagttacaaggaattcagattcaggaagctgaaacaagagaccaggtgagtttcattagagccacagagttgcatttttttttccgtctgctatatgaagtgtatctatctggttatggaataatctagcacacacagcggcaacagtggcagctgatttccaatgagagcccagtaggaatgggtatccatttttcattagcatgctaacactatatcagctagctcagccctcagaggtgccagcaaaccttagcacctttctctgcactccatcacccaaacacctaaacctgatgctggcttgatctcagcctcacagtgaacttaatcgtacagatatgagggaggtaacatttactgtggactcataaaagctagccgggtgtcatggtgaccagagtttggatttgttgcttactgcctgtttgctgtaaatttgttgacttgattaatggtgattcacagggcacagaagttaagctcccgcgggcttggactacttgaactacttgagggtaaagttcatttccaaatacagagtagaagagtgtgacactggtaacagtgtagagtttaacaagagtagtcttgtgatagtgtgtcaggaaaggaatatttttctttgttatgaggatctgttgttgcctttgccatcagagctgaaggaggtgagattaaagatctggtattttcaggtgtcactgatactcagttcctcatctgtagtctttttttttattgatagcttacaggtggatttctaaagctacttaaactaagataaaatggttggcttctgatagcctgacatgggaaagggctgtcttggattccttagttatttctgtaggcttctatagatgcctcttgcttgcctggtgttttactgggtttcagcaattcagatacagttgaaagatggttttggcccataaggagctttcagcattacaaacccaagcataagttcagtctgtcttgttcctagagatgatgtctagtttagaggaggctgtgtggcttagctgtagtttcaggtaaggcaacacttgggctgtgtgctttagagtctgctttcacattaggaga

SEQ ID NO: 20076 - DNA, 1174 bp, Mus musculus
ccttctgtgggagggggcaccaatgtagctggaggacttggatcgcctctatctctacctcagatctttgcatgatcactaaagccagaaacttggtcttttctatagacttgggccccttctcctttcccttctaccttcaacgtatcatcaggttgagtgatactggaggggctgagggataccagtctgtaatatagattaatttggtgaatttttaaagtattttttcttttttcttcgaagagctgtatctggtgaattgatctgctgcatgtcaactaaatagcccaagtagagggcacataggtaggtagggcgtcatctccccgtactcagctcttcattgtttctccaggtgcagttggagaggatccggcaagcagactccttggagaggatccgggctattctgaatgataccaaactgacagacattaaccagctccctgagacatgacaccctgatagcaggattctaacctgcattttgggtttttaactcatctttagaatatttattattatttaactcttaacggaagaagtcacagcaaaggaagactgaagaaatgcaaatctggagggagaaggctgctgtgtgcagggacagccaacacctttcaaagggaacactaataagacactggactcgattccaacaggtgtgggatcagatgaggtgccagaaaagttgctgtttcctgcctgctttctccaacatggattttggaacatatttcctgacatgaaagcaacttcccaatagtgtttggaattacgttttctgttcatacaaaccgggagagagaagtttcttttttcagttgtctaaggcttcatcagtagcagtgttcagctagcagagaggtgtagtgtgctatatgagtattttatattaaaatatgaagtgtgagagcaggccattggctgttgattgtatttcccttgctcagtgcattttgtttcctttttaccattttatcttctattggaagaccttaaatgctactgaaacttgcctgagaactataggaccatggcaagcaaaaacaattaaacaaaattagaatctgaatatttggctgaggccatatattggaagttgaatttatggaaaaaagcacaaacaaccttggaagcactttgcacaccgtgatgaacttcctgggcc

SEQ ID NO: 20077 - DNA, 1727 bp, Mus musculus
tgagtggtgttggcttacagctggtacccaaaggaacattatgggagtgagttaactagacttttctggtttaactaccatcaattcatagcgtaaatggactttgttagtaatgagtcattatgaatttgccctcaagatgtttgttactttcttcttttaataaaacagataaggcctacttaccccataaataggttacttttataatcatgaatttaaaagtaaatatgaattatggaaacgtgctaaaagcttgccaatgcatggaaaaattaattggcttaaagtcccttgtatagtgctacttggtttaaaaggaatataatatcctcattgaattaaaaggattattaattataatgggattaaattagatttaagactagtccctggaccccaagctgatttgtttggatcaccattggctacagttgaatggataattcataatcatactgaactgtgtcactcccagtgaactgttttgctgaaaccaagtatcttacagatcttttctcctgaagctggggattgtgcagtaaaagcatcatgactagggtactgtttagagtctgtaacttgtggcaaatgtaaactgctgggatccactcaattgagaaacatcctaggggaagagaaactgaaatgctgggttgaatgaaataaagtaatgctgcaccaccaggtaagcagcagttctttaaagtcaagtcagttttctgcatgagagaaggtttggtgtaggagctgacgtcaccaggagaggaaaggttggtctagtttcacacaccttcctgtactgcattcagtctgtgtagacctgttctcttgcatgtctgacctggcttaactctaaactgtaacataccttattctgtggcttttaattggcagtcacttggtcatttctaggcatatttacctttcagaacttaagtaggcagatatgaaaagatgacctaaagccaaggacaaactgtatgcaacagaccacaatgttccttttcttttaaggtgctagaatttgcacctcctacccaccaaggagacagacatagccagactcaactctggaaggtattggtgcctgtgaggaaatgagccagcagaggacgctgcagctgtagaccttcagctctgctctgagcagactgagtatctgtgttgactgtactgaggcatgcccttaagaaagtgttcaaattaaaagagctgctgctgagtagagtgtgtggccttttcctttgcatcccagggttctggttcccttcagaggcacagttttggtactgctacttaagatgaagatggacctggcagtgttcagcaggagcctgtgtccagaattaaaacaaaccaaccaacccatagactttaattgtaaagcaaagtcaaatttttgaataaaaatttattcaaactttatttgaataaataaatttatttaacagaaataataacaaaaaggaataacaaaagaataaccacaccaaatcttatccaaaatgctcctttataaattaaacagtgctccctgtttgttttacagccttcaagttatgttcattccaggtggtgtcagaaggtgacatgatttcggatgtcattgatttgcttcaccatttcccttatgtgttcacccctgcaaaatcatcaaatgaataagatgagctgtcattgctgagttgtaaggactcccaccatcctagacagggtctctctgt

SEQ ID NO: 20078 - DNA, 1465 bp, Mus musculus
cagaactgacatcaactcccaactttgtggttgaagttaccaagactgatggcaagaagacccttgtactggactgtcactatcctgaggatgaggtgggtagggtggagtcttctgaccttcatgtagcatacacaggaaagatctgttaatctattagatggagggggtgggaacagggttagaactacagagcctctttgcacttcccttacctctgctgtatctctcagattggacacgaagatgaggccgagagtgatattttctctatcaaggaagttagctttcaggccactggtgactctgagtggagggatacaaactatacactcaacacagattccctggactgggtgagtgttggctgagggggtgctgggcgtttgcagagaagtgtcctctttcaagcattacaagaggggaaataaatgtgtctgcgtgggtgtgctgaaccacacgggaaggtcagcccacagaccttgccagaccacttttgggttttgtttttcaagctagtaaatgtattttctccccaggccttgtatgaccacctaatggatttccttgcggaccgaggggtggataacacttttgcggatgagttggtggagctcagcacagccctggagcaccaggaatatatcacctttcttgaggacctcaaaagctttgtcaagaaccagtagaactcagagactgcgggccttaatttaaatggcaagctttggccagtgaacaaaagctcccttggcatcagaattatgcttcaaaaatggctgtcatcctaatatatcggggggaagcaagtttaaattactgctgttacacctccattcgctattcctttgggctttttttctctgtacaaatttattatttgtagatttttgtataacatgatgatggacaataaatctgactccaataaatctccaggaaagttgaggttctttcgcccacatcagaacaccaagagcagagatgtctgaagttttaatataaaatccgttatatacaaaaggcttgtgcatacagggccctctcaggaaatgagttgttctcagctcagtagtgaagtgtgaggtcgggatggctagaggatcacagcccaggtgtcacaagtctggattaaacagaaaacaagatagtgtaacatcaacagttagatcttacatggctaaaagttgtcatcagtcgtgacatgtgtactacaagtagaaccactatgagttaattcactggaattcaaagaagccactgcgttcatggacctgttctactaaacagaagccatcagcaatgtagcttataagcctaggcaccctcagaaagcaaaacccgacagcttggggcttgtggagcctgacagcgagcctctttggatttaccaagtattctaagtctgcttcacagtagcctcttaagtgatccacacctatactcgcctcatccttggtatctg

SEQ ID NO: 20079 - DNA, 1189 bp, Mus musculus
cttcgcaagaccaagggcctcgcctatgatgtaagccatatattcctgctcccaggaaaccgatggtccattaaaactggcccatgaattgttagggcgtgcaaaggtttccaacataaatccttcatcctgttcttgggattctggatctaatgtctaatgaggccaggatgtccactccacagcaactgcgtgcaggtcagcctgggctttccagaattagtcggtttcagaagatcgttaagtgatctttgaatatacggttttgcgcgagttggggtgaacctgaacgcattccgcggtaacaaagcttggtgtggattgagaaaagcaggtgaattggggagagtgggcagcaagggagacatggtggtcaaggtagctgagtcaaggcctccccgactgcactggcggctcccagcagagggcgcggtccggcccggatgactgcagtcctctggggtggaaagcgcttccccgggcgagggcggggcttccggcagcgcgcgaggtcacacggtgccttggcccggtcgtccttccctctgcacgtgtccgccccgcgatgctccctctgctgcgttgcgtgccccgcgccctcggcgccgccgcctccggcctccgaaccgccatcccggcccagccgcttcggcatctcctgcagcccgcgccccggccatgcctccggcccttcggtttgctcagcgtacgggccggctcggctcggcgctctggcctcctgcagcccccggttccctgcgcgtgcggctgtggcgctctgcacacggaaggtaaggttcacgcaccctagtcggagtgcggccacccagcttggaacagaccctcgtgatcgaaagcttccccccccttctcgcgtcttggaaatgtggcttagcaaagtccgtagggtcgtggtttcaaagtgtggttgttggttatgtcttttggaaccagaaagaggataattgggaattcttttgtttaatatgggaagtaatagtagtgagtccatgataagaaataaccatctcatgataaatatcagttcagctcagtaagtatatcctgctctttttatagagtgagaaacggacgttttaaggagtgatttgggctagtgtcgtaagaatggatacagtccggtctatcggtaaccggcttttctccctttgggtcatcttggcttttc

SEQ ID NO: 20080 - DNA, 1105 bp, Mus musculus
gctgcttcctaaccagtcgccatctgaaaccttcgtcgtctgcacttgttagagggaactagagaagcctcggcatccttttcccagttggaaaagagtcatctttgctgatgactaggagcaaacattccccagtttggtactacttacctataatcactccccgctgagaagggagggctgcgagtcctaggccagcctgggctaggccttgtatctaagtgaaggaaggggaaggaacacactttcacagagaatgtttgaagggggggggagttttagcccttttattgtgcttaatcggtccaaacacatctgtactactgggattttctcatttatacagtgaattgtatttataagcaacaaatgggccaaactgccttcaaggcacttcgaagacagtgggcagtttctttgagtccagcaagctctttccagagagcctagcctggctgggcacttccattgccaggatctcattggttcacagctgtgtctgttgagtctggtctaggctttatctaaccctagccgtgggcaaagcttttagtcagtgcttagggctgtctgagtactcgtgactacttggatagaaatggtcacgttatcaaccttctgaaaggctctccggaatgtgctttctttttcagtgtattttttgtatttatgcaaggtttatttagccttgcttggtaagaggaacttttgtattttgaaaagaacattcatcgtgctagttaaagaaaacaaggaggcaatatattccccagcaattaacagtttctgttccactgtaaactaacagtaaactatcgaggtcttttctgggtcatgggaacagtagcttgcagtgactggctccagggtgaggcctaggaccttaccctggagggactgctgcagaggactgggacctcccagaaaagggagtgatggatacagtttctaaggacccaatgtttctgtatagaaatatgtttatcattctaacattgtggggggattttaatagaatatttagttttttattaagcttttttaaaaattactattcaacacagctgctcagggattacatgaggtgggagccccattctgactc

SEQ ID NO: 20081 - DNA, 1234 bp, Mus musculus
tttagtttagttttcatctcagtctctcctcccttatccatgtccttcctcaccctttaccctttacccaagctgctgcctaaggcattggaagtgactcctttggatgccaatcgaaatttcactttgtgttggctgcagtgtgcaatgtgtgtgcagtgctggggagaattaatgcttgaggtcttttctgtcttctaaaacagatgtcaatgccaatcatgtcatctcgaggggacatggagagtgtccgccgttgcatggctcacagcctctttatgaatactgctgaactccagacagatggcacctatgccaccacggacacacatcagccagtggccatccacccatcatctgtcctcttccactgcaagcctgcctgcgtggtctacacttcactgctctacaccaacaaatgctacatgcgtgacctctgtgtggtggatgccgagtggctctacgaggctgcccctgactacttcaggaggaagctgagaacggccagaaactgaaccgttccaggatgctgccagcatggctgggcctggagcttagatcacagctgtcttccaaacataagtttgcagccagacttccagactccaagagcttaaaagaattgctgaagcttctcagactcacccgtgcagaatgatcctacgtagagcatgagaagctgagcttgtgcctcgggtctcaccaggcagttttggagactgaattaacttctgagcctcagattcctcatatgccggagtcggataagacttacacgttcagagtaatgaagtttagagaaaatgaacagaatgtgacagagacttgcctggtgcaagataagacaatctgtgacttgtgagccattgtgctttgtgatactaattaggtacagcacagccccttgagctctcatgactgggggaggagccataggagactacagatccaatttgttgaaatgtttctccccccttcttactccctctcccgtggatcccagagcctcatgcatgctatgcaaaacactttgccactgagccaatccccagccctcacttctactttaatgtctacctgtgtgtattttagatagaaaattaaaaaattgactcccacagacagttccagagtaaggtatattctgacctgttgacccttatggctcagggtgtagcacattgtcttgtctgtctccaagcagaggccagcaagtagttccttggttggtccc

SEQ ID NO: 20082 - DNA, 1167 bp, Mus musculus
ggctgggtcatcctgtttaggctgagttgcttttcagatgagattttctcagaggttagcataggcttaagtaagctctagtaaacattctaggtggaaagtttcagatacatttgaggtagaaagtattttaatgactaagtggaactcgataaggaatggaatgagtacggtactagtaaatcactgaagaccattgtaactctatgggacgtgggccaatgggactgcttttgtcttgtttaaaaatttttaacgtttaatgacaatcttagattgtatgatccttatgggattcttaagtttgataattgtttttgttcaagaaggccttgtcagtaacttttaggaatttatttttattattattgcttgcttttaagccagaaatgggtttctttaaggttttatttattttccctaagttaattttagatttagctagttcatggagttattgtgaccgatctttaattctaaaatctctccaccagctattttcattttaaacagtgaatacctatacatattagtgactgaaaacagaaaatatattttggattattgttagggtgtgaattcctagtggtagaacaccatgctgtgtgacacactgtctcctggcagtgctgatttcagtcacttggcctcttagtagtttggcaggtccctggccctgtgttgtttggcaagatccctgtgctcactgggacacaagggaaagtcctcacttccccagccaacctctcaattccaattcttccaaaacacacttcctttttgcgatatgagtcagcagaaaagtgagattgcattatgggattctgtgaccgcttaaacttacatgaatacagtttgagccatttcctggattgattgtatcagaaatatccgaaaagcacacctaaagcatagggcattttgtttcgttgttacaggaatacagtatatgttcatttaaaaatgaatggacatgccaattgcatctccataggagatagattttatatactttggtgtgtttttttcactatgaatttttacttgtttcttccacttctttttctgtccctctgtgtcctcctgtcttttatatttcttttgtacttgcgtgaggcaaagcgtccacatcctggatcttgaaatggaaccataacactgtctcta

SEQ ID NO: 20083 - DNA, 1198 bp, Mus musculus
aactgggctgggctgcccagagagtatgtgcccagatgataggcccaccctgatttcctgctcctgctgagatgcggttataccagtgggctgaacactgctctagtgcattgatccatggacccctgggaagcatgggggctggcacacaggcagcagggtgttcttgaaggggctgctttgtgtgcaggagatctgaggcagcacaaggcttacccagagggatgtgtatcacaggacactccttgccggacacttacgcatcctcagacacacttagacatcaccccattctcacagtgaccattttaatgtgcctaagccacttgagtggggtgggtcagacactcccagctttgcacacacagacaaatggacacacacacacacacacacacacacacaatgtgccagagactgactatctgcctcacacacgctccaggctttgggagaccctgggtttcctgggctcaattgggcacaaattggcttttgggggcccttggctctgggatattgtgctggggagacactattgatctgagtagtgcactgaggactggaggtacatagacagactgttgctgatgggtactgtatgaccctgactgcttgtctgacatcccataaatgtgtgtgctgtgacatcctggcactgcaaacactgtgtctctgcctctctcttctctgtcgatggtaactggccacattgtggcaacatgagcccccccccccaaaaccccaacaagcacaaaaggtgactttaggacacccactactatttagcttagcccaactagtctctttcaactaacaacatcagagcaggccacttgcttctttgtccaattgttttgggaaactggagcatcaagccctgcccataaggagcgagggccagaggatggtatgggggcttggccttctggggatctccaggctcaacgagagaccatatgcagaaggaagggtttgtggtggacaggggagaacctaaacggtatgtctcagggaccactaggaccagtttccccacatgctagcaggcccctgccttgtgaaggtcacacagaaagttctgtgaaagccacccagagacatcgacccacatgctgagcacttgagagctggaagcagtataatcgagtgctcacagtcatgttcaagtaagtaggggatttgaggctagctggtc

SEQ ID NO: 20084 - DNA, 1386 bp, Mus musculus
ggctcagagcaattaagtgttatgagcagacctgtcattgaagtatgttagactgagatggaggagggaagagaaagaataggactaaggtaggatccagagctggcatccagaaaactgagcctccctcactctctgagttagtctctgcctgggggctcagatgtagagtggtcttgctgctacctgctgagttaccacactggatctcaggaaggtcttggaggagagtaccatctcatggggagtcatgctgttgctcttggcttactgttgctgctgcttagtaacagcagactgtgtttgtggggccagccctgggctggaagaatggctagagcctggtagcccaccttggtcctatctgtgccaaccttctcacatgaacccatcacagaggatccaggagtcctgtcagagtggcaccaagtggctgatggagacacaggtgaaagtgagaaggaagcgaggagcccagaaagacagagggtcaccaccacccagtctgagccagaagaacactcggctatgcagggccaaccgggatgctagagtcgggggacatcttcgcctctctggccagatgggtccgcatgcccatcgccgtcagcggctaaggagggagtctgccctccggagcccctgttcctccacagaacctctctgctctcccaggcaagtagtcgtctgagcccaggaggacctccccttctgtcccacgagtctcctcagtcacctgggacgagaatgccctgatctgtcacatcctagttctggcccaggtctgccccaaagctggtgaggacctgagggggaaaaaaaatctctgagcctcagtttgcttagctgtaaaaggaataggagatgagtatcactccctcctagatgggagacatctggaagaccgaggcccaggtgcaagaccagcagcagccctcaccgagctataaaataactgcccattgcttggcctctcaggcttgcatgtcacaccccaaagggaggctctagtggggctttcccagtcccccagggtcacctgggccctgctcagggctctttctaatccctgctgagacatctccttgtgttcagtgagtctgacagtgacctagagcctgtgggagccggaatccagcatcttcagaagctgtctcaaaggctggacagagccatcaaggctgaagagaggtgagctgcatcttggggtcagggtaaaatggccatgggctccttgagccatactgtatttctagagaaggtgctggttctaataccaacctgccacatgaccaagaccaagtccttgtccatctgtgcatctgcctcctgggatgatggtaaaggatgcactaggaatcatccaggttatagattcccaccttc

SEQ ID NO: 20085 - DNA, 1310 bp, Mus musculus
agtggtgacatgaccgtctcccttatccgtgaatgaggacagcaagcatcctacaggtaatgaccctgcgtctttctcagtctcttcctcctccttctccttttcccacatgtaagtttgcacgcacacttgcaggagtgtaaagaaatgaatggagtaagaaaaccacagggtaggttggtacagagttgtccacttccctcagccaaagctgattacatcaacaccctgtgatttcagaggactgaaagtcaactctcagcctctcaattgggagaagggacctatagtatcctatatctcctgccttgagaatatagagacgcacagtggaacctctgtcttacaggaagccggctctgtccaaccaccaagccaccaggatgtccatgctgcccaacccatgaacttcctggagacagcattgggtttatcagcatccccaggccactgctaacaaggatttgactaacatagggtccagaacccttctacttcagccatatctgggcccactggtaaccactggccacagcctgagagttatttaggaagaccttgaagaggtgatgggaactgcccatgttcccccaggggactcctggactcgggcacacccatctggctctccagcttcatagttgtccatccatattaggaatgtaccagaagatgctagatagttctgagtctggaaactaggaccaaggacctgcaggagtcatcccacaaaccctccccctgtattcccagggcagagattccggaggacccactttcactgctgcttcccacccccaggaccccacaggaagagaggaggtatttgcagactgcaagcctcagctcacggagcctacttatcttctccatgtaggggcactagcgtgcctggaggggaatgctgttcgaaagcagtttcttctctttgtaaattatttaagacatctgctatgtcattctattaaaaagataccagtgtgtcatttgtaggtcacattgtttttcgtaataaaagctcgctttccatgcttggcatgtttttagatatctatctgcacataccctgaccccacactgacaccgtaggtctggagtgcatacccccatcccctccactccgtccttctctcagagggaaacagagtataagaaaagctttttcaccttagcccaaaacagagcgcatcttaaaggcaaataaggtttttatttaagtgacaatatttcagagttaaaaacagctcacatcaaaatcaagaccaattgtaaaaatcttttaactccgtaatgctgtttttttgtcttgt

SEQ ID NO: 20086 - DNA, 1151 bp, Mus musculus
gaatggtcagcagcctttagagaagaggactgcggagcccgcagtccccgctagggtgaacagggcctttgggatacctgggactgcaggctcggttgaggcagcaatggaccccaggacagtgtgggtgaacgggactgtgggcgagcccgaggtggttgggcctgctgggtctgtgtgggtgactgtatctggggaggaggagctagacaataggagctctccaagctgtgagagaaaaggtcgtccaggaacacttggccatgagagcatcctggaactgtggttgaaggtgcaggctatgagggtagcgtcgggatgctgggaaggaagcagagtggagctccatcccgttcccgtgggagaggggccgatcgagaagggtattcctgggcgagcttcctgggtagagaccagccgaggtggtgtcaccggaccctgggtgagaggcaatactaggacattcccccaggcctcaggactgcccacagctaggggaataggggccggttgtgagagagtctctatcctttgtaggcagggacaagctgggaagacaccacctcctgtgggtggacctgaggtagtagagaagatagactgtgtttcctctggaccttgggaaaaaagacaaactgtggtggtgcctgaggccataggatggtctcaggtcttgaaaaggcccagagctggagaagtgagggaatgtgagggtacctcatgtctctgtgggggagggcagtcagggcagttttctggggctctggcagaaggagctgaatatgggcatatgttatgggaaagggggctgatggaagggggccctgatgccctgctggtactacccagggccatggaagatggaactacctcccacgggggcccagggttgtggcaaaggagacaagagatggaagatataggttctaggggtattcctggtctaaggaccatgggacagcttgtaggagtgccttgtgctagagaagaggaagctagatgtggaggtgacccggggtcatggggtgcagcacaggctgtagaattgtgtgcttctgaggagcatgagataggttctcgaggtgcccagggcctgtggggtatagaacaggcaatgggagcacccagggctttggggaaggaggcagatg

SEQ ID NO: 20087 - DNA, 1296 bp, Mus musculus
ttccaacatcacattgttgttcagagtgcatcagaaacacacaagttggtgtccattcctctgccaatcctgacaaactattaataatgcagatattagtgtctggggtgtatttttaagccacttttaagattctgtcttcagaagaaagttgactcatttctgaaagcacctttgtcaatgttttctaaacccacttttcaggcttaaaagggctctccctctatttcagccctgcccctagaatcctaaattaaagagttgagggaaagagatggcaccaggcatgctgtctcttgttttcagcctatggggcttcctagtgtggaaatacaaggcctctcaggccaagtgttttaatgattcatcttgacacaagcatcctaactatttaataaagcttgttataactagctgatggcataatttgtgttcaaaaacttgtcattcaaagtagaattcactccacccctagtaatattcatagcaacagtgaaaacttaaccattctttttacagcctcaaaaacttgtggagtctgagtgctgtcaatccagccttgtggagatgatcttctctgaagattaagatttgatgaccttgccggactgtggtggcacatgcctttagtcccagcactcgggagacagaggcagctggatctctttgagtttgaggctacctggtctacaagttgagttcaaggacagccagagctacagagtaaaaccctgtctggaaaaaccaaaccaacccaaaaaagcctgatgattgcaattttgtattgattgcctggtttgtttaaaagcagccacattattgctttgaattgatgagtaaatgatgttattaaatcagtgtatatctaaacaataaagaattgaaatacaaaccattaagttttttaacacgtggctatctaaaagatttgagtaaaatgagtcttcagtatggtggtagtagctcaaaggaaatattgaagatagaaagtaacttactaacttccaaatctgcagcaattagtatctattaccttaagttctgtgtatttgcaaaaccctttctgcctttgaaatggagaacttcattaaaccatttaggaaagacatgggattcatatgcttaactcaggcagttttctttcacaaatgtctaaaatgtgattcttttgttgtgaaacaggctggttctcctagccacaggccaagtactatctaaatcttcatttcttcaagtaacaattgtgtcaggcatagtgacacacacctgtaatattattttagatgctaaggctag

SEQ ID NO: 20088 - DNA, 1218 bp, Mus musculus
cgaggcccatctttactaggacccttccatctctcctgggacaggcaggaaccagagggaccagggctcaaatcttgtactatgtggctttgacagactactggctccatgctgggctcccggttctcacatgcctgctcccacggtctccacacgggggggtggggggggagcggattgccaggctgggagccccgtcctggtgcctcttctggatgtccccagatcatcatatctatcaccacgagagaacttcccatccagggcagaactctgatcttaaacacttcccactgccagagtgagagtgggagtcatggcctcctgaaaacttggactctgcatggtgccaccaccaaccattgagtagtctgaggtgctaacatcaggccctcctgctcactccttggctgacctgcccccctacttgcctcatttcatatttcatattcatttcatatttcatattcattaacagtttgagctcccttcccagctccccagtaagccctccttcagcctccagatccccacccccctagctgaggctcccccagaaaacccctggttttttttttttccagggagctcagtttgatcattctgggaattcttgtcctgccagcctggtgcggctgggatcacacttcaaggatggacagtggtgtctctttgggagatggtgttcaagtgggatacctaagtcttcccgtggctagatccagagcagattcagccggctcatttccaagggctgggccactgcacagtttgtctgtccccgttggactcttgagctcctctgggaaggcctttcccttgccggctgtgcattgtggccaggactggtagcaacagagcatggctgagaaggagcagcgtgcttcttggtgtctgagcagacagaccctgccagagtaaactggctgaggggagtgtccatcatatgaaagggagacaggagaggaagctctccgttgtctttcagtgataccctcttccttgcttaatttgctctgaaaagaagcacagttgggtagacgaggcccgtggatgtcatttttttttttctgggcagaagacagtatggggacccaagaagttcccatcaaagaccaagtatgtgcctggctccttaggagggatgactcctgaccacactgttgaaggcttgctcttgtcaaatactctgtctgctatggaaagttccagtgtgct

SEQ ID NO: 20089 - DNA, 1298 bp, Mus musculus
gctttcatctttggtcttcagaagatgtcttttccttcttctgagctacagatgacctggagaaaaggctttcgcttcttgcactgaactcgagcacctaggctcaactgctgggttggtggctcaagaaacccctgctttatcctaagtttctccctgacctttttctttgccttcctcattggctcttctggacaagacaggttaggaatatgaggcctagagggggagatgaagcaggagaaaggaaggaaagagggagggaggggaaagtggaaagaaagggaaagagaaggagagggggagggaggggagggaagggaaagaatgggagggggaggtagggaaggaaggggaggggcagggcggggcagaccagggagaattagagttcccagaaagtctttatactgggagttcttaaaagactaattgttagaagggcaatcgtcatagggaggttcacatggtgcagggccatcttgaactatcttagccccttaaaaagaagccatttgcccacatctgtgtgtgacctaacatcctgtgactcctaggtaaagttttgaaacatatgagtggatcccaactgctaagaaagtcatcacatatgcatctggagcctatagcaaggtctcccgctttgctataaccgctcacctgttgtaccaccagaatttgtaaagtgactttctttgttttgttattttaaaacttcacagaaattgttaccaaggtcagagcacagatatctgaagcaaactgaatctgtatttctggaccacagtcactcatttggctccaaaataaacttatctctgcatccttttagagctgtgtctttcacgtcggtgatggggagggtgacaaggtgaagccaccccgcagggtagctgaggtagctgaggaagggggcgtgcagatgaggtttagcagtaaagtatggagtaagtggctggggcagcttatctagtgacagacacactattcaacttttagacctgggcttcagcacaaaggttacccactggggtaggaaagggccaagggttacgtgtgcaccaccttctgaaagctggaaaggggaactgaccttaggttcaagccatgtcacccaccctcttggggtgaggtgttacctcatctgaggataggaaagtggaggcccatggctagcatgaggaatggacgagtcctcacctgggctttggaatggaggctcaaagctcccggaggtcaagactggagggaagcgacctgaacacagtgttgggttcagacctctctgctgctatgag

SEQ ID NO: 20090 - DNA, 1110 bp, Mus musculus
atcatacccactcgagtggcctgcttggttcccaccttttctctcctagctctacactcatatcttcgagattgacttctgcccggtgatggatgtctctgatgtggtcctttctgatctttctcatttttaatgtttggttcggacttgcctttggagtctttgatcgcttatctcttgctatttggacaccaaatagcccttggccttctttgaaagagcatgctaaaaatccgaaggctgaggctgaagcgatggctcagcggttgggagcactgactgctcttatagaggacctgcgttcagttctcagcacccacatggcaactaaccatgttctgtaactccaagatctgacacccttacacagacatgaagataaaacactaacgcacgtaaaataaattatattttataaaaattcctaaggcttgccttttttctggaacgttccagtgggggcaaagcacctgggaagaaggaactcgagagtgttctcatctgtgctccccagggcatgtgggaggaggtccctacagagtggggactggtgggagaacgctgtggatggtggtacctggtacacgtcagacatgtcactgcctgggtgtccatgctggcatctaggagattcccttgtcacctgggcattttggttctgttctggaggcaggtcatggttctctttcctcccctaaggctttgcgctgccacataggttgaggtaaaaacctacagttcccacaaaccccatgtttccttacatttctctcttggtttatctttttttttttttttatcacatctgagagaaaggagggcagtcagacaaagacccacggaagtcagttctctccttccaccatgcgagtcccagggatcaaactcagggtgtcacgcttggctgtagtcacctttacccactgagctgtcttgctaccccctaagcttgtgcttctctaacatcaagagctgatagcacaatccttctgcggacgttggggaatttgtgggtgtctgaattgaatattttacttcctccttccccccactacctggcttctcaaagcagtcaccgtttccaccaacggcagcaccatcactgcctgg

SEQ ID NO: 20091 - DNA, 2083 bp, Mus musculus
tgctattcgctctctggcgtgtgaccatgtgcccctcacactcgttactgattaaaagtattgatgaggctaagctgagccccacagtccctccacaggctggaaggagaaggaaaaactccagagtcaaaagaaattggtgctaagttatgatcttcctacagggagcgctcatggtttccctctggtgaatttgatatattggcttgacagggttccactgattatcaagctttctttcttttttcctatcaaagtacccagaggttgtttttgtttttttaacttcctcacactctctctttttttttttgttttgtttttggtttttcgagacagggtttctctttatagccctggctgtcctggaactcactttgtagaccaggctggccttgaactcagaaatccgcctgcttctgcctcccaagtgctgggattaaaggcgtgcgccaccaccacccctctgggccattgccaagaaacagtctctagttcttgggaagaaacagcttagtcagccccaggtcctatcttcctatcatctcttctctgtggggaggtggcaggatttctacctagtcctggacgggcttctggtactcacaggagaccccacaagtgtccagctaaggaatggttacctgagcagtaactgagcaggagcaaggataggtccttagggatgagagagttcccatttgctccaggtatttatagaaaaggattgcatctgtaccattgacctgtttgtacacatgtgacctgtttgtaagatgtggtggcactcttcgcttgggtttgttatttctgtgtgggaaatgggaggagggttgggcaataagagacggcatagatttaaacagagatctactgaaatcatacctttattgtttatgtatttaaaaccacttgcctgggaggctgaaagcggcatttgctgtctaccaatgtgcttgtccctcagccatctctatgttgttgaaggattgtgaacagaaaatttaccccctgcccatctatcccttagatattggcaaatatattatgataaaaagtggcccaaagttgatgactttgagtgatcattgtttttggggtgtgtgtgtgcacgcgagtgcgtgtttctttcatttatttgtatacaatgcaaggggttgggaatagaacccatgttctctaatatgcaagcaagctctcaccactgaggcccacctcctgcccctgcccctggggtggtctctttcatggaagcccatcaaggagtgctggtttaatttcacagctgtttggcagtggagtttgaatagaaaaaccatgagagtccacaaagctgcagctcttcgcttattcctccccaagactgaagattcattttagaattgagttggatgttagccagagacttttaaaacctcccttgaaggacctaatatgggcactttatttcatgtaaccccctctgagtggggtcagccctgtgtccgaggtgttgggagcttaggacagaatgtcctcagggatcctgggctctatgacagagcttgcaggtggtttgagcattttcagtggctctgtttgctcaggctgtggccttggtccatcttttgggttttcccacagtgggagccgttcccttcctggctctctcaacatttgtaggcttggagagccctattcttagcagagacacatactggggcttagggtttcaaacttaaagccaataagggcacactagggctctataaacagcgtgcctatatgtcactgagtagttgcacatggcaaagcatgctctcctgagtggcagacatggatttctgcctctgcacataaaatatagcaggtcttactggatgaggaattgcttctcttaaactgtaggaacggtgtcccttgtgtcccgccttcagaacattacagactagataggtttagggttggctctgtgatgttcttgtttacaattgtgtgtatgcaagtgtgtgtttgatgtagaattaaaagtaatgttttggcccaggtgtggtggtactcatttgtaattcagcagtcaggagatggagaaagaagattttag

SEQ ID NO: 20092 - DNA, 1214 bp, Mus musculus
ctgtgctgtgaccacagctatagcctgtgggttgagtactgaccagaaggtgtaggaacgttctcttcattggctccctcagcaggcttgccctctctccacaggggcaaaggtgagaccagggccaaactaaaaaggtcacagagtttcggtgtggccagtgccagcagcatcaaacagatcctgctagagtggtgccgcagcaagactgtgggctatcaggtgagtgggctgagacaagccagggatagtgccttccctggacttgctagcagggcaaggttctgctaggctgggggtgggggggatgggaggcagggagcttaggtcttctgagtggtatccaagctacccacaacacatgcttagaaattctacctgagcagactggtgtagtgcaccttaagaggtgagctccagcatggttgactgttcagtgggtcggggctggagaacccgtgctgagagttgaattaggtgtcaggagtggggttcctgttgacctcaacttttctccgcttgcagcacgtggacctgcagaatttctcctccagctggagtgacggcatggccttctgtgccctggtgcactccttcttccctgatgccttcgactacaatgccctgagtcccacacaaaggcagaagaacttcgaactggccttcaccatggctgagtaagtatggcaggtccccgctggctactggtcccagcctagaccctgaatacaacttctaccctggttaggatcaggacgcacagacagctttccagcgagcttagggaccttgaggccatccaggctgtctttctcttgtctgaatgggaagactgaggctgatgaaggatgtgcccagaatcacacacaaacagctcggtgatagagctctttctgctcttcccgcccccttgccgggtgcccagcctttgctgtgcagtctgggaaagcagccatagacagagcctaaggaacagtggggcaggggcactgtggacatcctctcaggctggtgtcaaggtccttagcaggaagctggggttgcctggtgtattttaaatgtagattatgtttccctaaatgctgtcacagcatgggctgtggaattacctcgggcttcaggcctgctttctgctattgtaacagaacactagaggttaggtggttcattagaggttaggttgactttggctcctgtgtctgtaggcgggacac

SEQ ID NO: 20093 - DNA, 1449 bp, Mus musculus
cattctcctctggctacatgttctggctgccttccccttcccccaatcacttccacaggcaatgggtaccttcttggagccctgaggatagcatctataaaatgggcctgatgtttgtttgatgaccaaattccatttgcataataacttgcccctgctcttgatctgagatccagaggaggtgggctatgaacccaggccacttggtgggttggcagctcagccaatatcccaggatttcccctgacaccccccctcttggtgtttgttcctgtaccccagagttactgtagcccttgaagatgtgtggagtcagccagatctgcacacactatatgtctagggaactcttgtgttgctgtgtctgacagaaaagcctcagggtgacttggctccatatccctttttgtccccaaaagaccttgcacctcaccctatctgtttcttccatgtggaagtcctagctgtgggggacagggacctagcctcccacacatcatctggtgtgtgtgtgtgtgttctcttcagaacttgcaaacttgatctttatccttagccttcttgggctctgggacgagcctctccggattcgggagtccctggcgttaggtgtgtacatgtgttttctctggaccatcgctgaccattctaccttctatatgatcctttcttccccaaatgagtgaagtttttgccatcagaaccagcagagattttgggaagtgcctttagggtgggcagctgatgggatgggcatatctggctctcaccgacagggttcagtagtgttggtgtctccacagagcgtggaacatgatgaagccagtgaccttgaggtgagacgtgcttcaaattcatgcatcttggagaacggacaccagctggatgcaggtaggagcctatggcagaagggaagttgcttggtagatctgaggttcggggcttcagccaggcatctgtggcagccatctcttgtctttgggggtagtcttgagactgaactccatcaggaagagacagttcaggggagcatcctcattcagtgtgtagtagaactcttaaaatacagagagcctggtgcaatggtgcgcgccttcaatctcagcactcaggaggcagaggcaggccggtctctgtgagtttggaggcaagcctggtctacatagtgagttccaggacaaccagaggtacatggtaagaccctgccttgagaaaacaaaacaaaacaaataaaatacacaaagaaatgggagttcaaggaagagatcttccctgtttctggaagaaagcaagcagaggctgtgtaattgtcagttcataaaagtgggtagagtggcccaagctggtgcaggggaagttgaggagaatcaggtctgagcggtgcagtaagatgtacatggtaatggaggtgagggaggctgaagtggtcagaaggcttcctggaggagc

SEQ ID NO: 20094 - DNA, 2199 bp, Mus musculus
ccatgtaagatgtggtcccttgaaagcagtagcgcttgtgagggatgggaggagcacggagattatattggggaaagctgaaggagggaaatggacttggtctggtttgttgtccctgggccactcctgagctctttctggtcttgcctggtagctgttgcagtcttttgaagacatcccattgtgtgacatcctggatcagatacaagaaaaatacagcctacaagccatgaacaaggtgcgtgagattcccagacagacaacctgctcctgaacagctatggggagggaccctcttcacctgtgttttcaatctttttctaggcaatgatgagacctagtctctttgcaaacctttttggagtgctagccctctttcagtcaggccgcctagtgaaggtaagagcttttggcacggggcgcagggactggtttagggctggaggggaacagatggtaacagaccctgctcttcaccttttgctctctgtggataccaggacaaagaggccctgatgaagtccgtgcaattgctgaagatcctgtcccaacaccccaaccacttacagggacagccaataaaggctctggtggacatcctctctgaggtagagaatcacaagtcatgccgtctgatttgggaaacgttgaaaagatttgggtaggaacatgatgaggacagatggtttgaccatgcaactggtatgaggaggttgtttgtttgtttgttattcctctctcaccaactatcttaaatctgccttgtctttcagggtctcagcacatgtccactcagttaggcagttcagatactccataaccctctctggtggcctttgtgtggctagtgtgggtctggaacagtgcttgtcaatgcctgagtatgtagaaggcaatctgagtacatttgccatagttggtttggtcaagcctgggtctgtttgtatctagagtcatttgccactgtcttgtccctgatttgtccttttggcacaaatggagacagaccagaatttaagttgcagctccccacatagggctctgtgtatatgacaccggctagccctcttacaaaacaaaaagaggtatagttttgaatatagaccccaggccagttagtcatcaatacagtgctggggtctgctgcttggcaagttgactgactagtggtgtatccgaagcccatgggtagaacaagacccaccctttccacctgtgcccccactccaggtcccagagtccatgttccaggagatcctgccaaaggtcctcaagggtaacatgaaagtgatcctccgctctcccaagtacttggagctcttcctcctggctaagcagagggtgccgacaaagctcgagtcactcatgggctcggttgacctgttctcagaagacaatattcccaggtttgaggagattgtgagtgggttctcacgggggtgtcctgcactgtagtcctccgggtaacgtttactgaatctcctctgccttctagtctggtgaacatcctgaaggtggccgccaactctgtcaagaaggagcacaagctgcctaatgtggctctggacctgctccgcctggcgctcaaggagagcagattcgaactgttctggaagaaggttttggaggaggggctgctgaagaatccgtcctggacatccaggtgtgtgtgacactggtcttccctctcctccagcctgggtgggacctgatcaagtacagggcctctgaccaggctctgccccaactctccttagctacatgtgcttccgcctactgggtgcgtctctgccgcttctgtcagaggagcagttgcagttggtgatgcgaggagacttgatccgccattttggggagaacatggttatttctaaggtaggtgtcgtcttcccatgtggttcagtgctgcctgcagggccagggcaggggttcttcctctgaagatctggtaggggaggacttggccagtaatcaggcccttttgtcctggggcccacttaccagcaggcccagccagccatctatttggaacactgctgggggggtcacattgaggggagtggttattgaccccagtgtgttctgcattttgtgcctagcacctgtaagacagtgatgggggtggggggctatacagaaagcacttgggttttgagccacaggatggcacgggtaggtactggtctatcacgacttgag

SEQ ID NO: 20095 - DNA, 2838 bp, Mus musculus
gacttgcatcaagaaaagcatggagcagaatccccgccgatcacgctctagagccaaaggtgtgtcattgctcctgggcaggctaagtaatcaggctgtctgtatcccgctcagcctaaatctgctctccctcctgtagcctcccaggagccagtatgggtggaggtgatggtggagatcttgctgtccttgctggctcaacccagcaacttgatgcgccaggtggtccggagtgtatttggtcatatctgtccccaccttactccacgttgtctgcagctaatcctggctgtgagttggggcctttggagaaatagattgtaagatgggtctactgatatgtgggagtatgtgacgtcttctgtacctctgcacctcaaagtgctacatgccgccatccccacaggccgttcaagggacactcctcttttcctccctggggtggtgggggcctttggccaacatagaagagactttcaggggtgacctaaggagagtatgaagttggggcagcaagtacagtggtggtctggaacttctcaggtgctcagccctgtgacaaacgaggatgaggatgacaacgtggtggtcactgatgacgctgatgagaagcagctgcagcatggagaggtactcaccagagggcgcttggtagggcgggtatctggacatagtctcttagtgtcatcaaaaaggtgtcttacctcttcccacccataggacgaagactcagataatgaggacaataagaactcagagagtgacatggacagtgaggatggggaagaaagtgaagaggaggaccgtgacaaagatgtggacccaggcttccgtcaacagttgatggaagtgttaaaagctgggaatgcattggtgagcaggacccaggggagagggggtttgtccagccatttaagggtcggctgatggctctgctgtgtctcagggtggagtggacaacgaggaggaggaggagcttggggatgaggccatgatggccctggaccagaacctggccagcctatttaaagagcagaagatgcgcatccaggcccggaatgaggagaaaaacaagctacagaaggagaagaagctccgacgggacttccaaatcagggtgagtgtactggtagttgccatgcaccctgagctgttcctgcctctcccatgtttctgcatgagctgactcttagccttttggccacaggcactagacctgatcgaggtgctggtgaccaagcagcctgagcaccccctgatcctggaactacttgagccactgctgaacgtgatccagcacagcatgcgcagcaaaggctccaccaagcaggagcaggacctcctgcacaagaccgcccgcatcttcatgtgagtgcacacgagttacccacccctgggttctcacgcttgcggcttcctgtgcatagaggagaggtcccatcccagccatcactgttagaatagttggggattccgacaagcccactctgttcctgtctctgaggacatagaacttcatcttactttacagaggccagaagccactgtcccacaagacagatacacgtaggagaggagggacactttagaggcatcaagtttctgtccatctctaagctggtttcctaacttagcaacgtgacttggggctgctctttgctgtacttgacagagcaaagtagagagacaccttttgaccaactttgcctttcctgcccataggcaccacctgtgtcgtgcccgccgctactgccacgaggtggggccgtgtgcagaggctctgcatgcccaggtggagaggcttgtgcagcaggctggcagccaggctgatgcctctgtcgccctatactatttcaatgcctctctgtacctgctgcgagtcctcaagggcaacaccaataagaggcaccaagatggtcataagttacacggagctgacacagaggactcagaggtgagccagggtcagccctgctcaagactctccctcagccttctccctgctcccagtctcaccccagctctctcaccaggaccaggctgctaactgcttagacttggactttgtgacccgggtgtattcagcatcactggaatctcttctgaccaagcgtaacagctcacttacggtccccatgttcctcagcctcttctccagatacccagtaagtatgggagccagcctgtctgttgggaactctacccagcccagtccccagctaatggcctcttgtccttccccaatccctaggtgatctgtaagaacctgcttcccgtcctggctcagcatgtggctggcccatctcggccccgccatcaggtaaggggctgtcagaaacacctggacagtcttctcacttgagaggcctgcgtcactgaccttggctgtgctcgtgctgtaactcgtgattggcacagaggaactggaggaaccttgctctctggcctgcataagagggcttcccttgtcggcttagatgccagggctatcagacaggctagagggagatcaacatgaggtcgatcttgcttctatccagttgggaccactgcctctccaggcctcggcaacccttttcccacataagaagagagaaattgatgattgtaaggcctagcacatgcagccttctctaagtttctgtgagttcctgagtcttgacctgacatactggggttcctactgactattacattcgccttgatgcaggcccaggcatgcctgatgctccagaagactctgtctgcacgagagctgagagtctgttttgaggatcctgagtgggagcagctgattacccaactcttgggaaaggccacccaggtaatagctgtgaa

SEQ ID NO: 20096 - DNA, 1213 bp, Mus musculus
aatctgtggatttgtgggagctgccttcttccagtaaatcagtgccctcccctccctggaagggccgggagcataggtcagcactggaacttgccaggtcctgctgtcttcctaaatcctcctggacaagggtgtaggtctctgaccttcccagtggcctagccctggaagctttagctttctggtaatgttaaacaaggatcagagccccaagttcacaggaatggcgggagaaagctgaggaagccagctttggaacaatacccaaagctccacctctgacctgaccccttcccacaggtgccgctgggacagcaatgaactgcagtttaggttgggagaggttctccagcatcctggaccggcaggacggtcccaaagcttcctgtgtaactcacagttgggtacccaccctctttggcctgggaccgccaggactgagtggccctatcttcaagaagaagccgcatcctcagttagcctggaaggctgtgtgtgctggaaccactcagttggacacaactccagccctggctggggactggagggccaagatagaagccaccgtgcagcagggatttggggagattctggcctgcccttagctcatatgatcttgagggagccactgccgtcctccttcgacagtagaaacaaggagctggagcttcctccattgtgtgccatgcaaggcacactccacagctttgaagaaacaggtcctgggctatacacagaagacatggctcaggtctcgggacctcagttccagttctgaggtctgccaaaggctctggtgtatggggaccacttccccactcttaggctctaaccttgggaacagcaaattctgcctggcatatgtagctgggtatccacttttgggtgtttctggctgggacagtctcccaggataccatctctgctgtcttcagctagttctttgcctggaggttttctcaggtgggagcacccccttaaagaaagctgcggcactagggggtgaaggccctggtggtaggctgagaacttgaccttttcttaccccagccccccaactcctacagtaccccagaagccacctcatcctacaggatgcaggatgacccaagagtcctttccaatgaggagtcagataagatgctaaaggacttacccagctgtccacactacttggcctagggtataaaactgctggagattgcccaccagt

SEQ ID NO: 20097 - DNA, 1170 bp, Mus musculus
agtggtggctactgggaagccagtaagagcaccacacacacacatgaagtcagacagcttgtgtatttctctgtgatattattagcttatgacttactgctcgacggatttagtggcagttttttgttgtttgttttgtgatgcattaaacaccaagaagtcactcagtatgatagatcaattaaaaaaaacactttaaaggtattataaacacaaattaaaatagaatacagagctgggcatggtggcacatgcctttaatcccagcatttgggagtacatttgaggccagcctgatctgcatagatctagggcagccagagttacatagacactgtctcaaaagaaaaaaaagaaaaaaaagagagagaacaaaaattagtcatttttcctcctgaccaagagtcctctttgagggaccttgtctttacagagattatcttttatatttaattttaattgagaaattatcttgctttgtagcaaggtgggtttagaatacttggactgcctagctctacctccctagcctggattacaggcccctaccccagctgaagaggtgatgcacttaatggcttcttggctgaagactgacacggaccagccactgttattttacacattatctcatttaatcctcctgaaagaaaacagaggcttagtgaggtcaaataaatgctgaaggtcaaataattgctgctaatggagttgctagagccaggaccttcttatttttataaacttctcgtattcagtgggcaaattgctcccaaggagccgtagttgacgcaatcaatgaagtataattttactttattaaatttttttttgtgcatgaatattttgcctgtatgtaagtatgtgtgccgcgtgggtgcctggtgcatgtttggtgctagaagagggctccagacctgctagaactggagttatagatggttgtgagatgccatgtgggtactgggtatctgtctgggttctctggacgagcaattagtgttcttaactgttgagccatctatcagtcaccatgaagtagaatttaaaaatcaaataccatatgtattggtttactcctttggtcctagcacttgtaagacagatgcagatgaatctctgagttcaaggaaatccttagtttcatagtaagaccctgtcttgagtggt

SEQ ID NO: 20098 - DNA, 1112 bp, Mus musculus
tgtctcaagagaatagagaaaggctcttggatccttttgtacgctaagcatgtggaggtatgagtccatataccatttacataaccaccgcctacagataatactgcatacacactagttatgaattggaatgacttttttattatatattatgtgtgtttgtaagttcatgcatgttacatcatgcatatgagagttcaaggacaaattaaaaaaaaaataaaaaaaatttttattctgaagaaaaggtggagagaaaaagggtcaaaaaggcctcacatgggagacctaaccttgtcccatccacagatcccatttagacaactctactactttttcactataggcttctctcagaaaccattccatcactcaaaaaactctaagctctcctgggaaagatgagatacagcataattatcactcctctgtgggatggttgatcctgagcctgcgggggggggggggggggcaagctggttccagaccttcccaaatccaccgcatttctttgcctccgattcttatgtgtccaaggacagggaaccaaaaccacgcccttgtaggaggatcaaggacaactttgtaagagtctgttttcccttccacctttgtgttggattcagatgtaagttacacttaggccatcaggcttatatggcaaatgcttttatccagtgatcctctctagtcctagagtatcagttctcaaccttttgggggttagatgtctcaagctaccctttcacagggtcagtgaagaccaacagaaaacatagatacttatgatttataacagaagcaaaattacagttatgaagtggcaatgaaaataattttatggttgggggttacaataggatgaactatattaaagggtcacagcattaagaaggttaagaaccactgtctttgcaagatgtgtttggcaaatgccaatgtgtaagaaactgaactatatagtaaaaaccagtcatttaggaacaaacaaaagacagacatttcactaaagaaggatggatacacagatgttaaataagcaaatgaaaagatatttggtattagtagacattaggaaaatgcaaattgaaagcacaataagacattaccac

SEQ ID NO: 20099 - DNA, 1163 bp, Mus musculus
gggggggggtttcgagacagagtttctctgtatggtcctggctgtcctggaacttactttgtagaccaggctggcctcgaactcagaaatccgcctgcctctgcctcccgagtgctgggactaaaggcgtgcgccaccacacctggcttatatgtgtgtctttaaaaggccatcccactgttttaacaggccagctgttcaggatggtgacaaacatggtaagaagtgaattatatgagatggcctgcctacacttttctggctggctgtgaagtgagcttcttggtcagaagcaatgctatgtggaataccatggtggtggataaaatattctataattccatgggtttagttttgtcagttttatatgccagaaggcaaatcaaaaaccagaatacatcgtatttcacaaaggacaaaacattgccctttccacaatggaaatagtagtcaacctgccacttggttgctagctggacacccaggggacttagtgttggtctctgctgctggcagatctggcacttagctgtagtgggagcaaggtacaacctcagaacacctaggattgtagagatcatgaagagaagttgaggcttcacactatgtggcagagtacctgaagacaaaaatttagatgagggtattggtgaaagtgcagcacagttgcagtggacatgccaacattttggagatgcctatactgtgagatgaccaggatagcagcagctatggagtggagccagtctgagcctacaagaaaagctgcatgtgctgtggatgacagagctggataaatgctgctgccaaggacctttgaagctcagtggatcctgagtgggtcctaaacatcaagcagtgactctacactgttggacttcgatttgatttgatttgtaaccgccctgattctgacctcttaaagtatgtaacttattttttatttttatgtgagcctaaagttgagatattttgaagttttagagtgactttggatattttaaagagactgaatttaaagtttgaattttttttttttgtttgtttgttttgtttttcgagacagggtttctctgtgtagcctggctgtcctggaactcactttgtagaccaggctggcctcgaactcagaaatctgcttgcctctaccttccgagtgctgg

SEQ ID NO: 20100 - DNA, 2534 bp, Mus musculus
aacaagtgccaactaaagatgattacgcattttgaattctaatgaactgttttaactttcaggaagaattgtaaagacatgtacatagcacaacatgatccggataatatatatactgttcatgtacatccacaaacacaccttgtaccaaataatgctttcttgtagtagaataagaatcgtgtaaattctaaaagactttagcgggttttcttttcccattcattgttttttatcagttcaaaaagattccttaaagcatgtcaggtgaaaaccaataaggatgaaaagtttccatataatttcctttaaaccattgagtctttcattacattctttccatttactaatcttttatattttctttgttttgtcacacccccctttccttttatctctgatatctgccagaaagttctcaaatcatttagttaaaatactgaaatactagtaaattacttgagtttttcacgatgacttcagaggaggggtcatcactaggtgctttgtcctttttgtactatgattcacccatctcttggattggatgtagcaataacattttctggctgttgagagctcttgatcctagtcattatctcctgagaactttaaaaataaaatgtaaaggctgttctaagttcatcttagtgaaatttattccaaacaatacaaaaatccagatttggtttttgcccttaagttgtctaatattaaggttggatgaatatagcatgcgcagctacaggctttctacatctgggattgctattaaaaatgctatttgtcctattacccttctccttagtccatatttgtttcttcttacagcagattttcctcacctattgtacaaagaaattgcgatgtatattttcatgtaatttgattttggaattttgtcaccttatgtagtgagttcttccaaaatataatttttttccaataattgtcaagttgttggcttttattgtattaaatgaaggttatagtactgaataccagagaagtgcagtttagaaaaatctcaggttgattccttatgcaaacaaacttaatacttgaaaatctcatggccatggcagtgtactctcgggttctgtctacagtctttaaatctgaaggtgttccagaggagagtcctttgctagctgacattcagactctgtcactgacatagtgcacttagatgtgatttttgtttgagtgtaaatatgtttcctaagcagttttataaaacaacttcggtgatgggtaaaattagtacattaaatgttgaagacaggctggcctaaactcctgtctggttttagctgagatgggaagttgtgtttggtatacaagagctagagagcataaaacagtacttgtcacttgatgctgtttgagtgcgagaataggtgtggctctgcccttggggtttggataaatcttttggcagaagagggaatgaaaggattcctgtccgtgtcatacctttcaacttatgtctttttaaagcagaggggaaatggatcaagatgtggctatgacacagcaacattttaaagttttcttggaagcattgtaaaatcctataaacctgaaaacccgtaactatggagcaactgtgaacacctcagttttgttggagcccaataatcttgaagagcttttagatagctgttttccaccccagactagaagagttattctacagtgctactgtcctcctataagggaccgtcagaaattgttcccacagtggttgcttccacaaatgtggagttggatttttgatctattgttgtgattcaagcagtctgttgaattaaaatccagggtttgaccgctcaacaagtagtaaattacctagtaactcagggacaactatttctgaacttataagtggcactgtaatatacttatttacctttggataaccttgtgtttctttgggctagatcaaggactactgggaaggtaggagtggttgcctttctcctgaagctctttcccttcgtttccctcatggtgccctgaccatttgctacacatgaaacgagcctaaatattagggcttgcttttctgtcagaggtgtcatctgtgcctttcctagtgttcatctgacaatgcctctacatttgacataaactcatactcaggtggcactaaaccaggaggcatttctcccagtaatacatcatcattagtgttaggcaattatgttatagaaaaggtcccatcactaccccaaaatcctgccacctatgtccacccatcagctactcccacagaattttttagattatagaattgttggctgttaactaatttgctcaaagttcttgtagaggattgcaaattttagtctgtttttgtaatgggataatattgatggctttatgacctcagagtttaaaattcacatggaattgattttcttgtcattagaaggtaatgcttgaacatttgatttttctattctgtgatacctgggtgtcatactgtctaatggcctttggtcccaattgtgaaattttatatgagctca

SEQ ID NO: 20101 - DNA, 4239 bp, Mus musculus
acttaccactttcttgggggcgaaggttcatcactgcctcagcgggtgccaaggactacacagcgtctgtgcttaacttcttcctgtttgctgtagcttagctactcattagtattttcttaagaactaaaaattgtgtgacttggtgtgacttggctggtagttggcagagttggctgcagatgccagagaccgggctgaccatttagaaccagtctgcttttcagtgcctctcacacttctttatttgtctccacagtcgtcactgcggccgtcttctttgccataaatgctcaaccaaggagatccctattataaagtttgacctgaacaagcctgtgcgggtttgcaacatttgctttgatgtactgactctgggtggagtctcttagtgaggcccccaggaggacccaggcctgcatccctggcacctccccagcagctgctctgctcaccggcctgcctcctacccagagcaagagctggcagttgtcttcctgcggcagaagaccatggcgtgatccctgattgttacaaatgattctgtatgactgtcagtgtgtcagactgtggtctattgcactagatgtctcactggttggaccaggccagtttaacctgcgtgacaaatgtgataggaattggctagcagcacacaaggacacttggagacaatgttcccttccagtaacgtagcgtccatctcagagaattcacaaagtctccctgcctgggctgactcagaacagagccctcagagcagagagcggctgctggatgagcgctggtcactctagggcggtggctaccctaagaggctctggcctctcatgcacagtgttttcataaagagaataggaacctctgccctcaagtcttttctttctttaagctaagctgtatttttagtgagctgcccttttaaaaaggtgaaatctttctaacagggttcaaagatgagagctgaaaaattgtggccttaacaactgaaagctttaccaatgttgctgctgctgggcgtcagaatgcctgtggcagcttgacacccagcagctgtctcatctctcgtcttgctgcgtcctgtctttggagtcctcggtcgctgccacttgagtggtggaagaaatgcactttgactgtgctgcacttttctagctgtgtcattggtgaatccaattcaaaaacccatgttcaagaatgccatcacatgctcttccatcagtggttctgatagccagcttggactggacctcagcacacactaatctaaaagggaaaactgccaagaaggaagaaattcatactgataagaaaggagatagctgtgactttgatccaggttctctctccctgacacatccttcctgctaaaaccttgccttgcatgctgagtgctagtggcaccagttctgggtggcgctgtgcctcatcagagctgaacagcccaaggccccggccagctatgagcagcctgttttagagctctgtctgaaatgatgagcgaggctacgaagcataggtctttggttcctgctgctgccgcctgttctacccctgggatgcggggcctctttcttcttaaagtttggccagtgttttgggttgtttctgtttgggaattttaattttttcattttattatattgcacactgaaagagaaacttacaccactgggttttctgtttgtttttaagaaacaaaaccacaattgctctgagactctgagatgaacagtatctggtcatagtcagagcttaactgtcaatcactcgcactgatttttttgagacatttgataaccctacgatacttgcgttaatagagtatggctgtatgaataaaagggacttcttttggcatcactttcttccttggatagtggtatgctctctgttgctgtagagttagacatcttactgcctaaatatgtataaaatgtgctgagaaaccagtgtgctactttctaaaaatatttctgtgatttatatgtatgctttttatgttaacattagcttgtacacagtgtttaaaaggaagagttacttggaggagtgccattgtcccccagcctgtgacttacttcatatataatctttatggaaacatttaatcagtcttggccaacaactataggagcatgtagtcagtttccaggttttattgcctaaaaagggccacgaagacctagagttaggttgttaccgtggttctttagtgggaaaggtaggaatggtatggttatgaaccagggtggaaagggcacatagggaagcaggatgacgctgatcattgtgtccttgccctaccacaccagtttcagtaacaaccttgcctataactgtacttacaatttgcagatgatgcctaaagcatatgtaggttcaagcttctgttccttcagaggtcattgtagtcatccccgtggctgacggggctgtgtgacttgagcattggtagccatgctgtagatgtggctcaggctttcttccacagccgcaatcccccagaccatgccatgctcactgtgctgccctcctgctgtacactgccctggccaggaccagacttactgtgtgtctctcctgtgctctctccatgctgaccagatttcaccatgaaattgcttacctgttcttgttcggtcttatcactaccttaagaactagcagcaaaacttcatttattcattcaaaaagttgttggttgtgaatgagccaatcaggaagaatcaagtttactgaaacataattgctgcatcagttaacactgctatactcacctagctttttacctgcctcttgttcatcatgactgctgtacagtgtatcattaaggttttaaagatagaggtacagaccatgtgcttacactagtttgctatgatcttctaacacagcaatgtcccacaagcttaagtgcctacactgaggactcccttgtttccagttgtcttttcattggtgtctcactcagtgatgtgttagaacacgagtttcgggcctattccaccccagtagccaattcagtccagtctgaatattagactgctcagttcatctgccatattctctccaaggagtggggtccacatgatgtttctgtcctctacctcagaaccatgagttgtttctgactacccatcagcttcctccctctccttgagtgggtctttcatgaagctgggtgtgtggaatctcaccaccccgcccaatttgcgcccatcccccatactgaaccgttcctgtactagtcttgtttgcaggcaaggggtggaagacaggcccccatctaggatttccttacctggagaagagaaaaagtggctgaactgccaaatgcttaggagaggaagcaacagcagcatgtaaatgtctccctcacagatgctggcttccctcaggatcagcccctagagccacctgaagctccagagctcccctgccagcccagcagaggaagcagctcagcaaaggcctctgagctatgctcactatacagaactgatatagtgaaaaaccagctaactaaatataaaattcccagatgtcatagatgccttaaagacttttctcgggaggatcattgcctcttgtgtggaataaataatgtattaactcttacaaccgacaacattggttttccacagtgagggagtctggggactgctggacttactgacttgccagtttggcagctgtgtggaactgggcgttccatgatatcttatggtaccaaggacaaggtggcagcagctgggccataactgcaggcacgtgtttgtatagaccactttggctctcaaactgctctggtgctgctcagtgtgggatgaccgcatcagctgggaccatggctaaggcttagcagcattgtttctttggattctgtgtaatggaatgtatttttcaaatattgatattttgattttctgtaataattccttacaataaaaatgaggtaaaattgtaaatttaaagtgtaaactttaattaaagacatttatagctacttctaagtcagaagtaccagtaaacattaaaaaacagtttctaaaaattgataatgtgagggctggagagttggctcagcggttaagaataatgctacagatgacctgggttccattcccagctctcatgtggaggctcaaagccgcctcaggcaccaggtatacaagtgatatacagagatgtacatgtaggcaaaacactcatacccatgaaataataaaagtaaat

SEQ ID NO: 20102 - DNA, 1739 bp, Mus musculus
tcagcgggacctgagaatggaggactttccgtaggaagagagaggaaggtctctcagcgggacctgagaatggaggactttgatccgtaggaagagagaggagttcattctgaagcatgggaagggtctgcacaaatccagtaaatctacaaagtcggatactccaaaggagaagggcaaaaaagcaccccgggtgtgggaactaggtggctgtgctaacaaggaagtcttggattacagtactcccaccaccaatggaactccagaggcagccttttctgaagatgtcaacttgatttgaggaactgggcctgggggacagcttcaagatctggattgcagcagctcagatgatgaaggggccactcaaaataccaagcctagtgctaccaagggaactcggggtggcatgtttgggatgctgaagggtctggtgggttccaagagcttgagttgagaagacatggaatttgtgctagacaagatgcgtgatcatctcattgctaagaatgtggctgctgacattgctgtccagctctgtgaatctgttgccagcaagttagaagggaaagtgatggggacatttagcactgtgacttcaacagtcaagcaagctctacaggaatttctagtacagatcctacagctacagcatcgtgtagacatgctctgggatatcatggatgcccaacgtcgccagtgcccttatgttgttaccttctgtggtgttaatggagtagggaagtctaccaatcttgccaagatttccttttggcttttagagaatggctttagtgtcctcattgttgcctgtgatacatttcgggctggggctgttgagcagcttcttacacacacccggcgcctgactgccctctatccccccgagaagcatgatggccatacatacaatgcagttgcttgaaaaaggctatggcaaggacgctgctggcattgccatggcagccattgcctttgcacgtaaccaaggctttgatgtggtgctggtagacactgctggccgcatgcaagacaatgcccctctgatgactgccctggccaaactcattactgtcaatacacctgacttggtgctgtttgtaggggaggccttagtaggcaacgaagctgtggatcaactggtcaagttcaacagagccttggctgaccattctatggctcaggcacctcggctcattgatggcattgttcttaccaaatttgacaccattgatggcaaggtgggagctgctatctctatgacatacatcacaagcaaacccatcgtctttgtgggtactggccagacctactgtgacctatgcagtctcaatgccaaggctgtggtggctgccctcatgaaggcttaatgtggctcttgcctaataccaaatcgccgcttgccccaagtccctattcctatatcaagaatgtgctttagagtatgtgagcaacttgtcttccgtgtagtacaaaggcagagtgaggggagctttggagacttgcagctccttctaacccaatcctttgttcagccctacctccttctgcaaggagggcctaatcatgttacaatcactgcccaatgaccatccctcttcctactcaggcatccccttcactctgcctacagactccatatcatagctttgaccaatggttggaaaacccaacacctggagtgttgctgactagtgtgatcacagacagagccatggtgagataaggagcagtttgag

SEQ ID NO: 20103 - DNA, 1119 bp, Mus musculus
tcttatacagctgacttcctccagtttcagatacagttctattttattgagggtaattactttcacacttttcaacctcaatgtcattcaagactctggatgaggcccttagagagagagagagagactataataacagttgaggatgaagcacatgccacatctgagaaccttttaagtctttatctcaagtgtgtctcaagagaacagagaaatcaagatatagaaacttgtccaggtagtctttgttttagtcatatgtcaataaaaactaacttgcctatactgctaaatctatacaaagaaatcgtttgctctggtacaaaggacaaagtggagagtagtgatttgtaatcaggttagttagggaatagaaggaatgtgttagagctgatccattgttctttctcattagtggtagataaacctaatggaaattccatgcccatggagatcctaaaacaagaagtgagaaacactcttctcaatggggctgccatcttctttcctgatcgacagacccggagaagccagctcttcaccatgatggtaattatgtaccgaagtgtggattccatgactgagttagtctttatcttctctaaacacatgacagcattttctgatgtgctcactatacgcagagctttgtgtgagattttaaaggacaggcactgtgctcaatttggatttcagagtttattctcttgcttagtcacagtgtagtttccactcttatgacttgccgacaatcgaatttttatcttttctttcccaaattatgagaaaaatttaaaggaataacatagtgaatcctcatcacctaactttgacagtggcactcaggctaatcttgaggtatatctgtgatatatatatatatatactcaggctaatcttgaggtgtatctgtgatatacctcacttacttttcaatatacacacccacccagtgtcattttgaagtaaatccctgaccaattttattcataactatctcagtatataactgaagaaaatctaatggggtgtgactcctcagctggttcttcttaccctcctagggcccccccctcctacattactcagattcagtaccagggtagaaggtgcttttca

SEQ ID NO: 20104 - DNA, 1146 bp, Mus musculus
ccctttcccaggagtgagcctgcgctggctggctgacctcagccctattcccacctttgaggctcacttcctcagctcaggttggctcagggtgtcctaattttaccgtctatgcccctggtgtctgagactccaggcatccctgggtccatgtcagcttctcctgccacccagcctggtgtgatactttgtcacttgctgcctggtcccctggcattactctttgctctgctcctcctagcatacattttttgagtcagagagatgtcactagggaagtgactccataagggacttcctcccctacctccccactgaaagaaagcatctcgtggggaatctatcagatgaacgtacattgctcttctttttttttttttctcttaactctgctgttgcccctttgacaaaagctagctaactgtcacaggaaacggagtaagtgtgacttagctcttcttgggtgtgtacaatatgattattttatatgtaaatcaagattcacatcactgtcctgacccccagtaacaaaagccccctcagcctaccttgcagacagatgaactccgtgtttggctgcccactctcctgcatctcctccccccgccccccgcaggctctggaggggcctcagagagaaatagagtttggagggatggcttggcaggagcagagcgctgtgcccacttgctgattgtttctgatggagaaataaaggtgtgtgtctgagggattggagctggtagtcttttctgagccctgtggggcccctagttctgtggctatggtgggggagtggggtgaagggggagggcatccacctggaattagcagagttaaaagtctggggtcccatcccaaagccaagtccatctcttactcaaagatggggctttgaaaaacactaagttggaatctcaagactggacccacaccccaatggcagaagtggggtgagcctgcccttcattggaacagcctgcttattgctccactgttagcagtttaaaagcagcgctcaactgtttaatcacatattttatgattaacatgtcacctcaaaggaaaaggagctgggggtggaatggaacccccttgtcccttggaatcccgggcatccagaacctgaccccagcaggctgttgc

SEQ ID NO: 20105 - DNA, 1196 bp, Mus musculus
tgcaccatgactctctagcaaagcagtttttaaaaggagcgctcaatagagtgagcctacagcctacatccttctcactgccttcttctgtaagtccatgaacaccccgacagtcctctctgtgcatttgtaaatattggtgtttatgaagggctcaggaggcagccttctgactgcgtgttgaagctctggtgctgtgtgagtctctttagcctgactgatgaaagcggaaggaagcccaggaacctgctgggtgaggggaggtggctactgtttgttgagactgtgctttcttagggcactgcgttaggcacatgtttgtttctcacagcaagtctctgaggaatatatttttttataattactttacaaaggaagaaacaggttgtagaagtttaatgagttgctcagagctaatgaaaaactcaggattctaacctatatctgtctaactttaaagacttaaaccttactttaaaaaaattgttttagtgtgtgtaattttagtcaacaattgcttataagaagagcaatcagaatcttccgtttctgccaagtttttgttttaggtagaatctcacatagctcatggactctgatcctcctgcctctgactcccaagttctgagtttattggtatgtgccaccatactcagctatgcagatatttcattttcaaggcagtatgtttgcctggacatcggttggggaatattgctcattttatagtgcaacctgaatacaagcctaaggcaagatggcctaagataaaattgtgggcagatgcagttggataagtcctagaggtaactattgtttttgtatctcctgagtagtttaatgtggagtcaggattgggaaccattgggtttgaacaaaggttctgaagcccatttacctggattcaaattctttttgtcgctctgtaaccttggacaaaattagacagaactgtcaggagtctgtcaacatgttgcagctcttagattggtgctttggcacatagtaggtatctagtggatgttagttatctggcgttcttctaagtagtcacctgagcaaaccagcttcagagaggggaactgaaatgagtatcttcatacccacagctataccagctgtcaactaatttttttttcttattaatatcaacaataataacacttgttaaatgcttactgagtaacggttgctct

SEQ ID NO: 20106 - DNA, 1162 bp, Mus musculus
tggattattagaaatagacctgccctgaacattgctatgtgagctcctttgtgaactcacatgtgtgttaggattgaggcgagaattgagatgttttaggatatgtgctagagtacattctgataccctttggagtacccttgtctatgctacccctagcaggagaagcaactcttcccatgtagcctatgtatcatgcaaaagacaaaatctgctcagtatctttttcattggtttttagtcagggtctcactatgttgccttggctggccaggaactcacagtgatctgcctgcctgtctcctgaatgctaggattgagggtgtctacttccacacccagcttgatattgtcttaatatgaacttcccatctcttctttttgttttgttttggtttggttttggttttttgttttttgtttttcgagactgggtttctctgtgtagccctggctgtcctggaactcactttgtagaccaggctggcctcaaactcagaaatctcttcataattttacctgtctgtataaattgttttacaccttttgttcatttttgaaggtttttttttttgtgatttgtaggatgtcctttttcttttgggtgtatatctttgggggagggaggacaggacagtacagtttgagaaaggccccaatactgtgaacagccctatgcagcagtatatttgtttatttgttggtgctaaccccttcctctatctgagtcctacctgactattctgcatcccatcatttgcttattgcaggtcaatataaacatttaagaagtcgaccctaccctcttgttctgtgttcttttgaaattattactgtttcagtttcttcctcttctagaatcattatctaaaccatggtaaaaaattcttagcaagctgtaaatagcaggtaggaaaattctgtgtcttgttttttagcaattcccaaggtgagactggagacaatctacatttgtggagtggatgaaatgagcacccaggatatcttctcctattttaaggaatatcctccagctcacattgagtggttggatgacacctcctgtaagtatacctacattttcggtgtagtatgctttcgtttatgatttttaaggagttcttgctattttgatagtgaataattattgcccaaactgcct

SEQ ID NO: 20107 - DNA, 1342 bp, Mus musculus
aggaagatgactcggagcttcagagagcatggggtgctctgatcaaggagaaagaagagtctcgccagaagaagagtcggctggatagcttgccttcgctccagattgaagtcagccgggaaagtagctctggttcagaggcagagtcctgatgccctggccttggcaactgcccttaaatctgacattcttacataaggtggggcgtgcagtgggaacctcccttgcaggagctggcgccctttcctcctacctgcaccctgaacacttgctgtcctagtaggacagcttaagagtgtgatgagttttgaaggaagggtgtctctgtcttgtgctgcagagttacagttctgggtcctcaagtcttccccaccaccccacaagctttacccttggagttaaaggcaaccctccagattttgtagacattttcttaatatttttaacattgtgtcttttaaaagcaatgttttacacagtcatccaaagagccgagaactgaacttctcattgttgccttggccctgacagatcttgccagcaccctgttccaagaaaagtcagttctcaggtgcttactggacagtctttgagggggaagatgagggaagctgccagctcagccttccagggccttagtgtggtggctaagtctctcagacctgacctgagaccctcccgagtagatatgcttgcagcagcagtcagcagtggcttccattcctcccggggggagtcttttagagccttttgctggctggtagcctggtgtaaagaccaagttcagtgctgtaggacttctagggacaaacaactgtgacttctggatttggagttgatttctgtgcttaggggtggggtcttgggttgatgttgaacaatttttaagtctgtattatgtttaaaaactattaatgacttaaaagtttaaatttttaatttttatatgtggatattcctcctgttggctaaggggaagctcaagtggtgtcttttgtgttgttaaatatacattatatactttggaagaaggcaaagaaaggagtgtcattattttgaatggtaccaattgtatggtctgttgtacttgagttcaacttgctttgtggccactgtaggaaagaaactgctgtccatctgtgatgggctcttgtttattcccacttttctagaaatgataccctgagaattcactctttgtgtctctgacttattattgaagacttattcaaaactagcaaataagacagtagtttcagaaaatgtaagtttatgtttattctcctttcaaatgattttaccatggaaagggagtaagtagattatttggcttctcatctga

SEQ ID NO: 20108 - DNA, 1191 bp, Mus musculus
tgccaaccaggactctacacactgggcctgagccttggtttccccatgaagcaaggaaatggtctggtgcagagattctggctttgttgatatctctcagtggtattttattcttggaagttgtggctgcagcatgtttttctgttgaggtggccaaagtgtcagggaacaaggtggccatgagattgtgaacagagactcaccccatccgtttacaggctccagttctcccagtgtgttgaagatgtgcctgtggggtctagagccccaacccatcctcagctttcttattgttctatctggcaacccaggcccatttgcctagggtctttgagcacttgtcaacctcctgctagagatgaggggaggactttatggaaggtaggcagtatgtattcaaaactaactccttgagctgaccaggaaagatgcccttgagcagcattgcagtttttacagcacagacaacccagaaacgtacatactgcctaaagtgatggtctgcccagcatctctctctccagccagctctcagagctgcccagagcttcaacaccttgaaccctatgtgcttaggagtgacagtagtcaggatagcccagcaggcagctgggtatactttattcagggcactttctgtacatgtggggttagtctttatatgtaggagattattaaatgcccttttgctgcttcataataattgcagatacctcatctttgtttcctactactcttctttgtagaggggcctgatggcctctggccctcctctatcataattccatgattccttcccctgcttctgtctttcctttctgcggcagcttctctcaaccctccctcttcattctacacattgtagtgggggcaaatttttacttgagagatacgtacatagtatgcagtttatccttgtacagtgtacatttgattgtcgtctatttacagagctgtggaaccattatcatcatcagttttagaacatatttatcaccagaaaaatcctgttcccactagcagtcctccttcacctctcctcagacctggcaactactaatctttctgtccttgtggatttgcctataacggacctttcataaatgttatatgcgatgtgcaatgtgtctgtttacttagttttaaggttcatctgtgccatggtatatatcatcatttcaagtagtgagt

SEQ ID NO: 20109 - DNA, 1195 bp, Mus musculus
ttccgactgtttctcctaatattttcccataattagccttgttttttcttctaaagcttatcttggtttttgttttgtttttttggttggttggttggttttttgagacagagtctctgtatagctctggctctccaagaactcactctgtagaccaggctggcctctgaattcacagagatccacctgcctctgcctcctgtgtgctgggattaaaggggtgagtcaccattgcctggctggcttttgtttttaaaattaaatgcacattggtttgtgtgctggtacaggttggtgggcagggagacaagaagagatcagaggacaccttcggtgtcatcctcaggaatgccatccaccactgagacagagtcattggttgtcctggaatttaccagttaaactaggtttctaggatccttcctcccctagcaatgaaattccaagcccgtaccaccacagccagcactttatatggattctgaaactcaaactctaggctttgtgcttgtaaggtcagtgctttactgagttatttttcagcccttgttgtattttttgtttgttttgttttgttttgtactaagttttgatccagggccttgtgcaggctagccttctactgagctgcatccctagccctctttagtatatgagaagatctctgttggggttggtcttatgcattgtgtattcagatgctgagttctgtgctccaagatccaattgcagtctggccatggggcattgcattgaccaatgtgctgtaaagaatgatccccaataatctctgattggataataaaaggctcaagcctgtgactgggcaggaaagagaggaaggcaggacttaagattgaggagagggtctcaagtagggatgatgtcaaggacaaaggaggggaagatggaggtcattatgaggcaggatggaccatgagcatgtggccaagagaaaaatcaccctgaggaaacacgtggagcagagcaaacagagcaagactcaggtggcaggtaacggggctgtgctggggatgtaggttaaaatagctcagaacctgcccggtttaggtttatagcttgttaataaggtttctgtttctttcttgggagctatacagggtggagttgggcagaaacgcctcttaaaattaccattatagatctcgggttactcactccatagctgcaggct

SEQ ID NO: 20110 - DNA, 1179 bp, Mus musculus
gccgaacctgaagcgcgccttcagcagcagcctcagcgacagtaacgagtcgccggctgtcgcttccgacgacccggacgaccccgacttccccggcagcctcgtgggccagcggcggaggcgtcctcggggcagcggctcccggaaccagcggaccctgacaaacactccaagagtccaaaggctgcgacctcggctcccgcagaagtgcagcaccccgtgcagccggctgcgaccgccacctttccccaactgcagcccgggctgcctcgggtcggaccacagtgtgtgcatccagtccagggacagcaacgagctgggcaccagtgcctccctcttcagctctccggcctcgcccggagcccccgaccctttgtatgctgactctgcagtccccgggagcttccacttgccggcagcctccctaagtgaaccgtctgtgccctgcccccaggtggcagcaaccggtgacaggtacaccgggagggccctccgagccgaagccagcttcaggtcatctctctttagccttgtgaactcaggggccacagaagagaacaagtttgggacagatggggagaatgtgaaggaatcgtgttgtgaaagaagacagcagatgggaaacagactaacggaccctgatctgacaagcccgggaaagagaaaggccgcgtgtaaaaaggttgtgtcccaaggagtcgaccagagagactatgaggagtccagtgcttgcaaagaccttcgtgtaccaggggaaatcagcaggcctaagagaactgggccactccggaagaggaaacagcaagaagcaacgggaacccctccccgccactaccaccaatctaagaagaaaaggaaagcgtcagtctccttatggaacttgaatactagccagagggattcttggaccaaaaccagagcctccttcggtttccacaagaagaaaattataaccagtgtgatagaggtatgcagttctgttgccagttcttcctccaggtccctcctgtctgaatgttcgacccctcctatcaagaacagagcacaccttactgtttcttctcgatgctcttctgtgtatttgctaagtcccttaaagaccctgcatgtcacagaccaaaggccatcttatgctgaaaaggtttatggggagtgtaatcaggaagggcccatcccctt

SEQ ID NO: 20111 - DNA, 1659 bp, Mus musculus
taagccacaggccatctgtactccttgtcatggctgccttctctgggtgagccagcccatcctgaagactgagaagctgtctttggctcctcagtcttccaggtttgcaggaaggttctgctgctgggtgtagaatagagcatccaacaggctaaacgctggctctacacagcaggcacttgaagatcccacctcattaagtacacatgggtctgtggcacagggctgcttggttctgggctcctgtgtcatcgagcagatgacaagaatttccaaccaagtgctttgcctgcagaggctcctattcccaagccaaagtacagaagggtggaacagcctttggggctggtatagtaactgtttctgctgcctttgtcatctgagcacagttttggtccttcatcccccacgcacttgcgtgcagccaggggagggggagctcatccctcactccacttaggaaacctgcttacgtgaaatactagtctggtaagatttgttctagttagaaggtcaacagaatatctgtttatcttttattaaaagccagcgtagcggcagccggggctggaagaaggcgggtggattctggcagtgttctgctggcaggtttctgcttgaacttgaaaggtcaaaccgtgttttctttgaaactattacaggactctggctcccttctctgtgttgggcagttttccccacttggtgattgtgctatgttgtattgtggtctggggctcttcaggggctttcaggttgtcccacgctgtctggaaaccttataagcctcgtccccactgctttggctactctgcctgcaggcattacctctgggctggatgactgtgtgctgaggaactgagaggccctggctgtggtcctcacccttggtttgctgctgaggtactctgggcaggatatgagatgcccctgccctctgctcatgcctctctctatctaataggtcatcctgtggcttccagagtaggtaccgccagcccagctcaagttctctgcttaacgggagtagaataatggcagggcccagtctcctctcagccctctgggctggaggctgttcctccacactctgatccagtctttcctttcatggctgtaccaagtcttagggctccgagccttgctgaggccccttcatgtgactgagcctctgtagccgatacttctgcttggatgtggggggacatttccactgttacttccacaaggggttctcctggtcacaactctggaaactatattttgcaggtgttaataggcatccagatgcccccagctctgttgatacactaaagcagatgtgggagggctccagatagaaggccttagccagagtttctctctctgtgataatgaatgtcaaatggtgtttcttggaaaaccatctggacttcagttttgtgggccctttttgatactcaagcctcctaggccctgtttgcatctcaacagaccatgtcatcctccagatgaacagaaagaacttgcctgaggccacacagccgccttgagcccgttcctgcataccaactgtacttactgttggcacagcaagcagttgcatttcctggagcctgggttttgaggaagcctggtagctggggtctctgcactggcgggcaggtgctgaggtccgag

SEQ ID NO: 20112 - DNA, 1122 bp, Mus musculus
gcccctgctcctgcccctagtgattctgtggaccaggctgtggagacctacgggctgcagaagataacactgctgcgggagatctcactgaaaaccgggatccaggtgggccctcctttccagcctggcccacaaaacaaggggacgggagctttcttgggatggtagtctctggacatgtgatgggaggctgggaggtgctgctcttgtgtccacggctgagactttggatgttgggccctgtccccagattctgctgaaggaatacagctttgatagccgccacaagcctgccttcactgaggaagatgtgctcaatatcttccctgtggtcaagcatgtcaaccccaaggcgtcggatgccttccacttcttccagagtggacaggccaaagtacagcagggtgcgtggcactgtgggctgggggaagcgggagtgtctcttgcccagtcctgaccttgccaccccggctgcctcgtaggcttcctgaaagagggctgtgagctcatcaacgaggctctgaacctgttcaacaatgtctacggagccatgcacgtggagatctgtgcctgtctgcgtcttctggcccgcctccactacatcatgggtgattatgctgaggtgtgtaggctgtggcacttctggctgtcacgtattagttgggactgcatgaaagaaaggtctggggaccccaccatcaccccctgttaaaacagggagaatgggtttccatgtagggaggtccaaagttcttgttccgtgagctcatcagctcttgttgctgtccttgggagaactcagtagctgcctgtgctctgcaaggtgaacatgacaccgctcagggacacaggcaagagagccagtgagtaagagctgcgacacaatacctggcctttgagtgaccatgggaagaccagccgatggtctcttgttttctttggtgttctgtggcattccagctattttgctggtcttcaggctctcggtatgctttgggccccctgctctctcaaccagaggctgtcctaggaaagctttttaaaaattaatgcattttcagatgttggtttttgcataggctttgttagggaagaagatgtagaatgataagtttcggatgg

SEQ ID NO: 20113 - DNA, 1646 bp, Mus musculus
gtccaggctactctgacttcaccttcgcctcctaatgttcagccaaaaagacttggaaaacctgaaggcagaggtggcacggcgacaccagctccaagaggccaacagaaacagggataaggctgaagaacaacccatggcccccgagcctgagcctgagccagagagagccgtggaggacatgggctcccctcagactgccaaggaaggtccttcttccctgaacttacagggataaaaaaagaaagaaagatggacagtccagcagccccattacccggcgatgcagacagattccaggagaattctgggggcgtgccctgcagattgggagaggaagctagtcctcaactttatacccccacctcaccccaccatctgcctggggccctgccctggtttgcctgcccctaaaagatggttttgcactggttcaatgaatattcaatgcagaggcctaattgaagacacgaaagtaaagtgtgtaggcatcagctccagctgagggggcaagtgcctccccagcatcaagcagatgtgtgtgtgtgtccatgcctgtggatgtcttgctccgtccttcctgatgtacatagcccagtcagttctgagtggatgacgtgcagatgcaatttctcaggtcatttatatgtttgacattatggctgctgcttttgttgccactacccctgggtccagcctggcttaaagtccaggtttcagccaaaaaagatgggggctttcgtgtgtcctgggagggggagccagatgtcttctggtagggtgcaaggtgagacctgcagtggctttactgtgattgggcctggcctacctgtagcctcagggtgaagggaaggggccagcagtggtagaccccacacatccatgtgcctggccttggccaagcaggagaggaggtcctgctacaggctttgacttgcctccctgctccctgtaccccaggtgagcataaccttgggggccaacagtctgaatgtatctttctccccatttaaacctgagctgcctaatgcacagttgggtaaggggtggggacccagggctgaattgtggatcccagggaaagtgctatgcacaggagtgatttgtcacctctggagcctggctcctccttggtctttgccatataagcacttatacaaagaagctctggggtgttggggctcctactgccttggctgccctctctctcccctccctgcctgtgtcgcttctctttgtctgctgtccctgaaggagatggccaccctttgagcttaagggagctgttttaggcagagcctctgcttggggcttttctggagctgctgatggatagtatctgtccagggaccttgtttcaaagggaatgggcatgggccagcaaggcacccccacagctatcaagaacgttttcttgtttttaaaccatcacgtcttcatttcacattggaataaagtgagtttttgaaacctgctgccccagcctttcctgtgtgctctgtggaacttgttcctattgcttgagtgaggctcagaagtactgctgggaggtaattgtgtatatattatgtcaaactcaacgttatgttcaagtcactgaagtggaaggggtgcgacttcagttgttaggctgggccctacacaag

SEQ ID NO: 20114 - DNA, 4168 bp, Mus musculus
gacctggagggaatcaagtacaaggcctgctgggcttatataaaatatactgctcaaaaagcaagcaaagcattctgtctggcttagtatggtttgaaaacaagccttttcttttctctttcagatttccataagacggcaccctatgtggttactggcagtgtagatcaaacagtaaaggtgtgggagtgccgttgattgagtcacatttggttcttcctcccttttttcctctggatgcactctgatgataccatggttaccccatttgagctctgtttaaataaatattgtcctttcatgtaaattattctggatgtagattgaacttattaaatgttacacacaaagtattcatgcatggtgaatccaaattgtatactgtaaatttacatatgttgtctagaagtaccatagggtttaaaaacctgggctggcattggtcacaccaggcctacaagggcagaagttaaataaattgaactagggcactaaactgaatagttgacagtgtcattttatgttggattattaattactgtttttcttcctgctatctgttggtgcctgacttgatggcctcattttggggaaagtggtggttattagggctttttctgaaatgtgtatctatgtaacatcacttaagtgtgcttactaaatctttaagggtgttagataataagactgcaattcagaatctttgctccatctgtgtaatggggattacacatgaagtttttgtcatgacccctttgccaaatcaataggatatgtttgttttggcagcctatcaagcaaaggctagtggtttatttatgtaagaaaatgatcgtaattctcaagaaaaatctcagcagctaatagtgaatcctttttcatttgggtcttactgctttgtaaacaggtcaggaagcactgtcctactttaggcttctcttcacactagacatgcgagttgtattctccagactgttggactgtgtagtgatgtgactccccagtagaatttgatcttcccattgagtgttatggtacagatcactatgtgtttatgatgtttttagggatgtgcaatgtgcatgtcagaattatgaatgctgacaaagctgggtgcgcattttaaaggagtggaaggaacagtttccaacatgaccctgataacaattcgaactgtttcacttacaagctataaaaaaaagtgacagggtgtaatgaagcgtgcatagaatatactgggttttttttttctcatgttttgtttatatgtaaatgtttataagtatatgggcctatctgtaagtggatatgtctatatatgtatatcacacacatataacctccatgttgttgggtcttaagtttttgaagaagtgctaaaacttacgcatagagtaaatcttgctggggaacaccaaccacagccatgctaaactcttctgctgtttctgactctgaggagcttttctaagagaaagtcacttcctttgttctcccctctaatgtggccagtcaccatgttacgcattcctcataggctgtatattttgatccagagtttctacagtaggtttaagagaattttgcccatgacttttggaacactattccattgtcaatttttaataaagaatttatcacctagctaatcaacttttttttctttttaagaaaatcaatttgaaaggttaacagaaacaatgacataacagtgacagtctaacaatgataattttttttttctggactgcattttattcgtttgtataatagattttttaaaaatccctttaagtattgaatggaaatttggttcctgaaaggacaaagggtgagaattaatgtcctgtagatatacacaagagattaggctctgacagaagctcactgtctagcttgtgtgcttttgtttgttcacttgtttgttcttaatattcctcagagatttctctagaaaggaaaagtgttttgagaattaagtggttatttttgaggacaaaaactccatcgtgactcccataaacaacactgtaggttggcttttaggacaacattgcctcacagccctgcttacattaagaagtctttttctcctagctgttctgactggatttttctccaaaagctatagaaaataccttcgttctcatttgctgctatttcctgtcctatttcaagaatataaatacatagaaatggtgcatcttaacatttgtttgtatgtgttaaaatgtcttgttttttaattcagttttagcatgtagcaacatgaattgtttaagggtaagccacaacatctagacatcattcatagaaacaataaagaatggtaccaatgtagaggagcaaagctgctgggtttcctcccctgcagcagtgactcactgacaacggaggagagagtgctctgtaacaaagctgtccttacttgggagaatgccacagcctgctgcttagctgagttaccagacatcatccatttaagcagcagaaaacattgaatctcagggatggtccacagctggatccaaacttaacgagccctgtttgaataatgaagggtggcggggcaacatccacatctggcatcggatttgcaaaggtttctcacactgttgtttgacactgccctgttgatgcccttactcttatgttactgttttctctgtctgctgtctaaccctgtgccttgcctgggataaggacaatgataaagttactggtttgggttgtaagtagaggactttatgaattggttagcggttcactgctgctttgttactttcttgagtcagattggctgcttactaaataaaaagctgatagaattgtgtactcggatggttgttgattgtgtgtgtaaacagacattccagtgccacctatagcacagcgtgcccaagaagtcctaaccgcatggagagtgcaagctgcaggttggtttgtgtagacatgacctgaagaatagttgcttttcacatgacatcttgcactttaggagactaagaccgtcctgttctgtctgcatgtggtgtgaccaatggtgtgctcagagcactacccacaatcactagtattagcaagccgtcccgggccgtgatgcactattagtcctttggaagctttggctttaggctcaccaagcccagtctcctgtttgcctctttctgttctttgtgaacttccagataataccactcactaaagtttatttttttgttgtttgttttttaatttaaaagaaaaaaactatttaaaaataaggacattttgtttgttgacagtggtggcttgataatccttaagcaacaagttgaaatagaaggaaaaggcacttgaaaaggttactcttcctgtccagctgtatataaacccagtgtgttgattaatctagatggtgcaaaaaggaatgtcatggtagacaagcaacatgggcaaaattgcaagaaaggttttgggttttttccagtgggctgggttgggtgggatggggtaagctggactcacaagtcacgactggacgggcctttttatcctttcactgtatcatgtaagtagctgctttcttgcctgcttatccttcaggcatccccaaagctcactctgaagacgttagaaataaacacaaactctacgagttagaagccggtcctgacactgacatgaaggcaaacattgatttcatatgaacgttgcagaggtggtcattggagaaaacagttcccagattgttaagagttcaccgaagatatcgacaaaattttaaaaatcagtaaaggaatgtatataatattgctcttgtgttttacagtaagatttgttgctctcagactgtgtaaaacaaaatttatccatgttttctgcatattaaaaatcttattgtaccaattggtaaactattaaatgcctataaaactagatctggtggggtttttttcaatggtcattgggggtgaggttgtgttgatcttggcaggaagtgagacttgggcaccagcaacagaaagaatgttagttggccataagcaacagagctgtgctaccactgccttttgctgttgtctaccccttatctggagggagcagcatgtaggtaggtctctcgtagccataggcttgagcctaactagaactactgactgcactgcacagctaagcacacttactg

SEQ ID NO: 20115 - DNA, 1121 bp, Mus musculus
acataatacttaaaaaatagtgaaaatttggaagaatactagtctatcttaagagtatagctcagttagttgagtgcctgcctggcatagcatacatagagctctgggttaaaacctcagcatggcacaagatcagacatggtagtatatatctatgattccggcatccaaggtggaagcaaagagggtcatcatctcaaggtcagtgagtttaggcagctctgagctacatggggccctgtttgcatggggcaggtttctgggatgtgcctctcttgatagaaaaggtatttacaggcataaaaaccctgggtttagttcccagtactacataaacttgagtgtggtagtgcctgcctgaagttcaaggttataaggccttgtcaagaaaaaagaaaaaaaaggactggttttagtattaaaatgtgttctatcctaaatgttacttaagtcaaatacttttttgtctttaaggtgggtcatgataactgggtacgtggagttctgttccattctggggggaagtttattttgagttgtgctgatgacaagaccctccgtgtatgggattataagaacaagcgatgcatgaagaccctcaatgcgcatgaacactttgttacctccttgggtatgtacacattgtgaggtttctgaacatttgaattttggagtgccagatgtagcagttttatgtaaccttgtcgacttttccaggtaagaagtgaccaaaaggcctgtttcaacattatgggttcctgccagtggctttaagcttctctctttagaattaagcttatagttaaaatattgtttcctctgttgtgcattgggtttggaaacgacttggaaaggatacttaatgatcactcctattgactggctggtatttttctttcctattaacttgtaattttctttttttaaagatttatttatttaatatatgtgaatacattgtagctgtcttcagacactccagaagagggtgtcagatctcattactgatggttgtgagctaccatgtggttgctgggatttgaactcaggaggaccttcagaagcgcagtcagtgctcttaactgctgaaccatctctctaaaagaaatctttaaaaaaaa

SEQ ID NO: 20116 - DNA, 1099 bp, Mus musculus
tgcactgtatgcactgtgaacatgaatgcactgtaggaagaatttttgaaagccagttctgtgagatatctactttctttcttctctgtgtggtttatttttgttgttgttattttttttttgttttgtttttcttatctgggtttaaattagaatttaaataatgtatatgctgctggtatgcatttattagacttgaggttttaaagttttattgtgtttagtggtgtttcttgtcagcttattttacctagtgttgttttacttcaggttagtgcccattttttattacttttacttttctttttttgatgtagtgtaatttctctaactaatgatatctcttcatctcaatttgtgtcacttttggaaagtgttctagtggttaccatttattcacaatgtacacttcttaaattgacagctactgtgtgaagacattcacaggacacagagaatgggtacgtatggtgcggccaaatcaggatggcactctgatagccagctgttccaatgaccagactgtgcgtgtgtgggttgtagcaacaaaggaatgcaaggctgagctccgagaacatgaacatgtggtggaatgcatttcctgggctccagaaagttcatattcttccatctctgaagcaacaggatctgaggtactgtacgattgattgcatgtctttttatgattttgttactgtgtcatagggcagagccttaggtaacttgtgtgattttcagtctaaggtctctggatacaactaaaactgtagcctagaattctgagttttgaggctttttgtttgctctttgtagttgtcagttattattgggctagtaagatggctcaataggtaaagacacttgccgccaagcttggtgacttgagtttgattcctgaacctacatggtaggaggtgggaaccaattccctcaagtagtcctttgatgtctgtctgcatgccatggcaagaatggagtacacatacaaagataaacaaaatagctcatccttgatttgttataagttggagatcatctactaaaggcagactggatcatttaaatccaggtctgatggccctgagatgattcataatca

SEQ ID NO: 20117 - DNA, 1156 bp, Mus musculus
ggtgatttcctataaaattctggtttttcttccacataaggtgcaacataagcgaattccctgtggaagagaagaagttagccttttcctgacagccatagaaaactcttggattcatttaaggcggaagagaagagagcgagtgaggcagctgcgggaggtgcctcgggctcctgaggacgtcatcttagccttggaagagagaaagtccactcccaaagagctgagtagtggccaagacgtggcccacagcccccaagagagtgccctgtgtgggcttgatgtgccgggcggcgaggctgctgctgatggaggccattgcctcagccagaagttactgtgccaggaggagactcccgaggccacggaggatgaaagggatgaggaaaggggagggatggaggccatggaaagttgtaaaggctccagcaatggagcccaggacggagaggcttctgagaagggggatcgcctggatggggcggccggacgctacctgtttaagtgtttagtcaacattaagaaggaagctggcgatgccgtggttgaaatgcattgggttgagggccagaatagggatttgatgaaccagctttgcacttacgtacgtaaccaaattttgaggcttgttgctagttaattcttaatttcttcctcagttagaaaagtgatgtatggggctagggatatgatgcaatgaccttatgtgcttagtatccagaagttaccctgtgttgagtcccttacatctaacatcattacaaggaaaaaaaaaacccatattataaaatagcttgctttggaggtagagcctattgggaggccagcagaatttcaccactggtccatgagtgacaccatgtggaatcttctttaaaaaacacaaatttagttggatgtgctctgtggcacttgtaaccccactacttggaggcaaaggcaggaagatggctatgggtgtaagggcagcctgtgctacagagacagacactcgtctaaataaaaagaaggaaaaaggaaagcagcagtggatccatttttaacccttgccctcttcacagcagctaaacctaggaggagcagatcatcgcagccaaaggccagaggggctctggtggcatctggtgtgggtcagggctgcctagaaagtgtctgt

SEQ ID NO: 20118 - DNA, 1165 bp, Mus musculus
atggttgtaggctcaaggagaaactctttgtctctttatggtacaaggtcagggtcagcagtgacccttgcatgctgtttacaaactttagttactgctccttgagtatggaggcgtcttgggcaccatcgggagtgccctgaggaaggggagaaggggatgtgtttacattgtttttagggagtttgttgctctgaagatttcatttgctgaatggccatctcctcagtaaagtcttgtcatgttcattaatagaacaattggcctttgcctcttaaaggaagcattaatggttttgaaaggtgctaatcatcccatgtgccttgtgtgggtaccactgtagtgttaaaatgcctggctcagggtactcagagcaatagagcttacacatgcctaagatcctgttctgttctggaaagatctgctgtgactcactcaaatgactaaaacagtggttcgtttctttaattgctggttggagcaactaatgctgcctttgtgaatctgtgcttttaccctgggaaactatgttgtgactgagtgaagacctcgtatgtctttgggatataggctatctggctgtctgagtccaagcaagaaagctcagggcctctaggctctccttgggagatagaagatcatgggtgttccttagcaacagggaaagtgaacaggagagcaaggtacagggctgaagttcagctgcacttggcagaagtggcttggaagtaagctcagaggagggcaagcttgtactccaggtactgttcacccagggcagggagcagtgggagagcgcagcttggcagcctctcagcactgggttagcagtgctgttccactccttatatagggcaccagtttgactgggcttcggcctctggagagtgagacgtgagagcgccctgcctgcgggaggactcaacagcaggggacttcagacacagcaggggacttcagaaacagcaggggacttcagaaacagcagggacttgagacacagcagggacttcagacacgatgacatttcaacttgtgtcctctcctcactgtgtggagagtcgtagagctttgtcagaaactctcctgctgttggtctcaggtgagaaggttaagaccttgattaaacctttaagggtaggtaggcagctgtagagtactgctt

SEQ ID NO: 20119 - DNA, 4034 bp, Mus musculus
aactggttgtaacattaagaaagttgagaaccactggtctagaggttttgagggtcatagagcctgtggtcgttgctaaggacaccctgctgtccccttgccctgtccccagtccctgaagaggaaggagaaagagtatgagcatgagatggagcgccttgcgcgggagaagatcgccacccagcagcggctggcagagctcaagcatgagctgagtcagtggatggacgtgctggagatagatcgtgtgctccggcagacaggccagcctgaggacgaccaggcgtccacctccacagcctccggtgagcctcggcccctgtgctcttcctgccactctcagatgttcttttgggcttctctgaataggttcttccctgctagaaaagaggccacctgtcctagtcccgacgtgttcccagactcccaagcacccgtatgcctccagccaattgttttccaacctcttttgacttagtccttgccctgtgctccctgacagagggcgaggacaacgttgacgaggagatggagggagaccgggcaggcctgggcccacctaagctgaaccatcgtccccagccggagctgctgaaatccgccctgccaacccccagcaccgcccctgcgcctctgcctacccatccgcaccctcacccccacccagtggccctgtctcctgcccaccttcctgtgcagcagcagcagccaccacagcaaaagacccctctgccagcccctcctcccccacctgccaccccaacccagacgctagtgccagctccggcccatctggtggccacggctgggggcggctccacggtcattgcccacacagccacgacccatgcctcagtcatccagactgtgaaccatgttctgcaggggccggggggcaagcatatcgcccacatcgccccctccgcccccagccctgctgtgcagctggcacccgccacaccccccatcggccacatcacagtgcaccctgccaccctcaaccatgtggcccaccttggctcccagttgcccttgtacccacagcctgtggccgtgagccagccagtggccgtgagccacatcgcccacaccctgtcgcaccagcaagtaaatggcacagccgggctggggcccccagccactgtcatggcaaagccagctgtgggggcccaggtggtgcaccacccccagctggtgggccaaacagtgctcaaccctgtgactatggtcaccatgccctcctttccggtcagcacactcaagctggcttgagaatgaggccacttaggcccccagtgggggcagggaaggggacctgactgcccctaatcccacccaccagctccacacattccagccaggcccaggcccgccccacccacaccacccccaggcctccttaggggaagggggtgcagagactctgagccaggggaagggaggggcccccagggagttggctgcaggcaggaagtcctgctgcaggaggacttggcagacaggaggatgcttttggtggacattcttgcctacccagcctggtgccagttctggtgccgctccatctccctgttttgtcccctggaagtctgcactgtggcttacgttctctgccttccccttccctggcctgccttcctgtgctgttgctgctattgctctgtctggggaggtggctgagctctccggcttcccctccccagcctcagagtcctgtgggacctctggataggaaacagggagccccagaaagatgggagatgggtggggaggggcccacctctgagtgcaggtgacagatcctaagatctggagtcaggttaggacaagtgaaggcctgggcctgggccactctgacccacctgtggtcactgtgattggctacagtagaaactgttcagaatgagtcccaaccaacaataaacgaggtcctggctgttgtcaaggttcccgagcctgcccctggggtggggcttccctagtgcttcccccggccctggtttaggtactgcctgcagcttgggaggtgtggaccagcaagggctctaggagctaaggtacactgtggaggtatcccggggctcttcccattctccctccctctcggtgccagtgttgagacccctcccttcctggtggggctgcagtgtctatggtggaaagggcctttgctggggaagacaaggcacagcatgtgtttgatggagagcgggggtgctgtgcttcgggggtgctgtgtctcctgcctctgcttctgcagaccgctttggcttctctttttaagtggatatttattacaagtggccttgtgtcagacactcagttactcgcgtgcgcattcaggccctcactggacactcaccaatggcctttccgtgtggggcaggaagcaagtgcccctaaggtgcgaagtttgcactgggggcttaggcagtccaggggccagaggggaggactcagggtccttcagatgacattgtgagcagacactgaggccagcgaaggtcctgaatacattctcccttgaaataatgactcctcaggtgcctcagagctcacaggtcctcctggccctggaaacctcccagggcactttattattattatttgtctcctggggtagggaatggtagctaggaccaggtctcaaccccagcacaggaatcccaacaaactggctgccttcctgtggctgctgccagccacctctacccacattctgactctgggggccacctccactctctgctctgtgttgtgacaaggggcagagtctggtgctggctgggtcagaccacttgtcccattaacccttctctgtgtctcgaggccagttgcagagttgacagcatcgtgttggcccccaggcctgcacagatacctcatcatccacccagccctccccccatccccccggcaggggttcctccagatctagtgccgaatgactatgtccagattggtggtgatgggtgttgtcgctgtttttgttgtttgtgactgctgtgtgcccaagtgggcagccacctcccagccctttcttgggcatctcccctttgagagctgttaggaccacatctgtcctcacgctgtgggaccgcctggcccttcccttcctatcccttccagcctgggacacacacacacatacacacaccttacctctcatgcgtgttttacctgtgctgtttggagtggctcactgcctgggatctttacctcggggaggaaaaggggagagtggttcccttggggccaaagaagggcaggggatacctggaggggagttgggtcaccacagtctctctctaggaacagctgcttctccccccaccccaatcccagggtcccactcccaatccccaaagaggtggcccttgtttacagtgaggacttggtcactgtgtctctgtttcctgaaatatgaattgtagcgaccccagactgtagagatttttatgtgtttgggtacatctgctgtgtgggaaaaaaaaaaaactacaaaaaccctaattttgtacatattgtatttttactattgaactgtactctagtggctgttcatgctctgagtttaggtattgagacatgaatactatccatgtaataagcacttgcctggaataaaatataaaactgaaataaatctgcactgaaacctgagacggagctcccaagcctgcagcatctgggtcatttcatttcaagaggcagggacccacagggaagcagcaagaggtggcaccctgaaggctgctgaagggtgaggttgggtgatggcctgagtaattaaaaccctggtaatagggttccagagctggctcagcagccagaccatgtggtgctcttataccatgaacccaggttgggtctccagcacccacatcaagtagctaactgctcgaggctccagttgcagggctcttgactccctcttgtggttcccatgagcatttgcatgcatgtgatgcaggcacatgtaaataagaaaattaacagcctgttaaggcccgggaagatggctcagcactggc

SEQ ID NO: 20120 - DNA, 1770 bp, Mus musculus
gacttcaccgacatcatcaaattcttcaacggtatgagctgatccagccattctcgatgtgccctagaagggggcatggggcctcaagtcctggactgggcagagttggagggttctcaagaattctaggatcacttcgcataggaggtatcaagagcacagcaggtggaaactaagcagaggtttcagccagggctcctctcaacctcccataattctccatgttttccccagagcgggctgagcggcatgatgcccaggagatcctgcggattgcccgggacttggtccacaaggtgcagatgctcatagacaacaagtgacggctgcagctgggggtggcaaagtgcagagcccaggtaccaggcccctgagctccagcagggagaggcagaggccatcatagcccaaactgcctctcccgatcccttaccccaccctcacccctgccaaccccacccactcagctgtgtaacctaacaaagtgactgagcctgggatgtgagtgtgggcagtgctggccctgcagggcaagttggggtcaggatgcctgcagatcacagctgggtaggaggggtcggcctcaggagactggctgccttgggggacccctttctgtgttcccctctcaaacaacttagaatagccccagtgccgcctgcagcctcagcctggactgtttcccaaagcctctttcctgtcaacctggggccctgtatggttagtggggtctacagtggcccgcgcctcatctaacaagagttgcataggaccaggggctctgtgccatatctctcctgaggccttctatggtctcaactagctgcctgttcaggcatgtgtcctaggggcaggagaccttggctacctcccaggctctcctaagactctggggcagtcagatgtgggccctgggtgagagtggcccacctcagcagcactgccacagcctctggccagagattaaccccatgatctccccacagtacacagtgacccacccactcgtgtgtacagtgtcactctctgcaccctgcccttgctttctgcactagaaatccctaggactgcacataagcaacacactcgccgcccgctgtgtggtgtggagggcagtgactgcgcttgccctccagaaccaccccagaaagtgtaggaagacagtcctatcacaaccttcctccaaggacaggcctgtgagttccggggtacctgttacctattccagacatctgagtacctggggctgagggaggtgggagtgcctggatagtcccagttcatccccagggagaggcaaggccagctccactttccataggcttttcagggttctgagaagcctgaagacccagaagggtctctggaagagtttacagggttgtcgataaaggtccaacccttgacctgaggtctaggcatgctgtttctttgttctgtcaccccccccatgtccccaccatctgagcacatgtaagccaagtctgggccctgaagcccacacctggcctggctcctgcctagaagtcaccaaggtccacagacttgctgcagctgaaaaacacgagaaaggaccagccgcattctgcacatagcacagccttccctgtcccctaccccaacccgggtactgcacagcctgtgtggggccagcttaccccattgcccacccttgttcctgactcctcagtctccaccaagcacgggtggccaatgtgtgcctgccttagtgactctggttttgtgaggagcagagtgtatggggttttg

SEQ ID NO: 20121 - DNA, 1530 bp, Mus musculus
catatgtaccagagccagtaccttgggttaaaagtgacatctcttcaacagtgtctgaagtagacatggagtaagagactcagttgggttctgtctctactgcaaccaaccaaaactccagtgttggagtctgggttgtgaccaggcagcttgtgctctgtatttcagttgtccatgtctctgctaagtacagaatttacatgattacttacactttcttcattaggattttgaacataatttttaaagggaagatggaaacaaaattttcatctagagacaatcttgcctgaatttaaacagaaaccgtctggtaaggagctggccgttcagcctgccccacccagttcagggaggttaggtctacattccccccactgagtacaatgcagacgttctttacttctggagagactgtttggaaatgctgagacagcactgcagccagtgccacgccagcagtcggctcaatgagcagtttcattctcccccacaccagctgggttgcatactgttggcacagaaaggagcaagggttaatgaaacaagaaacggagccggagtctagtaggttacattcgaaaaatgaagtagacatttgggtttgttgtgataagtatgtgatctactgtcagggttctgttaacaatgcctgagtcttaccttgatttcatcttcggtgacagtgaagacatcatccacaaggtctcttataataggccaggtattcaagccaatgctggatttgacaccatctgctatggtttctggaggatgaagattgggggtcagttctcctttcagtttagactggtagcagtcatctgcattcgagggctcagcagcgtataccttcacactaggtttcagggcctggggaaggaaggcacatgttacaatacagcctttgtctacgtaaaggaggcagagagttaaagatgtgttacccttggtgatcagaatggaaacaagaccttgaagcactttaataaaagttgtatctgataactggcttgtctggattctagtaattgggaagggccatagctttgtgaggtggacttgaggagtaaggatgccaccattgtaactgttaactgcttctatagcagcatagagcaaaaggacagtgggcaaagaaggctatgagaggtgatggtcctatacctagtctaggaagtctagaaggtgtttttgtccccaacccccatacagggtttctctgtatagctctagctgtcctggaactcattttgtagaccaggctgaccttgaactcaaattctgcctctgcctcccaagtgctggcattaaaggcatgcaccaccaccgcccagtgaggctgttttttttttttttaccttaattgtaatggctattccagcaaccattcctcctcctcctactggtaccaccagtgcatctaccaagggaacctgtagtaataatgtaaataggccaattaataaacctttatgtgggctggagagatgactcaatgataagagcactgactgctcttttagggtt

SEQ ID NO: 20122 - DNA, 4170 bp, Mus musculus
taaccagatgtgatatacactcttgtaatccagaacttggatggctgaggcaggaggactgaatttgaggtctctctggaatatctatggtgagactgtgactcaagaaaggaaggaaggaaggaagaggggctcagcaggtaagagcactgactgctcttttggaagtcctgagctcaattcccagcaaccacatgatggctcacaaccatctgtaatgagatccaaagccctcttctggtgtgtctgaagacagctacagtgtgttcatatacataaaataaaagagaagaaaagaaagaaggggtagacttacaggttgtgtagacagaataatttaatgcctgaacatgttagagatctttgattctgaaataatgaactagtttggggtctttaagatctgaataggagccgggtgtggtggcgcacgcctttaatcccagcactcgggaggcagaggcaggcggatctctgagttcgaggccagcctggtctacagagtgagttccaggacagccaaggctacacagagaaaccctgtcttgaaaaaaacaaacaaacaaaaaagatctgaataggaacatgacttggatacaagagaatacaactcccctctatttccataactcaagtaagtacgtgtaactctaacatagttaaattcttaacctcactgcttactaaacactataactccaaatttctgcctttgtagaaacgttctttcctgatcaccaatattatcatttgtatttgtattttttttgttgttgttatgtaactagaatgacaactttccttccctctcttctccattattcttttcttctgtgttgtttcctcttatcaacataatagaaaacatgaaggaactaaaggaacccagacagcgcaaagataataggcgtccagatttggaaatctataagcctggactttctcgactaaggaacagacctaaaactaaggaggcttctgggaatgaggaatttaaggatgagatagtaaatgacagagattcttctgctgttgggaatgatacacagcttattcaagtttgcaaggaattggacagccaacagcaaaatggccctatagatgcagaaaatagtcaggcacaggaaacttttccaaagactgttggactagaggaccgaagtctaaagatcatcaaaagaagcaagaaaccagacctgcagatctaccagcctggaaggcggttgcagaccattaccaaagagtcagcaggcagggcagatgaagaagagatcctcaaccaagtggagcagttgaggatagaggaggatgagtgtaagggagaagctataaaagaagaagttaataacaaaccggataaaaccgagatagaaaagcaccaaagtaatgaccgtgtaagaactgccaagggagaaaagggaaaaaagattgaaaagggggaggggtcaaagaaggtggctgatgactctgtcccaggaaagcctggctctgtaaagagatactcgagatcagacaagagaaggaatcgctaccgcacttgcagtaccagctcagctggtagcaacaacagtgctgagggagctggcctgaccgataatggatgtcgccggcggcgccaggatcgggccaaggagaggccacgactgaagaagcaggtatctttgtcctcaactgattccttagatgaggacagagttgatgagcctgatgtcctagggtccaggaggagctcagaaaggaagaagcatttagaaagaaattggtctggctgtggtgagggtgaacagaaaagcaatggtaaagaaaaccgaagtgcccttcgtgtcacttttgatgcagaaaccatgagtaaagactcccctgtggtgaggtcagtcaaagataatgtggatagaatgaagtctgacaaaggcccaagcagtgggggtaagggctctgagaagcaggagctcagacacccgagacaagaacttcgagatcgtggtcgtggtatcctgattctgcctgcccacactgccctatctgtcagttcatcaggttctccggagtctacacctttgggacctcgacttttatttggatctggtagtaagggatctcggagttggggccgtggaggcactacccgccgactatgggacccaaacaatcctgaccagaagcctgccctaaaaagccagacacctcagctacatttcttggacactgatgatgaaattagccctacatcttggggtgattcacgtcaggcccaagcatcttactataaatttcaaaactctgataacccctattattaccctcggacaccaggccctgcctctcagtatccctatgcaggctatagccctctgcagtacccagtaggccctacaaatggtatgtatccaggggcttactacccgggctatcctgccccctcaggacaatatgtgtgtagccctctccctgctagcaccatgagtcctgaggaaatagaacagcacgtgcggaacatgcagcaacaggagctccatcggcttctccgagtggctgacaaccaggaactgcagctcagcaacctgctttccagggaccgcatcagcactgagggcatggagaagatggctcagctcaggtactgagtgttctttcctactgtcttgcttagagagaaatggacgctgtagggctcctgtggctgaggaaggtagaggatttttagataagccactgagtgttacctgcctttcacatgaatccctaccccccaacaacccctcgtgggcatggacatcaagtctggagtcttgtgcatcttgtattaagtgccctaccactgagccacacttgaatcccctttacattgattttttttcttttttcttttaaattatttatttatttatttaatgtatatgagtacactattgctctcttcagacatgccagaagagggcatcagaccccattgtaaatggttgtgaaccaccatgtggttgctgggaattgaactcaggacctctggaagagcagtcagtgcttttaacagctgagccatctctccacccttcattaattattattatttttttttataagcaacaggcagttgggaaaataagttttaattctagtcttaaagctgaatatactttttactttaaggggaaaaaatgtctttaagggaacatataattttcagaatgccaatttcagcttgcaccaaagagctgctttcagctcttcaatgtaggtgtacacatatagcaatatggtattttcctagatgtatgtttgtaagacattctgctgtgcagaataggacccattatgagtaggatgcctggtcacatttcagagttcttgtcaggaaggaggtggctggtttgcaggagattcagatcttgggtgtggccttgcctgtgatgtattgaagctagactttacatgaattttattccagaactgaactactgcagctgtacgagcgctgtattctattagatattgaattctccgacagtcagaatgtagatcagatcctgtggaagaacgctttctatcaggtgattgagaagttcaggcagcttctcaaggatccaaacagtgagaacccagagcagattcggaacagactcttggagctcttagatgaggtaagcattgttattatcatcattattgttgttgttattgttatagcctcaggataaagtctgcagcatctttttgtttgttttttctactggagatgttatagaacagaatattgccaaaacccttctatttttcttgcatttagatctggtctccctgtactgcttcctttggactatacacacagacagctggagttaactttttttccagtgctcagctactgagttacatctccagacccagaattacatttgaccttgaaagctttctgaatgagaggggtgggcgggagtggggtggggaaggaatgagagctgaaagaggtggggagtggtaaatgaattatattttttaaaacatgagaggcttactataaactgttgctgagattatccgatggcctctaaccaattacttatggtaagtaccttatatctaggatttctggacattgatagattgtgaaagggttgtttggccaaggatttggtaagtagattacaaaaactgattgacttagttttgttt

SEQ ID NO: 20123 - DNA, 1197 bp, Mus musculus
gtttagcagccagcaaccctatcctgactgccaaggagagtctcatgagtttatttgaagagactaaacgaaaggtaagtaagagtgcacgtgggcttatccttcctaggagaatgcatgtcctctgggctgaagtgtgaggagatgatgaaacacatcttcacatagaccctctgggcttcactgacgggttatcagttggcccctgcaaagaacggatattgaaatcaatcttcaggagggcttgcagggcctttagagcgtacctgttccacagcacctagttcacagaattaatgatctatatggcagcagaggtggtctctgctactttggtactgtagcagaatccttagatttttatagtctttagcctgcagacacagatgatagaggaatttttcattggctgactgggagagtctgagcttgtgtgtctgttgtataggctgaacagatggaaaagaagcagcatgaggaatttgatatgagccctgataagtggcgaaaaggaaagaagtctactttccggcatgttggggatgacactactcgcctggagatttggattcatccatcacattctcggtctgcccagggcactgagtctgggaaggattctgagcaggagaatggtctgggcagcctgagtcccagtgatgtaagttcctgagaatgatgcagtgagccagactagagtctggctgcctcaggtcgtgcaagctggggctgaggcatagacaggtcccagctttaagacatttatcgatttatttaaagaaaaaggatcttgttctctataccgggtaagcctggaacttacggtgtagcccagactggcctctaacttgtgacaatcctcttatctgacttgctcatataggggtgagccaccatgcctagcacccccacttactctggagagtacgacccactaactttaggttcccttatgcctccttggttctcacagatccctttatctttggcatgtgcttcccttatttaccactatgtggcactgtagaatttagtaaatgtagagttagaaattgttttactgttttgagttgggcatcaccaatttgtatgagaatttgctgagattttgtactttgctgagataatgtatttaatcttgaatagctttctatttggagtatgaactaaagcaacatgggtaggatgattaatctg

SEQ ID NO: 20124 - DNA, 1167 bp, Mus musculus
tgcccatgggaagctgtttacccggattgggtaagtgtgcaggatgtttattttatttccctacattacaagtcattttggaatttaatattgttagcaactagcctgtgtttgtaactgagggcacagggtgtgaattcttagaggcctccaccttctcttcattctctttcctactgtgttcataaaatttgagatatatcactatctttgtctttcctttttttccctttcttttctaaagccattcttttaggacagtctttcccagtcccctcttcttgtcctcctgggttctgttgactctgtcttcctgcttaactcccaggaagtctgagatagtcgtgctacatccttgggtgcagcttccaggggtcctccttggggaaaaattatctcctaatctttcctcaataacagagtaacattttccttcctctgtgttcttctgacccatccaacttcctatgcactcagtcccttgtgccacattgctgatctcagtaaatctctgtaagccccagggaaggcagtgtgtgcaaagccttagggctttctcccttgagttcctgggaagagtttgaatgttcctcttgggcatcagaagagttttcctggcaatataaaagctgcacagtgccttcagtgtcagaggagatgtgtgctgagtgtctctgtgcagggcctccttgggtaagggacatcaatgtgaagaagcagcatcccttctataaaggtgcactgctcaattggctttgggtttttgagacaaggtctcttctgtgtagcccaggctgggttagaacttggcaactttcctgcctcagctttccaagtgctggaattcccaagagtaccactgtgcttgggttcctgttggctttcaatcttttttgaatattggttttattgtgagctgcccttagaggtgattggcttcacattgcaaatctcctgttatggcattttcctttttcttcaatgccatgaacttgtaaggttccctgtaattatataggttttctgcagggagacaggagtcaggtcggcttccatatactttgtgtttacttttttaagatgatggaagactttgtgtcctgcttgaaaagccattgccctgttgattgtgagtgaaagtgtgcttcacattatattcctctggca

SEQ ID NO: 20125 - DNA, 1151 bp, Mus musculus
caggcatgatctaccatgtcttgtttctgaagtaattctttaagtaaagaaagtttttttgtgattagattccttttacggagcacagttttcataaaggagacttagggatggtgtaggtactaaaatttaaaggaaatattctcactgtctagaaaatctgtttcaaacagaaactcttatcagtttgaatccatttaatatggggggtgggctgtgctaagaaatagcctgctaaataaagtataataacttacaacagctatttatccagtaattgagttgtttttatctctaagctttgaatatttttcttttttcttctatatgtgcaaaactgtggaataagtaggaaagaaacttcctaggtattagttgtgtgcttgggagaggggaattgttcttctgagtgcctttaagaatgtgcctcaataatggaatccccatatttgtaggatggagacattccctgcagtggctgagaaggtccttaaggagttccaagtattgctgcagcatagcccatctcctattggaagtacccgtatgctgcagcttatgaccatcaacatgtttgccgtgcataactcccagttgaaaggtaagggaaatctaatttctccatctagacagagttgaatttagtatctttgctaccttatcactaaccccatctccacacacacagacacacaacacacaacacacaacacacacacacacacacacacctctcccttctattgcttcttagatctttattttagtctctaaattctgtaagactctatagtgcttggttgggatattaaggagagatttgtaaatataaagtttaatttaaaaatccagagatgcttttgcacatctggctatgctaatggcagcagcaaggcctcttagaggctgcatacccaggacttctcccaagagagaggcattgctgaaatgtttcattccagagaccgtatgcttggcagggattaggcattgctgtttctggactcgtgtaccctgtttgttcaatatggaaaagtctagttccctatgggatatcccttatgggaccctgccagagagtaagaacagagaattgatgagctttggtgactcaaatctggaagcacaaaacccaccaggcccagaatctg

SEQ ID NO: 20126 - DNA, 1210 bp, Mus musculus
aagaggaagaggaggagggaaaaaaaagacaagctgaagaatgtttccatgcttaagagcacttactgttcttctacagtagagtctcttctagcttccataggcactaagcagtaacatagtgcatagacatgcatacatgcaaaaaaaaaacaaaccctatattaattaactaaaaaaatattttttaaaaaagatttagctgggcgtggtggtgcatgcctctaatcccagcacttgggaggcagaggcaggtggatttctgagttcgaggccagcctggtctacaaagtgagttccaggacagccagggctatacagagaaaccctgtctcaaaaaaccaaaaataaataaataaataaataagtttgtttatttattatttatatgtaagtacactgtagctgtcttcagacacatcagtagaaagaaagactttctggtcttaaaaaataatttctaaaggaaaaaagaaatatatatttttttaaaagatagaggaggaagagcaggaatagaaaaactatctttactttgagctggcaccagccatcactcctcttcccttttgatttgctcttctgtgaaacttttttttttttttttgcccatttctttagatgtcagtataggagtgatgcctcccataaaatactcagtaatgttttgagataacatatttaaatgttgtgcacctaacttttacctcactatgtcttagatgctctgatacagacctcatgtgttgtgcatacacatcacatgtagctgtggtagactcgtactgtgcatagttaagcccacaggtgagacaggcatgtatctacttgagatgagcagtacagttcttgagcttcctcatggttctgattatcaagggtgtaataatttaatgttactttgtcctcaaggagcttataatctcattggtaaaacatgccacatacataaaatactagggtaaggtattgtctgttagtgtgcatcagagtacattgtcttccacatttttctgccctttgtattatgtgcattgagcagcttctgggtgttgttgatagagaatgtgtgagggtaaagggggctatacagagacttaggagaaaagagtcatgtggggatatgtaattaatttttatactttccccagtaaaccatcgaccctttttatgatgtcatgagggattccttaattttgcagctgcttcc

SEQ ID NO: 20127 - DNA, 1202 bp, Mus musculus
gactacacagtgtgactactccctgtgtgcctgtggctgaaggagagaggctagtgcccagtttctgtctgtgtggtatatacttgactatgcaagagcagggacttctgagagctgccgtaggcactgggtatctagactgtttaaagtgtctcatcatactgtctggaaaggtgacagaaccagcattaggcaactggttctccaaattctttttctttctctctggttaggattaaaagtcccccgatcaatttcacctttacatagagagtacacacacatagatggtagctatgggcacaacttaatattacatttttgataatatttcttgggagctgccagccagccttacagcttttgttgcaagtccctttccattcccagagcaggaagaacactttcaccgacctctttagaaccgttcttcttttcttgtcttgtttctcacagggttgctgtggatgtctggtcaacactagctgatttctgtaacatactgactgcagtcaatcagtctgaggtgccactgtacaaggacccagatgatgacctcaccctgcttatcctggaagaggatcggcttctctctggctttgtccccttgctggctgcccctcaggacccctgctacgtggagaaaacctcggataaggtcagctgcaggccaaacatcccttcccatttacccactctcttaattctccagactttattcttgggaagttttctgtgcaaacggaacatgattaagtcattgagaagggtgttaagggaaaatatcgaccttttagccgctgacatccagttctgtgtcctgaaaaaaaatccctctcaacttcctttgggggggggggtgtctcctgtgtatgtgtatgagagagagaaatgaagggggggaaggaaaggagggagggagggagggaggaagaggggggtggaggagagagagcgcagagctcctggcatgttgtatatacgatcatttcctcacatgtttaaatagtgcagcttgtgttggcagtgctcttactcagctccaaatggtttgcatcatgcttaaagcaccctccttccttccctctccctccttccccagccacagaactctgcactaggaaaacagccagggctttttcccttctctaaggaggagagtgataaataggtgactagagagaagcagacaccatgtgtta

SEQ ID NO: 20128 - DNA, 1150 bp, Mus musculus
gtcagctcactgaagacccaggttggatttcctcactcatgtggcgggtctcaacttgctgtaactccagttcccttttccagcctaatcaggcactaggcatgcatgtagtacacagatatacatgcagactcactaccactggggggtgtgtgtgtgtgtgtgtgtgtgtgtgaatattagtgaattagttctaacttaactgtaagtgttgtctttactcctcaagtatagctgcttgcaatgagtgttaacagtattaccatttctttctctggcagctcagactttagttctcttatccctaggcattagtctttatttggcttacatacacatctttaactgccatgtatttactagtgcaataaaagatctactatctatttatatatcttccttgcatgtttatggccttgcttatttttatatcattatcatcatcattactgatatgcaaattccttatatattgtttatagttatgtttcatgtattaaaaatgttttctcctgtttagtgatgtttatataaacttatttattcttttaatggggctggagagatgacttggtagttgagagcactgattgctcttccagaggacctaggtcatttcctaaaatccacatggctgctcacaactgtctgtaaatcatgcatgtggtgcacggatatatgcaggaaaaacaccaatacacattaaataaataagcaagcaaacaaacaaataaataacgtgtgtgtataattttacaatgtacaaatttagatttttatataggcaaatgtgtctgttttctgtgtgtctacttggatttttaatcatgcttctctcttagtacacttattttgtacacctgtttaattagatacagttcagcagttaagagcactggctgctcttctagaggtccttagttcaattcccagcaaccacatggtaggtagctcacaaccatctgttgtgggatctgatgctctcttctggcatgtaggtatacatgcagatagagcactaatatacattaaacaaataaatctttttttaaaagtttgtgattaacagagtatgttattcatgtatgattcatgtatgattgacatgatacagtcaggcttctgccatttttgactgcagaagaaattc

SEQ ID NO: 20129 - DNA, 1234 bp, Mus musculus
actcactgccttacgctctgccctttcctacttttagatctttgtccagtctgtctctcaatccaaaggactctttttttgctccacatttcctgttacctgttgaaattctattttccctgaattccccaatgaaactccatctccccagtgaagccttccctgatttctcccaggaggaatttgtctctgtgctctagggttcctgcagagttgatttatatctcatttgtaggactgctatcatgtctcacattacagttatttgtgggccttttcccccacagtaccatgaattcctaggaatctgggaccatgttctcagttcagtttagcaagatactgagcatcgactctcctaatggctgggttgtacaaaccttgggagtcaaaggacacggggaggtgacatttcacagcaggccatacagtatagaaactattcttttgtttgtttattcttttgcttgcttgcttgctttttttttttttttttttttttttttgagacagggtttctctgtgtagccctggctgtcctggaactcactctgtaggccaagctggccttgaactcagagatgcttctgtctctacctgtctctactgagagcttgacttaaaggtatatgcctacagctgccctatgagaagctattattgaacaaatgatttggcatgttaatgaggtcttttaaaagatcaagtattaactgggtatagtgacaaatgcctttaattctagcactcaggaggcaaaagcaaacagatatctgtaagtctgagaccagcttagtctgcatagcaaattccaagacatacagagctacatagtgaaatcttgtctcaaaaaacaaaaaagatcaagtatagggctagcaagatggcttagcaggtaaaggcacttaccacccaccaagtttgataatctgagttcaaggacccatatgtaagaaggagagaactgactcctgaaagttgtcctatgatacatgctatgacacatgcacttactccctccaccacacatgatagatagatagatagatagatagatagatagatagatagatagatagatagataggtaggtaggtaggtaggtagatagatagatagatagatagatagatagatagatagatagatagatagatagatagatagatagaaaattgtttttaaaagatgagatacaaacaagcctgggtaataccatatatattgaagctca

SEQ ID NO: 20130 - DNA, 1179 bp, Mus musculus
ttggcccctttcatcaccccaaaccccctaaacttcctcccctcagttccttgtgggacttctcgttctgaatcttacccctaccacctgtgacaggaaccaaataaagccttcccagctgtccttccttcccaacccgtcacacctctgagaagtctcctagctgggagagctgaaccccaaggtagaggtgccagggtgttgagcccgtttctggctttgtcattgtacttctttacccagaagaggggacatggggccctttagcctttgagggttttggttcttttaggttttttgtttttgttttttgctgcctctgtttacaacctcacttggaggctcccgaccaggaatgaattccttcagtctagcaaagaggtagaggaggattgagaaggctgtctcaggctaagcaggggatcacacaacccacctcaggaggagcagtgcttcaccaagggtgctctgcccttctcaggcccaggacagtgcccaggactcagctcagaagctctcttgattgtaaggcgcaggcaggctacttcctttgaggtcccctcctctggctgtgagggtcattggctgggggttgggggattgggaatggaagaatacctttcttctttctgtcccacttggaaccctggttttgtttccttaataaatttttagttatgaaatataattgacctctgctggtctattttttgggactggggaggggcggctggtttgggcctgtacacctatgttggggccttgccacccaccgtggtgcaggggcagaagagagccacaggattatagggaccttggttactgctttattgctgtttggttgagtatagaaaatggaagcggctctggaagagcctgtgtacagagtagagaatatacaaagggacagaacgggaaccaaggaaggagacctctctccagcccagctaaagttgggctcaggataggggtcacctagggcgcatgcaataaatatatggtccggggaccccaggaagaggaggggacacctcggaagcagagacagatgggtcagggttgtcatccctggcgccagagctgcccaccctggtggtgaggaaaggaagggttggccctggggctagtgccacttgtgcaaaatgaggaacttcacattatcagtcccgggctgggcag

SEQ ID NO: 20131 - DNA, 1180 bp, Mus musculus
tgaattattcagaagccctgtactgaggccctactgtgtgtggtgagcccagctcctctctctgtgcttccttctcctgctgtttttttcctcttcgttttgcagggcctgccttgccctccatccatcttgctataggatctacaacaaagagcctgctagcctccaggatcaggctgcctcaatgggcttcaggtcccttatggggggtgctcacgtctttgagcttgtggcctgccttcttagcagggaaatagatttctgaaggagaaaggtgtgtcctaggagctgtcagtgccccccccccccagtgaagctctctgcagcttgggtggagagctatcgccttctaggcaaacgaagctgggagccattgatttgtctcttatcaccccttagaaaagaagagctaccctgtgggaaggctgtttactgtggagggtttgtcccagagagcagtggggacaccaaaatgagggcacaggtcccctcctgtgccaccctctctctttgctgagttgaagcctgtgccttccctataccaggaatatgggcgctccgaggtcaccggtcctgtgtgcctcactgcagtgacctctccgcccgactgggactggccggatgttcttactaataagcaaactgcattaccatctcgacagaattaaccaaaaaaaaaaaaaagaaaaagaaaaaggaaagaaaaatggtccttgaacaaatgctgctggtgtctaccaggacctaagatctggtactatctgttttttaataattgagggtaataaatatgtatttctttctcctccctacccccatcctccgagcttgtcagctccctgcgtctctcctctgatcagaccaagtcttccccaagcaaaaaaaaaaaaaaaaaatcctttaagcaaaaaaggattaaagccttgaaagtaggtctgcctgcacgctttcctcccctccccccaggcctggcgtggagaggcccctcaggaaaccagggactgggggttgggggtgtggatggagaccacaggtcttggggaagagctcagtggggaaggaggacccctgtagtgctctctccctgcagcctacctagcctgggctaacctggaagtagcaacagtgcagccgaagtttccattggtacctgagggctagcctgagactaggtccactc

SEQ ID NO: 20132 - DNA, 1149 bp, Mus musculus
tagaagtgtattctgcatgttaaacacaccacacacctatgccctcccccttcatgcccctcccacttcccctcagtcccttttgtctccttagagagttttacttccaatttctttttttaaaaattatttattttatgtgcattggtgtttatgtgcgtggatatctgtgtgagggtgccagatcccctgagactggaattacagacagttgtgagctgccatgtgggtgctaggaattgaacccaggttctttgaaagagcatccaagtgctctcaactgctgagccatctctccagccccctactttcatatcatacaaacatacatgcatatatacatgacttgataggcctttatagaatgtaaaaaaaaatgaaagaagatacatgctacttgctttttgagatggatttactttacgtaatactcctcttgccagttggccttctgctgctttgttgttgtttgttggagacaaagtctcacatagcccaggctggtctcaagctagctatgtagctgaggatggccttgaacttctgctcttcctgactgtacctcctgaatgttgagaataccagcatgaaccaccacgcctgggttctgtagtgctggggatggaacccaggcccttccttgcacatgctaggcaagtactctagcaacagagttacctcccagcccattctgccattttccgctcagcactgtgtgggaaccccaggggagaccatccctttccttatctcacctcccaccaggcagtcttctgtactacagtgacagagaacattgccagcctagtggagacatggggtggcccctggcatcctcagataagcttacaaatggaccagccattgtctaggctttggggacaggaaaatgagaaaacaggctctctaaggagctgagagagccgtgagtgttctcaaccagtgtagaactgagcctgtgttactgtgttactgagctgcagaacaaggggctcagctggggttggagagtcggagagggcttcacacacactcccaacccgtccccgccactatcacagtctcagaagaaagaggggcagctagagaagacagtgggggagggttaggctgatggttagtggcacacagtagctcagcctttgaggt

SEQ ID NO: 20133 - DNA, 1871 bp, Mus musculus
cagccgcagagtttgtgcattctgcgttatcaccagcttagtgcctgtgaatagatattttagttgttgtattaaatgaacataggtaggctggtgtcagaaagtcgggtagatcaagggagagtgtagggattttctgtcttcctgggatggacaggaatggtgaagagcagagaagtaaccttgcccagagctggagcagaagcctcagtccctactaccacagagctcctctagatgaaagtgatgctttagggtgagttacctgtctgctctgggcccccactgcacccatagaaagacagaggcttctccgggaggatgctaggtctgagcacagggcacctaggatggggaaagggtctgtggaagaggatctggcccaactccaggaagtcacagcactttctctctgagacttgtaaactttccttcttcctgctggactcattgaagccactgaagcaaagaaagttctctcttccgctgcacgccaggctctgccactcacaaacagcttctctcttttctaaaggatgaatctcgaattaaggccactgtgatggacgtgaagcccgtggacttcagagactatggcagacggctgatcgcgaacatcaggaagaacatgtgatgggagcaagtaccactggtggccagaacggaagagagaagaacagaaatagaatggcttccttcccgccccatgggacagctccacaatgaagatcctctaggggaggctggcaacccatctgggcccctcttgggactcactgataagcaaagacagtgagctcagagggctgtgtgtgaaccttccgctccagttctcagccaccggtagtgtggcagcagtcccctcctcctgccttccggctttgtcggatttcatgaaattttgttatcttcaaacagaaattatgtcacaagtcattaaccccactctggataatgaggcaaattatgtaacctggagtgtgcttttccagtggtggcacctttttgtcttgagttcctcctggggggagaagagtaggggagaacccaggtgttcagagggtgcgtctgcctggaatcaaagggtctgttttgcagagttactgcatggttgttaatgcttagaatggcaacaaggtagaattattaatcaaaggcctatcgttaatatctgaatatccttccttcagggtttgataggtttaatagactgagtcagatgactctgatattaatcagaattgtctcctctgaggacggctgataagcactggcttgctgtccccttggggaaaagcaaacccccaaattgcataatttacttcattatccacatagtggggtcagttacttgagacacaatccctgtttgaagataacagaatcttagtaaatccgacaaagcctgcagacagaggtggcactgggacatccaggctgctacagagcatggcttcagtttgcatcagttaccgttcggttgccaggcggacctgtgtacctttattaaagctatgttaaatagaatttaagaaagaagctttgtttcctttgctttgtttgaataaacagtatatctttgtggatcctactttctttgactgtaaaggattcttgtaactggaaagcaattaattagccttcataataaatattcactagggaaagatgttaactcattacagactcagagattagactgaggcctggagatgattctcactaatgtttgcaaccctggaatgcatctttaaatgaatgaaaacacaaaaggaaaggcgattgagcccaggaacaccgatgatctggcccctcggggttggattgatgtttacgcggcagcctaacaccaagccaactctgaaacgtgg

SEQ ID NO: 20134 - DNA, 1055 bp, Mus musculus
gtttccggtcactccagagctacagggtgtctcctgaagtgtgcttcagcctagtaaacaccttttaggaaagtggagtcaaagcttgaagtaaaaaaagagaaacgcaagtgcatatccgggcacttgctgtttggggttgtcaggagaaggtcataggaagccactttggtgtgaagggaagacttcattttgccttgatggttgctgtctgttgtcccagcacttgggtggaaacaggaggttcactcagacctccaggccagctagtgtccacagtgagttcaaagctagcctggactacatagcaagaccctgtctcaaaaatatatacattagagtaaacaggtgaattgggacccttggggggcctcagtgagtgaagcccttgccaagcaaatctgaccacccgagttccatccctgggacccctgcgacccctggggtggtggaaggagaagacctgctccatgcggttgtcctctgacctccacgaatgcgcctggcatgcacaccacacagtcaaaacaaatgaacattaactgactttacctttactcatttgccttcttatacactaggtttatttaatgcagagcagaaattatgccaaacataagaaagacactagctaaggtaaaaaaaaaaatagactagttagtaaaagctgtgttttctagttcgtggggattggtacctgtgtatagtgtccttccctcctccctccatatcgcttggatgcgtgtagaggccacggaggaggagcttttgccattgtttcctgcactttcctttctttttctgccctccacgctgtttaaatcacccacaaggtcttagcagatagtccgtcccgagaagtccttccacacagatagctggaattgacttttaaagtatagtttgccttttatctgtcttgccctctgttttcatatcagattttcaggcttgggcagcctttcaggattttttatgagcttattatagttggctgttcttggtgctggtgaggacgcacaaggcttccctcagggaatgtgctgctctggggg

SEQ ID NO: 20135 - DNA, 1153 bp, Mus musculus
agctgcttttgttttaccagagctgatagcttgaaaatgtaactgtatatgtgggattctgcaatgtctgcagccctgtgagggtctctttacacttggactgttgctccgaggatggtgtctaactgtcaaaatggcctgctctcgctgttgagagcgagggcctagcagcgcagttctaatgtgctctcccttgcttctgcagggtgaaatcagagctactgctttcaatgagcaagtggacaagttctttccccttattgaagtgaacaaggtaagaagacggtgttgagtcagagctgacaggctgaactgtgagagccatgagcacagtttggaaggctgcattgtggggcgggctttgatggactgagtagcttgccctgacttggcctcttttgcaggtgtattacttctcaaagggcgccctgaagatcgctaacaaacagttctccgctgttaaaaatgactatgagatgaccttcaataatgagacttctgtccttccctgtgaagatggccatcacttacccacagttcagtttgatttcacagggatcggtgacctagagagcaaggctaaagacgcactagtaggtgcgtccagggttgagggcaaagagtggtgatttttgtctccagtgtttggggtgatgcgtgactagcgtgcttgcctttcgtccctgccgtgttttaaagaggagccttgatgggagctcttacaaagtgttctttgtttcagacatcattggaatctgcaagagctatgaagattcgattaaaatcacagtgaagtcgaacaacagagaagttgctaagagaaatatctatttgatggacatgtcagggaaggtggtgaccacaactctgtggggagaagatgtgagtccttgcactgagccgagtcctgagggtggggctttagctcagggagttgtgctatccagtaagtatttgaagaccttcgctgtgtgagatgatcggttattgcagcttcttgtagtgcaatgctccttcccgagtgggaggtctgtcttagagtccacagacattgactgactcttctccataaaaccatcctgtacattcttcttgtcagtgatgtgtgcgtgcgtttgatttgcaggctgacaagtttgacggctctcggcag

SEQ ID NO: 20136 - DNA, 1173 bp, Mus musculus
acaaatcagacataatattataaacaagtattagtgtcactcaattaaaaagtcactcaggaggtgagatcaatccccagcataatgaggggaggaggggagagaaggaaatgaatgggaggggaggaggaaggaagagagaaaaaggaaagatctcaaagcagaacacaggatgtaatttaaggcctaagctctcgactgaagttgtccacttttaatgacccttttcatgctcatggttttctgtcttcggtacatagtgaagagtggaaaccaagggtcatcctggaatttccttttgttttcaggcatgtcttaaagacatagtggaagcaggtatgcatgggtatcctgaaagactgcagcccaagatgatggtgcgtaagacagaatgcctggtgaacctggggagactccaggaggcaagacagaccatcagtgatctcgaaagcagcctcactgccaagccaaccctggtgctttcctcttaccagattctgcaaaggaatgtccagcatctgaaaataaagatccaagaaaaggagactctcccagaacccatccctgcagctctcaccaatgccttcgaggatatagccctgggggaagagaacacacagatttctggggcctccctctctgtcagcttatgcacacaccctttgaaaggccgccatctagttgccacaaaagacattctcccaggagaactgctggtgaaggaagatgcttttgtaagtgtccttatcccaggagaaatgccacgacctcatcattgccttgagaacaagtgggataccagagttaccagtggagacctctactgtcaccgatgtctgaagcacactttggccacagtaccttgtggcagctgcagctatgccaagtattgcagccaggaatgtatgcagcaggcatgggacctctaccatagcacagagtgttctcttggggggctgctcctcacactcggggtcttctgccatgttgccctgagaatgactcttttagccagatttgaagatgttgatagagttgtaaggatgctttgtgacgaggttggtagcacagacacctgtttacctgaaagcaagaatctggtcaaggcatttgattacacaagtcagggagagagtgaagagaagagcaagataggtgaacccccaattcctg

SEQ ID NO: 20137 - DNA, 1119 bp, Mus musculus
tggaggtagggctgcaggtttgccgccagggctacaacatgctcaaccttctcattcaccggaagaacctcaactatctgcacttggactacaacttcaacctgaagcctgtcaagacgctcaccaccaaggtcctgtctgggatcttgcggctctgctgggcttaggggtggatgggactgtggcacacctccttctgtggccactatcattaatgttctttgtgttcttggccttttcaggaaagaaagaaatcccgttttgggaatgctttccatctatgtcgggaagtactgcgtttaaccaagctggttgtggacagccatgtgcagtatcgcttgggcaatgtagatgccttccaggtgaggccatgctgcctggacccctgcctggatggagagacagggtaaagcctgtgctggctttggagctggctctggctctaagtctaatgggtgatttttttttttttgcagctggcagatggtttgcagtatatatttgcccacgtgggacagttgacaggcatgtatcgatacaaatataagctgatgcggcagatccgcatgtgcaaggacttgaaacatctcatctattaccgcttcaacacggtgagacccagccctcactgccagccttcacacacccttgctttttctttgcagttagagcttttccccaggaccttcttagagagaatctcttgactatgtccttactatactcagtgaatcacagcacttcccctcaaacctaccactgaatccttgcaggagcctcagtttctgccttgaaattcttacatgcatccctattctagactgaggactcaaacaacatttaccctgtctcacggcagcctgattcatgttcatccttctacttctgcctggttttctttctatcatttctctaaaggaattgttcatttatgttcatgatttctgcttgactgtagggtcctgtagggaaaggccctggctgtggtttctgggctgctggctggcgggtctggctgttctttatgcgtggaattacccctctgctagagcgatggctgggcaaccttctggcccgacagtttgaaggtaagtggtttcctcacccaggcttgtgttc

SEQ ID NO: 20138 - DNA, 3000 bp, Mus musculus
tcaaagggggtggcaaagacagtaacgaagcagcgggtggagtcgcactttgacctggagctcagggctgctgtgatgcacgacattctggacatgatgcctgaaggcatcaagcagaacaaggcccggacaattctgcagcacctcagtgaagcctggcgctgctggaaggccaacatcccttggaaggtaggctctcctccacctccaaggaggcctgccattcattcatccttctgaggttaggagtaccacatcctcacaggactgtccaccttctaatacccctccttcttgagacagtctcactgtgttgtcctggctgagctggaagtctgcaggccaggctggtctcagactcaagagatcaatctgcctccgcctccatgctggggtgcaggtgtggagcactatgcttgggtcttagtactctttcattgtgtctgtacctgcaggtcccaggactgccaacacctatagagaatatgattcttcggtacgttaaggccaaggctgattggtggaccaatactgcccactacaaccgggaacggatccgtcgcggggctactgtagacaagactgtttgcaaaaagaacctgggccgcctcactcgcctgtatctgaaggcagagcaggagcggcagcacaattacctgaaggttgggacagctagactgggtgtgggggctgggtggtgaggtggactgcagagtgaggatcaggctttgtcctggtgtggacagtagtgggagactaacctgacgttcaccttccaggatgggccttacatcacagccgaggaggcagtggccgtgtataccaccactgtgcactggctggagagccggagattctcgcccatccccttccctccactctcctacaagcatgataccaagctgctcatcttggctctggagcgtctcaaggaagcttataggtaaggggtggctggtgggttcctgttgggacggtaacagagagaatggcatcgtggtcagagttcagaggaaggtgtagttccttctggtttagcatctcattcactttccttttgctttgtcagtgtgaagtctaggttaaaccagtctcagagggaggagctgggtctgattgaacaagcctatgacaacccccatgaggctttgtcccgcatcaagcgtcacctcctcacacagagagcctttaaggaagtgagtaatatgttccctccgttttcttttggtctgtgctctttattcctggcagattatctagtgggtggcagattggcttaggtgaattgatgtgaaccaggttcctcctcccacaggtgggcattgagtttatggatctctatagccaccttgtaccagtgtatgatgtggaaccactggagaaaataactgatgcttacctggaccagtacctgtggtatgaagcagataaacgccgtcttttcccaccctggatcaagcctgctgacacagagccacctccactgcttgtttacaagtggtgtcaaggtacaactttgctggagttacttctgtataaacattcaggctgcatagtccgttttattgcataagagtgagtagtactgccagatggtggtggttctatgcgtctttaatccctgcattcaggaggaagaggcaggcagatctctgagtttgaggaccgcctggtctacagagtgagttccaggagagccagcactacacagagagaccctgtctaataaaaagaaagaatgaatactactgttgggatgggtggatggatggatggatggatggatggttttggaatgtgttgagagctgctgaggttactagtcctgaaaagaaatttttaatgtgccatatctccgacatttttcttttgtaggcattaataacctgcaggatgtgtgggagacgagtgagggcgagtgcaacgtcatgctggagtctcggtttgagaagatgtatgagaagattgacctgaccctgcttaacaggctgctgcgactcattgtggaccacaacatagctgactacatgacggccaagaacaacgtagtcatcaactataaggtctgtcctagagcaaggaacaaaggaatgtgttgagggcatgtctgacccagggagttaggatttgctgagggagattggaccctgaagtgcttgggacacagtcaaccctagtcatagctaagaattgtggttctcttttttcctttttcctttctaggacatgaaccatacaaactcatatggaatcatcagaggcctgcagtttgcctcattcattgtacagtactatggcttggtgatggatttgcttgtactgggattgcaccgggccagtgagatggctgggcctcctcagatgccaaatgactttctcagtttccaggacatagccactgaggctgcacacccaatccgactcttctgtagatacattgatcgcatccatattttcttcaggtaatgacacacagctcatttacccaacagggcagggagccatgctctgtctgtgcagtggctcttgtagcttagttgattaattgcttttgggctataaagtaaaatgaagcctagtggggaatagggtccccactgtggagctagagttagttctcaaagggtcctagtatatttggagttcgaccgtgtaccttgtcttaacgtaggttcacagcagatgaggctcgggatctgatccagcgttacctgacagaacacccagaccccaacaatgaaaacattgttggctacaataacaagaaatgctggccccgagatgcccgaatgcggctcatgaagcatgatgtcaacttgtgagtctcagctgggtttgtggaatcacgaggatgttagtcctcaattaggactgaggaggttgtgccttggggggaaggaatataggcctgttgggctatcgtctacctggtctttgaatgtgtcttcaacagactgaagtgcctctgtgttctctggataggggtcgggcagtgttctg

SEQ ID NO: 20139 - DNA, 1079 bp, Mus musculus
ccaacctgctattcaacatgtgtggctttgagtgccgcatcctgcctaagtgccgtaccagctatgaagagttcacccacaaggacggggtctggaacctacagaatgaggtacagtccaggaaggacatccttttacgacccctgtaactctggagtcaatgggtggagaacagtcatagcttctcattatcattaagtgggttgggtttagtcacagttaatccttgcttgtttaaacagtgtctctgtaacactggcaggccttgagttcactttgtaaacaagactggccctgattgtctcagatcagcctgcctctgtctctacctcccaagaagtgtaaggattaaaggcatgtgtgctgttatgcttgattgattgattgattgaaacagggagggttctgggggctgaagtaaggaactaaggcttggtaaacagcaccttggcctgctctgagccatttcaccagccccttgggagtttctgagacaagttaacactgactttatggtgtaggttaccaaggagcggacagctcagtgcttcctgcgtgtggatgatgagtcaatgcaacgcttccataaccgtgtgcggcagattctgatggcctctggctccaccacgttcaccaaggtatggagggctggaaacctcagatttcctgccagcctctgtcttagcatcccttcagctcgtccctggtttgagtttcctgtttccaaactgtgcctagtattctaatctccatgtattattttgggactgcatcttagaatgttagatctattgagtttatttctgaggattccctgcaaaaatttaacaggctgcatttgtggggttttgatgatttttagatcacagcaaaagtggagtctataatttgaacaaaagtatctatttgcattttcccttaggctaagtcaaacagcttataattttagggagtagcatagaataccattaaaatgaagggtcttttgtttatatttttccttaagttgtttctggggcccatttaacacagctaagggaagctggggatttgttagttgtgtatattagggtcttgca

SEQ ID NO: 20140 - DNA, 1195 bp, Mus musculus
tttttttgtaactactaacgatttttaagattaaccgttacagtagggatgtaagtaattcactagtaactgcaaggcctgcattgctcatgtgaactttactcctttctgctgactttagattgtgaataagtggaacacagctctcatcggccttatgacatattttcgagaggctgtggtgaatacacaggaactcctggacttattggtgaagtgtgaaaacaagatccagacacgtatcaagattggattgaactccaagatgcctagccggttcccgcctgttgtattctacacccctaaggagctgggtgggcttggcatgctctcgatgggccatgtgcttatcccccagtctgacctcaggtatggcctgtgtgctagcttcattatttcaactcggagggagatgggtgtctggttatgtttgattttacttttatctcttgtctcgattttccaaaacaggtggtccaagcagacagatgtgggcatcacacacttccgttcaggaatgagtcatgaagaagaccaactgattcccaacttgtaccgctacatacagccatgggagagcgagttcattgactcccagcgggtctgggctgagtatgcactcaagagacaagaggctattgctcagaacaggtgggcatgcagagagtgtgccaatcacacagcttttgggtcacaacattttgaatcttatatagaggccatgggaagagtatgtgtttaggagttaagactgattctgtttatccttggccaaagaatgttgaatgcttcctctttgtgaggaaggatgttgactctgtttttttctggcagacgcttgactttagaagatttagaagattcatgggatcgaggcattccccggatcaataccctcttccagaaagaccggcacacattggcttatgataaaggctggcgtgtccgaactgactttaagcagtaccaggtatgtggactggagagtaaagcaagtttctcccaatcaggatatttctggcatccctgtcacttagagtggtagacacccagacgcttcactgtacttgccttaccttgctgtctaggttttgaagcagaaccccttttggtggacacatcagcggcatgatggcaagctttggaacctcaataactaccgcacagacatgattcaggcgctgggtggtgtgga

SEQ ID NO: 20141 - DNA, 1530 bp, Mus musculus
tctcttcaagggcacttacttccccacctgggagggtctgttctggtaaggactctgccccaactacctgagcccatcacttgtgtgctgtagtggcctgctgctgcttacccagtgagggcgaagcacctctgggaggtggatgggcagcgtctcacttggttcctctgctcatcagggagaaagccagtggctttgaggagtccatgaagtggaagaagctgaccaatgctcagcgatcaggattaaaccagattcctaatcgtagatttaccctctggtggtccccaaccatcaatcgagccaatgtgagtgtgattgttcagcaggggagatgagggaaggttgtttcttttgccttaatctttgtcctaagaagtggcctgctgtggtctcgggtctctaaagcccgtctctttcttggcaggtctatgtgggcttccaggtgcagctggacctgacaggaatcttcatgcacggcaagatccccacactgaagatctctctcatccagatattccgagctcacttgtggcagaagatccatgagagcatcgtgatggacttgtgtcaggtgggctgcagttgaggggtgacttcacagagtcacgtcacctcactgtttttctagttttggagacagtctatgtggccttggcctagagctccttatgctggccttgaactcggaccaccacctacctctgcctcccactggcttggattaaaagcctcacacggccagcttgctcttttgagaatgagaagtttatcttggacatgcaaggattagactcctcctgcttcatctaacttctcttagcgctcagtgtaagtggatatctgtaacgaggtacaaccctctcgtctttactcccaggtctttgaccaggaactggatgcactggaaattgagacagtgcaaaaggagacaatccatccccgaaagtcctataagatgaactcttcctgtgcggatatactactctttgcctcctataagtggaatgtctcccggccctcgctgctggcagactccaagtaagtgttttgtggcccagctttaggtattaggaaccttggtgttactgtactaggcattttacttaaggggttagccctgcctctttggttttgttattctggcttaaaccttataatcctattgcctcggcccctccaaatgcttgctgtacaagggtgggcaccattcccagcttttgctgacattctttcaaacttggaggtagtgttaacccctgtagcccatcagcagtcagacctgctcatttcctgggggtcttgctgatctgtttgttttgcttgtttttgtttgagacagggtttctctgtgtagctctgcctgtcctggaactcactctgtagaccaggctggccttgaactcagagatccgcctgcctctgcctcccgagtactgggattgagtcaagcaccaccactgcatggctaagggtcttgctgatctacactgaggaagggggtgactttgagatttaggtgcagtgttg

SEQ ID NO: 20142 - DNA, 1780 bp, Mus musculus
gaactcagaaatcagcctgcctctgcctcctgagtctgggattaaaggcgtgcgccaccacgccgggctgaagccatcctcttttatatattgagttctaagccatccaggaccgcatagtgagatcatgtctctaaaaattaaatatcgggggggggggggcgagacacgacacctacagaagccaggagcatcagatctggaactagagttacaggcagttgtaagctgcctggtgtggatgttgggtaccacatcctcacgtcttctgtaagggcatgatcttaatctgatgccagtagctctggcgcctgtcttacttcactgtttctgaacaactataattcatcattaaacatgtaggcatctttttctgattactaagtttagcatccatgttcgtcgttatagaaacagtttatttcaagatttttttttttctagataattgaggaaggtagactcagtttgttttgttcctttttggttattagttggccaagtggaagactgctgaggaagtggctgccctgatccgatctctgcctgtggaggaacagcctaaacagatcattgtcactcggaagggcatgctggatcctctggaggtgagaggtggacacagtagaaggaggtaggcccacgccctctgggctgtgtctctgacctcgggctttcctttaggtccacttactggatttccccaatattgtgatcaaaggatcggagctccagctgcccttccaggcttgtctcaaggtggagaagtttggggatctcatccttaaagccaccgagccccagatggtccttttcaacctctatgatgactggctcaagactatctcctcctacacggtaattagatgcttaggaagagggcctctctggggtgaatgtggagtcaggagaggagcctgtgtgcctcagggttctccagaagccacttgatgaggtcagtttaaaatctgaacctatgtatacaaagagcaggaactcttgcagaggggttggcaccttaagcaactggggacagtgaggctgtgaggctagggtaaaggaggagagagcctcacaaaactgatgtcatgctttgcacgtcttttcccaggctttctcccgtctcattctgattctgcgggctttgcatgtgaacaatgatagagcaaaggtgatcctgaagccagacaagactactgttacggaaccccaccacatctggcccacgctgactgacgaggaatggatcaaggtggaggtacagctcaaggatctgatcttggctgactacggcaagaaaaacaagtgagtaggggccaggtgtcccagtgcagcgaggggaagcctggctcaggacataggctctggagtttggaaacatttaggcttatcagtttctcagatattttacctgtgtttggtaatgcatgcctataatcccagcactcgggaggcagaggcaggtggatttctgagttcgaggccagcctggtctacaaagtgagttccaggacatccagggctacacagagaaaccctgtcttgaaaaaccaaaaaaaaaaaaaaaaaaagaaaaaaaagaaaaagaaaaataacatcttggaaacttaggaagaaacacagatctcagtgaaggcattgaagccattttgaacagattcactctctttttttgttccttctgtctacatttctcttgtgttttgagacaggatttcattctgtatcccaggctggccttaaagcttccaacaaccctcttaaccttgtagctgctgaa

SEQ ID NO: 20143 - DNA, 2206 bp, Mus musculus
caagctgagtttgatgctccagaacccctgtataggtgaaaggagagcctgtcccatagaattttcctctgaccttcacatacactcagtgccatacagaataataatacattaaaaacatttttgtttttgagacagggtttctctgtgtagccctggctgtcctggaactcgctttgtagaccaggcgggtctcgaactcagaaatccacctgcctctgcctcccaagtgctgggattaaaggtgtgtgacaccacgcccggctaaaaatatttttgtatgtaggagttttttctgtacaccatattcaggcagtacctgtagagagcaaaagaaggtcctaaaactggagttgcagacagttgtaggccaccatgtggcaggtcctctggaagagcaaccagtactcttaaccagtgagccatctctccagccccaacaataaaattttaaaaacttctggcattctgggttggtactaagaataccttctgatctcatctctagattgcaggatacctgtatggggtgagccctccagataaccctcaggtgaaggagatccgttgtattgtgatggtgccgcagtggggcacgcaccagactgtgcacctgcccagccagctgccccagcatgagtacctcaaggttagtggtggtggagcctgggagtgcactcactgtcgtgctaccctaatgggggacatttgtctgcagatgggttgaacatctctttattgctgtttgcctacaggagatggaacccttaggttggatccacactcagcccaatgaatccccccagctatcaccccaagatgtcaccactcatgccaaaatcatggctgacaacccatcttgggatggggagaagactattatcatcacgtgcaggttggtgtgggcctcttgggtggaaatattatagagcaggcattgcaggccaggacctggattggtggcttgagcgcttaccctgtccctgtcccccccaccccagcttcacaccaggctcctgcacactgacagcctacaagctgacacccagtgggtatgagtggggccggcagaacacagacaaaggcaacaaccccaaaggctacctaccctcgcactacgagagggttcagatgctcctgtctgaccgattcctcggcttcttcatggtccccgcccagtcctcctggaactacaactttatgggtacgtggttgtgtgtgcctaggaagtgtggggtagagacaggtgaccagcatgcttggtcatcttgtcatcttgaggtctggctgccttggaaacggtccaggggcccaggctgggtgaggcaggcagaaccttattaacttctgatgtttcccctcccattaggtgttcgacatgatcccaacatgaaatacgagctgcagctggcaaaccccaaggaattctaccatgaggtccacaggccctcccacttcctcaacttcgcccttctgcaggagggtgaggtctactctgcagacagagaggacctctatgcctagttacttccttctgcttcagatccccaaagcctggagcctcttgaacgccctccccagacaagctgctgacattcagcagtcagcccctttgcgttctgtgcttgtgttgttgatagattgtaatcctgaacaaaatgtaataaattttataaatagtgcttttgttttcttgctgttatgaggtcaaattctgggcataggcgtttgaggattggggactagcttgggcagttgacagcaaggtactgggccctgccttcagagccttgaggccttctccgctggaggcttagaggctccctagactcagggagctgagttggggctggcttattactttgagcatatttgctggtttctctgtaaaagtacttggagtctacctattttcaacatcacttcttggactgtgtggtcctcctatagctgtagtgcccggtctcgttcatttttgtaaactgtgtggttcctagtgggggaacatacttaagtgactgtccctgcagtccagtagaggctgtttgctgaccttcagtctttcacctcttggcagccaagtccaggggtggagcccgggtcaggcgctatggggagggcttgcctgaagtgaccacttacagctctagtcctcaactcttggatacctgcctggaagttggccgacctgtatccagtgaccttg

SEQ ID NO: 20144 - DNA, 1214 bp, Mus musculus
tcgctagcctagaatttgccgagtaaggttaggctggccaaccactgagagtcaagggtccacttttctctgtctcctccacttgacaccatgctacatgtccctcccctcccctctccttttctgttgagacacggtttctctgtagccctgactgtactggaacttactctgtaaaccagttggcctcaaactcagatagcctcccgcctctgcctcccgagtgctgggattgaagtatccacagcttcaaccctgcttcattatgcttatgtagtgtatgtgtgtgtgcacgcaggacataagtcaaggttagaggacggcttttgggaattggtactcacctgctaatatgagggtgaggatccaatttaggtcatcaggcttggtggcagatgccattacctgctaagccatcttgtccctccacccaccctccctttccacacagggtctcttgtagcctagactgccctcagactccttatctgtggatgactttggcctcctgatccgcctgcattcagctctaaagtacttacttagatagtaggcatctaccctccagtagaatgagaatcctaatctgggactgatgtcgtgtcaaggcacgggtgaaacccttgaaagtgtagacaggactgtgttttttgaggaatggcttctttattgaattctttgactggtctctggtttctacaaatactgaaaacatctgcattaaggggtctgggtgaaccagccacatcttgtcagttgccagagccttaaggcactcacagtgagctttggctttcttggtggtaaaatcccaaaggcgagtctgtgtctccaatctttggggaagcctacctgttctctttctttatacacacagagaatgtcactaacagcacggtcgggggcagcgcagagccggaacccgaggagttgagcctggtgaatggctggctcagctgtaaggcccaggatgagattctgaatttggccttcaccgtgggctccttcctgctcagtgccatcaccctgcctctgggcatcatcatggacaagtatggtccaaggaagctcaggctgctgggcaggtcagtgtgggatccgtgagggctgggtcagcataagtgatgccttgagctgcattccctgctgtagggaaccttggactgtggtagcagtgcaccatgggactccctaaattcccaccctggacagga

SEQ ID NO: 20145 - DNA, 1217 bp, Mus musculus
tctgttcaaacagtaatcacataaccccaacagtgagctagtggaagccctttgaggcttctcatggctcagtggtagagctcactcttaacatggctaagaccctaggttctgtttcccaagagagctattgtgtattttccaaaccatctctcagaacacttgtctgtgaaaaggtctagtggggtacgctgagttaaagtcagacctgccacttcacagcagggatccacagccctttccccatgttcctgagcattggagctgggggtagcaccaggtgtagtgtcaggaggacctctttgagttcaagcccagcctcctgtacatttcgagttccaggctagccgggactattcaatgagaccctgtccaaaaaaaaatccaaaaacctgtttgcaaggatgtggagaaaaattggaagttttaggcattgctgtctgagtggtggagctgagagctgtggaaacatggcacagtcccgtaatgccagcaccaaaaggcaaagggtgacatctttcagcatgagctgcaaccctgctcacacacaaggttgtgacatgctgagtggtgacaaatcatagccatgtgcgacatggtggctacttggctgaaatgtggattggctccaggcctgggtgtggatgtagctcagttggtagcatgtttgcctagcttacccaaagccctgggtttgaataaacctggcatggtagtgcagcacttggaaggtggtgacatcaggatcaaaagtccctcttggtcagatagtgagtttgatgccaacctggaatccaagaactctcatcttcggaaaaaagaatgacaaaatcagatggcagaccactggtctcacctatgtctcgatttgattctggtgctgcccagaggttaagatgcccctgtgaggaagagaagaggttgagggaatgtcccttcctgctagggatatagcctgcagacacaacctgtgcagttcccagcaacactgaggggcccacacttttgatcgtgatgctgtaagggtatatatcctaggattgagacactagaaaactaaatgtgggatggaaaagagccaacggtactggaagatgagagacgtccactggtagcagagaacaggtgtggcaagccagatgagctctccctaatcaagggccatcctgcgctgacttggcagacatgtcagtgtctttgaatcacggtgacagcct

SEQ ID NO: 20146 - DNA, 1419 bp, Mus musculus
tggttttacccgtcaaggacagtctcaccagaagcccctcctttgtggtcttggcgttcatcaaggatggattcccctgggactctacccttacgactctgccgggacctattcacagctggctccaaccttcattaaagccaaggtacaggccctcgggaccacctcctgtgctctgtcccctacacccacatccagaagttctgatcaaaacttgtacatagccagccagtggtgctggtgcacacctttaaccccagctctcccctgctcaaagctcagcgcttgtctccacagagcccagccacaggggctgttatagcctcaacactgttccctaggaagggcagtaaggtagttgtgggttttatggcagtgacagtgccttatctgtgaagctactaggcacaacctaaaattgagtaatatacatatatatatatatatatatatatatatatatagagagagagagagagagagagagagagagagagtgtattgactcagctgtgtggaaagagcacccaagggttacaggagggctggcttctcctcgggctgtagctcttccctggattgagggtcaagatgaggctgtgtccccatgctctaacctgccttgggccctagagtgtggacagagcctcctgagctgaggagagtccgtgtcctctatgaggaaggtatcatggctctgtcagcacagccaccaactatgccccttggtccctgcagtgagtcattcttccatggatagatccaagacaggaccacaggtcacttcctaaccttgactgttctctgaggggaggcatgtgggttagcagccactccacattctcagggaaagctcctgccatttcctcacgtgaaatggaggcttctgtgctctcacgaggtggctaaggggacctgtaggtaaatcgcaagaacagcagtgtgtgtagctcacagcagaaacttaacaccaggaccctggagaaaggcagacagcacgggagccaggcaccccccccccctcctatgacaggaccctgacacaaggggactgaccatgtcagactggtggccagataaagatggtactgacctcagtctcttcagaagtcgtcttacagagaagccttaagttccccccttgcctacttttctattttgtccttcacgtttttggtaagaggcttggccaaagagtcttgatgtcaaaagtcccagcagcccgtaccgcctttttgaatgactacttggccaggctgtgtgtgtgtgtgtgtgtgtgtgtgtgtgtgtgtgtgtgtgtgtgagagagagagagagagagagagagagagagagagagaggtgtgttggagagaggtgtgttctggtgtgtctgttgagagagatgtataagtgtgcctatgtgctgtaatactggga

SEQ ID NO: 20147 - DNA, 1208 bp, Mus musculus
tggttttctctcctggaccagggttttacctcaaactcagaggtctccctgcctcttctccgcccaccaagtactttctttttaaaaaaattttatttgacttttagttatgtgtatgcatacatgtctgtacacataggtgcaggtgcctagggtagccagaagacactgacttgtttggagctggagttataggcagctgcgagtgacctcttgtgggtgctgggcaccaagctctggtattctacaaggcagcatgtaagctttctctgcagcccaccgacttccgttcaggctggtacaagcttactgctggtttgaaggtcttgcgggccagctcacagttagctgtgaaattatttggattttggaatcagcaaatgtgtctggtttaatcctaagttctagtacacaaatgatttccaaagttatttgaaaatactggacaaaaaaattcttttactagcagagcaaggtcgtgtagaaaggggagttaggtggtacggccatttcttccgccttccgtgtctgcggccctcgcagaacttccagcagcgacatgttgggccagagtatccggaggttcacgacctccgtggtccgtcgcagccactatgaggagggtccggggaagaatttgccattttcagtggaaaacaagtggcggttgctggctatgatgaccgtgtactttggatctgggtttgccgcacctttctttatagtaagacaccagctacttaaaaaataaggatatttaattcatccctttaacagaatgaagaaagtttaagagatgatctgaaaattggattaaactcttgaactcttatactagaaaaaattgtaaataaactaatgacataaaaaaaaaaaaaaaattcttttactaatgttaaaaagggggttggctagagaggtggctcagaagttaagagtaattgctgcttttctagaagacccaagttcagttccctccaaaagcacacacatgcacatgcatgcacacaaaattgctataacttttaaaaaatattgatacacacacacacaccttttatcaaacgagagttactaaagatttctctggcatctgattctacaaaatttgaatgtaaatactacttgacctaacaactacactttctactacatttaccacacgtatagatgtaagtgcatcaaaagacgtgttctgcatctggaaa

SEQ ID NO: 20148 - DNA, 3008 bp, Mus musculus
gtcactgccgtgctaacgaggggactcctgggtttccatagaaacaaattatggacattgtttatttcaggggctggaagactttttacccaggtcatagggctaacttggggtgtcccttgttatgctgagaggaagttatctgctcaaagagcaccttctagcaccaagaggctaagaaaacctaggacctttattctctggctttcccatggttctttttcacccaggcctgtgtgcgtgctagctaggcaagcactatatccccagcccaacccatgttcttaagcagcttctggggatggaagaggaggattaagcagatgccagttttgtagtcagtgccagaaccttagtactctctctccaaggcccccaccaactggcacgcctcctcctgggatctctccacttgtcatgatttactgtgtgcttctggttgcccttgttgcttccttaataatttctatttcttttctagttttgcaagacagtggtcaacaggaaggcccagcagctccaccctcctgagtggcaggccatcttcggacgcagcctttctgtgctcattcttcaggcaactttcaatcccttactatagctatttctagatgccctttaacattgtgaacaaatagaccgtctggtattataaagcctgtgtgtgcgggagcctgatcctctaagatacatggtgtagctgctgtgtttacagctcatcctctctccactgtgctctgacccatttctgtatgccctccccttttatttccaagtgatggtctcagtcttcccaatgagctgccttttgtgatgtgattatttaagctcatttatttcagccttgggataaactgagctattttgcttcctgggcagatctttggcaatgctgaatattcacttggggagagaggaggagttaaaaatacagagacacctacccccagctcctcacaataggaatgtggcttcagacccctgacctctgctcctagtaacctcttgtttgcgtgctctaagcaccaagaaggcacccaaggcccagccagtctcagaaaatttagcaaataataaataacccctactcgagtcattgcatctctggttaatattcttagaaatcttggcttctcagccctcctgttgcccactctgtctggatctctctgtagagcctacaagaccccaccactgcccagctggagaactgtccagtatggcctgttgacaccattcagaccccacaggagcgctgtatgtccgtgctccttttcccttttgggctggtgctgccactcagcaataatcctctctgtgctttcttagacccctgtcctctgtgaggctggctaggatgcaagagtcctggtcttttcatgctgcacaaacaagcatgcaaaaagctttttatccctagcaaaacatgtaccttcctgtttctaatcactggacaagaatttgcagataaagaactcagctcatcctgccccacactgagttctgtcctggacaatcaaaagcaagccgtgactgtagcctggaacagttagcacagcaggctggggaagcccaggctccaagggagtggaagctgcaaagcactggcttttctagatgggcagaaactgaggatgcctttctggtgggagagtgggatagaattgtgtcacctgacatttcccaagccttcttcagtcagtcagcccagtgtgtagtgatccaagcccatgattgccagggtacctgttagagaccaaatctctactaggggagtgagaagtaggatggatcgttctccttgtttttgtctgtgttggccttactcatttctaagtgcaataaggcagtgtctcagggactgcacctgtgacatcctgactggatgcttccctgtggtcctcctggaataagggtagacagatttgggcccctcagcatggttagctctgaccttccttgaggttcttttaagaccaggagatgtctggttactgacacctttcaaggtattagtctcctcaccttgtagagtctttaggcatgcacttggggcatcttggtgattagcatatcagctgctagtagcatgggaaagttggagaagaggcattcctaatggaaatggaaaaaacataaatgttctcatataagctctgtattacctatcaaatcctatttgtgcttaaagatcttccttcagtaactaggttaaagttcagatgtgttatcttgagagaagttgatagtctacgcagatagtttacatgatatgagggtcaaaagatatttgtctccttcagcacttcataagatctatacatatcagtcacattggcctcaatcctggcctgctcttacctgccttgcgcccctgctgttgcccacatttgaaagcatccaaatgatccgaactagaatttcctgagaccagcctggatttagggctcctgcccacataaacacaaaggaggaatgtccctgtcttgttccatccccatgggtggtgttgctgctggacaagtgttggcttttaagtatcccctttttttacccacccccaaaattaactagcactcaagagggctggtgatgaaaggctcacctctggtgagaatccctgagagtgcgacatgcttcttcagactggctgcttccattacatttccagggtctgctttactcccagcgggagcagcagtgtctctgcacaaggcctgctgggctccagccttcttgtggagagacactggggagggacaggtcagggtcactgctgtgggcatgtgtgtatccttccacattcttcctttcagtcccccctggacctctgacgtccttgggttggttcttagtgctacttcttttacagactacactttatagaactgattagatttcctgtttatttaatgtgagtttgtgcctttttgtctcaatcttccaatacaggtatattggggggaaaaaagcagtctaataaaatcctagacagagttttttggagt

SEQ ID NO: 20149 - DNA, 1124 bp, Mus musculus
tcattttcagaggatcttccctgtgcacttttccttagactgatcagtcgtctcaaacataaggaaggggttggaggtatctcagagatataggatgctctcctaatgggcaccaggaaaaagaagggggcgggctgatggggtgtgatgtcaccaggacctttgaggaggagagctgggtttctaagctgaggtctctaacgggctgaaaggaagtagggtgaactccagtcccttctggtatgaagcaggggtgatgggaggtagtaggggacagaggggacatgcagggttcagtggcctcagcccagctctagccaacctcctatactcctttggttcatcaggtggccacccagttcaagatgagcctcctgcagctcgtggagatcctgaggtctaaggagcctgcctatatccggtgcatcaagccaaacgacgccaagcagccgggtaggtcctctggccccatgagttgtgaactgtgcctctgggatgggaacacttcctctcaggaagagcctaaggaccacctttgttactctccggtcactttgttactttgtttcctctcaggtcgctttgatgaggtgctcatccgacatcaggtgaagtacctgggactgatggagaatctgcgcgtgcgcagagctggctttgcctatcgtcgcaaatatgaggctttcctgcagaggtgggtgtggtcggcccaccagtgaatgaatgaactaggccagtgagcacttcctggaacctgtgagggaggagggacggttgtagctctagtttagagggtgcagagaccctcagctgctgtgagacccagaccaggaatcgttttatgctacaggcctaatgttagtcttggaaaagacaatgtaagtcatgtacacagccccaccctccctgaagcccctggtgagagacacaggaggagcacgttgacaggctgctaccagagatggtgtgatcagggctcagagaggaagttgtggctgtatagctattcagatgacagaacctgagccaaccagaatatgaatcccgtctctgctctaggaagataggaatacttcagtcctccatctctaaaatggggacctcaggcatgtgtagcatgtgcc

SEQ ID NO: 20150 - DNA, 1574 bp, Mus musculus
cgtgtgggaggttcactctggcaagcaggtattgccatggaaacagaaaagtcttcaggacctagactcctgtaggactgctaggggaccatctagcctgagcctgtaagcccctgcagctcctccacttactcctgggcttctccccctaggtggccccacggctgaattctcggtgatgaaggcttcagtggacccctcctgactcctgatgcttcgcttagtcccctcctcccctcccagttaccaaagactcaagcttccagacagggatccatggacaccctcaaaacccacctgcaaactcctgcctcctgctcgccccctctcgaggtgatcaggagccagggagctaccccatgagtgggccaggccgggccacagcaatagaaaagcagaggcctgagcaggccaggccagccctctgctgatgccaaatatctaagagaagggaattttaactgaggttttctctgagattttttgatgctttataggaaactatttttttaagaaagccattttcctaccctaaacacactggatgtgtttttccctgcctcgaacagggcaaggaatgtaactgaaagactgactgggctgggctggaaggtcctcttctctggccaagcctctcctcattcccttgtctgtctgtccatccacctgcaccttttgcagcccactatgacctccaccaaaaggctgaggccacctctgcctaccccatattcctgccttaagaatgtccttttaggggctggggtatagcccagtggtagaactggtgctaagcatgtgtgagaccctgggctcaatccccagcattaaaaaataaaaaataggtttttaatattttcaccccagtctgagggcatccctaaagtgggggaaaagtcttaagagtttggaagtcttcagagacagtgtctggtccaggctcctggaatctacagagctggagacagaggcacacagagggagggaagacttgcctagtagaagactgaagcaaatcctaaagtgaagcccgccctcagcacatctcactgcctttcccagggacagggaggcccataaggcaagggtcgcgtctcatgtatgcacctggctctctgaccagcaatcacccttgggagctaccgggtgggagggactcttctgcctgggtctatgccttaggatgacaacctccatacacatacatactttcgacccaatttaagaatggtagggtcttttattggccttgggtgcctctgtgacctgggagcctagggacagggctggccttggaggaactgcaggggcatcacctctttctgctgcttctctccaccccagaggtccttgggtttgcccagctccctctgtgccctctggggctctcagcccactgctgacacttctgcaatccagagaaacactaaataaagcaatatgtatttgccaacacagtcttcctgtgagtgtggaaaaggggccctagaaggtagacattcttaaggggcttggcactacagaagaaaggagacagacctacttaggagcaatagagagaaaccaagttaggt

SEQ ID NO: 20151 - DNA, 1123 bp, Mus musculus
ccactttaaattggtacttcttggccaggttttttgtttttgtttttaaagatttcttttatttgacatgtatgaatgttttgcctgtttgtatatatcaggtcagaactggagttatgggtggttgtgggttctgggaactgaatctgggtcctctgcaagagcagctgctgagccatcatctcaccagcccaaagagagatgatttttaaggctgtctctggtaattagaggcatcagtgatttaaaatggttgaattgttttctcagttttgaaatactatacaaatcttgcctcccaaatttggggattaaatgtgtgtgctaccatacctagcctttttaagacaggatcctggtatgtagctcaggctggcctcacactagtgctgggagtagaggcctgcgttaccatattgttcgataaatctcaacttctaagagtagatcccaaagcttactttatgcttctgtagactacccagaacagtggtgttttctttacatgtagtctccattttctgatttagcctgatagataaggcttgagatgacttggatagtttcgtacttggagacctttttggaaggggggggtctcactgtgtacctctggctggtcagtaatttgttatgtagactaagcctgcctttgacttgtagagatcatctcactaccattgcctcctagggcaccgtgctcagtgggaacctgcttttcaggatacagatgagacagataagagtatgctgctgagaggctattggcctaactctgcatctctatttgggcccacattgatggtgccttttttttttccctatagtttatttataggggagggagttgagggagtagatcagagaaagggtgtgtatgtggggaagaagagtagaggccagccatgagcatgtggatagaactcggggaggggaatggagagagggggaaagagggtaaaagtgagaagagacaagagtgatggtgctttttgactcgttcatccctgtggtatttgagattatgaagagcaggctaaatcaggctgatctggatatcagctggccttgaacattatcttcctccttaaccttcaaatacttttttgatgtttttcttgtt

SEQ ID NO: 20152 - DNA, 3012 bp, Mus musculus
ggcaaacgaggtcacttcccattcacacatgtccgtctgctggatcaacagaatcccgatgaggacttcagctgagtatagctcgacagtttgctgacagatggaacaatctgtttccccccaattgccatctatacaattttcttacaggtgtcaaagcagtctagtttatataagcattctgttacctgggatcttttttaagactgaactactccattctcacttgtatttaccatattcagggtacgaaaccggagggcttatgtggttaacttctgagttggcagttttaggtggtagttgccgtgcctgtatgagaagacgtaaatacattgcctcctttcttttgggcaaaacagatcaacctgtggaaagctgatgggcaggaaaagaatgttactcactgctgaccctgatttcttcagaggttctgttttcatcctgaatccatactgtcaagtggcagcagactgttccccactcccatgacgtaatcatgcactgtgtgaatattacccagtggggttgcatttgcatttatggaccatgaccattgtatgactcattctgacatttcaaatcctgaggattctgagaacactactagaggcatttgtcttccttggatttttcttggattctttccttgttactctcctcccctgtacctataagtggcttgattcttaggataatgtatatcttcattccagatgagaagcaggatgtacagagcactttattcagtgcatagctttaagccagtattggattcactcagtggataaactcccagctctctgccttcccccaagggggcatcgtaggttcacactgctaccacagctcaagactcaccttactgatgggacagatctggcagggccatttttcctgattgctagtatcctaatgggatgctcaaagttctcagattctacttggagtggaaggaccaatcacttactgtatcctatagaaggtatcaagggccaaactttgccctctgcatcatgtgcaagttgtataaaaggcaggttagaattctatgcatttgggtaggattgatactttgaaaactattccagtcgtaaattacttatgtatcattttacatggtttaatagttggtgaagtatattacactataaattgccttcatttgggttctcctttgtccagatttagtttacaaccctttaaagtagagaatgatttatacgaggtcagatgctccagagactaggcctctgaggccacaaattatagggtttctttagactgtaacatgagactttcaggtgataaaggcacttgctggtctctggtgtaggtgaccaatagaaacaccttatactttgctttgaacctcattttagaaaaataatttaccttcttagttgtcttgtgtagattaatatgatgaatttgcattcattgaacatataccaaatcatgtgactgaagtgactagcacattgctgagcacgtgtgtagagattttgtacgaaagaatgagcagagtgcagaagcgtgttgtatggcccagggacgccagttggcatacattaccacaggcagatttaatgagttgatgctaatttaatacattttttacctcactgtagcttgataaaaacagtaatactcaactttagagatgttggcccagttctgagctcataataggtggtcagtgatactgaatggacaggtttgtagcacgtgacttactgcacctgactgcttgtttcacttttcagttagcatagattgtgtaaatccaaatgcacagtcaatcctgtttccctaagccttgtgtgatggtgaatgtctttagtcctagcccttgggagacaaaggcaagtggatctctgagttcaagaccaacctggtctacagagctacttccagaacagtcaggagttagaaagtgagaccttgtttcaaaaacaaaaacaaaaacaaaaaagaatctgttcctgaaattatggcatcgaaaacacttcttagaaaatcatcgtcacaactgatttgaatgctggtattttcttttgcctttgatgctggcttgtattgtctcttcactatatgtggtgggaatgggatctgcagctctccgtgaagcctacgaactcctcagtgattagttattcagagccattacgtgaactgtttggttggatttggctgggtgtagcagttattggacctcaagagatcaaaggacttcttacaaatatcttccaaaaatagcaagtgctataatcctagtcagatgcgtatgtacattgtcacagagcaaagtaaactgaaattggctgctatgttttatataatcacttctgcaagagcccatttttggatactaatatttgacatggttaattcttattaatttgttgaaaatgtttattaataatgcaaatagataattttaattttccacaagtaacatttcactattaatggtttgaaatgggtgataagcaaaccaatttgaaataaaatatgaacatgtgccattgtattataacactattcactttcttgacagttaaattttaaaaatgtttttttttttgtagcatgtattgtatatgtttatagtatatgtagtaaataaaagtatggccaaatgtttggcttggtgatcttttgagaaagtaatcttgaaatatttttcacaaaagtgagtttttgtgtttttaaggaatagaaggtatgtgtctcagctgttcattagtagttacgtaaactgttacatggtgggtatgctataagatctctagaaagtatgacactactgttaggaaacatgaaaatcatatatatggaatataaaggaagcacattgtgaacagagaacaccagacttgcctggaaatgggtctctgtgagtgtaagatggcagtgtgatagggaactctgcaaacttgagactgcattctctgttgtgagaatgctgctgtggatacgccattcatttctcctttttaatgtaagtag

SEQ ID NO: 20153 - DNA, 1208 bp, Mus musculus
ctgtttgagcgcttggtgctaaggttataggcaagagccactgttccatagcttatttaatttagactaggttccctggcatctcattgatggctttgccttctgagattgcaggcgtgcatatgcactcttcccctccccattgcttgacttgactcatttgatgattataaagttatttttaattggaaaggatatgtgctccagattaaacccagggcttttgtgttctggctgggccagacaggatcttcctctgtagctttggttggtcccatacttttgtagctcatagtggattttgaacttaaggcaatcttcctgcatcagcctcccacctctggatttctagccccctaattatctcttgttttctattagctttgcagggggaaaaagataaccatgaaagggatgggtcaacaaaacttgttaaatctatagtctccttttaccatttcctgcatagaaatggtggaatcaatgaagaaagtagcagggatggacgtggagctgacagttgaagaacgaaaccttttatctgttgcatataaaaatgtgattggagccagaagagcatcctggagaataatcagcagcattgaacagaaggaagaaaacaagggaggagaggacaaattaaagatgattcgggagtaccggcaaatggtgagattgttaactgttttgatacggtaccgtgttttgttttgttgagtatatatgggcattttgtcttacctatctctgtatcatgtgtgtgcctggtacccttgaaagccagaagaaggtgtcagatctctagtactggaaatagattacttctcaaatataggtggcattgagttaatttgcagttttagtaccattaatttctgtatctctgttaaaagtgattaacttacatagagaacaggtttattttgctcataggattgaagtaatattgaatctcttattgggcattttggatggcagtggcagggtacatacatgtctgatagcaaaactgcttttatgttgagccaggatagaagacatccaggatagaagacatccaagccaaagtagtgtccagaaacagtaacatttgtgacagaagtaacagggtgtcttttacctgaattgttgccttttatgttcatatttaatacctggtggagaaaggagacttgtttcttgtgagtatctggcaaaatcgcaggcct

SEQ ID NO: 20154 - DNA, 1168 bp, Mus musculus
gccagttttcagtccacattggaacatcagagcatacgttctaacaccaggaagaaatggttcaggatagatgaagttgccagtgagagtgggggcagagaaagcgacatccttcttcattcttgtcttaaatgagctgccgccagaaggggtagcccaggtttaggtgaatctcttaactccacacgatttgggatgggtttcccaccttaagttggctgcttgggatttagttattccaagtatagtcaagcagacaaccaagagtagccatcacagttggtaccttacaatgggaattaattcatgtaagtgcttggttagtctttaggtgaactgtggggggttgtgtatgctttaaagaagaggctttctatactcttaccagttttctatcaacttttaaggactaggtctaaggatttggagacatacatgctttaagacttggttcttcagatattatatttagaatataataaagacttttgaattgccaaagttaattggatgttttccctccctaggttgaaactgagctcaagttaatctgttgtgacattctggatgtactggacaaacacctcattccagcagctaacactggcgagtccaaggttttctattataaaatgtaggttctatactagaagggaaaatgtaagatttaaagttggctttagaaccataactttttaaatgtagattttcaacttttatttaaaaatagctgagaatttggagggttagttatcagaacttacagttttaattagttgaaaaaacaatactaatgaagaattaattgtatttgagattgtctgactgttgtgcaaagtacctgtacaaaatacacagcttttcattgttgagctgaccctcctttcccccacccattgtcctggaactcactaatggcagaccatgctagcctagaatttagagatctgccagcttcctgagtgagattaaggttgtcaggtttatttgagaagaggtctttatatttctgattggcctggaactctgtagattgggatcgtctcagatttggggtgatcttgtcaacttccaaagtgctaggattatatgttaccacaccctgcctgggtttttgattttgtggcttccttcttagctaaagtttcccattttacagtataatctt

SEQ ID NO: 20155 - DNA, 1055 bp, Mus musculus
tttaaaacaggaagtccgcccgggcagtggtggtgcatgcctttattcccagcgcttgggaggcagaggcaggtggatttctgagttcgaggccagcctgctctacagagtgagttccaggacagcccgggctacacagagaaacactgtcttgaaaaaaaccaaaaaaaaaaaaataataaaaataaaaataaaaaaaaagcaaagacaacaacagcaaaaagccaggaagtccttaagaaagaaggatttccaacctgatggatactgaattttgtaaaaaaatctatatcttaagtgttaactgtattttgttatgtactgcatggtagagaaaatttccatgctgtaaggactattttctaactgtgttttttgtctactattgtattgtaggaaaggggactaccacaggtatctggctgagtttgccacaggaaatgacaggaaggaggcagcagagaacagcctcgtggcttacaaagctgctagtgacattgcgatgacagaacttcctccaacgcaccccattcgtttaggtcttgctctcaacttttccgtattctactatgaaattcttaattcccccgaccgtgcctgcaggtaagtagtggacaaaatttctcattgtggagtgcaaacgttctagaggagggagctaccttctgttttcttgtaggttgtcacaggattctcttaacataaattttggggttgcttgctttgtttgaggcagggtcttggtactagatatctaacctagcctctcctctccacctcacctcgccttgtcttgtcttgcctagcctagcctaggcttgaatggattataaatgtttaccacctcaacatcctgggaatgcttttttttttgttttttgtttttcgagacagggtttctctgtatagccctggctgtcctggaactcactctgtagaccaggctggccttgaactcagaaatctgcctgcctctgcctcctgagtgctgggattaaaggtgtaggccacaccatgcctggcttcattttaccttttgtaaagtacattggtgt

SEQ ID NO: 20156 - DNA, 1957 bp, Mus musculus
gtacagtagcacatcttcctaaacaccatagaactctgtggagcttacattccctggaaggatagctgatgttgagcttgtgggtaaataactcccacctcaaggtccaaagcaaggtactgttggttcttgaagaggtgaggttattgagaaagaacattgaccctagaaacacaggaagagcattttaagagtagtatttgtatgtgctcttgaaagacttgtttaacagagacacttgattcctgagcctttaaattttttaattatatcgtcctataacacttgattatttcaggaccgtggttggtagctcttggtttaagcacctcagctgtgaggattagaagacctttttgcctgctgatgtttgctaacagttgtagtgaaactagggacccttagcttggaatgatatctttgtgaccatatgtgagcatatgacagtaactgtgccttattccttacaggtgaagagcagaataaagaagcgctgcaggatgtggaagatgagaatcagtgagacgaaataaaagccaacaagagaaaccatctctgactaccccttccccccctccccttggaagttccccattgtcactgagaaccaccaaatttgactttcacatttggtctcagaatttaggttcctgccctgttgtttttctttctttttcttttttttttttctcccctccccttttttaaaacaaacaaacaaacaaacagttttcagaagttcttaaggcaagagtgaatttctgtggattttactggtcccagctttaggttctttacgacactaacaggactgcatagaggctttttcagcattactgtattgtctccggccacactggcaagatcatcattagaaatggaaatgacatttgaaagccattagacttctaggtgatgcatctaagaaagattaatcacacaatagaggcatatgcgctgtcatttttcctttttttaattgttaaattgaattttataccaatgtttaaacttaaattgggtgttagcttgaggtgttttgggggagtttgttgtaatggttttgctgtaaactgtgtttggaactctgctgaagtgttgctgaaaagcatggtgctggtaacagttcaacaatccgtggctgctcattcttgccgactcctccccctctgaagcaggttagcattgaaggtggtatggaagcctgcatgcgtgttcaactctgttcctcctccctcctcctcggcctccctcctcccctccttcgctcgctcaacctcttttgttcagtacgtgtaacttgaagctaatttgtactactggatatctgactggagccgcaggtacagatctgtattgttcttactgaaacacagcatggaattaacattaaacttaaataaaacaaacctaaattaaaaatgccaaatatatcatgcctccatcctttatacttctaaaataaaatctctagtccagacatatttgacagtattgtttgtctgaatgtgaaatatcccccattttatcccataaatcatttgttttccaatgatgtgtatttggggggaagggaggattgcttgtaatctggtgttgaacaactaagtcagtaattgtcctgtctttcaaaccagttagcaacacaatatttatgtttaaatttatcattaaagtacaacagtcatttaacacaggtgtaactatggatcattttctaatgtgtaattttgacttctgcaattagataaggctcagtgtgtcgaaataatccttgattattagaagtagaattacacttctcactgtataagtcagcggcaagaacagtattggttgaatcccttgtcaatatcccccgttaacagaaacagctacaccatgtgcctaatttcttcagaagcaggtcatgtggtagtgtgagtgggtacttctgtctccttgagcaggtaaacgc

SEQ ID NO: 20157 - DNA, 1187 bp, Mus musculus
gggctggaagggataatggtccagtgagtaagagcacactacagtggacttgttcccagaactcagttgagacgttccccattgcctgtaactccagttctagcagagttgacacctggcctccacaagtaccagcaaacacgagtatatattcaggcaaaaaaattttttttaaatagtgaagctaaaaaaacccaaaacaagaaattctgacatgcaggtgagttcaaggtcagccaggtcagcatatgagttccaggacagacagggctacacatacaaaccctgtcttaaaaaagcaaaaacaatgaattagaaatatttaaaaacaaaaaaaccctttggccatccagccttagagcctgatgctgagttcatccttactgtgaagtaatacctaattctgatttgttgtgaggttgggtctcatattactcaggctggcctgggaattcagcccaggagggctttcaagttcctccatctcccgggtgctgggaggacaggtgtgtccttgaggacaaaacctggagcctatttactgagaagtgttgtaccaactgagcttttactctaagcctggccatacaggtgtcactgtcacaaagttggcttctccagaatggacttctgtgtagccagcaaacctaagtaataaacaatgactcttgtttttgttttccggagacagggtttttcttcttagccctggctgatctgaggccagttggctggcctcagcctcggaggtctgcctgcctctgtcttccaagtgcagagtattaagtgtttttcctgcgtgttactatgtctgtgcaacaggtatgtaagcaagtgttcctccctgaagaatctgatcccttcggactgaagttacaggcagttgtgagctgccatgtagttaaacagaagtcaggtcttgtgtaagaacaatagttctctaaactgcaacacatctccacccagtgcttcatgagcatatccaagtaaatttgatactgaaaaaacaaaacaacaacaaaaaaaacccaacctgtctagagcttcaggaagtacggatcaagagtcgaaggcccgcctgtaaccatgaggtcatggagaaatctgctaaagtcaagagggggcttttcagagttttagagctgctaaaagcaggaaaggctgtgaaggtgattagcccttgcaag

SEQ ID NO: 20158 - DNA, 1172 bp, Mus musculus
gcacttggcgaaactataaggcggaagtgcgcttcgagccacgccccaagcccgcgcgtttcctcagcaccaccatcgtctaccccaagtaccccaaaaccgtctacaccaccactctggattacaactgccacaagaagctgaggaggtttctgtccagtgtggagctcgaggccacggagttcctgggcagcgatgggctagccgatgaatgttgactcagctagcttgaggttggaccagctgttcatacactgccctggtccccagaccaccctggacaagctgggtagcattgctcttgcacatcaccccagccccagagggatctaacctggagatacctctaagcctagccgggggaagatgtatttaaaaaaaaaaaaatcactgcatcttataataatagagaaactcggcttccttaaaaatttttccagatagttaaaaaaaaaaaaagtgtgtgtgtgtgtgtgtgtgtgtgtgtgtgtgtgtgtattctggttggttgatgcagtttccccaaagtctcaagttgatgagaaaatagaggcagaacaaaaggacaatgataggacagtgatatctgggcaggtggaggtgagcttgtcctccattttctgatgaacaaagtaggaaagtctctggaatacagaaggtgcgttaagaaatttcagccatgcatatgtttattgctgggggcggggagggggagaagccagagttaacttgggtagactgtgatgcccatatgtgctcaatctgttctgggccagctttttttgtttgtttgtttctgcttctatttgtttttcctgttaacccaaactcttagatttatcaaaaatctttttcatgatattaggggagaaaaacaaaaacaaaaaaaaacacaaaaggagatgcctttaaaacaaactctgtgccttccgctgttgtcggttgggtaaacagctagcctggtccgaggcaccgcagccctgtggttccagagggttggtttcaggcccaggctctggtgcagcccgagcatgcttggcgtctggttaacgtctccccgggcttgtgtaactctgctcataggtatttggggttttgaaatacttttccttttttttttttcatgcaaaatgcagcagagagctcttttttagaagaacggcattctgaaa

SEQ ID NO: 20159 - DNA, 1099 bp, Mus musculus
tgagagatgatctgtgctacaccacatgctacagcacacagctaacaaacagcactggtccacaggacatgctctggctcgtctggcttctctctcctgttttcaagctttctgtggctagaacattcaacacagaaatgggtctgtcttagcaggaagcactggcctacaggacacctggagagcagacgtctgtgtccattttgtatgaaagggcagtgtcagtgtgggattacccagtaagctgctatagaagccatcactccaccttgtccctggagtttcaggccagtttttggtgtgtgtggacacagaaaactggtcatgagaggccatgctaaaaaggagaaatggtgtaggtaactgctttcaagaagctcacaagtttgatactggtctttatacaaagcctgcaaagatgctggcctctgctggcctcctgacctactcaagtgcttcaggttctcagccctgcctcctgcccattgtcagtgagcccttctgactagaagtcagcaggcatgagaattcattgttgatatacagataaggacaagggctgtctagtaaacggtaaaagacatacccacgatgtctttcctagtattggaaaatgacacagtttcaagaaccaagttgtcacttgcttctgacccagtatgggtgttgccgggtgttgccctgagtgggtgggaaggggagaacagtgcttcacctcccaaaactctttcccaggcccaaggaaggctcctcaggcttgctggtaaaactactgcagtggggctttgacaggatccaagttatcaccagaaaacaaaacaaaaagtgcttttgcaaaaggctggttagaaggaggaggtaatggggatttttaaaaaagaagaccaaaaatccagaggtttatcaacatccagaaggcagagactaccccaggcatgatttggtccttggaatactgaggcagctagtgtgagtgcctgacccctgagagtaattaaccatcctttttggctttggcagtgtcaaagagccgggccgccttcttgcacagcagtgagaaccagtagagctggggagagatgaggacggcattggccat

SEQ ID NO: 20160 - DNA, 1211 bp, Mus musculus
tcatggtgtcttgcctcaaagaaactgtctggaccaagttctccacacccaaagaagagaagcagtttctggagctggtaagctgcctgacgaatcctgtgaagccacaggggattccagtggctgctcttctggagccagatgaggtgctcaaggagtttgtcctgcctttcttgatgttggacatggaggaggtgggcctgagtctgaagctcttcatccagaccctcgaagccaatgcaggcctggaagagtattggctgcagacctgctccccattccctctgctcttcagcctgtgccagctcctggacagcttcagcaagttctggcagctcccccgggagaagcgctacctcacgctggacagcaaggatcttgtgacccacattctggaactcctctgtgagatcgtgctagccaacacagaaaccttctccccagacacctgggccaagtccctgtcctggctccaccgcaaattagaccagctagattggactgtgggcctgagactaaagaacttctttgaaggccacttcaagtgtgaggtgccagctaccctttttgatatctgtaagctctctgaggcccagtggacctcacaggtccacgaagggtatgggcctggcacgggccttctcgcctggatggagtgctgttcagtctccagcagtatctctgaccagatgctttcccttctggtgatggatgtgggcaatcctgaggaggtcagactgtttagcaagggctttctggtggccctggtacaagtcatgccttggtgtagcccccaggaatggcagtaccttcagcagctgaccaggaagctattggagaaacagcttcttcatgtcccttacagtctagagtatattcagtttgttcccctgctcaacctgaagccttttgcccaggaacttcagctctctgttctttctttgagagtgttccagtttctctgcagccagagctgttgtaactggcttcctttggacggttggagccatgtggtcaaactcctctgtaacagtctgaccagtgtcctggatgcagtcaggttgatgcagtcggtgggtccctgggcccaaggacaagaaggggatcttactcaggaaaccctgtttgtctatacccagatgttctgtcatgttctgcatatcatggccatgctccctcaggaggtctgtgaacccctctacgtgctggcc

SEQ ID NO: 20161 - DNA, 1907 bp, Mus musculus
gtattccaccactgggctgcattcattttgtttggtctcagattaagctcatgagcattgagggttcctgttctgccaaggactcggtagttgcacagtccctggtctttcatcagcggccaggctctctggccagctgtgcaaatcaccaagcaactgtttgctgctcaccagctctcctgtgagtgaacaacattctccacacagatggactgctttagcattaatgcacggtggagaatgcagacttggagtaacatttgtccctctgtttcctaggcaatggaagcagacaaaagtgacgagtggtttgctacgaggaataaaccaaaggcttcgggttagtggaagacacatgaagagcacttacatctccagtccagtctgttatcagtctggcacttatgttttgagaaatgctcccaccacttggctgtgtcctgcataggaggtctgtgcagtagtttcactcttcaaagctctgtttttagaaatgaaatatttttatcactcttggtagaggcaaattcctactgtgtgtaattgtattaaatttggtaacaaatttattgtccagactgagacaactatatggaatattactcttggttggggctggaggaaaatctgattacctgttaatcatgtagatactattgaaacaaatgtcagaatgaagccaaaccagctaggcatgggggtgcacgcctttaatcccagcacttgggatacagagacaggagagtgtctgagttagaggccagccaggactatagagaccctgtctcaaaacaaacaaacaaacaaaaaaaaaacaaaagctaaatctactgcttagagtactcatttccaggacccgatggtaagattctgttctgttatcttaccacagaaggtcttgacgtttagaaacttttcccattggctttctgagacagtctcacctgatagctctgggtaacctattaattcaccatgtaactcaaggcagcttttaacttcgtaactggaactcggtaggctagattggtctcaaactcaagagaccaacccacccctgcctcttgctgagatcaaatgcacaggatactgtacccagtggttttgaatgtttgtcctgcttcagcctccagtgttaggactatagatgtgggccactattccatgtggtggattgaacatggttggcccatggaaagtggcactattggaggtgtggccttattggaggaggtgtagcattgttagaggaactgtgtcactgtggagatctcttatatgtgctcaagtctggacaatgtagcagtctcctcctggctggttttcgattaagatgtcaaacttttggctccttcagtaccaagtccacttgcataatgccatgtttccaaccataatgataatggactgaccttctgaaactgtaagctaggcccaattaaatgccattttaagagttgctgtggggctggcgagatggctcagcaggtaagagcacccgactgctcttccaaaggtccttagttcaaatcccagcaaccacgtggtggctcacaaccatccgtaacaagatctgactccctcttctggtgtgtctgaagacagctacggtgtacttacatgtaataaataaataaatctgaaaagaaccttaaaaaaaaaaaaaaaaagagttgctgtgatcatggtgtctcttcacagcagtagaactcctaaatcagacaccaggcttgatgtttcaaagaattttttggctatgtatggacagaatccaactcctagctggcacatcatcacccctcacctaaactctgtaaaaaccccttgctttagcctgcatgtgtgacttcactgatcctgtgaggtcagtgaacccacccaagagctgcctcctaataaacctgcct

SEQ ID NO: 20162 - DNA, 1118 bp, Mus musculus
tgagcaacagtatactgagtaatagtaatactgagcaacagtatactgagtaatagtaatactgagcttagtatctatggcaagttggaaactttcaaggtccctggaatttgcatgcttgctgactgctaggcaaagaaactattttgaggttagactatagaactgtctttaggattccttctcctacattgtttttaaaagtaagtctttccttaaataagtgccaaatggttggtgtgtgcagtgtgtggtgggggtgtccacagctgctgtcagcaccttcggaggtcatctcatccttatttggaatgtatgggactgaaagggactggccaccatgtgttctaaagcaggaagcagagtttcctgcgctcactgagttcacttgctctcattcttttaggccttatgatgggaagtggagtaaaacaatggtgggatttgggcccgaggatgatcattttgttgcagaattgacatacaattatggcatcggagactacaagcttggcaatgacttcatggtaaatatcactctgtctcagtggatctggatgaggctgagacagttataatagtccaagttagaaacaaagttggctttaaaaaatgaaagattgtatgtgtatgaaggttctgcctgtatatatgtatgtgcaccacatgtgtgcagtatctgaagaggtcaggagagggtgacgatccccttgaactgcagttagggatggttatgagctgcccgtgtggtcctctgcaagaatatctaatacttttaactattgagttatttctccagtcctaaacaactttttaaaatttgaagttgaaaatagtggttagtgaggaggtgacattggaggaggttcagaggagggaagggacctagggcagcatgtggatagaggggaattctaggtggaggaaagagcctgtgtgcaggcccagaccctgacttgagagttgtaaggaatcgctgattagagaggtaaggtaaaggtggtaggagaggggtaagaagtgacatgatagctgggtatggtggcacatgaccaaaatcccagcatttagaaggctgaggcaggggggttatgagttcttgagcccaaccagtgcta

SEQ ID NO: 20163 - DNA, 1176 bp, Mus musculus
tgagacctatagccctggaaagtctagaacttattatatagaccagggtggccttgagcatagagacccaccagcctctgcttccagagtgtaggaccaaggtgtgcaccaccatgcctagctctacaggcatctttttgaggattctgtatgaaaagaggtgagaccctgagtccactttgcagcataacctgctgctggaagtgccagcttgcttaccagctccttgctgctagtcatggttttagtggcacttgattaaatgctgtgatttaggggaacagcaagatgacccagggagtaaaagcacttgctgtccaagcctggtgacctgagttcaatccctggaatccatataaaggagaaaaccaactccacagagtctttctctgacctccacacacagcaatgatctaaggggctgccgaaatggcccagcatctaactgatatttcagagatcccagttgaattcccagggctcatgtttggtggatcatgttgggtggctacctttaatttcatctccaagtgatctgctccttctggcctcagatatgtatactcagatgtgcataaacagacacattcatatacatgtaattaaaaataaaaaaatgtacatttcatttttagatcaggaagcatcactgggtgttgtgagccgaggaccttacaaggtcagggtgcggaggctctaatcatactgcctcagcactgagctctcagatccccagggataggctggatccttaaaccccaaaatacagtgaggtcagagaagaccaaagcaggtagttgcacctgctgagtaaccatgggaaggagtgggggtgctggagtttggaatccgttctaaacactacttctgcaaccacaaacaattggtttagagttgaggttccaagcaagtatttgtgctacatcttcaagcccagcagctccaatgactaggttcctgtcggactcctttgctgcttattctaggaaggctgaacaagttgctgcacgtacaacagaaaccatagagccaacccttccctttccattccttcagctctagtaaaactcttgggagaatcaactgggcaagctgcccatgtaccaggtggcagatgccagggctttggggtgctttaggagagattactggtagtgtttggttttgttggctgtg

SEQ ID NO: 20164 - DNA, 1203 bp, Mus musculus
aagacattcctgtcagtgagtgagttgttatttgaaattacatactggccagcaagctgaacatccagagaactttctagatgcagagtgtcaagttgtccttaagtaatagtgagagaggaattcatttaacgccgagtggaagaaatcgttgctggtcaccagggacgaggcattaggaagctgataggttgcactgtcggtaatttctccatttcctttccatgtcggcggaagcatgcggagtatcaacgaggctgcctggcacttctcttccttcccttattaagttaagtgattgcttttctctgtctgactgataagctaaaactgtggctgaccctgcaaggtgcttttaagaagaaattaagcaccacccccatcgtgtgctttcttttgcttgtcatttgtccattttagaaagccaggccaccgctgcctgttattgtctccctgcctttcccagtctcagtgacaggattttgacgagaactcttgcccatgctgaacaagtactctcccacaaagcccagccaatgcccagcccagttcaacatctccaggtctcctccaagctgcttttcccaccagaaccctcactgtacctccctttccccaaaactgaccattctcgctctcaggtgagccaaacttgggcttgcctccagcctggcctctcagcttctgacggcagtttgcattctcccacagcaattagtttgcccggcacggcagccctgggtttcccatggctttcctgaaagctcgtgtgtgtgtgtgtgtgtgtgtgtgtgtgtgtgtgtgtgtgtgtgtgtgtgtgtgtgtgtgtgaccagtgacagcattgctgcccaggctgcagtttccattgctgatctgtattcacctaccatggggacggctccatgaaaggtgtaagttaggtagtcaagctttgaagaaaaggagagactgatatgtagcatttggaggtcaggaggatgtgtgtgaataatcaggacaggcgggtccataacattgtctcagaagcctggcgaggttccagtgtctgttggccaaaggtatagcatttgaaactggataagaaaggcaatcactgggaacccagttcactgaacccaattccgattccataccgtactggtgtgagcgaggtgaggtagagggctcaacggttccgtgactgcagatttcagcctaaagt

SEQ ID NO: 20165 - DNA, 1220 bp, Mus musculus
ttttttgttttttttttttttgtctgagatctgccattttttagctgtgtgtcctgtgtaggatactctgcatctctgtgccgtaggtccctcattgtaaaattgggataatagcacctgcctcataggattgttgtagggtctgtatgatatgcatactcaataagcgctgctatcatttattaacaaattgttacaacattgagtaatctgttattacaaacctgttgtgagggctttcttcttcctctttttctttctttctctttttttttggttttggttttggtttttcaagacaaggtttctctgtgtaaccctggctgtcttggaactccctcagtagaccagactagccttgaactcaacagaggtctgcctgcctctgcctccccagtggccaccacctggtggttcctttcttaagatcccactgtagcccagaagggtcttgaactcaccacagggttgaaaaggactttgaagttctcacccttcagtcttggcctcctggtgctgggattacaggcatgcatacctggtcctgtctatgtggtacaagcgagaaacgtgaggcttacagcatgctaggcaagcaccccaccaactgctctatcatctttgatgtatttttaagacttttctgaactaccacttatactgtgtgtcttagtcagggtttctattcctgcacaaacatcatgaccaagaagcaagttggggaggaaagagtttattcagcttacatttccgcattgctgttcatcactaaaggaagtcaggactggaactcaagcaggtcagaaagcaggagctgatgcagaggccatggagggatgttccttgctggcttgctcagcctgctttcttatagaaccaagattaccagcccagagatggtcccacccacaaggggcctttcccccttgatcactaattgagaaaatgccttacagttgtatctcatggaggcatttcctcaatggaagctcctttttctgtgataactccagctgtgtcaagttgacacaaaactagccaatacactgtgtaagggggtacagtgaaggagttcagggaactgccctgtaagagctaactaaccagggaagagaaagatttggttgactgcaactgcataagcaaatgagggtctgataacactggagagacccaaagacactcgcctgccctacacctgccgccacagggactgatcc

SEQ ID NO: 20166 - DNA, 1831 bp, Mus musculus
ggcacagacagattgctttgttctttcatttctcccagcactcactttctgcctgagtccggtccaaggacttttactttgcgcttcgtaactactgccagcttctcctctcctggccctgctcccagattgcagcctccctgcagtgtctgcccttgccacctcccagcctgctgcatgcatgtgcagcatgggcttttgctccatcaccgcaaagttctgcaggggccctgggcagtgctggcctgtctgacgtgctgcccttggcctccttgctctccacgtgtggaagcgcatctgctttccttgctgtctgtgcaaatgctgaacaaggagacagacacacactaatcctcagcacagagctggaaagctcatttctggaatgttctatttgagaattgccatttctggggtttgtctgttctatctcctgcctaccagtcggtatcttcagctgtttcttctattgctggattttctgttccttttccccagtgttctgttttctttgagtgtaatgacccacaagtgtcctgccattaagagaggtcaggattgcacctgaagggtatggtgggcacccaggctgtgaaggaacaagatgagtggagcggccagcagtggcaagtcaagggaagccagtcttcagtgtaaggacccgcagtggctatcctagtgtacattctcctggagagcagcttctgtggctgaatcaggtgtccaggtgaagacaggccctgtcctggaacctggaatcacacatacctcgtggtacttttgccttagattttacactctcaacagccaagcactgccacggggcagccacaatgccatgcgtgctccagagcctaggaacagcagacagaacccagttggaatgcttctaccctggcttctaaattcaggcctgtgggtaatcccaagtatacaggaaattgtggggtaggctgtctctcgtgaattgagttctgctggggctatagagcatcgggtcggcagctgtcattcccagctctgtgacctactgcttggtactaaaaaggagttttcttccaaaagcactgtttccagtctgagtaggagctaccagcctgtggcaatcagcagggaaagacaggtgctcctgtcataggggcttgagctaccacagctaccacacagctttctggatcttctatatggcagttcattcttggccctcaggattggggagaccagctctcattgtgtgtgctcagggctaagtctaaacaagggtttgctggcccccaagctgttgtttgttaggtgaggttaagtagggctcttctggtcctgtgcatacctattgcctttgacagaacggtacagtttgtttatgcaggaggatggcatgccaacttcccagctgcctactagcagtttaacaaggagccttgctgtctcagacaggtgaaagaaaatgtcatgcatgtaaagatcacatctgccactaccttggcactcaggtgctggtatgtgcattcttgcttccaaaggattgacagtaacaaattctcaaagcttgactggagctggctgcagctcaaaacagtgcctcctgcctctttagagcggggctgctcggcagcagtgactgcagccccagcttgcttaagcagtgtaacagcagggaagcgggaggagctgagaactattagaagttcctattatttataaattccacccaaagtggacagagtcaggtgccagacctgatctgaagtgcaccaaggaagtatctggtggttctcctgagatgggggccttgcagcccagcaccccctcactgccagcagggcaccag

SEQ ID NO: 20167 - DNA, 1199 bp, Mus musculus
gaccaggctggtcttgaactcacagagatctgcccacctctgcttcctgactactgggattaaaagtacatacgtttggtgaagcagggtctcttaatgaccctgcaggtcgctgattggctggatgggattgccctattccccagggatcctcctatttctgctccccattgctaggattatatgtgcatgacaccgcggtttgctttccaagtggatgctggagatctgaactcaagttcttgtccttatgcagcaactactttatcctctgagccgtctctccagtccctacataaagacttactttggctcaaggtttcagagcttcagtccattgactacatgtttctggatctatggtgacattacgtgtagttttaggctaaccacctttgctctgggactggccgtgctaccagctcccacacggcttcccttttgctctgcctgcctttgctcggggaagtgggctgcactaccagcccccacctagcttcccttgaatccttggacaaaagacacacacagtttgttcctttgcaacttgcttttttggcacaattgctgggctctagtcccaactagcccctgtcaaacattcctgaccacccgcctgtagtagtagccacaggctccccttgagacctcacatggttgctgtgttcttctccctccaaagcatggcagaaactccctctctctttccttgtgtttcctttacctcctggtacctggaagtcccgcccataccttccacccagcaattggtccctggctttctttactgacagatcaaggaccaattgaggaacaggaccttagcatcagaactacccccttcatggtgaggcagagtacatggtaagaaaatatggcaaggagaagctgaaatgagatacacccctggtaacctacctcctgatttttaccatctcccaaaagccatcaagttatgagtccatcagtggagtactctggtcttgaatttagagccctcatggtccattcacctcccagaagcctgtcaaccagcaaccaagcaaaccttcattcagtacatgagtctgagagagacttcattctatggaaggttgttgcccctgttttaagggtgaaaggggaactgtcattgtgattagtcactgctggtaacttctgccttggggcaccctctataagaggcatgcagggtctcc

SEQ ID NO: 20168 - DNA, 1228 bp, Mus musculus
cagagaacccatgtttgagtcccagcatttgcatggtggctcacaattgtctgtaatcccatgtctaggggatccaattactctcttctggccttcacagggaccaggcatgcatgtggtacacagaagacatacacataccaaggaactgaaaactcccttctcccgtgcgtacactgcagccctgtacctccacagtagccatgataggcaaaattttggtcctcaaagaggatcctaattcctgacccttgtatataaaacaaagagactttgaagatgagagtaagctagggactttggtgtgtgtgtgtgtgtgtgtgtgtgtgtgtgtgtgtgtgtgtgtgttggtcagggtgatataaccccttgctactgattttgaatatgaagaaagaaatgactagccaagaaatgtgagtggtgtctggaagccagagaatgcaagaaaatgatgagttctccattctccagaaaggaatttgtccctgccagcacctccatgttagtgtgtaagccctaggctggcctgggctacagagtaagaactgcttcaggtttccaaggtacagaaccataagacaattgagttggtgctattttaggtgtcattcactatagtgacttcgtgggctaggggtttgttttcctcccattggggggactggctcagcaggaacttcagtttcaaatcctcccattgtcttacagtgggaagatgtttgccctcttgcttgtgacatcacagtttgaaatgtgtgtatgctgagttacctgtgtgtgcttgggatttagggagggaaggaaacaaaggattcaagctaatcattggctgggtgtccctgtaagaatggagccaagtatggtggtttgtgttcattatcctagcatcaggattggtctcagtgagttctagacctggctgggctacagaataaaaaacccgttttaaaactaaattaaaaaaaaagtgttcatggaagtcctacctgacaactcctaattggtcacactttgggaccaagctgggtcatatgaccatctttagctgcaagggagtctgatcgggaatcttggctcttcagctcactgtgaaggatgttaggggaagggaactgtgaatggcttttggaaaacagctcagtattggctccaccatccttccccgaactttgcacgcttgtaagttagggcatctatataactgtaagtcaccctctccattcct

SEQ ID NO: 20169 - DNA, 1620 bp, Mus musculus
tgggccgccccaggacgctgcactcagatgaacagatggaattatgttgcttgtcttctttttgagagtagatcagttctttcaaggaacgctagctgtagcggctggggtccgaccttccattgtggtgccgtggagggaagagtgcccctccctttccagttctgccctgtacaggacccccttggaacctcggttttgtgtcattcaatatttttttcaagttcgtttctcccattttgggcttaccccagttatcaggcttaggcatggacagggagggatgtcttgtcagagcctgaggtaagatttgtgaccccagtgaactgttgctccccggccacagtttttaacagaatacctttttttaaaaatatatatttttagtaacagttcaaaacttcccacttcacaaaaagatatgaaaaacgggaataaacagcagaaaattccaagtgtatttgtctgccctggcttgagaggtctcactgtttagctccggctggccttgagttcctgcctcggcttcctgagaccctgggactactatctgatgtataccaccaaccctggctccaaacagtaccttcctccagtttcccatgtgtcccagtgactcagtgaagatgtgcagtccattgctactgagatctacaaacccataccaaaggatgctctgcctcctgccctgctcacctctgcttgttcccttccccttgataccagcattgacatttattgagaatgtctttctgcttcttcctggtactcggatcagaaatggggacaggtgaggaagagccactctagaggacacttttgtactgggacccagatagctgagggcctccatgctggtcgtggataagtgagtgggaagcacagtcattgctctgccgccctgtgagccctgtggagttgaggcaccttggccttcaccacatcactgtcctgtcttactgctgatgacctcggcctgagggggtggcttctaagaatgggtctagcctttccgacttctctttatcttctgtctttaaccaggtaagagttttgggattcattgagcttttgaacttgttatattaagtggttgggatgcatggccatacccaggtcatctgtggcagatgcggcagaggaaacaaacctacccaaatgacggattgtgcactgtccttattttaccgtagagggcatcctttggcctgatctccaaaaggatgcagcatttcccactgcgggccccaaactcattcatccccctgagtgcccatatgtccctttctcagagagaatgggggacgagaaacaaggtcttaacgtgataatctggtgagaagctgggaaagttgagtcatgtcttaaagaatgtgtttttttttttttcaatctgatctaaaatcttagtaccaaaatatttgtaccacaccctagtagctctcagtgatgggaaatcagttcttaccatactttattccgatggaagacgattgacgcctggtgaaaaatgccaatacagattttttttaatctattcttttccaaatgcactttctaattttttgcttttaaaatagagacttggaaccaatattattgtatttttacttaattttt

SEQ ID NO: 20170 - DNA, 1206 bp, Mus musculus
gtgagatgttggtaggccagcttcatgtttgaggtggtctgaaatggagagtgctgtagaaagggcgtctcgtctctgcgtcagctgtgagcgctgcgtcagctgtaccgccgccaacacatcagaatggcagaccttgccattgctttattattttttccactgggctaatatttgcttgtacatgataaaattgcatttccactgacaggcaatcagcacctgtcattgcccctagcggtcccatatcatgtgaagcttaatactaggaagtgagggaggggacttggttctcagtgaggtctgctcatgagccactgcaaggagacagtgagagggtggctctctggccttcctgtctgtcagtgtggtgccgcctggagcaagggtagcactgtgacctgatgtcacagtattcgtgccctgtgcagatctatcccttcctcctctgttggcgccttccttcctactcctaggccgccggataaccactgagggggcctgggactcctgcctgcacctctctattactttgggcagtgacagaattgtgaatgtttctcaaggttagccacttctcagcatctgtaaattggtaacttgtcgtactgaactagcggatagtgtaaagactccaacatctgtgctctgctggtcctaccctggagtggcctccagcacattgtccaggggcagtgagtggatattagagctcttcaccattctatggtgggggacggtgcctctgggccaccttgatacacttactgcgcatggacagactgacacccagtctgggactgactgacagttttgacatcctgctgttgaagtgttagtacattctaggtatgaaaggcatttgatatatttttcttaattatggggtttatttttctaaatatgggttaatcagcttgttgactgggcatgcccttaaaaggaatttaaatttccctctatagaccttaaagaatcagggaagttcatttgttaaattctccttgagagaacagaacttctcttccctgacacttctattatctttgattttttcaaagggccttgattggcatttgtgcctcagctagactttatgggactttggttgttatatagtgggcatatatgaaatctgaagtatcgtaaataaagttatttatttaaatatacagccagtcttttctactggtttgatgacatgtt

SEQ ID NO: 20171 - DNA, 3812 bp, Mus musculus
gcatcatttggtgcatctgctccatcaagtctaatagacacaaagatggcttccaccggctgcggcagcatcatgatgaatatgaagatgaaattcgcatgatgtcaactggctctaagaagtccctcctaagccatgagttccaggatgaaacggacacagaggaggaaacattatattctagcaaacattgaaaagcacggtttgcatatctccctgtatacgtaccaggcaaaatgacagctcttcttgggagacactgcagtaagaagagaaattccttccgccttcaaagagctttgggaagttagcctgctaaattcatactctctgaatgtcacaggcagttttgaacttcccttccttaaagtactcttaaccttttctttaaaaaaaaaaatctgatttctatttatgcagcagaagatggggcagccgctttgtttccctttttaatttaagacgagctgttcagagactctatagagacagcataaagccagctagtagatgttgtatcttgcacatcagacatttactagtggctttagttttgttctctttaatttaaaggccaaaagaatccagaaacattaaggcagggacaccagtcagactctgacacaaagctttaaaaactcgagatttttctccatctactgaggagttctcttctccagttagcacatagctggggtttctcttattcaggtctaatggaggctggatgatgcttagacagatctgacattaggaaatggaataaacgggcttccgtatttgtctttctacctgtttccaagctgggtcagaactggtgggctgtgctctcagcaggattttactacctctcttgtaaggtttagcaaagttctagatatctttatcctagaggagaactcactggctttgctgtggaggcaccagatgtcccatgagtagaggtgaaagggagatggagcagaagcaaggacgttgtctgtcttatcctggtaaaacccataggtgctgctgctttatctgtgaagcactcattctcctaggaacgcctgttccttagcatttcctacatttcagcccttctgtgtgtacacctgcggtttccatatgacccacacctaaaggttctgaattctactgctgaaactatctaaaagtggaagaaacctacttgcacattctcagtacacttggatccaaaatgtctacacttgatgctccggcccaagcctctgccctgtgatggcatactgtcatggagatagtgtggcctctgcacatgggcctccaaaagtaattcagtcctttgtcctatgattcccttgacagtctttttctttttctttttttgatcaagcaattatgttaaaattttcagttctaagctttgaaatatggttctttccatgtaaaaaagtcaactgaaggactgccatgtgatagaacattggtatgaaggtgtcctcttcaatgccagtcaggcctaaaagattggtattttattgtgtctgtctgaatgctgttcagtggaatgatgctttttgtaagtgtgagtcttaccaatgacgtaacagtttaatatctttgaatgtttttaatggccaagttgctgctgaacttgtactaaatcaggggatcacaaaactagctcttacctttccaaactgcattcatgccattgatgtatcagttaccctaaggctcgactcacccaggtcactcggccacacttggtgaggaatgcacccaagtggctgtgtaaagttgagatcttagttgatggaaggggctaatgagatcttggtatctgttagtcacggtcacttaggtggcttaggtccagctgttctggaatctgtcctggtatcagcatatctgaaccttgcttctctgcatgaacagaacaattagtggcagttaatgctaatgaagagcacatgactccatctcttccggtaatgctttgttttcctaaatgatgtgtattgttctttttcagctttatttttaaaagtgccaagtcagaaaaccaacaagtggcctgtggctgggccctgcttgggacaaatagaaaccaagttcatgtgacagccttcacgttactagagttcactaaaggacactttccacttgttctctggcattaagtgtgtctttaacagttcatctcagcagtcacaggccatgccttggtcacaggccatgccttcttaagtatgtatgaaacctttttagagatgaatatatagaatagttctcttagtcatcttttcctgaaatgaaacccaaattctgctctaagttttgagtctttaatgaacttctaatgtactgaggcggaaaatccggcctccccagcctgccacctatgaacatgaatgtacaagacccatgactacaagactttgttcttagcccagccttctttgggttgtgaaaccgatctaatcctacactacttcggcagccgaggacactgaagccatatggggtgggcagtgcatgcctccagtgtttctcctggagaccttccatttcttcagagtcctggactcaagtgtcacagtattagaagtttgccccagtctgagatgtgcctttcctttgctcacaaggtgttgctttgtcctcgtgatgagtttataagccttcttccctccctgctccttaacaaaaacaatgtgatggatcggtgatgttcacagttctccctgtgcggatgcacttgtgctcatagggtttggtaagatgatctcaagtaactacaccagctttggtgtagcagtgaactccgggtggtgctgggatctgatccaacgaaaaacacttgccattctcaccgaagagaactggctttgggactctgttaactttggggaaggaaacattgtatgtttggctcagtgtgcttggctggttaatctttggtaatttcacctgaatgagatttgatgaattaatgaatattgaatttaaaactaattatgagtgaaaaataaaagggtcgtgcttatgtctgaacttgctgcgtttctgagctagcaccagctcaccaggaaccacggctcaatactccattcatttccacctgtccccagcattagaggtttctcgtctgccagactcacactcctgccaggtttggtccctgctctctcagaagcttcttggctatgaacatgtcatggtgtcctgcagtgtgggtctctggtggattgttttatggtagcacccaagtatcttcccccaatttttcctttattgttattactaaaattccactaatggttaaatattcaatgatctttctgtctagcaacttgttgataactttaggtttctgatttgttttaattatagcagttttggggggtgaatagggccttcgattaatgtcaattgaatttgggtttctagttttttgaagaaaaccctcccaaatacacttttcctttatacttggaaaaacttcattaatagttccacttaactctcaaagtattatcctggttgattttgaaatttgaaaataggttaccattttgaggcaattagataaaaattatgtaaatacagacaattacaatgtttataaatagtgtaacatgaatgtactagctacattcaatgctgcagattttttggaagtgtgacatggtatttttttatgttccttttacctctttttttttccaaatacttccccagatccaaaattctccacaacaatttctatgacataacacccatttgtcttaagtgcttcagtcttttgttttatttcatgcactgtgccttcaaaatgaaaactt

SEQ ID NO: 20172 - DNA, 1213 bp, Mus musculus
aatttgactagaatcttggccgcagtgataggagaggaagaaaaagacaagatctagacaggaaatctgggcaacagaagacagagcctcagctaaaaaggctcagctgtgtcagattgaagttacttatttgagatacatccttcaaggtgggaaacagtggctaaagaaaaccagaaaaaagattgtaactcagatccccaccccaactacaccaaggctagtaagaaaattcttgggtaccgctggtttctgcaggctttggatacctgggttggtgactttagctgcccgttgtaccccctaaccaaggaaggggaagtgtttgtgtggaccccagatcaccagaaagcctttaaagaaatgaaaaaggccctactgattgccagcctttgcctgacctaaccaagcctttcactctttatgtgaaagagaatcaggggttgccagaagagtccttactcagactttgggactttaaaaaaggccaatggcttatctatccaagaagttagaccctgttgccaggaggtgtttttcttgcctgaaagctattgctgccatagctctgcatgtcaaggatgctgataagctcagtctgggacagcaaataactgtagtggaaccccacactcttgaaagcattatctgaaagccccctgactgatggatgacgaccaatgctcctgtgacacattatcagagctttttttgttgactgaatgagtgaccttcgctcccgttgctgttctcaagctaccctactgcctgagacttcacctactcatcactgcgctgacattctggcagaagaaactggtactcgaaatgatctgaaggaacagatcagccttggcctgagagtttgagctggtacatggatggcagtagccttgcagttgaaggactgaaatggccaatgtgatagccaagaagatcctagaagaaatcttcccaaggtaatggacctgcctttgttgcccaggtaaatcagtgactggcaaagatactagagatcggttagaagttacattgtgcatacaggctccaaagttcaggacaggttaaaaaaaatgaatagaattctaaaagagaccttgacaaaactaaccaaagagactggtgcagacttggtgctccttccccttgccctatttagaactagaaatactccctcttgattcagtcttactctttttaggatcctctatgg

SEQ ID NO: 20173 - DNA, 1868 bp, Mus musculus
ccgctgaccatagtggcatgcccttagcagcttagctggttgctctcagagtgtgagagtgggggctgctgtgcttgccgtactgccctagagacaagtcctcccgggtgactatgagccagacgctcggcactgacctgctggtgtacaagtcagcaccacagaggcagctgcgcgtgggccagcacggggcctgcagagctgtagggcctctctgaacccccttttcatagttggtgaaaacacagcagtgtctatcctgtctgcttcacagattgctagtaaactggagctcaaatgagctcagtgggcagtgctgggaacttggtgtttttgtagaagacctttttacactagcaagaagttctcctttctgcctgccctctgaactcaggagtgtttcttctctcctttccaggctacctgtgcatgaccgatgagtggttctcggagtacgtctacgaggtggtggtggacaagaagcatgtcccggaagaggtgctggctgtgttagagcaggagcccattgtcctgccggcatgggaccccatgggggctttggctgagtgagtgcgtggactgcctcctgctctcctcctcccatgggatcggatggagctgccaaggacagacccggggactgaaaccaaagttacatggatggctgttcccacaggatacagtcagactcttgggtttccagtctcctccaggaacctctttgagaaaaatgctttatgctgaaacaaaatattcataaaggaaaaaataaaggggaaggatcggggcatccgttgctctcctcatctctgacggctcaggatctcgtagcattttaattggatgtcattgtcctctgtcacagtctttgtgtttgtagtaagacggagtaagatgagcagctgaggtgtacggagaacaaacagtcctgggctccttgttcctagagtagattaggggagggttagctaggatttgaactctcaacgctgcatgctgcctcacaggtcactgtccttcctacctggcagtcgctgaattcaacttctgccgagttgtttcctgtgacaggaaaggggaggttgatcggtctgagatgactccttctcttcctggtctgagctgtggggctccctcgggccaggttaaacggggttcgagaaaaccttgtcaggggctcagctgtaatcacgagggtcacccactgagtgctttaatgtctgtgtgcgttggggttgggcggggagaggcagcgatgctcgttctttctgataactgatggtgctgagaagctttggaataaaaccctttgctaactgagagcaagccggcgtgtctggtctgtaaacgttctctaagaaggggttattgggctacagtgggagcagccgagctgctgagactctttcttcaaagtgaagaaaaggaggagagctcgggttctcctcctcagctgctctgcaggcctcgatcgcggcctgagcctgcccacccccacctcccaaagggctcctgcagaagccttcatgccccaactctgggggccctgtccctgccatccagcactgtctcacccagaccccgtgtctctaaggtggggactctggtggtctcgccgtagaaggggctaagtcgcatgggtggacggacggcatcgctgttttgttgaacactgagcagagctcctagttagcatttacagcagggtttgtgcccaggtgttcctggctccccagaattcttctcagagcttgcaggggatgttgtttgtcatgacacttcccaaggtcaaattagataaagactcaagccttagccagtgtgttcacagtatttaaggcatcctataccagggtgataatccatct

SEQ ID NO: 20174 - DNA, 1172 bp, Mus musculus
tagtgataattgaatattttaaaaaatagttataggccatttgtgtttcttcttttgaaaactgtctaatttattagcccatttgttgattggcagttttattttcttgctaattaacttctggtcttttaaaattatgggtattagtcccttgtcagaaataaagctgcttggtaaagatgccctgccattctgtgggttgtgtgctctgcttgagatacaactttaccccagagagaatggctgccatccagaaatctaacaacaaatgttagaaccgccatgggagataggaaccttactcagtgttgataggagtacaaattaatacataaatgaaaatcagtttggaagttcatcaaaaattaaaaattgaactcccatatgacctagctgttccattcctgccatatacctaacaaactccatgtcttaccatagatatacttaaacacatttattgctgttctgtttaatagcaagggaatagaaccaaccaaccaagatgtctgtcaatagatagtcaaaatggtgtgtgtgtgattaaatattgtttagctcttgaagaaaactgaaatcacaaaattacagaaaaatgggtggatttattatgtataatattatgtaatggtcacccaaccttagaaagagaaaaacttcacattctcccacatttgtggatcctacatgtatatatgtaaacagctgtgtggctgtgctacaacatttagagagagaggaatattaggtgataaggaaggatggagtgttgtcaaaaagacatgcaaatcatgaaataggtttataaagccaattgttcttctatttctgtagtgtataagtgcataaaaatgtaactggtagagtgttaaaccccaatgaagttccatggcttcagaatggctactctaactgtataggttcactaagatgtgtagcgtttgagacagagtaagagtttatgtagcttgcttgcttgcttgcttttttattagacgttttcttcatttacatttcaaatgctatcccctttcctactttcctctctgaaaatctcctataccctctcctctccccctgctccccaacccacccactcccacttcctggccctggaattcctctatactggggcatagaatctctgcaagaccaagggcttctcctcccat

SEQ ID NO: 20175 - DNA, 3301 bp, Mus musculus
gtcctggtgcggagcgtcacgtctcgtgcgtgttcattcagccacgatgcctgaggaaacccagacccaagaccaaccaatggaggaggaggaggtcgagacctttgcctttcaggcagaaattgcccagttaatgtccttaatcatcaataccttctactcgaacaaagagatctttctgagggagctcatctccaattcatcggacgctctggataaaatcccttacgagagcctgacggaccccagtaaactggactcggggaaagagctgcacatcaatctcattcccagcaaataggaccgaaccctgaccattgtggataccgggattggaatgaccaaggccgacttgatcaataaccttggcaccattgccaagtcgggcaccaaagccttcatggaggctttgcaggctggtgcagatatctctatgattggccagtttggtgttggtttttactctgcctatttggttgctgagaaagtgactgtcatcacgaagcataacgacgatgagcagtatgcctgggagtcctcagctgggggatccttcacagtgaggactgacacaggtgaaccaatgggtcgtggaacaaaggttatcttgcatctgaaagaagaccaaactgagtatttggaggaaaggagaataaaggagatcgtgaagaagcattctcagttcattggctatcccattactctctttgtggagaaggaacgagataaggaagtcagtgatgatgaggctgaagaaaaggaagagaaagaggaagataaagaaaaagaagaaaaggagtctgatgataaacctgaaatagaagatgttggctctgatgaagaagaggaggagaagaaggatggtgacaagaagaaaaagaagaagataaaggaaaagtatattgatcaagaagaactcaacaaaacaaagccgatttggacgagaaatcctgatgacatcactaatgaggaatatggagagttctacaagagcttaactaacgattgggaagaacacttggcagtaaagcatttttctgttgaaggacaattagaattccgggcccttctttttgtcccaagacgcgctccttttgatctgtttgaaaacagaaagaaaaagaacaacatcaagttgtatgttcgcagagtttttatcatggataactgtgaggaattaatccctgagtatctgaatttcattagaggggtagtggattctgaggatctccctctaaatatttcccgtgaaatgctgcaacaaagtaaaattctgaaagttatcagaaagaatttggtcaagaaatgcttagaactatttactgaactagcagaagataaagagaactacaaaaagttttatgagcagttctcaaaaaatataaagcttggaattcacgaggactctcagaatcggaagaagcttttcttttttttttttttttatttatttattatatgtaagtacactgtagctgtcttcagacactccagaagagggagtcagatcatgttacagatggttgtgagccaccatgtggttgctgggatttgaacttcagaccttcggaagagcagtcgggtgctcttacccactgagccatttcaccagccccggaagaagctttcagagctgttgcggtactacacatctgcttctagggacgagatggtttctctgaaggactactgcaccagaatgaaggaaaaccagaagcacatctattttatcacaggtgagaccaaggaccaggttgctaactccgcctttgtggaacgtctccgaaagcatggcttagaagtaatttatatgattgagcccattgatgagtattgtgtgcaacagctgaaggaatttgagggcaagaccttggtgtctgttaccaaagaaggactggaacttccagaagatgaagaggaaaagaagaaacaggaagagaaaaagacaaaatttgagaacctctgcaaaattatgaaagatattttggagaagaaggttgaaaaggtggttgtgtcaaaccgactggtgacatccccgtgctgtattgtcacaagcacatatgggtggacagcaaacatggagagaatcatgaaagctcaagccctcagagacaactcaacaatgggttacatggcagcaaagaaacacctggagataaatcctgatcactccattattgaaaccttaaggcaaaaggcagaggctgacaagaatgacaaatcagtgaaggatctggtcatcttgctgtatgaaactgcactcctatcttctggcttcagtctggaagatccccatacccatgctaacaggatctacaggatgatcaagcttggtctaggtattgatgaggatgatcctactgtggatgacaccagtgctgctgtaactgaagaaatgcctcccctggaaggagatgacgacacatcacgcatggaagaagtagactaagtcaccagaactatgtgtttgcttaccttcattccttctgataatatattttccatgatttttgtttatttttgttaacatttaaaacatctgtgtggcatgaaaactaaggggaagataaaatttctacatgtgatactgtgatactataggtttaactcaagaggttgatagagcgtttgttataagacgtaacgtaacctactgttcatgttagctctggtctgaagtgtttagctgttgagctggattccttaggagaccaaattaagatggcttaaattacatcttaaaattttcatttcctgtagttaattctgcatgtattagtcttagaagtaaacacaagttaaaacaacctgacaggaattccccaagtggcttgttttccaaagtcccgagaacaaccctaagtttcctaggtcttgtaactcagcaaggcttgtgaatggaaataacagtgcccaatcacattctgctttaaaagataaatgcagaggagataaaaaaaaaaaaaaaaaaaaaaaagaatgagttgcaggtggccaaagagatggctaaaagtgcttgctgctggtacatagctttaattccagctctcaggaggcaggtggatctctgagttcaaggccagcctggtttacagcctggtttcaggtgatctgacatccctttctggcctgcaaggggacccacacacaaacacagcatgcatttgcaaagacatgtagacatatatataaataaaaataaactgggctggagagatggctcatcggtaaagagcactgactgttcttccagaggtcctgagttcaattcctagcaaccacatggtggctcacaaccatc

SEQ ID NO: 20176 - DNA, 1851 bp, Mus musculus
cgctaacttcggctaaagagtgagaccctgtctcaaaaaaagtagcatccatatgccacacattatcaccaatggacactgctctctcatctcccggtgtagaatatcctcactgcatctctcttagcagagactgagaaaatgcccaatgagggcactggggagcggacggacaaatgacaacacctgattttgttttcaagatttaaagaatggaagaaaccatcttctgctgtcttccttcttaattgtatttcctatcatttaactcacctgcctaggtatcttccacacagggtctataattcagctatgccaaagggtcttgccagccctccaaaccccaacacttgggttgttcctaagtcatgcttatggctaaggcaggtgcataataagctgttgaagactttttactttagcatttgataatttcagattgtctgtctgtttttttttctgttcatggaaagcctggacctaactctgacgaactgttaagcaggaaaaatcttgacctcctgactagtgcttaacctcttgctcaatgcctctgtctctctttactgtttttaagaccacagtagtcctgtcagtaggtctggaaaagtgtataagcatacatgtgggcacttagacagaggagctgacatttcagtgcctgggctaacagccccaggagcaggcaggattggagctacagcctgactacattgagctatacctgactatagggagaggaccctagccctttgttgtttttggaaacagcagcagtgggtggtgtgggcacagtatagtagggagcacttcatctcagtttagttgcctcttgttcttcttaacatattcgttcctgttcctgcatccccacctcttcagcatcttagtgttttcctgctctgtacctttgtctctactgctatttccttctttctcattctgagaactaccaagagctccagggacagcctggggacacatcccaggttccaaggtctcctgctcctgagcccagatgtttcctctgaaggcctctgacagtggctcacaggattctgcacctgaggttctctttcagtaaagatgttctgtgggagttgggttttttggggttttttgtttttgtttttttctaagcattatgcaaaaagttttaagggcattttaaagaaaagccagtttttcttggcttttccaaacaactatctgtggatactttgtttactttgtgagtattaaaatatgcatcatcgctgtggcctcaggctctgaagccatggttgtcctatgagtcctcccccagagaaaatgccatattattgtcagcccttgtggataagtgggtcagctgtggagccgatctccttctgtgtcctgcactcgcatccagcagtcctttcttagtgctgatgtgtctccatagtgatggtcgtgatggtgaatggatagtatgattgtttggtttttgatttttaacggtagacaaggtgacattccgttgtttcagcaccaatccaacttaaaagatcatagacttcgttatcccttccaaactaaaagatcaagcatgtattggacataagtgtatgcgttgcctcgactcatctggcacccatattaggaaaaggcctgccaccaaagcaggaagctgcacgctgctctccccagggctttgggacctcttgatgccatgaagagctattgcaaggtgcttctgtactgctccagcctgaagcagaggtgactaggcctgcttctgctaggaagagaaccagcctcatctcagtgccccagagatctaggacaggatttctaaactggaatcacctcttaccaacttgaagagcc

SEQ ID NO: 20177 - DNA, 1173 bp, Mus musculus
ggggagagcggcgagcggcggcggggcggcgcggggcggcgcggggcggcgcggggcggagggcgcccgagggcgagcgggcgggcgggcacggcgggttccgggccagccccgggggcggacggttggccgcgcgcgcggagcctcgccggggccttgcgggagccgggccgggccgcagggccgccgccgccgcccgggcccgccgcccgcgccccccacgctggcccagagggctgcggccgcgtcgccgctgaggatgtcccggaaggggccgcgagcggaggtgtgtgcggactgcagcgctccgggtaagcggcgggatcgggtcgggggcgggaccgcgccgcaggccgccgccgggcgggcgccgaggcctggcgggagcgctgtgccgggccggagggcggggcgggggccactgcggagcggcgtccttggcgggagggccggctgcggggggcgctgtgcgttggagccggtgaacgggagggaaccgcctcccacctccatcgcggcatccagacggaagcgccagcctggtgtggcaggagggctgtggcggaggccggcaggctgtgggaggtgggcgctaggatggtttgtgtcatccctgccacccccgcgtcttgcacctgctgctcacatggcccgcgtgcccgccggagcggtggagggcaaggggcctggatacgagctcctagggagcacctgacaggggcagctactcttaagactccccgcccctgcttcccaaggctggggctgcttagagggcccggtgttcaggaacaatctaagcatgggcatcttccccggaagcatctccaggcctgctggtgtctgggaacatctagactcagcttttcctgttccgggtaggcctgttggagaaggtgtgctaggtattggttcagtctagacgccgatccctcctggtctctagctcattggataggagaaagcggtgaggttgcttatgctcccctggtccagctgactcctgagcgaactggacttacacactgcttcctccctactaaccagcagagtgagtcggtctgagctgctgtgaaagcccccttggcttgctgaggaagtgaagggagggcaacaactcaccaggctggtcccttctctgggaggacacagccgttgatgggactcagcagc

SEQ ID NO: 20178 - DNA, 1212 bp, Mus musculus
ctctgtcctattcttccctttgctgccttcctggattagatctcggcaaaagtgcatgtctcagaggtacccacacctgttggctgcaggctgtgacgtttgggtgggggaggcttggtgtgtgacctcggggtctcatctccctgagccccctgcatgcttgggaggcaaccagcaggggccaggccatccctcatgtctggcctctctcctccctcctgtccacagcttggatctgtctgaattggccaaagctgccaagaagaagctgcaagcggtgagtctgcctcaacaagctgggactacttagagcagccctctcctgtcttgccagcctcgcccctcccatcacctccccatgcccttttctttgatcctggttctgccctccaagtggtgtgtccagagcctcatctctgagaggaggaaatggcctggactctcttccttgcacagtaaaccttacctatccctcagttctaaaatgagctgggtaacacgggtcatgagacttgcccacatcacacggcatcctgacagaccctgggtcccctctctgcctccagctcagcaaccggctttttgaggaacttgccatggatgtgtatgatgaggtggatcggagagaaaatgatgctggtgagtggtaagagatctgctgtaaagagcaaggacacagtagacgtaagggacctgctgcaaagagcaaggacccagggaaccaggggaacggggtactgctctgagacctactggggtgagtccctgccatcccccactgggcagtaggagccagctgcctccctacccaccaggcactggagctcatgttgctctggctgcctcccattctggctgtctccccagccatgctccacccctaccctgcatcactccttcctggccacagccagattccaacccaaactctgggtctggcctggtgggccctgccttgttgtgttgtcagtgggcggggctcacagggtgtggcccagcttttgtgttcgtggagaccctgcttcctgtgacactgacccagtcagaatagagggcctggggggctctgctcagtgcttctctgagggcccattcaccatgggtgatctgctccctgcccttcccccacagtgtggctagctacccaaaatcatagcaccctggtgacggagcgcagtgctgtgcccttcctgccagtcaaccctgaatact

SEQ ID NO: 20179 - DNA, 2299 bp, Mus musculus
gagctggagagcttagatggagacctcgaccccgggctccccagcaccgaagacgtcatcctaaagacagagcaggtcaccaagaacattcaggaactattgcgggcagcccaggagttcaaacatgacaggtagggtgggcacaagttcttgttaacttctgagaattggggtggagggtattgctagggtcctctggctctggaactcagaaatctctcatctaactaccccctttccctgacagctttgtaccctgttcagaaaagatacatttggctgtgactgagatggcttctctcttcccaaaggtacaggggccaccgagaagcagagtgggagggccttggggtggggcagatgcaggtaagctgactgctgcctgggtggaggtgagcacagtgagccagtcagaagcccggcttaaagtccagagctcatcggctcctcactcctccctccagaggccagccctggagcctgtgcgcagttcactgcggctgctcaacgccagcgcctaccggcttcagagcgagtgccggaagacagtgcctccagagccgggcgcccctgtggacttccagctgctgactcagcaggtgatccagtgcgcctatgacatcgccaaggctgccaagcagctggtcaccatcaccacccgagagaagaaacagtgaccactttccctgcccttacccacaccctgggacctcactggccatgggagctgggccactccagacactaacccacccccaacagagccactggcacaagtgcccttagtgccaccgttttcctctggcatccaggtgccctggtgccctcccctcaagccccaaggacagaaatgtgaggtgacaggagcctctgtctcccacattccataccctccctctgtacatagcatccctgccctgctgatgtgcaggagcctcaaggaacccctcccagctcttcacctgccttccaggcgccctcagcaaagggtgtggggcagggacactccagatggggcagctccgcctactgcaccctatccccatgagccagtttagccctggggggccgagcaggggcaccccctcctttgtacattatctctggatgtctctgtcctgtagccagcagcccccccttgctgctctttcatgccaaacggcccctgcctagagcacaggccccaacttgtgtgccagggtccccagcagcaaacactggaaagtcttttcctctccctaccccttaattttaactctgtggtaactgagtgtccctgcgttcctgcaactgaggatgtgagcggcagtgccgttccagagacctggcccacctggagctctgaggagcaggggaaccagagtagtggaaccagcattggaagtcagcccctctccccccacctgggacagggagactgtcagggtcaccagctgtggtccagttgctgcccctacttgtatccctgtcctataaacttaaaaggaaaaccacttccctccatctctccccgacccctatgggaagtgtgctggccaggcagaggacagcacctgcgcctggggctggctccccagggtccccaactcagctggtggctgtggaactgagcccctccccctagcctctgcaaggccagcacccacatcactacctgcacctacagtgacccacccctgaaggcctggggatctggctgcagctgggaaggccggcaaggcactgacagcacccaccagctcttctccccaaccaccttccctagcctgtggtggtgggtagctgtcagaacgtgtgtcatgtacatttgtatcaaaaataaataagtgaccatgtgccacttctgatgtctagaggttggaggtggggcttagcccagtattcagttcttggttcaggtcattgttgctgctacttaccatgtcctctctctgcaatccttgcaaggctgaggcaggacagcaagcttaaggttgggggtgaagagtcaggagtgtgtgttgggcggagagacttgcagaaaggtgagctagtgagaggagtgccagcacctgagcaccaagccacttgattagaaaccggcctgatgtgattcgaatagccctgggccactgactagagacctgaaaggagtgtgactgagggcaagagacaatctcccaacgactccgaattctactaaaataatttaattagaaacaggaatttgtatcaggaaagctacaaggctactcttccaggaaccaggtgaagcctccagggcctctcggcccgccgccagggggcgcccgcggacggc

SEQ ID NO: 20180 - DNA, 1186 bp, Mus musculus
ggtagtgtggggtcaggggttctgttgagtagctagatgcatggcaagtaactccaagttactctgaaggtagcaaaaacaacctatatcccaatgctggtgtgatttggattctcttgtctttcttggctctgattttcttctgcaagagatggcattctgtcccttcagctttgagaagtgagtgaatagtgcttggattgcaaaacactatatcatgttagcaatgtgtgctttaatgtgttgtaaacagttcaatttttaatgaatgctctttttaaaaattgtttatatttattttatgggtatgaattttgcctgtggggtattttttgttgttgttgtttttaactttggttagttttggttttttgatttttttttttaagatagcacttcttcatgtagcattgactgtcttggaactcactctacatacactacagtagacctggctggccttgaactcacagacatccacttgcctttgcctccagagtactgggattaaaaccctgtgccactgcctgaggcctgtgtgtttgtatattcagaagagatggatctggagatataggttgtgagctgtcatttgagtactgggaactgagcctctggaagaggagcaaaagctcttaaccactgagctgtgtctccagccctccacctctctctgacacagggtctcatgtagcccaaactggtttcaaccttcttctatagccaagaatggtcttatttattttattttatttttactgtgttcctttttttttttttaagatttatttatcattatatgtaagtacactgtagtgtatgtaagacactccagaagagggtgtcagatctcattaccaccatgtggttgctgggattgagctcttaaccgctgagccatctctccagccccctccaagaatggccttaaagctctgatcttcctgcccgttgaagggctaggattacagcaggtacaccaccggacgtggctgtctctttgttgcatgtaatccttctgtttaagttatttcattgttcagaatccatctgactttatgacttatttatttttagttatgtttacaatccacctgttatggctgatttcccctgtctgacttaagacttgcattatcttcatctgatttcttgattcgtttttctccagcatcacaggccctca

SEQ ID NO: 20181 - DNA, 1209 bp, Mus musculus
tccccttcttccaatctggaggagattttcaactggaagcgttcatacaccaggtgaggctcgcctggggaagccccttggacttgtgagaaagacccccacaaggtatcacagcgagggggggcctctgtgttcctctcttgctaactggagaaagaacttcaccctgtgctacgctaccttgagaagagttgccctggctctaagaaacattgctcagccctgggccactatttcctgtcatcaaagtcccaagcagaatagcagccctggcgaagtccatagaccagagagaaattccggctcacccagctgggagtccaggcaggatgaacttgtgagagtcaatgggtggttctgtcccacataaatatcatcttggtgactctatgtctcgagctggagccacttggtacagaaaggacaggatgtttgtgtctctgtcccatttccctcatgtgctctgcggttgtggttctgctctgacttgcatatcagcagctggggaagcaggctgtcggttgcctagctctcccctggctgagaagccagcagaggcaggagatgctgggctgaggccagggtggaaagagctagcaagggtagaatgtgtgtgtctgtccctgcctctcatggtagatggaagctctgatctaggccaggctctcaagctggtacagctcatctcctaaaagttattttaggagtaagaggtgctattgcccagggtctaagggttccgttaggtcatggttgtggtagccaggttaggccagatacacacacaccttcagttctgatcctggagcttcctccagagagccgcagccagccagatgcgttcctcctgaagggtgggctttctcacagtcagtgggaagggtggcaaccgtcacaatagtctctgatcagttttcttctggtactagcttcttctccctttccacagccaggcaagaggtctgggagcggagcggagaaaacccgagggcttagtgaaggcaatccaactatttctgagtgtctcacattacagctttgtctgctcaattattcaaaagacagaagcctgttttccgaatctgttcactcagccactaagtgggcatttggttttgaggaagaatgctgaaggcccaagaacaataagccatagctcccaggatgacttacatggcttgggttggattaagcctttacaaatcattt

SEQ ID NO: 20182 - DNA, 4390 bp, Mus musculus
aactactaccagaaacacattttatcacccattgtgagagtcacttggtcaaatttagttaatgagtccattttgatcataatgcactcacactagtgtgtttgaatactgactgtctgtctgtccagtaaggatttctgcccccatctaattgtgtggcacccagtttttccatgtaggtcattatacctggatgataacatcaatttagttacaatgcatgtagtttgcacaatgattaaaatgaataggtttgtgtttatagcctataataactctagttgaatcatgtacacagcaggagtggtcacagtaaaaactggtagcaggaaaatttgaaagggtttgaaatgccctgaaatcagggcaagtacttaatggggaaaaaaaagcagaaatgtcaacatttgaccaaattaacactacctcctccccagttgttggtattcattcattatatgtgtgtttaacaggatgagagcatggcgagcttgtagcacaccagaggttgtagacctatatctggtatccagaacctgacagggaaacagttcttggtcccccttttttggggtcagcattttaaaaatgcaaagcctatatgttgagacattgtattcctaattagattctctgtcctttgcacataactttcttttaaacttagttctaaccctaaatcttgacatcagaaagtgtttgcactgtataaacaatgttagctgaaagcatgtttattttttaaggagctcctgctcttctgcacatttccatatctagagatggatagtcctgaacttgacgtcacacccacaggtgaaacagcccgaagtcaaggccttgctagtaaatggagctttgtacatagtcattgtgatgtcttggctgcccggacaccacgtaaacataacactaaagaaactgtcctggagatcccatcctgctactaagaagttttctgtacatcacttccaaacattggaaactttcagatcataaggcagaatttagtaattttgtgcttctgttaatgtctagcattttaaacataggataacattgttttggacactggaataatatgatttattttcacctgtaaaaatgacttcattgtacttgaacacctttgcatttctccatttgtgccatttacaagtggaaataaattttattataccatgatctactggcgttttaaaactgttaaatgtgcacattttgggtatagctattttcacttgtatgtatatattgtatatacatataagtgtctgtatgtgtgtatagatggattggtataactcattctaaacgtgtctgccagggctcaagttttattgttcttgccccactcccaccccatgttacagcaagactggtcttacagagtgagtactctgggtgatgcttacgggaaggagattggtagatgcagtctttttttcccccttagcacttgtatgagtgaggagaaagttaggtaaagattgaaactataaattacagtgcagtaaactgtgctagggaaggaatcagttactatttaagtttgttttacaatgcaataaaagatacaagctgcagagaaaagtaaactctgcaaagaacactggtaataattgttctgcaaaggttaagaaagccactgagtcacagtcttcatggacttttggggtttcttagtgttggatttttggggtttctcatttactttttactcttaatactaatgcttatgtgtttcactgagtatcaaaactgccaagaagggtaactaaggttcctaaactgtaagatgagcaggagatgatcactgggagagaaagcatactggattgaaggaagggctgtctccttttaacttcttgttgatagttgcaagttctttatgcaccttctaccccttctgagccactactattcaagcagagattttgtctaatagaacatgcctttcttgcttttgcttcttttcttttgagacatgtaccctttctgattggataattgatgtttagccaaggctggcctcaaaatactagtaatctttctgtaagcctctcaagtactgggattacaggcatgaaccaccatgcctatagccacagcaacccattcttttggaggttttatagttctccatttgtctcatgttccgaatgtgaagtgtcctaatgtgtattaaagtcagaaaataatatatttaaggtatactaagtatgaatctgctatgataaaagaaattctcacttctcaaatagtcttcttgtaaggagcattgggctgtcatctttgagctgcttatcaaaatacagatcattattgcatatatgcaaattctgttttattttatccctaataacagaagtctcccttccatggttttagcgttgcctttttaaaaaggcactcaccctgagttgttaagaactggacctgccccaccctcagattccttaaaggatgaagagtgtgctgtacactcagcatatgtgcctcttgtatgcaaggactactgattgaagtctgttttgctgtgtctggttatgttgtctgcacttttatgaaatcactacaatagatctacgttggaaataactatcaatttgtaaagaaatttttattaaacactgtagaaaaagtgaagctgagaactcttttgtgcatttatatttcctactgaattctggtagcccacttttaacattgtattgactttttttttttttttttgattatattcagatttccaaacaagtgctggccttcagatcataagtataagaaatatgcatcatatctgcctattgcaggcttctgaaacttgcactgcccatccatgcaaaaataagtatcttaaataaaagcagagagcaaaaactggggagccatgtactatgtcaccacatctgttaactgtttcctgcaatctaaactgaagtgtgtgtgtgggtgtgtgtatgtgtattgggggttttgttttgctttgcttttaaatatacaaggggttcttctttaaatagaggaaaaggttaatcctctccagcaggatgcccactggatatattaacatctgtaggtagttggaagtgtagagagaagagaaggtaagacttctcagtgaatggaaggatgtcttgatgctcaagagtccccgcccccaaagtacgggtaattcagcctgcacagtttcctttcactcatagtttcacaattacgagtgaaaaatcatgtaattatctgtaaatatgtagctaacaaattgacctagtttctgtacttttttggttttgtactaaagtttataggtctgtgccagctagagaggagttgctgtcattgctagtcgtgctctagcatacaaccctgaaaccatcctaggtgacattttagaattaatacttaagtgttgttaaatggggacatggagcttaatcattggtcaggtttgaagtcttttgaagctaagtaattttatttaatatgattacatgtcgtcagtcatgagtgaggtgtagggagtctccctccccaagtggccatgtttacagagtgttgtctacaaagtgcaagtgtgttaatgtttatgtaaattatgcaggtgataactttatggtttgggactgtttatgggctcttttaagtgaattttcaaatgaaatgaactatgcttattgctggcacattgatcccatttctggaacatttcctacttccagaattccgtatgttccttagacattacccccacttaacctcccttcctctgatatgccttgtagctaagatttaaaagactgttgaacatagatgaggggtatgcatttcttaaaaatccatgaaccctcaattgtatgctttcagtattgtgttatatgtttctatggcaactttgaagtcagtggtttagaaatgagataccaatgttaatgaaaagtatgtactctttgcttttgcatggcttggcttagtatccaaggtatattagagccacttgaaagcatgaagaccagttatatggaaacaggtttctctcagtggcacattttgctttttcttagccctcaaatacattgcctcggcatgaacattattgttaatataaattgcacatggtcatcgagtgaattataaaattttgaaaagatgcagctgcccaatattaacagttttagttggtctctatctcaaataacagtgtaggtattggaacccttgtagcccttttgggggtcaaacaggtatatggatttatcaaggagggcattggctgcccctggggtattgccacgctgttgtcttgctgcccattcactccatgtgctgctgtccttccttcacttcatactctcaaagaaaccatcaccctttcttcctattttttttt

SEQ ID NO: 20183 - DNA, 2120 bp, Mus musculus
ccctgaggcattcagccacagctacccaggagcttctagttggtctcacaatcctactgggggtccaggacctcactggggtcatcccatgggtggcacaccacaagcttggggtcatccgatgcaaggtggaccccaaccatggggtcatccctcagggccaatgcaaggggtacctcgaggtagcagtatgggagtccgcaatagcccccaggctttgaggcggacagcttctgggggacggacggaacagggcatgagcagaagcacgagtgtcacttcacaaatatccaatgggtcacacatgtcttacacataataattgaaagtggcaattcctctggagctgtctgccaaaagaaactgcctacagacatcatcacagcagcctcctcacttgggtactaccgtgtggaagctgtgcatatggtatattttatttgtctttgtaaagcgttatgttttgtgtttactaattgggatgtcatagtatttggctgccggggtttttgtggttggctttttgtttttgtttaacttttggaaaatttttaaagtgataatagataagtatttcatgtatgtggcaaaaaaaaaaaattggcttaattagaaggggtattatctgaacaatataaaaacagaatgaagcaagctaatctgaatcatcactttagggtatccatagcctaagaaatgtgtcagaagatctaaagccttccttcatattccagttctgtgagtccctaacagcaggcagcatccatgctgaagcacatacacctccgctcctcaccagtgggttttctttatttatgaattgatctgatttctcaacctcatttgaactaaaaaacaagaccatgaacattaaaagattgcatttaccttttcagtggtagaaaatcatttagttctttgctataaatgattcagaattttgtcagattttgtaggttgtatcatcgtaagacggagttgcataaggagatcataagctgtgtggctattgcactaacaagcctgtgagctttcagaggggaaaaactagagggcgagaggggcccctgaaagttcctgtgacagggatgctcagcagggaggagggaaagcctgtatagctagcctgacattttgtttcttgtacaatatctcatgtgacccaaacttgagactccaaacagtacctttgctttgtttgtacaaaaatgaagacctatagccaacacaaagcaaatgccagaggtattggatgatgccatatttgaactgccatctattagcatattcatcacactacatagacatagttttactgccccctttttagctcatgggatttcctgtttacaggtagcaatagtcaattatttaactacttagttgccaccaggagtcactgagccaatgactatcagctgctgactaatcttcacactgtagttattgcttcatttacaggtcctctgtgcttaattgctgtttttgttgctgtagtaccttatgaattcttaattcattgagacttagtgaccatctgggtccatgttaatatcatataatagcaaattcctttcagaagtctctagctttagtgctaaaatactactgagaaaggaactaggtagtttggtgaatgaaagaaaacaaaatttgaagatattatgtagtggtcaaggaccactaatatttggggagtgtgttttgtctgttcttcaatgaaggatcaatccagtgttcttcatcaatgttagttaatatcccattgcttgtgtggcgccttgagttggtggtagactagggcaaatgccctctttagtgagagaccagaggttttgtataagttattgtcctgctcccttttcagttgtcttgaagagctcttgctactaactttgggtcctgcttttcatttaggtagatggtaagcattctcttaatcataattagaacaaactagtgaccaaattgtcatctgctagtatggaagttcttagttttcttaaccatgctttatgtcttgtccaggtatgtcagtccagtttccatgacgtacccccttcagaagtttctgacattggtttgaggttttctgacactaattaaaagaaaaattagat

SEQ ID NO: 20184 - DNA, 1164 bp, Mus musculus
caaagtgagttccaggacagccagggctacacagagaaaccctgtctggaaaaaccaagagagagagggagggagggagggagggagggagggaggagaggaggaggaggaggaggaggaggaggaggaggaggaggagggggaggagggggaggaggaggaggaggaggaggagagaaaaggaaagaaaagaaaagaagcatagttatccaggtatcttcagaacagcttatgataggatcttttgtcacataatattggttattatctttttcttttagggatgttcacaccaggctacaaagagagacgttatatagcatacaaaaacttaatctgtcttctctcattcttcttttctataagtcatgaatgggtatttcacagtagaatgtatcagtttctcctctttctctcagctgcgtttggatgaagcacaggaagcagaatgccaggttctgaagatgcagctgcagcaggaactggagctgctgaatgcttatcagagcaaaataaagatgcaagctgaggcccaacatgatcgagagcttcgagagctggaacagagggtctcccttcgcagagcgctcttagaacaaaaggtatagataataggaggaggaggaggagagcttcttttttttttcttttaaatcaaaagaactaaatatatgtatgtgcccataagcttggtattgagtgggtatttttcttttattatattgtgtatgatgcatgtatgggatgtgtgtgtgtgtgtgtgtgtgtgtgtgtgtgtgtgtgtgtgtgtgtacatgttcatgtgaacccaggttcacagctttttctttcttttttttaagatttatttattttatataagtacactgtggatgtcttcagatacaccagaagagggcatcaaatcccattatagatggttgtgagctaccgtgtggttgctgggaattgaactcagggcttctggaagaggagtcagtgtccttaacagctgaaccatctctccagccccgttcacagcttttattttaattttttggcctgaggattgagcctacgacctcacatttgcaagacaagaactctactgatatcagtagggcttgtattagatttctttcataatgttttttagttctaatttagtaggtttgttgttgtttt

SEQ ID NO: 20185 - DNA, 1216 bp, Mus musculus
tatttaatatgaatgcaatgagtgccttatatcacatagcccaaaatgaatcccctacactacaatctaatgaatggtgagtattcccataagatatgattaatgttttgaaaagtttgtaaatattgatgcaataataaatcattatcaaaatgacttaattttatataaataaaagaaaggttacttttagttttaggaacacaaataaccctcctaatttaatagctttttaagcattaatattttgtaattaaaatgaatagattgttgtaactgtttaaaaaatagacatgtaaaagacatgagtaaaatgttttaattcttctttcaaaattattatgtctagctaaatatgttagtcatgttgctctgatttctcttctggtgtattaattactaataaaacttcatgtaaaacagtatatggaaaagagattgaccgttttggactagaattgttatgaattgaagaaatcatgcgttagttacttttctcattgctgtagcaatgtacctgacaaaagcaacttaaggagagcttattacagtttgagtgtacagtccaccatgatgtggaaggcatggtagtaggaacaggaggcagctggttacatcgtgtaactttttgagggaggaattggaaagagttagatgctggaggaccacttgattcatcccatttattcattctgggaccccagcccatgggttggtgctatctactaacctacattcagcatctgactttctcagttaatactttctgggagcatcatcatagactcactaagaggcatatttccagggtgattctaaatcctgtccagttgatagggttaagtcattactattctgtcctttctcagaattaaacttgcccctcagttgcattttcatttcataatatatattagtccatctctgagagttcccatagtctttaacagtcccaacattatacataatgtatgaagtctattcagacttgtaaactctcatttttgaccatttgtgcaacaaaaacaggtctcattttttatagtctcagagtttgggaggcaggagtattgctgcaagttcaaagccagcctggactacattgtgaaaccctatctcaaaaagcaacaaaaatgtgttgtcctttttgaatattggaattaactgttgattaattattatgtaatcactgagctcccatgaataatgctattat

SEQ ID NO: 20186 - DNA, 1175 bp, Mus musculus
ctagatactttccttaaaacacctcaggtttgggtgaaagaggttcactataaatatagtaagttcttttatcataccgtctgttctggaggttgcttgcatcgaagtacaaaattccaagtattttaccaagatatgagtttagggaaataaaaatataccaccctgaatatatcttttggcaagatttgtgttagttattctgttggggtaaatctccaaccccagtaagcccatgcaaagaacacacaactcaattataatatgataaacaacacacctagattgggcaaatataccaccatactactctgtttcccagctatgaaatcccttgctacttgtggttcctccaggccacgtgctactgccccatctttcttccctcttccttttttttttttttttttaaagacttatttagggggctggagagatggctcagtggttaagagcaccggctgcagtgtacttagatatagtaataaatgtttagaaaaaaaatatttatttaactgaactgagttcactgtcgctgtcttcagacacacgagaagagggcagtagatcccattacagatggttttgagccaccatgtggttgctgggaattgaactcaggaccttcagaagaacagtcagtgctcttaagccatctctccagcctccaattcttcctttttagtccttctttctctcctctgtctcctcttcctttttcccctctctccctctccaaaactttcatccccaccttttccttacactgcccaatcagacgctctagcctttatttgaccaggtaaggtggagagaaggtacacactaagtcgcctgagtcacctgtgattgatctactcctcctccaaaacaacccctcgtgagaaagcagaattagcatcaaaatccaaacagcaccaagtccattcacaacattattctgcagaccctggaatgactctgaaatgcaatcttcctaggaaaactgtcattttaatagaacagtctttgtcttgctgccttactgtagtctccttactttcccatagcctgcttgtttaaatcaccatcagaaagcttcaggacccccattctgtaatacagaatgctattttaaggtcaaccatatgaccattcttttgagtttttgttctttgtacacattaataatttgt

SEQ ID NO: 20187 - DNA, 1548 bp, Mus musculus
gcaaaggagcagataatgatggtagtggatctgagagtggatataccactcctaaaaaaaggaaagctaggcgcaatagtgccaagggttgtgaaaaccttaatttagtgcaggacaaaataatgcaagagactagtgtcccagcattaaaacagggacttgaaactttaaagcctgactatagtgaacaaaagggaatgcgagtagatggttcaaagcctatttggaaatatgaaactggacctggaggaacaagtcgtggaaaacctgctatgggtgacgtgcttcgtaaaagctctgatattaaacctggtttgagtagcaaaaaatttgatgatcggcctaaaggaaagcatgcctcagctgctgcctccaaagaggactcatggaccttgtttaagccacccccagtttttccagtggacaatagcagtgcaaaaatagttcctaaaataagttatgcaagcaaagttaaggaaaacctcaacaaaactgtacagaactcctccgtgtcaccatcttcatcttcatcatcatcatctactggggaaactcagacccagtcttcaagtcggttatcccaggtcccgatgtcagctctgaaatctgttacttctgccagtttttctaatgggcctgttttagcaggaactgatggaagtgtgtacccatctgggggtcagccactgctaacgactgctgctaatactttaacacccatctctactgggactgattctgttcttcaggacatgagtctggcttcagcagccgttgaacaaattaaatctagcctttttatctacccttcaaatatgcaaacagtgctgttaagtgcacaagtagatctgccctctcagacagatcagcaaaacctgggggatatcttccagaatcaatggggtttatcatttataaatgagcccagtgctggcccagagactgttattggaaagtcatcagatcataaagtgatggaagtgacatttcaaggagaatatcctgccactttggtttcacagggtgctgaaataattccctcaggaactgagcatcctgtgtttcccaaggcttatgagctggaaaaacggactagtcctcaagttctgggtcacattctaaaacctgggactactgagagtggagccttatccttggaccccagtcatataggtgacctgcaaaaagcagacaccagtagtcaaggtgctttagtgtttctctcaaaggactacgaaatagaaaatcaaaatcccctggcctctcctacgaacactttgttaggctccgccaaagaacagagataccagagaggcctagaaaggaatgatagctggggttcttttgacctgagggctgctattgtatatcacactaaaggtaactcatttgttttttttctaagattccaatgggctgattgtgtgtgtgtgtgtgtgtgtgtgtgtgtgtgtgtgtgtacatgtatatttgatattctatattatgaatgactgggtaagaattagtatcaattaattgttaattgatttgaaatttttgaaaatt

SEQ ID NO: 20188 - DNA, 1101 bp, Mus musculus
ctgaatagcataactttcctttttttggagacaggattttttttgtctagccctggctatgctggaactgtttttgtagaccagagacccacctgcctctgcctccagaatgctgagattgaaggtgtcgggtcctccatcacaccaagagaaaacagtagtttttatttgcatcctttcatctctttttttactcttttgggtataaacaaacatctagtacatactgcaggtggtaatttgtttttagagacaatatatatatattcctggctatcctggaactagcaatgtagattaggctggccttgaactcaaatacctgcctgtctctgccttctgagtgctaatattaaaggtgtatgctgctttttaataaaatactggttcattttggtagtgagttttttaatctgtaggaaaaaggagcccatcatattgaagggatgaagaactacattttttctagaagaataactgacttatttagttagttttttgagacagggtttttctgtgtagccctggctgtcctggaacccactctgtagaccaggctcatgaccaggcaggctcaaactcagaaatctgcctgccactgcctcctgagtgctgggattaaaggcatgagcccaccactgcctgactaagaagatgaatttgtgttttgaactttttagtctgcttttctgtttgcaccacaccagtccctgtaaattttagaagagtgtgtcagatcttctggatctgtggttacagatgtctgtgagccaccatgaaggtactgggaaccaaattgggaagaacacaagtatacttaactactagccttatttccagcccaggtttttttttcctatcaaagaatttttatatgtatgtattgtctgtctgattgtctgtgttggtgtacacgagcttttgggcgctaacaggatattgggtcctctggaggaggagttataggcagttgtgaactgttcagtgtaggttctgggaatctaatttggggtccactgcaagtgcaggaggtgctcctaaaggctgagccatctcacagccttttataaagtgaaatactgtgacagtattttcacatca

SEQ ID NO: 20189 - DNA, 1153 bp, Mus musculus
ggcatcggatcccattacagatggttgtgagctaccatgtggttgctgggaattgaactcaggacctctggaagagcagtcagtgcttttaacctactgatagtagtataaatggttttgaagatctgtgtgccagctagtttagagtatctgatctttttagtcacccaaagctaatgtcttttctgtaggtagagaagctaatagtataaaaatatatttcagataactgttgagttcaatttgtagcaggttattagcatagataatttggtcctccagtttcaggttttgcaatacaagagacttcttcctcaaaaacacataggtgaaggaaaaaaagcacaaacatgtattgaaagattataaatgtcaggaggaggctacacctcagtggaggtaggtggatttccagtatagaaagaataaatataacagcctgtattatggagcatttaaactggattttgatggacgagattttgcttgtatgttggttttttttttttttttgcaaaaagggtctttctatgttgccttggacttttagaccaggctggcctgaaattcagagatccacctgcctctgactcctgagtgccgtcacacctgatggtcttttaaaaagttttggttatgtatatacgtacttgtgcacataggaacctatggaggccagaagagggtatcaaagcccctggatactaacagttgtgagctgctatgtgggtgctgggaattgatcttgggacctctggaagaacagtcagtgctaagccattcagtccttatttttattttttactgtgaaagtgactgttgagttttttatggatttgggaaattaccaattccagaccagcagtttacattataactcagacttgtaagaactggagccaggtcaaaattggttagacaaaaaagcagggcctgatatggtagtacatcaatctgtttgagaggctaagacagtggattacaaactcaatataattctaaatttgtctgaaatcaaaaggaggactgaggatatatagcttgctaatatatataaaaacacttaagtttaatcaatccccaatgcagaaaaaaaaaatagaatatgaacagtgggaatgtgcatgtagaggggcaataagaggctttgaga

SEQ ID NO: 20190 - DNA, 6138 bp, Mus musculus
caagcgtggttctaaagttcctgctgtcatctacttgggcaacaaatgacccactggaaaggcaaatccacttacttctaggtatctgtaccttgttctgtgactaaagtgatacactaatcacggggaacccagaatgattcaacattttcccctactccacccttgatcttttagttttgagccctgcgagaatgctggataaatgccttgaagtttgcagggatgttttttgttgtttgttttttgttggtttttttttgtttgttttaatacaatgatttgcatgtcttgccaagagttctgcagcctatgtggggtgttggggaaatagttcctttccttttattttttgttgggtggggacagggggagggcattgaagttctacaatcctggaatagtttgtgggtatatagttaacttactttggttacatgtttggacttttaacatctaagagtgtcattcaaaaaaaagttgcagaacaagtaattggctgataattacccattgtaattgtgtaactgggagcaaaaatatattctgcttttctgctgtaggtgctctgacttgctctctgtcactaacactaagtgtatactcttgtttttcatcaaccatttaagagaaacgtatgtacctttctgtaaattcttttaatttcagtttctcagcaaaatcgaaaaaagaaaaaaaaaattaatgaaaactgtcttgtttttttagccagtgaggaggtaataaatcctgattgtagaaggtgtgttttcaggcaaattctgcttctgagcttacttgtttctgattatatcttaatatattttatcattagagcaagattgggttcctttggttatttttttctttctttctttctttttttttttttttaagaaaaataatgtgaaattctgaattttgttttgggcagaaagagcattagccctgtcttatcatcgcattaccatcctgttgtgctgcagcttgtgtatagcatgcgcgcgcgtgtctgtgtgtctgtgtctgtgtgtgtgtgtgtgtgtgtgtgtgtgtgtgtgtgtgtgtgtgtgtgtgtgtgtgtgtagaaacgaagggtccaatataagactgggtgatgttagtggcataaaaacaagttctctggcctgatgtagcaacacatcacacacataacacatacagagaaatcaatgtatccatgtatgtcaaatacaagttaaactagcagggcatttatacagttgcagtcttctaacaaaggcaaactggatcccctagacacttttgggggagaaagtagttactttttactcttgttttctaagaaatgtccagttttgagcgattgtagtgtggatggattttctggttttgttaactatttcaggtttttaacaaatgttcatgaaagaagctatttgatttactgcagagaaaaatactttttagtctggatttctgccctgcttagattttttttttttaagtataagcatggattgccaattccacttgatgtaaacaaaactttttatacataatatatataataacttattgtatcagtccaggttcagaaacttgtggtaggccagtttcagatagtttcatttcacctgtaaactgtatcacttttactgatattgtaattttcaaatgtataatatgtttacagatgtgccctgcatttagtcgctttgttcctattttgattttttgtttttgttgtttgtttttgttgttgagtctcctgcctgcttgccaaaagctaggatgcttcaggccggtgtacatcagtgaggcatccttgagctttaaagcattgaacaaactggaaaatgcaacacgccacatattgaactgagtctgtgttttgtgttctttttttttttttttaataaaaattttcagaaaatttaaaaaaaaaatcttgattaaagaaaaacgaggctccagtttgttttataggttttaaagttctgctgtgtgtttaattgccttgtgtgaccacttgtcgccttagggctgaatccttaccccacttttttttaaatgtccattttgcttgcctggaatttaaaagttcttctgttgcacaaatcacaaaaacaaaacaaaaatatatttccttggtttatgtcgtacaaggttgaatgaacatagtcaaaatgaaaagaaaattctagtttcctgaattgggattttttaacttagaagtaatacttagtacctttaaggccttcactttcatagttccttttccataacttcaggcctctgcaaaggagctaaagagagtttatttctccttctctgtccaaggcttgagaatctcacttcttctaaatgaaacaatgcaacatttcactttgatttgtccactgaaattttctcaatgtggttagaggtatatatatatatatacatatatatatatatatatatagtagttagaaatgtctcttaactttctgggatccctagtggcccatcatattaactgtcagtattttttggacattgggttaatggacttaattgcctcagtacgagcaggactttgggacagatatcttttgtgctgtttgatacttgtctcaatctttctccttaggtcctcacacaattccttacagagcacttattaaaaaagtcttacgagttcatctgttttctgattttttgtgtgtgtgtgtaagcttctaaaagaaatatcagttgtgatttaatttagcacatttaaataacaatatgttggtataaagaattttccttcaactcagagtattagtactgtagcataaaccaaatacagtctagaggggatttttaacatccctccatttaaaagactgaaaaaagatgtgtgtgtgtggatgtatgtattttgggatgcttgtatgttggggaaagatgaagatactaagaaatagtaaatgaatgtgtaagacattatattagtattcagagaatgaaacttgtatttattttgtgccatttgttttcattacatgggataaagtcaggtagtttaaatccttcaagggtagtactagaaaaatggcactacggatgaaatcatgacctatttttttaatggctaagaaactaattatgggtgatgatttccttttcagttcgtcttgattgtaggttttatgtcacacaccactcaattttgtggaaaagtcttgaataatctcccttcctcacaaaagacagggtgtatttatcttttctccattctcacttcaacaacctgaagttaattgcatagtatttcctctaaccttagtagtgaaccttcacatcaataaagtttttatggtgtctatagtagcctgcccttctctactttctaggaggggataaccaatatctaaaaacttggtagtgacaccttctccccccccccccatcctccacccgatttcctagttaccactcaatctgcaattgtttcaaatgacagtttgtggagaaaataaggcaaacctcaattgatagggcagtttcttcacaaaattggacatgtcagcagtagctgaacacttggtagacttgttgccagccttcaccaaaagctttttttttttgaggtcagtgaaaaggcatgtaatgtgaacttgaactagatgggcacatgcaaaggatattgaagacttggctcaatttaaaaacctgtctaaataggtggtggtaaggtgtctctcaacttacttagtgtgcagaagggtttgataccacttcaccatattttaaaaatacacgcctccttttatatattaaccaaccgaactagtaatgtagtgggccaaatatgtgaacaaaaaattctgtgatgtttgcctgccagagtggactttgataggactgtattaagatgggacttatttccccggcttctagaagcttggtaggaaagcacaggacaagagtaaaagtcaaagtagctgcttaaaggtggccagaagaacacatggcctgacaagtcactgatttttctctttggcaccagtagacttctgtgttgaaggtgggcttctgctgtgggtatcttaaaatgcttatgaacacttagctatatatgtcagtgagtggcaaggctattctggtcgtgtaaagaatgatatcattaactccactcaagaactgatctactgagttttaagaaaggtcttaaagcagttaatgccagcagtagttgagttttaagttctccatcataaaatgcccagcaaagcagcagtagtgtaatactattctattatgaggactgtcaaatatggattagaaactcaaaagacaccctaaactgtagtgggattgctggtttaaacatttcctatttagaacattttgttctgaagtcataacaattagatgtctgaatttttttgtttgttttttttgttttgttttgttttttgttttttggtttttttttttttttttacttttttttaggtggggtgggggatgttgttacagggtttctcagtgtagtactgactggcctggaacttgctctgtatactaggctggcttggaacttagatctgcctgcctctgcctccgattgccaccaagcctggcaatgtctgttatttaacagccttatttgaaatagttagaattgtttcccccagttcagtttggctttccttgtaatctgttttaatcttcagaccaaacaacttagattaacattacaatagctttctgtatatatatcccctttcctcaggtgctaaacaaaggctccaaaatgaatactgctttagtaacatctcttattaaaatgcacatttcttttactaattgtaaagatttggtgttaacaaaatggttttaatatgtaaatatgaacaaataccttaagttctacttgtctattaagtgtgtttgcatttatcttttgtagataatttttcacaatctttaatacatttcattaggtattattgcatctttagaatgaaaacaactgttttgtcttagattacgcctgctgctgctgctgctatgggaaactgagaaatcaagaatgtgatgcactttttaaacattactatataccataggttgcgttaataccttttttttttttttttttttttggtagcacagccactaacaaaaatgaacagagtttaatattctcttcaggtgtgagtagtaaagtagtctgtagtttgtgttgatttatgaaggggacaataacttagaagtaaatttttggttaatattatattttggccttaaaatgtcttctactactgaaaatattttaaatcatagctttgtttctattccctctgcttcaaaaagacttgggaaggattagaggaagtcatttcattgttttctttttagttgtcagtaagctgggttttttattacatttatttcagagaagtaatgctaccctaaaccaatcatacctagtttagttaacaagctcccaactattccacttctctagtatatattcaaagataaacaaggtgtaagaatgcaacttgacaaaggaaaaatatctttgcaagcacatactcaaagatgaaggaggaaaagtatagaggaaggacaccaaatgaggtggaggaatatgagaatgatgtgtggtccaaagctatctggttatattttgatgttgccaatattgcagagccaaatttttaatttgcttactaatatatttgttggccagagatctatttttatatcagtgtgccttgcatgtatattaactttggaaaggccatgtagtaaatgcctgagatgttgatggttcttaccacctcactgatttttatgcagttgaaatgttcattctattgcccaactggtgctctctgtttaaagttatagatcttgtcaaactggaactcttttataaactggggaagtgacttgttttttcactaatccccctacccccatagtctgttagtggctggtctgtagggaaatagtaaaaattattcactacctacccctacccttaacaccaccttcaagtaatgtgataataccatttctttgtgcgctttgaaaaaagtttcagcttgctgcctcctttagtgttatgaaaggtattattaaaagcattgtttgcaaaaatgcaggaag

SEQ ID NO: 20191 - DNA, 1197 bp, Mus musculus
ttaccaaaagtaatctgtcattattttgctgttcttagctttaccatctttggaaacatggttcaaagttataatctgggctagctcatcagtggaactaaaatgaaggaaaactggcacccactgaataaagttgaattgtaatgagagcctgacttgtatctgttaaagggcttttcttcaacaggacagttgtatcagctttataaaccattggacccaatgttcttctcagtgaaattttaaatatttatgaaaaagaaatggaaagtcattcaaactgaaatgaaggatagacctttgccatatgaagctctgacaattttatgtcttaagtctggtttaaagttaggatagcctttttattaacctttattttaacatgaatttgattaactggatgatttgaaattaaagtcattaagtttaaagggcaaagcacaagattgttttaaagatatattgaaaagcccaagttgatctgagcaagttcatgatctgggcgtgtttggttaattcaccgcagttgcatgttctaagtagtttcacttacttgaagtgtgcactcacaaagttgtgtagatgtgctggccagatcttgtcattcatcttctaatagatagctttgctcatttcctttaggacatttgtagacgagtagaagatattatcaatggtgttttccccaggctcccagatacaagatatatttcattttatagctttgtctagtaaagattcttcaaaatatggttaatgatgcataaccttataaacacaggtagtagcgaacagcttggatggctttggctgctcttgaatatctgtcattagtttgattcacatcttagttgattacacttgtaatcctggcaaccagaaggctgaagcaagcggattgagtccaaagccagactggcctgcatggcaacaacatagtgtattggagaagtaaagtaatctattgtgtgcagatttatttatgagctgggttgccttttaattttggaaaaggagaattactgcattatagttagaagatgttggcccttttcctgctgaaatttttttcaatacttgttttgcccagtttaaaaaataataaaagtaggtcttttttagatagaacagtgaccagaagtttattgttttgctaaataactgactgcttagttatactaaagctgttgatgttat

SEQ ID NO: 20192 - DNA, 1152 bp, Mus musculus
tggcgtccaataaagttctctttctcgaagatggtaatcttagactctttatgattctataatacataagtttaaagactttgctagtatagttattctaacttaacaaattagtactatactaattttttggcataacatcattgttgagcttaacagggattttataagagaaaatccagctgggttgttatggtgtacatgtttagtcccagcaaagatagacgttttgagttggaaatatagaactaaatttagggaagaatcataagatagaatatttggtgagtatctagcccaggcaagtgccattccaaaactcagaaccattttaaactcacatcaaatggttggtttgtttctgcttaagcatttttattcaaaatttgctgggtacgctagactggcctcatgttcaagagtgccttttaaatttcctgggtgctagaattacaagtatatactaccatgtccagctctcacagactaaatgcagcctcttggaggcttctatttccaactggggtcaccatgttggaggaggaatgtggagatttggtattgaaaagggtagttctgcaaaccttactcctgaattaaaatatttacttgtttatggataattggctgtgatctgccgttgatgttcttagatccaaattcctgccactatgctttcttgtttgccttgctccagagtcagatccagatccacagctccagattcagtctactgaaaacagtctgaagccatgagctggaacataaatgtcctttaagtcagttactctctctctctctctctctctctcttttttttttttttttttttttgagacagggtttctctgtatagccctggctgtcctggaacttactctgtagaccaggctggcctcgaactcagaaatccacctgcctctgcctcccaagtgctgggattaaaggcgtatgccaccattgcccggctctaaataggtactcttgtcaacaacgagtaaatggcaatacaaaaaaaaaatttttttcctccagccccactagggtttttcaaaattagaaaaacggaccaagtttggccagttcagttgtatcctaaacaagagcttaatcgaaaactggatattattaagtaaaagaaatgaattgctc

SEQ ID NO: 20193 - DNA, 1170 bp, Mus musculus
gctgctggtgcccgtcttttccccacccccacccccaggctgggagagccggatgacccaagagtggaccatccccagggagaacaaaatctaagtcagggggtgtcaccaacttgacaggtccttccctatgggctgatgtgggcagagtacatgccagtcaggctgatataactggacgatgggtcatttgtaataggcagaatttctaccttctcattagccttgaaagaattgccagaaagcagctaacaattagctcccagaagccccagggtcctcctgtcccatacaaacagctctgtccctcatctcactgcccagaacccaccaggtagcttctctggttctggaacccactccaacacgatctccccaccaaggagaggcgggatgggtgggacaggtttggacttgctgccccagggcctgcagacacaggcctgatgccctctgatctacccttgccccaaccagctggaggagcaactgagtcgacttcagcgtgagaaaaacgagattcaaaaccggctggaagaggatcaggaggacatgaatgagctgatgaagaagcacaaggcagctgtggcccaggtaccctgacaggaatgacaacagagtgaacatcctcggggcctgaaccacctcacaaatccctggctagattcctcctcctcctcctcctcctcttcctctcctattcttcctcttcctcctcctcttcctcttcctcctcctcgtcctcctcctcctcttcctcctctcctcttcctcctcctcctcctcttcctctcctcttcttcctcttcctcttcctcctctcctcttcttcctcctcctcctctcctcttcctcctctcttcttcctcttcttcctcctcctcctcttcctcctcctcctcttcttcctccttctcctcttcctcctccttttcctcttcctcctcctcttcctcctcctcctctcctcttcctcctctcttcttcttcctcttcctcctcctcctcctcctcctcttcttcctcctcttcttcctcctcctcctctcttcttcctcttcttcctcctccccctcttcctcctcttcttccttttcctttttttgatatctgtaaccctggctggcctagagctccccatgtagaccttgtagactatgtagttcaggc

SEQ ID NO: 20194 - DNA, 1247 bp, Mus musculus
tccaagcaccatcaggcctgcctgagagcgtgttcagtgcggtggatggagagcttctctgttgcccctcccccagcaccctctctgtcagcagagcaggcagtaggagggggtggaaacaggtgggcagccaagggcatcacccacctggacatgggaagccagagagaactagagggagcgttatgccttctttactacccccaggaccccaggacaggtggtgacatttcaggccccacagcacatacagaatagggtttgtgcagctgctggggaccagaagaagccattggtggtggatgaaggctctgcctcctgcatctgtcacctcacttatctctcagagttccttctactcaaaagggcaatattgtggtttggactcctgagagataaatacagatgccccccgagtgaccctgtagcccaggctgtcactttgcagagccaggctggggtagatagtcattggaatgacactgacttggttctccctcacactctaacctctgctccaaatcatttcctgcctagcatcctaccgctgccaaggagaacacattcgtgtttctgaagtagacagattcacgaggctgagagagagagagagctctgcctgggtcttttaatcaaacactctcagcagaaccagttacctctgaacactggctgtagctctgggagcttctgggttcaatgtctctgaaaaagcccagatgaccatgagaacattcacatgacaggccagcctctgtgtagagctgccagagtctctgcagtaacagtcacccccgcctttcctcttccagattacctcttccaaagacccctgcagagatgcaggtgtcatctcccccctggaaggacagcaaagctcagagggagtcagatcagttggctaaccctacatggaaggagacctgagtttgctcagcacttatgtaaaaagccagatgcagtggtacttccttataatcccagaaatgaggagtaaagacaggaggattaccagggctaggtgggcagacagacagacagcctaattggtgagctctaggtcttaatgagagaccatatctcaaaggacaagatggatactacctaaggaataatacaggttgacttttaaaaaaagattttatatatgtgtgtgtgtgtgtgtgtatgtatatatatatatatatatatatatatatatatatatatatatagctgtcttcagacacaccaaaagagggtatcag

SEQ ID NO: 20195 - DNA, 1196 bp, Mus musculus
ttatttcactgctgcttcataactgtaatgttgctactgttatgaatcgtaatgtcaatatctgatatgcaggatatttgatatgtgaccccaaagggtcatccaaggggctcgggcagtgcttacgacaggaggacttttggtggaacctttacctctgcacctccactgccacctccagggaaacctaaactactgtctgctccctcatcttactttaaagatttatttatttattttatgtagctgtattgatggttgtgagccaccatgtggttgctgggatttgaactcaggaccttcgaaagagcagtcaatgttcttaaccactgagccatctctccagctcctcatcttactttaaaaggaccagtaaaggggcaccctcaggtttctagttcagaatatagtagacctagcaattgttgacacttaccttgtccaagtagaaggtcaccaggacctgtatcccttgtctcttggaacacaggcacccccgggtacaaacaaagctgggtccagggcaccagtagaggtaatgctgtgttgggctgtgtcttctccagggacattagactgtactgcatgggcttagggacagtggggacaggaggaggctctgggaaagaatgagagtggatggagccagagaatgtagtcctgtctgctctgttggatgttacagtccttctccctccaggggatcatacttcttcatatctttggagggacagccttccagagccaggggcccgattgaagactccaaggagttgttaaggacccctcccattggcccatcctcaaacaggtcctgccagcctctgtcccgagcctccgttccttttccagtagaggatgccatggtcaaggactgaagtcttccaggcccagggaaaccctgattaggggaaatagatcagacctggggtcctgccaggagtaatctacctgagagtttcctccttggacaggttgtagtcaagtagtcacctgccttaaaccttcatccgtgtgctcttggactgcttacacgggagcaagagagctgaaaactccgagtcccagggttcctccctcaggactcagtctaagcttctcaggggaaggagacaggaatgcacttcttaggcttatggaagcctggcccttgctgccaccagccttcccatcatgttagtctgaaaagcttacca

SEQ ID NO: 20196 - DNA, 1150 bp, Mus musculus
cgcatacacagcgcaagggaaaataccagtacatacaaaataaaatttcaattttaataattgttatgtgtaaggggctttataatttttataagtgatctagtaagacatatagccatctctgttttgttcttttcatgatggcccacctattcatttgcgcagaaacgagagcagaaaaaggagcttggccatgtcaatggactggtggacaagtctagcaaacggactacatcccccagcagtgacactgacttgttggacagaccagctagcaaaactgaactcaaggccattgcccatgcccggatcctggaaaggagagccagccggcctggcacccccacatccaacgccagcacagagacccccacctctgagcataatgacgtcgatgaggacatcgttgacgtggacgaggagccagtcgcagcagagccggactatgtgcagccccagctgcggcggccttttgagctgctgattgctgctgccatggagcggaaccctacccagtttcagttgcccaacgaactgacctgtaccactgcactaccaggttagcgacatcatcatcataaccctctcttaccctggcttcccaagggattactactgcccgtagccagttttttgttcctgttcctgattttgcctggagaagcgcatcaaaggttgtaattgttatagtacttattctgttttctgagtcgtctatctcctatcttgttattcccctgcatcttttgttttctgtttaagatatatgccaaatatcacacaccagtaatcttagcacttgtgaggataaagcaagaggatcatgagtttgaggccagcctgagctacctatctcaaaaacataggaggatttgagaaggtggcccaatccttaagaacactggctgcccctgcagaaaggactgaggtttagttcccagcctttgcatagtgattcacaaccatcaatatctccagtttcaagggatcttctggcctttataggcaccaggcgagcgcatagtgcacatgtgtacttgctggcaagcattcatattcataaaagaataaatgaaaaaaaaacttaattaaatagggggctagagcagtggctcagcagttaagggtacttgttcttggacttccagag

SEQ ID NO: 20197 - DNA, 1229 bp, Mus musculus
cagaaagactgctcatgcattattcttttcacatttgtttgtatgacagacgatacacaattgccacaacataagtatacagatcagaggacaacttgaacaagttggttctccctttatcatgggtctgacgaattgaactcagcaggcaggcttgttgggaggtgcctcttgttgatttatgtatttatttttaagtgagaattccttaaagaacaggggcagagagcggagctgagtactaagcattggtcatttttgctctaacagctactttagccgtactccaaacatttagattcacaagatacattcttcgtataagataaaataatgaagaacctggttttcatcttccttgctgactgagtgtgacagagcctagagggagggaagatggacaggacaggctgtgaggactgactgaggaggaaaggatctttttagagtagaatggtcttgaattttgccccagaaatcacccatcacatctcgttcctctgcaggagttgtcgagtggcccccctcatccagtgtgactattgcccgcttctgtttcacatggactgcctcgagcccccgctcactgccatgcccctgggcagatggatgtgtccgaatcacatcgaacatgtggtggtaagcacactagtgtttagtgagctctctacaggcccagctggagcagggaccaatcccctagaaacagtaacatccccttgtgcagagctcagtataatcttgcaggtgctgggttcagcagaccatcctaattatgcttggtttatctcccctgcgcatcttgcctttccccagtaccttcttcagctgtacaggcaggcttgacttgcttgcttataatttttactccacagtgaattaaacaattgctattatagccatagagactgagtattagagccaaccttaaaaaaataaatggttggctgtcaggagtccgtgtggcccatgcgtccagtgagtttgttgccctcttgcattagttctttataacgaccctgtgtcagtcatcctgggtttcagtgagttgttgaatggcacctttatacactgagccatctcacaggctctcttcagacactgcttcctacactagaacagatctgctctttgcaggacagatagtccttctatacagtcacccaaaaggtcgtagagggcaacttcatgaaaaggtattccctcacaaaaacagcctttccaaatta

SEQ ID NO: 20198 - DNA, 1173 bp, Mus musculus
tcacaggttctgggtttctgaatgatcctatccctatgtttgtcttgtagtgcaaagaaaggaggtacaggcccgagctgtgttctgccccctcttagggttgggaggagctgtgaacatgtgctatcgaaccctctacatcgggacaggtgagccagccaggagtctgggaggggtactggaccttcagcctaaaggtggacacttagagaaacccttttgaggttgatagatctaacaacaccccactggggtgtccaggcaagagagactgagaacccagacaatccaatggggtacttccttggctcaggccttttgctttaactgcctctcagtagcttctgaaacactgtaaggaaagacttaaaaagagaacacttctttattctcaggtgtgataagctcacacataaccttcctttatttgttagtttatttttggtcatcaagatgatttaagataggatctcctctgtagttcagggtggccttgaactccagtctgttctcttgcctcaacctctcaggtactacatctatgagtattgcccaccacacctctgatcacccctagaaattgccctttaaagtgccctacactattgtgttcacatggatataccatcctcttcagtagcttactgtctgtctgggtggcagccatgtattctaatgcagattagctttagaacaacaaaaggaattgctgaacttgccaacatatatctataatctcagtacttcagtacttacggaatggaggcagggagatcaagagttcaaagctataccccattactataaaggggaaaaaaaagagaaaaaaaaaaaagaggccttgagctaccttgaagtttctactagcacccacccactcccctctctttcacctccccaacacatacaccttacagtctgttctctaccttttccttgactcctgccaccttgcaggagctgacatggatgtgtgccttacaaactatggtcactgtaactacgtgtccgggaaacatgcctgcatattctacgatgaggtgaggggcagagatgggtgggagggagctttcctagcctgaggtccttccccagcactgggttctggacacaggcagaggcaaggatgaaaggcttgtcctttttcttcctgtccatcttggaaggaaagac

SEQ ID NO: 20199 - DNA, 1178 bp, Mus musculus
agcttggcctcctctaagccttccaggagtcagaggctgcagctcctctccctcagctggggcctgggagggggtcccaccctaagccacctcaccttcacagggcagtgaggttctacctgttatagtctctgacacgggagttgacaacacctgcggaggcagagagactgtgggttgcatcctgtctcctaccccgtctactctctgcaactccatgtgcctgtctgtgtccttttcatactcgctgcccctaaacctgaaggtctcccctctgtaggaaggcgggaaaaggtgggtagtgtgggggcagtagactggaggagtgggaagatgagccccaagtgtgtgggaatcagggccagtgaagatagaatcctcgctgtaggagctccctgtgctgcagatcttcctccagagcgctcagaagtccccttgcagctccagggccagcagatctaagaggggtagacaagactgccagcccctgcatcccgggggctggggcctccagctggctcaggtgtctgtgtcctcgacaggtgaagatcatgacggagaaggagctcctggctgtagcctgtgaacagttcctgggcaagaacgtacaggacattaagaacgtcgtgctgcagaccctggaggggcatctacgctctatcctaggtgaggccccgcccagactctgagccagggccaggaacttgtgcatggtaggggctgggagtatgtcccactgaggtttgagtaaaatatttttctagtttttaatttcaaaactcaaagtggactgaagatatagttcagtgataaagcttagcatgcaaaagaccctgggtttaatccccagtgctagaagaaaaaaaagaaaggaagagaaaaagaaggaaagaaagaggtagacttggggaaatagttcagatggtaaagtgcttgcctacaagcaagaggaccccaggttccatcctcagaacccaagggttttggttttgttttttttttaagatttatatatttatgtattttatgtgtatgagtgctgtcttcatgcacaccagaaaagggccccagttcccattacagatggttgtgaacccccattaggctgctgggaattgaacccatgtcctctggaagagcagccagtgctcttaacctctgaaccatttctctagccc

SEQ ID NO: 20200 - DNA, 1880 bp, Mus musculus
taaagtcgatgagattgtggttctcagtggggacaacagcaaggtgacatcagaagtaaaccggctgctagcagaactgccagcctctgtgcacgccctcaccggtgtggacctttcaaaggtatgcaccttcctagcggtgctgggaatccctagacagcccagactggagaggctggtggcttcagggaagtagccctcaccatctgtcatccttgcagatacccctgatcaagaacgccactggtgcacaggtgtgaggctcctgcacactcagcctccagcagctgcctgcccttccagcgcctgttttaacgtcacagggacagcgagaacatttctgactctggtgccttattttgtagggaccagaagtgctgcgtgttcaggccatctctggctatcttcctttctctcctgtctgccttcctctctcccatgccctcacattaatggccaccttcatccagcctgtctcctcatctgccatatgtgcctcttcctctggctatctgtttctctcccctttctccccaacttcacacacatcatctactttaactgaagttgaagttgtgtatgataatcactgtctgtctgtgaggagtggcctcgctgctcctcagaatcctggtgccttcaagttctacatgtatctgtctgtcctccctggccctggcagagcccagcatgggtacaagggtcctaggtaggacacccactctcctctctcctggtctgaatctccgagtgctgaacgctgttgcgggaagcccacaacccacacgctcttgccctttgaggcctgagtggccatggcctattggccctagagtaatgcccttgacatgccgaggcccaggcctgctgtcatacctgcccctgtcccctgcaccatcacggaggcacagaagcaaggcctcctgtctatagcagcttcctcagcttactactgccttaggaggccctgcttgtgctcagggacatcccttcccttggcttgtccttgattggtgggtgggtcttagtctgatcccattaagtgtttctggggtcaatgtctagctctgttggggacaagtaaggtttataggccttcttcctgctagtgcatggagctctcccaggaggccagggctgtgccaaccctaagagaatcaagtgctgtagactggccaaacctcattccctcaatgccattttcttggccagaataatggggacatgggaagcagctaaatattctatacctttgcaccactggtggctgaagaggccaatgccctggtgtcctagtaggggtacaagggtgtcccgtgggccccgtccccacccctggccctgcccagcctgtgtagctgttctgcatgtgaatgctgcatgtctggtccgggatttggatgttgcactaccccactgcctgtccccctctggtgaaaataaagatctcttatacccacacctttcatcgtatattctgtgaggagagaaagtaaggaccaagaaccagccacattaatcactttggcatccgggttgctctttccttccttagccactgggaggcatcagcacactggccttgccctcagtagagactgaccttggcactgaggcaagggggcggaggatgcagagtgggtaacaggtcctctgccagtcctgagtctgctcagcagtacagcccgattctcgggcttaagagcatgaactctgatagggatgcctgtattctaagttaaattttagttttgttgttggtaaacaacttaatcttgaagacctcagtaatgtatgaggggtttgctttgagacagggtctcatgcagcccatgctggtctcaagtttgctatgttatatatctggccttgaactccat

SEQ ID NO: 20201 - DNA, 1203 bp, Mus musculus
tccagttgtacctttcatccttctttctgtctctgcatctcatccctgcagctggttaaggagattcaggacacttctctttttaccgacgtgtagatgtcggccgcgtagtaaattgcacagatgggaaaaagaggagcctttttcatgtggcatctgatgcagtaaaccggagggggaaagatagaacccaggattggcttttttaaactatacagcatctgtgttcattacggctgcccttattctcctctttgggtcggtcttaatcagcagcagtaatcttaaagaggcggaggttttggttggaaggaggagcagccctccggccttggtagttaaaagcaatcctgataattgttagtgattaactctggtaaagtctctttcttgagaacactgtcacaggctttgtgtattggctcagccctaaaggagaaagagctggagccgggaaacttaccttcttactgaacttgaaggccttacttaccagcctctccattgctgtatgtcttatagtcataggtttcatgactataaagtatatagtcatatatatactatacatagtattcatgggctcgtgaagggatttgtttctgtcaccaaagctgcatcttttaaaaaaatgtagtctgatttgtctttttaagagttcttcttaatcttttaataatttgggtggctgaataattacaatttagacaatttttatttttggagttctttgcctttgaaacttaataatttttttttaagaggaactccctctatagtttaggttcagcctgccatggaattcctatcatcctgctttagcttcctgcaaactactggcaattaacaggtgtgcaccactgtgctagatctgaatcctttctgaaatacatgggtctctccagctccaattagggaattctttacatattttaagtagaaggaaagttaccaatcgaaggtgaaatgcccagaaattacagtattagggacaaagggtgtgcttttggatgtcagtgtccatgttatctttgctttttgttttgttgttattttttgaagacagagtctccctgtgtagttggcctggtagccaggttgtcctggagtttacagcagtccacctaagctgcctttgcctcagcagtgctgggataacagccaccatccccggcttctcttcatgttgcgcattttcgatca

SEQ ID NO: 20202 - DNA, 1178 bp, Mus musculus
taggagggagcctggcatccttaaagaggtcttgttatggaaaatgttccctttggattggaaacccagcatccgctggagtcccctgatgggaggcacccggagatgagaacaaggagactgttaacattaatgaagcacactgagtgggtattcctgcagtctccaaaggaaggcaaatctttccttctcctttttggaaagtgacagttgccatggatgaaatacagatggtgtttgccacccaggacttagagatggcctgtgtcgtcttctcagtccctccctgctgtcctccacataggcaaataaataaagccttttgatcttcagccagtcaggcccccagtaaactgtaaacagacgtgaacttgtgagtgggagagttggcagcttcctccttctctcctgagaaagcatcttattccctgtgccagatgggcctgtacacccatggccgaagcaccccagctgcctcgctagccactgcagactgaatgtctgcctagggactaagagtgtccccttaaccagtgtcaggaatgactgaggagggcactggcaggcggctctgcttaaagctttaaccctgcaccgtccgggcaggtgggaacttggagcctcatgctgtactcttggtgatgtccatgagaaccggctacactctagatttccaagctagagacttggaaagttgtttttccaccctgatccatagagacctctgaaacaggctcccagtggtcctgccccctgcagtagtagtgagggttactcccaggcctggcctagtgtgcgtccccagtgagtgtcagctgtgcttgtggttgtggggactgtggttttatctagagtgaatgctgtagatgacagccccctgccccatctcttcagtagggcgtctaggaaggctggttggcttggcatcctgtcgtcatggcttcagtagggcgtctaggaaggctggttggcttggcactgatgagcccttcctctctgctctccttccctctctttctctctctctctctttctctctctctaggggacactacacagaaaatgagaactgctcactatcccaccccagccgaattggacgcgtatgctaagaaggtcgcaaacaacccactgactataaaaatcttccccaacagtgtgaaggttccccagcggaa

SEQ ID NO: 20203 - DNA, 1237 bp, Mus musculus
ggctttacagagaaaccctgtctccaaaaaccaaaacaaacaaagaagctattactggcttacaggcacagccagctcagttgagagtggggtggatagcaactccagcaggctctgatagcaactccaccgtcctctgcccacagatctacccagacccagagctggaggtccaggtgttaggcttggctatccgctgcatccacagtgaggagggctgccgctggagcgggccacttcgtcatctacaggtgaggctcgggtggggagctagaactaacccttccttggcagatactgactgttatctgtcccaccagggccacttgaacacttgcagcttcaatgtagtcccctgccctaatcgctgcccagccaagctgagccggcgtgacctgcctgcccacctgcagcacgactgccctaagcgccgcctcaagtgtgaattctgtggctgtgacttcagtggggaggcctacgaggtacatgggtccaggctgacggtggaaggagggtgaggcacctgggaccccaggcatcccatcccctaacttaacccctgtggtgatttcagagtcacgagggcgtgtgcccccaagagagtgtgtactgtgagaacaagtgtggggcccgcatgatgaggcgactgttggcccagcatgccacgtctgagtgccccaagcgcacccagccctgtgcctactgtaccaaggaatttgtttatgacaccatccaggtgaggcccttgctgacctgtagtctgtgagactgtgtaccagggagttggggtactgaccactcttgctatttctggtcctagagccaccagtaccagtgcccacgcctgcctgttccctgccccaaccaatgtggagtgggcactgtggcccgggaagacctgcccacccatctgaaggatagctgcagcactgcctttgttctctgccctttcaaagagtctggctgcaagcacagggtgagatgccccttcttcctcagccccttagcccttgaggtccttgacagagcatcagttgctgccatagttgaggcctcgatgggtcctgctagtcaactcctgctcattcccagtgccctccgccattgtcctgttcctgtggaactaggtgcctgccaccccgacctgcttctcctctcccttgggccttcctcttttggtaactttttccttctcccatggctttgggttttgccaacagtgccctaagctggcaat

SEQ ID NO: 20204 - DNA, 1604 bp, Mus musculus
cgcctttaaccccagcactccgcaggcagaggcagaggcaggcagatttgagtttgaggtcagcctggtttacagagtgagttccaagacagccaatctacacagaaaaaccttgtctcgaaaaacaagaaaacaaacaacaaaaaaattaattcctgacaatcacatgaagactcaaccatctgtacagctacagtgtactcatatacataaagtaaataaatctttagaaaaaaacaaaaacaaaaagccaaaacctacaattcccccagagaaaccctgtgtcggaaaaccaaactaaaccaaaccaaaaaacgccacatttcccaagaagccctttcaaagggaaaggtggcgcatgcttggtctcccactctagggaattaaatggaactacaattcccaagaagcctcatattacagttcatccaatcagtgctatatataagctatcgcgagacttttatgagcctccattctataagctcatgggaattgggctgggccatccttttcagccaagatggcgccgaaagcgaagaaggaaggtatgttgcggtatgggaatctgtcaggtcggtcttggatacccgcagagcgaactcgcggggaagaagaatgcccggctaagccatggggggcttgttctgtggctactgtcgcgactaggccccgctgcggggtatgaggaccgcgtgggccaagccgcatgggctggttccagtgcaggggattggcaaagccaccgggccggcagcggccgccactgatggccaagcatttgactttgggaagctccttaacatccacagggtggcgctccgggtctccagacctataagggattaaaagtagtccttattcgccctttccccacgttaaatggggttatacgcacccacgtgatggtacaacgggttaattatctttgcctgtggtatcgtgcatatgatggaaaaaatctgaagtctcctgagacctgtgatgtcttcaaaggaaccactgatgcacatgctggcaggacggccggaaggggtcactttacgaatgccacacttaattttaattgtcctctcccagctcctgcccctcccaaagccgaagccaaagcgaaggccttgaaagctaagaaggcggtgctgaaaggcgtccacagccacaaaaagaagaagatccgaacgtcacccaccttccggcggcccaagaccctgcggctccggaggcagccaaaatatcctcggaagagtgcgcccaggagaaacaagtcagtagggaccctggacccagtagcatgtagtagggcattaggagttcttaacgtagcttcccttataaaacacaattgttgaaggagctggtgcggtggaagtgtgaggttatttagtcagtgtttgaaagttgacttcaaagagatgttgcttatcttggttccaagtgataggggacttgttggaacacaggagagtgttgattaagatgtccaattggggagtgatggccttcgaatagtgttatgaaacacacttttttttttaagatttatttgtttttttatttacatgagtacactgcagcagtcttcagatacactcactagaaggggg

SEQ ID NO: 20205 - DNA, 1604 bp, Mus musculus; identical to SEQ ID NO: 20204

SEQ ID NO: 20206 - DNA, 1147 bp, Mus musculus
taagcctggtccagtgttctatagtgttcccctgaggtttctgctcctcatgtcaggtgagaatgtccgggaattcttcttccgtgtggcagcactaacctttgaggccaatgtcctggcggagctggagaaatccggggctcggcacattgcagatgttgttcgtaagttaaccacctggttaacagtggcagagagcggaggtggggtggttaccttcaatccatggttcatatatttcccatcccttttcaggcatcaacagcgatgacaaaaacctgtacctaactgccagcaagaaaaaggccacatgttgtccctgagcagtgaggactgtccagagacttcccatttccggggtaccgtgctacctgcaactgctccagaactcaacccctggacatttgcactgactttttccagaccaaagagctatccattgatgtcagtgccccccagaaggtgacagggaccatgctagtcatttgctgcccccaggcaccatgccaaagactggatgaccctctgttcctctggggctctccagggtgcctggtgaggggcagtgttcttgctgcttttgctcagcctgctgggcctttcatgtataaaaatgcttaatgattttagccttacactgtgccttatgcattaaagtccattattagcattttctttctttctttaaagatttatttattttatgtatatgagtacactgtagctatctttagacacaccagaagagggcatcagatcccattacagatggttgtgagccaccatgtggttgctgggaattgaactcaggacctttggaagagtaatcagtgctcttaaccgctgagccatctctccagccccgttattagcattttctaggctggagtccttactagagataataggtgtagtgggggcatgtagcgatttggggattggagcccctatggggattctgttcattcctggctcctaaaacagggctcacactggctgacgtctcagagatcaggttttggagactaactatatcttctagattctctgggttaaaatctgagtaactaccctttccttgctgttttctttcctctctgtctccctctccctttcttcttgaggtagggtctcttgtaggccagcc

SEQ ID NO: 20207 - DNA, 1440 bp, Mus musculus
tggtgccatgtggcctgaggacttcacataagcaggtattatgtctcttcttgaaagccaagacctatgaagtgttcccatgggcattggtttctggggaagaatgcaagaccgaggtgggttgcttcctgtaaatgtcaggttctgtctgtgaaggtggtctctcaccagtggctagcaggaaggcttctcaggattccagaagactcctagtctctgagacttaccctttgtgttccaggtccaacagccatgcagctatcgactggggcaagatggccgagcagtggctacaggaaaaggaggcagaacgacggaaacagaaacagcggctgaccccacgaccctctcccagccccatgatcgagagcacccccatgtccattgctggcgatgcgaccccactcctggacgagatggatcggtagggggcctgttcctcggactctggttacctctgaagctcccaagaggcctggccacttatggcctcactccctgcccctcttttttttttgtccataaagtggcgtgaaatgacgttctttttagtggtcagcctggctggatggtggccttgtgagctggtgtgcaccgagcagcagctgttccactccgggcttgtgctaaccacctgttctggggccaggctgggagagcagtatggcagggaggagagcaaaggtggagcagtctgtaatgtctctggaagccctcacctgagacaggccctcatgaggcatgcagctcaattgtctatgtccccagcctgtgtggggacaccgatgctatttattcagtttggggcaggagggaaagtagctctgatcctgatggcaagaccttggctgtcaaagcaggactgtgagggccatgtggagcagtgctgagctgccagcccctgcctgcctgcctgcctgccttccctcatcacctaacctcacctgcttctcgcctgtcatttgaataaacagtgtttgtacagagcgcttgccgaggcctccagctccctcgctctgtagggctgcttcagcagtttgaagctccaaaaacttcctctcataatctaccagagaatccaggattcacattgcctggggttacctcctacctgctctgagccctgtgaccctgtgtggacttcttccatctgttgtttgccgtgttgaagtggagtctctaacccagactggccttggccttacagcagccctgcctcagcctcctgaaggctggaattacataaatgatacacgtgcacttaaggggtttattgttttttttgttttgttttgttttgtttgcttttgagggtttccctgtgtagctttgtttgtccaggaactcactctgtagaccaggctggcctcgaactcagagatcaactgcctctgcctcccaagagctggggttaaaggcctgtgttaccaccactgggct

SEQ ID NO: 20208 - DNA, 1163 bp, Mus musculus
actcaggacctctggaagagcagtcagtgctcttaaacactgagccatctctccagcccccatgcctttgcttcttgagtgttaggattcaggacctatactaccacctctggattaaatgcttttaattttttctttctttcccagtctcatctgtaaagtgaacctatcaaagatcaatagcaaagtcctgaagagtggtcagctggtgagtacgtcagggtgattgtggggcttcatagcctcttgagcatgggtatgaaggagcttagggtccttgtgttgttagattctgtgcctttaaaggtttttcccaaggcaatgctcaaccagtattcctaaccattgtagctttgtttgttttgtgggagacgattttgtcatgtgtagctatggctggcctgatatgtagcccagtctggctttgaactcatggtgggcctcctgctttagtcttgagaactaggattataggtgtgaaataccacactggttccagaccattccaatttgatctaaaactttaaacctcccttcacaggaggatacatgtctggtagagctctcactggccctggacctgcgcctacaggtcagcgtcagcagttggcatctgacggctgtcactgtggatgtgtggacactccatgctgagctgcatgaaggtctcttccatagtcagctactgtgtcatgccccaggccggatttccaaatcagtttcttgttcaggtaaagcctcggtcattgagtttcttggctgctgtagtcttggggattattttggaagtagaaaaaccagtgacttggccccttgttgaggtgtgagtcattagacacaatggcctttgattaggtagagggagaggaaataggtatttccgtgttctgagtcaaagaacttaaacctaatggttactgtgagttagcactgcatgttttatgtatgtttttactatcttttttttttcaaataaagaaacaggcctagaacattttagttagctgacttggctgatgtcttatagttagtgaaagtaagtgtaaattatttgacagttaagtccatatcttctccattatacctaactattcactttactgtttatgcttttagcgttttagagtctgggaacggaagtatatcagatacctgggtctgtg

SEQ ID NO: 20209 - DNA, 1618 bp, Mus musculus
gctgtcctagaactcactctgtagaccaggctggcctgaaactcagaaattggcctgcctctgcctcctgagtgctgggattaaaggcatgtgccaccactgccggacaattttggttttttttttttaaactttgtcttcatatctttctgctgttccttcagaataccattgggaggaacagcaatctgaaggacttcactttttactttgtagctgtggccaggcccaaaactaaactgtcagcagttttgagaactctgttccttgacaggaagtggctattataatgatgtcagtcttatccctgtgtagaaccttccctcagatcctggctcccattatcttcagcacctcagtctccaatgtcagcatttccattcagcttggagatacaccaccgtttgctttggggttcaattccatctccctgggtaaggctcagggatgggaagggaatgaggatttgccctttggttatagctatgcctgtttcatggccacggtgccttaattgactacctccttaccatgtatttcagactaccagcacctccggccacaaagtatccatcagcgagcagtgctaactgtagatcatctctgctggcgtgtgggcagtgactcccacattcagcgggcaccacatccacctaatatgcatgtttggggcgaagcacttgttctggattccttcacactacaggtaggtgggtgctgtgtggtgagtcagggcccacggagtgccctgtcctgacacgcatctgaggctggagtgtgcccttggtgtgggggctgcatcagggtctcctaactgcatcggcatggtttcagtgggtttcctttcttttctagggaagttataaccagcccctgggcttgtccagcacccagtccaatactctttttcttgactgtactattcgaggacttcaggtagaaatatcagacatctgtgcccagtgtctgtctcgagtcctctccttggtgattccacaatctgaaaggtcagctgtctctaggaagtcgtcacttggggagtctgtgaccttactgtggaaggtcgacttgaaggtggaagacatgaacctgttcactctttccgcactggttggtaagtggaacaagaagtctgctgaaattcttcttttcattaaggaagcttattatctgggtagcctccttgttagagggacaaaacgttagaaaggcttggatgacaaactttgttctacttcttagtgtctattgaagaaggaagtatttaaaaaagacacaatgggaaaaacttaaccttggcgtgatcagaggatgaggcctgtgtggtgtgtcttttgatttttttttctcaagacagtgtttctttgtgtagctctggctgttctagaactgaagtagaccaggctggcctcaaactcagattctcctgactctgcctccccatgctggaattaaaggcatgcaaccagctttttattttcttgtgtatagttctggagagtaaatgatgtatggataattctagacactgagaaagttcattgactttgccaggtctagttaggtaagagaagagaaagttttcctaacatactaggaatcacttaggagaagtgtt

SEQ ID NO: 20210 - DNA, 3414 bp, Mus musculus
aagaaaacatgcctcaaacttaaggcattttagaatctactagaagaaaatccaaaagtgtaagtacttacaagtgacagctattaacttagcactttagtgctaaggggaaccaagcaaggcagtagttaatgtagtttcttaggaaggacttatgaattataattcatgaacctggtaggcatgtgtgatagtcctgttccttctactgtcctgagacatagtgacgtgcattcttttcttataccctaaaggttcagtgtggtgcagggctgactttactctggagccccccagatcacatgtatctgtaccaacatgtcagggccactctacagtgccgagacctcttacgagctactgtgtttcctgagattattgagtcccattcactaaacactccacagtccacttgggagccagaagaccatctccctgagtcatccctgcctaggcggctgctcaccctgaccctggaggtgagcactgccaagctaacagctttcgtggctgaggacaagttcattaccctggctgcagagagtgtgtcgctgaaccggcatggaggttcactgcaggcttactgccccgagttggctgctggctttgatggcaatagcatcttcaacttgaaggaggtagaggtgcagcttctgcctgagctagaagagatgatccttcacaggaaccccttccctgcgctgcagaccctccgcaatcgggtttggcttctttccctcggatcagtctcagtggagtttccttatcagtatgacttctctcgaactctggatgaggctgtgggagttcagaaatggctaaaggggctgcatcgagggactcatgcttgggcttctccaagccctgcccctcttccacctgatttactcctaaaggttcagcacttttcttgggttttcctggatgacatctttgaggtgaaacttcatgataactacgaactgatgaaggatgaaagtaaggagagtgccaaaaggctgcagttgctagatgccaaagtggctgccctgcgaaagcagcatggagagctattgccagctcggaaaattgaggagctctacgcctctttggaacgcaaaaacattgaaatctacatccagcgctctcgtcgtctctatggcaacacacccatgcgccgtgcactgctcacttggagcctggcagggctagagctggtggctctagcagatgcatcctttcatgggcccgagcatgtgatagagcaggttcgagaacttgatcctggaagcccttttcctgctgaaggaatggatcttgtcactcagtggtgtcgtatgctcaagtgcaatgtcaaaacttttctgggtaagtgcatcttattggtggagcctggtatctgtcctgtgagtgccagggagctctctgagtgattgcaaaggagctaggtttaggctgtattgggaactacacttggtttgagtagacagctctgctttcctttctttgttcctgatttccaccctgaaactactctgctgacatattaatgagcacaggcttttgtgaggctagtgtggctcttgaatttcatgttctctctgtccctcacctttgcctagtggtctctgtgacctgttttatctttgctacataattgccagcccttgttctctagattgactataaatgggtaaaacaagcaagggggaaaccatgtgtgaacgtaaacaaccagtgttcatctgctgtctaataatagttcggatcagagactatccacggtacctgtttgagatccgggactggcggctaatgggtcgacttgcgggcactgagcagagtggccagccatgctcccgtcgacgtcagatcctgcacttggggcttccctggggtaacgtggcagtagaaagaaacatgcccccactcaagttttaccatgacttccactgtgagtaaaggaaacagttggtttggctgaggggtatttatgggccttgggtagacgataatctgaggaccttttggagcaaaggaagaccagagaggtgtagtaagcctgcattcctctaccctagcggaaatcttccagtacacagtggtgtggggcccatgttgggatccagcctggacactgattggtcagtgtgtggacctcttgactaagccttcagctgaccccagcccacctttgccctggtgggataagagccgtcttctgttccatggggactggcatatggatattgaacaagcaaacctgcatcagctggccactgaggtgaggggctccgtggagtcatttccttgttgggatggtgtagttgggacctgcacagcatgtggggtgtgaagagaaaggttggtcttttgtctgtctgtagctcaccctcgttctttgggctcgggcgggtcattgtaggacccctataatacaactgagaacatgcactgggagtggagccacctttcttttcattggaaacctggtcagtttgtgttcagaggggacctggatgtcaacgtaagaacagcttctaagtgagtagtggagtgaagggtgggggccttaactggatgggggagttggggtgggggagagggaagagccaaggggaacaagtgaccaagtctctgagggctggggctccgttgtgaggcaggtatgacgactgctgcttccttcacctgcctgacctctgcatgacactggacctacagtggctgtgccacgggaatcctcatgatcatcacagtgtcactctgagggccccagagttcctgcctgaggtacccttgggccagctccatgactcctaccgggccttccgctctgagaacctcaatctctccatcaagatggatttgactcgccatagtgggagtgagacttgggcctgggacagtgggaggatgggcttgggtcctgaccacttagagtgaaagagggatgggacagaaggacagaacagagtttaggttgggacctttgcaggaggattggtggttttggactgctgttaacaataaaaccataagttgtgttgcttatgagcagtggatattctcaaagttgtatagtctaggaagttaaagatgcaagttgtctggtgaaggtcctcagctgacccagtgcaccctttgtcatcaatatcataaggtctttgtccttgctgtcagcttcctttatcaattccatcaccttggagtttaggattttaacctaaatatctggctgtcggagtcgagtagggggatgaacagacaaacgtttagaccatggcagtaggtgacagcagagagcttagatccttgaaagaagtgctagggacactgcatatgaggagggtgtgtgggttttgtaatctctaaaagtgaagctagggaagcgcttcctcacctacgtgtcaaccacagcttgaatacgtctgt

SEQ ID NO: 20211 - DNA, 1135 bp, Mus musculus
gcagccctggctgtcctggaactcactttgtagaccaggctggcttcaaacacagaaattcgcccacctctgcctcctgagtgctgggattaaaggcgtgcgccaccacgcctggctgagtaaaagttcttttttttttttttccattttttattaggtatttagctcatttacatttccaatgctataccaaaagtcccccatacccacccacctgagtaaaagttcttaacactttgtttagtgctggctttctccatctttcccagttaagtatagcatttgaaattaactgattcattaaaactgcattaagtgcagttaggatgtaaagtaatgtacaaactaagacgacttaatatttctcgagggtcttgccatttctccctctgtttatagcaagtttgtctctgcatttctgttcaggaatagaggtgggaatgtctgtgtgaccctggtacccttttcctgtttctcaggagctttctgctcgagatggtgatcctgcctttcatacacaccagctgtatttggtagatttacggatttcctggacaaccaccaatagggacattgcctttggcttatatgatggctacaaaaaagcagctgtactcaaacgtaatctctctactgaggccctgaaaggtttgaagattgatcctcagatgtcagccaaaaagccaaagcggggtatcccacctagtgcccaagtcccacctcatgtcagcactcccagcttcagtggacggcctgataagggatcatcaggaggtaggctgggacagatgagactatgggtttacatttagaacgtgaacatgtgcttggaaaaggccttaagaatgactcagttatgactggttccatctcgatacagacacagagatgcaagtgtcatttatttatattcggccatcttgggtttatattgctaaaaatgaggaagctttgaaagtctgtcctgtggccagaagatcagcaagaattggaatcagaagagaaagggaaagaagcagagttaagaatgctttattgctgatgtagttgaacacatttttaatctcagcactcaaggcagaggacagcctggtctgtacaaattctaggccagccaaggctgtagagtgatact

SEQ ID NO: 20212 - DNA, 1099 bp, Mus musculus
gaggcagcaaggactggaaggaggtggaacagctgggatgcgtaagaaggacagaacgtcactgtgcatataggagacttggctgctggaaggagttaaaatggggaaagtataagcctgttctatagcactgtagaagcggagacaagcggacacacctgggttcagttcctgccattgtctggatgtggaccctaggaacaaaaataacaccatttaaactggtatttctatttttattggaaatcgttcacttttatttttagtaacactgaggggaactaaatagcttttatcttatcctttgggtcaagggttggatagagtgaactgcacccgtgttccaggttgaagatgtagctcagtccttacctagacaggaagtaatagaagctcagtgtggtcctgcatgtgttctccttcccttcgagacgctgacctttccccatttccgatttccttgccaggtgcttacatgttgcagaagctgattgaagagacagacagatttgtagtattcacagaagaggaatccggtatgagtgaccaattgtgtggcattgctgcctgccagacagatgacatatacaaccgaaactgccttattgagctggttaactgccaggtatctttttttaataggaaaccagtacgaagatagatcccaaataaaaatgtttacttccctatcatttttttaaaaatacaaaaaaaaaattaggattctacaagttggatgtggcggctcacacctttaacccaaggaaggctcttgggaggcagagccagggggaatctttgagtttgaagacaatatagtgagaccctgcctcaaaaaggggggctgggagggggtcccactgtgtggctcaggctggtctcaaacttggctgtctttgccttggtttcctgagtgctgagggcttgttattgctaaactcaatgtttctccacgtataactgaagaatgggtggcgagaactcagctttgtacctttctgtaggtttcctgagtaacacttccacgtataaaacccaataaagcttgctctgtaagctagagttagcagtgatctgaatacccttctcagcccccttt

SEQ ID NO: 20213 - DNA, 1095 bp, Mus musculus
tgtgaaagtagttatttcctgcatggttttaattaaaggggttcctgtgcgctattgatactaacatttgcttggccgttagtaagtccggccattagaacagcctgtgctcttagaggaaactgggacagtggttattacttaggactctgaaagaagtctatttctactcctgcgtgcctcctcttccctttgtgaaggattgactaacatgagtggttccacatgttcgttaggctgggtatggtggtgcacaactttaatctccacaccagaaggcagaggcaggtggagtgagttccaggccagccaggactacatagcagaaccctgtctcgggggaaaaaaaaaatatatatatatatatatgttaggagattgaatatttaggggagaaacctgaacctgttatttaactgcttacaattctgtaggggctgtggatacttttactctcatccaccacgaattggaaatttctaccaacccagctcagtatgctatgattctggacattgtcaacaacctgcttctccacgtagaacccaagcggaaggtgagcgtgagcctttctagaattcaggttagactcacctgaactttgatcttgccgtttacttagatcccagttaagtaaagtagtgctgggctggtgagatggcagagtgggtaagaaagaaactaatacctcaccctggaaggggcttatgattggtacatcttctcagtcaattacagctgttggaattcctattgtttatgtttacgtgtcccaagactgtatggcttgttctagacaggtcacctaaacatcactaacagtggcacctacacatttttgcctccatctctaccctgtgggtctagcttatgaaatcttaggaatgtggattgcagatcttttatactgacctaccccttattcttgctactgcgtgattggtaaaggtcagctttccagaagagagcaccattcacttttctgcaagacttaactttttaaaaaacatgaattcaaggggctgcggatattccttccattagtaaagcctgtgcttagcatgtgtgaaactgtgggttttattcgcagcacca

SEQ ID NO: 20214 - DNA, 1156 bp, Mus musculus
aaagttaaagatatagaaatcataggagttagtgggaaaacagtgctttactaagaagccatagaactaaaggacccatggccgggtgtggtggcgctcacctttaatcccggcacttgggaggcagaggcaggtggatttctgagttcgaggccagcctggtctacaaagtgagttccaggacagccggggctatacagagaaaccctgtctcggggaaaaaaaaacaaaacccaacaacaacaacaaaaacctcaaaaaaaaaaaaaaaaaaaaaaaaaagaactaaaggacccatagctcagggtgtcagaaacaagacatgggggggggggtcgttattaactaagccagagtaagttggtttctgggcttacagggcactccggctgtgtgtttttttccttacccctttgaatcttctattcatgcatagatgttttaaggatttccaactgcagcgagccaataaaatggagcttcgaaaacaacaggaagatgtgagtgtggtccgtcgcaccgagttttactttgctcaggcacgttggcgcctgacagaagaagatggacagctgggcatcgctgagctggagctacagaggttcctttacagcaaggtattagggtggcacagtcacagcagcagccaagtctcaggcgtggcctgattcaatccatagagaaaaaagggggctaattgtatttattaatgatggtcatgattggagacacatcagcctgtaataaatgatgtagttatatagataattaaataaggcccagactgaagtaattaccaagttgagttggaatagtgctgttctgatactgacagcatttctgtagttgcccaaggagaaatattccaattacaaaagatattgaaaatgaataagaaatttaaatgccacaataactaggaagttacttaaccgttactggtttagctagttttacttagaagaaacactggtttagagggtatgttggttgcatatgagattgaaagaggtgttagcagggtgtgatggtgcttatgtttaatcccagcattccagatgtgaagttaaggagggttaggaggccaaagctagccacaggcacactttgaggactagcctggactttacaagatcctgatttacagaggaaagag

SEQ ID NO: 20215 - DNA, 1176 bp, Mus musculus
catccccacatttatacagcaagacttatttttccatccctagccacttagcttctgaccagagggagggcattgtgatttgagctggaacagcttgcctagcttagcaaagaccgttgcttcagttccctcttgcttcaattcttctacagaagacctgtgatttacttttaagttgtttttttaagagatgtatagttgagttattggccgctctatcctataggtggttctaaggccccagagttcctgccagtctgggagacagctagccctccgcctcttcagcaaagtccggccacctgttggtggtatctctgttaaggaacactttgaggttagtaaacaatgccttgggaactcttggtcaaaggttagctcaaaactaactagttataactgttaaactagttagtaatcaaagacagggctagtacttgagcttaattgtttcttcacctctttccctctcaggtaaatgtggtgcctctcaccatccagctgtcccaccggttcttccatagaatgatgggctttttctttcctggtcgaaatgtagaagatgatgaagttggtgatgaagaggataagtccaaactggtgactactggtaagaattggttatgttggaatgccaggaatatggagtggcagcctaaagcagcttcaggaagagagtcactgttggtttgcatgctttttcacaggaataccagttgtaaagcctcggcagctgatagcaacagatgatgcagtaccactgggctccgggaagggcgtggcacagggcttgaccaggagttctggagtcagaagatcatttcgcaaattacctgaggtatggcatatgaaaatcagagaacctaaatgtggtggtccactataatttcaacacttgaggacaggagctggaagataagtccaagggcagcttggactgtatgagatcctatctcaaaaaaggcaaaagaagcctagcatgggggcacacacctttaatctcagcacttgggaagcagaggcaggccaggaatgatatacaaagaaaccctgttgctaccaaaacaaaacaacaaaaagcaaaagaaacaaaaaggtaggggctggtgagatggctcagtgggtaagagcacccgactgctcttccgaaggtccagagttcaaatcccagcaacc

SEQ ID NO: 20216 - DNA, 1676 bp, Mus musculus
aagggacagccgaaaagctctggttgcccaggtatctcgccagggctcatggctgtttcgttagcagggactggcaagcacattgcctttttaagagccttctcttctgtgctgtattaagagatggccaggaaaggggcagataatgactgatctgtccttgtttgtccatgcctttgccctggtatgctagtgactcattaattttgagggaattaagggcttctacaacatcagctttatgatggttctgattagattgtaagcttcttacaagcagactattatctatatactttgaagtgcccttttgtgtttacatataagcttaataaatctttgaattggttcactttaaattgtacaccccgtttcactaatttttcctttccttttattcctttccactgccaggtaatcaaagaaaaactaaggctgaaacctgcaacggggtctgaggtccggggaaagctagaaacaaagtgtgacctgaacatgcaacagcaggaagaagagaaagctcggctcctcattggtttaagtgtgggcgacaagaaccctggcaagaagtccatcttcggcaggcgcaagtgatgtggagacccaagtgactacagtatagaattgactctggctcaggatccagggacttgagggtgggcagagcttcccttcatcctgcaggatttgtggggcatatgggaactgagagacattgttcaacagctggcctgtccctgcagggcatggtggacaaagcgctgggttccctctcatgggattagacccagggccacaggggcaagaaaaccagaagacccagggattgtgtccaagcctagtatcctgctctttcggggcaacagaaagggttgggggatagttttgatcaagtatgataaatttttataaagatatatatatataaaacatatatatatatttctaaatgtaattgctctccctttgtgccaataagctaagggaaggagtctgatcctctgtgcctcactccactgccttgttgtctaagaggtgttgggtttgggggataaacttcccagtctgtgctcacttgggaggatggcattaggagccagggctggccatgggtaccttactttcctccctggggtatgcccaggagaatggagaaaaaagagatttaaagaaaaaatattttaaatttgatgttggccttttttaattgtattgagtaaaagcgttcaagttgtctgtgtccttccctcctcactaacccaacacattttttaactgccccagtaatgactggtcttgtctttctcctctgccttgaagtcttaccacaatcacatatacttcccagtttgggtatgatgctgacctaaagctgatgggtctgtgtacactggaagaggtggggctcatgggtaatgcagcatcagagggaggaattgcttatgtaacttggacaacagatttagcagcgcgaaaagaggcagaggctggaaatgggagcagtaagctgtcggcagggacaacacacccgggtgtctgctcctcagaaggtagggtatggggctctggtataggctctggctgcctatgggagggaaatgaaagatgtaggggcctgaggctagaaagtgcccagttaggagactgtcactgatatccattgttggggtgggcat

SEQ ID NO: 20217 - DNA, 1186 bp, Mus musculus
gtaaaacttgtcaagagaggagtttgacccactgggttctttaaagacattttgtagaacttacttgggaaattgtcctgaagaaattgctatcatttcctcttcctatagggagaaccaggaagcctaccattctttcaaaatatgaaagtttgcttttttttttctttgaccatgattttgttattttatggtgctgggtattaaacctaggtctttgtgcttgctagatggatactacactactactaaactatacccgcaatcctatttcattaactttattctgtctttagtaactcaagatttttgtttgtttggttggctttggttttttaaaaaatatttatttatttatttatttattatatgtaaatacactgtagctgtcttcagacactccagaagagggaatcagatctcattacagatggttgtgagccaccatgtggttgctgggatttgaactccggacctttggaagagcagtcgggtgctcttacccactgagccatctcaccagcccagctttggttttttttgagacagggtttctcagtgtagacttggctgtcccagaactcactctgaagaccaggctggccactcagagatccacctgcctctgcctcttgagtgctaggattaaaggtatgtgccaccaccagctggcattcctggagtgatctctgagttattctggtgtaactctagattctgagagcacttgaaacatttcccatcctctgttcagtctctcctaccccccactctttctctcttaagagttatctatttattttatctatacgaatacactgtagctgttttcagtcacaccagaagggggcatcggatctcattacagatggttgtgagccaccatgtggttgctgggatttgaactcaggacctctggaagagcagtcagtgctcttaaccgctgagccatctctccagcccctaccatatctcttaagatgttggttggaattagaaaaggacgtggcagggtcatagtcaaggtagagtctcccattggcataaatagatttgcttagtctgtttatactatgggctgcatcccctatatgtacgggatgcataaggatccaaagtggtttcctatctttcttttcctactagtagttctgtgtagtaaccagcaaggattagctaacttctt

SEQ ID NO: 20218 - DNA, 1748 bp, Mus musculus
ccttcagctgtcctggcccaggatttctctgtcgatcatgtcgatccaggggaggaaaccgtagagaacagagtcctacaggaaatggaaacgagcttccccacattccctgaggaggccgaattgggagaccaagcacctgctgcaaatgcagaagccgtctcacccttgtacctgacatcaagtctagtggagatggggccccgggaagccccaggcccaacagtagaagacgccagtaggattcctggccttgagtcagagacttggatgtccccattggcctggctagaaaagggtgtgaatacatcggtcatgctacaaaacctccgccagagcttatccttttcttctgtgcttcaggatgctgccgttggcaacacacccctcgccacgtgttctgtgggcacttcctttactcctccagcaccactggaggtaggcaccaaggacagtacttcagagacagagcgcctcctcttggggtaagtgacctctaagcctgtgcctctggggctccaatattgtgcacctgccactcgaatctcttccccttcctgtcatcttttcttcttttcctgtggtagctgccgtcctccagatctggctaccttgtcccgacacgacttggaagagaacctgttgaactctcttgtcttgctggaagttctttcccaccagctacaagcctggaagagccagttgactgtccctcaccgggaagctcgagacagtagtacacagactgacagctctccttgtggggtaagaagctgctccatagaacttggaggatcccagtggaccctctgcctcagaaactaagctgagaagctaccagaggagaaataggatgccttgatcacaggcttagtcatagcatatttgtagaagctgagaacttgagccacgtgtggtggtgtatgccatccaaggacggaactgaggtaggatgacctcaaattcaagggtaaacaggactagagagtttgaggctagcttgtctgttttttgtttttgttttaaaaaagctaaagattgctgggcaatggctgtgtacatttttaattccagtactcaggagataaaggcaggtggatttctgaggccagcctgatctacagagtaagtttcaggacagccagggctacacagagagactgtttcaggaaaaagagaaaaagctgaaactctggacatatcttaaaccgtttggcatttcctggactgagtacatccagaccgtccaaggcaagaaatgtaagcagagatcttcatttctctggagctcagaattgaacccagagcctctgtgtgctaggcaaatccagagcagtatctttagcccaaagcagggaagttttataagaatcattttctttttttttttttggtttttcgagtcggggtttctctgtgtagccctggctgtcctggcactcactttgtagaccaggctggcctcgaactcagaaatccgcctgcctctgcctcccgagtgctgggattaaaggcgtgcgccaccacgcccagctaagaatcattttctaagtcattatcttacagatattttatttactaattattttttttcctatttttcctttgtcagttctcagcccctcttgactaaggaagagcatatttatacttcctgttcccataatttatttttggtttttcaagacagggtttttctgtgtagccttgctgtcctagaacttactctgtagaataggctggcctta

SEQ ID NO: 20219 - DNA, 1202 bp, Mus musculus
atggacaagtatctgagccatgtaagcagttctgtttccttccaccacagaagcaccctgccatatatatttcctctgttctctctagctgtgttctttacgtgtagggttcatgaagcctgtttgcattgtagaggcacatcctggaggagaatcttcggcgctctgacacagagttaaagaaactcgatgacacaattcagcatgtctatgaggtaaaagtgaaggaggtagtgggacctggctgccggaggggctgaggagcatggctccggttctcagcctgactacttttttttttttttaaagatttatttatttattatatgaaagtacactgtagctgtcctctgagggagtcagatctcattacagatggttgtgagccaccatgtggctgctgggacttgaactcaggatcttcggaagaacaggcagtgctcctaaccgctgagccatctctccagccctcagcctgacttcttacagtggcttcattttcacttttccagcatcacaggccaggagctttggcttcaggcttgtgattcagaactgttttctgtctcttcccagactctgttgtctatcccagagactatgaagagttgcaaggagttacaaggattgctagaatttctgagctaagaaactgaaaatattggaatgcagtggtgtgcacctgtagttccagctgctccagacgccaaagttggagtgctgccaaatcccaggaatttgggaacctaacacagacaacacagcaaaaaccctgaaaaatgaattccactccactccagtttccttcagggctctttatcccaacccttatcccaataataagaccaattggcatagagccgaccatgttttatgttatttaaataaagtgtatttaatgtagtccttccagtccactgaatcttattttgggggtaggagtgggcagatcagcacttcagcctaggcacccttcaccacttcctgctgcagctaaagccaaggctgactgcttttctttgcttgattctcttcttctaccaacaaaaaaagggggtgggggggagggcaatggactgcctgttccctggaccactgcctggggggaacagaaaagactccattcacttactttccccatcccccttgggggtaggcactggtaaatatggggcagagcacagaaactcaattccattatt

SEQ ID NO: 20220 - DNA, 1213 bp, Mus musculus
acactgaggaggcagaggcaggtggatcttttgagttcaaggccagcctggtctacagaatgagttccaggacagccagggatacacagaaaagccttgtcttgggagaaaaaaatgaaaaacagaaaaaaaaaaaaaaagctcactacaagcccagagagtggtgcaaccttttagctgatggtaataggccagattccttaagacaggaaccagaactgggcttatgtaatggtgcatgcttataattccatcatttggaaagctgaggcaggagaatctcaaattttagcctgagttatgtcaagaggctatctcaaaaaaaaaaaaaaaaaaaaaaaaaagaaagaaagaaaaagaaagaaaaagaaagaaaaagaaaagaaggatagagtgcctttatgctttcttcactgagccatggcgctccatccctctgtccccccgcacaggacatgatgagctacattgggcctgagaggacggcagttgtccgggggctgatccacagggaagccttcaacatcatcggccgtcgcatagtccaggtcgcccaggccatgtccttgacggaggatgtgcttgctgctgccttggccgaccacctgcccgaggacaagtggagctctgacaagaggcggccgctcaagtccagcttaggtagggcttgggctttgttttaggaagggagaagacgtgagtccggcggaagatttacttatttatgtgtatgagtgtgttgtctgcgtgcatgcatgtgtacggcatgcatgcttggaggtcagaagagggcgtcagatccccagggactggagtgaagatggttgtgagtcaccatgtgggtgctgggaattgaacctggatcttctgcaagaacaaatactttaaagctctaaaccatctctcctccctctgttttttctttcttttttttttttggtatttcaagacagggtttctctgtgtagccctggctgtactggaactcactttgtagcccaggctggactcgaactcagaaatctgcctgactctgcctcccaagtgctgggattaaaggcatgcgccaccatgcctggcctttttctttttttttttttttgagacagggtttccctgtgtagctctggctgtcctggaacttgctctatagatcaggctaaccttgaatttaagagatttgccaatgtctgcctctggggtgctgggatta

SEQ ID NO: 20221 - DNA, 1555 bp, Mus musculus
ctgctaaccccatccctcaccctcctaggtatatagggctgtggctgccgtccagaaggcagcaaaggccttagcccttgggcacctgtcgtccgcctttgctgccagccaggaagccgtgacctcctccgagcgcgccttttttgacccctccctcctccacctcttgtatttccccgacgaccagaagtttgctatctacattcccctcttcctgcccatggctgtgcccatcctcctgtccctggttaagatctttcaggaaactcgcaagtcctggaaaaagcctgagaagatagactgatccgggcagcatgtcagagggagccctcctctctagccacgctgggagggtgttgggccaagagaccaaggcaaggtctgctggtgatgacatgtcttcactctcgcccgtgggctctctacggatggcactccacgatgggctcccttcccctcctagtccactggcttgctcctccatgcctacaagcctcagaaggtacccttcctgatctccatatctggctcgaacttgaaagcctttgtgtgcctacctctggacaggggtactttgtccttgcagcctgtcagcacagcatacaaacgcactgagaggtgaatttaggggagtacttgagttgaattgtagccctgtcctctccacttctgagaccacctccctccttcctcagcttcttgactggcgtcacccactggggacagcctggtctaggaggcagtggcttaggatcttctaccttgtggctaaggttcccctctaccctttcagagaggtagtgtggaacaggagaaaacatttctgacttggaacccaacaggcctgaatcagactccggcttctgcacttaacagactagagagcatcagctaagccgctcctcgctcctcacctgagcctcaggtttccattggtgggaaagcactgatgatgtcaccctcagaaaggggctggattaaatgtgataagcctgtaaaagtgttctgtatattgggctctttaaaaacatacattagactgttattaaacgttggttgaatatgagttgatatggatgaccataactcgttcttgtgtgagaagcagactgacctgttctagctcaccatgtgttcttcctgcctcccgtcctgagcatcctggggacggctcgacacctgggctgtgctgcctgcatgttgtagggtgcctgcggattgtagggtgcctgaagcagcttttagcaggagttctagtggggagtagcttgagccagtgacagccctgggatagcaactcaattcaacaaaggaaaatactgggtgggtactggctgcaaggagctgtgtggtagtgctagggtgttacgaggaacagtgtatagagcatctctgctttcatagagctgacctttgaggaggaagggtcagggaacaagcaagaatttcacttaatgtattacaaaaaaaaaagggctggttagctggaaattgagaagaagtactttagaactgggtgggttgagacctgggctgaagtcaggacaaaggtatc

SEQ ID NO: 20222 - DNA, 1230 bp, Mus musculus
agtggttcctctgtccctgcctccctctctcccagttctgaagtccctacagggtctggctcagggtcctgacctttgccctggatgggcctctcttgcagtcagtgagatgattcgtcacccgtatgagacccagtctgacagcttctacttcgtggatgaccggctggtgatgcataacaaagcagactattcctacagtgggacaccctgacccctaatgctgcccctgaggctctggcctagaccctgtgctgtaacctctccgacatcatctccacttggggatggatccggtggctctggaccctgagtcagtctcgagaggaaaggtgtccagcatccctaggcaaacctctggagctagtgggaggggcagcagggggaggctggctgtccccatgttcaggaaggcctcctgcaagaggaggactcctggatgcctcgctaggtccactgggcctgagtttcagagtagtgcccccttcttgaccgtgactagatcaggttagggaccatttcctgtcccttgcccaccacctccaggctatttatagttgtcggttcacagacaaagatccacagtgggtaccctgctctgagccctggcctcctccatcaggggccaagaaactacccgaggtgtgagaggggcgggtccagatcgcagcctgtaagacctggacaaactgtatatagttttcaataaaccttttctgttcttgggtgcggccagcctgtgtgtctatagggaaggtaaggggtggagtggagtgagaggggtttgtcttagttgctttttatcatgacgaaagtacatgagaaaatcaacttaaaagaggcaagattttcccttcagttcagaggtttcagtccatggccaccgagtgggcctctggtgaggcagagcatcatgggaaagtgtgcagaggtagaaactgctcacctggaagcagaagtggggggggtgtattaagggggggagagggagaggaacaagatactccttgcaaacatttgttcgtctccctcatccaagccctcatggtcacctcagtattgccactggctggggacctaagcctttggggcaatgcttatgtccagccatactgatcaagagaataaaaccccccatgtcccagggcctctggccagtggcttttcctggcctcagattctcaacatctaagtgagtatttagggcatggttcaagataggactcctcc

SEQ ID NO: 20223 - DNA, 1175 bp, Mus musculus
tacgccaatgggtctgccttaacctgtccccagttcccgtgccctactgtgactcctgatttagttccctgcccttaaaggaatagctcctctagatgccaccctgactgaggcaaaccagactgttctcaggcaatggctttcccggctgccactctgtggcccacttctaatccagagatgccaggcacaggttagatgagaggacactcctgtgtcaggccctgccatcaggacccagctcccatgcagaaccatgtccctgcttagttctggacatccaagacaggggaagaacatttccccatctcctgacctgagagcagccagcttgagtaaggtgaggttgccagcctcccataagggtcaatacaacgcctggatccccaaacctgtgctcaggaggaagctggggctgagaatcccccaaggctatctactcacattgtgcctggacccgggctcacctggcttcctcctgcctcatggccttgctctgtaactacctggtaccccttctagacttcctttaggcagcctcctttggcatattgggagtcagggtgtggctgaactggacctctgcctggccttgttgctcctcctggtgcaagaaggggtgctttgcttatgcaaggagaccataagagctcactctagcccaaacctttgtgcgtgcctaaggctcttacctagcctgctccatctgacttccccagctcctcacccacacagagcttgtcacccacctgctcagggaagccccaacaccaccagtagcccgagcagaacctgcaccatgggaaaaaggcaagccatccacaggcaagggctaattcctggggcagtttctcccaccgaagtgtgtcaaatccattgggaatctcatcaaaattcagagcaggccacctgggaagcacctgggcctctgcatttttcagattcccaggagagctgatgaaagagagccctcactaatccagccattccaaacacccccaccctggtccctgatcatcacaacagccttttcctctctccagttttacagagctgagtggctgagtgatgggatcaggtccccaagttattggtggcagcctcaggatcttgccttagtcctggtacccagatctgttctcctgagactcatccaagaggctgtggcccatgct

SEQ ID NO: 20224 - DNA, 1240 bp, Mus musculus
taagggcaatggaaggagaactgggcgagctgtaactggtgtttcaccatcagagtctggaagaagtgtggggagccccagactccattgcccatcacagactctcagtcaacccacaatgctctttgtattcagctccagttagtcagaggaccaggtcaggttctttggggagcctgtctgctgtgaatttccttggggaggagtagaggagattcagacagtgtttctgtaaaactaaaaagactgatctcagtaacttctgaatccagtgcccatcatctgcctttgctggtccattttggggtctactgagtctggtttttctcataaaagtaagtagaacccaggcctttaccccaaatggactctactgccttgaactggcccaatagtcagaagacaggcatccatagaagaaaaaccagttgatacaggatggtggaactagaagccaggcagctaactctgtagaaaaggaaatggtatcaggccattttccagagcttatatggcctgagagaaatcagatgatcagtatggccctcatgttaaaaggagccaaagatgtctgcattgtcctactgtcttgttacgttacactgttcagaacttagataagttaaagaatctgtctaaggcacttgaaagatgttatttattcaataaatatttatcgtgttcactgtatttttatctttggtcttaaaacacaaagcacaaaaacttgcataattctgtgaattgctcaatatctgcccttttgtttgtgacagggttttgctatatagttctggctgacttctgcctctgcctcctgggttctaggattcagacataggccatcatggctggtcttgggggtctgtttgtcctgccagcctgcccacctgcctgctttccctgtgtatgtctgactgtatgtatgtataccgtatacgtacaggagcctgaggaggtgagaagtggaactagagttgagctattgtgtgggtgctgggaattgcacctccattctctgcaagagttgtaactgctcttacccactgagccatcacttcagcccctcaagccctctggtcctaattgtgactttgtttcttagaagtgcgctcatactgttttctctcttcattttgtaaaatatattttacatcctgaggtgaatataagtacaggaacacatgtgccagagttttcacatggagatcagagggcaaccttcaggagtccgttgttg

SEQ ID NO: 20225 - DNA, 1213 bp, Mus musculus
tcaaatcccagcactccagaagcaggggcagaaggatcacttcaagttggaggtctagtgtagtgatactcttaaaacacagtaagaagcaggcgatgtggctcgactggtcaaggcacttgctgaggaagcctagaagtaaaggtgaggacagaactgactccagagtcacatagccccaggtaacccaatgcctctgacttccttgggtccctgcactcaagtgcatggtacccagatacagatccacacatataactaaagtaaaacaaatccttaaagcagacagttataatcagtggctctgcgctgcagtaagaggagggcagggcaaggaaagttccctggaggccaaaggtgatctgaaaggttggggtcagcctggtgacaggcatgagaatacttcagtagtttgagggcaaagctggggagactgctgtagttgcttctacccaggccgctatggtcggggcccacttggatggatcttcgagacagcaggctcatcgagatctctctcctcctagctattcctccatagtgtttttggctaccgaggggtcgtcctgtttccctggcaggccagactgtatgaccgggatgtggcttctgcaactccagaaaagtaagtttctctatcttatctcatggtgtcctcaggtggcctgacttgtggcagacacatgcagttggggtaaaaacagcatcccttgggctttagaaataaccccaagccaggcgtggtactgtacactttaatcccagcacttgggaggcagaaacaggagggtctctgagttcaaagccagcttggtttacagagtgagctccagaactgcaaaagagccaggcctttgtagagagaccctgtttcagaaaacaaaacaaacaggaacaaaacaaaacaacccaaccaactaaaataaaggaaataatcccagagtgtttctttggcactcatccccatggagacaaaagtgctatggggtctctgtgggcctccccagaactgtctgtccttcctttttataatctgaaccccagagaatgttttagggaacagttttcttgatttattttcttacttttttttacttcttttcttttaaaaaagtttgtttttattttgtgtatatggatgttttgcctggaagtgtctgtgtacagtactcagggaggccagaagagggcgctgggtcctgagactggaatt

SEQ ID NO: 20226 - DNA, 1925 bp, Mus musculus
ttttggctcatgccaacaataacaaaaacacctgagtaagctgaacttgtggtcagttcagcaaaggccctgggatgagcacagatgggtgctattctttgctgtgtggcactatctggtttttatgactcttagttccttacaatttgtggcctaaggacttaggtcccaagacttgagactgaattgctagtttagttgggttcccccttaatcttgagtgtggtgggacacttctgtagcccagtggccgtgcttactgtgtgtgggcagaggttcttgggtctcttagattataaccccagctcgggctccatcagaggccatgggaccacacagttcaagaggcttcagttcagaccttactccctctaaacccgcttctccaatcctcaggggcacatttcgttttgagagaccggatggctcccactttgatgtccggatcccaccattctccttggaaagcaataaagatgagaagaccccaccctcaggccttcactggtaggccagctgaggcccaggttggccctaagaacaacagctctcaacccataattgctgcagaactctaaacctctccctactgtgaaattctttttttggagggagattgtaacttttcttggaagacccacataagactcctccaaggttggccttggccgctgtccaggacaccacgttccagcaaagctgtcagggaactgttcagttgtcccatgttttctggaatgtgaggtgtggtcaataaaccagtgctcacttggccaccacggccatttttgtctccagggtctcaggcccccttgctggccctttaggaactcttagttgcttttcatgcaaagtttcttctagggagctgctggccctgctagggtgcgccttcctcagaggctggacatcttggggcactggtaacagtgagcagcactggactaagttccgggtctctctaccctccgcccagtgtagaggaggccagtgtagagttggactgacctgactatagacacggattacccaccagcacttctggcttcactaggcctggagaagagtgaggcaaaaccagtcaggtttctgggaactgtgggcttctgagcattgagcaaagcctgtcaagcatccagaccacaggggcaggaattcagccaagaagcagcttaagttatggtcagtgaccaagtcaagctgcttttggagcttctttcaggccaacaggagccagagaattggactgcattttgccccaggtcttaggattccttcaccactatagttactgttagaggtcctttcattcttgcattattaaatctcagttctagtccttctgagtattgttcttaatcttccaccagggggagtgtgggtctgtaggattatagaggaatgagtctcttgactacctagaacacaaggtcatggagggaacagaaataaaagaactgagcccacagctgtgagctggccaggctctgctcactggaaacatggctcagcagtgtaaaacaactttattagaagttagtgtttacttccatcacttaaggtaagcaactgagaccgcaggtatgtagtaaagggcacattctttcctgccagaacctgtgttacccttcaggccaaccagtcacatgtcccaggttcaacagcacacagctggtgtttgtgagcagcgtccagtctgaccctcatgcatgttttatgtttaagtcccctggactgcctgtgatcaaaaaacccatcctgctacaactcctttaggacagggctggtaaatctcacgagtccagatcacttcagtattatttccttaaaccaaggagaaattttcagtcaaagaagatgaatgcccaacccgggactcctgctatgtttcctcagcccatgactagacagcactgaacagcaga

SEQ ID NO: 20227 - DNA, 1965 bp, Mus musculus
actttgtatgtctatcattcaggggaatctattctgccttgacccaaagctttttctgacactgatcccctcctgcacaatcttaaggaaaggctgagacaggaggatcacaagtttgagaccagcctgtgctatgtagttaaaagttccaggccagcctgggctacataggctttgtttcaaaaaaaaaaaaaaaaaaaaaagtagactgaccagctttggcttgtcagcctgactacccaaagaataccaagagggaaaggacgtccaagttgaaaatggttttaatagcatcctgtggggaaagggtagggtcacatcactgactcagacttaacaggattctttggtgtgagcctcatacttgggtatgttcagctctaagacacagatgtgctgcagcccctgatactatgtctcagtttatgtcctggttctgcctagtgatgcatctccaaatacatagtaactaggaccacctaagcctttgaaagacctttcttctgggtcactgaccacggatgtaccaagatctagacctggtgtcaattcttcctttgcgctttggtttccctccctttctttgttgggactggctctcttacctggattctatccagaggaatgttgtcactggagggggctgtttgtaagcctaaggaagtgtgtacccatcaacagtgcccaagaagggccacagattatcagctgtatcccttgactactcttatgattgccacatgggcacacaaaggctcacctcttagagcctatgggcagatgccaagcccagggttgggctctcacaaggatctagcctgacagggcaaggggaaatgggaaatgtgacttaataatcaggcatgttatgttaatcacgatcttgaatgtataaatagctctaagatgcttgggtcaggcaccttagtgacgagcaactattagttcgtccagatctcgctggaactaagatgacaatccaacttttttggccaaatagaggctttggctttcagtctttcccacagactttggaatgtgacagcatgaggccaccaatctgttttctcagctgtcccctagaagcctttaacactcagattctcagacccctgcggtgtttccagtttgtctctttaccgccacaccccctttagcctccatgaggcgctttgacatccatctcctctgctgttcagtgctgtctagtcatgggctgaggaaacatagcaggagtcccgggttgggcattcatcttctttgactgaaaatttctccttggtttaaggaaataatactgaagtgatctggactcgtgagatttaccagccctgtcctaaaggagttgtagcaggatgggttttttgatcacaggcagtccaggggacttaaacataaaacatgcatgagggtcagactggacgctgctcacaaacaccagctgtgtgctgttgaacctgggacatgtgactggttggcctgaagggtaacacaggttctggcaggaaagaatgtgccctttactacatacctgcggtctcagttgcttaccttaagtgatggaagtaaacactaacttctaataaagttgttttacactgctgagccatgtttccagtgagcagagcctggccagctcacagctgtgggctcagttcttttatttctgttccctccatgaccttgtgttctaggtagtcaagagactcattcctctataatcctacagacccacactccccctggtggaagattaagaacaatactcagaaggactagaactgagatttaataatgcaagaatgaaaggacctctaacagtaactatagtggtgaaggaatcctaagacctggggcaaaatgcagtccaattctctggctcctgttggcctgaaagaagctccaaaagcagcttgacttggtcactgaccataacttaagctgcttcttggctgaattcctgcc

SEQ ID NO: 20228 - DNA, 1583 bp, Mus musculus
cctcgtaggtgtctacgccccctatttaataatccccctcatactcctcctgttcatgcttcggaacccgtactacaagtatgaggagaaaagaaagaaaaaatagggacggccaccagcctggtggggaagaccccacagcacagttgccttttggacaacacaggaaaactgccccaaacatgtttcagcagcatttgaaacaccaacagcagtgcatacaaacaagacagtggtgggagacgtgccaggccttcacctttcagcaggggtgtgaccaagttacagcaaaatggtgccaaagcgctaccacagcactgctaaaaaggccaggtgggaagccggttagctcctgacctggaatgcacacacctgaccaagtcctcacctcgaccttgatagtcaacaaatgagcagtattttgtctctttagcactttttaacatggtttcctgcccacacctccacctctgggagaaaaatatattatagcctcacatgagtccaagccagaaatgggttacagggaaggaaggtgcctccatttctatcttgaacagatagcctgctctgggttattctggtgctggttctatgaacggctctcatgtccctactctggcacctcaccccactgggcttcctagtacgcaggcttgtgagggtgactggactgtccagtgtatgtctgctgcttgttccactgactctacagaaacaaaacccggtgggtgctagacagtgctggctctgcttgcaagccatgttgctgtggttgttacttatgtgtctggtccaaataaaggcagctgctgatttgttgttagcctggtttgttgtgtggatggggggggggtagaacaactctgttctcagagggactggaaataatgcacacagcaccatagaagaaagaccaagccacttgcaaatggtatttattgcttttccttgagagctttgtgaatgtaccaaagtttacagacactgagtttgtgctgagaagtcgagctgaagccctgtgctgcctggccactagcagaggctgtgcactgtttatcagctgcccccgtaacactgcatgcgcacatcagtgacatcactggaatggtacagaggtttgtttttttggttggggtgcttttttttttttttttttttttttttttgccttcctgctataaaactgaaattttcagttcatttctgaaaaataaattggtcaataaattcattttgttctgcttctactttacacaaagcttcatattcaacccgatacctgaaaaacaaaattgttagaagccctgaaaagaatgaaataaaaacataattctttgagtgtatagagctttaaaacagatgcaagaaaccatgaattgagaaggcagggccagagtgtcagataagcaaagccctgtttagagccacctgggagaacactctaccccagggaaggcacgggaggtggcctcagtccttgttataagaaccagtgctcacaccatggaggcaatttggaattaaccaagtccccactttcttctatcaatttttaaagtgagatgctctacctgggaaat

SEQ ID NO: 20229 - DNA, 1132 bp, Mus musculus
cccaagtcctgtgttccctattctcatcgaatggcagcccccatcttgtcccaggcctatcagggtccatcatataaaatcattatttgtgggctgagcagtgattttggagccagcaggaaagtccggctcgcagcgctcctaaactgccactgcgggttctggttttactggcccggggtcccaatacggaacagaacccagcgaataaaacactcgtggcacagggaagaccagcgcacgcagcccgaggctgcacacgcgcacccgccgacgtggaccgctcagagccacgccccctcacgcggtactcccagcagccaatggaaacaacaggtaggccatcattcaaactatagccccgctatatgggcgggccacgagggcctccacccactcacgagccgcttctgtttttccccttcgaccaataggtacggcctgtgtgagccgggggcgggacggcacagctcgggcgcggggcttctaaccacgtagcaggcttctatcaccggcttgccagtcgtagcccaacggacaggagggaacatgggggccctggcagctaggcgctgtgtcgagtggctcttgggcctctacttcgtctcgcacatccccatcacgctgttcatcgacctgcaggcggtgctgccgcccgaactatacccgcaggaggtgaggctcaggggtccccacgtggccgtcctgatttctgttggctccgtgcctgacttcggccccagccggctgtccccagccgttgaccaccgctttgtttttttcagagcggaactgagggtgcaacccaatggtagggcgcatgcctaggaggtcctgggtttgagccccatgtactcgccaatcctttgcaaaacctttgcctgggtgtgtttcgctcccatggttttaactacggcagttggctgagggaagttgcctgggtgaaccagtgtctgtcacgtgttgaatctattgcgtttggatggactttaaaagtccagtgtaagccgagaaagaaaaaaaagtcctgcgtagtagaataaaatgactgaagggttagcccttggttagtgctcgtggcattcatacactccttctgggtctggatctagcttgaggagcagttgaggaa

SEQ ID NO: 20230 - DNA, 2622 bp, Mus musculus
tactgcaccagtaatgctcgcacggccccttcagataggtccccacccaccaatactagtttgaggggccgtttcttaagggcattttctgattgaatatgagaaaccttatttataacagctccccatcacttaacatcatgaagtaggctccatggatggcactgtacatatattacctcagttattttccacaccactctgaggtaggccacaggatccttcccactcccactcaatatcgtggccctctcccatccctgaagctcactgcctcgctctgggtaacagatccctaagtgaacggtttgcaaccaactcagtgtagatacaaaagcacagaaatgctctgcacaggcccctcctaagcggggagggttgccaggtggtagtggagtgccctgtcgcactgactcccagtctccctttccttccagttccaccgtcgctcagccgtctgagatgccgccgtctcctctggtgtgggagtgactgtggaagacactgtactactgaagatgtaatgtagctttcactggagtctgggatttgcaattctggagggttaatcatgcttgtactgtaattttactaatgaagttttaaattaacaaccactacttgtatgatatgaataatatttagaaatgttactagacttttaatcttgtaaagtggttgtgcttttagaagaaaaaaaaatattttacccagagttgcacatggttaaagaattcagtgcagctgttgcggctcacctcagaacaaatgaaaattgaaccaaatttgggcatttggggtttatgtttttattttattattattttttttaatgaagtaagattgttcacatgtatacactcagacacagaggacagtcatacattttgatatttgagccattcctaaagattaagggttttctaaaactaaagaatctagaaagcttgccagtgaccaatcatggagcctcgtgagctaactgtggccgcgcctggggcatgggcaggaggggccacctaatgatgaagccagtgattggcttctcattagagccgtgctggtggtgtgtgcggtctaacctccaatgctgtgcgtagaaagaatgagtttgtggctaggagaaactaaccctctgtttcccttacccggtataaatatatatatacatatatatatttaatctatttttattagaagtttttctgctctttcttacataaaaaaaaaaaaagacccaagcatgcatctttcatgtatgtaaataattcatttctgggctaatttcaaaagaatcccaacactgctgtatagagaactagcttgcacattttaggtctgtgaaattctgtgagacttttcctgcactggacagtgaaaaataataaataaaagacaaaaagaaattttaaaaaaaattacagccacaaaggcacatagggaatcatgtcaaatgtgtttgtgtccttaggcaaagctgtgggagtcttgagatgtcacagtagtaaataacttattacttttttgacaaattctttttcctgctggaacactgaactctgtgcatatgtaaatatgagcaccaatcgaaggcctctacctcctggagttacacaacttggcttgttacctccacacgctgatgatgactctttttttttttttttaagttcaatgtggagacttgaaacttgaatgtcccttccaacttttatattaaaaataaaaagacaagaaaattgaagagcgtttttcacctgtacgaggagtactaacggatcgtcttaaaactggtctaggaaaaagcttggtgtgtgtgttacggacaattaactgttaaagttactgtaagttatctgtatttagcagagtattttcatcttgagtgatctgagctgaatttgaagactattaagttatatttggaagttttaacttcaatgaagtaattatttgctgtgaaagaaacaaacattgaattactaaacaaagatggtgcaatatctttgttgtcgttgttgttgttgttgtttttatgaggctcctgagaagctacccaaccgaagcatttcagtccccttgactgagcatcaaaagagcccgagaagacactggtgtgaaaggttggtgtgaaaggtacaatctcagaggtcggtcagttaccgtggcacacttcctggtcactttgtacaatgtagatttgaagtacagtggtgagaacattaaacgtgacatttgaaaacaatacgtcgctgtcttatttccactcctcccatggcttgctcttcagtacagcctctgtcctgtcctgactttgcaaagtctggagacacatgctgatgtttctactcttatctttgaggaaattacttgtttgtttttagttcttcccaggaagttaagattgccaagaatgtgtcagaagctcggttaaaccggcatcagaggcagttgatctaaacatatccaggaggacatcttgtcctctggtgggatctaaccctagtatatgggattcaaagagagtaaatgagggggttgctgtggctaaagcaggctagatgagtcatgtgaccctccctcccgctttctgcttcacggccctagaagccctagctgctt

SEQ ID NO: 20231 - DNA, 1226 bp, Mus musculus
ggtataggcagtacagtgacaggccaggtagtattgtgacacatccaggcagtacggtgacaggtccaggctgaattgtaacaggccaggtgatactatgacaggtccaggcagtactgtgacagatccagtcagtactatgacaggccagacagtggtgtgacagatccagtcagtactgtgacaggacaggcagtactgtgaaaggtccaggccagactgtaacaggccagatgatactatgacaggtccaggcagtactatgataggccaggcagtactgtgacagatctaggctgtactgtgacagatttaggcagtacagtaacagatgtaggcagtactgtgacaggtccaggcagtactctgacaggacaggcagtactgtgacaggtccaggcagtactgtgacaaccaggcagtactgtgacagatccaggcagtactgtgacacatccagggagtactgtgacagatccaggctgtactgtgacagatctaggcagtactgtgacagatccaggctgtactgtgacagatctaggcagtactgtgacagatccaggcagtgctgtgacagattcaggcagtactagacaggccaggcagtactgtgaaagatccaggcagtactgtgacaagacaggcagtattgtgatagatccaagcagtactgtgacagatccaggcagtactgtgacagatccaggcagtactgtgacaggtccaggcagaactgtgacaggccaggcactattgtgacagatccagtcagtactgtgacagatccaggcagtactgtgacacatccaggcagtactgtgacagatccaggctgtactgtgacagatctaggcagtattgtgacagatccaggcagtgctgtgacaggctagacaggactgttataagccaggcaggactgtgacaggttcggcattactagacaggccaggcagtattttgacagatccagacagtactgtgatatatctaggcagtactgtgacagatccaggcagttatgtgacaggtccaggcagtactgtgacaggtccaggcaggactgtgaaaggaccaggcagtactgtgactggccaggcaggactgtgacaggtccaggcaggactgacaggtccaggcagtactgtgacagatccaggcagtactgtgacatgtccagtcagtactgtgacaggccaggcactattgtgacagatccagtc

SEQ ID NO: 20232 - DNA, 1197 bp, Mus musculus
ttcccttcacttttgccggggttttctctctcctcttctgtcctgcctgtcgcctcttcgcctcactctcttcctccagcctccttccctggctcattctgcctaggaaagtttggtacatctcctcagtccccccaatcaggtcaaccagactcggagtagggggcgatgtaggaaggcctgagagttcgaggggagggaagctggaagctggtttccctgataatttcccctcatcttttttgatttagagtggttggaatttttttttaattgtgtttttgaggaggtgggaggtgtttagaaaaggatgtgggaatggaaggggtagatgagtcaaccctcttacaagattccaagggtggcgtgttaccagatccttttcgtgtgcggagttcagggggtcgggaggtttggcctttattcccacattcaaagttggaacctcccccccattaagaatggagttttagtatccacttgtggcaggaatcctggggggaaggggcccttttccctttttcttttccttttttttttcttcttattttatgttcttaacttttattttgacaacccatacccttccacacactctcacccccaaatcgaacacccaagattgtcaaacttgtctggattgaccgatgaagacataaagccagttccgctctatgttttttgaggtggagtgagtggtttttcttcatttttttaaatggccaaatgacagcttgacccagtttgctttccaatcaaagggcatttttttgaatgtctctttgtggcacaagagccaacgcaaaaatgatggcggcttacaatggcggtacatctgcagctgcagcaggtcaccaccaccaccatcatcaccaccttccacaccttcctcctcctcaccttcaccaccaccaccaccctcaacaccaccttcatccggggtcggctgctgccgtacacccagtccagcagcatacgtcttcggcagctgcggcagccgccgcagcagctgcagccgcagccatgttaaaccctgggcaacaacagccatatttcccatccccggcaccgggtcaggctcctgggccagccgcagcagccccagctcaggtacaggctgctgcagctgctacagttaaggcgcaccatcatcagcactcgcatcatccgcaacagcagctggacattgagccggat

SEQ ID NO: 20233 - DNA, 1105 bp, Mus musculus
ccaggtgggcgaagtagccagaagatgcagagaggccacactgggggttgaatgttcgtggggcactcaggtgagctagtgcctgtctgtgcccttgcagttctgcgggatgatgtgacctctgtctaagcagaaggggcggacagtcccgaagcacgtgtgtccacttgtgaaagctcacagttttcttcctcctcttttgatttatttcagacaggatctcagtgtatacactggcaggccttgaacttttgaactttcagcagtctttctgtctctgcctcccaagcacttagatacaggtgtgccacaacacattgctgctgctgctgctgctgataaatgctcgtcaggacagtttgcaggatgcagctcacttcttcctctatgtgggtcccagagactgaactcgggctatcaggcttggtggcaaatgcctctatctgttgagtcatctgttggctcttattatttcttctttaaaaaaagaagatctttattttatttgtgtgtaccacgtgtgtgcaggtgccctcagaggcctgaggacattgggctccctggaactgaagttataggcagtatgagctgtctgatgtaagtgttaggaaccaaacctgagtcttctgcaagcagttagcgctcacactcacgcacacactcacgctcacgctgagccatctctctagccctctattgtttctccctgactgctgttctctgaataggattgttccctcgacacgtgtgtcaaacaacgctaaggacttgggtaagtcagacacccacttgcctggaaggatcattcctcagagacaagcagagccacaggtttgggctcccagatgactgccaggcaaagggcaagagcaaagccgcagtccctccatccccactgctgctgtccagtccatctgagcccagggaccaatccttacctggtggtgttcgtggcagtagagtagccatgtgtgccaccatgcctggccttaggcagagttgttcattagaatggggctgaggagaaaggactaacactgatttgaggagctggggctgccactcacagggagtgtgagaggggtgtggggtcccgttgttatga

SEQ ID NO: 20234 - DNA, 1227 bp, Mus musculus
ctccgagcacccaagtctgctccagccgtctcttaaaacaggccactctctgagaagttgtggaaatccccttcccctaggccccagcacagttattcacactaccggagagctgggacagtagcattctgaccctacctccgggtggggaggaagagccgtgagcctctgttcagatctgcgtgggctctccaatcatttctctaccccttcagctttccacattagcccttgacgtgacctccctactccaaaaccgagttgtgtgtgccccctgcctctggcagtctcatgcctgcaccatcccagaggccacagtgcctgaggctcaggccggtctctcactgtgtaagtgttgtgatgttggcctcccctcatggtagaatgtgaaccgtcaggctgccagctgagttaacccttttcagttatcccctgacaccaaatcacagcaagcggcacacagcctactgacagcagcaagcctgggtcttgctttgtgctgtgaacatcacagttgagaaagctttgagccctgcattgaatatggtcttgtgcattggctgagaaccagataggaatagtagtggcccctggctgaaggagctgaccatcttctgggggccagtgtgctggggctgccatctgccccagtggagctatagttctagggccctcctccttgcttcccaagtcctgcctctgctcggcccttcctgtaagagagttcccaccgtggcccccacttccttttctacttaagtgactgtgaattgaagttaggaaagcttgcctcctgcgcactctcctcgtctcctgggagacacatgaaggatgacagatactgtgaattcagcccgcgtagccactatgaaggcagtgaaaaaggcccaagcatcggagaacctgcccacctaaggtgtgatgccctttaccaggcaccctgggttcccagcctcaccccgagggaggccttttcccatcagagtggcaagtagtgaatcctagctagtgctgggctgctctaatgcatccagtcagagccctcggccattgtcttcctggtccaggcagggagtggcaaacctgtgttgctctgtagtgacagggtggggtgggacagccacgctgtgctgcagcgctggccaggatatcatcagtgtgtacacctagcgtcttctgtggccacgaggcagacatttatttgcttattttgaatgtgatgtaaaa

SEQ ID NO: 20235 - DNA, 1502 bp, Mus musculus
tgtgccttttctactgatggcagtgttttagctgctgggtaaatacatttttcttgtttctttttcttttgaaaacttatttttcttttatgtatgattctgtaaatttcctagacaaactctttatataatcctgctacttgccttgccttggagttcttattagagtctaaggtgagatgtatggatctgatctacagctgtagggacataggacaagtgtagttgtgtaaccatgattttgtttttccatttctctgaaggacacatgatggaagtgtgtatttttgggccactccaaggcaagtccctagccttcaacatatatgtcgcatgtcaatccgaagagtgatgtccacccaagaagtccaaaaactgcctgttccttccaaaatattggcgtttctctcctaccgcggttagactgaagactgcctttcctggtaggcctgccagacagagcgccctttacaagacacacctcaagctttaccagctcaagcgtctgtccttggaggctcagcagatttatttaattggaatccactcttattcttcatttcattagttggacttttaaagcattatttatacaccatagaaatatttctgaacatatcatgtaatttttttaagataactgtgaaaacattacatacatgtatatatttagacatgagctgctgctatatattgaatgggccctttagttttctcttagttctgacctgtatatattgctttaatagagccacgatttgtatatgtgctgttcattagagcaaattcaggggaatttttgttctttttttttttatttgggggcactaagtttagatgagatgaattgcctcataggaaatggaattggtcaggatagatggtgtgaaactgataagaggttttggatgtgaaaaagagtttccaaaagaatggtgtctgggagtttgaatgtgatgattaaaaaaagagccaaggaaaaaggtagctagaaaaaaaggttggctctcatcagccttaattttggaaagcagctacttacccctcagagaataaagtattatgcattcttgtcaatttgaaaactacatctactgtattattgctgaatattttgttaatactaagggacaattattttaagaccatgggttttgtttttaacatattttatttctgcagaggatattggtaacttaccaaagagaagcaatacacagtatgtctgctttagccttcttttatttatctcatctgcagatgttgagaatgtatgcattatgtaaaatgcttgtttttttatccctgttgagtttttttaattaaacgacacaaaactactacattgccgatatttctttcatgggttgcattgtgtagtccttttgtctagctgtactgtaaggttgctggtgggtccacagatgctcagtgcagaaggcagtgaggaaggatggaagcatgtacaggaagcatcactttgtgcgagcatgtgtgcggtg

SEQ ID NO: 20236 - DNA, 1178 bp, Mus musculus
taaaaaactggcctagcatggtgcacaacttgaatcccattaaccaggaggaaggaacaagaagatctctatgagttcaaggtcagcctggtctacacagtgagttccaggacagccaaggctaccagtgaccctgtctgtaaacagacaaacaagcaagcaagcaaacagaaccaaagcagaaatataaaacctagagagctgggtgggaagggtggctcagtggtttacagcaccggctggtcttccatgggacctaggtttaatttccaggcctctgtggtaaccaggcatacatgtgattgatacccagacattaggcatgcaaaacactcatagacataaaacataaaaatctagagttgacataacatgcaaaatgaaaattgcttcagccaggctgtggtggtaaatttgcatctgtctatcctcatcaggcttaggttatcacaaggatcttcagacaagagctacgtttatggaagttctgacaaaaatccttcaacaaggaacagaattcgatacacttgcggaaacggtgttggcagatcgatttgagagacttgtggaactggtcacaatgatgggagaccagggagaactccctatagctatggctcttgccaatgtggtcccttgttctcagtgggtaagtttattgagaaagtagggtaatagaatgcttgacatacagctagtgcttcaaaataagtatcctcagaagtgtttattaagtgaattgacaaaatttaagaactggaaaaaattacataatggagagctgagactgtagctcattggtagaatgctttccctagcaccacagaaaatccatcatgattgtgcttgcctgtaatctcagcagcttggagggtgaaagcaggaggttcagaagttcaaggtcctctttgttaatagtgagtttcaagccagttagagcactgtaagactgtctaaaaaaataattaaccaacttgagtcattaaaccttttttcttaatgtgttttgcttctaactattgagaagtggttggtactcctacccctgactagttctttctttccaacccagtgacaaacgttcatggaatcaccaatgggaagaaatgtaaaacagcgttgtctcttatctttacgtatatataaagtaatagttaacctaactattagttgttaat

SEQ ID NO: 20237 - DNA, 1132 bp, Mus musculus
cactttagtggtaagtccctaggaggtgatctcgcttcaccagttctttctcagctttaccttaccagactgctataggtttctcactgtaatagtattgactcaccaggcctacaagcaggaatttgaaattttatcaaacaagaaaataataaaaataacttgcacaccatagaaagctacaataagggctttctttgtcatgcagatacttgtaattatcatataacctaaaagtttattattagttgatagtgttggcattactagtgcaggtttattatatagccactaatgtaatgcatcaggaatttgatttagggagcatggttgtgtgatttttgcatgatatttacattttatttagttgaagatgaaacatactactttagagttaaaatattggaattttctttttcttttacagaagagaccaagcaagttttgaggctcagtctaacagagttctcgttacccaaattttacttactgtttggcattagcaaagtcaagtcggctgctgtcattgccttccgttccagttaccgggaccgctccttctcccctggctcctatgagagggagacttttgctttgacgtccctggaaacagtcacagaagctttgttggagatcatggaggtatagaaagaaaaatgacaagaaaccaaattaaaatcgtatttaaaatgtgtaatatgaaaggtataatgtcacaggagggagagacaggtagattgtgtgaacttgaagccagctgaatctatgtagggaattctaggccagccaagcctacataataacacctcatctgaaaaaaaaaattctgtaatatacagaagaaatactggtttattctgttacagtacacactgtcctttagaatgtgttctttctttacatttatcttactttatgtatctgaatgttttgctggcatgtatgtgtgtacaccacatgtgtgcctgttgtccaaggttgagagaagaatccagaagaggacatcaaattccccagaaccaaagttacggatggatatgaaccagtctgtggattctagaaacagaagtcatatctttcctctgccacaacaagtactcttaactgcctagccatgtctctagcccctaga

SEQ ID NO: 20238 - DNA, 3119 bp, Mus musculus
agccaagtgcagaagcaaagaagtgctggcagtttcaaacgtaatagcattaagaagatcgtgtgaagcgttctttgtttcactcttcaaaccaacctaacatggcttctcactagtgacccctcaccttgcactgctgcacttcgtgtcttatgatcccatctggtcgccgtgtcgccagacggtcatctcttggagcattgcctaagtttaatgctgcttttctttgatgtttttccttctactttggcatgtgtctggttgagcacttgttctgaggacagcagagacagcaggcggtcaggaggcctgactgagagcgtggaccgtgggtgtggatgaaccctgcagtgctgccgctgccgcaagccacgggccgtacgcggaggacggccttctgtgttcccgtcttgcagagtgaaggggtcgtcttagttacacacttataagtttgggggagaaatcatattttaaccccagtgtatttaatcttctagctgtggacttttttttttttttttttttaccttatgtagttgaaggaaccacagaggccaagcctcaataaagccacaggccagggactgagggaggggcaaactaatattttgtaacgaattcttaagaaatactaacatttgagtcttagcaataagtacaggaaaataagcgtgacacacacatcttaacattgctgaattaaagctattggttctgaggccttatacatacttggtcatccaacctgggtaatttttttccagttgattatcttttaatttttacatatgaaggtgttctgttctttttttttttttttaagccaagactatactaagtatagaaactacacttgtgtttgcacttgctttctcctctttcctaagtgattctaagcagggtaatttgcagacagagtggtgagactcgtttccacaaggtaattttcatagctctttccattggctccgtagcaaaatggaatggtacgtgacatagggtaggtgatatttttattttgttaaataattttccaagaaacagaatatgctgtatattatcataaatttctttgataagatgtatttttaaaatcttttaatcttactcctctcctccaaataaaatcaggaatctctagcaaaacatttggattctatctgataggattgcatttagtcactgtgaagtctggccggcctgtgtggtatggacacaggacctctaggatcgctgctgtgcagagtggctggaccagtgggactcaggcccttccaagggatgcacacccagctgcttcatggtacccgcaggatgcaagacagtttgactttagtgagcacagtagtacatggatgctctcagttaagattgaactatatttatttttaaaaggtattatccctctacttccaggttcccttcatgtattaagacataatggctttgggagggaccaaaagaaacccagtagggtgtggacaggtcctgtagtgctggctcactagtggatttcagtaagttaaactccacagctaagtcaataaataatggtacatttaagtattctgactttaataatataacacgtttcacacttatccatacagtaacaatgtaatatgttaatgtaaataaaattgcttttgatattcagaaataacaatttaatttttttaatttgtttacagccctgggaaaagtaagaaccatttgccaaaataaaaggaaaccccttagtgttagtagtgattttaacatagaatcactggagactactggagacagatgcagcaaactgagctcttgtaaaggctgccttagaataactgtcagagcagataaccaaggctgggaggctgagatgccagctgagtttagccgcaggaggcccgtggcttagctgccaggcccggctccccaccgcagtactgctggggtgcaccccgctctggctcctgcaaccgtgggcagcacagactgaggctgctgtaactctagttgcttggcttttttaaagtcattgagttccattactggcccattactgttttgcttcccccatcaaaacaggacaacttataaatgtgcactcttcctgtagcgggtttccccatagttcttaaactgccccacttgagctcctatggaaagatcaaacggagccacttctgaccagtacatcccaggaaactggggcagcattccagttttatctaatagacagaacttccagcttttgaggaaagtctatctttgcaagcaactgaacctacagagcttaaagtatcactagctgcccctcccccaaaggagactctaattacaggagcagctgaaggtctgagtaatgtcccattttacacaatttggtgtgagttctgtgattcattttcaatttgtgtttccctgacttaaaagaaaacaaaaaaacactaacggctgtgtttgtgcgtttggctggtactcctcccctgggctcccatgccctcactgtggggacactgcactctgctggacagttactcttgcctgcatagtgctgaggccggagcctggacagtgcagactgccacagccccagtggggggactcgccccagcaaccacttccttggggggtttaaggttgcaagtttcctctgggagatctggcttttgttttccaggtttggaggagtttccccccccccctttttttttctacattactccccaagcatattgaagcatgtcttattcaatgttatgcaatggacttccacaaaaattcacttagtgtcagccacacaatttttttttaatgcggtatattcccctgtaaatagtttgtgtaaaatttgacagaaaagtctatttactacattgtaaatacatgtgatgatatattgtattattttgcttttttgtaaagcagttagttgctgtacatggataacaaacaaaaatttgattattcttgtgttcgtattgttaacttcttcctgcgactgcgttccatcatttaaagaaaatgctgtgtattgtgaactgaccttgtatatgattaacttactcccctccccaaccaggggttccctgcctacaaccttgttgataatgtaaccagcaggagaacct

SEQ ID NO: 20239 - DNA, 1173 bp, Mus musculus
tgaggactcttgccctatttggtgttgcagtacctgccggggaagggtttgcatctgcagagagcccttggtagaacagacctgaactttttctagtccctaaggaacttccccagccggcttcattgcctccggctatggaggaaaaaggcagccacaaagaggcagccctgggcctgaccctggtcccctgctctggccagggctgtaagagagctgcagccattttggggagtccaaagctgcttcttcacttaggacgttgcttgaggacagagctcacctaggttccgcccttctgaggcgcgtgtcaggtacagtctgggaggaagcatccctaagaggctctggcagcaggggatgggcaggtggattgtgtgtcctcactaaggaccggaaacccctctcacccagattctgtctctgctgccaacatggccgacttagtgtcatgtgcaaagcagcacagcagtaaagggcagcgcccaggacgtgaggaatcctggtccttcggaagtcagagggaagcttcatgagcagggacagggggtgggggagccagtggaagctgacaggcctgtgtgtctcagactgactgatctgagagggctgtgtgtgtgtacatatgtgtgtatgtatatgtgtatgtacatgtgtgtgtttgtgtctgtacttttgtataggtgtgtgtgtacgcacgcgcccacacacacacacacacacacacacacacacacacacatgctcatgttaaacccgactgtcacatattccggatcctttctctgtcactcctcacttctctttctttctctaagctgattaactagaacattgctgtcacagagaagagcagtaaaggacctgaggacacatttcagtttacaactgaggacgctaggcagactgaacctgccacacttgctgcagctcttgttactcctggcagtgtacaattaggacttctgtaagaagtggaagagagggctggagggatggctcagtggttaagagcactgactgctcttccagaggtcctgagttcaaatcccacaaccacatggtggctcacaaccatctgttggggatccgatgccctcttctggtgtgtctgaagacagctacagtgtactcatatacataaaataaattaaaaattctgaaaaaaaagta

SEQ ID NO: 20240 - DNA, 1165 bp, Mus musculus
tctctctctctttttttcttccaaaattccaaaggcagttttaagaactcacagaatactcagcttttctgtcaagttcccccaagcccccgaggaaatgaagctgaggaagcccaggcgcccctaagattttctggaggcatttgtttgtttgattctctgtgctgagcagggggtaggagcctcctgacctcctaagagtggccctatctagggctggggggttgctagagaaccttgtgggcggcccctgtgcagagggaagtaccttttagcctggtgcttccctgcgtgcgcccagcatgcttctgtatatgtgagtgtctcctctcttagtccccgctgctgaggttcatctcatggaagaagttcttctcatcaggtgcctttctgacaccttgagtggggccctggaccaggcccatgcagctggctgtctcctcccctgccacccgttcttccagctcttccctccaaggcccattagtcagaagaacagccttatggactgaggctcagaccactcactgcccgtttatctgtctgtccacagggtgtgaggagctgctgaaggacgtgctgtcggtggagagcgcagggaccctgccatgttctccagacatcccagactgtgtggagcaggtaagggcccctgcctcagcgcctgctgccttccgccaccctctgcatttgcacctgggctcagctttggaaggtctggaaggactgggctttccactaatgatcttctggcatcaaagtcaaaagacagctacaggattgctgagtaaggtagcacctgcctctaatcgtaatcctcaggaggctgaggcagggggactgccacaggtttgaggccagcctgggccacatagcaagactgtctcaaaataatcaagaaaagaaaaaaatatcactttggaatcggtacagtgaagcccttaggaagtctagtgtgtacacacacacactaaatatgtaattaattttttttaattttaaagttagttttcataacccagtctctagcccctccttccgtctagaggtggggagttagaggggctgagagtcccaagtgtgatatttctgtgaccagcaccatcatggggcacctagaaacaccctaagtcatctcagtgacataaactcgggtgtgggtacc

SEQ ID NO: 20241 - DNA, 5436 bp, Mus musculus
gctgcagagcggccgtcggacctgggacctaagggcaggcctgcctgaggacgaagaaagatgcaggctttgcccacatgcactctgtgattgtacctctgagcaccctctctgtgtgtgctggtgtccgtgcaaggagtgagcttggggccatggctgtgggtgacaacccacggtgagctgtgtgtgcactttgtagcccctttgtgaggggcagagggggctggatgtgggggagacactctcaggagttaacagcaaggcctggaagcttgcatttaggatactgatgaaatgattctacctctgggataagggttagaagatactctcaggagatgggttctctcccctcccccactgaagtggggacaaaactgttacattctccagaatttggtgtccttgccaacctttcaggccacctttcaagccgggtttttttgttttgttttctttagctcagaggaggaaggggtattggagaggcccctgaggtctagccccctggggtgcagataagcaggtccagtggactcggacttacagagcagttagagtgcactgtccatgcctttgggctaagtccatcgtagttttctgagcccctcccagtcttgcttgcctacctcccctttctggtttggctttgctttgttttgaagatggaaaatacaagcagcattcagctgggggtggaaggaaggccaagaagggtagggtgccccaaggcaggtgtgtgttagcactgggggccaaaaggagtgattgcctgggagagaggtgtgttttcatggctgcatcgtcacacatgacctctctgggttccatgctccttggtgaggacaggcctagggaagggtttgcaggactgatacccttgcctcggctttcagacccatctgaatcaggtccccagttagagagccgacacggctggcaggaggtccagtggagaatactgggggaaccttagtcttcggttccgtcaatacatgatgggaattcacatacacacacccgtgttgggggttgagggagggttaaaatgtgatctgggagtaggtactgtatagaacattccggtttatctcagttttatacagcttgtgattggttggcttccttaccccagctcctataaaggtgtatggttcaagtttccccttcagtttgttttcttgagcacatcttgtgtaaaaaggaaggtttagggatgctggggaggctagcgaacagaaaggaggcacagttgaaagaaaataggggatctagggtgtgtgccccggggtgtgtgcctgcttggcagagacggggcttcggtcagtttcagtccagtcatggtgctttctttggcttttgagactccctgtaatcatgtgcttggaattcatctcatgctgcatagatagtgcgtgggcctggtctgcctggatgagccacaccaggaagacaggaaggcttgatctggggatacggggtttccttccctggcgtctgggaagatagagaaaaagggggctgggtagggagtcttgtgaggaacaatgggaagataaccatggcttgaggttggtccgtgtgccgtgctagcagaatgcagaggccagctgaatataggtcctggtaagaggggcctacgctcaggtgagcagttcagacttgaagttgtatgggccgcccgcttcacttgtatgtgggtttccagagaaggccacagagaccagagtcagtgtcacagaagaggaaggagtctgtcagggaaacaggcagggaaggaaggctttaggcccaagttgtagggctggaagagtggactccctgaggacatgaccaggtttggaggcccctgtggatctggacgcttgctatctaggcctctggaagaatgatttctgaatgtggtctgacttccatgtaacacacctcaggcgaaatccagccttcttacagaatacacttagaaaactctgtcaacttccccataagatcatgtttgctgtttgctgtttcttgtagtggtgacagtaggtttctggttttttttttttttttttctgttctgggttagaaggcccaggggtcccagtgccacaccacccatgggaggttccagaacttcccttgcttggcaagaatctaatctctctttctactgcctccctggctctcgctccagttgagctcccagagactttcgggagtctagagcttacacttggcattcagttacatttggattgcagataaacaagaggttttagaatcaccgtgttccatgctatacctggttagaaagcgtttttaccattctgatcctcacgtgttctgacagttggtagaggtgtggcccaggccttggaatgctttaagaatgccacaggtgacgctaatttagttaggtctcctgtgaagagggtgtggctctttctaagttgaagggtctgcagtgatttgccaaggtccaggaaggttggggccgtgaaggaagtacacctttcatgtgacacttagccatccttgtattccactgggagccaaacaagatgagcttctgtctccctgatttgtttccttttatttttgaattagccacttttttttagaccagtagttttctttgagactctacagaggaagttccttttgaaaattttatttctgatatactaaaaccacaaatctcaaggaccaagcagaacgccaggccttgagcctgagtctgccagtttggcagtgtgctggtgtcatacctgatgctggagggcctgggagtggaacacaggagtggcgtgcctggcatgaggttcagtccctggcagcatggaagaaagttgatgacagaaccacctctgacttccatatataattggtagcacagtgtggcccggcacctgtgtcttcaatggccttcccaagtgttgttcatgcacagatcaaggtggaggcccgtaaatcatgtgaaatgtctgctgaggtcagcagggctggagaagcttgtgtgtggcccagaggatgggtaattatgccactgagtggtccttgccctgagagtccagctgttcccactactctgaaagtctcaccctagacggacaggatataagtgccagcatttgactgggcataggcccattaggaattggaggcaggtaggcgggaagagctggaccttgagagcagcctagacgcagtggccacttgtctccgcgggctttgtccatttcataagggtgtctcagttgcttccctgtcagtgccaaatcagcagcacccagcccacactctggagaactctaggtgatggtctgatagctagttagtcctgagttgtggtccttctgcttctgatggtcctggggctgttggtacataccgggctgtgtaagggatccagagactctacagcaaggcctaaagaataaggaggacttcactcatctgaggggcattggcaaatctacacctgtctagataggactgatgggagtgggaaaggtacagggtggtcaccaggctagtcaccaggatgtccagtgactctgtcgaggtccaggtgaagctctttagggcctcagtgatgcctgttatccccagtctttcctcactggggcccagcgcttccctctggtggctcctcaggctggtatcactagcatgcgcttgacgaggggcctccagttagagcagccagatcttggaaaggacctccctgtcctgacttggaccctgacagaacgtacttgcaatgggtttatcaggaaagggtagaggtagcaccttcagggcggggcagctctgtggctctgtcgctctgtcatcgttagctctgtggctctgacatcgttagctctgtggctctgacatcgtttagctgctctgctaagaaaaaaagccacttgcagaaaaggctttgtttctggaagcatagtcaggttaccagccttgtcgctctgtgcactaggggctgggtagctttggtgttccttccttgtggactcctcctcttcccattgtgactgtatcgtagggatgtgcattcctgaggtaccatatggaggacagagtcccaggccacctctcctgcaggcctaacttctggtggccctgtctcgtgttgggactgtcttctttaccgttctgcactgtttcttgtctgcatggtttggggtcctcgtgcctttttaccttgttaccaccacacaggattctctgttacccactgcccccttttgtacgtccccttcccccatctcccccagtcctgtgcgtactcacgtgtgcagccatatggctcaactgaggccagctggcaaacactttaccccacaccaggccgacttcccatagctccccagctctgttgacttggtaacttttgtacaggattttgttacaatcttaagcatagggaccacttaatccccatgtacctgcagctagtttagaagccctgcatcccagacaagggtagctttgtgcagaccagcctctcccgcaaacctcttcctcgtgggttcaggtatttataaaagacagatttcctttaaaatgaggccctggccctagcagggaggtgacaggtctacaaagctctgtgcatggctcttctggaggaagccccagccatgtggtttccagtgcttggcaatacatctgggtttagggccattgcctctcgtgtctcccctgatttgtgctgaaggaagtcacttgccactgtccctgcctgctgtcactacctgtccagcccttccttgtttgctggtgctcagaccagagtgccattaatcaccagaccaacgtcaggacctgcacaggacagagtgcgctgaggactctcggccggctgcctcccagcttcagctcccatggggctgggccttctggggtccaggtggaagaagctataggcagataggctctgcctttccagggattacatctggggctttgcctcagaagccagtggttgcagatggccttagctttgggcttgggaaggagcttccactttaggccccagggaagggagaatggggtacagcccaggccctgaactgtttgtttccactctgttctctccagaaacaggctttcagtggggggcaccttccaaggaactgtattgtacagaccacagtgtaaataaaaagttggctttttgtgcctgacttgtgtgaacttctgtgggggactgggagagggaatggaggtgatgcaggggagaaaggcaggacccaaatacggtcatgttcagttcacaggtacattatctttagaagctgcaactcacacacccccagccccactgaagaaattgtcacctgtactacagtgctggaaggcgtgggagtaaacacaactggaaatgtacccctccagccccacccctgccacccacatgctcaccaggtcctcccgtgtggttagtat

SEQ ID NO: 20242 - DNA, 1140 bp, Mus musculus
ttctttgagaaactgtcctcgagccaagagcgggcggcgggactcatgccctgggcagcccgtcgtcgggggacgcacggcatccggaactccaagacggacgggagctgagagctgggtctttgcgggcaagatgagagtgtcagttcaactggcctacaaagtcccagtcctcggtccccaggaccggcattttcttcactctcctcgccgcccgcagcccgccccttcttggtcctcgtgcgctccggctgggcccccccctcccatgtccatcgggatagaagcgactggaaaggcgtgcgccgcgggatgtctgtgcggttttggggggaatctcttgcttcggcagagaaaccgcaacgtgcttgaatgtcctggggtgggggagaaaggacgtttttcttctgtaccggcctgccttgctgtatggcgccaaccttgagtttgggggtggggaagctagagcctggtttctggacttactcctggggaggtggcctcgatgcggagcccaactccaggtcctaagtggagtctgtggacacttctctaaccagtcttttgccctctttaataacccattactgacccccatcaagttttatgctgaaaaagcccccccccccagttctattgctcttaaaactttgcttaccacccccacccccacacaaaattccatacaaagccctgaaatctcgagttcctgaccttggtcccttttgtcattttgtgttgtgtgactgttctaggagcacttagcagacttgaactccgtgtatgaagggcaagctgaccaatagggcacctcctgcccccttcttcctggcattaggaaatgagagaggtttctagaagctgggaggctggagacagagaaactaggttggtccaccactttgtacaaagttgcacaaagaccatataagaggtattccccccccccccggctccccgtgcttgtgaaccacgtgcaaagtagtccctgtgcaaatcacactcgggctgctgtccctgtcccttgctggcatgtagcagtagggacaggagagggagccaggtgtggagagaagtctcagaaatgtggtgtcgggccggctgatgagccccagcaaggatcatagcccgagctgtgtc

SEQ ID NO: 20243 - DNA, 1164 bp, Mus musculus
ccctgctctggactcctcagatccctttggctccacactccctcatatatacaacagaaaccttccactttatcttggacgggtcatggacagtgtgtatgcctatgtatatgggtatatctctgggtgtgtatgctgtgagcatgtgggagcctgaggaagccagaagagggcatcagactcccaggagctggaattataggcagttatgagctggccaagtagggtagatgctgaattcccgttctctggaagagcagaaagtactctttaaccacggagccatctctccagcctataaaagctgatttaaaatatccattacataattttctaattaaaaataaaatattattattatatcatctaaattttggaatataaagaaaaacagaaagaaaaagttattgtactgtatgtcacaatgtatgtacagtatgagtgtactgactgtcagttaattatgaaatgtttaattgcatttcccttgagttcagggcatggtgatcgatccaggtgaagaatagaatagcatttagtaaacttaggacttataaaggttggaccgattggagatggaggtgattgtaacatggaggtcaaagcctacaataccacaaatgggcaggaggtggtgggagcaacgtggagccatagaagagtggtgctcggccctccttccaggatgagagcctctggatgaagcatcttagcagcctctagttgaccaaggctgtgggagctctgcatcttatctcagccctgaccctgctcccccaaccccacccctttccttccacaggatcagatctagtgtgctttctctcctgggtcccactttgcacctccccctttttttccttttccatttttttcaagacagagtttcactgggcagccccagttgtcctggaactcattctgtagatcaggctggccttaaacatatagagatcccctctgcatcagcctcccaagttctgggactaaccatgtgcgcggccacttccctgcactcccccctcctttgtttttgacatcactgtcctcaatagatcttccactactgatgcctgcttggcctctgcttcccagaggccccagtggctgccagtgagatgctctgcatttctaagttttaaagttatctttaagaagttagta

SEQ ID NO: 20244 - DNA, 1197 bp, Mus musculus
tggagcagtccaagagactagatagctctttctcatgccaacccagatgattcggacattttccaccataggagagatggcgtgctccctccctcccaccttgaggatccttaggagagctttaacagcgtttcttgaaacattttggcatgttaataccacaccatctgtgttggcccgaggccaggccacatgaaccatctgtgcatagctccacctcacccagcctcgggcctcagatacaaaagtgatgacggagccagtccgaccagctcaagacagcctgggaacccagctcctcatgtgttctcctccctgtaagacactcccgtttaggtggcagcggcaccaggagtggcagcccatgtgtgaatctcaaagtttctggttttttcttaccaatgcagactgacctgccttagactcgtcgctttgtcagtttccaactttggtatctctagcgctggtgactcaacctcccttagctgcttataccttatttgaacagggaggacacagtttaaacggacagggttattacacaagaacacgcatagaagatgctatcattctttctggcatacacgacgcaggattgctttgggtagttaaggggatacggtggagagcgctgggcttcagttctgatcctgccaactctcaggatgccatttcaacctctctgagcctcatcttcccctgcttgcaaaatggttataagggtttccccttggttcattgaatcaaaatatagaatataaagtataaggcataaaatagctgttcagtagatgttaatgtccttctttaaaaagatttattcatttattttatgtgtctgagttcactgtagctgtacagatggttgtgagccttcatgtggttactgaggattgaattaaggccctctgctctctccagtcggccctgctcgctccgaccctgctcagagtccaaagatttattgattattatatctaagtacattacagatgtcttcagacacactagaagagagtgtcagatctcattatggttgtgagccaccatgtcgttgctgggatttgaactcaggacctctggaagaataagcagtcagtgctcttaacagctgagccacctctccagcccccaaaatatttgttattattattagatttacttatttatatataagcataactatactaacatatt

SEQ ID NO: 20245 - DNA, 2839 bp, Mus musculus
tcagtgcttagtcagttacaacagggctagcttgctgaggcacagtgtggggctgactagatgataacatggtacacgtaccgtgtcttttaaaaagtagggaggaaaccaggcagtggtggtgcacgcctttaatcccagcactcgggaggcagaggcaggtggatttctgagttcaaggccagcctagtctacagagtgagttccaggacagccagggctacacagagaaaccctgtcttggaaaaaaaaattagagaggatagaaaggaatttgaaagtttttactgtaaaggcatgataatgtttgaggcaatagataggctgaactttaacactacacagtgcttaaatgtgtcagagtaccttattttattcatatatatttacattctcttaattttatgtgcggaagtttctcagaactttttaactggcttagtattaatagttaaatttgcttaattaaagccttcccagttttctagctacgtttacagtagttttttggttccttttgaagatctttggatggattacatcaaggaagaattgaaccatcccttcggtaaacctgagaactgcggacagatctattggcgagccatgaaaatgttgcagggacagtcagcagagctgtttgtagctaaacacgccatgcaccaggctggccactagtggtcgagcaccaccagttggctgaagttgtgatgcaagtctcggggcaggtttgtgatgagctggtgtgtgaattgtcgagagctggcagaagaacggattgatttttgtaacatacttttacttggtgttaatctttggttccagaaatgagtactgctagtgcctgttaaatctaaaatacacagaaatcatatgattcagcttcaattcttgttccaggctaagcatatacagctctaatctagactaggtgtgagggacccagttcaaacccaagagaaagtatagttttgtgtgttctcttcttgttgtgaaagcctgcatgatacctgtggagataggagggacgagggtgtggatggactgcctcaaccctccagctcccgaatactgattaagagactttatttatgaaagcttagtccttatggcttagccatgtttaccacctggctgatcacctctcctcagccccgtacattcaagttccaagtctggccggcagatctcccacctctcaattcttcccagagttccgatctcttcttggatgtcccacctttactctcctgcccagccatcagctgtttatcaaacaaatcagaagtgatagaggagaatgtgtacaatcttcgatgcaggtgatgcttcataaaaataacagtaccaaagtccggacagtactctactggttcaaaaatcaacactgaatactacaaagacagcctttacagtgcccaagattatcccaacactagggcagagcagagcagaaagtcacttagatcaccgaagtgaggctgaacagtgacttcttttcctgtatctgaattggatctgtacttttaaatcaatcattcaagaaatagcgccttccttcacctgcaggaaaaagggagacttggaagatgagtgacagagaaggaggcgctgggtattgggagaagtttgtcttttaagaaggttgaggtggcacaggaaacgatttaccccaaggatggacaggccaagaatggcatggaggatgcccagctttgtggcgggggagggagtgggaagtgcctcagtagggggtggaggggcagattggcacaaaggagggcatttggggagtaagggaggaagctgaaataaatcctttcattttttttgatactgggtatttgtttgtttgtgataaacctaaatttgcatttgaggcaagagctttaccactgagacagaccccaggcatctttttattttctgttttgagcaggtctcactaagttttggctggcctgaaaagttctcaggtctaggcaggccttgaactttgaatgctcttgcctcagcctctcaagtggctgaggttacaggcctcaacagctggaccttaacattttgatatcattgggaaagtattttgaacaagttacttaatagtaagccttaattaatattaagttcatttaataacatggaaaacacctaatgaattcatagcattcccttgtcttaattaatctcctgtggctatagttttttaaaagtataaacgatattggtgaagattcttgtcaatctttggttacattcactggcacttccttaggggacttacttgacagtggaattactgaattaggtaaaagaacaaaatttgccaatttgctctttccagcatcacatgcaggaggcaacgcccttgtctgcactggggattacgtacttccttttcatcattttataattcaccactcagtagatgaaagcggtacatcatcacttaagctactttttcttattaatttttgtcttaaaaatacattgagagagccaggggagatggctcagcggttaagactgactgctcttccagatgtcccaagttcaattcccagcaaccacatggtggctcacaaccatctgtaatgggatccgatatcctcttctggtgtgtctgaagacagtgtagtcatagacataaaatgaataaataaatctttaaaaaaacaactcattgagaatgttaatcttttgtttgtcgttcatttcttacagataagtttatgcttctcttccctttgtttgctgtttttgatgcgggaagatttgttttgttttggtttttatgagacagggtttctctgtgtagccctggctgtcctggaagtca

SEQ ID NO: 20246 - DNA, 1225 bp, Mus musculus
tcagttcctgctctctgctgtctgcctctccacactgaagatcaggcaggccagcctatgtcagttcttatgccgtggctcccagactgcagacagaaggcctgagtagtgtggggctgattggctgtgggcttttgctcgcttcactgacagatgatggctgatgatggctacggttgggttccccactggaattggactaaattatcaaactgttgctctggatgacgtggctgggggctgtaacccatctttatagtggtgagtctctcagagcacttctgcatagtcacatctaatggcttcctttttgtgagcaggtttgtctgcccttgtggatttcttgggcagagtggagtgaaagtgctaaaagccaggaggacacggaagccatctttaaggtacaagctcccatttctgtcccttgtgcagggattggttattttatatcctaagtcacgatgacctagtagctcgggtgggtcttcataatatgttttatatctctaagttccttttgtttttttcttttaaatgtagaaagctattatagctgtcacaggtgccagttcagtaactctgaaggagaaatacctggattgggcctatcggagtggaggctacaaaaaggccagagcagtgtttaaaaggtaccacactctaatcctagttttgaatacagttgaaaagcattagatagcctttttcccttgtcgccaggctactttgtgggttcctttttcttccacccttctctacccctcttcttttctcttttagccccctcaacactaggtaggagagaaaaaaggacagagggcaaaggggacaacaatatccttagactgcttcctactgattaagggcatcgagtttcttggggcgagtttgatcttcaccagtaggatatctaatttcttcttttcttctctgcacacaactacttgacaaagaacaacaaattagagccaaccagcagtctctgtcagggctctagcatttatatctcctttgaagagtcccggataccaaatgtcacacactggcagaaacttatctgcagctgtcaaaactacgacactgctagagcacgagacaaatcatagtcagctgctgtgacagatctgaagcagccaagcctcatatcctataccagggaattaaaacgaaaacatattcttacaatatttctgtgtttttaaagaaaccaaaattcacactacat

SEQ ID NO: 20247 - DNA, 1185 bp, Mus musculus
ctatggtgaggccaacatgtctgcttctggtctgtgattaagatctaaggctgggggaagaggaaaagaatatacaccgggcagtggtggtgcgagcctttaatcccagcacttgggaagcaaatgcagatggatctctgagttccaagccagtctcgtctacagagtgagctctgagacagctagacctccacagagaaaccctgtctcaaaaaaccagaacaagggctggagagatggctcagcggttaagagttttggctgttcttccagaggctctgagttcaattcccagcatcacatggtggctcacaaccatctgtaatgggatctaatgccttcttttggcatgcaggtgtacatgcacatagagcactcatataaataaataagtaaatcttaatgaagaaaagccaaaacaaaacaaaataagaagaaaaagaaaaaggatatcctttacaaaccctccacgggcctttgggcgtgctgctcacccagtccactgcataacgtttacattcggcacctttgttcttgggttccacttcttcatgtcgtaggagagaagctagaacatgcatcagtttgttctttgaattcttcagcgttttggtagagagttccgttgtgttttttctctgcctctgttagaagaatttaagagaccaggctctgcagggctcatggaggtgtctgtggccacagataactactgatgtgatttggagagctataataattttaaagataatatttgttggggttttgtttgtttatttttaagaagggtaggctggccttgaatgtgtgggaatcattctgcctcaggcttctgaatgctgtgccaccacgcccagctaaaagttaatatctgtaaatgatgcctgaaacattctgcaatctaattgatatataacaactttggtccattgattagtctatttgttaagctattctggaacgcctgttaggaaattactctttttttttttttttaaattacatatttaccattatgattgttactgagtattttctttttttaaattttattagatatgttctttatatacatttcaaatgctatcccgaaagttccctaatccctccccccgccctgctgtcctacccacccactcctgcttcttggcactggaattcccctgtactggggcatataaagtt

SEQ ID NO: 20248 - DNA, 1207 bp, Mus musculus
taatttgctctctctgcagggctatcatcaagaaggcttccgacctagaatacaaaatacatcggagaacccttctcaaggaagactttatcaactatgttcaagtgagtgagtctatagctttttaattcccttcaagaattttttttttttttggtttttcgagacaggatttctctgtgtagccctggaactcactttgtagaccaggccggcctcgaactcagaaatccacctgcctctacctcccaagtgctgggactaaaggcgtgcgccaccacgcccagctcccttcaagaattttaaatcagacagtggtgagcttcacagcagttttctacagaaatccagaattctatgattgtgtgcacgttttttaaaattaggatcagagatgactgtgtggagggcaattgcccaataaggcttggtccttgtcagagtgaactatttcctcctgttgggtcagtagatcagcaacatcattgtgtatcaggattttagcaggaaacttgtcttctggcagtgggcctgctagaggagtttgacaacggcaggcggttggaaggtctgtagagggcttgcttagcactgtcaacctgcaaaagaggtttgctttgagattttttccatcttctaaatggacaagagattgatgttgagattaaacatataggatgaattgtcaaaggagggagaatggctactatgtacagagtcagaccagaaagatgaaaaaaaatatctgcagaggccccaagagagtgttgggtctggaagtgttacagatggttgtgaatgtgggttcgggggactgaactcccccccttttggaattatagccactgagccatcgcttcagtccccagaaaggtaggatgttagccatgatggtgctgcctagaatcctaacgcttaatgaggctgaggcaggaggatcttgagtttgagatcagcctggatacacagtgagacttgtctcacaaaaatcaaaacaaaaacataagacttaaagctttgctggatctgatggcttgcacttagaatctgaggcaggaggcatggcggtacagacttttagatacactactcagaaagtgagtagagacagatttttttttttcgaggcagggtttctctgtgtagccctggctgtcctggaactcactctgtagaccaggctggcctcgaactcagaaattcgcct

SEQ ID NO: 20249 - DNA, 1151 bp, Mus musculus
gggacgtgaaaatgcacggttaccatactggtttcgtgaagccagccgactaagaccagggcagctggtccgcagccttagagcctcatcgaatttgcataattaacaatatcgtcttcagttacattttttagttttcagtgttctcggtgacgagaagcgagaacctgcgacaggagcatgataaaaacaaatgacttccaggtagcgtacttaaagctcctatcaggtattccgggaggagctttttccggtctccgaggcgcgaggatttagccccgcccccagccccgcccccgcaaaagatgcattcccagaccggaaaaggttcttgctgcaatcctatagtcaaccacagggaggcgacagcggcttcgctagaaaagaggggctccccaatggcggaagcggaaaaggcgggacttacgaagcacgttcagtcaatcactaagagtgaggctgaaaggtggctgttctctacgcttatcggccgcccggctgcttgtgaagttccagcctcatggcggagataattcaggaacgtatagaagatcgaatcccggagttggaacagctggagcgcatcggactcttcagtcacgcggagattaagtgagagaggatcagggaagaggaaggagcggggaggccggaggggagcttgaggccagtgtgtggcggggaccggcgtgctgacttttctgagtttgtttgtagctaccatgctagcagagggaaaagtccgtggctggaatttgaccacggtcagaattcaactttaacgtattgcaatgcgatccataatcagtccgtttacccttcctactgaccgtcatccaatggtcagggtcttgcggccgtaaaggtgatccagccaggatcctagcccgtcaaggatactgggcagtgtgaatggcgggagaattccgattagaaaatggttatagtttaaaagtttggggtatacagctttagatagtcgagtacagcgccacggaagcccagggggagtgggtaggtctccctaactaaacttatagactgaagaccattcaattcatttcctatgcttctttagcgctctgccacagggcacggaatatagttggcatttggtaatttggtaaaatcagttacttttagtgattttc

SEQ ID NO: 20250 - DNA, 1148 bp, Mus musculus
gcggcttcgggggttcggcggcggcggtggcggcggcggcttcgggcggcaaatccggcggcgggggctgtggaggcggcggcagttactcggcctcctcctcctcggcggcggccgcggcggcggcggcgggggccgcggtgttgccggtgaagaagccgaaaatggagcacgtccaggctgaccacgagcttttcctccaggcctttgagagtgagtgtgagcggcttcgagggcaggggtgcccctctccggcgttcggggcacggggcactccgccgggttctcggagagtccacttgctttgggagtggagggaggactcgctggggaacgccggggtcccgagcaggtccctgactcccggaagggtcgccccggggcccccaggttcagagcagccttggaggtggggacgtgacggttgaactgagcgcatatagatcccgagacgagttggtgttttcgtttgtgtcttccttactccacaagtacagggattatagttgtaggtttcggggggacgagacacagcctgtccggagatgagtgttgtaaagccgaggaaattgtcatgggtctgaaatgcgttcgtacccactctggctgcgtgtgagtgaacacgcagcatttgaaaccttttaagcttttcaaacctttccgcccattttatgggtgcgtagactgagagagacagaatggggcaagcgtcctctccgtggacaaccttggagttgtttcttaattccagaacattttttttttaaatcccggtttttcgttttaaaagatgcgtggagggcgaaactgacttttttggaaaggggatcacacagtgcctggaaacaaacaatagaatttataaacattatgactataaataaaattgttactaagtgggcattatatcctgatggttttgcacctcttttgtgtagatagtggaatttagcaatcttctagctgggtattttacggcaacttgaatgaagtcagctttgccgttgaatctctttatttacactatatccgtggcatatgttatgggctttggtatcagctgtgcttggaaagacgttttacattgttttaatactcttccttcattttcattgattcttcgtgaaattcttattggaatttaatac

SEQ ID NO: 20251 - DNA, 1127 bp, Mus musculus
atttacttattagggtgtgtatacatgtgtgtcactgcacaactggaggtcagaggaaaacttgtgtagtcatttttcactgcctcatgcttgtcctcttttgctgtttaaaattactacaaaagcctgttgatgtttctgttgataatccattctaaacatttcttttttttttttttaagaatttattttatgtatatgagtggattgtagctgtctttagacacaccagaagaggccattggatcccattgcagatggttataagccaccatgtggttgctgggaattaaactcaggagcactggaagagcagttagtgcgcttaaccaccgagccagccatctctccagcccctaatggtttttctttattagctaatatatcagattaaaagttacaagtagttcatgcttgattttcttattgtagaggttctaactcatatgtaaaaatggcattttaaaatagtaaattatatatctacagtaattttgggacttttttttaacttttaatttgagagtaaagctctactttgaataatcttttaggaagaatgagtttccattgctttaatgtatttgaaagactggggaggtaaaaaacttgctgaacatgtcctagcaccatgggaaagatatttaatactacttaaattgatttagcttctattggcaaccttttttgataacatggaatgataaaccttccacttgccgaacagtggtggcgcactcctttaatcccagcacttgggagacagaggcaggtggatatctgagttcaaggccagcctggtctagagagtgagttccaggacacacaaaaaccttgtctcggaaaaaaaaggaaaaaaataaccttccactttataacaaagccaataaagcactgtgattatgggatatttgtgtattgtagtagaattggcttattattttgattaatacacttaagaggagaagcacattgggttcccaagccacagtagttaaagagagaatcaaacatttatcagttacttctcctctctgaggttttgtttgtttgttgttttgagacagggtttctctgtgtagccttggctgtcctggaactcagaaatccgcctgcctctgactccc

SEQ ID NO: 20252 - DNA, 1437 bp, Mus musculus
aatggccttgtgcatacagggcaattctaccaactacactaccttcccagtcttgttttatttatgctttttctcttgatggtagttgaaaccgaagccttgtacatataggcatgtattttaaccacttctctgtacttgttgctccacgtctccattcccaagccatttattccatgatgatagtacaaaaaccttggaagtaatttcagctcaatactggataaactgtatcatcatttccattatattgtccttatcttcaatttctttaatattgggaatcttaactgtacaattttaattttttctttctaattttcagcagtatgttagtttcacattccattttgtacttgtggctttataatttattgttgttgatatgtaagtataatttatcaatcttttctttgccaggatgtaagttgtccaataagacaagtccctactggtaaaaagcaggtgcctttgaatcctgacctcaatcaaacaaaaccaggaaattttccatccctggcagtttccagtaatgaatttgaacctagtaacagccatatggtgaagtcctactcgttgctgtttagagtaactcgtccaggaagaagagaatttaatggaatgattaatggagaaaccaatgaaaatattggtaattttatttctgtaatttcactaggttttattattagagattaaagtggtcactgaaaatgtttgatttagtatttctaacatttagaaatgtttttgaagctttcctttttttttttaaaccttgactttttgctggccatggtagtttgttcctttaatccaggtcttcgaatgctgagtcagtagaacatgagtttaaggctagcctaggctatatagtgtaaaaagatggtctcaaggataaagtaaaccagatgataataaataaattaaaacaactcaccaaaccttgtttctttccaaagttggaaagcctgttatcttactttactggacattgaccgtgggccttccttaggttaggtgtctgctcactgcttagcttaaccaggagctttccccctttttgcctcactgcttctccttctccctctctttctctcttctttaattctgtcttgatgcagtctcttcattgcctagcttggactcatggtccgtaggctcagattcactggtgatactattggtgcatgagcagtaaaacatattacaagtttatccctgtacccatttctttatttttccagcagatctgaattcatttttgaggtaatcattcaattgatgtatagttactgccattacaaagataattaaacaagaagtgctcttctcagaagatttaatactcagtttaggagagataggaattttaaaattgaattgaaatgaccagcagtataatagaggtactgtttgaaacttagaaggagatag

SEQ ID NO: 20253 - DNA, 3215 bp, Mus musculus
accatccttgatttcttgatttctttctcctttatattgccagtgcatacaaagatatgtgatgtacttaaaggttatgaaagtcacatagtgagcgttagccccacaatcctgattgcctcagatgaagccatgaaacctacggaaacttaagggagttaagtaactccacaagatgacctggtgtgcagatgcacatgcacaatactaaaaataaactttacaaaacaagtgatggaagagtggacaaatgattcagtggttaagagccaagcattaaggttcaattcccatctttcacagtagttcattcctgtctgtcattccaggcacacatgtggtatgttaatgcatgtgcaggcaaaaaattcatatacatatattatacattcatagggattggattaaatgtttgcctcctaccccctgatatgcccatttaaatgtaatcaacgttttaaaagtagattgcttacctacaatgtatagagtagtattcctcacatcccagaattcatgactttagtcaggtctcagtctgacagctcttacggttcctttattgaggctcctatcagatcttaatattagttactggctattaagtaacttgctcggacttgtttgtcatgttacacagtgcttatctcttgttgttttcccaaagaatttgtatcattaatgctttgtttttcttgaatagatttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgagaaatgcagcaaaaactagaaaaaggagaatctgcgaccccttcaaatgaagaaatagctgaggaacaaaatggaacagcaaatggattcagtgaaactaactcaaaagagaaagctttggaaactgacggtgtctcaggggttccaaaacagagcaagaaacaaaaactctgagaacttgccccatgttttgaacagacactgaagttgcttctagggaattcagcctctaggaagagttttggttttaggttgtttggcttttaatcatggattgggaacaggcagtgttcgatgatgtcattgatttcagcacggaggttctgtgggtctgcttggctgcttctcctcacgtgcttatcaactttagtgatgtcctcaatttggttttagcctgaaaagcagtttttcaaatagttaattttttcttagctatgacacacatcttattaaatatattgggttaatctagaaatttcacacctaaattttaatgcttatttcatttgtgactttttctgctttgtaattatgagacattttctgggaaagggatgttgggatgttatgctgtcttagagatggagaatttttgtgaaattgttacttacattgccactttcccccaaacgttgacccttgattcagaaatcatgcatctgggatgagaagttacaaagcaagttctgcatcagttgtgttacaagttcaaaacagcaccagttggtctcctgtcggaggcagtgtgactgccttccatgcagccatgcagtgccgtcccgtgcgcactgagggagctcgctgttccttttcaagtgaatggttttagtgcttgttttcccagtttaggtttttacttgaacatgtttttagtttttccttttaattaggtaaccccatgggaaattgttctgtgcacgtcttttgcactaggatggtaaagcaagagaaacagttggagattcagaagatgccactgtggggagggtgtctctgagtgtaaaccagaagatgtcacaccttgtttcctttgtgacatccttcttgattagaatatccatacagataagctgacttgaattgttgtgagcaattttccctgtgttctgtgttttatgcacatattcgtggttgggttttctccaacagaaagtggtttcactactggcacggatagctttttattccagctccaagcactgtggttgaataacatcacctcaattttttattatcctttaaagatattgcattttcatattctttatttataaaggatcaatgctgctgtaaatactggtatttttaatgttttaatttcattccaccaccatcagatgcagttccctgttttgtttggttaagggacataagctttctcatggtgtcttcagagatttataagtgtaaatactgatttggctggtctttatgatgtgtttaactgtgaggctatttaaatagtgtggatgtgacttgtcatccagtattaagttcttagttactggtttttgtgttaaaaaaaaataagaaagagggaagctgcagttttcgttgtaggctccctagctggtaaactctcctcacgagttcactgaactctgatttttgcctctgggtagtgggttctgagcatttctcctgggctttaatttgctaaagctgtgcacatatgtaaaaatcaaaaaaatagattattttagggaagatgtaggtgtagaattattgcttatgtcatttcttaaagcagttatgctcttaatgcttaaaagaaggctagcattgtttgcacaaaaaattggtgatttccctcccctgaacagtaatgaaattacttctgttgagtaaactttttatgtcatcttataataaaagctaaaaatgccctttggttctatttataaaaaaaaaaaagcttttctatatgtacccttgaaaacagattttgaagaaatcatgtaagatgataaagcatttgaatggtacaatagatgtaaaaaaattcagtttaaaagaaacgtttgtttttacattaaatgtttatttgaaatcaaatgattttgtacataaagttcaataatataaagctgtcttctgcttttcttcattcatggtctgcattgttattactgtgtgcttttgcttagatggcttaggaaggatccagaaaagaacactggtttgatgagagcttaatatgaaatcaaggaaattgaaagtctgccttcaacactcacaggtgacccactgtcatttacagtgattctgacctgctgtgtgtggtgtgctgctaggcggtggctctaccacttagataaatgctattcttctgattcattt

SEQ ID NO: 20254 - DNA, 1232 bp, Mus musculus
ttttttttgtaatttgtgggtctaagcccaattctttgttgttaaatatttattaaatttagccaagatctttctaagtagctactgtcactcagttctattcaatgtgtgtatcccttgaaaagatcattataattttttttgtgtctttgtcttgaaagagtggacaactggctttgagggatacagtctgagcagtcgaagaaatatagccctccggaatgatgccgagtcctcgggtgttctctactccagcgctccaacctacttctgtgggcagacgctgacattcaggcaagtggattgggacatgcctggcatgcctctggctgtgtactggagcgtgtggggtgtgcctgagtctgagcttggcacgccccagctttagtccatctcttacagggtcagcttggcaacgcttttgttttgtgttgttttattaaaacagggttttactgtgtaaccctggctggcttggagctcacaaagaccagactgggctcaaacttagagaagtctgcttgcctcttttccaagtgctggaattaaaggcgtgcctaaccacaccaggcttttgacaaggcttcattcagacttttcctgtttcagttgtctgtgtctgtggggttctgtataaaagcttggtacttgatttgtttgtctcttttgctctggtaagtaaggatgaatagaatacctgttagaagtttttaaaagtcagaggcatggtggtgcaaatctgtcactccagaactcaggagatggaggaattcaagatggcctcagcacaaagcaagtcagcatgggctgtgtaagaccctgtctgtacaacaaagcaaactgctcggaggccaagaattatttttccctttgtctctgaaaagcagcttactgttaagagcacggcgtgtgtgtaactctgtaaaatataactgaaagcacgccttccctgccatcagctctcctttacctgctttcttgttagccgagcagtgtgttctatggtcgtatttctaaatagctctttgtagaaaaccaaagcccagatgctttggtttggtttggttttggctaagccctgttttggtttgagtgattaaacgtgtgcctggcttttaccatgcgtacttcagggtaacagaatctccgcaagattttaagtctcaagattatcaaatatttttatttctttaaaaatgttcttaattgggctggagagatgactcagcagt

SEQ ID NO: 20255 - DNA, 1154 bp, Mus musculus
gtgaatatactttttttacatatattctttaaatctgtatatctgagttactatattttaattagaaaccatgtccaaattagccattgtatcttggctgttgataaatcattcagagcaagaaggaaggaaccaggcacgctaacatagcattgggataccacggcaggggggtggtcagttcaaggacaggctggaaaatagaataagactcactctcagagaagaaggaaaggagaagcaactgggtgtgataatgcaaacctgtaatctggaagttgaggcaggaagatcaccatgaattcaaggccagcctgggatacatatagtaagaccctatctcaggtcaaacaaaaggaaaggaaaggaaatactgatagcatgttgtctgtgccttctcccagaatggtccatactgcccctgttcagcacatagacctgtgtgttggtctagatgtcctggttctgtggattttacctaacttaaaaatccttctccataggtggatgatgacttcacagcccaagattacaggcttcagttccgcaaatgtactgcaaatcattttgaagacgtgtatgtaggttctgaaacggagttcatagtgttgcacatagaccccaatgtagattatcaattcagagtctgcgcccgaggagacggcaggcaggaatggagtccttggagtgttccccagacaggccactccacactggtgcctcatggtatgtatgctcttaccatgtcagacctgaagctccatggggtatagaaactttttttcaccttctgctgggattcctagccacttttcctaaggataatcctgaattgagagactgtggaacctgcctttccttagatcactcatggaaatgattttcatcacatctgtgtagtagattggcctttggactcacaattgagtatcacctaaaaccacacactgaaaatggtgccgaggacactgacttttctagaccctctaaaagtcttacaaacttgatgttggtctttctcctccattactgatttaaagggcatactcctttttcctagaatagttaggatcttgctgtgttgcccaacattattttgaacacaacaagactcatttcagcttcccaggtagctgggctacagccatgagcca

SEQ ID NO: 20256 - DNA, 1124 bp, Mus musculus
tgtgtggtcctgatgactctagagtatggtgactttaaagaagagcttatttctcttaatgtaaattttgaaagacttttgtatttttgtggttcaagtttaaaatgaaaaatttgagttacaaattgtatatatgactgtgacattttttctgaatgtttggattatctatttttgctttattgtatactttctgtatgtgtgaactgtttgtagaataattttcacttatagatttctagagctgtttcagttctaagcttacctgtcatttttcccttttcctgtaattgtcctctcctgccaagcagcagagctgtgccactgtaaataggcagtctctaaagttacacaatggaaaacagttatgtacagggtattttaaaatgtcctaggaagtaaattatgcctcggttgtgaaaagcattgcctttgtttcttgtgccttcttccaccacgttttacatgtaatcattgagtcattagcactggcagagtaaagccttctgaattctagcatttgcctagataagaccatctgtcactcactccctgtagttacacagtccagtgaatcttgccaactcaagtcgtttgtacattttctggtacttttatatcattgttttatttcataaagtaatgacactgtttatctgttgtggacaacttgttgatggttcaagaagtaatgacggattctaccatggggcttctacctgactgctgttcccatttgagtatggcgtttgttgttggtttttgtttttggtgctgaggattaaatttaagggtttttgtattataggcaaatgtcttgtatcctagtatatacacaggcgttgtgttttactaattatttgcagtggtacgtatcaaatccaagatctcgtgcattctatgaacatgctaaaccacagagcgagaacccccatcctgtttttgaggcagggtctggtatattgcttaggctactcctaatctccttccagaattttgtaatccccgtctcaagctccttcagtacttacaggtatttgctaccacactgagcaaggtcatcttttaatattttttgagtacctatttttaactttagtagcaagtttttaaaatgcacattt

SEQ ID NO: 20257 - DNA, 3024 bp, Mus musculus
ggagtttggtcctagcagaatagtagaggctggctctaccctctgggcagattccctcacacccttgtcctttttctcacaagaaaaccctgtcctgggatccttagcagaggtcaccctgcctgccgggaacccacagggattctggattcctccccacccagagggaaggctatttttagtgttctctttttcctcagccctctctgtctccctcctcttcaccccagatgtgtttgtcacaaggagactcttcccatctgttgacaaccctatgaacactgagttagggaggaagctctggcccagggctgagcttatagggcataaaggaaaaaaacgaacaggtgaccccaatggcgggggggtggggggagccctggtgcctccctagactcaccagtatggctacaactacctcagcctggtgtggtaactagcccaggcctttgatctcagtgttgggggcagaggcaggtagaactctgtgtgttccaagccagcctggtatacatagtgagttccaggacagctgcagctacataacaggactgtttctaaaacctaaaacacaaacaaaacaaacaaacaaaaaaaacctaacccacaactgtctttaccatccagttcccaagcccaaggacacagaagccaattgactgagcactctgacagctgttctctgctctccgtggggctgaatccccgagtctctgccactcctttcctctctgtcttctgtctttctcctttggtctgtttttttttttcttctctctctcatttaaagtttcagtgttgtcctggctccctccgtcagaacacacatgtcccgccggggaaccgcaccagcatggctgcctttcccaaccccccttttccccttgcagccacatcagcagagactggctgtggcctggggtgacccatctcggaggatctggctggctactgtgcatctgaagttctggagaagtgttcacctcagccctagttgtccagaaggaagccctgaggccagcagctgccccactagtgaactccagggtgtggttgatcctacgactccccgtgctccttccagcaaactctcctcagtcttgaggagctggtatggagaagaattcagctctccaagcttagaagtcctgaagggttcctcataactgcaccaagagctggccatggtgacgcatgccaggcaagaggcgagggtgccatgagcccagtgacaacctggactacactgggggttcagttcagcctgagttacatagcaagaccttgtctcagaaacaaacaaacaaacaaaccaaaaaccagaacagaaaaaaacagcactcaggaggcagagactggcagatctgggacagtcacagccagggcaggttacactgagaaaccctgtctagaaaaactaaaaacaaaaaacagaaacaaaagcaagcaagcaaacaacaacaaaaactacagataggggtggatgttgcaattaaaaaaaaaaaagtgcccacagcatccagacaaaatttttaaagtttaatctaaacctaactatgaagaaatcctcagacattcatttattacttacatgttgctatacagccagcctggattcttcaaatgacacgattataaaaggtaaaatgggccaggcatggtggtaaacacctttaggtctgtgcactcagcaggcaaaagcaggtgcatctctttgagtttaaggccagcctggtctacatagttgagttctaagacaaccagagctacatatagagaatttgtttcaaacaaacaaacaacaacaaaaaacgaggagaggggatgatacagacagacagaccaaagccaggggtgatactacctataattttagcattagggaagtagaggcaggacgatcagaggttctgctattatacacagagagtaaagggctaacctgggctacatgaaaccctcattcaaagaagaaaaaaacaaagcctgtaccaagttatggcaacaaatgcaatttgggattcttgtttggaacctggattttaaaaagagagaaaccttaatgttgggtggcattggtagtgcatgcctttaatcccagtgcttgggaagtagaggcaggctaatctttgtgagttcaaggccagcctggtctacaaagtgagttccaggacagccagcattacacagaaattctgtttcaaaaagatgggagaaggactggagagatgactcaaaggttgagagcactggctgttcttccagaggtcctgagttcaattcccagcaaccacatggtgactcacaaccatctgtaatgggatccggtgccctcttctggctttcaggcatatatgcaggcagaacactacataataaataaataaataaatcttattttaaaaaatgggagcgagatggagagaaaccttgaagctgggtaaatggctcaatagttaagagcactggctgctcttgcagaggacctgtcacccatacgacagcttacaactatttgtaactctagttccagaggatcagacactctcacaacaatacacaaaataaaaatttaaaagacgccactgtaaaggacataattggttttggagaaattagggcctggatgtatattagatgacaatattgtaaaattgtaacaatcatgatgtgtttgtatagaatgttcctgtcctttgggacacatactgaagtaaaatgtagtgatgtctatggccaattttttttttttttttttttttggtttttcaagacagggtttctctttatagccctggctgtcctggagctcactctgtagaccaggctggcctcgaactcagaaatccgcctgtctctgcctcccgagtgctgggattaaaggcgtgcgccaccacgcccggcttatggccaatttttaaatggttcaattgaaaaaaaatcagatatacatatgtatatatgtacatgaatggaatgtatgtgtgtgtatttctgtatctatatacagagagcataccactg

SEQ ID NO: 20258 - DNA, 1227 bp, Mus musculus
aggaaatgttaatgttggtgagagcatattaccttactatcattgtaaagtacaggagggaaactggctagatcagcactacagagatctatatgagggaagagagacctggaacaaacatctagtactctaagcaatcttttgacaaacttactctgagagacgtaaatatgagtcagatttaccaattttagtgttccttgttgagtatgttactgaaccatggtgtaataaaaccatgaactgagaacctagaatttttcattatagaagtaagccaggagacttgtccactatcctcattttcagcctgttccttggggtataactctgtccctttgtctgtcgcctgctcttgctgagctgggtgtttatggaaagtgagtctggaatgagttctctttagaccccagggacttttgctgtctgtgaatccagtgtaccagttctcccaggcctagctcccgacgtttgcttttctccctggcaggcacagctgcagtgttcgcatcaactgtatttactgatttactttatttcaggttttctctttttacatacactttttatccagagggggaggcatgagactacttggactgtgcttcgacgatttggttatgacgatgacctggacctgacgcctgagtatttattccccctgtatgtacctcagcgctctcatttcgtttactttctaagttatttcactttatagtgttttatttaatagatgcatatttttaagtgtctcatgactaatttaaaattataggtagtttctcaactttggcactctgaacttttgagtctgtctattgtgtagctctggctgacttagaactcactctgtagaccaggctggcctggaactcatagagatccgcctgcctctgcctaactgagtgctgggattaatggtgtgtgccaacactgccaggcctgaaaattctttattgtggatattgtctgtcctccccactacaggatggtgagctgatccttcagtgacagcagtcctcttcttttatttgtgatgagtaaaaatgtcctctcatgagaaaaatcactcacagttgaaagccagtacttactatagcagaaacactatttatttacttagttgaatttttttgttgttttaaggcaggtttcttactgtacggagcaggtcagccttgaactcacagagatctgtctgcctctgttttccaagtgttgagatta

SEQ ID NO: 20259 - DNA, 1606 bp, Mus musculus
tgacattaaaaatattcagctgatttatctgacttcatttcccacgtgacaaaaatatagaaaattttaggtgttagcttctgactagtcgctaactgtaagacatttgtctctcctgaagcctgttttgtagtattcgctatatcgaccagggttttggggaagcactactgtatgcagttagcctgacaagtgtgctaacacttcccccagatggacagttagatgagtactgtaactttttcctactaacaatgttttcaatattaattgtattttctgactgcaggcacgtgacacaagctgacctcaagagctcaacgttctggcttcgcgcaagctttggtgctacggtctttgcagtcgtgggctttgctatgtacagagcactactgaaacagcgatgattaagggaggcaccggcctaccaaaacacatacttctatgtacattctgaatgctttaaattctgctagaatattgagatatttatacatgcagagttactttattaatatttgtaattcatgcataagagtattttactcctagtaatgactgcagtattgactggcatgtggaaagaaaacatcttaggagccaaatataagtggctaaatttcagaggccaaaagggaatattttgtaaataatgtacatattcaagcaagatacggtctcctgaactgacttcagaaatgtgtttccaggcatttctacagtagtgttctagtgttcacttggctcaccctgctaggtttcagtcacccagagattgtgtttactcaggcatcacgtatttatttcaaggtgactcagaacaatccttcggcttctgtagccgtttctctccatttttaagatcacacaggagacgaggtcagctttccaaaaccactctgtttccgtcacttgcggtaggccggcttcaaagccatcatgaaacctagaaagttgtggagctgagtatgtggctgagggcctgaggcaggagcaggtggcggaggttacctgtgtcaccacattgcttctttgtcagagtgtggattttatagccctttcaatcaaatggggaaaacagtttgtatattatcaatgtttttagttacaataaagaagccgccctgaccactgctgaattcccacctgaagtgaaaccgtcctcgaatggccgtgtctgtgtagttattgccgtagctgcatgtgtcatgatgtgttctgtatctggccaggataacctagaggcaacacttttttaatggtaaaataaatctaatgaatataaactctcacaataaacctattttttccatcattgaccttttcaagtatttaaataaataactgctgtgtactgtgatcttgaggttttttgtcttctgaggtaaatatctctgtccagatgtgagtgtgctcctttggtttctacctttcttagtttagacattatttttatacaaaaaagtactactcggtaggaaggaagttgtaggatgtgtgtaggagatctacttagagggctgtgacggcgatctctgaggtctgcctgccctgcctgcccttctgactctgtcatggtcgtctactccttgtcatgatggcgctt

SEQ ID NO: 20260 - DNA, 1206 bp, Mus musculus
ctaagatgactggaaacaccccagcttcttccttttgtgctttttttgtttaatttaattaaacacaacaatcagaggaatgtcttcaccaggtcctaggcagacgctgtgttacagctggggaattttgctgtctcataaatcctaagcacgtgctgcctaaagagctctggagatgagttttggcttcttgggagtttaccgtagtgtttagcaggatttcctcctccaaaagaaacatagtatgcctttctcagtacaatgtagaagtttgtaaagtacatgatcctagcaagatgtgatgacacatgcctataatcccagctactcaggaggttgaggcaggaggttgtgaggttccaggccagcctgagctactgagtaagtttatgtccagcttggactacagggcagtcatcaccttcctggtcttactgcaccatcagctcgcttcattgacagcctgttcatcctctgagtgcctgatacaaaccaatgggcaggaatgacgaagccaccttttgaagcgaatatacacacgaattatgagtgtataagcacttaaaaatgagctttatgtatagaaacttgtgggctggcaaggtggctcagaaggtaaagaaacctgccaccaagtctgacaacctatgttcaatccccaaactcacttggtaggagagaaccaactccacaagttgcctctgacccatacagagctacatactcaataaataaatacatgaagatatggtgggctggagaggcagctcagcagttaagagcattgttgctcttggagaggagccggcacctacctggtggctcaatttcaggggatttgacaccctgttctgacctcctcaagcgtcaggcacacatgtagtgtatagatatacatgcagacaaaacatacacataaaataatctaaaaccagtaagaaagaaaagaaagaggaagagagagaagaaagggtatactagcttcaagatgaaacattctctctgactaaaaagctcttgtggcaatttacacaataggtatttatttgccaggagcctgtatttttttcttccttatttctagataaaaatgctggaattcttaagcagtattaagaaaaagggaaataaaacagttaatataggaaatatcctttacaagcaaatataagaatgcacatgtggtgattcatgtctttgaatgta

SEQ ID NO: 20261 - DNA, 1202 bp, Mus musculus
ggccttgaactcagaaatccacctgcctctgcctctcaagtgctgggattaaaggcatgcgccacaattgcccagctttaaaactgaatttatattaagttccctccttttttattagaagtgtgtgtgtgtgtgtgtgtgtgtgtgtggtgttttgcctacataggtatgctgtatacctagtgctctaggaggacagaagagcattagaatcaccgggaactgtcattctggttgtgagctgccttatagatgtgggaaaagaatctgggtattctgaaagagcagcaaatgctcttaaccttggagtcattttaacatttcctgttagatgagatgaaaggcatttgttatattatttatattgaggcagaatctcactatgtaattacttttgtttcctttagttggcaggagggcaattttgtgcagttttttaaccttaatgatgaccaggtattgtaacagagattttgatgatgagaagatccttatacagcaccaaaaagcaaagcattttaaatgccatatttgtcataagaaattatacacaggacctggtttagcaattcattgcatgcaggtaagaatttctcttctgttttgaccttgtcccattgtgatttgtaaccacatgaataatattgaatttgtctttggttgtttatatattgggtaaatagccaaatctacttaaaactcaggtatgtgttctattctctttttttggtaggtggtagggatagaacccaattgataagcacaagctttggcacaggagtacctacctagaattcacgtctgttctgtggccattaagaagataagtggacttgactgttaattttgagacagttcttacttagtatttattctagctgactgacctagaatgttgttatgtagattcggctaccctcaaattcacaaagatactctttcctctgcctcataagtgtattcagttttttgtgtgatgagtatacaagaacacaccctatttggaagtattgttgtgttcaatgtccaaattgcttgcttgctggtgcccccgttttttttttttttttttttgtgtgtgtggatttggacgcatagtttgagtacatgaggctgggaggtgttctttggagctgaattttcaggcagctgtgagctcttatttgggtggcagaaattaaactcaagtcatctggaagatc

SEQ ID NO: 20262 - DNA, 3417 bp, Mus musculus
tacctaaatatcagagaaatcttcctcgaccaggacaaactccaattggtaatccaccagttggaccaattgggggtatgatgccaccacagccaggcctgccacagcagcaggcaatgcgacctccaatgccacctcatggtactttttttccccttcctttcttttagtgacttaaaagtggtatgtgtgtgtgtgtgtgtgtgtgtgtgtataaaatgtttaaaagcgaaagacagactaactttatatattgtggtgttttttaggtcagtatggtggtcatcatcaaggcatgccaggttatcttcctggcgctatgccaccgtatggacagggaccaccaatggtgcccccttaccaaggtgggcctcctcgacctccaatgggaatgagacctcctgtaatgtcgcaaggtggccgttactgatcttacttcatcaagtctaataggtttggagattaaaccttttctcaacttgtgctgtttatatagacaagcttccgtcattaaggcttcattgtgacttttaacaaacataatcttcccacataccaggaactattggacatttatttgacatgggagaaattatttggaataataaaacaggaacttttcctgaagttgcaatttatactgtatggcttctttttcatgtttcatctaggtttttagaagtgaagtatagtaaatttggttcgttaaattgtgaaggcgctggaattacatgaacataccaccttaaataaaggcaagttctgtaagattacattgctatttgtaaagttatgccttcgcagcatttccaatgctgttggacttcatgtccccaacctagcttggtgagggttgtaactgtttccaagtacttgtacattggaagtttgaatgtgtaacaatatttaatgtaattagagagagttcctcctgttgcagggtttaagaaaacgggcccattattatggtcatgtgacttttctgtactgttaaacttcattgtaataaaatgagacaaaaatttatgcctttttattcataacccagctgtggaccactgcctgaaaggtttgtatggatgcatgccacggtagatgtccacgtaataaaactcagttaccaatacagttttgatacatgattgaattctttaagctgtagattttagctgcatgttttagtatattacagaatatataaagttcttgttaatgtatctgttgacagaaacaacacatgaatcattacatacgtgtaggaaggctttgtgtatgttttacttctttgggtttcatgttacagaagttcacaatgtaaacttcacattttcatgctaagattgtttagagcctagtgccagatgcattcattttcttgggattaatttagagacttcaggtgccagttgaataatttatgaacctcagaagctatccaggtgcttctagaagcttaggtgctgcatgcttcttgtgttaatgtaggttcacttgttgtactgtgcttctagtacagtgttggaaagtttttattacactccttggaagttatttgagattagctaggtaacctgtgtaaagtcagatagcttgactggaaattaggatcctgggaggtttaggatattgctgtgtcctgtaggaaattttactgtaggggtgattacctaccattggggaatttgtgttggatgtctcaccgtagtcgttcttacagcgtttgtggacatcttttctgggttgggggcacatgaggcttgggtaggtttatggtcagttaagtatcaggtgatctgtacaaagtaattacccatagaacgaatatgggttgatttgatttaacaattctgagcaaatgctgtctttaatagttctaggaagggtattagataaatgatgtgacaatataagttaccttaattttgtaggaatttatattgaaaatatttttggcttgttaacagaggaaagttagaacaagtaaagttcattctgaaatatgacaatttaaatctgaatgtcattttttagtctgatatttactgcactgattgtgtgccgcctctgctgtagttactggtacacagaaagttccagtttgtaatgaaaatattcatatataccagaaatgagttcctgccagctgctaaattagccttcacttcttcatcctgattacctctctagttaattaaagtttcttagactagcagcactgccaaagaaaaccctttattgaaaatattaaagtttagtttgtcagtggtgatgcatacagagacaagtgcatttctccttgaattgtaggaaggccatccagtgctacagagtaagttccagagcagtgagggctacccaaagaaatcctgtccaaaaaaaaacaagcaaaaaaccttttaaaaagatggcaagattacatttagaaatgctttcttttaaaacagaacatttcagaatttcatgaatttgattatcagacaactgaagtattgatagaacttttaagaattatgcaaagcttacatttatattttgttcaaagcacaagatagcaggccttattctttgaagtctacaacttaaaagtaaaagaatcctaatattctaaaagtttgtaacataaggtactctaatgaaatataatttgtgcctcaggagtggggtccatttactatgttgttgaaagtataatttttgcatgcatcaagaataattaaacttctagaaagtactgcttacctaattgcttctggggtccatagtgcggttaaatcacaagtgtaacaaatttggtttatacttgaattcagatggtgttacaaagtctgctttcagttatttgctatgtccctgtacaacattgaatgaagctttaagataaataagcctgtcggcttccatctacttgtgggtcaggtttttaaaagaaaagtctggcactagtttctactctatttagctattgatagaaaaaaagactagcagatgaggatccacttctgagtgacttctgaagttatcacttaatttgacgccttagtattatagtaatctcatgccacttgttagggggagaacacctattcagattacacattgagcttaaactgagtttaatgaatcacttctgggaatctccaagaaataagtttggactcagtgcagctgtagacaaaaagacctgctctttttctattgcttgcttgatcattgggacttaaaaaaaattgatgcatgtcttttttaattaattgggtgatgtttttctaaaattaaaattttcttcttcctatagccctgccataggacaggctgaggctgagtctcagtgttgccctgttcagtctgaggcaagtgggatttattttattacttatgggggctttcacagctttatggctgttggatatttatgtc

SEQ ID NO: 20263 - DNA, 1225 bp, Mus musculus
tatgctctttaatgttctcaaatctcaccacactagagcaaatgttaatgtagagccctgtaatgagtggggaggtcatttgtctgtgcgtgtgtggtgtattatagatgggtgtagactacaggtgtggtattaaagggctttgggtattacatggctcaatggaaagagaactaattttcaggtagccaaactgaaattgggtcatataataaatatgaaactagttcagaatgattttggaagttaaattttcagattttactgagcagtgcttcatgtaatgcacacaccagtagtatatccacatttgttttcaagtagaatttgctttgattttggtgttcagaactagtgtgttgggaaatggggtgatgacagaaagtaggttccaacttgtttattccttacatcagactggaaacagattttaatccttgggggggagttgtggttattttaattttagattttttcaaatgggttttctctgtataaccctagctgtcagtctggaactcttgtttacaagacctcgaactcaggtatctgcctgcctctctgcttccccagtgttgtgattaaaggcctgggccccgacacctgacaagatattaatactttcaggaactactgtttccgtgacaatgttccactggattgctgataacatttagtaaattacagttttgggttttttttttttagacttgttaaatggactttacttcaatcatagggtgcttatctaatgctatgtccaagaccttgaatttcattcccaccaccatttaacaactgtgactgcaggtgtatttttatcttgtgtccaccctactctagtatatgtaaatctcttaaaattgcctgagccgattttaagttaaaataggttcttattttcttgaatataggggtggggaagcgatttactaatcatgatacatttgcttaatgaataccaaatcattctttgcacttggctgtattcctcacagttgggaatttgagttaggaagattgctgtgagtttggagatcagcctgggctacagagtataagaccctgtcagggtggagatgatggctttgtagttcagtgatccagagaaccagttgagaattatgcagttttcaggtttctgtaaaagcacactgataacatttgataaacaatactgacttcgctttgttgagatacagtaagcaaatgaatgtgggatttg

SEQ ID NO: 20264 - DNA, 1197 bp, Mus musculus
ttgccaggatacaatgatgtttgcaaggaatacagggtataaaagattaatatttaagaccaattgtcctgtcatgattccatgccttcttggctactaagggaacaaaccagagaaacacaaagtggtctgagtgcttcactgcctgagggagtgcctcagtctctcaggaattgaaaaacctatggagcatgcctcttaaggcagctaggccaggccttctccatgcttctttgcagaacatattgtcagtatttagtgcttatcttgcaaaaatgtcagtctttcttatttgtttgttgtttgtttgtttgtatatttttttaggcatggttagtccattgtgtctctgttggaactctctctgtagaccaggctgcctttgaactcaacagttctgcttgcctctgcctccaaagtgttgggattaaggctatgtaccactatgtctggccaatagtttcatacgttttaagaagatagtagcttttttgtttgtttgtttgttttttgtttttcgagacagggtttctctgtgtagccctggctgtcctggaactcactctgtagaccaggctgccctggaactcaaaaattcgcctgcctctgcctcccaagtgctgggattaaaggcaagcaccaccaccgcccagcaatagtagctttttaaaaaagctagctttataaagtgtgtgtctgttcctcaggagtgagtattctatcttttttattttatttttttgagacaaggtctcatggagccctagctggcccaagacctttttatgtagaatagctggcctcaactcacaagatccatcagtgtctgcctctgtctcctgagtgctagaactattactgactgcaacttttgagacagggacttagatgttcctgattaggatatactggttggccattgagctcctggggaatcctcctttctctgcctccccagaattgggcaattgggggtttttcttttctttcttttttgttctggggattgaactgagttcctcaggtttgtgtggctggcagatactttaaggactgagttatctaccctaaaattcacttcagagttacatattttagtgttgttgggttttgtttttttttttttttttgtaaaaactgtattcactaagtttgtgcaatgaccagcactaatttcagaacatttctatcacttca

SEQ ID NO: 20265 - DNA, 1211 bp, Mus musculus
agagaagtaggtaggaagtggaagggagatgcctggtatccttttggatacctgtgtatatgtttgcataacatcacaaagtcacacggtcacaaaattaaaacaaactttttttaatataaaaaatgtgtatatgactgtttgtctacatgtatgtatatgactacatgtatacctggtgcagaagagggcattggatcccctggaactggaacttcagatggttatgaaccaccacgtgggtcctgggaattgaactgggtggtctgccagagcaaccagtgttcttaacctttgaaaactctctctagccccaaacaaacctttctttgggggtggggtgagggggctgggtatgacagctcacacccttcgtccagtgtagtcttcatagtacaatccaggccatccagagttacatagtaagttcctatcttaaaaaggggtgtggagtgagggtgatatggagactaacaaacacatatgtgcatatttcttttgcaggttctcagctgcttcgggagttgaaaaagatggatgataaagcccttttggtggaagtacagcttttagaaagcaaaacttaccatgctctgagtaatctgccgaaagcccgagctgccttaacctctgctcgaaccacagcaaatgccatctactgcccccctaaattgcaggccaccctggacatgcagtcaggtaaaggcccagcagtgcataagacatgctttcttactgctcacctcatcttttttttttttttaaagatttatttatttattatatgtaagtacactgtagctgtcctcagacactccagaagagggcatcagattttgttacaggtggttgtgagccactatgtggttgctggggtttgaactccggaccttcggaagagcagtcagtgctctaaaccactgagccatctcgccagccccctgcacacctcatcttaagggtgaaaggatggggattggggactagaaggtggggtaagggtggaactgaggttgggaaacagttgactgatttggtccaatcttcctcaaagaaaccaattacaagggtgcctttctaaccagctttttcctattaactgtctaaagtacttaagaacacagttattagtgcctgactccaaactggctgactggcttaacatacctgtgttaaccaaatctcttagagaagattgtaagttttttttt

SEQ ID NO: 20266 - DNA, 2523 bp, Mus musculus
atttatttatttatttatttatttattacatgtaaatacattgtagctatcttcagacaccccagaagagggcatcagatctcattatggatggttgtgagccaccatgtggttgctgggatttgaacttgggaccttcggaagagcagtcagtgctcttaaccgctgagccatctctccagccccctaaaggacctttttttttttttttttataaagaagagagtaaatagaaaggcgtgctgtgaaaagttgggagaaaatgaggctagggagtgggtcctattgttactatctaatacctccttccacctggtttgtcactgtgtttctttcagggattttggaccagggggagggtgtcctgatcattttcgatgaacccccagtagataaaacttatgaagctgctctggaaactattcagaacatgagtaaagtagtggactccctctacagcaaagccaagaagctgacataggtgagtgctggccctggggccagggtcaggcagcactgtcctctgcctgtcgacactgaacaccgtctggtcctcacggctttcccgattgacactgctctgtcttctcttgcagagttggatctgtagcggtcctttggagagtgtgtgtggcgggagagtgaacccttggggaaatgctaggagattcttttctttctgttccacttttcgctcggaaagtttttaaccctcattggtgcatctgtatccagcgataggcggccagttctcatgtaatccgtactggccaacacgggaatggggaaattgcttaaaaaaaaagaaaaagaaaaaaaaagattctaaataaaaggaaaaaggcttacactacctaaagctgtgctctctgcctcctgggagagggccgcaaagccaggcaccctgccaaccactggggatcctcacccacctgctgggcgccacctctcctcctcttcagaattgggtgtttgctgaccatcaaaagcaacgactttttattctgtttgtactgaaccaaaacaaacaactatgtatagactgctgttttccttttcatttgaaatgaggcgtttggtgttttcccctgccatctggcctgtccacccttccctctctgacattggctccagcaaactagctgaagggtccgctgtgctgccgccgcagtacatgctcggctccgacctgtgaaaaaacggaaagaagtccaggagctagtgtccaccatggccacacggggagcagtgagggcccacagccctcgggggcctgctgtgcatgtggctttttttaacactgtaactagattagactcagtgttttaaccatccctctccaccctctttgctttcctctcctctttcctctcagccatgtcctttctcttttcctctagaggagttgagctgtctaaactccatctgctgcttccctctcccactctttcctgctgtcagatggatttggttgggttctttttttttttttttttttcctttttaaatagtgaacattaggaatgagactggggtgtttttttttttttaattaaaaaatattaattttccttgttgcatttgaagcaccctcatgtctccttcccagtgtctttctctgcctcttgaaagggtgacagacagggtggcgctgttttagcatgctctgtttttggtgcagttacctagcagcaggctttgatgccttgtgggcaggtaagcgcctgcacctttgctgtgcccactgtgctttgtccctgtcccctccctccctccctccctccctccctccctccctccctccctccgcccatctcccgcctccttcctgctggcctctttctcattctttagaacctttctcagattatccttccaggttttggtaataaatttctattttgtaaaaggattttgttgtaccaggttttgcatcttcactgaatctgactggcttttattttccttttcaaaatcaggtttttgttctcaaccctcctctctccccatcatgtccagtccctgttttggttttggcaccatcattatcaaatgtacaaacggttcttgctgaccaacaccaggtatatctgatgttcagatgagttccaataaaataattttttttttcaaaaggtgtcctttcttgagtgctggagggtttccaaacaagttcaggtgctccataaagccttttctggcttggccagagctatcttacctcactgcctactaggagtccttgtagccattctgggtgtccatatttgaaagggaagttgaactgaggagtggcgtcagaaatggagttcagttgtcttttggggcagggtggctgtgaggacttggggaatgggccgtagtcttcaggttgttcctgagggtttgcaggagtgaaggtgcggagtcctggcggccagcatgctgttgtgtgcttgtgtgctcttcaatagcagctcctttcaccgccctcggaacccaagcgtgggcttctgagggacctatctttggctcaggatagca

SEQ ID NO: 20267 - DNA, 1195 bp, Mus musculus
ggccatacttttgaacagttgttttcaagtcattgttttatgtaatttctctccccacaccctgattgatgtatatggttaagtctccattatttgtttcattctgtccccctgtgactcttctctcccctcttactgtacaaatctaatctactgtggatttggcagtcagacaggcacattagaagggagtagagagagagaggagtggtgttctgatgagatagctcttatgtgacagttgtgagatatgagttttaagaagcccgtgtcttgtcttctctgagaaccctttttgattgctttgctaagttagttcaggaggctgagttctaggtaggtgcggtgccacttgaaacttattactgcccttggcatttggattatgtgtgtggctgaacaaaccaaacttaggagtggaattttccatgctatgagcattttgcttgctggctggcttttggcaagcagccgctgtgcttccatttgcatcccctacctcccaggctccggttttatctgaaaccttagatgaacaggaacttctttaacatggtctcagtttgtcctagacaggtgctgctcagagccagggctgtatcagaagtgcctagcttcagagagacgtctgagctccatctcctagagaccagttttcaactctcatggtgcccaggtgattcttgtgtacggtcaggacagcaaccacgatccaagcaagtgtgctggcatcccagggttgtgctttggtgaagcacaatggggcatggctgtcatatgagctgactggaatagtaacaaatgtaacaggcaagtaatcactgtttgccctttccttttactttagttgtttaatagtcatgtgctactcttcatcctcaagttgtgttttctcttctttcatcataagactaggcctctcccaccgcttttgccatgctgtgtgttgttttacgttctgtgtccagcttctcagccctggctgtcctgggactcacagtgtagaccaggatggcctcaaattcctgtctgtccctctggagtactaggattaaaggcatgcaccacacccagtctgtatccaggttcttaattttaaaaattacattttgtgtgtgcatgcacacgcacgcgcgcacacacacacacacactttggcggagggagatgactctgggtaaaatgcctgcctcac

SEQ ID NO: 20268 - DNA, 1184 bp, Mus musculus
aaaaaaaaaaaaaccaacaaaaaccaaagaaacaacaacaaaaccttccttctcaatttgattttcaattacattttctttagcgttgaataagccagccccaggcttattgatttgtgatcaataagggatgctcactgaagagggatatatagcccatctttaagtgggctgcagttagagatctgctcatccaattgaccacatccaaactgtttcataaaacacccttctgggagctgttaatgggtgtgttgcagaaagcctcttctactacccgaaaagctcccgtttccccatggagttatgttaatctcatcaaaggctctgagaccttctgtttaaagccagccatccccctatgtgtggctccattgtgttaagtaactgctcaccttccagggaagggtctccggtttggggaacactaacctagagtgtgtactcatttggacttctgtgcaaagttccccactttctacagagtctgatctcttcctcccccccccccccccaggacaaccgccctgctgctgtccgttagtcacttggtgctagtgaccaggaacgcctgccatctaaccgggggcctggactggattgaccaatcactgtctgccgctgaggagcacctggaagtccttcgagaggcagccctggcttctgagccagataaaagcctccccaaccctgagggcttcctgcaggaacagtcggccatttaatcatctccgaggccccatttccgcccctgggcgagccttctacttcctgtagatttagttgttctctagagctctgtcggccagccctgggtgcagggtaaagccgagagcctcacgctggacaggctctgctgcaatggcaaacagtggctggagagtggcagtgtaatcccacagttaggggagacgctgtgtacctctacagcagagcgcagaaagctgccgggctcgctgctacatttagttcatttaatgtttccaagaaaatcgagttgccctctaagaattgagagacttcatatcaaattagaatttccggcttctgaaaatcaaggcgtggcaacatggacaatcagaactaagtggctaggtcgagatagtctcttcgggtgacccttgtgctccccttgctaatttgtttgtgttcagtgctttggttcctgaagcatcagagctccc

SEQ ID NO: 20269 - DNA, 1214 bp, Mus musculus
tgcacctttaaaataatcagatgtaattctacaattcagttctatctacagacatgttgggtgaattcctttctgtttcctttaggatctgggtttttgttttttttttttttttttttttttttttttgctcttgttacttttggtatccacgttcattctccatggatgattttcagaccgctctccctgctgataaccaagttcatacatattgttcaaggatagcacaatatcccattatgtggacattccactacagcatccccaatgctccacgtggtaggggggggtgcggctccactcctctgccatcactgtctcctgagcagctcttgcccacatgacttcaaggtttcattaggacagattctcagagacagacccttaaagaccaccatctttttttccaatcagcaggttagatgtactctctccagaagcatgtgaggacataccttctctgcatgccatcgttattttaaaatacccatttctattttaactggtgaggaatcacttcatacggctttgtttttaatttttgagtgacgaatgagacggatctttatccatatgttggcttctgtggcgcatttcctcattggtagattggagctgggcttcctcttcatggctataccagctgctcggcagagaaagagcagaagctgctcaggggaacttggtcccccctcaggccacccccccccagctgtttgcctctggggctgtgtttgctgatccctgagctttctgatccctcatctgtgaaatttggttctaatcctaggcccacaggcttgtcctagggattaggtgacaaacatcactcacctaccgcagtcactgacgtgggcagctgcaacagttcagtcaagcctttcccttctagagtccttcagtttctgtctttgtctcagagtgctcccttaagtcctcagggatctgcaacctcgccatcacctgagaagttattagaaattcagtctcgggctctgctgccatttgcctgtaacaaagcaccaacatattccacatacacaatgaaatcagggcatctccagctataagcattgagatttgaaagacatgtatggctgcactgttcatgcacaacagatagcatcagattcaaaaaaggtgggggaaggataagcatttaggagcctgatgcttgggaactctgatgtctactcccttctcatccttga

SEQ ID NO: 20270 - DNA, 1133 bp, Mus musculus
ccaagggaaagaactgtgtgtagtttgctgctgtcttcccagcacagaacctgacacatagtggatgcccaggaaagccttgaaaaatgagtattttcacgaggtatctgcaggatcgtgtcttctggggccttggttgacttcctctagcaaatactgtaaactgcacttccagggggaagctggcggcctgtggcacgagaagcaggctataaattactggacacctgtaattctcacattttaagatggtagagcaacaagtgaagggtggagcgtttatgggggactttcagggaagggagcagctgtctctcgttagtcccatgtctgaaaacaaacaccagtaggagagaaacgtaatgccgagggcagtgtgttgggctaatttgccaggcacactctgggcgtgttcactgatggctctggatttgttgaagccgaggaaggtttcaccattcgacagtcaaatggagcggtgcctgcttcttctgaaagcctgtgttgtttccctggcatcggctgtgaacttcagctctgctctggctcctttgtagctcctggcagtggagagagtagtctgggcatgaggcagagctctgaggcagagctctgagagcccggggtggggtggggggcttaaaagagaaaccaaaaggctggaaataggaacagacaagccattgcatggtaggttctacatcaagaacaaggggtcattgccctctctgggaaacagcatgcttcaggagggcaagtcaaacagacctggtcttgggctttaggtctgttccttcctaccaatattccctgggcagacacttagcttctgagcttccagtaataaggtctctgtcttagaggtaagaagagataacttggatggcagtagatgcttagtattcaggagccattactaaagtattaaaaaaaaataatagctaggcaccatgtgcatggtacatggtggtaagaggttctaagtactatcaccataattaccctgtctttccttggctacttacctgggagagatgggcatgttcgttcttattttagttctcgaatcaaccatgtggactctgtgccgaggtctttattggatgctagaggtataaaataaaataaggctt

SEQ ID NO: 20271 - DNA, 2143 bp, Mus musculus
cttccttggagacagaggctccttgaaggtgaatttgcctcctcaaaatctgactactcttaggagcacaggtccatagctgggaaaatgtacacaccctgcttaccaaggctggctcctgtatcatgtgtggcagatgcacttgaagggtaaagaaggatgattgctgtgtacaagtgcacacaagggtattttgcaacagtggaagtgtcctaaaataggctcatctgattatcaagaccttgaaatgtggctggcatgactggagaaaaccataaacgtttcaagacaacttcaaatggtctcaagttaccagtgacatcacatatcacctgagcatcagttcaagaggagtgggtagagtcactgttgctgaatcactgggcagctgccactaacctcagacaccttgtttaaggtgtgcagcgcacaccctggttcagaggttgtccaggaggaggcctagcttaccaactcatgttaaaagttcgcattcaggtctaagcctggccctcgccaggaactgtgggagactggtttccttgtttatgctgtgccacctcttgagaatcctctctctgttcttaccaactcagcaggcttacatatccacctcctgtgagctaggttactaggatggaacttgtgagcctctaagatacagacccaccaccccatgtaactcctaaagtaagatcccatcaggcggttgcttacttgtctggctctatctttcacctgctctttaagacatggatgtagatgctctgatgagggcagagtaggcaacattcagtctggtaagtaaagcatttaactctagtctcaagcagaagctgctttgcgctttgaacacttggaccaagcagcttggtccagcatcagactattcttcctcatcacacagggccaaaagttcagccctttgtccctttaatgccttactatatatttactccaactcactgtcagatctttgcaaagaggttaaactgtatgaagacctttgtatcttttcccgtctttccacacaaccctaaggaccatcacctgaaacctcccacacggctggaaacgtgccctctgtggcctttgtttacaatagtgccagttgatgacaggcattgttcattgctgggtgctcaataggtccagccatcagcaagagacagggtagaatcctttcatccagttctcccaggggtgatacactcccctcccctcaggcacctcttcaggtaggtgggtacaggccagtgcttactctgtagtctgctctttaggctgggccaacctttgagacacacttgtctgtattcaaaagctacctactgtcagtctttcagggtaacttgttcctttccacttagctcttgaaggcccctctacagtgggaccgtaactaacttcacatggtgcttcccgtctgctcttgagaatcttacacttagctccacttccaactgtcccacagtttctccaatgcattcttgtgatcttgggtgagtcacaccacagagcaagggtaccttgatcaagaccaggtggccaagcacctccagaagcgggatgcagtctctgaagagcaatgttctgcatgtggcctgatgtctgcctgcatttacaagttctctggcattatcccccacacaccagatgggacaggcatctgtatttaaactttattacaaaattataaagcagagctctgtaacaaaaaaatacacatttgggtatgcttttaacacccaggtgagaaaatcttaatgtaagccacttggagctacacatttacatccgagagatctcaacaaatttgtacaacatagactattaattcctttacagcttattagtttagaaccggctatttccaacctatgaaacagcatctttgaaaactaagtctcaactgaaatcttggtgcaatcagcaaaatccacagaataattggaaagattaggtgtttcaacattaagaccaaggatccgtgaagaacaaaaagggggctcaggtatttaaccaaaaaaaaaaaaaaaaaaaattaaggttttctacctgagatgttaactggaatgggttccaactttcatttggtttaacaataaagttgtttgacatgttttggtttttttccccccca

SEQ ID NO: 20272 - DNA, 1169 bp, Mus musculus
taagtcttaagtgatatagaaaaaaattctaggttgagtcacttctgtttagtattggggttggaaagaaccagtctctgacctaactgctgggaagtccttcagagatggtgctgtttctctttgggtttgactttgtatcatccttaactttggattatgaggaaagagaaatcaaggcagcggctttgtctttgtcttctggtcctcattttccagcatgctaaaatactttaaaattttttctcttcctttggtcttaaatttgcttactgaaagcataggaacttcagcaaggagctgttctctagcttggctgtacatggagttcttggaaagcagacacacaggacagtgcatgaggcactggatgtgttagactatgactacggctgctgaaaagtcttaactgcactctgttctcagctgctcgggcaggtcaagacaagcattctttaagtcatgattgcagccctcccaggggctttacaccactgacacagctgagaacagctcaacaaagcacaaaatatactatcagaagagctgtgtgtttctctgtggggtgtacgctcaacttggctaacactacccttcactgtgtagctatgtgagactggaataaccaaccactcactcatgactgacttggaaaagtggagggacgcctcttaggggactattagaaatgcttaggcttctccactgaattccttcagaggatcaagtagttccatgaagctgttgtcagagatgccaggcccacttacctctgcattcgaagtccagatgaccagattttgggtcaaagcttttgtggatgtcagggattcagatccctccacaaagactcccttgccctccctccctgaacagtgaatgctgtcgtttacaatgtttccagattagcatgcccactgattttgctgctcctggactccactgtgaaacaggtctgatcttacagctcagtaagacctaagaataacattaaagccggctggctctccctcataactgctttctcttctgaggccttatctccctacctcctgtacaggaacagaaaatacactgatggctgtggttagcaacccaagtaacaaccagaacccatgccatttaatttggcgatcttacctttaaatctttacccttggtgttctcat

SEQ ID NO: 20273 - DNA, 1235 bp, Mus musculus
attacagcagggtcattggttacatggcttatgtttacatcacataatttcatagtgagtgtaaggcaatagttcacatcataggtggatacggtttaaggagttacagcagaattatttacatgtctttcctttaagcctagtacctgacgaaacatcccttagctattttctagctccgtaagttccttataagtttaaagcttttatggcacaagttagcaaggttttgtcaagagagaaaccatctgccttgtgagttattttgaagtcttgtatagataaactagtcagttatttactttctgtccttatacctaccataagtttctcattcccagtttatgacctttagttactgagattagtagcctcggtcctaacctagaaggaaggttttccttgatcgtaaatttattccaagcctatttgcttttcctggtgcaattagcttgtgacacagaattctatttgcagctttttattctacaggggggaggggggcttaaaattactcaaatcaattcagtagttctataaagtcatcatcataaactatgaaatcatcgattcatctgaacagcattattacatgaaagtacatcttcagattgatctgccggaaatttgccaaagagggtgggctgatattcaggattcagcgggttgtgtgacggtggtaggaaaggcatatcaacatcgagaagccatcctgggatgaagcctctgggatccatgtctctcagctctcacccactgcagccatacaaaacagtggaccatctccagaaaaactcccttgctcgccatagcctttcctgcatagctcttgtcaaattaaaatgctgtccaaatggaatgttagtcaaaggctaggaagggattcagtcaaggggcattcgtgcaatagggcatttatgagaagcagctggtttgctgacccagatgaagagactgggagcaaacatattgactgtcacatcagcttcagcaaatccagggcttgcagctatttggaatagtatatgcagctgattcctggatggcgtctgttagccaattcaaactgctgggacagatataactagggacagaagttaaagcttaggaatttaaaggaagtattacatttggaactctgaggcccatggtactggtagttgggagaagggaagagttccaaaaccaggagagagagaaagatcctaccctccggaggcatggctcccaccctt

SEQ ID NO: 20274 - DNA, 1235 bp, Mus musculus
tgtaggaaaaaattaccaatgtgtatatcgtaactaactgaggctgaaaacaaagctggagagaagactggcaaggcaatgtacacatgacataggctatgggaacgttgagaccataaggactgaaaccagagatgaagacaactcaatacagtaagtcatatccaattcttaaaacagacttccattttaaattggttaatacatttatgaaaatattgtataaggataaagataaagactaaaaacataatattaagtagcactggggtctgcgcctggagctgattttgtgccacagcgctccaatccctaaataccactgggaaagaactggcctcccacaagtgtggacaagcctgtgagcgcaggtaagtccaccacttctgctcagaggtacacacctggaactctcagaacacaggaaccaaatcacatgaggcaacagcaagaacacaagcaacagataccaaggccacttggcatcatcagaacccagttctccctccacagcgagctatcatgggtaccccacacaccagaaaagcaagactctgatttaaaatcagatttcatgatgatgatagactttaagaaggacataagtaactcccttaaagaaatacaggagaacacaggtatacaggtagaagcccttaaagaggaaacataaaattcccttaaagaattgcaggaaaacacaaccaaacaggtgaaggaattgaacaaaaccatccagaatctaaaaatggaaatagaaacaataaagaaatcacaaagggagacaactctggagataaaaaacctaggaaagagatcaggagtcatagatgcaagcatcaccaacagaatactagagagagaagagaatctcaggtaccgaagataacatagaaaacatccagtggaaaaaagacagaatttccaacaaacagtactggtcaactggcagtgaacatgtagaagaatgcaaattgatccattcttatctccctgtacaaatctcaagtccaagtggatcaaggacttccacatcaaaccagacacactgaaactaatagaagagaaggtgggggaaaatctcgaacacatgggcacagggaaaaagttcctgaacaaaataccaatggcttatgctctaaagtcaagaatcaacaaatgggacctcataaaattacaaagcttctgtaaggcagaggacactgtcaaaaggacaaaacgacaatcaacagatt

SEQ ID NO: 20275 - DNA, 1326 bp, Mus musculus
cagaaaaggagcttaaattcagagagtccatctcccaagactctgtccaccccttgagcagatcggaatttgccttcccaggagtcacactcaggaagggcaccggctccctcccctctctcatgaatctcatttcaaggcgtgactcgatgcaggatgaactagatagcagcaggagtcgggagtgaagaacctcttgtggtggatgttgtcaactctaggtctgaaaaattgcgaagaagaacctggacgcactgaggtcctcagtcttgtctagcagcaccgtgaggatattccgcagcacaaacagaaagaggacggcgtgctgggcggggcatgcaaatgaacatggccctgtctcccggaattctgggaaagaaaagagcaactaaaacttctcttcctattcttaatttcacggagttttcatggcgtaaaagatgtgggcttgatagaaactgagagttggtgtctagtgcatgtttataggctcccgagggtttgtgaccataaagtaaaagtgtgtgtgtgagttagtggtgtgagcgtagtggtggtaagagctatcgcttctcggccttttggctaagatcaagtgtagtatctgttcttatcagtttaatatctgatacgtcctctatccgaggacaatatattaaatggatttttggaactaggagttggaataggagcttgctccgtccactccacgcatcgacctggtattgcagtacctccaggaacggtgcaccccctcgggggtttctattactggttaaaaaataaggtgtaactttatggctttttcgtagtctatgttatcttttagttggtctttctcaatggatttttttcttttgtcatagtatgccttataagggtctacgactgcgaaatattaattgggttttcgtcttgatttttctagcaactccccaagacttcataggtcaaatgggatcatcataaattcaaagccagccagcctagggctacggggtgatcataaattcaaagccagccagcctagggctacatataaatggtggagtcctatgacatacaagaggctggaattaaaggtatataccaccatgattggctaaaatattactttttttcccctattttttatttttaaggtcctattcatgaacagtgtcatcttttctctgaaactacttatgcagcatcaagattaaatgattcatgtttctacccacaaatgtccaaatcacttctttgagactcctcttctttgagactctggattacagcgattagtcatacctctacccaacatgctccagagtcaactgtttttga

SEQ ID NO: 20276 - DNA, 1265 bp, Mus musculus
ttaaaagatttttttctctggggctgcagagatagctcagtggttcaaagcacttgctgcttttgcagaagaccaagttctattcccaggttgagcccggggtaattcataaccccttaactccagcttcagggcctctgacacccttttctggcctccgtgggcatgggtacacaaataagcacatagtactgcatacacttataaatctcttacttaatgtatgtgtgttgtttgcatctgtgtcatttggtgcccatggagatcagaagaggacatcagatcccctggaaccagagttatgggtggttgtgagctgccatgtggatgcttggaatcaaacctgagtcctctctagccacctccctagtcctgataagtttctttaaagaaaaaaaaatttccttccaggctctcgagtagacaactaaaacctttaggaaaggaaagaatgccatgagagattggattctcatgtagaatatactagaagcttatggtttatgtcagctggaatgttggcttgtaatcaccttgtattcatatggttggttattttgttgtttttggttttggtaggattgtgaagatcccaatcctttgattcgagccttggcagttagaaccatgggatgcatccgggtggacaagattacagagtatctctgtgaacccctccgcaagtgcttgaaggatgaagacccctatgttcggaaaacggcagcagtatgcgtggcaaaactccatgatatcaatgcccagatggtggaagatcagggatttctggattctctgcgggatctcatagcagattcaaacccaatggtaatactttgtgcttttacaaagagagaagcattgaaagtgagcccgttccaaggcatgcttggcacaagcattgtcttggagacacgactacagggtagttgtaggcaatagttttgtgtaatgtataggttgtatacttcatatccctaggtaattttattttgtttttaggattagttttttcaggtagttgtttgtggtcatttcttctatgaaaaaaactggatcaaagtaatgtttattgaccaactattgtaatgaactctcaaagaactctagggtagaaaatgattctgttctgtgtacttagcagccagagcataacacttacaagttttagttttgcattcctttgtttatgtcggtctgaggattaaacccagagccttgtgtaagtgtgctgctgttcctgagctactttcctgctccctgtgaat

SEQ ID NO: 20277 - DNA, 1098 bp, Mus musculus
ggccaaggaggacatgccagtaaatgcattccgtcaccttcctttcttgtgtttttgtatcacaggcctgaaatcttgaagcaggaaatcaaggtcttctttgtgaagtacaatgatcctatctatgttaaactagagaagttagacatcatgattcgtcttgcatcccaagccaacattgctcaggtcagaccttaagctatcctaagtttgtgccggctgagagcttaagatctggcattcagaaggtcatggaattgctgttgaaactctttaaagggggctgatgagatggctcagttctcttccaaaggtacagagttcaaatcccagcaaccacatggtggctcacaaccacccataatgagatcttgcgccctcctctgacacatctgaagacagctacagtgtacttatgtataataataaataaatcttcttttttttttttaatctttaaaggttatttacttcttggatatttgacaggttctggcggagctgaaggaatatgccactgaagttgatgtggactttgttcgcaaagctgtgagggccattggacggtgtgccatcaaagtggaggtaaggccccccaggagatgagatcgcacatatgggattgtgagtgttcattattttacagtgtgtatacattgaggtttgtcaacatacttaatgagtaaaataatttttaaaaatgtatttaatgtatatgggtgttttgtctgcattatgtctgtatcttgtatgtgtcaactacctgtgtaggccagaaggggttttcgtaccccctggaactagaattcagatggtagattatggaccaccatgtgggtgctgggactctaatccatgtcctctggaagagcagccatcgctcttaatccctaagccttctcaggctcagattaaagaatttttaacaaaacatcactgcccctgcttccttcccttctttacctagatccacttgccaaaaggatggcttttaactcttttgtattagattattttgatacttccatatccataaataattttgttattatttattgatttcttagttatagatttttatcttttcagcataccccc

SEQ ID NO: 20278 - DNA, 1259 bp, Mus musculus
gtgaacatgtctgtctcatgagctcttgtacaagtttaaagcttagttactaaaacataattgaactggctttggtggcacacacctttagtcccatcactcaggaggcagaggcagatgatctctgtgagttcaaggccagcctggtctacagagtgaatcataggacagcaaggtctacatagagagtccctgtctcaacacaacaaaccataattgaagaacagtggttcacagtcatctgtaactccactcccaggggatccaacactgccttctgacctctgcaagtaccaggccttcatgtgatacacacacgtacatgcaagctaaacactcatatatgcaaatttataaaattgtacataaaaaatattttaaagcatatttgaagaaaaatttaagccatgcaattttgacttactacattctgttgactaaaaacctttgcagcttggaatcccttgtgtatggtttttttactttagcttctactgttaaatacagttcttagttttggccttagtaactagtccatttgttacaacaggtatgaaagtattattgccaccctctgtgaaaacttggactccctggatgaacccgatgcccgagcagctatgatttggattgtaggagaatatgctgaaagaatcgataacgcagatgaattactagagagtttcctggaaggttttcatgacgaaagcacccaggtaagtctcttccatcccgtgctctagatctcttcagaacaagagctgagaaggtgaaatgttagctagttttttgtgtatgtttgtttgtcatggtttcttcgtctcaaaagggatgatcgttttggtcagcactgttttctagataacaaagctgcagcgcttagagcagtggtcatagactatgatgggcattggaacatttgggggctgaggagacacagagcgagaagcacctgcacagtcagttcccacctgctgcggtgctgctccagaagagagcgaacttccctgcagtgatgttgagcagtaatcagggtcttattttctgtcacttaaggatgattacaaattgtccttggtatttgctgttgctcattatagtgcagcatagcgaggtttgagaagattctacatagatgattagatttcttcccatctgtccctctctccaactaaaattagagtcagaggctcagagaggcagtcagattattaagccctttctccctggcatttgtgctcatagcaaatagaactttg

SEQ ID NO: 20279 - DNA, 1163 bp, Mus musculus
agacacttttctcatagatgagtttctacgaagtgtgaatatcagttccctcattagaacttcctactagatactaatgcccaaatgagaagtaagacttggccaaacccaagtggaagtggaactatttaagttggatgcttctcccttgttctatagacacaagctcctcttttgttagggtacctgtaggccttttgcacagaatcatggaagctaaaattggaaacaaaccagacaaaatcctggatcactgtgttcttgcatcctacctgtgccttgacaaagcctctaaagcacgtgtacgtttatcagtggtggaagaaagccaccgagacattatgctgatttgtctctcgcaaatcctgtaactgcagtgttttctaactggtttaccaatgctgttaaaacaaagtaacattttaaggacaactaatgtattctttctcatctctgtctgttttttccccaaaggtaggacagtccttcatcccgtcatcagtgcctgcgaccttcgctccttcacctactcctgctgtggtcagcagtggtctgaatgacctgtttgagctttccactgggataggcatggcacctggcggatatgtggctcctaaggcggtaagtaggtagctgagcaacaccttttcagtggacaaaccctagataacttataataagagttacttccactaacacagagggcccatgaggaagataaagggtagcatagaacttagccataggaaacaccattaacatcccccttaaacgtttaggcttaaaattggaaacattaactatttgagtttgggcctcgtgtttagagacatccaatttgtcagcattaaaatacagctagtaaaaaccatcagaaaggacatgtacagtagagaaagtagcagggtttttttgttgttgttgttttttgttttgtttttgttttaacatctgttcattccccctcctcattggtactagataaggattctagagtatagtctctcaaatttgactttcataggttttagtacacctcgtttcttttgtagcccaagctccaactcaaggtcctttgcatcaatttactaggtgctagcattatagtggtgtgccactgttctatacagagaatgacctgtgacagccacctatgacctgtg

SEQ ID NO: 20280 - DNA, 1240 bp, Mus musculus
gtgtgtgtgtgtgtgtgtgtgtgtgtgtattaatgagagagaaagatactcattgaatctgtccctccagcagtataatacacagaagaatctctcaaaatcctagcatcagcaatagttgctgcctataaacaacttctcccttttctaatccatgtaatggaagcggttagaagttctggcataggggctgtgagatggctcagcaggtaagagcactgactgctcttccagaggtcctgaattcaaatcccagaaaccacatggtggcttacaaccactcataatgagatctgaagacagctacagtgtacttacatataataaaataaataaaatctttaaaaaaaaaaaaaagaagttctggcatagattgtgttggagcaggtcaatactgcttcctgctgttccttccatttagttgtctaagttacttcactgtggtagaagctgtacaaactcacaagtgtgtgactcctgcctcttgacgagtgtctgggtgttcctcctctctctctagcttcggtgtcatcccaagcactcccttggccatacatactccactgatgccaaaccagagcattgacgtctctctgccgctcaacaccttgggcccagtcatgaagatggagcccctgaataacctgcaggtcagtttcccttctcttggggagtgtttgtaatgtattgctgacttctccttaggtgtaaagtgatccctctgcagtagctccttttccattgctaacacaatgcccacgtaagaggcttatttagcttacagtttgggatgtgtgcgtgcttggtatcaacattgcatcactctgatgagggtgctttggcttccctgtatcatgcggagaattgtggtagatgatctgtgacagggaaaatcataatggcaacactgggaaaaaggggaggcagaaacagtgattctttaaataaaagcttctaagacaggctctcacaagaactactgtgtgtctacaaaaggccagcattcccactgaccttcccacttcccaccaggccactcccccttctcaacttcagcacgctaaggacacccctctccaccccacacaaacatagttaatacatgaaacctctatggaaaaacctcttttcttgtgataaagttggtaacaaaatagttggaaataactgtgatgaagagtttttatttggttttaattaaaaacaacaacaacaacaaagctgtgcagttacttagagg

SEQ ID NO: 20281 - DNA, 3386 bp, Mus musculus
aatgacagccatacacatatataattttctatgtataagatacattttgcatgctttactgttattactagtaatattttgtttaaccttaatatagttaaaatttgggctttttttttgtcctttcccttgagaatcttttatgttgatgtttagtgtaagcactggttcccttagggtcaaaggctttgtttttagcatgggtcattctcatacttcgttcggaaagccacacaagctgtaggtagacatacagcacaacttgggaccaaccaagctggagttctgaaatccatggtttgtattaatgtgagctctctctttggctgctccagtcatagagtgtcagaatgtcagaaactgtctggatgtgaatgcatagatgcctttggagccaatgctgtctccatgctaatttcttgtctcctcctcttcacagctgtcgctgaagtgtagagcccctgaagtctctcagtacatctatcaggtctacgacagcattttgaaaaactaataaatgggtccagtcagcctgtaatcggtgcaagccaagaactcttaactggaagacgttgtactgttgtgtagagcctgaacccaaaccctgcggtacccaccccggtagtggccagtcatcttgtgctgacattagcattcaccctgttggataggttagcttcccgagacatctccttccaccattccccacttctgccacctgctgctcttctctgtccttagttgtgagcttctccatgctgtgccaatggctagccttttctacaccctcttttgagtgtagtttgatattttgtaatcaaaagctcatttcacaagcagaaaaaggcgacaagttaattaaagcaaggaaaagtgtcactgaaacataaactgcaccttattgttttatatttttgtacagatgagaagttgaggtagaacactgagtagaaagggcgactgaccctcatcaaacacagtcttagcggagatccactgatggccctggcccctgctggggcggggcaggaggcagccctgctccttgccttttgcattgtcattcctcccctctgtccaggtcattccttggctaagccttcgagctcccttatacccatgctatctggtttgacaattccatatatggcagtggtggtcttcactgatggttgcgagtgcagggacactggacatatgggctcagtgctgagaggtggcagagctgcgctcctgcccacagtgctagcccaggaatcctggggaggctgagtagacatgagtaagaacagggcgccgccccgccccttcctcccccaccccccttccctgtgtttttcagggctcattcaaagttaaaatcagagtctcagagttaaaacagacattaatgacttatccaaccctgtttttctaaaaagaaaggtaacaggcaaaaagtgtgttgccgaggcctcttggctcttgagtagcagagctgagactggttccctgatgctccgtcagcttccctatgtggctggctcattattttcctcaaagccttctgtctttcctgtgcctgcctgtgactctttgcacactctgtactgagtttggtgctccacccattcactggggtcaggtggcagttgacatcttggttataagtatgcatgcaggtaacaagagtgaaagcagagctgacatttgccaggctttcctggagcaggccagtgagtgtagacgtgtgtaaagatgtcgccagttctcactgtctgtcagctcactgagctgcccttcatccatggtccttgagctccagagcggagggagattctctcagcaggcccatctcacaaagactggggatgtgaacacattggtgtgagtcatcagaaaccccgtactcatggccctgctcagggctgctgttgactctgcttgagaggtggcacttgtcgaacagcctggcacctggtatccaggctccaacgacctcatgcaggactcagacctgacccactgaatcccgaggagaggctgaaaaaatcagagtagaaaccagcaacatttacaagtgtgtctggagtaatcctgtttcctcccagctgcaaagcttctctcaagttccttaatccttgagaatcttaagaggcttgctggctggtgaaaaagaaatacatccctccctccatcaccatgtggggatgcaggaaatcctgcaggggttgtgtgggaggcagatagatggtggtatgttgggtggaaagacaagttgaccaagttcccttgtcgatgctgattcctggagtcagttggttatgagtagtataagggattcccactacaaatgcagtgttcccatctcaaagcaaaactgtagttcccaaaagaagatgtgtcagggcaagcagaaagggaagtttaggccagaatgtggccatcccagaaactgaggcctctctcagcctcaccagtgacagagaacagctgtggttctctgctggcctcagctgatccatgctgtctgactcccggggagagttaggaagatgcaaggacctctcctcaagagactgttgcctgcctgaagcttctgttcaggctcatgccaagcttgaccggattgggagaactggactcagtttaacctgtatccactctccttagccaaagtgtgcgtctgtcgaaagctgaagtgcagagggcagggaagcaaacacaccagagctctttctggtcagattccccaggtgtttgtccccagccaagcctggtccgtattgtgaagcttgggatgctggagccaatgctgtcccaagaaggcttactttgctgttcttgttgggatctgttgttggggagggtggggtttggggagcctttaccttgtgtactcatcaataaactcatttacacaaaataaagtttgtggtatggactttgttcccaggacaatacatagctggctagagaaaggaccttagtaaccattcttattcttattctttttttttttttttttttttttttgtaaatggccctagccctcccaaggggttcagccagttgaaattagaattcagaaaaaaagtatttatatcaggaagccacctgttgttcaggtctcaagtcccataacttcaggaaggtgtgcatggggagagtcactctgggcagttcccaggacactaggtagaatggcagtgcccttcaggtcccccggggttgtcagtatctgccagcacaaccaaggacagaagcatagctaagctgctactcggtacctgtgcactctagtccaaaagccctttgaacccagggcctgcgtgttcccaagcaaacaggatagccactgccttaaagaaagcatcccaaggagtctataactacttgtattgttt

SEQ ID NO: 20282 - DNA, 1160 bp, Mus musculus
aagtttttaccttttctgttctgctatcaaagtctaactttactttttattcctctagtcttttagttttttctttcttatatttaaaaatagtcctaatactctaatttcatatttttcatgctgtgcctgcagctttaagttatggtttgagtagtaatcttttggcttggggttgggaagatgaattttttttaacataaaaagtaatattagatgtgttataaatgtgagaagacagcttgtggaaataaatccttgggaaagcacttagattgaatcattgaactctgaaatggatttactggaaagttggtgctactatttttctaggcactctacttgtgacagttaagtgtagattgagcccagggctcagcacattagagacttacttaaggaagaaatcatttcttcaatttttcctctgcagtggtggtgaccgcggtggcttcaaaaattttggtggtaagtgctgagtatcccaaaatgtttcagtggaaatgctatataaatctaaaagccaccaatatcccgcagatgcagtctaagcccttcttactctgttgaggctcgtgtgttgtgtgcattacaaagtactctctgtatacactcttatatccaagtacatattaaaagccaaatctgatctcaagtagtccaatgcgttctctacacagtgtattgcatgaaagagtctgtgaccgatgaatgaggaattcactgggttttgacaatagggttttttttccttttataaaggtagctgacgtggtgttttaaattattaggggtttccaatcagccttacaacagtgcttgacagaagtgatactagaataataacaaaagtgggtgctgtcttggacaaggctaaagaaatgttggcattcgtcttgatttcctaaactttaaataataaacatttatgtagttatttttaaacctgtgatggttgactttcaaggatattaagttctgactttacatgctttggttattaccgtttcctttttaatttcaaataagttgtcttagacagcctttccttttcttctcccataggtcacagggattatggacccagaccagatgctggtaagattcttgatagtttggtttcctacctctggaagaggaattaatgtgtttggagggag

SEQ ID NO: 20283 - DNA, 1214 bp, Mus musculus
attcctgtttgtctgtatatatgtggtgcctcgtacctgtggagacctgaagagaagaaggcattagattctaccaaaacaggagtcagagatggccttggactgccatgtgatttcaggaaatcaaatccagctcctctgcaagggcagcaagctgtcttcactgcagaaccatctccccaacccttgacccatgggctcccttgccatcctcagtggcagcaggacgccatttccttcagttgttgcatcgatgcattctttcctgtcattccaatatctttctgccccaccccccttaccaggatgcatggctacattcagggcctgagtagtcaaggtaaactctttatcctaggagccttaatttaatcctatctgcaaagtcccgttttccatgtctggtggtttcaatatgcttggtttagggaatggcactattaggtggtgtggccttgatagagtaggtgtagctttgttggaggaagtgtgtcattgttgggatgagctttgaaaccctccttctagccacatgaaagccaatcttctcctgtttgcctttggaataagatgtagaactcttgagttcctccagtgccatgcctgcctagatgctgccgttctcccaccttgatattaatggactgaacctctgaacctgtaagccagccccacttaaatgttgtccctttcaaaagttgccttagtcatgatgtctcttcacagcaatgaaaccctaactaagacaccatgtgtggtgacaatgactggttctggagattagagtgtggtcacatcaggaagccactgttcaatactctgtaccttgtctcaattccaaggaccatccatttttctccagtaccatccactcagaatggagttgcacatctctgaatctgtactataaccttctccactacccttgtttctctgatcgctactttcaaaaaggtgccatgcaatggaactttctatgacgagaggtaggtgctgcacaggttctgcatagtactttctaacacagtagccatcagcacatgtgaatgatgtgatgaagaagctgaatttaatttttttctgttgcattttattgaaatttaagaagacagctgatcagtggctaatgtatcggacatctcaaatacagacagaagaaaccagaaactaaaagttgtttgttgctagcctgtcagacctgctttagatctgtt

SEQ ID NO: 20284 - DNA, 1177 bp, Mus musculus
acattttttttaaggacaaaagagtaaatggaagaggaaattaaaacacaattaaaatggaagaaacagctgggcagtggtggcgtatacctttaatcccagcacttggagggcagaggcaggcggatttctgagttcgaggctagcttggtctagagaatgagttccaggatagccagggctacacagagaaaccttgtctcaaaaaaaaaaaaatggaagaaacattactgacaggtctgagcagtttcatgtcaagaggcaccagacaagggttggaggagtgtgtgggatgtcgcaggctgctttctgcacctgagatctcattctgtgctgaaattgtgtgtgtgtgtgtgtgtgtgtgtgtgtgtgtgtgtgtgtgtgtatgtgtgtgtgtatgtgtggtgtgtgtgtgtgcgggtgtggtgtggtgtggggctgtgtgggagtgtaggtgtgtgggctgtgtgtgtttcattctctagtcttgctgtccaagtgtatcatctgctccagggctctttaggagcaagcactttcattaacataagctgactattcctgaagtgaggtttataagtgatggcacacagcccacaccatcttattgcttggtaaggaaggcttgctgcccctgtagatgtataaatgagatgcctatgtttatacttagcaaattagaagccagtttgtggtccactgggttgacttttgaggtaaggaaaagaatctgctagtggggcattcactgtggcaacatgagtaatctaaacatgcttaaaaaaaaaaaaaagaaagaaaccaaggtaaaaacctaagaagggttaaagctggacatgtcagcccaatgcctgtgggtgcagacagtgtcctgttgcagtctggcttctggggtctcgtcttttctaagagcttgcctttgcaggcaggggtaatgtggctgcaacaaaggcgcttaggctttgctgacaaggagaatggtgacatccctagcggcctgggcaatgtgaggaaggctataaagccatcagaagactgagccgctgggtgtccacacaaagttaggacctataaacagacatctgtattgtgactgaagggctaataaagttgccttagaaaagagagggtcttccactgtgatctattctaagccattcccccactgagaggggat

SEQ ID NO: 20285 - DNA, 1225 bp, Mus musculus
ggtacagatgacaagggcagggcaaccagggcccagggaagtaaatttcgctgatttagtttttatgtttctgtgggagggcttgtcgttgttgttgttgttgttgttgttgttgttgttgttattgctgctgctgttgttgttgttactgttgctgttgttgttgctgctgttgctgttgctgctgctgctgctgttgttgttactgctgttgctgttgctgttactgttgctgctgctgctgttgctgttactgttgctgctgctgctgttgctgttgctgttggagatagagtctcactatacaggcctggatgacctggaactcactctgttgatcaggttgttacttattttggttcctggatagaaagactagataatttcttcccaagtagagacattagaaattaatctgggtgtgtgtgtgtgtgtgtgtgtgtgtgtgtgtgtgtgtctttttgtgtgtatatctgtgtctgtctatctgtatgtgagtgaatgtctgtgtgtgtctgtctgtctgtgtctctctgtgtgtctatgtgtatgtctgtgtgtctgtttctctctctgtctctgtctctctctctgtctatctctgtctgtctctgtctctctctgtgtgtatgtctgtacctatgtctgtgctatgtgtgtctgtgtgtaagagtatctgtgcgtgtgtgtctgtgtgtctgtgtgtctgtgtgtatgggtgtatatctgtgtgtctgcctgtctgtctgtacctctgtgtatctctcagtgtgtgtgtgtgtgtgtgtgtgtgtgtgtgtgtgtgcaattggatgtcagagggtgatgttgagtctcttcctctgtctctatcttattcccctgaaacatcatccttcactaaacctgagttgcttcacctaggctggctagcccaggagcccccaggatctgtgtgtctctcctccacagtgctgaggacacaggcacacagagtcatgccccagtctttatgtgagtgctagggactcaaactcgggtcctcatgctttcggagaaagctgttttaccactgagccatttccctaactccagaaatgacttttatctatatttttgagaggatgtcattgaaatcagctccactctggactgttctgaggttgagaataagtagatatgtctccagctcaggggtatcttgtctaagttcactctgaaacaaatatgcccaggctcctgacca

SEQ ID NO: 20286 - DNA, 2004 bp, Mus musculus
accacagaaccactgggtcaagaccaaactctctcctttgtgctatgtagtagtgtagttggttataacgtttttcatatggacagtgattttaatgctagaccaagacgtaggaaacatctttgttcccagctcctcggatgctttgctgtatggtaacttttagcacatgtttatttagcctcggttaggttatagaagtaaattcatatggaatttctaattcagtatgtcttccttttcataggaaaaaggttgctggccaaaacagcaagaagaaagaaactctcaaagagaaaagttaaaaaataaataccttagaaggcaatccctgcagtgtaacttatgagcctggcatggattctcatggagtacttacaaccatctttaccaaacatttgaaatccacaaggatatgagaggacagaatggttctgatgtagtgatgcatcaagcttcactttgtaggtgggatttatacaatgaaaataacaggcattggcatttctgcctgaatccagagagatacttcttatagaagaacaagagccgatgctaaaataacacccaagtgtggtgaactcttaaggattttgcccttcaagtgtgaaggaaagtgtgatgcatgctgtggagaggcgtctggaacagaattttaaaataaaaccttgagtttgagtgcaccatccacacttgtgtgtatggagagccagcgctgtgtgggatgcaaacaagagcagcagcacaggccagacacaggaaggagcctagcactccctttagtgtttctttgtggtaggagccacagtaaggaggtcccccatctgtggttatccaaattccagaggattggaaacttgagcctgttgaaattgacctgtactgcactggggaggaagcttatgcttagctgtcataatgttgcaactgtaaggttatgatcagcctttccctgtctgacttcattctccatcatttaaccatgttctttcctgtctctttccaccaagatgactgcctgaaagcagatagcactctatcctatcctgatgaggaagaacattcccgttacacgatacacctcgtttcattgtctcagatgcttatctttgctgagacttgatgggcttcagccaccctccacagagaactgtgatcatttggaccaaggcagtgcacagtatgcaggttttccttaattacctgctttgtacagtggaataaaaaaggcttggtacaagttgaagcacttaagactggagcctagaatttctcagggcctgtgctgccacaggactacaacataagtgactgccagcaactgaattaagcctgtttcctttactctaggcagttgatactttagtctaaaatcagcacagtagacctccttttaaatgtgtatttgttttgaaaagggatctctgtatcccagactggcctggaactcacagcaatcctcctgtttcagcccctttactgctgagaatacagacatgagactgatattgaatagatgggataaagatttaaaaaaaaaatcaggcttcatttaaataaactgctctagagaataaaaactaaaagtttgtaattgttttgttcttgcagagagttgagtcagtgtatatcctgaagtgggtatacacttgaaaccattgcggctgcattttcattttagaccttcagcttttcctgtgttttaagagtaaaagtgcctatctctgtgtctgaagctttgtatgctaacagcaccactctttagcaactaacggcagtgatgaagtatagaaacgattatgtggtatggggctgtgatctcaaagcatcctaacaagactcttaacacaggtggggagtgtccttggacggatgcagatagagatggtaacagatcgtgttgataatccccattcagttattttctctttattttttctgagcaaccacccagtccatgaagtagctacaaaacttgtatcagctttttttttaaaaaaaggg

SEQ ID NO: 20287 - DNA, 1178 bp, Mus musculus
gttgggttttgtctatctcactcctgcttttacgtaattcatcatcttccccgaggggacaaaacctgaggggtctctgtgctcttccttcttgtaccttgtgtattatccccaagctagggatcattttcagctggtgatgcagctctccttggccttgctgtggcccagaaggcagggcgaaaagctggcgagtccagttactcatctgttccaggtgacgtcatctccagctcctgacagtcagaaagctgtctgcattgtgaccacatggcctccccttccccagggctggtggagtgtggagggaggctccacactcagaggtaggctgcttttcagtgcactcttgtaatggcccccagtgtctctccatgccccagagtaacaagtgagccctccagtctatactctagatattagtaacaggattgaccttagcattaggaatggtcccagtttagccacatttataccactgaagcgtttctggaaatgctgtgtgaagtgttttctgcccagtggcctgtatccatgacatctgttaaagtacctgtgagctagatcttctccactcctagttagtcactccttgggaggtgccagaggaaaactcagtaggcgtaggcaaaaagcctttaccatgaaaattattgactgtttaatgcttcaaaggcttagttagaatcctccagcaggggttagggggagtgcgcaacattagccggctgattttctttgcatgcatgtattgaaatgactcatgttgcattcagctttacctcagctcttgttagccaagagcctggtccgtgtccttggaaacagtaaccaaggttaccgttctcaatgctgtacattgtgtcgggcagcttcacccacagattgaatggcgactaatgagcacttgggtttgggtgccgtgccttgccttctgtcctgtggttggtgtgtgacctgtgtggccatgcttgagacagaagggtctcgaggtgcccatggataccatctgagcttccctgtctcagtctgctagttagcataccatctgggaaacacattttaaattggtattttgtgttgctatatgtattttaggtgtttaggtgttttgcttgtttttatttttggtcctatttcctgttttcctatttatgtgtcatcaaaaagatttctca

SEQ ID NO: 20288 - DNA, 1626 bp, Mus musculus
agcctgcctttttcttcctgagcgtctgtctccagagacaggaggaagtggaatgtggtccagccactcaacagctcccataaatagttggaggttgatgtcatatttttttcaaatgcattttgagtgagtggggggaagggagggcatgtgtgtgccatggatgctgtggcggtcagaagacaatgtgaagaagttggtggttttctcttcaccatgtgggtcccagcaatcaagcatgggtcgttagtcatggtggcaaatgcctttacctgctgaacccctccactatcccccttttttactttggggttgctagacctgctggatgaatttgtgagaatgacagtgctaattacgtttgtactgtcttacagctctgtcaggtggtgaggttggtacctggagcctacttggaatataagtctgctctattgaacgagtgtcacaagcaaggaggcttgagactggcacaagcaagggcactcatcaagatagacgtgaacaaaacccggaaaatctatgacttcctcatccgagaagggtacatcacgaaagcctgagactctgctccatagtgcaggccagcgtgaaggaatgtgaacagtcagagggcaatgtacacattccggagacttgtgttggattcttgctgtgagaagaaggagagacactgggagtctaaggatgatgaccgctttcttctctgccctctgtaaagcgctgcttgctgttgtcaggatagtgcgtcagagtgtgtgttcgccaagttattattaaacaccagtgggcatttgttcctagcagctcttgtaagtcaaacaagaaccacgggccctcgcatcatggctttggtggaaggagaagggacccaggccacagcatttcaccccaagaggccagctcagatccatgcactagagagtaaagttcccacactcactctgccttcccctcttgcaggcagattttaaatgaaagtttttagagcacaggaaagccttttcttccaaggagtttttctttttttatgctgacatcttagtttatgagatgaagaggtggagctctcccccatgatggtctgtctgaaacttcattttaactgtaatgtctagctttgtactttgcagtctggctgtctgatgtgcagtcgactcttgaggaggtggcaccggatataaaatgtctctgttatttttagaattaatggattaaaatgttttgctatttaatttgtgggtgtgtcagatattctggtaacttaagcacaacttgggttgttggatgtctgcctcaacacgctgcactgtctctgcttacatgtgtgtcccgtgtcctggtctcacctctttacccgggtttcccaggataccaggcccatgaggatggagatgatgcaactaatcagctctgtttctattcaacctgaagcctaacttctcagtggtgaaaggctagcctgcaataaaagctgctttcaaacacaagtaaagccgctttctgtgagactcagcggctgtggggtgagtcggtctgccacatctgaaacgcggcacagtcatggttatctcactgtaagcagagctgcaggtgggtacagctcagaccgcacagcttaccccc

SEQ ID NO: 20289 - DNA, 1220 bp, Mus musculus
ggcccttttgatgtccttgagaatcaggttttccagaacaaattaagcagttccttctgccccgttccagtgccagccctcataaaacttacctcattgcatccatccccatctgagcattcatcctaagactaaattcagaataaaaccaggcacaggtgatggctccaaggaaaagatgcttggatgcgagactagcaagccactaaagctagaagtggggattaacaccacacagttgtcctctgacctcacatctgtgccttgcaccatacacactttatgcccatcacaatacagtttaaaaaaacaaaacaaaacaaaaccacacattagtctggcctggctgcctcctgcttaggtttctttctcagacatgaagttggtcactgctttactatatagtaactatagcatttggcttgttccagtgtggatcttttgagttaaacatcacccacttcttttcaaagaaaaataaatgaacaagcaagacctttggtggtgactctgcctttgatctgaaggtatatagtacttggttaattaccacgtgtgacttgtcctgctaaagactagtgacaagagagaatatctcctgagggattcctgtctccgtttgtcagctgtcaagacagattagaacatactctttctgttcaggatggacatctggttccagaatttagaggaacctgtttgagagaaacagataactaatgactccactatgccgatcattcattgagacgaaggtgtgcatgatcgtatctgtactttgatagggcagagagcttatagattgttatttttatttcaaatgaatgttagagtgactgtgttggtgactttttctactgctatgataagacaccttgaccaaggcaacttataaatgaaagggtttatttgggctatggttgcaaagaattagactccacgatccagggcaaaggtatggcagcagaaagagccaagggctgtcatcttgacctgcagttaggaagcagagcacacactgggaataactagaggcttttgaaacctcaaagcccaccacctccccccagtgacatatttctattaaggccacacctcctaatctttcccaaacagttccaccaattggggactagacatttaaatatcagcctgttggggctgttctcattcaaaccactttattgactgaggagctagctaaaccagcctacaggagt

SEQ ID NO: 20290 - DNA, 1200 bp, Mus musculus
agagagggagagagagagagagagagagagagagagagagagagagagagagagacaccagcagagaaattggattttgctggccaacacctagctccaggcttactgagagactgtttcaaagaaataaggtggaaaacgatgttacaagaacccatgatgtcgtcctctggcctctctgcatgtgtgcatcacacagacacgcatacacccacatctaacctacatcaaagacaaaaaactttagtaacttacaagttagtagagagttttggtttttatgggggggggttgatttgtttcttttttcgtgtcttttatttttgtctttgttttaaaacaggattttgctgtgtatgtagcctaaaaccttctgagtagtccaagcttaggtctgacttagaatcctcctgccttcaccttcctagaacggcattacaggtgtgtgccgccatgtggagcagttttaacttcttataggacgtgtcaggtatctggagaagcagaggaacatggtgaacgtgtatctgtgtggccatcctcagcggttttcagcacagtggctatccagtgacatctgactgtccgtgccctttcctcttgaccatgagctgcttattctgaagccaattccaaatactgtatttgttttgcctataaatattttagtattaaaactagtttaagtcatgggaagagggttgttgacttgtggaaatggtacttccatcttcctctggcctttctatgatgttcctgagagcattcatctcagctataattggatcgtctattatttaaaaaaaaaaaaaaattgaagcccttaagcagaaaggccaaagactttgaggccgcctgcactgggggcttatttctatataacactcatgagaggtgtatattcatttgtcttcttgccaaggaccagcctcaccatggagaagggttctgagaaatgaggtttctgggagcagtgaaaacaaatgactccaagtcaaatcgtggatcccgactgatgacctgtgttctgcttgatccagcttttctcgtctgctgctctctatgttctgccttctctgtggcgatctctctatattctgcttgcttgctattccaagagatctctctgtccatgtccggcttctttgtgtgggtgtgtctgctgtgtctctgtctctgtttctgtcagttctccaagca

SEQ ID NO: 20291 - DNA, 1320 bp, Mus musculus
gcactctttacccacgctgctacagatgagtcacagtctcacaacagctttgcttacaggaaagtgttcccattggtatagttattccttcagtctcactgaaattgtgaagagattggtaatgcgcatactgtgagaactacttctaaaacttttaatttataagcatagttaccacaacctctcttttcctcccttggaggaaacaaacatactggaatagaatagccatggaagccaggctttaatctcagcacttgggaggcaaaggtaagtggatctctgtgagttcaaggccaggctgatctgtagagtaagttcctggacagccaaggctaaacagacaaaccctgttttaaaaaaaccaaaaaaacccaaaaagagtagccaagcaagccagttcttagactcagacttatttccaagccacttgtggtttatgctttactttcttgtgtgttctcatctataggttattgcttataacctacttttctcttaatttttcccatagctctgagagcttattttgaaagaataatggatgaaccatctccgttggccaaaactctggagctaaaccagcactcccgattcataattgggtctgtgtctgaagacaactcagaagatgagatcagtaacctggtgaagctggacctagaagagaaggagggctccctgtcaccagcctccgtcagctcagatacactttctgatttggggatctctggcttacaggatggtttggcctttcacatgaggtgagaagaattgcttcatggttaatgtgtttaatctgtcttgttattttcactgcttatgttctgaaaggaataagaatatattaatttcacctccattccctggcccatcttctatgactaggaaatgatgcacttttcaggcttggggagtatcttttcctacgtgttctcctcagtttttccatcctttatacatactaggcccttcagtatgacccagtgaaggagagtttggttgaagaatttcagcttctgtagtactttgattaataatgttgcaactctcattgagtgataggaatttggcagacatggccaaatttgtagtctttcctcctctcccgtatcagtgctagcaactgaaaccagagccttatacatgctaggtgaatgaaccgctgatcttcatccttagcccgtggcattttgttttttgtgttttgagtcagggttctgttacccaggttggactggaacttcctatatagaacaggctgacctggagcttgctgagaccttcctgcttttgctacctgagtgctgagactgtaca

SEQ ID NO: 20292 - DNA, 1135 bp, Mus musculus
gactgttctgcatagaatgtgtataagatcttagttctcttgtacttagaaacggctggcccatgtttctgttgtcaacatcatggcggctctggaatgcagtttcctctcaccagtgtgctgctccattttaactcttgcatgtatccagcaacgcaaacactggctttcatgtcagaaacttaaaaaatgggagagatttagtattgttcctctccctccaaaaaataattaaatgcatatggcatcttctttgatttacatgaaaggctatgctcttgtagctatgactctgttcctttgtctccatatctgactaatacatgaaggaggaatggaactggctcccacaagctgggctgagcggcctctaacgctggtgggagtttgcaaagtggcacgttttcatgttgatttcaagttctccactcctagttcttcctggctaagcttgtgtttggagttggggaacagtaggactgttcttagaggccctcctccacgatcccgtgaggctgctgcttgcttgggactgaagtacggctactctctgagctcccttccccagccctttggagaggtcattcttgatactcttacgtccatcatttcttcatggagggaaaaccccatataaatcttgcctaccatttttatataatcccccaaagtgaaaggagatggtcttccttacgtctccggttgatagcagtacaactcattcagccctctgcctcctggttggctctattggatataacgttttataggtagccactctaagaaacgtgtcattataggaagagttcattacctttgctaccctggaatggctgcctggtgaggaaaccaggtctttgagaggggtggaaatattggcacaaaggactattttaacttccccatgagacagctttctgcaaaagagttgtataatctagagctacttgctgtttattttccctcagaaatcctactttctttttcaaattttaatgcaaggattgttaattctcacttggaggaagtcaagactttctggcagaaaggggtaatgattagaggtagaaggatctgccagtatgaaccaaaatggggctggaatttgcctttatagggagctaattatggcaaa

SEQ ID NO: 20293 - DNA, 1257 bp, Mus musculus
caaacacactcaaccacctcagtggcgtctcagtatccctggggagacggtcaccctgccaccaccttatcactatgtaatcacatagtgactatacctaggagctaaaggcctgtgcataagggccctagcctctgcgggtggatggagacaggcaggcagtgcaggagcctgaggtggctaagaggaggctcttttctgttggtgataggggaagagtacttcaaaacaggagaagtctcttctggggacaggttgtcactatggggccatgcctattcctggcagaaggtatggcgggtcacccacctgatgacacctgtgctttcagcaccagaaactggccttcttgatgttaggaggcttccagggaacaagaattcacctgcccttaagataccttacagttcagtctcggtgctggtgtttccagacttctgggccctatgtggccagcaacacggcttcctcaggggtggcctgaaaagtttaactacccatttgtccaagaaagcagctgatggttcagcatttgtgttcataaagcaagaatgaagatgatcataactcgtataacatccagtttcaactttatgactaatacatctgtcgctgaagatcgagaaggaaaaagatacctgccacagaaaccattcaagtgagtacttcagtctgagccttaacctggattccacgaaaagagctgacctccccttcaggagcacctcaagcagatattccagaggaccttctcaatggtgccacattgcaagtggacatccaagggactatagatgcaagttgccccacccccacaagccctggtggaaggaacaggagggccagagctggatcaggtggggagcatccttagtccagaaggaagctccctggcccctggttccctgcttacctggtaggtaaggatgggatttatctctggcctccacttttgctacagcacgtccaatcccacacccccggtggtatgaaagctgctttcctggagaggtggagtgggctgggcttgtataagtcccttttccctgctgccccatccccgggaccgggccgtctcaatacggagaagtcagagccacggcacatgggcagtgtgatggtaccacagcccattacacatgcagggttactgaggaggagggtgaatgatgtattgacccagactggcttgaactgagattgccatattatctgtccacttgttcacaaagcagccttcacacgtgtcagtgagag

SEQ ID NO: 20294 - DNA, 1124 bp, Mus musculus
ttgtcagcagaaataccgtaggctcgttggggctttcgggagatgggaaatattctaggggttctgctggctggtgctgagggtctgacaggatatgcttctgggagaaagtcccaactatgacattgtgccaggatgtaggatggctccaagactgaggattgaacagatggccaaaccactgacatgcggtggtctttgaggacgagcaggtgaacgccttctaacttcttccttcacccgggagcagtccaaggttagctcagcaccagcacagcctctaggctcgcctgcgtcagcggaggcagtgcgactcactcctgtagggggtgcagtggagacgtggttgccgccaagcgcacatgtgcgtcatcggacagggggctgggcctccagaacccggaagctggggacccacgtgggaggctgggaggtgactgtcttggctcgagggtcaggttgtgggcagtccttgtgaggggacgaagtgtgggaggtcaacgggtcctccccagctgtctgtcagtggagtctcgggcgctgctggagcaatgcggcgactctggacggtcgggtgcttcagtcgcctgattgcccgccatttctcctcggtggctcggcgcggggaacggcctggcggggaggagctgagtcgcttgcttctggatgacctggcgccggcccagcggctggaacgtctatttggcttgtccccatgcctcctggccttgcgggctgcccgtcggcgcgtggcccggctcctgctccaggccggtaaggctgggctgcagggggagcgagccgagctgctccgggtggccgaggctcggggcatccctgtcttgaggcccaggcgtcagaaactggatgccttgtgcggctaccaagtgcaccagggcgtgtgcatggaggtgagcccgctgcgaccccggccttgcgatgaggcggcagacacgagctcaggcgacgaccctcagcagctgtggctcgtccttgaggggctccaggatccccgcaatcttggggctgtgatgcgctccgctcacttcctcggcgtagacagagtcatcaccagccagagaaacaggcacggacgtcccttaattcagtttacgcccaatctg

SEQ ID NO: 20295 - DNA, 1436 bp, Mus musculus
taaaggcagagaagtgtggtaaaaggtaggctcataggtatataggaggtaattatagactgaagtgtttgaaaccaagctgagttaggttttattttccggttgcatggtgcttattctgtaagcattccagttagagattgtgtgactgggtaaaaacttaaaaagctaggctgctttaatttttagttgccccaccaagcatagtgttttgcattttttgtcatggtcttaactactgctttaatttgcaggatgagtctgaatgtacttcagatgaggaaatctttatctcacaagatgaaatacagtcatttatggctaataaccagtctttctacagcaatagagaacaataccgacagcatctgaaggagaaatttaataaatactgccgcttaaatgatcacaagaggcccgtttgtagtggctggctgacaacggctggagcaaattaaataaataaaatagctctgtctttcaatgaaacactcaagatgactactgcgccttctcttttaaaaactcctaatttagtgacttctggcaaaattttaccttaaatcttaaatcaatgtgattccttgttttgggagacggtggaggtaacctcattcgtttgttctttcttcaggcttgtgtctttagtttcgtggctgcgcaggcctgcctatgatttaagccatctcttcattaaacgtttctcttcctgtgagacttactaaagcaacttagtggcaaaagtaatgttgtacttacacctctgtacagaaatgacagtgagctggatatatggtttacagtagacatccacttgcaaagcatctggacagaatgttaaaggcaatgtgcaaaatttaaaataaagagtatttattaatacgcatagtagaatgtggtgtacatgtttctactcaccgtggtggtactttagtatttgccactcgtgaactttgtatctaaccattgttgatggagagagcatgaagagcaaatgagggtagagattcagactgcccaagactgaattcttcctttgatgagacttgataactgagaaaagcagttctagtcttgttcttaaagaataaatgcatttaaacactggctagcctcttccttcctcatgagacttgaagttcccaaggaggcaacggaaacaccttaacttaaaagaggttcatattgacataaaagaatgaagacagagtgttggtaatcagcctttaaggctgggaggggaggattcctgagagctgactacattgtactttgttttccaacatgaactcagtatggctttacaatcaccacttgtcacaagctgtcttgagtactgaaggggcgagattcccaggagtagtattttgttgccatttgataggtcaggtcagtgatggagagatgacagatgcttgtaagaacccgagttgcat

SEQ ID NO: 20296 - DNA, 1213 bp, Mus musculus
cagagaatggtgggaggtttcagttaatgaagagtatggatagctgggtaggagatgagaaatggtgtttgctgtttgagactggtctggcccgagtactcagtgttcctcagtcactgaggacactgatcagacactggttttaacagcagtattgatgatgagagctggctgttgagtggatagaaaatgaatacaaggttatagtgtgttgagccttaagtggaaagtataagagtagaaggaggagccggtgtggtggcgcacgcctttaatcccagcacttgggaggcaaaggcaggcggatttctgagttcgagccagcctggtctacagagtgagttccaggacaaccaaggctactcagagaaaccctgtctcttaaaaaaaaaaaaaaaagtagaaggaggaagtgactttgaaattcttcagaaaacatgtcttaaaggagtcatccaagtcataaggcctagattctgatttgagtgctaggttatttaacctaactatcaaaagaggaatatgagacgagacagaggatttaacatgtaagatagagcagcagttgacatttcattgtcagtaggtagaactcaacctcattttgaccttttccccttagtgggattaaagtgctgaattgtgtaatgacatgttaaggtgagatttgaggaatacttagctatgaaaagacttgggttttactaccttaagcaggcatgacatggagtttctaggattgtaattcgacctgcagatgatcgggtaggagccagttcagaattagtgaaaagtctagaagcctatccttgaatgggatatagacagacagacatttctgtaggaaagcacatctgccacacagcaaaatgcaggaccaatgtcacactggaactcgtctgggaggagggtctgggaagttctcagttagtttaaagaaatgatgtgtgtagtgcttgctacttacttagactacttagagtatgcatcttagtgtgctattttattatgtataaacttatgtactttattatattaatatgtgactttcatggctacttggaaattaaaactagataagtttgttgcgagagctagctgtaaataagagtgacttaatcatgatcacattaaataaagaattttcaattggttaaagattgatccctgtttaataggtgaaaatactaactttttaaatgccttttggctt

SEQ ID NO: 20297 - DNA, 1188 bp, Mus musculus
tacatataactgtctctgcctcccaagcgctgcgattagaggtgtgcattaggttttgatgtatagttggtgtacagtctttttttttgttttttgtttttgttttgttttgagacagggtttctctgtgtagccctggctgtcctggaactcactttgtagaccaggctggcctcaaactcagaaatccgcctgcctctgtcccccaagtgctgggattaaagacgtgcgccaccacggccggctggttgtacagtcttcgcatatgggagtgacagcataagggtggagatacaagtccttcctagctttcagctactgccacaggtcccccttgaacttaaagctggtattgatctttaaggtgaatcggaaactttaagaagcttgctgctgaacccacacctgaggcagttgatgattagcctcgatcagggtgacaacaaagcaaagctgatgcgagcctgtatgcaggagccccttttcgtggagtttgcagactgctgtttaggaatcgtggaaccatcccagaagagggattcctaagactggatgtgttctctgctcaagttacctgctgctgctccaagaggtggctgttttcaaggccaccatacgcagcatgcacacgtgggtcttcctctaccacatggctcgctgcagcaacttcatgaagaggaaacttgtagccctggagtgatggctcagcagttaggagcattgactgcttttccagaggaccccagttttcagcacctatttgactacttacaactgtaattggttgcagaggatctgacagtctttactgtatgcatgtgcatagccatatgtacagggaaaactcctacatacataaaatacttaaaacaaaaacaaaaggttggctatttatatttagatggttctaaattttatttcttgtacagttcagagttgcatcataaataccaagtatatccatttgaattaaaaacatagtgtaacaatttaaggtgtggttctcttgatgctgcattgttcattgttcttggtaacattaaataaatcagtttattaaatattattgttcccttagtaaactatatgcaagttctcccccagccaaaattctagaggcaattttagggtgacttggcccttttaaagtgcttgtggatggcccagtatccatcttgctgtagtgac

SEQ ID NO: 20298 - DNA, 1561 bp, Mus musculus
agcagcatggacgaagactttgagtctgactacaagaagtactgtgtgctacagtaaagctacacttgggctgctactgggctgctgggaagggaagtgactccttgtagctggcatttggcagaaccatccctgaaaagcaagctacatgtagttattttatcctgtgacctgaagcacaaaataaagtcctaattaaaatagcagtcaactttaagaatagtaataattttgttttgaagtctcttacaagctgtctggtagagaactttcaggcagatcccaccattagcctgtaaacaagagggtttggcaccaatcacctgggaccaattaagaatttaattgtgctttccaaataatgaacaaacttgtagtgagtatagagtttaccaataatcataataggatactaaggatttccttggaatcaaagttaaaaacaacaacaaaaaccgtaataccataatgttgtctggggacaacatgatatgctacctcctttttcctgaagtttcattccgttgtgttacaaatggagaaagcaaaaccatgcaggaatgcagatagttcttatggaatggacacaaagagttttcagttttttgaatcatttcccctatctctctgtgtctttcttgctttttgttcttgttggttttgtgtttgaaacagtgattggtggcagaggcatatgacggtcagtctgaaccgaagagtctctgaagactatgtgccttctacccacactcagttctgagaaccaggagaaaggaaaggcagccatggtgtccagctcagatggccctcctgtagaggcgcactgctgggtgtggcagctgccacagggtttgcaccataggtcccaagctgatgttgcacacagcttctaggaaggtaggcggctgcgaagccagactgtttcctgttagtggtgggattgttttcccctttgtttctcgttttgcactttaaaagagagaacacatgcaaacaactgtgcttgtactttaatggctctaagggctataaattaactccattagcgtgtaaaatttaaaaacaaaaatacatccaacattaatagtttctaagaattgtttaagaaactctgggtttagcaaactctagttgtttgcctgtctgttccttaccaacttttttttttgcactggtcatcagaagtttctttgctcacttttttttttctaactattcaaaactggaacaaaagtataaatgttatttatttctggcagcatttttccctgtgttgtgttttagtatatagttaaaagaaattttcacctatttttggtccattaaaaatattcatcaagaccctgggaattgattctggtttgttgtcagatcctcttaccccctcgtcatgggtagtaaataccaatgtagtcagtgttcgtgttgtgatagctgagatcagtaaccgcctagttctcggcacagttggagcagttgtcttaaacaactgcctaggttgacccccttcccagaagagtgagtatacttgcaaggaaggagtggcctaaaggagtgatgc

SEQ ID NO: 20299 - DNA, 1166 bp, Mus musculus
cctagcttgtgtctcactgtgtagaccagcctggccttgaactcaaagagattccccttctctgctggaattaaaggtgtgtgccatcacacccaggctgagttgactttaaaaaaaaaaaaaaaaaaaaaaaagtaaagagatctgccaggggccagggtttccagtttagatagttgagacaaaaggcaaaacttccaggcacccacagcatactgtggacagcgacaagtgttttctttgtaagttattgtatccaccattcaccttcagttagccaaagaagattgtttttactaacgtggagatttatacctttaatcccagcagaagtagaggtaggcagatctctgtgagctggagatgatcttgatctacaaagtgagttccagaactatataatgagaacttgtctttaaaaaaaatgctgtacatcacagagataatttttctatcttatctaaaaccttttctttcttatttgcttatttttgtttttttggttttgtttgtttgtttgtttgtttgtttttctttctttctttctgtagaacttccctcaggacaaccaaaaagttcgactctcagtgagtggatttttgtgtgcatttgaaattcctattcctgcatctccagtttcagcttgcagtccaattcaaacaggtaagatagaacttgagttccttcttatgagtgcagtgttgaacattgatctagggccagcaaaacggttcagctgataaagaaagaggtttgcagccaagtctaatgacctgagttcagcctcagcactcctaaaggagaaaactgagtcctgcaaattgttctctgacttccacatgcatactgtggtatgtgcttatattcacatatgtgcatatatacataaatatagtcaacattggtctaagagttaaaatcttttttatatatgttatgctcaaaagaatttttgagcccagaagaaacctttgactggagaattttctaagaactcttaataaccatttgactcatatctttcttttgattaatagaaaatctaaaattcagaaacagtaaacaaaccaagtaggtagctcttagctcatatatacaccattaacattcacatctaatagtaaaatggcacagatggtctgaaaggaacctactaccagaaaata

SEQ ID NO: 20300 - DNA, 1141 bp, Mus musculus
taacgcaggaggattccagcattaccctttgagggccagcttctgttattcagtaagtctgtcaaaaaaagaaaggaaaaccagaataactaaattaaatacaaataacgattccacagcatattactattgctagtcttttgtgttatttgttgcagttcccacagaaaagggcgccacaggtctgagtaacctgggaaacacatgcttcatgaactcaagcatccagtgtgtcagcaatacacaaccactgacacagtactttatctcagggaggcatctttatgaactcaacaggtaatctttggacccaccagcagttttccttctgtagctttgatctgaaatctagtactgcttaaatctccttttcctttaactttaaagacgaaacgttatgccattgccttgtcaaatatggaataagggcctatctcttgataggtagttttgtgcccacatgagtgtgaattatggagaaatctttggcgacaaatttttctctcaaacttctaggacaaatcccattggtatgaaaggccatatggctaaatgttatggcgatttggtgcaagaactttggagtggaactcagaagaatgttgcccccttaaagctccgggtaagcagactaaaatactacgaaatgtgtaattccttaatatttcttttactacttttattacattttctctatttaactttttcaataatttttttaaatctttcactaagtgtagcctaaatacccaatgtttgtatgtgttcaagtaaatgaaaaatactgttgtatatgtagataacaggaagaaaagactaaagaaatagtccttctttgagatattgttcattttacaaacttaacaactgcttttcttgtaagaagagtaaacccttttgatactctttgactactagcattgctaagttatttgtaaatcttgaacgttaaaaaatatgctcttaggcctctaacagtaaaaactaagataaaacaagacaagagtaggtaaatagaagaaaacatttatatagactaagacatctttccatgtgaggaattgccattttactatttatataaatacaaatttataaatataaattaaatatctgtgtgaatgaatagataatttgcttc

SEQ ID NO: 20301 - DNA, 1184 bp, Mus musculus
acagttttttcgggtccgggtctttttttttttttttccccagttttttcgagacagggtttctctgtatagccctggctgtcctggaactcactctgtagaccaggctgttctcgaactcagaaatctgcctgcctctgcctctcaagcgctgggattaaaggcgtgcgccacctcacccggcccaggctggtcttgaactcaagagatctaccactccctgccttcctgaatcctgtgattaaaggtgtacaaatctaggtttctttttttattcattattccaaactggttaaatatctgtatttatttgtttgctttgttgaaatggggtcttaactatgtagctcagagtaaccttgaactcataaaaatccacctgcttcccaagtactgggattaaaggcatatatcaacacacccagcaaaattcttttcattgaaatttaatgtctgtaaggaaattaaaacctcttttgttcacttgatgttaattattgcctttcaaaatttaaagctttgggtcaatgaagtgactcattgggtaagagagcttgccaccaagtcagacaacttgcattggatcagagggaacccccacattgtagagagagaggattgactcacacaggtgtcctcagactttcgtgtacactcaaatatacacactaagtaaatacatgtaattgaaaatagttttttaattttaaatcatctttggtgttttgtttttgctggtcaacaagaaattaataaaccagagtgatttatttagagttagttaattatatagtaattgtctctttccatataaagtttgtccataaactttactaaggaattgagattacacttgataaaaataatattatatgtaaattatattctttagacagataaaatagaagttgggagtcttattctcaatgcagatggaattttaagcataggagaaaaaagtcttcagtgatgagtcttgagtgagaaactaacttaaggggatacagctgactaagtgcaaagactaacttaagggagggcatgtagctgagagcaaaaaaaggcatgtgcatagcatgtccaaggcttaggtttaattcagcagcaccagggagaagagagaaattcaaagatgtgttttgcctcttgaaaatctgtaaggtaacgtttcttatagaatgact

SEQ ID NO: 20302 - DNA, 1155 bp, Mus musculus
ttggttcaaccagccggcgcgcaagatccacaggcgcaaggcccggtgcgcaagatccacaggcgcaaggcccggcagaggcgaaagcgcgtcgcatcgcccctcggcccgcgtccggtcccatcaggccgatcgtgaggtgccctacagtgagataccacaccaaggtccgggctggcaggggcttcagcctggaggagctcagggtggctggcatccacaagaaaatggctcgcactatcggcatctctgtggaccccaggaggcgaaacaagtccacggagtcactgcaggccaacgtgcagcgctgttgaggagtaccgctccaagctcatccggttccccaggaagccttctgctccgaagaagggagacagttctgctgaagaaattaagctggccacccagctgataggacccgtaatgcccatccggaatgtgtacaaaaaggaaaaggccagagttatcacagaagaagagaagaactttaaggcttttgccagtctcctaatggcccgttccaatgcccgactctttggcatccgagcaaaaagggcgaaggaagctgcagagcaagatgttgaaaagaaaaaataattccgtgttggagagttgcaataaattttccataaaacaaaaaaaaattattctagaaaaagaatgaaagcagtgtaatgagtgtaaaactgtctcctttttcatttattcttctttcatatttacatcccaaccagtttgccctccttcctctctcttccctgtcccttcccactaaaatttttcgataattctagaatctactgaaaactaaatcttattctaatgttctattaaaatgtttgatgtccatagataaacaaaatattccctaatggaaaagttgacattttgaaaaagaaagcctacagaggtaagcaatccactgcttcccattcttttcattttctgctaacagaagaaagaaaatttaatggggttcctgctcgagaacatgtttcaccaaaagaaaacaggatggaagaaatcaaggttaagaaatttaacgaagttttaaaagataaacaatgcacaaaagatatgaaggaagctggggtaagacaccagcaaacccagcactctggaagctaatgcaaagggttctgtgctataaagacc

SEQ ID NO: 20303 - DNA, 1205 bp, Mus musculus
gattcctgcaagccattctctgcattccacatgtacacgtggcacatacacaaataaaatgtgattttaaaattaaagggaatagcccaacaaacatgaaaaatacagtcaagaaagccaagactcttagtatacagccagagggacttagtgaaaggtaatcttgatgtaagtgaggtctgtggttagaagaaaaggaaggtgggaaagagtatgaaggtgacaagaggtagcaatgctgggacaaacaacattaaaggaactgtcaaaagtatttttgcaacactgaaattgaaaatgaaaccaccttagattgaaactagagagatggctcagagattaaaagtaccagttgctataccagaggacctggcttgattcctaacacccacaaccatctataactgcagttctatgatgtctgacaccctcttctgtcctccttaggcacacatgtgggtcacacacatgcaagtaaagcttccatacacataaaataaaaacaagtattaatcttttttttttttttgagacagggtttttctgtgtagccccagctatcttgcaactcactctgtagaccaggctggcctcgaactcagaaatccacctgcctctcccaagtgctgggattaaaggcatgagccaccaccgcccggcttataagtattaatcttaaaggctaatataaatatagaaaggtacatgaacacaaatgacactcaatatgtattatattattttagatttcaaaacaaacacaagccaggtatggtagcttacagtctcagtactggggaagactgatagagtattattctgtgctccaggccagcctggaaaatacagtcagttccaggaatgcctgggttacacaatgagaccttatcttaaaaaaaaaaaaaattaatttccctatacatttgtaacatttctaaccacttttaatgctttcaaaaataagacaacagtaacttttcccattaattataactctgaatagccttacactgtaaggttctttatacagtcccacactactatgcaaatcaattaacttcctacatataacataaattattttaatgattacattttatttgtttgtgtacatgtgtgccacagcacatgtgtggaaatcagaggacaatttcagagtcggttctctccttcctctgtgtgagtcccagagaacaaactcagga

SEQ ID NO: 20304 - DNA, 2358 bp, Mus musculus
tcagctggagccccacaagcctatatagttaatccctccaaagacagtttcaggagaggctttttgtatacttttattggatatttagcgtcctgtggtatgtttgtggtataggaatgtcatggtaaattgtttttcaataaatgttttaaaacttaagttttcacatggattatttgtatttaatcttcatttttggtggtgtgcacatacagtgttttgtatagtcagataacttccgggctcatcttccttagctcagttcaactgaactcgcactcagtgataaaggaacatggtcttagaagccttgactacagggtgataatgtcagttggcaaccagcccccaccgccagcagcagctctatcagctgctccatctgaccattccttaatattgttctctgtaagttactaaaggctactctaatgcctacactctagcactccatcttcttagtgatatgactttatatgttctgattctagtgaaaagaatgccctgatcgtttcaagggtgggattcatccctcagcaagggtgatgtagtgagaggaacgccaccgtaattttattttaaatattattaaagcagggtgtggcacatatctataatgtcagtattcaggagactgagtgaggtaagagactgagttccaggcagcctgggctacaaagggagattgtctccaaactctaaaaggaaaaactgaataaaatttacctcagaataatcagtggcttgcatgtaattttaaataagggcctctgctctcaccctcccctggattctcgtgttcctaaagtctggtgctattccatttgggggcatgaggagcctgtgcatgcatgtgacccagggagtcacttgttcggtgtaatagcgccaactgagtaaaagctcagtgcacaacatttatggtcctcaaactaggctttgccctgaggatttaaaccctttctttctccatccatgtacattcatttttataaacatctcaccagcaccctgcccgggtattgctgcctgtgagaatcaatgatttgaatggagccctttgtcctagaccatgggaatgtcttgtgagcattcagtacagggaactgcacgtgctggcacaagttcaatcccaactccatgggaggctgaaacaggagaatcacttgggatgccccaggatggcctagtgataagaccctgtctcaagaaatgcagtagtgcaccagctgccagcctggaagtctgagcagccattgaacttgattgtctttataggcaaaacgcgatgcaagcttttggccaaaattttgcaaattcaaagaatgttttgctaagttacagatgttgttaactgccatcttttttcttttttatatatatgttttcccctagggtgtttagccttgctgcttccaatcttctttttctggatggcaaagttactactggaaagaaattatttataattactgaattttaagagttttattttgttttaaaaattaacacttttcacctcttggctttagaggacttcagattagctggaattaaaaaaaaaaagatttaagtagaacatttggattagtgtacagatcttaacactagtatttcttttgtcccaaatctcaggaatgttttaggcagaaaactggcttttcccctgatggtgattgaaggagggtgctttaggattgattaaatagcactgttttaattgcagttctaggtatctatagcatgagtggccttaatgagtttgttgaagtgcacatgtttttcagaagtaaaatttaagattaaatatatatgctatatatagatatctagaaaacttggttgtggtgcacaaagtgttgaatcactgaatcgcaggtaccatttgtataacatcacttgtttctgtatattccttttatgggaaaatatgttgccatggtgactaaaaacttttcaatttagttttacttttatgtgaatgctacattttattaaatattaccaggtcagtactatttttataccttattaagtaacgggttttagtttaataggctcaaaataaaaagaaaaacccttaatggaataattacaaatgaatcactaacattctttacaggaaaatccccactactagtgccacagtaatttctatagtaatatctctggtcattaataaattctgaagacagctcattgagtcagaacggcctttcatatcattctcacttgtagtgcccaccgttatttgtaattattaaaccacactaagtatgtttgtaaccagcattgtgatatattctgtacttgtattgctaaatgaattattgacctaataaatagtgttcctgcatt

SEQ ID NO: 20305 - DNA, 1870 bp, Mus musculus
cgggtagtcctgtattgcagttcctgtagaataagcatatattgagttatatcagcatgtgccgcgtgtataagtagtcccacattctcaccccagtagaacaacaggaaaccgttttttttttctttttaaaaaataattcgtttttcagaaagtctgaaagaaaaaaaaaaaaagaacccctaaataaaactatttaagagtttaaaagagttgcattcttattatgtaaggatgatttcaaaaactttttaacatatagttaattcttccatgtggaggtattcaatactgtattgtaaggaaatcttatggaaaactctttatatgcagtatagaaaagtaacatagatactagtaagaggggaggggcaccctgacctagatttggccgtcttttccaaatcagggcattcagccattccagaactgtctcagtgacggactgtcaggttcgtctgactggaccaacgttgatctgtcggtccgtctcagaaccccacgtagaccagcagttgtaactctgtatttggtaccacggtgagatgctctaaagtgattgctgacaggaccagaaggactaaaaggaccaggcagccgtggacggtgtgacttggaccagcggctttcagttgtggctttagtgactgcagttgccttgccagtagaatgcagagtactaatgcaagagcttcatttacatcagagataccaaactgtgggatgtgggcaacgccagtggcaaatatttagtcctggtacatggatggcaatatcataagcacaccaatgtctaaccatctctgcagccactccctttaatctttgccctgaatctccatgtagttaaaaaacatactggctaagagtcatgaaatcagtcatgttcagatgagaattttaggtttactgtatggtgtgtggggattaaaaagatgaatgcacacaaaaagaaatcttagaaaatttgttattgttgaaaataattgtacaactaagtcattttaacggaaatctcggactccttcagttgcaatgtttcactgattggggctttgatttttctaagtttttcaagctagccagattactcaatgtggggctaatgctcagttcctaagttgtgacatgtaacaaaagaaaaagaccttctgttgttacctcaattcttagcacagtggcccctctggtctggcacctctgtggttaagaatctgggtttctcccctattttcaggggctctgacttggctgttagctacactgctcccggcagtgcttggaggtgtgagtgaatgggtatgtgtcagattctgttttgttagcatgtttgtatgtcggtgaggggaaaacaaagctatcatggagaatacagaaacattatttaagatttgcctgaactttttgttttaacttacccttttttgtgtttttttttgtttttttcgagacagggtttctctgtagccctggctgtcctggaactcactctgtagaccaggctggcctcgaactcagaaatccgcctgcctctgcctcccgcgtgctgggattaaaggcgtgcgccaccacgcccgactaacttcccaatgtttagcttggtttgaaactgctctttgtggacttagtggtaagccagtgtggtatggcctttagaagggactttcgtggagatgcaccccgcagatgaggcaggctctctgtcatcctgacacaaccactcaaacttattcctccaactgaatttcctttaaaattcttcaaagaactcaatttggcacacttgcagtttatgcagctggctctccccttcccccttaattactgttttgtgagagtcacctttatttccacatagtctgtgtgacca

SEQ ID NO: 20306 - DNA, 1160 bp, Mus musculus
gtaaggaaagaagctggggttggttggtttgtttgtttgtttgtttgtttgtttttggttatgtttggttagagattttgttttataaagactggttgcagaattgtaagaattactgaaagcactccttggcagttggatagctttaactttcatgtctcctatcattttactctttgtttcttgtttatgtatttggttggtttggttttttgagacaaggtctcatatagtctaggctgctcttgaatttgtcttgcatccaaggcttctagtcctgttgccttggcctcccagttgcttacataggcattcaccgccattcccaggtgaccattctcttttaaaagctaatttccatctataaaaggtagcaggttaatacagtagaggctgattctgcaagataatttaaggtacaccattttccccttaatttaaatgaatattttctatgaatagaacaactttcccaaaagtgtactgttgaagaagtcttggggtggaccacaactgcacacacatggaatcctagcactagttgaagcaggaggattgccatgaattcaaagccagcctgggctacaaatcaagagcccagttcaaaaacaaagaaaacaaaccctacaaatgtggaaagctttgaccttggccagttcttaactacagtcagttatgtcttcggtactcagtaaatactacattccttaattttcagttaagtgttgggccctgggacgtgggtttttggtctgttgatgtgtcactcgcctgctctctttgtgcagcacttattctagaggagattgcgattgactgtcacaacaaggagacggagcagcggctgcttcaggaggcacacgacttgcacttgtcttcgctgcagctggctaagaaagcatttggggaatttaatgtacagactgcaaagcactatgggaacctcggaaggctctatcagtcaatgagaaaatttaaggtaaaaaaggttttatattctacacttgatcttagccaaaaggctgagaagcgataaggttttatattctttgtctctgaataattagtaaatttaatgtgataaattttcagtaatcttaaataataccccaaaggagctgagagaaaactgagctagtgtaaaaaccctgtagtgaaat

SEQ ID NO: 20307 - DNA, 1187 bp, Mus musculus
tgtggtactcctggggtggttgaggaggtcctgtcttcctcccacatgatacccaagtgtccctgcagtgttcatgctgtcctcagtagctgactgaagtgtgtgttgcttccgcatttccgaccacatgtgctgtgtcatcctttaagcacttgttctcatgctgtgttctcttgtggtttttaattactatttaccggatgactgaagaaaacttgaatgcctttgcgtgctttttgtctgagttttctctttggttcaaggcctatttaggcctttcttttttccttcaggtggcctgtctgactgatttcagttgtggggacattttgtagactttgtatacgtcagtgaagtagtctgattctgctcctggtaacttactaagtaaacttgtgggtacacaaggaggccagaaggtgttgggttccttagggctggagttagaggtgtgggtgctgctgtgacctcatgattgagcagcaggggcttgtcactactgagcctcagtttaccacccattgcctaattaaggagaaccaatttattccctcttactagcttttcttgcttatcatttgactgccctctgcagttatcctagtataactgtttgctcaaacttacaggactccctcattttgctgtgacctttactgtgctatggggtgacttttatattttgtcctttcagtagagttccagtgggcagagtatgtaagtaagtgattcaatctgctatcatgaatttacagttggagtttagtattacagagttgttgtaatactaaattgttgttgtcactgaatttaactagacagtatatggtttggaattgatttgagagttctgttatttaatttttaagttatcttaagcaagcttcttaaccatgcaaagtatttatttcttcatttgtaagatgaaaataggaataatttgtttttctttttgtttttcaagacagggtttctctatatagttttggctgtctggaacttaactttgtagaccaggctggcctcaaactcagacatctacctgcctctgccttcttagtgctgagattaaaggtgcacaccaccactgcctggctagggaagaattttatgtcttattggcttactgtaaatattatttgaagtagtacgtgcaagcttctttgtataggactttggtgatgagt

SEQ ID NO: 20308 - DNA, 1150 bp, Mus musculus
tgtgttttgagacagagtttctgtgcagcccagaatgatcttgaacttgtttgctcctcgtgtctcctcgcttccagccctggttttatgtagcaccaggagtcaagcccagggcttcctggaagatagataagcacctactgagctacatctccagccctcctgagcgttgtaaatgggaatgtgctttttgtggagagatgagttcttttgtacactgatggttattgataccactctatccatgaatgcttatcctcctgattctagcagtcttacaagaattaactgcttctttgggtgtgaaagccaggtagctgactaaaaaagccatattcttgagaagtgtaggtgttgggtagagtttggttactctgtaagccttattgatgagaagagatggtaatggatggcttattatgatcagtgtatttaggcatctgtgattctgtggaggttaagaacttgcctttgatattattcctggacaggcattcttggagtaatgacattccacactgtgctggtcagcagcagggagggacagagagggatagaattagttgcgttggtgtcatcttttgctttgaacttctgtggttttagagttgtactgtattttaatgaaaacatttctgtttaatttgcaggcttacagtgggtctcccctaacagaagaaaaggagaagatagtctgggtcagatttgagaatgcagatctgaacggtatgactaacttttctgggatgtgtatattaaatgctcttttggggctgacctgattttagaaagggaaccccaagttcagtcaggctattttgcttatactaaataaattcatctttggctgggaatagtagcacatgcttatcatctcagggctcacaggcggaggtaggaggatccctagttggaggtgagtctggggcatagtaagacccgtctggaaaccagccgtgctgttgtgtataaccattgcagtcggtggtcatcagtcttagagcattttcatctggggaataaactagatttctttctctctctctctctctctttttttccgagacagtggaactcaatttgtagaccaggctggcctcgaactcagaaatccgcctgcctctgcctcccgagtgctgggattaaaggc

SEQ ID NO: 20309 - DNA, 1169 bp, Mus musculus
ttagtttcttttattgacattaatataaacatacaaagtaatgaatgtcatttctggcatctttagacttgtgtccttgctctcattccttccttcccctgtagtatgactcctaaggccgtcttttagacaagcccaagtgtgttctaatagcattatgcaaattttgctaatttgtaggctgattgttacttcataattgaagtttatcctaagttgggatctttcttaaatgagagccccccccctttttttttttgctttctaggaatatgtatgtatagttggtttttgtttgtttgtatgtggatgtgtggtgcatgttcttgaatgtgcatgagtgtgtgtttccattaggagaaaaaaggcatgggctctttttctcagttgtttctctgtcttaattgccctgagatggggtctctttttgaaccagaagctgtggtttcagctctactgtctggccagggaggtcttcacagctgcctgtttctgcctctcactgttgggcagaagtaaatacttcttgaaaaagtagactggaggagaaggacggagttgctgtatgtcccatgggtacatgtgactcctgtttaccaacagtctaaagcagagtgatgtggttggagtctctgaacctgagttcacatgttattgccacccacagtcagggttcatttcagtgctgtatgaggggctttgacagatgtgccatgacacgagtcactgagcattgttcactcatgtccccacaccttgaatagaggccatcatttttctcattacttgatattgtatttggcaaatgtcatttgccatacttggagtggccatttcagattggtttctgttatattgaatatgcatataagcgtcctcttgtttctttcatgaattgatagtttatagacgtcatataccattgtaaatatagtttataataccacaagctatataaagctcatgtttatagcttgactttttcctgtgtatgtgtgattgtgcatgtatgcacacagacaagtaagtggaacaaacacactggatggcatttaaggatccttttctttctcatgtagttccctcccccatgggtaaaacagtcattgtcctgaccacagattagcttggcagttttaaacaatttaaatttatgcactatggagtct

SEQ ID NO: 20310 - DNA, 1158 bp, Mus musculus
ttgagctggcatgcttggcccaggttcactgtctttctctgattcagagataggcaagacaaatgtccatttttgtttccccagtgccaattgcggcttacctctgtcttcctgggttactgaggctacacacctctcctggccatggggcaccatcatgtccatcttttagtcaaggcatcaagaactttgggaaggagctctgtgggtcaagtggctattgaaccgatggcagagaagatgatgtaggagcctggaccttgagatcacactctcctcttggagactttgatcctactcacttctgacctctttcaccttcacagttgcccatcccaaagtggaaccagcatgcccctgccctccttgggtcagctcttcagtcctggttagaactaagcaactccttaaatggctaacctcaaaacaaaacaaaaaccccatgtgtacttagcctctccctctggtaggtggtgatgttgcgctgagatagtgcctcaacgtctcagtagccttaatctcacccagagttccttatggaactatacattggtcttgctggacagcacaggaaagaactggaaggctggttggcggtcagtggtgagcctgtgggtggtgaagatttctgaaacaagcatttaaaccagttcagccttagtcagtggtgtgtagctgcttgatctgaacgacgggatcccaccctttacctacatgtgcctgtgtgtgtcccttatggaaacaccgcatattcagtgtgatccttagccttcatgaggtgaagacaactgtaatgaggtggtgctatccactccgtgggtggcaagtgaatcaaacttgtggataggttgagaactttggtcttagagccacagttccaagatgttgtggtggggtccagggagcatccacacacaacaggatataccttctttctataagcaaggttattcaacctcactctctggcatttctgtctgcccttccttcatgtctaccatgagtggatacttggtcacaggaaccaggtccatggcaacacattctgtttttaaattgaaatgattatagttttatgtgcacttgtacagaaaattagaaaattagaaaattccataaatcttttaatatgccctgataattttcacaacttcagag

SEQ ID NO: 20311 - DNA, 2192 bp, Mus musculus
tcaggctgcaggtgaccagggtcatcccagtaatagaccttattggtatggttcagtgggttttttggactctgcatttattttagcagacttctctgatagcattttgcagctttcagctatttgtgttggaaagacaaataataagtaaaccagtccagggctctgtttctttgtgcaactgactgtgtgtcctagtgccctgctggagggtgggggtggggggcgtgggagaagcagtgagggctcctgtgggatgccagaggagaggggggttttatgctcttaatgtgcctcccctttcttgttatttaggacatcaatagaaccaaggcgtgttagaattgttctttaacattgtgtagacaggagcctctccacagtgttgagcatctctcactgaacgtagtcacacccatcacactgttctgcttacaattgcttaagcaagtgtttcttgagtacctagaaacatggcagtacccaaaatagatttgtcacgctcagtgtttgcattgtgtgagtgaatgctgctgcacatatgggaatagtattcaataaaatcttcttctgcactaaagttactattattatacataagtccactgtagctgtcttcagacactcgagaagagggcatcagatctcattacagatggttgtgagccaccatgtggttgctgggatttgaactgaggatcttcggaagagcagtcagtgctcttacccactgagccatgtcgccagccccaacttctattttcttaacctttgagttatctcaaccctttaagtttgaagatataactacagattataacttcctaatgggcaactctcctgagtcctcaattaagattgttttgttccaaagtcctttggagagagagacttaaaaattagtgatactctatttatccaggttccaaataaaaagacagaaaaaataaaagttttaatcattgtgttcatattgtctggcaggtgatctagcaacaaatggtaactttgaaaaacatcaatattgatgaatttatagaacttaacacaaggcgataagggtaccatgaaatcatacacatggataatctgggacaccaggatgttgaagtgtagtctacatcactaaagatgtgttacatgatactcagtatgggttttgcattaaggatgtttcatcattttctagttcctgtgaattagtatccccatctaataggtaagatgtgccgttagaacgtttgctaggtccagtgtgatgatagactcttttgtttgttttgctttgctttttgtttttttgagacaggatttctccacgtaactaccctggctgtctgggaaattgctctgtagaccatctctgctctcaaattcacagaaatctacctgcctttgcctcccagtgctgggattaaaggtggcaatgggacactccttttaaccccagcgtttgtaagacaaaggagaacagcttggtctgcatggagtttcagaccctatcttaaaagacagacaaacagacccacggtgtgtgtgtgtgtgtgtgtgtgtgtgtgtgtgtgtgtgtgtgagagagagagagagagagagagagagagagagagagagagagtattagagttagaatagtttcatggaccattaagaggaagctgaacctaaagtccccacactgggtatttggatgaaaaagtcatagtccctagttggttctctatggctggtgtctgagctgagccgcctaaaaaaatgcatacagtaatggtttccccccttaaggtctcactcctctgtaagctggttcctacatttacctgagattttccaaattagtcctgttagaaacaagtgtgcttaagttagactcttctctcccagagaaaaggtaaagccttgggatcgaaagcaactagaagaactcacctaacaatccaagatcctctcctcaggatggcttagtccctgccaccactgagtatggccactcagaacacctgcatgattttaaactgaggtctaaaggtgttaactaactctagcccaggtacagagtgacaggctgctggaagtcccactgaggtttggtggactcctgcacgttatagcccttaggaggggtcctagcattgctcttttggtttcctgacgaagctgagtgataagtttccttcattatggctacttctgtc

SEQ ID NO: 20312 - DNA, 1165 bp, Mus musculus
tttaaaaaaaagaaaagaaaaaaattgttcgtgagcaaagtcatatgaaaaaactgggaaagaatgtaggcaagagcagactctaatgcatgttctagaacagtggttctcagcctgtgggtcaaaggactcttttggagggcttgtctaagactataagaattgacagatatttactttatgatgtataacagtagcaacataacagttgaagtagcaacagaaataattttatgttggggatcactacaacatgaggaagtgtatacgtgtcagggtataaagaaggttaagaatcagtgctccaagatgggcgtggtggcgcacgcctttaatcccaacacttgggaggcagaggcaggcggatttctgcgttcaaggccagcctggtctacagagtgagttctaggacagccagagctacacagagaaaccctgtctcgaaaaaccaaaaaaaaaaaaaaaaaaaaaaaaaaaaaaaaatccatctccagagagtcacagacaggaaggatcttatagccttcagctaagcactgatcgtggttcagcatgtgggaaactacctaaggcctaggagagaactattactgtagaatatcagaggagacattcagcattcactggctgtcagacaggactgtcagctttcttttttctttttggtttttttttggggttttttgtttttttttcgagacagggtttctctgtgtagccctggctgtcctggaactcactctgtggaccagggtggcctcaaactcagaaatccacctgcctctgcctcccaagtgctaggattaaagacatgtgccaccactgcccggctttcaggactgtcatttctgtcacaccatccagaatagaaaactttatggtttatagacaaacagagagaaggtttatgtcacaaaatgggctaaatttctttcagttttccctaacttagaaggaagacatcataattaaattgatctaaactaataatgaagtggaaatgtaagtatctcataaggtctgtattcccatacatcccacaaaagagttgataaattacacaagtgttctagaagtctaagaaagactatcagtgtgtagataaaggctcataagccaacttgtgttaaaggaaactccaaaacccttacacaaatgtacacgc

SEQ ID NO: 20313 - DNA, 1123 bp, Mus musculus
agaagcaggaaaaaaaaaatgtaacaacaacaaaaggccaccccgaaacaacaactagtgaagaaaaagaaaattccattctgataagcatgttttcctgccttgcttatgttgtgctgtggagtacagatggcccaagagtgacatcaattttaaaaggtttggaggcgaccttgtctccttactgtgtactgaaaaaccatgcgattgtctcagttacggtgattatttaatagaatgtaattatctgaataattcatttatttgactactcgtctgtgtcctccagtcacagaggccagaatgccaaagatcaagtagactgggaaaatgggaaaattctcattataaagacgaagggtggagggaaaggatggaatagttggaatttcaacgcagtggtttctatttatctgaaatgtcaagggcagtgtaaaatgtatttttaaaatgtgttgctgtatggtttgtgcccattcttggcgtggctatggctctacagaggccattgttccttgaggaatatgagggggtgtctttgtccaaagtgacaaagagagggctgagaagactgggcctcctttgttcctgtgcggtgctgtaaaagttggtttgaaattaggacctcagggaaggaccttcaatagagagctttcatttcctgccagcattttaatcactgtggggtttaaagtggatggccagccagcataatggccctatgtttaatagaacagcttgtattttgaaggccagtgaaggggtctgtcatccgcccaatattcatcttctgtttcctgtccatttacgaagaccgcccacccttttaggtggctcccttgcaccattttgtagtggaactactgcggttccttcttaaagaggctgagctggggtgaaagcaatgcagcctgcatttgaggcaggatgggtgctaatgagacccagggttggtagctgtccctgtcagtttcaagaagaaagagtcagattttgccaaaatatagaatagtagaaaggctaaactgtaaccctgtctcatcagaactatcagcacccattgattcagtaggtgtaaaatcattgctacgggggaaggaaatgtccaggaagaggaggggtc

SEQ ID NO: 20314 - DNA, 1126 bp, Mus musculus
atacttatttatctattgcatgaacctaggagatagggggtgctaaaaaaaaaaaaaaaaaaacaaacctgaagtctccttcaatacccacccgtattcagaacatcagacaatttatacccagacgattacaacaggtcagctgagtagagctcatgagcccaagctgtctgagtcacaaggacatgagtaccagctgctggaaactcagttttctccaagacacctgggaggagcacaagaacagttctgtcatttgaagaaactgaggtcacaagacttgtcttgttttcttgtagctttctcacaagcactaagaattgacttcccatgaatccatccttggatcccatcccaacacttactggccgtttttttcttttttaagctgggcttcactgtgtagtccaggctggcctagagctcaccgtccttccgcctcagccgtcagcctgtagaattacagagtccgacaagctgaatgtggtgccacacacctataagtgtgtaaatgtgttaagagcatgtcccaagcaagctaatgtccgcagcatctgcactctgaaacaccaaggctttgctgggcctccttcgttgtggctcctgcttgtcgccccttctgctgcacacacatccaagagccattgctcaggccagcgccattgcctctccggtttcctcttacgactctcaccttttcaggccctatactaaaggcaggctttgtgtgtgggtggggggagggcaaggtacatagtgagagtccttatttctttttgggctagaaactcaccgtgtagatcaggctcgcctcagaagacatctgcctaccactgcctccctactgctaggattaaaggcgtgtaccaccaagcctgccccaatttcattcttactgagaaattaatttataatctttatctttaaccgcaggttatttgttgcaggttctccctaaacttcacagtagacaagaaatgattttccatgaaactcctctaggggtagaaacccagacccaaattctgagtcctggattctgatgtctgttcagtttgtcacacagacttggacttctacagagttccatctcaagaaattgcagactctcgagatgcagctcagg

SEQ ID NO: 20315 - DNA, 1180 bp, Mus musculus
gttctcattggctacagattcagtgtcttcagttatatttactcttgagttctttctataactcaactccttccactcttggctgtcttgtattttgtcattcattcattcattcttcattctcttataagctgaagattctcttagcatgagacttgagtttagatccccagcatgcatataagaggaagctatgcatggcggtgcatactgtaaccccagtgctgacacacagtggcagcggaatcccaggagctcatttgctggccagtctggccaatcagtaagcctcagtgagagtcagtctctctctctctgtctttctctgtctctctctgtctctctctgtctctgtctgtctgtctctctctctctctctctctctctctctctctgaagataaggtggaaggtgacagaagacactcatcatattttctgcccataagaactcggtacctactactcagtacctaacccccattccttccccacccctcagtcccagcactcacagtctgctttatatttctatggatgtgactagatcccatatagaagtgaatgatagtgctggctctcttgtgactggcctacttcactttgtataacgtccatggggtttgttcattcgcactgtagtttagggcaggatttccctcttacggtgtaaaatatttcacttacacagtaggtggtttctttatcttggctacagtgagtaatgctgccctgtgcaagtatacagttatttctttgaaattcaattttagttctttcaactatttgcccagtaataggcttgcattggattacatgttctgtggtttttgatactgttttccacaggacctgtgctggaagtattttatattcttaacagtgcataagggtttcactttctctaatgtgcatgggtactttctgttcctgggttttgcttgtatatattttgatattggtgggaaatgatatatctttgtggttttaacttgtatttccctggtaattagtggtaagtgtctttttatattcccattgcctatttatttatattcttcgtgtaaatatcttttcgagtctttgcgccagaatctcatgtagcccaggctggcctcttacttgctgtgtagtggggttcctggccaggaggtctcctgcctccacccacgccaggccac

SEQ ID NO: 20316 - DNA, 1155 bp, Mus musculus
ttaaaggagttctcttcaaattggcttttaatttgctcgacataattacattcattcaagttggtcactatcctagagtatatttctaagatttttgccacacagcattttaaatggtttctggtgtttgcctcacatttgaaatggcattttccatttctctattgttgaaagattgctttcatgtgtgcctttccttccctcttcctttgtacatgaaccttgcacttgtagtagagagtcaaagactcgtttccaatttccattccaactcgggctaggaaaagacacgttaaatttgaattctgacgtcttcactgatgaacacacaaacacacacactctcacacacactcacacacacacataccatgctctgcctcttctatttctgtacatacttgtaagatctcaaaagttgtatatgagaaagtcctgttaacgtctaatgcataacttggaaccattttttagtgaacacattcacacatgatttttgttattttttgccataatcggtctcaggtttgaagtaaaatctgtctctagaaaagagcaaatctcacagattttgaatctcttctattgttttcataggactcccttatcaataagagggtttcctgagccctgggtgggagctgaaaaatgaggagcgaatgagcctgcagagactttccctgagagctgagcctcttcacagttggaggaagtcaggaaaagtaggcgggaaatttggaaactattcaggatcagagagcccagtttgtttgtattttgctgaaagagttcaaaggcagaatcttgggaagttggtcactctgagatgggacttcctgtgtcagcaagggaacattctacagcttgacctgtggggatttcaaagatcgcttgaacacccaagctaaactctgtgtttggattggcccttgtaagtaagtatcataaaggaaggatgggaggctgaggcagaaagatcacaagccaacctgagctgcgtagaaagacaaaaaacaaaataattaactagagaaggaggcagtcacaacacagtagatcatggaacaggcccttttacaagtctttcagctctcactttgggagtgtcattcagatcattgagttgttcaaattacattgaatcattatctaccc

SEQ ID NO: 20317 - DNA, 1294 bp, Mus musculus
agaacttcagcgagagggaagcatcgagactctgagtaacagctccggctccaccagcggcagcatcccaagaaacttcgatggctaccgatctccgctccctaccaacgagagccagccgctcagcctcttccccactggcttcccctaggcaccagccacctgcttctgactggctggcccgctcacccctagagggactgactgggaggggggagtacccccatctccctacaccaccaccaccacccctgtcccgcacgcctctgttcccacccttttcagtctcctcaaccccaccttccctaagcttagtggcaacagctgttcatcccaaactggacgagaagagaccttcagaacacctcggtacaccctgacctcccccactcctgtcagtgggggctgtggcccaaagagactgcagaaactcagtcccttctctctttgcacacaacgtcccgcactggatccgcttttgtattttctaactactcacaggggactggaacaggggccagatcttagggcctctggtaggggagagttgaaagatccagccaggcattttggtggacatcagccctagcccagttcaggctgggatgcacattgcccccaggtacccctgctcagttctaaaacaggagtgaactgagacctagagcgatagagaggaagaaggaaagaggcctccccttgcccttgcttccctgttggctcatggagagatttgtctgtcttatctttaagcccttgtcccctggtcctgtactgttccatgaagggaagtgcagttaccgaggccgtgtcaaaagtgcacgtcttgtccaataaatctcgctgcaattggtgttcattcctgagttgctggggtcagggtcctatccaaacacggagcaaagtcctgtaggtctgaccgtggcactggctcccaacacccacaccctcactatacacaagtgtccagggagcctgtcttgggaagaaaaggggaggaaaaccttcccactggaatttaggtgtggcctcactgaagtccagtctctaagattcttgcctgttaccagagcctctgacttctggaggagccaagcttggacctccttccaagtcctgcccctactatgtggtgggttgctcaaggaagagagcttgcccttgcctgtggccttgtcttagagcacttgagaacctctctctcactccgagaagatggagagcctgttgactaaagttgggtatcctctgaaagttggaacacctctgatagcaagttcttgggttttgttgt

SEQ ID NO: 20318 - DNA, 1111 bp, Mus musculus
tcaggccatcctggtctacatagtaagttctaagacagccaggactactcagagaaactctgtcttgagaaaccaaaaaaggaaaaggaacatttggtatgtacatttaaaaaataagtaaatgttgcatacacacacacatataaaacggaccctgaaataatggtccattaaaaaacaagaatctactgtgaattttgagtgcatgttttagagagtgaaacaatgtctgatcaaaaatgtttataaatgatggtcatctctgacattccaaaactacactgatttacccacccccaaagaatggacatttagactttttatatggtgatttgaattgagagtgtggtgtggtgtgtaaatgcaacttttattgttgtctcggaggcttacagcctttggctgctatcctaagcgtttagcttccgtacaatcttatctaggcctagaatgtcttcagcctctgagactcactgctgaataagctcaccccttccgagttctttctgacctctggctggctgagtcaactcagcttttctggctcaaactcctctccaagctgatttaatcaggcttctcactctgagtctctcctgaattgctctgtttgacctcatattaactttggcaatatgttctaaccttctggcccttcattttctagctcattctatctttacctgtgtctagcttgttctttcttcaacctgtttctgtaaaactttcctggtaaaaccgcctggctgcttcttcctcaccacactgttctggtaagtagtttccctttcttctctcatgagagttctgcatatcctattctatcaaatgtttctctgattcataactttgtctgccactcaattagacatcactttcaaacatgggtgcctccttctacaaactaactttcattatttatgactaaaggtgtatgctaaggccatgtctgtattccagccagaagaattaaaggtgtgtactaagggctgagccacaccagaactaaaaatagggctttttagtaaattacacaatctcagggttcaaatttggttaaatatcctacaacatgtgtgtatgtgtagctggagatcaagcccagggcttt

SEQ ID NO: 20319 - DNA, 1205 bp, Mus musculus
ttcacttcagggtagtatttgctcatattctttctccaagtgtactactgactgtatgagcattcatcaacatttaatcctgaaatgttgaagtaaaaaattctaagtcaaatgtaaccacatggggagatgcttacataaaaatgactggagcctttttatatttcacatttgaatactgaaaaattaaggctgtgctcattttatagtaactaattattttattaagaaacactactaatttttcatttttattagtatttaaaatactcttatttctaacctaccacccataggtatatatcaactaaaaaaaaagaaagtaaatatttctcatatattaatacctctcgaaatgagtgtcaaagaatcatcttctgattgaaaaatatgattacattttaccttcgaaacaaatgatatgaataggattatgtgaaatagtctatttaggcaggaccattaaatgcattagggcttgagtactggctattaaagtgaatccatggcaatacagggagagaaacacaggccaaaaagcatttccaaagagctgggactgtaacaataccagtaacgagggcaaagaggtcttaatgcaatttgcactttctaaagtttcaaaaagagactctgcgttagtgcgttattaatgtactgaacatctggtgctgcataaaagctatggacgttgaacaaatacaggattctaacttattgcctccctagtggcatactggtttttaagaagcttgaaaaagtgaaatgacaatgtccagataagacacaggcattccaaagtattcttttaatttgtgagatgtgacttttcaaaaacatgcctcgaatgctaatgaatccaagcaatgtgaacaccagttggtagattgtctctatcattgtgtcagctagtctctgtatgtgactagtatttactttttaatgatctataaaaataactcagaaataccttgtgggttttttttttttctcttgtgtggtaggcctgaaaaaccaagagacaggtctaagtagtttcctttaagctgtttgagagagtgaacaactgaattgtgtgtccagtcggcaagagggaatcacttgagccatgtacatgcgttctttgagtgtcacctgcagtgagaacagaaaagctgtagacctaaggatttgcttagtgaaaccgaaaatgaggaagagagaga

SEQ ID NO: 20320 - DNA, 1101 bp, Mus musculus
tggtactctgctgaagatctggcagttatttcaaagaatcccaacaagcactttgatcaggaaaaagaactctggaaatatgccatcaggaaaaaaagattctgccacaggaacaagcacggacaatgataagacaaatgcatcaatggacccacctgggaggtaagcaagctaactcaaactgccttaagatctacgtattatattccaggactgaaacacctggtagaaaaaatagttcacggttgtgtgccctgccaaaaggtaaatgcttgcagaagcaaagctgactccttcctgtaagagacctcggggaggtaagctgggagcctactgggaagtggacttcactgagataaaaccaggcaagtatggctacaaatatcttctagttttcatagacactttctcaggataaatagaagccttcccttccaaacaagagaccaccacagtggtggtaaagaagataatggaagagatttttccccgatttggagtatccaaggtaatcagatctgacaatggccctgccttgttgccaaggtaagccagcgagtggccaagtacctagaggtcaactggaaacttcactgtatttacagacctcaaagctaagggcaggtagagaggatgaacagaactctaaaagagaccttgacaaaattgaccatggagactggcgctgactgggtggtgctccttcccttggccctgtttagagtcaggaataccccctcccactttagtctgattccttatgaaatcttatatggaactcctgctcccctgactttcctgggggacatccttgggcccacttgtcatagtaacaatgatttgtatgccaggttaaaaggcctgcagctggtgcagagagaagtgtgatcacagctggcagctgcatatgagcctgatactcctaagacatcgcatcagttcgaggttggagattcattctacgtgaggcaacatcgtgcccagaggctcgagccccattggaaaggatcctatctagtactgctaactactccaacggctgtcaaagtggatggaattgctgcctggatacatgcctcacatgtgaagccagccccctta

SEQ ID NO: 20321 - DNA, 1225 bp, Mus musculus
cctgttcctccaacaagatctgtgtgcagccctaaaagaagaatgctgcttctacatagaccactctggagtggtaaaagattcgatggccaaagtgagaaaggggctggcgaaaagaaagagagaaagaaaacagaaccaggggtggtttaatcttggtttaactctttccccgtggcttcacgaccctgatttctatccttctgggaccattgctaatcctgatgttgcttttaacttttgttccctgcattttaaattgcttgctagcttttattagagaacacataagcacagttcagattataatgctgagacaacagtatcaagagttaagtcagggggctggtgagatggctcagcaggtaagagcacccgactgctcttccaaaggtcctgagttcaaatcccagcaaccacatggtggctcacaatcatccgtaatgagatctgactccctcttctggtgtgtctgaagacagctacagtgtacttacatataataaataaatgaagagttaagtcagaatgagctataatttcatgactgaaatacaagaaaaaggggggaatgtgaaagtttaagaagcacaaaatggctgctagaaggaggatcttgccagaaataagactttgggtacagaaggattatgactaattcctcttcccagaatgtcccagaaaaacaggaaggcctttactgcagagcagggtgggccaggtgcagataattcagttcccctttgaagataacaaagacctcaccccacttagaacaaccaatgctgagaaaggtcgatacagactactaataagctttaaccaactcatactgttgctgaagtctgcccccaagaactgtataaaagatgcttgaaatgttcagggtagcctctgccctaattgcaggatggccccaatgcgctggatcattaaacctcttgcttgttgcatcgatctccgtctctgtttctgtgagtgggcctccctggacgtaaggctctaagggtcttacagtaccccttttggaaatggatgatttaacctacacagctagtcccctaggactagaagactaatttgcaacgaaaaggaaacctttttcctgttgtctatcatgcaagtaacctccatggttacagtatgggaagaaagaggaatgcagactgcaccagaattgtcactacaatgctaaaattagtgagaaggtcctgtggtactttgt

SEQ ID NO: 20322 - DNA, 2732 bp, Mus musculus
tttgtgtaggatgcctgtgttgaatttatatttgcaactaaacaattgtgttgcttttcttcccaccagttctgacacaagctaagcggtactcgtttttcatgccaactcttccaagtttggtctccttttgtcgagcatttcctccactgtatgaggatattatgtctttgctaattcaaataggacaagtgtgtgcctctgatgttgccactcagacaagagacattgatccaatcattacacgtaagtgctacttcactttaatgtttcaaacaagactatattcatttcagaatatcttgccttaattattttctctccttactttgtaggtcttcaacaaataaaggagaaacctagtggatggtctcaaatttgtaaggatccatcttacaaaaatggatccagggacactggaagcatggatcctgatgtccagctctgtcattgtattgaaagcacaataattgaaataataaacatgagtgttagtggaatttaaaaaaagttttaagtgcagccacttgctatactgaatctggactttatgagaactctaaactgaatgagaatagtgagatcttggaattgctgaagtgactcaattcagcatgaggataatttagagctctctgagaattatacttgtttgattggcatatctttggatctgctctgatggtatgtttatattgtagcagctgaacttcttttccactggagacactttaagaaacttgtcactagaaaaggattggttcctgtacttagcatttgacgtgaagaaagattgccaggcctttaatttaattgcttaaaaaaatgagcctgtggatatccctcatatttgtgagctttcaacagttttcaacaaagagaggagaggaaggagaaagagggatgtagggcaggaaccatttagaaaaaattaccatttaagtacacagaaatcttacagacttgtaatgcaaataacagtattacaggttgaacttctaatttgttagagacagtagtaggatggctttaaaaaaaaaaaaaaaaaagcaggtaaggcaggtgtggtggagcatgccttaaatcccagcctagggagaaagggagaggcaggcagacctttgaccaggccagcctggttcacgtagtgagttccaggaaagtcagagctacataatggaccctgtccagactactaaatgactgccttggaattacagatgaagatacaaagatttcacaaatctgcttcaatttttcccaatatatgaagccatatgtttaaagagatacttgaattctttgaaattttaagatactgattgtagttacagtaacatctttgtgcaaagaagaacctgaaagtaaatttcatttattctttttaaaatttatttttgtaatactgtattatctagttctcagaggagcaaagatgtatcaaattaaatgaactttagagcaataaaccccaatagtgctcttggttcatcagcaggattataattcacattttactttgaggagatctttgagtaagaaaatacagtatttgaacctcaggaaaaattataatgtggaaaatgctgtgttgctgactttttcagccctctgttaggagcttcacgtttaaggagatgcattcagataaccataatcatttttgtaaaattaagtacctatatacaaggtacttctttgctctttgagaaatacctcaatcatatgtcaccctactcagagcggacctctggttaaagaaggtagtaagctaaaaggaaagttatccctccccccacaaaggaacttagcttcatcctttcctctcgtacatagtcacatctcatttttctttgtcactcctgaccctacctcatgaaggtgttctattaaaacaagtttatagctgtttccaatcatgaagtacatcgtatcatgcatggtggaatatatataactttttattagatgcttaatgttcaattaattaattttgatgtgaagagtaaaagaatatgctttaaagatataccacaagaattttcctatttttaaatgaggcagttctgaagtctcttaagattaaatacaactgctcccgttttgtttgtaaatgagacctttctggaagtttttctgtgaatagtagaatcctttaggaattctgaattatttgaagtatgttttgtaatgaaatacagtacacattttgtggatcaattttcaaagactagtcataacctactgtgttaaagtaataacatagcctgtttttcatccaatttgttgatgatgtaaataaaatatgtaaataatattagtaaatgttaatattcatatatcttaagttaaggttataagctttgtcacaatgtgattttttttattcaagtcaaaacagatgtgtgcaactattttggatattgatttataaacattcattctttaacaatgaactgtagcttttatgttttatttcacaactgttaatgtaaaattaccaggagggagttagaatctaggacaccctagttctggggctttaatatatccctttctttaaggtcacataaatgaaaggaaccctagaaattgtagttaccgatggttatgagtcccatatgggtgctaggaatgtaacctgggtcctgtacaagagaagcaagtgctcttaaccactggtccaccctcttcagatcctggagtctgcttttataaaacaaatttcacag

SEQ ID NO: 20323 - DNA, 4640 bp, Mus musculus
tacagtatgaaattcttagcaaagagggtttctgtggttgtggtattgatgtcatctcattgtttaggcagcaaagggtgtctctctctctctctctctctctctctctctctctctctctctctctctctttctctctctttctctctctctctctcacacacacacacacacacacacacacacctctttgagtcttgaaagtactatccaagtgtatattgaatgagatggattgacacagtttattcgctttcaggtttgttttggaacagtacaatgcactctcatggctaacctgtgaccctgcagtccaggacagacgctcatgtctcccagttcattttgtggtgctgaatcagttatataacttcatcatgaatatgctgtgatcctcgtttgatggaattacgcaaggaaagaacgggaagaaaggatattttgctgcaagattaagttacagttctcagtggaagtcatttgtgatggggtctaattcttattacttcaacaaatattgttttgacttggggggcggggctataaccctatttttcattgactttactgagctctttaggatgatgactgattattcaaaacgtattataacactttcgtagcaaaaattaaccttttttttccagtcacagtatttgtgaaaagtaatgagccatagtacccattaatgttaaagaatattaaagcatggagaggaacatgaggaacaatgaattccaacatatggctttagaacatcaggatgttcttgtattggatatagtatctagtattcaaaaatgcctgcatctcttatttattgtaagtttttaaatgtataaattgtcttatatttcttaacctcttttataaaaattttcctagaaggtttatactgccttcttgctttaaagcaattggtctaaaatatatgtaatcgtcttaattaaaacgttgcagtagggttgcttttagagtattatttttttgtaagggggtggggtggacagtaaatttgtattgtctcaatgtacagtttaacagggatagaggggaaataatgtccatgccattgtgtgtggaagatttacagctaagctgtagttgcagagtacatgtacagtaatgaagttcactgtgtttataaactgaaaaggtaccgggtcttacagcattttatatatcacacctttacagaataacatgatggcaatatacatacgtgatattgttaggtggaataacttagaataaaatgagaattcttgagttatattttgtactatggtttagggctatgactaatatttcaggccatttccagtgaaagaaacttagttttacaagaaaacatttgctactgaatgcttacactaatcttggtgtttaatgttacatgcttaaattcttttcagttttcacagtggcacatttaggcatggggatagtactaattatgaaatttcctgcaggatctgttctaaggttgaaatttagcccagctctaggcattttacaaattattttaagaacagtcactcttgattgttttactttttatttttaaattaaagattgggaatgcgtgtgagagtatgcataagcatggcaggaagagaggggggagagagaaagagagagagagtgagaaagaaagagagagtgagagtgtgtgtgtatatgtgtgtgtgtgtgcaatcaaactgtggtgtaaatagatcctcagtgaattctggtattcagactctgttccactagtgaatgaaccattttctaaacgtttccctttgacttttttatttattgaattttcttggtttggagatggcagtcccaaacaccagagtctgtacttttctatgacacagctcaaattaaagtagggcacatgccaaggaggttctcacctccctaaagaagggacttgaattttagggactttaattcaccctttccttcaatccagctttcccccttcttgtttgcacatgccaagataactgcttttatgcaggctttacccctgaaaaactcctttctacagtgctgctcacgagagcccagccagtctcatgcctgcattgctgacttgaactcacagtcgccaagtctacctatctttcttggaagcagtctttcaaaattcctacttgtatattcatccattgttgacaaggacaaaatcagttgtatttacaaaactcttaactcggtattttttttttaaactgaatcctgttttgtaaataatatacatttaatgttgcttagcataaaaaatactttcttacagtaatcttctttaaattgggtatatgaaaacattaccaactcttgtttttctataaagaaatacagttaataacaaggtttcaaattattcctttaacattaatagaacaatccaaatgttgagcatattttgatattaaactaaagatcacgtctctgtttttaaattatgctaacaccaccacagattatgttgacgtattttcttctgtattttcttggtgggacttgagatttgaggaaaaaagatgcttatttggaatttctattaagaactatccttgttattttcttagctcaataattactcaagaaaaataaaagattataatctcagtttaaaattactaatgtgtgacaaccatacctcagtttgaaatagatttaacaagattattccctgacattttcttccatgtagccataagcagggacccagcatacaattcttcttacctaggaatcaggaactagtcccaaatatacaggattgagtcatggtttgctttttttttttttcctttcctttttttctcccctttacacatcagattttgctcaaataggaggtaactaaatagccattagaagaagaagtgaagcctttcatgcaggatgatagatctaacttatcaatgtactgtcacagtacattaatcgttttatttgagtaggtaaacaaatttgcacacttttccccagtgaattcccaacaccttgacttcctcatttcagtgctaataacctgttttgtgtgcagttaatccattctgaagcaggtgaaaggtcagtattttagcattttaaaagatgagttatataatgtctgcttccagccagtctgcaacatctagccatacctttcttatgcaagccattcagttatcaggactgtgaattaacactgtatgaatacatttctgtacaccttattgtttggccagagggccaccaagtgtacttatatgtaatccttaaattttaaactagcttgtgatttttaaatatttctaaacttttcttaaaccactaaaattaagctcttactacttagtcaactatcctcagctgtattcgtcttcaattgtcagtatggcacagatcactgtattaaaatgctctttcgtcttcatatttaccttctgaggtcattttttaacttaatgtgttactacaaagatttgcagatctttaatcaagcactatgttaatactgtaatatcaaaatactatgtcgaattatttcagatgttcagattgaatagggtaaaagaaagtctttaaatgctatcgcatcctagaccctcttcccacctactatggcattgcatattagtctgttgagacattcattgttgcttgactgacattttggtctgggttttcttttaatattttattttaattaaaattaggaaaaaatgtgttcaacaattttttttttgtcccatcttctccaaatcagtgggaaaagcttaccttttggtatatcttagtgttttcatgggcccagaactgtggtttaaatttttatatgtattctcattctcatattcactcatactcactctttttctctctctccctctctctccctctctcccccccccttctcttttgtggagtataaattaaaaaaactggatttgggacctacaatactcctcaggttgagatattcttgaagttttaaaatagctttagtttttaaagtaaactggatttgtggaccttaaagttactgagtttaaactacaaattgtaacatcattactgaacatgtccgcatcaaccctctgagaataacttggtcactttatgaaggggcgtttttaagttgtttagcagtgacatttaatatggtccaattgcttttctttttaacatgacaaacaattttaaaagagactaaggaacaaacactattgcgccgaatgccataacactgagttgtacaaattgtgattgaggagatgaaaaagtttatactttttaaaaaaaaaaaaaacaaaaaacaaaacttcaaatggaataaattattcatgaagccttccttgtggtgtctcattctgtggaaagtacaagctccttacagcttccccatggttagcagcagggctctttctgtgtcatttgcttggggacggtggttttgaggcagggtcttgctatggagaccaggttggtcttgaactcagtgatttccttgcttgtgccttccaagttctgggattaaaggactgcatgcaccactaatctcagctctgaataatttttaaaagagaatgctggttctccacacccagtattggtgatgtgtgtgtgtttacacacccaagctccttttt

SEQ ID NO: 20324 - DNA, 1190 bp, Mus musculus
gattgttaagtgttcatccagaggcaattttgttaaatttccagctttgcaaaaataaataaataaataaaataaatgtgcaggattactcctttgacattttattttattttattcatttatttttatagcacttaggtcccaagtgtgactgtgtggtctcaattttgttcaacccagggacagggtacacttcaggcctatgggttcagtgtttccttaatcatttgctttatagacttgggcagattatatttagaagataattgtaaagcttgtttttaaggattgctatacgatttttaaaagtaaggctaaagtaaaaattgtagagagacacgatgtaagttttacaccttaaagtttccatcaaaaccatgaattttttatagttgctcccacagataacactgtcataagatcagtttcatcaggataatacattaggagaacacagtgaaatgaaatgttgctttccctctgtggctgactgcgtccctcccttcctttgtaggcctctttgcacctccacgtgccttcagtgcaatctgacgagctgcttcacagcaaacactcccacccactggactcaaatcagacttcagatgtcctcaggtatagctcccatgatgctaagggttctctgtttcaacttgggtaaaagagaatggttattatgagatatatttattcttttgggtaagagttcacagcgttttatttttgaatcattgggtgattccccaccccaccccccacccccgttcatgatatagacaaagcatagtgcctgtgctggcttggtaaattgctctacctctgagctaaactccatttaaaaccccatttagttattatttcttaaaaacaattttattctttttatgtccatatatatatgggtcttttgtctgcatacatgtccattgcaccatatatacatgcagtgccactggaagccagaaggcatcagataccctggaactggagttctaggctgttagcaggcatgtaggtactgggaattgaattctggatctctggaaaagtagtactttaagcatgagtcatctctccagccccaacctcgttaaattattgagaatgaatacctttctaaaatgaatacgtttttgagtttttttctccccacctcattcattcaaaaagcggtcttatgtatcttaggc

SEQ ID NO: 20325 - DNA, 1181 bp, Mus musculus
tgcctcacaactgtctataactcaaacttcaccggatttgatgccctcttctagcctctacaagccctgtacacgggtggtgtacaggtatacatgcaggcaaaatactcgtacatatgaaaataaggcttcaaatgctagaattgtcagtaaaagtttttgttttaaacaaggaaccatatatatatatatatatatatatatatatatatatatatatatatatataatacaacaggtataactagtatctattatgtattatacaagtatatgtaacaattttataaatatataatcatatataattatataatacattttatacatatacacagacatatacactgacttcattctgaaagtaagccatcaggcataagagttttaacttatttatgatgacctctatattagaagaaatacactaatttaaaagctgttatctatttctctttcatcgtcagtctcataacagagcagtaactttaagtactgtccttccctattgatatccacagattggagttgtttgctgagtcgtcgaaacttgcaatctctaagcaaaaggctcaaagacatgtgtaggatgtgtggcatatctgctgcagactctccaagtatccttagtgcttgtttggttgcaatggaaccccaaggttcttttgttatcatgccaggttagttatgttcagtgtatgtcagatttaattatcattgtacgcgtttaacttaactgttacataaaattctgcacttacaaaaaaggaaaatgcatttctctttagattctgtgtcaactggttctgtttttggaagaagtaccactctaaatatgcagacgcctcagctaaataccccacaagatacatcctgtactcatatacttgtgttccctacttctgcttctgtgcaagtagcttcagctacttacaccactgaaaatttggatttagctttcaatcccaacaatggtaagttaattgaaccttaaatttttaatctaatttgctttgaaatcatggtctttctatacagccctgtttggcctagtacttgcccaggtgtggtcttgagctatatccctagccattctttatatatctgtttgctataatacggctttatatcatctactagaatataaatgtaatttagtgaaccttttaggttgtgtttag

SEQ ID NO: 20326 - DNA, 1175 bp, Mus musculus
tggattatattcttgctacattttttgctagtctttgttaggtatatgttccatgggtcacagtggaaaatatagtattagagggatataccaagggcataaatgtgttccatttaaagtaacctttggtatgttgggtgtggtggtgcacacctgtaaatcatatgtatttgggtagctgaaacaggagactcgctagaactatgtcttggaaaaaatgtattaccaggggtggttgtatatgtttgtaatcccaacatttgagagggagaggcaggaggatcagaaattcatccttcagcaatataacaagtttgaggctggcttgggttacctgagaccctttgtccagaaaaagaaaaaagaaaaagaaaagcagctggaaatttctaaaggaaaataaccatgtcttcatagttacccatgctttcaactcagttgttagttataagtgagaaggtttgttttaaatgggtcaagttctgcttggattttataatctgtatccaaatagtatggtaaattcactgattctgccttttctatatatattttagtcctgtcgattaggccaacacagacctatttctcgattgttgacggatgggatcatgaaagtgggagctactgcatcaaagaaactttcagaaaagtttgtaacagaatggttttctcaggcagctgatggtaacaatgaagcattttccaaattgaagctgtatgcacaagtctgcagatatgatttaggtattaaatttgtattcatcctacaagagcaatgtgagcagtatgggttggttcaccatctaagtttgtaaataaaatctttgtgtcatgtggccatctccatgttttcaaacactgtctctgcctgcttttgtcctgcaaagtcagaactgaatagatgtggcaaagactgtggtttcagacttaagtatgcactgtctgactgtccatagaaagtctgctagctctgtatatgggaatgctatcaagtagtcattattggttccaaaatattctctgctgcttctgtggagtctgatgtttcctgccattgatcccagcattccggaggcagagtcaggatctctgtgagtttgaggccagtgtggcctcaagacaacagggctacacacatagtaagaccctgtctttaaaaacatttttttttg

SEQ ID NO: 20327 - DNA, 1195 bp, Mus musculus
aatgactaagcttgggcaagccattcttaatagttactaagtctgaaaaaccaggtatatttacaaatgaagaaatttcaaatttccttatactttttatcttaactagattcatcgagaagccaagatagtaagatgatgtaagttagctagctatttgatcccagagctattaagtgaatgtgagttgatttaaaattcttttagaagacaatatgtgcatgagtgttttgtctgcatatatgtatgtgtaccatatgtatgcctggtgcctgaagaggttagaagaaggttccttggaactgtagttaaatatggttgtgagttaccacatgagtgctgtgaattgaaccagagtcctttgcaagagccagtgctccttaaccatcacaccatctctcctgttctgcacatgggctttatgaattgttctgtacaagcgatttgtaaattcaaatcatcatatttttagagttgcatatgaaaaaccaatgaccttactgtctcaaaatcttactttatatattttgtctaatagttgtatattaacataaataacctaaattttttttttttaacttttcaggcataaaagtctcaagacaagaaatactgggcaacaaggacaggcaccatctttagggcagcaacagcaagtacttcctaagcacaagaccaatgagaagcaagacaagagtgagaagccacagaagcgccccttgactccctttcaccatcgtgtatcagttagtgatgagattggcatggacacagattcagccagccaaagacttgtgatctctgctgcagatagtcaagtgaggttttcaaacatccgaactaatgatgtagcaaagactcctcagatgcatggcactgaactggcaaattcacctcagcctcccccacttagtcctcatccttgtgatgtggttgatgaaggagtgactaaaacaccttcaactccgcagagtcaacatttttatcaaatgccaacaccggatcccttggttcctaccaaaccaatggaagataggatagacagtttgtcccagtctttcccacctccatttcaggaagctgtagaacctaccgtgtatgttggtacagcagtaagcttggaagaagatgaagctaatgtagcctggaagtattacaaagtcccaaagaaaaaagatgtagaatttttaccacc

SEQ ID NO: 20328 - DNA, 1205 bp, Mus musculus
gctttgtgtgtaagctgtgtttagcatagctacccaggggaacttttaatgtcatttatatcatgaattgttgacctcaagagaagttgttttataaggttgctgattgctttttaagtactggaagtatcttctttaattttaaatgtagtgtgtgttttaaaatttatgtggcagtacttcataaatatttagatttatttatctacattttcttcaagttgcttagagtcagaataaattgaataataggtaaatattcccagttcattttgaaatatgattatattttgattttgtggtaggcatattttaagcaattttcaaaatcttagcgttatattttatattaaaatgtataataaatttactttcttggagtgatgataatagatttccttttttattagtcttacatcattataacactgtttatgattttatttgctgtaaatctttacttactggatatctgctttggtttctagttatcttaagtccatttggactaaatggcactctcacgggacaggctttcaagatgtctgattcagctacgaaaaaattaattggtgaatggaaacagttctatcctatttcatgtggtttgaaggagatgtctgaggagaaacaggacgatatggattgggaagacgattctttggctgcggtggaagttcttgttggtatggattctgatactagtctgaagggggtcctgtgtgtttagattttactaaataacaaaccgctctcttggcattcagtaccaaacagttatttcttgcttatttcctctgcacatcacacaagggctacagcttggctgtgatgactgtctgcatgttcttcctgtacagtccaggttaagaagcacctagggtctgggacacagtgttcctaggaaaacaagggaatgacagggatcacgcctgatgatgaaagtgcattaaagtttctgctgagatgaaaatgagctaaaggaatggtacatttgctcccagtgaattagacaagactggttacctgtccaagccagagttactgggacagaggaacatgctttgttgtccacatgttatagaagggaacaagattaattgtgaaacagttattatttgggggctagaaaaattgacagcctgtattatgtatagtgcttgaatatttaataaaactttcagtaacagaaaatattcctaaat

SEQ ID NO: 20329 - DNA, 1152 bp, Mus musculus
ataaactgttcatagaattactgccagcaatagtggcaaatatcgcaacgtttttgtgtagaacgcattaattgtacaccttctgtcgacttccatctacacaaatatatagcttttctatcacaacattaagtgaaattgatgctgtggcaagtttattgagaaactttcataaatggatatccctactatgactgtgaaaacatgtcaggtgtcacatgagtgtcacagacagaaagcacatgcctatgcaatatggcctactctgtatttatttgtaaaaactgaagcataatttaaagtgtatatcaatactactctgagtttctaagagaggtgttcatgcttgtaccaggtaagtgaataaaaaaaaagattaagtgctttttctttcattacttgattattttctttaaaatcagctattacaggatatttttttattttctacattctgttttttaattaatatgtactcactgaactgaaatttactaaatttgttttataaggtttgtagtgttacagaataactaaactgggatttataaaccagctgtgattaacaatgtattaattatttgaacttgaaccagaccattaggaaaattatgttatttgttccccttgtatgctcttaacttaaagaattttcccacataccgtttttgagatagtttgagatttgaggataggatgcatgtgagagactccataaattcaacattctgtactatagctgacaactataaacaaaatgtatcttagcattaatatcttgagccttgaacatcatatttaatacaggaccattttagaaatattcagttagttgtatatttcctaggttacaagggctagatctaagattattctcatgagaaatgttgaatttatgagaaatggattttgaggctttgaaaatgaaaatggctagtatctcaaagatgtcagtatccatacatctatggtttcatcccaggagcagacattagctagctggacaaacagttgtgacaatatttgtcacataggggcctatggtttgttgctcaacaatatagtacttttctcatgtgactcaacactatagcacaagtattatttccctggattctctgaaggagcatctaaaagacgggtttctgacag

SEQ ID NO: 20330 - DNA, 1567 bp, Mus musculus
atgcaaaatcaaaaaggaaacaaatccgggaaggggatgtgtgagcatcctgcaatataaaaacaagaataaaatggcagtctcaaagagtcagtgtcattacctggaatgctttcgatggaggaaaaaataaacatggattttaaaaaatcaatcaaaaatggtgcaaaaaaaaaaataaacccacaaaaaactcaagcaaaatagtattgtggaatccacagacacatcagctgactggttcctatcctagcaacatctcggcgttcgcaagggttctcatgctgatggctgcaaactgacagtattaagggtaggatgttgcttcggaatcaccgttgaaatctgatgatgtcaaataagggttatcctaataggcaaagtttgagattgcctgtaatacttgcaactaaggacaaattagcatgcaagctttgtcaaactttttccagcaacacagaatcaaagacaaaagaaactttatcgattgatgttttacgtgcaaacaacctgaatcttttttttatataaatatatatttttcaaatagatttttgattcagctcattatgaaaaacatcccaaactttaaaatgcgaagttattggttggtgtgaagaaagccagcttctgtcttctcttgatgaaataaaatgcaaatgatcattgttaaccacagctgtggcttgtctgagggcctggggtggacctggggtgtttttttaatctttttgttttagtaacctagctgcaatacttgtctgtaatactaggggggaaaagtctgtttaatcatttttacttgcagtactgctgtgtgtttggcgtaactgcaagccttgggacaggcagaagttgtatgatctacattgcatccttgtcctgggcctgcactacactggaaacagtatcaccacctgttcttataccagtatttgagtcaagccttggtcgaggagggacagaagagaatcaggctaaagtgcataaagagggcagtaagcgggggagatagacctgcaggggagagggtgttgccacgggcgtctctctcgactctttacagcacattggtgtggttctaggtttactttgtactgttatgctgtttaccttccttaacaattttcttttttgagaatctaaaaaagaaaaaaatggtgtttttttcccctcctgcactggggctacatttttcacttataaaaatatttgatggccttttgatgaatgtcttccataacgaataagaaaacctagtggcttaatttaggaaacatgttaacaagacactgtttttgaaattgtaacaaagtcaacataagtgatttacaggtacaaagaataaaaataaaggtaactttacctttcttaaatacttcctgccttaaggagcatttccatgactagctggtgaaagggtttaatatctgcagagctttataaaatatactgcagtgcatactggtctaggtagatggtcacacagtgagtcctgtcacgccactctgttggtcttttttgtcttggtaatagttgcagcccttgggtttctttatgcagatgc

SEQ ID NO: 20331 - DNA, 1169 bp, Mus musculus
tgtcatattcagtaaaatttaggtgacttaattgtgtactaacttttttacatatgagaaaagtactagagaggctttaatcaagaccttttaaacttcaggcctaaaatctatatattttgaaatttgcagatataaaagttttaatttcaagccaattttagttctcaaacttagtgttttaatagaataacaatgccgctaaaaatagcttcctggagattttaaaaccccagtttttagcagctttttgtttttgtttttttaatttttaagaagtcagtcttacaaatagaagaaagcataaactcattagaagaggactggaagtaaagatatttattcctaatacatttcctttgtaggaggagaactatttatgcagttagaaagagagggaatattcatggaagacacagcgtggtaagtaaagtttttgtggttgtatggattcaggtcatgattcatgtaattaaaagcaaaaccaccttcccactgtgggcagccacatgattcagtaagttgatctggaggcagtcagtcactcagaacatcaagggggacctttgggactgggcagctattggagatcacgtgattcctttgcccccaggccttgggtggaccgctcttcactgcagaatttccttgaattggtaagctgcctgccttggttgtgggtgagtgtggttttccagtgaaattttgtatgtggagcaatggaaagtatcagaaatcatctcctcttttttttagactttccagttcccaaggtgcagtcttagggaggtgataaccctgaacatacatctgtggattgattttatagccaggatgggatctgccctcctattcgtaagatggcatctgcttcaaattaaaaatatacacatccttttgtgaagtgactgtattgggtaacaataaatcagtttgacctacacattaattgattagaaaacacttaaatgttttttctatcttaattaccaaactgcattccattgtttaatttcaggccttttctaacacagaagctgcatttaagagccttagggatgaagtgcccctttttggaggaggctctctgagccctgtggaggctgtggtcctgctagctgtgaaactgcctcagtcctctaggacacaccctccatcctggagtaatc

SEQ ID NO: 20332 - DNA, 1148 bp, Mus musculus
cgtattctttagggtggatgtgatgttctgctgcaaacttaacaaaaactggccttctgataccttcacagggccacacagaaccttctgaagtatgttaaatatgtcaggctttttaggcttgtcacaaatgattgtttttttctaagtcaccaaatgtatataagttatatatattggatagcaatcttgcatgtctatcatggaacaatttaatatgccttcctttcccaccctcaaaaaggccattttatgacgcattgcacaccctctggggaaattgatctttaaattttgaaacagtataaggaaaatctggttggtgtctcacaaatgagtacgccattttttattctgtatatttagaatgaagtcgtgaaaaactttataaagacatctttgatcattccgaaattgtgtccgttttctttagtgctatggttttttgtttctttttcacttctacaaagcgagtggcagccttgccaattagacttaaaccagaattgcccaggcttttatgtattgcctgagagagctacctccaaggtgttttgttgttgggctggagatctaagcgggactatgaggttcacctagagtgggaatctcttactttataaaaacaagaagtggtgatgtataaatcagaggacactagcaagaaaggctttttcatgttcatgttagttttagctgtttgtactccggctttaacaggtggaagcttacttctctgtgtgatttctgtgttttatttcaatgtgattttcctttgacatttttttgattgaccctgttcattttgttttgcctggtaggaaaataaacagctttctttcctagaattggcattaagccccagcaaaccagagatgtttgctttgctttaaaccctgcctgagcacctcgtgcttgccccctgtcgtggtcgtgacatcgcatggctgtaccaccttgtcggatagcttatcagactgatgttgactgttgaatctcatggcaacagcagtcgatgggctgtctgacattttggtatctttcatctgaccatccatatcaaatgttttcattcaaacattacccagcatcatggtttgcagtcaaaaattgtggtccttatgtcttgtgagacttggagcccttat

SEQ ID NO: 20333 - DNA, 1148 bp, Mus musculus; identical to SEQ ID NO: 20332

SEQ ID NO: 20334 - DNA, 1578 bp, Mus musculus
gtcttcagacactccagaagagggcgtcagatcttgttatagatggttgtgagccaccgtgtggttgctgggatttgaactctggaccttcggaagagcagtcgggtgctcttacacactgagccatctcaccagcccgaaatgaaatcttttttttttttaattaattaattaattaattaattaattaattacatgtaagtacactgtagctgtcttcagacactccagaagagggagtcagatctcattacggatggttgtgagccaccatgtggttgctgggatttgaactctggaccttcggaagagcagtccggtgctctaacccactgagccatctcaccagccccccgaaatgaaatctttaaacatgaaaataactctatctttcccaggcggctgccgaagatggagaaggggcaggttctggtattggatggccgaggccatcttcttggccgcctggcggccattgtggccaagcaggtacttctgggccgttaggtggtggtggtcgtacgctgtgaaggcatcaacatttctggaaacttctacagaaacaagttaaagtatctggcctttctccggaagcggatgaataccaaccctcccgaggcccctaccacttccgagcccccagccacattttctggcgcactgtgcgaggcatgctgccccacaagaccaagagaggccaggctaccctggagcgcctcaaggtgttggatgggatccctccaccctatgacaagaaaaagtggatggtggtccctgctgccctcaaggttgttcggctgaagcctaccagaaagtttgcttacctggggcgtctggctcatgaggtcgggtggaagtaccaggcagtgacagccactctggaggagaaacggaaggaaaaggccaagatgcactatcggaagaagaagcagatcttgaggttacagaaacaggcagaaaagaatgtggagaagaaaatctgcaagttcacagaggtcctcaagaccaacggactcctggtgtgaacccaataaagactgtttgcctcaaaaaaaaagaaaataactctatatatgatgggatgtaggttcctaacttctcttcataactagttatttttctgacactgcttacaaacaaatttcttttatttttctatggtactagggattaatgcaagcgtgcgcatgctgagtgagtcccctgtcattgagccctatcctcaaccttctgcttttattctgagatgatgtcacactaagttgccctggctggccttcagttcactgggcagtcctggcaggccttgagcttgccttcttcctgactctgcgtagctgggattataaccccgtaccaccagcctggcttccagggggtttaatcttgtctcacattgtggctaattagttactaatgacgtattcaagacatgctagcctgatatacctaccttcccgagtgccttctcggtggtgctttaaaagtgcttcagtaatcacagcagaatgacttcagtggcctagaatttgctcatatagatgaatgtaaaacttgtagtttgataggagctgcaaa

SEQ ID NO: 20335 - DNA, 2062 bp, Mus musculus
gtatggcctgataatgtcaaatgtgcatgtgttactgctttaaatataggatgttgtggccctcagccctgctccgttggcttttttaaggcaggaaccttctcagggtgagactgtattccaaattgggacagtcaaaagtgcccacacacaacttactcagtgaattgtgagtgtgctgcttgagtgggtaagagtgctgagcctggtgctaacagattctcctcctctttgtcatcttaggtcagccccagctgatgctaacagcaggacccagtgtggcagtccctccccaggcaccttttggttatggttatactgcaccaccgtatgggcagccacagcctggctttgggtacagcatgtgagatggaagctgatcctgtagtctcctattttcatactgaagcatcctctacccacttctcagtttataaacggggaaacaggcaacgtgttcttgtaacctttacttcatgaaggactacttttttgttctaactatagacttgggtcgcctatgttaaaactttattttcacattccgcatcattagaccttcttttcaaaggggaatagtattcatgtgggcttttttctccccctcattctttgaagaactgcttactattcaatctattgtgaagaacctgatttgcactctgtagtgtttaaagaaacaaagaaactctaatattgaatctcttaaatttagtgtatgtaaacagctttcactatgtattgtctaaatgcatttaaatctcttttattcaaagaaaagctaaggtgaaaatactggtatgtgaccatgcaagactgtcaatgccgacaaagacaacactaatcagcatatcctatattggatcacagtgctctccaaattatttgaaaaatgcatacagacaacttgcctgattgtttttttttttttttaatgagtataaaaggccctttcacctatgcaggtttccccattatgcatatagaaaatgctagtgtgtgttgctcacttcatgtgtaacaggtgtcctcatgttgtgctgtatcctgtgctttttctgtgggaccattccattcaggaacaagaagcaccatgattccacgcgtgtgtatttactaaccctcccttccctgaggtttgtgtatgttggatattgtggtgttttagatcactgagtgtacagaagagagaattcaaacaagatattgctgttcttcagttttgtttgtggaatttgaaattactccaatttaaaataaattactggactgtggaaataacatgtagaattgcagttttaattaaatacatctcaaaccagaatcatggttttcatagtttcatactggatactgctggagcattaccgggagccatagagggaaattatgaaaaagagatgcattatgtcaattacattcctgtagttatgaaagattatacagcagtcagtgaatagtggactccttctcacgtttccagcattttaatcaagtagcactccagggctttatgcatttcacgtaactaagaaaagtatgagtgttacactgacttgaaataaaggtatattttttaaaatatcatggtatttcttttcaacataaagggctccataatttaaatttttgccatggctgagaatattgaatttactttgttaacaacttaattatctatagttatagagcatattgcctagcttctattgctctacaactctcaggctaattaacatcagcttcacatacacacccttagcaaattagtattactgttaaagtcacttttcattcgtcttagtgaaaccgtgaactctcaggctagagctgcactgtgttcccagaactctacctactaccgtaaggaatcaagagatatatcagtcagttcattcttgacttttcctaaacttgtgaatgatgctcttttcccttaatagaaacaacttgaaatctcatttattttatgagtacgggtgttttgcctgtgtaaatgtgcatacaatgcccccagaatccagatgaggggctcagatcctctggggtggaagttaagtta

SEQ ID NO: 20336 - DNA, 1197 bp, Mus musculus
acagggtctcttgttggcaaaagtctcactaagtagtttaagctagctggccagcaagcacaagggactgatctaccactagtttggtgctgggattccaagcacatgcaacacctgaatttgtgggtcataggtattaattaactcacatcctattgtttgcaaggcaagcactttccaactgagttccacattttaacacatgaaagttcaatgattgagtaattttatcaccctggctgaatcaatattttagggctatgaaattaaactgttcttaggagatagagtgtgtgtatgttcattcattttatttgtaatttttgagatacaaaattcagtggcatgaagaatgggtatttgttactcctgcctcaacttctgggtgctgaattttacagcatattcaactaaacccatctgttcctttgtagtaagataagaatttggaaaagggattaggctgaaacctgtgttttactgatcatggattgcttttcctccttaggttggtgaccgttgttatgatgaaaaaatgtatgatgctgctaagttgttgtacaataatgtttctaactttggacgcttggcatctacccttgttcaccttggcgagtatcaggcagcagttgatggtgccagaaaagctaatagtactcgaacatggaaagaggtaatctaaacccaagtttgaatgatgaattaacattttgtttgatttttttttctcttgtaccgttgtactgttttttcttttctgttgagttgaaataattgcacatatttatacttgggttctcatagtggaaaatgtttattctaggtctgctttgcctgtgtagatgggaaagagttccgccttgctcagatgtgtggactccatattgtggtgcatgcagatgaattagaggagcttatcaactactatcaggtaacgacaccaggcctttatgtgaattgaaaccttcgtacacatattctctcctctaattgcattttttctttatgtaggatcgtggatattttgaagaactcatcaccatgttggaggcagccttgggactggagcgagctcacatgggaatgttcacagagctagctattttgtattctaaattcaagccacagaaaatgagagaacacctggagttgttctggtcgagagtgaatattcctaaggtaaccaaccagtcttca

SEQ ID NO: 20337 - DNA, 1207 bp, Mus musculus
ttttctctttttcaaacataggtaaatccaagtcgacttcctgtggttattggaggattgctggatgttgactgctctgaagatgtcattaaaaatttgattcttgttgtgagaggtcaattctctactgatgagcttgttgctgaagtcgagaaaagaaacaggtgtagcactgttttctctccttataacacacaagtttgtcactcctggtagtgtagaagagttgaaatacggctgactgacttgagtgtggcttctcagcacatggggtaaatcatggaggcagctgacagaagggtgacacacttgctcttagagttgaaaggtttttgtttctgtcattttctcctgaaatgtgattgtatttgtatagttaggagaagactgtgctgtttttaacacagtatgtctgggctctgttgttcttactagattgaagctgcttcttccttggcttgaggccagaattcatgagggctgtgaggagcctgctactcacaatgcacttgccaaaatatacattgacagtaacaacaacccagagagatttcttcgtgaaaacccttattatgacagtcgtgttgttgggaagtactgtgagaagagagacccccatctggcttgtgttgcttatgaacgtggccagtgtgacctggagctcatcaatgtgagtactgagtgtgctgagtgtgtgcagagatacctgtagttctctaactagttgtatttccagttagcaaattttgagattctatatgattttttttagttaatgtgcaacagttgtgggcagatgtgtgctttttaaaactttatttggaaatagtagtaaacctaagtctatatacactctctcctgaattgacatgtattagctttgcttgggttcttgtacacggcctgccacacaaagcattttaactaggttacatacctcatggatttgcatccattccggttctactttgtaagaatgaagaagtatctttatgtgggtactagcaacagtcagacattagcaagatactttaaaaagcttgttttcagttttgtcagggttttctgtagtttaggatcacaattgtgtccactctttagcctctttattctaaattagttcttagaaatttgtttttgtttgtttattttgtttttaaatgattgatacctttggtaaactaattttttatttgtattttgttag

SEQ ID NO: 20338 - DNA, 1176 bp, Mus musculus
ctcttttctcttttttcttttgttacagggtctcactctgtagccctggctgttctagaattcagtatatagaccaggctggagatctgcctgcccctgcctcttgagtgctgggattaaagatgtgtgtcactagggctggtttaagaaaaacacagtttaaagttgttcttgatgacattttagaatattcagctctttccccaggtggtgacacatacctgtaatgtgtacattattaatatgtacaacaggaagtagatggcctctagtccataaaaggctttgattcctttattttttttttaaggcacagttattgattttgtctttctactgccttgaaaatttttgtctggggagaacaatgtgcataagagctagctctctccttgtatcatggaaggcccaggggtcaaactcagatcttcacatttggcacaagtgcccttactctttgaatcatctttcctattttttttgagatagtctcactttgcagtgtctaggctggccttggtatgtggtaaaaccagcatcttccagaaggcatcattcttggcttaggtttcttatattttactcttcaattttttttaacatttatttatgttttcattttgtgttgatgtttgtgatgatgtttctgtgcccaggccattgcatggaggtcagaggtcaactcttgggagtcagttctatctttgcatcatgtagttactgcgtctagaactcagaatgttagtctccatataaacgtctttacctactgagccatcttccagcctctgccttagatgcttgtatttttcagtttatctttggcatcattttcaagatcctttattgtaggttaaggaaacatctagatttacttctagcatcacatctgtctgaatccagaaatgaagtgttaatgtataatttataaaccaagtgggatcaagataaattgactttgtgacacatgaattcagttggagagaataaaggctgcctctggctggagtgaagaataatgtcctaaagaatgctaagctagagaatagtaagggtttttaatttgtttaactttgcttgttaacattattctcataccagttattttatggggaaaagtaaaaatttgtagctatctatcaatgaaagatgagaaaaattcttaaactcagagag

SEQ ID NO: 20339 - DNA, 1213 bp, Mus musculus
tatatatgttcttccccagagtaaacatctttcatttaatcagtctttgaaaagtgatatgctatgaagaggcaattccgtctcttacctcagctccaggctcaggtactttgagtccctgtaatggaagactctgtcattgtaatgtttttgtcatactgaattacagttgcttgctgtctcagttttttgtcttctttgtttaattgtatttctagcaccatccaaaggtggttttgaaaagtaagaagctctcatctctctatttagttgtgtctctgatagaaaaaaggccaaggatgagtcagttagggatgatctgacagtcaggagttaaggagcctgcggggcttccttctctctgctactgtgctggtgttaaaggtgaagcttaacctggagctccttctatcactttaccatacactgtaaccatgcagcaaaccaagcaagcgtcagcataatcaattacctagtgactccgtctaaacagatctagcacagtacaactattctcttatgggtaacctgcaggtcctgtcagtttgtgtggaagaggagaacataattccttatatcaccaatgtcctacaaaatcctgacttggctctgagaatggctgtgcggaacaacttagctggtgctgaagaactctttgcccggaaatttaatgctctcttcgcccagggaaactactcagaggctgcaaaggtggctgctaatgctccaaaggtaactagttatgaagttaaggttggcatgcttgggctggtcttactgggctgtatttttgatactgctacaagaggaaccagctctgtaagattaactaactcctttccagttagatttttcttttaataaaatatgataactaattctcagtgtctctaggtttggtgtgtaaaactgcagaatcttagaaggatttatagacttatagacctatagttgatgtaggcagagttatgtccacttactaaaatacaatattatctgggctcataattgatggctttctattttaatttgagcagttagtattggttggtgttatagtgtgtagagttgtcagaaaatgagcagaatctattcccataggccttcacatcagtgttagttatggagtgtgtgcttactgaacttgacttaatggctagtggttactgttgcaggaatgggtttatctttttgtcacctttaaatttttttt

SEQ ID NO: 20340 - DNA, 1192 bp, Mus musculus
caaagcaagaacatctctgcttaaagtttttattgtgttacaggcagcagaaagaagtgactacatatgggcatttgtgggtattggagaggaaggtgtactgagaatagagctaagggaaggcgtggggaagagagggcagtgaggtgcctgccgcaggtgagattgggatcccaggctgagtagctgggaaagagcttcctgagatggtgacgtttgagcaaaagtttaaaagaggaatgatccaaataaattctgtcatgatactgaggaatcccagatgtccctcggttgtgctgctaacagcaggaactcaggacacttgcgtgctggagtgtttggggcacctgatggctgtccaggcgcctgtcgtcagccacatcgctgcttctgtgtctcagaagtcatctgtgcctttggtcactctgtgtcttttttttctcttcctctgttttataggaacatgcttttgaaagcagtcagaaatataaagaaggcaaatacatcattgaattagcacacatgatcaaggacaatggctgggactgacctgatagcatccatccggtccagcatccatgtgaatgccacccaactgaacattctacccaagcgtgagagagtgactgaacacactcggttccatcaacttaggggccttgccatcaggggtcatcctcccaccctgacaccatcatttttggtgactggcctctaaatcactgtctctctgtctctttgctttgtatctgtttgtgagttgatcttggcttctctgttctagtgttggctgaaaacagttacgagctggaacggacccttggctgcatggtggcagccctacttgagggggggtggccctgcccacatgagagctgcctgatggctgtcagaacatcggcatgtgagcatgagcaacagaacaggggaacctgggagtcctaggattggggaaggggcaagagggtgcaatataactgtactgttcttggagacctgctaacttaggcttgaaataattgactccttcaaaaggacaaagagaaaaaaaaatacctcgtggcttttgttctctctgatgatacactcctgccctagcatcagatgtgccaggacagcggattagcacaagaagcatccttgattctagctgacagggcaggaccctagcattctggacctggactggaga

SEQ ID NO: 20341 - DNA, 1124 bp, Mus musculus
agccaccatcacggatgccggtgggcaggtgatccactttgcatttcttctatttaataagaaaacctcgtatcacaggatgctgggaactcactatgtagcccaggctgtactccttcctcctgcctgtttcccagtgctgggattataggaatgccccttgataccggaggaaaactcaccctagtattcttactcttcttcatttctgccctaaacacaggcacaacaggtcttattctcaaattatagcacagacagacagacagacagacagacagagtgcacaggaaaatctgctgaatccatagctgctgaatccatagtaccgagtgtttgcacattctctggtctcctagctcccctcttcctcactttgtagattgattcttcactcaacaagacaacttaaagtctgaactcttgttctaaaacacaagaaatagaaagttctgaatagaggtggtagttcactagtaatgcccgctgagcagtggtagcacaggcctctaatcctagtacttgggaggcagaggtaggccgacctctgcattccaggaccaccagagacgcaagagtctctgtcttgaaaacaaacagaaaaaaaaaagctgtagtttgtatcattattattttggaacagtaggatttggtttcttactgatctcagaggctctgccagaagagccccttatctactgcttgtgcctctgtcattacccacgtgacttccgggagaggtgttctgggataatgtataaatgctcgtgtgcttcctcactctgcatgtgagatagtcctttgtcctatattgggaagaaaggccttctgtagggctcgctgagaggctccacgggggcgggatggtggtggaagcaacctgccagggaggtggagagggtggggtgggaggaggttctgcagctcgggggttcatgcagtgtctagtaccctggagcacagtagtgaaagaaaagcacttgattcacctgaggtggaaacagggagaacagaaagtaagacctgattggccttatagtctggaggtacttgctatcctacttatgtataacaggtgcagctttttgttgttgttgttgtttttgttgtttttccgagacagg

SEQ ID NO: 20342 - DNA, 1297 bp, Mus musculus
acacggggtggggagctaaggcaagaggatcagggggttgaggccagcttgggctacatagtgaaaaaccctgtccttaattttttttttataagaaagcagaaaattattgaaggccattacagccgttctgaattatctcgtatgtctaggtgcgtcttagtttaggggaaattgaggggaagaggaacccgaaggtgcagccaggcagtgtgtgctgttcacagggggcaaattcaagccagtaacagtttgttattactcagaaacccaatctgtgagctgagacagactcctgggttatggttgtcaatggagacattccgattagagtcttttttttttttttcaggtgtgtgacaatgctgtcatgcctaattttttcttatgtctttaaaaaaaaaatagacattataaaataagatccaattagtcatgtttttatgtttccttaaaaactactcgattcttacctttgggcttgactagactgatcctgggtctgagttgtcagtgatgtggcaaccctatagtgattggctggtgacaacactgttgcgggcgtgtttagcatgagccacatgctcctgatctctctcacttctctgaagcgcagacccagccagagttaacccagcattatacaccacttctctgccttccgatgtgactccatgcagacctgtccctggcctttgtgactaatttaatgatgtcagattgggagataaattcagtatagagtactagacgtcttttgcctaaattatgtctctgctgtggggcctgccacgcacagctatggagggcagcctcatgctcccttctgttgctttgtggtctaaattgtaataaagttttccaagaataaaacgaggtattgattttcttttatgcttgtgattccagtgtgtttcatgtaatttttttcagttaatgaggtaatttatcaataaatgagtcaacctgagctttctcactattgtgcataaagacaataaaggagaacaggattgcagtaaggaagtcgctttctggcatctggacagacagcttgtgcaagataatccactagggcagacactttattcttgtatattatacactgggtttctctgtgtagccctggctgtcctggaactcactctgtagaccaggctggcctcgaactcagagatctgcctgcctctgcctcccaagtgctgggattaaagacatgcactgccatcatccagctgtggtttattttgaaattttgcttcagaataggtcatattgtaaatgtgactagcacacg

SEQ ID NO: 20343 - DNA, 1162 bp, Mus musculus
ttctggacctaggcggtaccaagcgatgagacagcacagccgccaacagctctccttccacattgatagcagcacctcgagttcttcaggccagctagtggatttcactcttcgagaattcctgtggcagcacgtggagctggtcctaagcaaaaaaggttttgatgacagtgtgggcaggaacccacagccttcccattttgaactgcccacttaccagaagtggatctctgcagcagcaaagttgtatgaagtggctatcgatgggaaggaagaggacttgggctcccccactggggagctaacatctaagattttaagcagtattaaagtcttagaagggtttttggatatagacacaaaattctcggaaaaccggtgccaaaaagctttacccatggctcatagtgcctaccagtcaaacttgccgcataattacaccatgacagtccataagaatcagcttgctcaggctcttcgggtatacagtcagcatgctcgaggtccagcctttcacaaatatgccatgcaattacacgaagactgctacaaattttggagcaatggccatcagctgtgcgaagagaggagcttgactgaccaacactgtgtccacaaatttcattccttacctaaatcaggtagctacaaagttcccaacagtttgaactgaaaactggagctgtgcttttagtattagtgtgtgtttgtatggtgtggtgtgtgtgtctgagagagacctcgcacccttggaggtcagagggcaatgttgtgaggtcagtagtctccaaccttttcatgggtcccaagtatccagcccatggagttagccttgtgctgcaagcactgtgcctgctgtgtcatctcactggcacctgagctgggtgtgtattcatgtattaagatgatttatttggtacataattgggttgttttttaagagccctgcagaactttgatagtaaatacttttttttttctttctttgcttttatttgttttctgttgttgtttttgaaacaaggtctctatttaatcctggctggacctggaactcactatatagaccaagctgacctccaagtcacagaactcctcctcctgcctctgcttttgaagtccatgtgccactgtacccaattagtaaatactttctacttct

SEQ ID NO: 20344 - DNA, 1511 bp, Mus musculus
ggtctgtggcagttttatcaggaagcctggtccccgcttggctccttaccagcctgcgtattctggcagtgctgtagctcccactggacttcaggcttgctagtctaaggctgtcagacttagcaaatgacaggataaagtactccattaaatttgaatttcagataaatcacacacaaaaaagctttaagaataaatctgccctactaaacaacaaatatttgagtgttacatagaactcacggccaagaatgtgtttaactagtagaaatatctccttaatattgaatgaggtacacttacatttaaaaactacatttaattctttgcaggagttcagggatatagtgcttctctcgaatgttcacggccctaggttcaaaccccagtactaacacacaaacgtatgcatacacacactcattcatgtgatggttaatatcagttatatacgtcatgttatctataattacctggaagatggctttccatcttgattgggttaattgagatgggataacctaccctcagggatagactaccctgagctgtgcatgcagctcttgattccttcccttccacaacggagtgtgtggtagaactataagccaaaggaaccctcccttttctcagctatttcatcacagtgacgacaaaactaactggtcattcatcatatctgtgtatatatgtcttattctctgaaattcacacttaactgagaaccttatattttacctagctaccttgtttgtccattcttgaaaaattgcaatttatttctggaatcccatggtttactacatgtcttcatggcactgaacactatgtagcttcagccaggaagccatcacatatgttctaaggggagtagatggatcatttcgattaaagtgagtatcgctcaagatgcagaagtagctgtctttcttttccagtgcagaggagcctcggggctttgagcacgctgggcaagtgcttcttgcaagtgatctgagccatactcccagctccagcatcacctctgatgctgttattgcacaatggtaggaaagagacagagcatagaggtgtatttccagaaatcccattatttctattgaatgatagtgctttgagatgccaaatggtggtgttggaaagtcatcagactggaaagtggtcctggggacagtgtttagtacctaagaggcagtcagtttaaataaagtaagggcttttagtagaatgtcattttgtgggcagctataatgtttacaatggtaatgaaccactatatactgtacatttgatcattcttctggcataaaaggctcgtttaaaacaaaacaaaacaaacaaacaaactaggatgggcatggtggcttttgccagttgtcccagttacttggaaaactgaggtggagggaagcctgggcaacttggtaagaacctgcctcaaaaaaatagaaatcttacaggtaaaacagttatagggactggagagatagctcagcagttaagagcactga

SEQ ID NO: 20345 - DNA, 1501 bp, Mus musculus
gggattaaaggagtgtacaccattgcctggctttttttttttttttttaattttttttttttttgagatggggtcttcaaaattcagcacacagttatttctctgggtaaaattcctactgttttggtctaaatctcttttccaaatatggtattcaaacatacatttagttctgttaaatgatagtcctttgtttgatttcttgatcttgtttgtacagcctaattgcaagttctttgaaagcccaactacagtatataaatagccagatggctattgttttcccttgcctttcaaatttcaagactaaatatgtagtataagattatgaaaacgtttgtgcaatgaagcaaaatttaactcgtttaacaacctttgaaggttttgaaataaacattttgttatttgtttttctagctaactctactgactgaagaagagaaagctgcaacagagccattaaaatctcatatgccggactgataaaaaatgttaaagaggaaggctggtggaaagaagaccaactgcagagattgggcgagacgtctagaggcggggctgatgaggaagcctgacatttcccttgaccgagaggatcgtgatgcatttcagatgaggaaattgtaagaagcgtagatgtcctgtgactgaaaaccaaaaggatgggatggaaataaagcaatgtaaatactgatacccagcattcattttaggcaatgaaatcccttagtactacttttttttttattttctgttttctttttgtatagtgttggcataattttagatgttttgggattttgtaaaataatatttatgtacattttgttcagtatgtaaatgggcaaaatacttgtataaaaattcaggtgttgtttgctcttttgagacaaggtttcactatgtagctctggctggccctggagctcactatgtagaccagaccagctctgaatcctaaagatgcctgcctttgctatcacgctgggcattgtctgtctgtctgtctgtgacaaggtcttccatatcccaggctggcctcagatttggtgtcaatagggataatatttgacattggtacttcctgagtgctgggatacccagtgtgcagaagcacgtctggtttgtgtagtaccagctagcacggctcagctgagccacatcccaaccctgtatttttttttctttaatgtacattacagttaataacacacttacttgtatgtatatactgtccagttttcccaaaatctaacaaattaataggatgttttgtgagaacttttattttttttttcctttttcccattgcttgctagtaataaaacatcattagtttgttttcaaatgctgttttagactttctattggtgttacaataatatgttatctttcagtgtagttttgtatttgtttattctatatgaatgacagactaaaatcactgacacatctgctattatccagtgtgtgtgtgtgtgtgtaaatcagtttcactatt

SEQ ID NO: 20346 - DNA, 1099 bp, Mus musculus
tggtgctgtgaattgtacctgggtcttctggaagagcagcaggtgctgagccattttttcagccttctcttgttttttaagacaggatctcactctgtaggccatgttgggctggaactagagataatctcacttcagtgctgggattacagacataaattttcataccttcttttaaaatttgttataagcacagaactctgtctgcctctccctcctgagttctgggattgcatgctgtgcaaccaggctgagcctgatagattactgttctgagagcaggtcccagtatatggttcatgatggcctggaattcaacttgccttacgtacctgtgtgtgaggttacaatcacctccaaacccagcttaaggtatatactgagaggtgcacagaaaaccagtttagtaggctgagaggagtcaagaaggtactatactcaaaccggccatggagttccaggtgagtcgggccacacagcaagacttgctttcaaacaaaatccacacgtgtgaatgttttccccttccatttgttttccaggacttgagactctgtgaccctcccggcctggagatggctcagagtttaagagcactcactgttttttcagaggtcctgagttcaattcccagcaaccacatggctgctcacagccatctgtaatgggatcttgtgccttcttgttggcgtgtctggagacagctacagtgtactcataaataaaaattaattaaaatagactctgtgatcctcaaatattgccagtaaaattctctacctcaacatttaaattgaacatattcggattacttgttcattttgtagttttggcagtggcttttgttagctggaatggttacctttttaatgtatttgcatccacttacctataaaataaaacctaaaattggtcatagtatctagcctccatgttatattatcttcattcttattacttttatttaggattatttctcatctagatactattttctgttactatagtgtttctatataatactatttaagatatttaaaaacaagcataatgcatattatttagaagtagtcagccttcagtttctttattcatttct

SEQ ID NO: 20347 - DNA, 1153 bp, Mus musculus
gtttttgtgtgtttttttgtaaatgaggtagctgtatttggctagggattgtaactgattgttgttgttttggtggtctatggcttgaacctaggaattaattcatactgatggcatgtatatgcagcttctgaactgtgctccaagcccatggtatcattttgtacaggcaaatttaggcaaagaaattaaaaataaataacttgagttatcattgttgctacttagttggtacattttttttcatgtgtgtgatgtatgaatatgataaaaataaattccattgcctttttacttttttgacacagaaccttactgtgtagaccaggctagcctggaactcattatttcagcaaaactgtccttgaaagcttcagttctgtaaccttagtgataagattacagatatgttttttcatatctgcttttactgttttttataataatattgtgctctatttttaggaatacttagtctagagaaatcttggatgtctgagttagatatacacgtatggattgtttcttttcagtgctccactccagctacgggaactggtgaactgtcgttgggcggaagaagtgacacagcagcttgacactctccagctgtgtagtctcaccaaacatgaagaaaatgagaaagacaagtgcgtagttcttgggttttgtttactagttaatagaatataccatgtgctgttttaatgacactatctatacatatatttaaataattggtttgtatgtgtaattgctaaggtatatctatatatgtatggggtactgtggatttatcctggggccacatgcaaagtaaatgcccactgactttaactccaagacctagtgacacaacattgctttttttctttttcttttttttttttttttttctttcgagacagggtttctctgtgtagccctgggtgtcctggaactcactttgtagaccaggctggcctcgaactcagaaatccacctgcctctgcctcccaagtgctgggatcaaaggcgtgcgccaccactgcccgtcgatttgctatttctcttttatctgtaaatgagaaagttaatgttaatctttcatctgttccttaatatttaacttaatgttgtttaacttttcatgaccactcgtccacctcatcca

SEQ ID NO: 20348 - DNA, 1230 bp, Mus musculus
ctggctgtcctggaactcactctgtagaccaggctggcctcaaactcagaaatcctcctgcctctgcctccaaagtgctgggattgaaggcacgcgctttattgtaatgtatgtttttgcacatgtatgtgttcgagaacatgcatgtggagggccgaggacaacttgcaagagttggttctctcttactgtgtgggtctttgagcttgaacttgggtcatcatggtttgtggtagacaccttttcctacttatctatcttgctttggtagttagaggacaacttgaaggaactggttcttttctactacatatattccagggattggggtcaggttgtcaggctttttggcaaacatctttcaccttactgacccaaatttacagaatttttaaaaagcaatgttgcctacatagtacaattattaaaaatattggttatgaattttaaagaggcaattaactgaatttaagagtaatcacaatgattgcattatcatgttcttgcttctgttgtaaaggacttcagttacaatttgtccttcgtgtttatcttctaggaaagaaatgtagaagctgtaagaaatgcaaaggacgagcgtgttcgggaaattaggaatgcggtagagatgatgattgcacgactagatacacagctgaagaataagctcataactctcatgggtgagtgtgcttgcattctgttgccatggtatcgtgatcttgtttgtggtccagtctttaaggagtaaattaatgaattgatagtaggtaggaattttaagaactctatgttgtttaatctgaccacaagtctggcttctgttggaatataatcaaagagaaaactttttcacagccattgtatgaaaatcctaaatgatttgtgaaccttgttgttgatttttttttttttccttccacaactaagagaagatgccactactgatgcctttaattccagcactcaggaggcagaggcaggtggatttctgtgtttgaggccagcctaatctagagtgagttcctaaacgaccagggctacacaaaccaaatcaaaccaaccaaccaaagactcgagccgatcagccagtaaaggtatctgcccctgaggctgatgagctcgggtgggtttgcagggcgcacatgatggaagaagaggacttccacaactgcccttttactgccctgcacatgctatggcatgagtcccttctcccacaataaaaga

SEQ ID NO: 20349 - DNA, 1216 bp, Mus musculus
ctgctggagtgtgcatgctgaacttcagttcccttgtcatggggcagaagcatttggatttcaaagttaaaaatatttgtacacagtgctgtgtatgatggtgcacacctttaatacctgtactccaaggcagaaggagacaaatctctgagtttgatggtagcctggtctacagaactagtttcaggacagccggaactacacagagaaactctgtgttaaaaaaacaaagcaaaccaaaaaccacatagataataaataaaatatcttggttatataaggtccaatctaaatcaaaatatattttttgtttcatatatacattataacatataacctaaaggtaattccatatagtatcttcagtgactgctttgaccatactttgtggcatgaagttgggtatgtatcttctactctatggctgctttgttggattttaaaaatttcagatttagaacatttggatttcatatttttggattagtagtgttcaacttgtatggtcagggtgactttttttttttttccgagacagggtttctctgtatagccctgatgtcctagaactcactttgtagcccaggctagccttgaactcagaaatcctcctgcctctggctcccgagtgctgggattaaagtcacgcgtcaccacgcccagccaactatttctttattctgggaaaaggaaccttttgttttgtttttcaaattgggtttctctatatagccttaactgtcttggaactagttctctacaccaagctaccctttgtagaccaggctggcctcaagctcaaaagatccacctgcctctgccttctgagtgctgagactaaaggtgtgtgccactgttgcctagcataataaatatattttaaatttgtatgattttattttatcttcttttatgtgtatgggtgttttgcctacatgtttgtcaatactccatatatatacacaccatggcctggtgccaatggaggccagaagagatcttcagagtccctggaattagagctacaggtagtagtgagctgtagtgcagggaactgaacttgagttctctaacagaacagctactaattgctgagccatctcttcagtcccaaaggaaataattttaaaaagtgaggacacttggattttgtatcaaagaaattaaaattgtaaacttataattcaattatctctctatcctctatcatccatcc

SEQ ID NO: 20350 - DNA, 1154 bp, Mus musculus
catgatttcataaaaataccctttgggactgtggagacatctgggttaattaagtacttcctgagtttgcaccctagaacctttgtaagaaagctggacctgatggttacctgctcagaacctcagttctggagcagtagagataggaagatccctagggctccctggatagccaacttagcctaattttgttttaggaagagagaccttatctcaagtaagatagacagtacttcaggaaaacttcagcttgttctgttgcttccacatgcacacacaagataccattgtcttgtagcctctgacaactatcagcttgtattttgtttagaaggtataatttttaaagtgactttataggatagtatattttctttgacttacaaaactaaataaaaatataaactatgtttttattttttttaatttgtgtttgtttattcttaggttttttagtcttaatatttttattagtatatactacacatattagtaatatataatgattaaattgtggtttttatttctctcttttttgagacagggtcttgctcttggctggtctggagtttgttatgtaggccaggctgtgtgtgaactcctgagtgctggaattaagctgggctattttgtttgttttttgttgtgtttccttgtttctctatgtaacagacttggttgtcctggaactcactcactttgtctaccaggctggccttaaacttgcagagatctgcctgcctctgtcttcccagttctgggattaaggtgcatggaaccactgcctggcattttctttttaacttcatgtgtatgagtgttttacttgtttgtctgtgttccatatgcattcctggtgcctatagaggccagaggcaggcattgagtcccttgatactggagttacagatggttgtgagcttccatgtgggtgctaagaattgaacccacacctcctcgagaagaggaacaaatgcttttaacttccaaactgtttctccagggtctgactatagccctagctagccttgatcttggtctggccatgtgctcatagatggattcacatctgccgcccaaagtgctgggatttaaggtatgtggcaacatgtctgacttcattatagagttttcacgcgtgtgtgtatatacaa

SEQ ID NO: 20351 - DNA, 1243 bp, Mus musculus
gatgaacaacatcatagctttaagcctagcactcaagaggctgaagcaggaaactgaattcggagccagtctgtatttgtttcaaattcaacattgattatattttgatccactcaaacacaatttccagttgtttaaattagaacagctgttctcaacctctgggtatttacattacaatacataacagtagcaaaattacatatatgaagtcgtaataaaataacttcatggttgggggtcatgacaacataaggttgagaaccactggataggagggtttgtatttttgtttacacttcgtcttaattgatacaactttttaaagacaaggtcatagttaatcttattaagactctgtttcagaagcaacaaaacagaattatttttgtcgtagagtagtaaataagctgtcagggtcacagagtgccctgttgttttgaacattgtaggcagaaaaatatctgtatatggtaaagattagacctttctttcgctgtatagtgagttttgtgacatttaccatattcagaaatatgaatatatttttcctaaatatttttcagccacaaataagaagaattcccccaagtcagctcgggccatagcaggcagtctgtcactccgaagagctgtggactctggagaaaatagccgttcaaagggagactgtcaggttctggctgaaggtaaagctgacgaatttatagtctaattttattgggcccgtgcttgggaattgatgtgacattgctttaaccttgatgctgatttacggttggacttggggtgtgtgtggcctttattgtttactctttatgagtttgttcttttgtttgatttttgacttttaagaacagatttactttgattttttttttatcatatatttgtctgtatgtgagaaggttttactcttgatcctcctgtcttagcctcccgagttctggggtggctgacatgcacctcgggctctagtatctgatctcaaatcagagcagtattttcaactatgtattctggacttgttaatttttaagtagctagtcaaaaaggttggggtatatttttaattttgtttggagattttacttagttcaaaatgttcatatagtaggctggagaggtagctcctggcttagagcattgtttcagtcatgcagaggacctgggtttgattgccaactccccatggtgactcacaagcatccgtaactccacttttaggggatctgatgccttc

SEQ ID NO: 20352 - DNA, 1200 bp, Mus musculus
acacagagagatgctagcatatacttctggctgtcctggtcagtgtaatagtctgaccagggtaatagtccttgagacacacttgcatagtgggctacaggtactaactaataaaacaaactgtagattttttttttttttttttttggagatagggtttctctgtatagtactggctgtcctggaactcactctgtagtccaggctagcctcgaactcagaaatccacctgcctctgcctcccaagtgcatgcgccaccaccgccaggcaaactgtagcttttttaaggtatgctgtgtatgtgtggtaggaggggagaggtgggaagaaccacttaagaagtagagattagatattgaagacactggtaaatagcctttgataatattgtgtgataagtgttctgatagaggaactaaaagtatatcatcaaaaaagttgatatttagtaagttcttgctatgttattctcaaaattattctttatagtcattaacttcttttatttctgattttacaaacaagtgatttaagacttagaaatagaacacacatgatatgcactcactgataagtggatagtccagaagctcagaatacccaagatacaatttgcaaaacacatgaaactcaagaagaagggggaacaatacccaatggaaggagttaaagagacaaagtgtgaagcagagactgaaggaatgaccatccagagactgccccacctggggatccatcccataaacaaccaccaaacccagacactattgcggatgccaagaagagcttgctgacaggagcctgataaagctgtcttctgagaagctctgacagtacctgacaaatagagaagtggaggctcacagccatctattggacagagcacagggtccccagtgaaggagctagagaaaggacccaaggaactgaaggggcttgcagccccataggaacaacaatatgaactaaccagtacccccagagctccctgggactaaaccatctctcaaagaaaacacatggtgggagtcatggctctagttgcatatgtagcagaggatggcctagtcagttatcagtgggaggagaggcccttggtcctgtgaaggttctatgccccagtataggggaatgccaggaccaggaagtgggagtgggtgggttggtgagcagggggagggggcagaggggagtcggat

SEQ ID NO: 20353 - DNA, 1416 bp, Mus musculus
ttaatttagcaaattagtacattaacaaaggcagcttgtctactgtaacagaaagccagctaagtgccagaaagtacctggaggcattgcatgatctgatctggctcagcatcggtgcgcttctgtctttgactgacacatggtttagatggccatggttaggtttttcattaggctgtgatttcattaaggcttgtataatagtgaaaaggaagagtgcttataaacagactttgctcagtggacacttttcctgagtaactgcagcaatgttagacagactcttttctttgaaatatgacgatagaccaaattttatgtttttctcacttgttcaagtattggcataccgggtaatggcaccccttctctcagttatgtgacctttacaggtgtcgtttcaaatgagctcagtcattggggattggttctatgcatggtcatttggacgcatgtaagattacttaaagttgttcatcttttctgcttcctgaaacataactatagtgcaacaaatatttttgaacaatatatttccattggttggaccttgatctcagtgagtgcatctaaagatttatgcatatacatgaagctgtgttcaaggctttcttgcatattcccaattagtccaaaccccaaatgattgccaaattttgctactgtgctcctgtgtttgtgtttgagctgttgtatgtttgtaaatgtcacacttaaagctggccaagagactgttgaagaagcgtggatgtgcataggagagcaccccccccacctgcatgtacttagtgcctcctctgtgtcccatggtgatagcttgcttgctgaatgctgtgactcatagtttactgttctcttaacagcttgcacttttcgttaataaaattaacttgagaaaatgtgcctctgcagtttattcaaagtgggaccagaagcaccactccccctcttaaattttttgctgtggctgtttagcagtgtagacaaggacattttcttatggcattgggctaataatcattccttttaaaaccaaaagatttcttcataaataataaaatatatggaaagaataattcttactccaatccctagctatcttatattctaaaatgtccaacaagtaggtggcattttacttttggtattttgactcttctggggaagaggctcagagcccttgcatgctaggcaagcatgttactcctgagctaaagttgtccgggatacccagtgtttcgatgatggcaggagctgcactatggccaccttggctgtgcttgaaggcaggtggggagaagggcagaggcatgatggtagaatcccttgctgtgtctgcttgccctgggctcttacactgtgtatcagattctcccctaataatccatctttcctgcatcgctttatagaaacaaa

SEQ ID NO: 20354 - DNA, 1155 bp, Mus musculus
ttttattagtttttctgttgtactttattcagcataaggtgtgtttgttttgtgtgcatgtgtgtgcgcatgtgtttacgcatgtacacgatagaggtcagaggacaccttaggtgccattcctgggtagccatctactttcattttacttgaaaccttccttaaatacctagttatttatcttaggggtttttaaatttttatttatgtgtatgtgcatgggtgtctgaggccacagctgcacctgatgctcaggtgcagggaattccgctcacaaagcctctggaaagcttgagaacccagccaccacctctctaaccctggcttgccttctttttccttcccgttctttctttttgtggcagggtctcactatgtagccctggctggcctagaattctctttgtagacgaggctgcctctgccttttcatttcatgtgctggggttaaaggtgtgaatgtgagcatattgtttttgaacaattctgacaacttgattgtattcttcagtaatctttgagatggacaagttgtgtattgttcccacttggcaaatttggggagactgtgctgctctaaggttggacaccatgcttttttcagttcattatgcttaaccaaacaccaataaaaagctgaacaattgtcctgttttgttgttttattttgagataattttagatttctaagagttaggaaaattgtgagaattcccatgtagcactggcccagcttctccttttgtcagtgttctgtgtaaccatggcacagcaacagggatgtaatgaaccttgtttgcagtgcttttttcttttaagacagggtgtcatgtccaggtttgttgtagatgacatggataatcttgaatttctgacccttttgatcctccagccttcagctcaggagtgctgggagtataggcctgtgccaccatccttaacaagggctgggtttgaaccagggccttgtgcatactgccaactcagctaccctctcagcttcacattcgtcttacatccagggcctggaatttgctatgtagacctagttggccttgacctcacagagatccacccaattctgcctcccaagtactgagattaaaggtgtcacagtgctcagctaagctatgattcaactctctgaggaacttg

SEQ ID NO: 20355 - DNA, 1176 bp, Mus musculus
gcttctcctggcagctcccagtaactcttgtagcagcccctgggcttcccttccttccagtttctcaccttgcaccatttgagctcgtcacagcctctcgcatctgcggctcagctctctccatctctcaccttcccagttctccagctctgcaggccctcttcccagtggctccccagagctcctcggctgccttcgagctgttgctgctacagaaagctgagtacagccaaggagaagatttatattggcacttactgttgaacactggggatgatggacaggaactccaggcacttgaggagtctgggaacggagaggtggagccacacatgtggggacagtcaactatgagaggtggggccacacatatggagacagtcagccatgagatcccaagcagaaaagggtgatggtttcctgagcagttgcaagtgaggctgtctgtaggctatctagagttgtcactggcaaagtgactttgcagtatggcagggaaacacctgggatggcagtagagtcttctggagcaaagcccacagcccagctttggtgttcccattgctgacccagagttttctctgagcacccgtagttggcttagagctgcttccaattgtctgtagtcttggagaagttccctgagatgactatgaaatgtttaaggcagtccttgatggcagctcagaggacaggctgtctggcagctgccagctcctccttaaagcagcagccctcaaactggctgtgctgaaccttcaggggctgtgatgctgctcacagttgtccaggagacacacatctctcaggtcaaagggagtaagagacagtttgttcttgaccatggcccaggaggatggcttcagattgcctcaaataccacgtgcagagtttgacagtggttttattttttttgttgttgttgttggtttttcgagacagggtttctctgtatagccctggctgtcctggaactcactttgtagaccaggttggccttgaactcagaaatccgcccgcctctgcctccttagtgctgggattaaagacgtgcgccaccacactcggcattgacagtgttttgatagttgcagaacaaagtcataaatcaaggcccttttgtattcatttcatttttggcatgggggtgaaggttgcgacaaggactcactatgt

SEQ ID NO: 20356 - DNA, 1928 bp, Mus musculus
gaaagcatccttatgcagtgttatttttttttaatgtgtgtatagaagagcatatataaaatgctctaataaaactctgggttagaccacctgcaaagtttatcctctttattcaatgattaataaattctctcccaagaataacatagcttatttaaagactatttggaaaattaatctttttaaattgtcttttatgtgtgtgtgtatatatatattttatgtgtgtatttctctaccttgcagcctcagggatttagagacgctgttgtcactgctgcctcatcacagacagagagttctttgaatttccggaaacggtcacgagaaccagaggaagaatgctgaccaaatgctgatgccagtgtatccagttaactgatgatgtgctagtcagagtgtagtgtgtgtgtgtgtgtgtgtgcactgtgtgtgtgtgtgcactgtgtgtgtgtgtgtgcactgtgtgtgtgcgggtgcctacaaaagcaagcggagggtggtggatctcgtggaactggagttagaagtaactgaaccaccatgaaggtgctgagaaccagaacctagtcctgcaagaaccaaaaatgttcccaactgctgagccatccatctctccagctcctccaccctgtctctgaggcagggtcttctgttttgtctcttcattctccaggtctgcacactttaactacttctgttttggcctcctgtctcactaggaaccctgggatgcaggtgtgtagcacactgtgggctctgagaattgaactcaggtcgtcaggcttgcagagcaagggcttttacccactgaacatctttctaggccctccttaaattttaagaaaaaaatctctccctgaacgtggagctcactgcttcagggccacctatctaccccagcagcaccaagatgcacacatgtgctgcactgcaccagcttttattatatgccgtcctcatgcctgcatgtcaggcactttacccatggagctgtttccctagctcctgaaaagattttctgaagcactgttctataattatattttaatgtgtttttattttgagtaatgtggaaagctgaccttatgttacctatctggatttaccacccagagtggaaaatttctttgtcaattgcctaaaaaataatagaaataaaacactataatatgtttgaagtgtgtgtatatgtatctgtgtgtttgccaactgtgtggaggccttcaaagcatggaagagggcatcatgtcccctagaactggagttatatgtggttggctgccagatatgggatcttaagtaatttctgagtcatgtctctgtccctccatattcttaaatgtagctttgggggcctagagagaggacgcaggagttaagagcacttgttgctcttttagaagacctggatcagttatcagcaccaagtaactccagttccaggggatctgaccccccccctcctcagccctccacggacactaagcatgtatatagtatacatacatacttgtaggcagaacactcaaacaaatacgaaataaaattaaaaataaacaaatgtagctttgaaagcaattaacatatcactgtttagttagttgagttggtttggtttgctgactcctggtctgtgtgtcctccttgctgctgggttgcccagagcacctcctgcaagccattgttggaggcagcacacagtctgtaataggggttgaaggtctgtgcctcccctccaagtctttgtgcctggggacagctaagccctagagagaggcagagccaggtttggctccaagtcagggccaagagtatgtatgggagaggctggaagagaaggccttctctgagagatttaggtctgaagcccctccccaccctggaatccttgatgaagaaatagatggtcctttctttgatggtgg

SEQ ID NO: 20357 - DNA, 1211 bp, Mus musculus
aaattaacctttctataccggttttcacagtgcggctgtttttgttgttcctcttagtgttaattcacactaaagactgtgcatccgactcctacatttatgaaagtaaatgcctattgttagaacaaaaaaggctacagaacaaaaaacaaagcgaaataccatctgctttaggttcagtggtattttcccgctgacagggaggcgggtttttgggtacaggaaacgagtcactatggaggcggtactatgtagatgagaattcaggagcaaactgggaaaagcaactgcttccaaatatttgtgatttttacagtgtagttttggaaaaactcttagcctaccaattcttctaagtgttttaaaatgtgggagccagtacacatgaagttatagagtgttttaatgaggcttaaatatttaccgtaactatgaaatgctacgcatatcatgctgttcaggctccgtggccacgcaactcatacttacctggcaggggagataccatgatcacgaaggtggttttcccagggcgaggcttatccattgcactccggatgtgctgacccctgcgatttccccaaatgcgggaaactcgactgcataatttgtggtagtgggggactgcgttcgcgctctcccctggtttacttggttttaaaaatagcttgcactagcgataccgcgaatatggttattaggtttgttaggcacagtcgtgtcttactatagaaaaataacgtagtgttcattttgctgcctgtatgtgttaatttgtccttattgcgccattgttcttgttaagtcttctgtaaggagttgcgggtttcaaactgtcagtctgagagcataagctcacttttcagtcagttgaattgaatgttacattcgattggttctggatattgatattacccaaggcttgtcctgtttgtaagtcttttcctacacctgacaatatgattatgtttacaatgtccctagaactctgggtgtatcgttcccactgaataaaatttgatctctaagttgacctataaatttaagtaccaaaaaactggtttgtaagattttggaaggcagaggcagggaagagaccaacgtggtctacatataaagtaccaggtacatataaagtaccaggttttgtgttttgttgtgaagcataagcaaaatttgaaggaaaggatatgggttagtagtagaactgt

SEQ ID NO: 20358 - DNA, 1142 bp, Mus musculus
ggatacaatacaactgggtgctgagttgtaggtttccaacaggaaggtaaatgtcacttgttcccctctatgtaatattttgtttttcattttgtaaatttattttaagttatacgtgcacaacaggcagaggtgacagaccctcaggagttggaatttcaggtggttttgagccacctgtgtgggttctggtcttccaggaaaccatctctccaacctccaatattttgcttttctttagctttcttcagagtttctcttctttatttccccccagtggtttccctgtggtgtatctttcattcccccttctcctttcccatgtcttctctgtactgaccgagacctcgaaacattcaaggccttcagttttctttttcagattgtgtgaggagccatatttgtgcatagtgtgtgagggtgcacaggcagaggcggaggcggaggcggaggcggaggcggaggcgggtgttctctgcctgctttcctcctttgagacaggctctcttattgaagttggagcttgccttgcttttggctaccctgtctctccccatcctgctggggttacaggtgtttgtggagatagtgctcccttgtctctgatcattgtaacaataatacagagaaaaagaggttgtcatttacagaaggactcaggaacagtatggagggaaaagaaaccaaaacaaaaaccgtctagttgttggtgttctgggaaagagggatattgcaggatgacttgggccttgctgccagcagagggactagctctgacaaatgaacactggcagcttagcagaagcccttttctagtttcacaaaaggcaccttagcaagccaatccaaatcctaaaacctcttatctgatctagggatgtctgaaggaatcattacccaaggagttctcagcttgaggagacttcctggtttgcctggtatgtctctggactcaggcaaaggctctgagaagccttcggaacaacccataaaacctcagataacaatcactgactatttacaaaaggctacttcatagcctaggtgctatcgtttcagaattcatggcagattcaatagctctgctaacattctgctacatctggtcctcatgttcctacagcaagctatcctaaatgctg

SEQ ID NO: 20359 - DNA, 1289 bp, Mus musculus
cagtcatggaattgccattttccccacgtggtttttcgtttgttcctcaccggaggcctccggtttgagcccgaagtctaaaccggtgcgcgtctgcgagctcgcgtgcgcctccgcggccggagcacagtcgcgggcgggcatcagggcggtgcgtggccgtcagtgacgcatgacccttcgcaggcagaagtgggacgggtcaagagaggactgtgatccgattggctgttcggcgaccgtatgctaatcgcggtgacagtctgcgtggtgtagggacacggtagcgactcaaaatgccccgtggacggggtctggagaggtgtcggtctgtcagagaaggtgtccccgcgagggcagacgcggtgtgagatagaggcgcggacagggatgtcacgggtcgtctgtgcgtcagtcgccgtgactaagatgtgggggcggccggtgcagtgcggcgcggtgtggagcgtgaggttaagactatactttcagggatcatttctatagttcgttactagagaagtttctctgactgtgtagagcacccgaaaccacgaggacgagacgtagcgttccctcctgagcgtgaagccggctctaggtgctgcttgactgcagctgcctcctgccattgatgatcgttcttccctcctttgggagggtgagagggagggaacgcagtctgagtggactcggtttatcttaaagggttttaaatatagaaagcttccttagtcttatgggtgagagtgctgtttaagccttacctaggtatgtctttgaacatttattacagattgttatttgtgactatgaccactcaggtgttctgttcttgtgaatttagacacactcagaaaggctacacactcaaagaccacaccaaagtgaagtactatctgggccgtgaaactggtcacatatcagttattttgcagtaaaacaaggaagtcaatcatactgcttcagtgggtcagggagtcaagaatgcacagtacaagagctggtgagattcctcagcaggtaagagcactgaatgctcttccaaagattctgagttcaaatcccagcaaccacgtggtggatttgaacaaaggatgaaaacaaccatccataaccagatctgatgccctcttctggagtgtcaaaagacagctatggtgtacttacataaataaataagtaaaaacattaaataagtaatttaaataaataggtaaataaatatttttttattattttctttttatatacatttcaaatggtatcccgaaaattctctatactct

SEQ ID NO: 20360 - DNA, 1213 bp, Mus musculus
agcccgaggtctaaaccggcgcgcatctgcgaactcgcgtgcgcctaggcggccggagcacagtcgcgggcgggcatcagggcggtgcgtggccgtcagtgacgcatgacccttcgcaggcagaagtgggacgggtcaagagtggactgtgatccgattggctgttcggcgaccgtatgctaatcgcggtgacagtctgcgtggtgtagggacacggtagcgactcaaaatgccccgtggacggggtctggagaggtgtcggtctgtcagagaaggtgtccccgcgagggcagacgcggtgtgagatagaggcgcggacagggatgtcacgggtcgtctgtgcgtcagtcgccgtgactaagatgtgggggcggccggtgcagtgcggcgcggtgtggagcgtgaggttaagactatactttcagggatcatttctatagttcgttactagagaagtttctctgactgtgtagagcacccgaaaccacgaggacgagacgtagcgttccctcctgagcgtgaagccggctctaggtgctgcttgactgcagctgcctcctgccattgatgatcgttcttccctcctttgggagggtgagagggagggaacgcagtctgagtggactcaattttttattgttttttataaagttagagttttatttttcttcatttctcctttacacttttggttttcttcccatgctcatatactatgtgtgtcttttaaagtcctatttctacatctttaagtttatccttattagtgattctttttataaacattgttgttacagtgcgtttatggcacgtggtctgaaagggcgcttcaggcctcatatgcattgtactctctaaggtagccaagcctagccacgttttcatgtgctttggttactttttgaatgtgacacaggacttttagtacagggacctcaagtggtttagtggttaagaccactgacagttcttggggtcagaggaaggcagcccggggctgctccaaagtttgtcttgagaaaacaattaagcataaaatataatacaagtaggaataaatgatgtaaatttgctctcataatggatttagttggaagacaagaaggtgaagtctttgaacgtatccagtggctggaagagttgattcagtggttaagggtgcttgttcccaacacctgcctgaagcagtttactcttacttgtaactcctatg

SEQ ID NO: 20361 - DNA, 1111 bp, Mus musculus
tttctagaaagtgtgtgtgggattgctttggtgaagaattacttctggttggtggttttgttttccttatttaatagctggtaacccttcaacagtttttcagcctgaatttgtttttctgtgacttagagacatgtggtgacagtataatgtggggttgctgtaaggattgtgttagataagacactatagtagttcagtaatcctttccccattctgaaaagcttcctccctccagttataaatctgtctctcgtcctgtcttcaagcaagctctccaccactgagagatacatgtccccaatatgttacctttgaagtctctccttcaccctgcccccatcttaatgagtcataggaacttaccttctagaacagtcagagtttgtccatttctttagcagtgcctggtgcctctcagagatgccttgtgccagtctcagaactgctatctacagcttcccatctctcagtgacttcccttcacaaaatgtatttgtatggtggtacatgctaaagcaagaggactttttgtttgttttggttttttttgagacagggtttctctgtgtagccctggctgtcctggaactcactctgtagaccaggctggccttgaactcagacatctgcctgcctctgcctcccaagtgctgggactaaaggcgtgtgccaccactgcccgactaaggcaagaggatcttaagttcaaagctaactgtggctacaaaatgagctctgtagttaggctctgtatcaagcaaaggaattgggaagtgttggtacaggcctataatcccatttgtctggatgctaaggcagaaagagcacaggttcaaagcctgcctaggctacagaattacttcagtgctggtaagagcaattaaacaaatgtctcaacaaaacaaattgctacagaatgcttagtggtagaaactttgcctaaaaattctcagttctcagtagttctcagtactccctgggggtgagatagaaccacctgtggatccagtttagaaaacttgctctggaagtatttatttggttcctgctggcaccttccttctcaagtcttctccttctaaatttggatctctagatttcgactatc

SEQ ID NO: 20362 - DNA, 1980 bp, Mus musculus
ctctatgacccagttctcgtctgtaactcatgttatgaacacattcaagtatctcgtgccagggaactcatgagccaacatctgaagaaacccattgctacggcttccagttgaatgccagaggaaatgatctgtccatttttagcagatttgaagggaggatctgcttcaggtgtagtctggaaggttccttggtatggctcatgaacacagagctcaaagataccgtcttgagaaatcctccttggtaccatgtgaccggagcagaggaatttgaatttggcaggagctttttctactggagagaccctcactttggggtgatggtcctgacctagacccagagtctggaagcttcacactgagttggtgactccagcttctatctcctggaggtcccaagatgattcataaatactgcctggtgcacagtgcccaaacagcaatagaaaggcttacttataaccaaactccaagtgatagtgagacccatctctcctctaccttgaagagagcagatcatagtatatgagataggaattcccatcctatttgagttgaactctcttctgtacctctgtgctctgtgtctgtgcatgaaggctcagtctttagaggcactccctctagttgattagcactgtcttctgtggagtttggttcaaagactggtatggcagatagaggcttggatgcatttttcatcaggctcagtggctagcatcagtgaacattcagtttcagagggacagttttgaggattaagacacttggaaacagaagaactctggtaatgcttagtcttgtgagaaccagttattctgggctgtgaaggcagttgccactgttatgcagtggctgcttttgagggacgcactgtgaagaatgagaagggaaaagcaagattatccttgtgaaattctgctgattgtgccctaccctttgcacctgacttttcctagttgtcctggtgctaaaatggaagctacaccttgatctctcctggcatgaaaataaaggattttgttgttccactgcccacttcccccatgttgtctttcccttggccgctgcctcctctgggtcacactgcttcttatcctgaacacttgacaccttgagggtagaatatagcatttggtttttacctcctagcatatgctacttggtatgtgagggtttcagtacaaatgctgctgtctatttctgtgcacttaacaatggaacccaaacagaaggaagaaagccttgataccaaaattgggagtgaggatgtgtccatttggaccaaacactttgttttgttttatttagattttgtttttcatcttactatgtaccagtggcacttaaccaaaagatacagtaacatagccatgtactgtggttgggacagatacagtctccttggcttataggacttcctagctacactttccttagcgcattaatgtgatgctcactctgtgttaaaactgcagccgttgtctttctcaactgctactgtcacgttgctttcaagaaaacattttttttcattccagactaaccagaacctgcatttagaataggagtcctttctccgaccttttcttcagttccacagcgaagcctctgtgctccttttatacttgccatggatgtaacctaaaaagttttggcatatttaggtcagcctagcacatttttttttttttcattttaatggagctgaagaatggagattttttttttgtgtgtgtgtgtctgagaaattcctaagatcaatgaaagagtgataaactatttgtctctgatacataaaattattttaagcattttctcaatcattaaatgttactgccagtcataagtggctttttaattaccagttttcattgcacttcactctgttttcagggggattggggacattcggggagactgtatctgtctactttgtgtgactgttttgagggactgtcccatcagtgaacagat

SEQ ID NO: 20363 - DNA, 1223 bp, Mus musculus
gtgaggagtcctctagatgggctcttccagagggaactgagccccagagtaagtaatcaagcaccaagcactgtcagatcaggactggacccacgcctctggattcccagtctgttctcatctactcctgctttgctaccacgctctgtaggtcccttcttggccttccctgctccaaggataggccctgggtggagatagggaccactctaacgatggctctggctgtcctcccgatggatcgtttgcactggactgtcccctggggcgggggcagagccatgtacatactcagtgtatatatgtccatactcagtgcatatatgtacatactcagtgtatatatgtacatactcagtgcctcagtccaggtcctccctctgcttcaccgcacaggccaggggaggagaaaggccatgccaaagcgggcctgaccccgccccatagtgctccacccctccctgcccaggccacctggcctctgtgtgatcccatcctctcagacccaggggaccagggggcagaaagcaggagttgggtttgccttattttgctcattggattcaacttctctcttgcatcattttcttccagtccctgttgggtccaggggctgagggaaaggacggatttatgcagctattttcatacattccctgttcagagtgggtaggggtgtctcccctcactctaaccatcccatccttcaccccttgtctgggcgagtctctttgcatgttttcttcgctgtggtgggagatgtttgattgaaccctcgccccctaccctggtctccaggggtgtgggatagtgggggcatttgtttaaaaagacattttactataataaagtctattttcacaaaattgatgctgggctctgcctgggcaaaagactccttagagggatggatgggtcacgttgatggctttgaattcatggcttcagtacccagaagctcaccttgaagggcagctgagaccaaaactaatcagcactgagtgcctctcgaatcgttcccaagtccctgggctgtgaggcagggtaggatggtggcggagaagcaccctagaaggtgattacaggaaatagaagagacaaggtgtcatttcaagagagtgggttggccacacaggactctccctacccctcttaacaagtctatagaaataacagacctgaggaaaacataatctatgagtaggcacattaccgagtcctac

SEQ ID NO: 20364 - DNA, 1232 bp, Mus musculus
tgagagagagggcagcccaccaccatccaggaaatagagctgacgtgacagctgagtgttgattatgttctacgccagcccggttccaagcatctcacgaagctcttacaaccctgtgaggggaacactattaccactttataacaaggaccctaagttacagacccaagtaatcgagcttgggaacttgaaagccaggctcgttcccaggctggccaacttcagagcctctgtgtttcgctttagtttagtgatcttttagcaggtatatgtgttgaggctgtctcactctgtctagctcagactagccggggaccccctatatagcccaggctggccttgatttgacagcagttctcttgtcttagcaatcagtattggtacttcagttcttatgtctagctggtggcacagccctgtgccctgaaacaaaccaacatctttttaaaatgtcagtatctgattttctcccattcagaactaaaccctgggatgggttgagccgaattttgagaactggtttgctttgtttcctcagctttacggccggcacaaggagtacctcagcagcctcgtgggcacagactttgagatggtgggtagctcagctccccacagctctgtgagctgttggggagagtgtctgactatagagggactgtctccctctcttaaacgactccaagaccaactctgcagggtagaaaggaggtcaaagaagagtttcatgaccctgcattttgatgagggtccttgcacgcatagaccgggtctgaaagggcacacatgctatgttggcctctcttgggacaggctgggtgggtggtggtaattgggtattgggcagtgagaaaaatataccaggcattttgacttcttgttctctagggtttggtggtttggggaattttatcagtggtaatgcattcatgcgttaatttacaatttatttaaaaaacaatataatgataaaaagtgtcttccttattactcatgtggatattgttccagagcaccttagataggcaaagagctgtcattttttgctggtcagatgttttggatcttagaaaatgaaaccaaaacagtttaggtcagtcactctggggtcctgtctgtgttttccccaccaccagggattcaatttctagacctgcaaacaaggatagaactactcaccctcgcccccgtctctagaaaattaactcgtattgttttatgctacatgagca

SEQ ID NO: 20365 - DNA, 1810 bp, Mus musculus
tcttgccgtctgtcaggattttaagtaagggctgtgtctttgtgggtcatcttcccatattcttccagccagaagtcgtgttgggaggatgctgggagtagggttagcctgacttcccctttacattctgtctgctccctgcttagccctcgttttttctcattccttcgttctcttagagcagcccctattgttggctggcaagggaatttctggtgactgtagttccttagttaggtcttagcaatcaaaccaaatcaatgcccgtcagttcttctttgtgtacgtttgtgtttgtctgtgtgcgtgtgtgggggtgggtttggggtagaagggtgggaaggggcaggataagtggaatctctagggtgtatgggaagtagagggcagttagttctaagtgggcttttatgttccctgttgtgagggtgagaacaggttggtatcaaaccatccccctccccttagttcatcttgcttggacactgctttgccttgtggctgtctgttccctgggaaaggttttggaaggtcacccagaacaggatggccatactaacatctttcctggagttggatctgggaccaggtgactggtctctagtgggaagtgagaatggaagtgatggggtggagggctccttggaacaggtctgaagtatagcaatgacctctgggaggcaggaggtggagaatggaagtggggtggagggctcctggaacaggtctgaagtatagcaatgacctctgggaggcaggaggtggagaaggctgactgggaggagattccagagaagagtgcaagggaaaccttgtctgtcggtgacatgattggggtgggtgggggttgtcattgccaattgagctgctgattcttatgaatcacattcagaactcgcatagggttgacactgtaaggggtggggaaatctagctatttttttttccccagcccattcttgggggtcggggggaggcaggagaatgccccttcctcctaagcccttcctgtgtgttgagcttttgtttttcttcagtgctggcaggggagggtgggaactggtggggactgagttccctgttcaaaccgttattgggtacaggattgaatgtttgattttaggttttatttttcttatgaatgtccagatctgtgtttccctgccctcccagactctggccagttggaagtgtctcgtttttgttcatctctcatttctggtgcagtgactgagaccctgccacatctatgctctgcatccacgcctcttttggacattaaaggtcgattgatgcacttctgagctgttggggtttctttgggggcgatgggtgggtgggcctgatgctgttagtgccaccggtgggtgggctaggtctgtgtttcatagggtgaggtagagctgtgctttcaatgagtataggaggtaggtggggcttcaggtatgaaattgggtgggtgagtcttttggggaagactgtggaactgtgaggtaccaaaggattaattaagggactgcagagcctgccttgctgctgcctttgctggttagtgattgagagagctggagtcttgggtgtttcaggacaaaggctcagttcaagttttagcagaaatgagggggactgaaggaccaaagttagctatttctgctccatatgtctcctggaacaacacatttctgaacagtccagtctagtcttactctttaggacttcctggaggccaccttgtggagagccctggaagggaatgataaacagggtcataggactgtggaagaaagacgggaactgaaattctcgcaga

SEQ ID NO: 20366 - DNA, 3127 bp, Mus musculus
ccagaattggatacagttttcttaacagtggaatttgaaggtaaggatacaggcaagggtgttcacgtaaattaccagagccctgatctgtctttgtattcgttcagcttgtctgaagacaggtgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttactcagtacaatcttttcatttttttaattcaagctgttttgttcagaatgggctaaagtgttgaattgcattcttgtgtaatatccccttgctcctaacatctacattcccctcatgtctttggtaacttgtattttaagtgatgtcatagacaggattgtttaaatttagttaatttccatgctcttcagactgtgatattatgtaaatgtctattctgctctggtttgtgtgaaatgggatgttgggggtgtttgtggttatcttacttgggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactagaaggcgagggttaaaaatttatctaccttaaaagatttgcaaacacttaatgcagttatcttcagctacaattgctttgctttttaaaaccttggcaattgtggtagaattgcccattttgtaacaattatttgctcccttcccccctttttgttttaatagggactaatgtgggaagaatggctaatttgtcacagtgcttagttacaactgttaatgtgtggcctgctgttggtgtacatgtgggtacagggtgtcaatttccaaacagagtataatatcaatactgctaaatctgcatgtcctctgtgtgactgatagagcattgttatttcattttttaaagacaaaatgacagcaaaataatagaattccaacgtattagtgtagataatctagttgggagtactttaagtctcaccttcccttttaatattcataattgactcatgtttaaaacactttaatttacaagctaaattgcagatgggagcaatagtttaggtttaggtgggtagtaataccagtaaacttcaattatataactttgcaaccacaaaacctgtgatacctgtacagtaacaagtgttggcattatcagttgaactgtaaatataaagtgcttcttccagttagtctctatagttattaagtttctaaaatttatctgaacaccatacagaaacttgttttggggaatttgatagttattgatgtgcatctgtaaactgatgacagacataactcatcattccccagaaactttttttggttacagtgtctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattccttcctgccccaaccaaaccgcattcgtgtggatttttttttcattcaacttaattggctattccaaagaatttttttcctatttttgacgattggagcccttaagatgcacgatggaattgtgttttgcattttttggtaaaaggagcaaagcgaggacctggagatatacgctggagcaatctccttggaaggattcagcacgagtagatggtaaacatttaaaggggaaaagggggggtttgtttaaaatagtaaatcagtaagtcacttctaaatttaaagaaaacaaaattggagttgaagaataagtaggtttccaattggctattgccgtttttctttgaaaaaaataaacattttttaaaaaacgatgcatggttgtcctttttcctcttgtaaaattttgattgggtaactagtgtatcagttatttaatttgataagattctgattctgtttatgtgttagtaaattaaagattctaataaatgatgactgtctctgttgtggaagtcttaagagcataataaactgagtgtaaggcagttacatacgtaacagttgtgtagagggtaatgatctggaaagtaatctttcatattttgctaaagaacttacagttgctgtttattttggtaatgctttagacaaaataggcttttgtacaaagtttgatagctaatcaattttagctttgagattctcagtggaactcaaattcagtattaacattaggagacaaaatagactacacagtttttttttttttaaattttggatagtgtgctgtcaaatgcttattgggttaataaatacattataaatcttttcagccatagagtgttctgtcgccaaactgttctgtattgagtcagcaattatatatatatcttagtctagtctactgttgtatctctactgataaccccttgaagcttaatcttcatcttaattggtttggagaatggaacttttatttaaaatcccaagcttgtgatttcctcctggctagaatgaatagaccactattcaccacagtagaaatagctagatctttaactttccttgagttgcaggctaaatatgatattgttcagatgtaatgtagaatataggggagaccagaaatttttgctagtgaaagaaacaggtttcaagaaatttgcatgagatctcagcctgctcattttaatgaccgcatacactgtcctgaaagagaaactaattcttttaagttcaaaactaggat

SEQ ID NO: 20367 - DNA, 1518 bp, Mus musculus
gactgggcccaaaactccaaagtaaatccagtctcccagattctgggattagccatgaagcaccatgcccagcttactaaagtagtattaaaaggttaaagccagctagataaatgcaaatgtgggtttactttgaatgctttggaaacgggaccaagaatggcctgtttatagtagttcagttgtagattgaaatgagcaaagtgttctttgcctcactgtaggcttatgtttgaacactagtgagcacagcgtaggttttaaagcttaggaaatagggctgtacccatactgacagttgataccactttggaactacaaatactttgatttctactccccgcccccctctgttcccttaggatattgtagggaaacctatgattagtttttctaaccacgaaagcacttaaatctctttaagcaagtactttcataacttctgattgaataacccaacttgctgttcagctcatcctactggagacaaaggtaagacacattttctgatacctagtttgggatctggattttaagaactaaagttgtgatgaataattgctcctgacttgcaatgttcctctcttcctcccagctttatatttttaatagttttgagtgtataaatctactcatctcaattctggagttgaatatgataaattccaagatctgtctatgagccatgcttttgtaggggtggtgctattttcagcattctgaggtcaaggtcaacttttggtgtttgcctttttgctttgtatatgaaatttgtagtgaaattacaaatgaaataaattatatgtatttaaatagtattaaaaggagagaaagtattagactgagttctgttataacaacaaccacttgtagcttatttccatcataatttgatgatagattgataacccacaatactggaataccacagattgtttttattgagcaaaatgaatgtaaaatctggccagagtagatgcctttattgtgtaatttgtgtaaaagtcacataggcattgttgaaggtgttttatatatatgaagtatatgtgataagatcttcatgtaaagtctgaacaaccatggatcccaaatatatatctagtttgggtgagcaaggagttgtagaattgtactagtactgcagaggattaatgttactatatgtaattttgggagtgaataaaaagctgttaatttggaacctttattgagatttaagttctccatccttttagactgaatcaggtacttaaaaggtgtcaaccacacaatatattccattactacatagtttaacactgtagcaagacttcatagaaggtaatacctacaatatacagtgtagtactcttgtagatgttttgatgtcaggtttttaagatttttctttcttcgagatggtgtctcttttaacagccctggctggcctccagaactgcctgcctctaccccctgagtgctaggattaaggcatgcaccgcacccagcttcttaaagactttagacttaatggtt

SEQ ID NO: 20368 - DNA, 2833 bp, Mus musculus
ataacagtgttcaccgtggctttccatctaagaagtcctaagcatgctgtgtgcatgaacaggcctccgctaggtacagtgtgccttctaagagatcactgcacagctctgatagacaggctctgtcccactggcctgctggtggtggactcttcccaggaaaggctctagaactcagaactgcatgaaggagtgaggacttttagccctacttaaaatctctgctctcagaatacctcgcagaagttaactgatcctctcagcatctctgtgaggtaggtaagtaaatctgaactgaagtcaagagttgagggctaaccaggttgctcaggtcttcccaggcaccagagaagagatccatgtcctgggcccgcccaggatgtgctcacgaggtcctcgcttcgtatttgatcacttggtagaaactggaatttgatttattaaatgttctttttacttaagagaaattagttcagaagctgaattttgcctatagttttgagagtctaaagtcccccttttgtcttctccttttagaagctgccaacctgtgccaaacctccacggctgctacgacaccagtgactctcactactccattcaatataacgtcctctgtgtcgtctgggactatgtcaaacccagtcacagtggcagctgcaatgagcatgagaagtccagtaaatgtctcaagtgcagttaatataaccagcccaatgaacatagggcatcccgtaaccataaccagccccttagccatgacctcacctttaacactcaccaccccagtcaacctccccacccctgtgaccgccccagtgaatatagcacaccctgtcaccatcacatctccaatgaacctgcccactcctatgacattagctgcccctctcaatatagcaatgaggcctgtagaaagtatgcctttcttgccccaagctttgcctacgtcaccgccttggtaaacagtattataaagtcaaaattgggttaaagtaaatatttaccagcaacttaaccttagttgattaaagcaaaaagcagactatgaaattgggaggttttattatgttagttaataagagtgtagtagctccaattttgctggggttgttcaaagtagggtatatgtgtaacttatcactggaccactttagtttactcagaaacccctttagctgacaccattgcttaaacaggatagtagctggcaagacgaaatgccagaattaaaaccaatcataaaacccatttcaaaataaaaaagcattatttgtttttattattatttttaatacaacagaatcattttattgtaaacactagcagagttcttccctctgtacaaggtggacggttttaacctggagctcaagcccacagactgagagctagtgtagcattgtctgtggttttgctcgtatgagtgaacagaggcattgtcataataaaatgcatttcagagaatatgcattttacctttgggaatatgttaatttcaggcagcattccctatgggaaaggtgataccagctctgatatgcaaagcatatgataatttatcattctaacttcaacatataatagggattgtgacctgatatttggagatgtaaatattgctcagcatattaatcctgatggaatatagcattgtagttgactttttaaaaaaaaaaaacaaaaacttaaaaaaaaacaacaacaataaattgtgttttgatgagaaaaggctgcagctgactgaggagaagtcaggtgtgcacgaagcaggctcctaacgggtcaggggatcctgttcaggaggagtgagaacttcggaagagtttaaatctattgctttaaattggaagacattggaggcactgggatgtgatatgcctctctctctcccaatcaacgtctgttgatgttacaacaggcacagatgtgttagatgctcactagagtttatgtcttatattaaattgtatacagtttttattctaaccactaactaggtagtatgccccttcagaacaagcagagtgtatcttttccccctccttctgtttaatcaagtattgtgcagatttgttcaactttgtaaatatggacatcacttttttttttcctttggaaaaaaaaaaacaacaacaagcccttgtatccgctttctggagtttccagggaggcagctgtctgcatgctccgtggaagccctgcagtgagtgtgcacgctgagactgtgctttttgtttcttagcgggaagctttatccctgtacatacagtagaaaccagaagctagggaaacagagactctatgccatcacgccacacttcatgttttcaaagcatcatgttagagaacagtttgttcaaaccaagaggttgtaattgttttttacattgcaatatgttttgggtctttttcatttttaatcatgcagttaagagatatgggaatgagttttagccctgcagaatgcatgcaggactgtcacagaagatgacttccgtttgtttataccccactgtgtcagtacaaacatcaaaataccatacgtctgaggcagacttcctacatcagggacaggtatctgtgtgtcattatacaaaacagttctagggggatgaactacatagtaaaaaaaaattaaaataaatagtacctagtgtaaaataattttataaatgatcttttgtactttaggacattaaattgtacaacttttgtatataaaaagcttaggaactttctgtttagcaggaaggcaacacattcctacacttttaatgtatatgtttgttataatgtccatgtaaacatgccctatgtttgtgccttttaa

SEQ ID NO: 20369 - DNA, 1197 bp, Mus musculus
gtatagactatagcagagcttagattgggagtgtgaacagagactctgtattcatccttggctcctggactctgaatcttgggtcagttcctgctatcaccccatatccatatttaaaagggatcagccgtgtgtttttcaggagcagaccctccgtcccacagctgagctgggaaggcaagaacagaagggtaaggtgcccccgctaatcccagctcagagaaagaaaatcccatagaactgattcctaagcaagcagccaggagcttaggcctcaccagatgttcagctgggagttttcttgtccttgattccaaattaacaagggacactggagctgctgaactggatcagagtgactgaaagggaagttagcagacaaggtgactcgggatgagccaagttacaggacggtgagctgcagcccaaggatcctgagagacccacgcaggtggctcactgcgttctgactcttggctgagccctgctcttgttcccgttcagcatctgggaggcgttcttggctctctgtcctttctgcttcaattcacgagagttaggatgcacagagggtcatgatgtgctggcaaatggttaaccttctgctctgggtgcaggagaaggctgatatgcaggctggggggatttccgagacatagatctccctaccagctcacttcaaaccaccatcatggctttgaggacatgggactgctagagaggctggaacccaaggccagccagtttcccatacgtgcagcagatcttaaggctgcccttgtttgctccgaagaggaaaatgtaccttgcaagaaagaagtactcttgcaacttgccttaaactcctatagcagggaagaagccgggacttgttctgtaataagagaacagacagaaacagggatggagggtatcctctgacctccttccctagagccttggccaggtgctcactctatctcttagtgggacctcggagacccaatgggcctggtccctcagcaggtgtctcctccttccaggaaccagtgaaaccaaccccactgtgtcagaagatgccttattcagggacaagttgaaacacatgggaaaatgtgagtcttgccccttttcccctccttgtcccagctctcttgaggcaggccctgtggcctcatgagagggagagagcccccccttcccccccccggaagattt

SEQ ID NO: 20370 - DNA, 1178 bp, Mus musculus
tcagattgtgctcgccaccccatttcggtggagaccttctacagtaaagaagctgaagggcctgactggacaggtcttgctttttcactatggaacggtgggtgggacccgtgcaagaagatggaagctgtgtgtcgtggctcgcgcgcgtagtctcggcacttaggaggcgaggcaggaggattgccacaagaccggggccaacctggcttcgtagcaaggctactggtggacttctgtcaaaacaaaaagcctgcgtggacacgctgtaatcctagctctagggaagtgcagggaggcactaaattcaaggtcatccttggccacactctttagtttaagtctagcctaggctacatgagagctaaccaactggacttaacactgtggccatgctaggttgctgtgtgtattggccgtgcctcctttaggcgggaggcccatttcagctcacccctaccaggctgctctttccttcgtttaagttgattcagagactttacaaccctgtggtaaccgactgaccttggttctgttccctttctaaggacgagggatctgatgcgggccggggtgttgaaagagaagccactgtggtatgacatatataaggcctttccacccctgagagagcctgtcttccgaaggccccgcttgcgatacggcaaagccaaagctgacatccaggacatcttttaccaggaggatcagattcgagcgtaagtgtctatcccctatagtgagcagggtgccgcagaccttcagagaggaaggctcatgtagaagtctgccaaccagaccaccagaagaggatatcagatcgcattacagatggttgtgagccaccatgtgattgctgggaattgaactcaggatctctggaagagcagtcagtgctcttaaccactgagccatctctccagcccagaaacagaagttctaagaagtggaatctggagactaaactgacaaagttgcagataaagtgtttgttaactggcctctgttctgtatgaggtacttgatcagcccttgacaaacatcagctcatagactttattactctaaccctgtccgcgaaggcaggtatcattgcctctgtgttattcaagagaactatcaggttcaaggaggttaaccaccatggccaccccagagggcggtggatctgagaatca

SEQ ID NO: 20371 - DNA, 1317 bp, Mus musculus
gaatatcctgggttctgcggccactgcttggaacaagtgagttgctgttaggctcctgaggatgtagttctatagatgtttgtgtgcctggtcactggtacactggcagcatctgagaggcatgcttgttcctggtcctgtaagcaagatgatggtagtcacattctctgcaaaccctcacaggtcagcgtgagactccaagcttcatcagaaggacatgagcctcaggaagacgatgacctggcgcagcgggggcaggtgaagcaggagccagaaacagccccgtcccctccctgaggcccttcagcgcatgagcacgcccatcaccgctggcccaagctgatggactctgatggcctccatctctcaggcacgtgtgccttctcttagtccctgttttcgggatgttatgaatctcagtactgtggtttgaaagcaccagctttgtgaacttttatttcaagacatggttaaataaagggttctccaatgcttacaaagtaaatttactttgaaactgtaaataacaccaggaagcctttaaaggtgccttgtgctggccttgggctgccggcatctgaactctttgggcttctcgtctggatccctcagaatcctacttggccacaaggtccggtccctcggccgtgtctgcgggtggtgtttgtactttttttctgtagagctgttgactgcatcctgacaggcacagcagaggcacagccaactcctgctgcagtaagaccgagtgcctgtttgatgtggacgaagatcacacccagtccttggatgtcacgggttgggttcattgctcttgagatgatcagcatgggcacacagctcataggctgcctagaaattgtttggtgactgaataaatgaccacacctagctaaagactgacgttttcctagtcactggatttccaagatggcaggggtaggggtctgattcaggtggtcttccccacaaacatcctgccgccctggtactgcttccttgtgttgtgttacaccaaataaatgcgatatcctgttgtgatttggctctctatttgtgggtagtttcatccagcagtcaaaagtcttaaagcctctggcttctcagtgcagttctgagtgcaggcctttctccatcctgcactgaaggacagtctatatcctgtccacctcttgcatgtgagtgtgggtgagtctaactgaagtgtttctctgctgagttacccactgcttccggcattgctgctggtttatggttcctcacactgggggtgcgggtgggggaatctcactttgtgatggagaagcaaatctccat

SEQ ID NO: 20372 - DNA, 1178 bp, Mus musculus
tattatattgcatatgaaattgtttacaaaagaaacactaactcatccttctctttatcagttgaaagtgacacacgggacagagggaaattggagggcaggtgagggaggggagagggtttttttgtattttggtttgtttggttttggtttcttttcttgaatgtgctttagtagccagatcctccaaggaaggcaaaagccagccagccagagagagagtagcgaagcgggcaggctgcaggtaagcacactgaacaagagacacactggcaagctcccccacctcagcgagagcagaaagcgaacagctcagcccagtcctgggcacagacactacacaaggcaatgctggaattgaaacaatactttaataccgtttaagtttgtttcctttttttttttcctcttttttttttctttcaccaagaaaagaaaaaagtaaactaaaatacaaaatacaaaaacaaacaaacaaacaacaacccatataaataaaacccacccctctctgggaaacaaccataattcaaacatggctatttagtaatcagaaggtattgtctcagacaggatttcatttccgggaggcagggcgtgaggggggaggggagtgggactgagagacagttccagagcctccagggaaggcttctactgctaactgctgtattctgtatatactgtgccaccctgtgtggagtctgtgagtgtgctcttgagtagcgtgggctagccaatctgccattcatggtgttataaactcggaattccatatgtaataggatgcaagtctaagcgtttcatgtggacataaatgtatctaaataaaacttcccctagcactgtggctgacctcacccttacttttatactttagtatgaaactgatgagaactttggtagtgagtattttttttatatatatacatatatatgtatctatatatatatatatatctcaagcatctttcaggtctttgtgtgtggctttcttaaagccctgttgtaaaaaaaaaaaaaattactaagtggatggcagtctctcacatcacagatgtggaaagtataattttatatttgtattttcaaataaataagtttgtgaaaggtttccatcctctactgtggtccagaaatcaatgtgtttgtctgacaaaaaaaataataaaataaac

SEQ ID NO: 20373 - DNA, 3881 bp, Mus musculus
acgcgcctgacctccctacactacagagcatacctggatgtccaggcaagactgggcgaagtttctgagtggccctttgtttaggtgacgtcctcagacctggacccccaccagcctcactcctcatcccaaccagaggtggcacacttggattgagggttgacacatctcatctcacccatcggctacctgctgtaatataagacaacagcttttaaacgtgtatataatccatgattttggtttggttctgtttgttttccttggtggtccccctctccctcttcccttctccttttaaatctccctcaatcacatttggtagtgatttttgacttagtctggtagtcacccagcttaatatctagttaaagctaaccatagtatacttgttatatattaaggagttttttttctttttttttgttttcttttttcctttaaagagaatttttgttttgttttgattctgttctcgcttttaaaggatgctgagatggtgatgttactctccatttttggtaccagttctgagactgtaagacttttcatctgggactttagcacacactgaatcgaagttgtgatacgcggagcgggaggtgggcatagactctattttgtgttgtagaagtgacatacagttggctgcttaacagactctctagccgttcatttttgtgacgtctctttgttaacctaagtatatctattttcggcaataaggtaaggacggccgtgttttgagggtcttcctttcctatgagtgctttttcttttcttctgttcaaagaggtcatattacaaggttttttgaaattgtgaattctaaaaaacaaaaaacaaacaaaaaaatgttgtaaatataattccattaactacatagaaactattaaggaagagagaatcaaaaaatatttttgtgagggagttgatcctgggcagttaggtaccctggaaggaggggagggaacctcgatgaagccagtacaacaacagaagagcccccccagctgccagggcaccccagacccccactcttcactgttggtgtgatagacctaagaaccacattagcaccctgccagcctaccagcctctctgtgcacagcttctaatgttatgatctagctagatttttatttaaaatatgaaaaactgcttttcccaagacgttttttaaaaggaaaaaaagctacaattttaatatttgacatatttaaagtttcaaagcacacttgttttggcttaggggaggggcagggtggggtcattctttttcagtcttaatttttaaatatctgatcattttatattgtccgatcatttcagcacctccaaagggtcctaggatattctgcctctctcttcaccctgtccccagacgggggaacccgtgggtcaggcgtggataagcctgcgagaatacaccctttctccattcactttctatttacaaattaggaaagcaacctttcagtttatatatatattttttttcctttttgatacctcagtgctgcaagtatcatcagagaggctatggaagagttttgtgttttgttttttgttttgtttttttttttaatttattgtagatgtaaacagaattttaaaaataaaatataaacatcactgcactgtgactggtggggaaaactgacagcttcctgtttgtacacatttgacattggctgttataatatatggtcctcagttggggaagacacttagaatgaaggatgttttttaatttaacttttttttttttttaaagaaaaatatcagtaataggtcggcaacagcagccgtaggaagtacaacttagggtagcattaaagcatactgtagtgtggatatattttttttcttttttaaaatgtgatattgacattttattaatattttttaaattgttacgtttataaatttggtacttaaggcacagccagtgtgaggcactgaacgcgacatttattacaatgagctgctgcactcctacttttataaattttactaacaagtagactaatgtagacattcacagacgggatagcgcagaagcatcttcacacgacaagtctccaaaaaaaaaaagctaattcagagagggcgggaggaagcctgttcccgttctaattaagtgcaaccttgttttatcttattgttttattttttaagaaaggaaatcatgttctttttttatatctctatatataagatacagagttgtttggtaaggtttggggtgttttttgttttgttttgttttaagtttccaaacaaccaaactaagaaaaatgctggatgcttttagaatacaaaacttactcaagtcataaaataacaaaatagaacttttactttaagaaacaacaacaaagagagagagagactcgattcccagcaagtcagtgtctcacaagggcactggctaattactcttctgtccgcgttgctgatgtcctgtccccagcccctgtccatctcccccacactcccatcacctcatagaacgctctttgttgatcattgtctgttaataatgtataaaatggctatcttgtaagtgtgctgtcttggtactagtgtagtgactttttttctcctcttctagtacatattgataggtataatgtaattaaggttttaaaaaaaatagacatagttattcagattaggaccagtaaggatagaactttctcttatttatgaaaagaaaaaaaatgctaataatttgggggcagttttttcctttttttttttttccaagttcaaatttacttttatttttgctgatttgatgtggtttcaactaacccaaggtctcacaatgttcaaatggcggctgactctacagcattctgtaggtccctgcccccctagctgaaggggtgtgccatactaccttaaatgcaaacactagatatgcaaaactggatttttttaatttattttttaaaagagggaggtgtggtatattaaaatgattttactaagagaaaaaaaatatttttttaaggatgctcagaagaaattgataatctgtgtgaatatgttttagatgtttatatacattttgaagagacccagtagcccatagcacaaatcttgtgaacatctgatatgttttcaagtggctacctaggataaggttcatcattagtacccccacccccaccccaccgccatctagaagtccatcttaaacaattttttgtaaattctttcagcactggtgtccatctttgtctttgtttcagttaagctcaatagcgaatgtgggaccccctcctctgaccttccctgggggagaaaccctcttggctaatggctcttccctggcattatcaataaccacccggggactctctggctttcagatccatctgcctgagaccccaaggtcctctcctccctagaggggaggtggagcagcagttgactcctggttccctccctatttcagcctggatgtggggctggtggagatgcctccaccccaggagcctctgcatatgtggttcgtggccttcttctcacccattgggaaaaccaaacagcctcacactctgtccccatcgctcattggcttaactcaagtgagaccccaactgggcctttgcgttttgtttttgtttttttttaaatccttcatgaccattctcttaatttgaactcgtagcttgggctttaaggtagcatggctcgattgctgtcgacttaatgttccactgcacagcaattcacggccagtgaatgttacacacatcttgctagactagtataaaaatcattgggtaattgttggttctaatgacctgaaaggtgttcagtttgtgggttttttttggggggggctgcttggggggttgtttttc

SEQ ID NO: 20374 - DNA, 1099 bp, Mus musculus
tattagtgcttacatcaaaaatggattaaactcctgcgtctttacaatcattaaagacggactactcaagtggaaagccttctgtacagatccttgagggactatgccctcaacaccctcctcacccaccagccaccagccacacccagatgctgggtccccgggtgccaagatgctgttagaagtgattgggcagcaagtgccaatcggccatgaggtgtcccagctccccacaggacccagcagagtgagatggactttgagggctgggttagttctctggggccccccactgtgtctgggccttgatagaagtgacagtctcagtaagggcttggccagtggcccacccacttactgactcccaacactgactacatttctgttctttgccacaaagttctttgttttatgccacagtggaaggttaccccagtcatcagcagagatgaagtcccctatgtcttcataggcaccacccaaccccaaggagatccctggctagtaacagaggtgtctgcaacatcaaactgtgattcaaggagggacaactgagtcgtgtcacgactgatgtcacattgtactttcaagttagaactggagacagtcctaagaccctgagtttgcttatctattacacagcgtaatgaaacccatcttaaaagctgttgagtgagtggccctcctagcctggccctctcttatcccgttagctctcacctatcttggcccagccatgtgtgatagtagtacatctcctccctagccattcctaccagggatgtgctgaccactgactcttaggtagctttcgtcactgctgctggaatacagtgctagaccatcttcgtcactgctgctggaatacagtgctagaccatcttctaagtctatatagtcctagccttggatttcatagtactgtagcatgtgtgtagtacagagaaatatgcattggtcatataagaagtaacgtatgagacacaagggatctatggctgggacaggcaggggtgagaccttcacgatgagcagcatagcaataagtggagatgactggagacacacgggaaaaccatactgcttgcttccctagtaa

SEQ ID NO: 20375 - DNA, 1225 bp, Mus musculus
gctgaaaagactagtgtagagagagcccctggtacccagccatgaagcctggattcacctggcaacaagtagggaaaccccaaagcaggaagagaaaccagaggtgcgtgattgacataccttggcagcattattcagggtagcatgaaggagctggtaattcttagacattgtggcctctgagtgcacatcagtaaatacctacataagaggtctcatactctcctcaaccatggcgacggaggctgggctagggtacggaaggattctgtggagactcagtcacacagtcaagtttccgatcaggctgtaggtgacggagagctcggcagccaagctcagtacgtgaggagagacctgcccctgccttcagagattgggaacagaagactggctactagggagtgcaatatagacttaaagagactgggctacctagaagccagccagggtcactatgtatattgtggggctggggactggttcaaattcttcatagcagtaaactgagaaagacagagccacctaagagagatgacctgggcagggccccagagcagacacaagtctccattttaccttcagtgataagttatcatccactcccaccctcaggatgtcagttctcactccgttgccctcacggcagcctctgccctcgtcctttctgctggtccatctctcattgcccttgtctggctcggactagtagaaagacagccacacctagtgaccggaacgtctcaaaatatacatctgctggaagtttccttaaagagtaacaggagagtattagaaacattcccctactttattaatacaataataacaattcatcagtagttgctcacattatgtgagtcaagtgctgtgtgcgccaagcccacacgccatacccctacttaattcggaagccataaatgggtgccatcagtccccttcccattttagagattacaaactgtggctcggggaagagatagtagcttatctgaggtggcagtgacaggatttgagcctgtcccatcagcctgtgttctgagccactatccacacatgctctgttgtgccagtctctctcccgcggtggttgagccagactgcaacttttaaacactcgacagaaaggtgcagctgttcccactcaattcttcctatccttaggggaggcgataacccaaaatcatttacaagtggtctcgagaggcacgctgtgcatttttgc

SEQ ID NO: 20376 - DNA, 1174 bp, Mus musculus
gaattaggctctaaagagagtggggcagggtggggtgctggtggaagataccaggaaacggattgttaaaggcccagagggcaaatgccaaaaacccaaactggtacggtgaggctcgtttgaaaatgtcagagaaaatccgttccatgcaaactggcactgcctccaagctacaaaggatcccctcccccaaggtacccactggagttttgggggtggcccaggtagggcattaattgaggtgggggctgctaaggggccgtttgccagagcttgtgattggcaggcaggctgggaagcccagatagctgggccctctcaacttctacccattctagtctgtgacggtcccaccttgccctctggccagtgtcccttggtgatcctcactcccaggccctaagacaggtgcacagttttgggggttttattatgaatgctttgggagaatgaagagaaaaaaaaaaaaagcaaaaagactcattcctacctgtgcctgggaggggagaaagatcaaaagaacagccttgaaatttgtgagtgttgtttgttttctccgatcagtttctttcttttgataacttggattattgaaactaaactttaacccaaaattaaccctgcctctctccccaccccaccccctccccccctcccccgacttcatggcaagtttaaagggcagtatgggattctttgcgagtctgagagccgcctccccgggctatgcccccttctgccactctgcccatacacagacccctcctcccccctccctatccaggcgggagccccactcacccatccctctaactcctaaccctcaaggtcatctccaaccacacattttgtttctcggatcagtggtgttttatttgtagccatttccatcgggagccaaatctcccacaggccatcaaggtcagccatattcatcgctgcactgttagtgaattgtattcaggaggacgctccccaaacccctgcccaccccagcctgggttgttagtacaaggagtaaatcctcagcttgaggtacccacccacgggggagcccccagcactgcctagtggctgtaggcttgggctgtacccaccatagagagaagcccagcccagagccccatctttagacttggaccaaagctgtcaagttggggaagggaactctgcc

SEQ ID NO: 20377 - DNA, 1206 bp, Mus musculus
agcatagtgggagccattgatggtacttggagagctgttgtgaagggcagtccttgcctattcctgctacagtgacaacaccataacctggggctaactattccctaaggagtaggtgctggcaagtccaaggtcaagttacctgtagattcactgtgatggtgaggactacttcctggtccacagatgcctgttttcttgttgtatcttccctttgtgagggtggggcatgggactatcgaactctttggattctgtcttgttttcttaaggtgagtatttattatgtatgtgtatgtctgtacatgatgtggtggagcatgcctgccacagagtgtgtagaggtcagcgaacagctttatgttgtaggtaattctcctcccaccatagatgaacattaggggttaaactcagatttctaggccagctcagcaagtgccgtgtcctgcagagctggcttgctggccctggattctcttttattttttattttatttttaatatttatttatcggtatataggtacactatagccgaacagatggttgagagccttcatgtggttgttgggaattgaagttttaggacatctaattgctccggttggccccactcactcagttgctgcttgcccaaagattgatttgttattatacataagcacactgtaactgtcttcagacacaccagaagagggcgtcagatctcattacaggtggttgtgagccaccatgtggttgctggggtttgaactcgggaccttcggaagagcagtcagtgctcttaccagctgagccatctctccagccctggattctcctttataaaggcactaatctcactaagggggctccatcctcatgcctactcacttcccaagggccccaccccctaatacctagcagatgagaatttcagaccgtagcatgtaataaccaaacgaagccttgaaacacaaaaagaagttcaccaggtaggggctggaaagatagctcagcagttaagaacactggctgctcttgcaaaggacctgagttctgttcccagcacccacatggtgcctcacagctgcctgtaactccagcaccatggtatgtgatgccttcttgtggccttcacagatacctggcacttgggtggcatgcacacacatacacataaataaaaagtaaaagaaggcaagtttcctcagttgatattaaaaag

SEQ ID NO: 20378 - DNA, 1154 bp, Mus musculus
gtggactgtggtatgatacttctgagcctctgatgttcagtgtttatctgggagatggagccaggactgagtaccctccctgtatcataagagagggtctctgatggtctgatgagaggagtccctggcaggcaggaccatcaaggaatctgtctaaaaggccaaacaaccatgaaagatgattataattgctgctgctgctgctgctgaggctggtatctgcaggcccgtccatcagctgtccccgcctccttagccctcaggccttctgcagccactgggttgcagccctgcgtgtagcgtgtcgtcctcactgcccttccagaacctaatttcatccttgtaggtttttccaaagcagaatttgcacaagtggtgtggtttcttaaatatttattttgcaggccatttactcagcacagctatttttacagtgagtaaggagcaaggctaaaaataacagctcgtaacccgatcgtttctgcatctgacatttacgtggaattcatttgcatctcatttgttctccttttctgtctaacaggtagaatgtaagaaagctcagccgaaagaagtcatgttcccacctgggacaagaggccgggcccgggggctgccatacaccatggatgcgttcatgcttggcatggggatgctgggtgagtctgtataggtgcggggctgggggtgtgcagtgggcggggctagcggagcgcagtgggcggggctggggaaatgcaacaggctggggatgagggctgtggcagcctgtacctgtgacccacccacctgagtcacctggcagttgggcaaactgaatccatctgaacttcagtttatctgagctgctgttccctcatcttctaggtcgataggtttgcctttgaggtggtcttggcaatctgttgagcgtatagcattatcacgcctcgagcctagcttgtgatatgcttgaaattctctggccatcctcttccttaaactcgacacaggacagcacacccatctctgtctcagccttcttggcccagtgagagctcctctgaccaaaggattctttgctacctgaacttgtgtggactcgggttactttttttctaaaacttaggagaggaactgaagggtggcaagggtgggcactaatcctgtctatt

SEQ ID NO: 20379 - DNA, 1159 bp, Mus musculus
caggggcctggagagatggctcagcggataagagcaccctctgctcttccagaggtcctgagttcaattcccagcaaccacatggtggctcatggccatccataatggaataccctcttctggtgtgtctgaagacagctacagtggactcatataaataaaataaatcttagcttttaaaaagaatgagttctaggacatcaagggctacacagaaaaatcctgtcttgaacacacatatgcatgcatgcatgtatacatacatacatacatactacatggataaataactcttcagcatcttagagctaggacaggctaggaagcccaagaaagaccatcatgcaacagttttccagtatatccatttcttgaaaacttgaagaaattttcccctagggtaaggtgaggtagaagtctgggcaggaagtctctacatggcactttctgctataggttgcagcagctaacattttagaatgtagacattttgattgctggacacttgcttggtacatcttacctgatttgattgtcacacgccttctagtattaaaaaagatatcggggctggagaagtggctcagcgggtaagagcactgactgctcttccgaaggtcctgagttcaattcccagcaaccacatggtggctcacaaccacccatggtaagatctgacgccctcttctggtgcatctgaagacagctatggtatacttacatataataataaataaataaatcttaaaaaaaaaagatatcaaaccattttccccattttaaagacaggcaaggcagagatgaagcaacttgcccaagaccacacagtcagcaagtggcagtcccagaattcaggaccagaaagctacactcttgagctcatggttgaaccacgaggctggcctttctctgtagaccaagaaggaccatgatgagccaggcaccagcactcgggaggcagaggcaggcagatttctatgagttcgaggccagcctggtctacagagtgagttccaggacaaccagggctatacagagaaccccatctcagaaaacaaaaaacaaaacaaaaaaggactgtgatgatgggattgctggcgtataaggctacccatggccacagagcatcttttccccctcagcccatgtagtttcttga

SEQ ID NO: 20380 - DNA, 1178 bp, Mus musculus
gaaaccctctgggaatggtgggtgggtatggctgcctctttcccttccctcccttttctctctccccctcctcccataagcccgcctcttcagctcaggtatatcatcattccctttgtaagtagagaatggcaggggaggggccggtgtctgggaaccgcgcatgttgttaatctgttattaggcataagtcttaccaccaggctgggtactcagatgcctcattgtgtgctcgggatggaattatgcatcatgaataaaaactgctgtcaacatgcattggtttgaaaacattagaccatatggtatgtgattatctgtattgtcaagtgcaataaagtgaatttggatataataaagaatgtaatattttagaaatttggtaataaactaagggaaggatgacagctgaggttccttaaggccccagacacaaataaattgaagttactggcctctaaggccaggcaggccgaatggccacaccgtggcttagctgcatgctgtgatttttcaagtcagggaaagctctgttgtcccctgactgacagctctcaggactgtggaaccgaccgattcctgtggaagatgggaggtggtggtggctcctggtagaaggtcaggccttgctgtcacacctggcccttaggtataccctgcagcctgctggtggcgttggcagcttctccctactagtcaagggcagtgccatgccagccatcaagacatcctgagacccatctccccctctctaatcttctcagtttggttggagaggaaggtgtctcaatcttgagaactataagtcactccctggggaaggtagccattttctggaactcttctcccactgggccaaatgatgaaataatttctttaaggcagcgagtgtgtcagggcaacagatctccagcgagggatgaaaggggcaggggcagcggaggaagagggctgggaactgagtcaagcccgagtgtgccagcacatgtaacccttctgtaactgtacgggcgctcagaggaaccttccacctgtggacaagaaaacagaggttgctggtctgtgagtctgagatctttaacgctcctatagcagcttctcccctcacggtaaccaaacacatgaaggaaatgatgtaagcgaaaatgatgtaagctgggcaaggttgttttgactca

SEQ ID NO: 20381 - DNA, 1155 bp, Mus musculus
ggtgaaccagcaggacaccagccgtccttaatcccaagtgtctgcaccaagtgagcccatggatggccgacctctgggggaggcgggaaaggctagggaagcagacctgtttggatagataaagaccttgagtctgcagaggcgcggagccctgtgagagcgagcacgctcaggagaacacttacaaaagcaaactgaaaggaaattacagggcgttcacatacatgatggattattacacatccattaaaatgatgtttacagagagtttttaaatgacatgtgaaatggcgatgacataatattgcatgaagaaagctataaaatttatacacactgtgaatcacattagaatgagcatcacctgggactcttaaagaatatcaattcccgggcccagcttacatatcaaggccgtctccgagggggtcccgggggtccttgcagtctttcctcccctgaagtctttgatacatcaggatgtatctgagagtaactacctcgagcagcagggtttttagtttgtttgtttgttttttgtttttgtttttaagcagaaaaattctccaagctgtgacaagaggcttctctggtggaggagttatggtggactcaaatctgcaccgtaatcatttgagtcttccaaagctttgccggggagctggttctagagacccagccatgcctctgccctgccctcccctccccgactctccccgttcttttggccctcaatctcagatttctactagcctgggaatgtatcacggctcactccatgagctgtgcctatttaaactatttctccagacagcaagctacttgttacaaagcgggaggattcagaatgcccatacttcattgggtgcagtctgagttctgcagtaagcagagggatgtgtgctgttgtatgtcatgtctctaagctgtacctgatagatagatagatggtcgctaaggggagggcgtcctcatgaactgatcttggagtctagtgtctgagagttggtgggggtcagcttctccccaggactttgctgagcaataagttgggcaccaggttgctttaccatgtgcagatctgggcaaagcccgagctttaaggtgtcttgctgtgtcacagtgaagcctggggcagagcttcaactgtattct

SEQ ID NO: 20382 - DNA, 1216 bp, Mus musculus
cagacagtgaaaaccatcttggctagcgagtcctggctgaaattgagcggccacaccctgcacactggttcaacttacctttctcgccctggctctcttagcccctagccaacctcagcactcagtgatcccagtggaaattattcatggtgattactcaatctgactctcaatttgcatcaagagggctcagagagcagcctgtcagcctaagacttgagtgagaggaggtggaaaaaaccctgcttgaatctgttagcagattaccacacttgcagatctggacggtcctgtggagcttcgaagtgcttggggggcagctgtacctgtctgttcccctgaccaatccatgttatagaaaaccatatatatatatgtgtgtgtgtatacacacatatatatatatatgggtctcactcaacctggggtccacaaacctttgaaatgatttgcccgatgtctgagttttgcttgggagtggatccctagtgttgaacagatttgtcaaagagaactctcagtggcccctgccagcaggaacatgttcaaatcattgctttgaatgggaaaaggggaggaatctagaccatcctccttgagacggaagtctgaggaggttatgactcggtgcagtattttgctgtgctctggaagtgccctgttcctggggtcctcattaatggggtgctaatgagcagtgattttgaagtggggtgtgaggaaaggctctggagtgtgctccagggaaggagtcctgggtgaacttaaagacctgtttcctttgccacatctattgttgcttccactccccgatatcctctgtgatcagagcggtgactgtgctggttgcgcctctttcctgtctgaggaagcagcgagtgaaaggcaggaagggatgaagggggccagggagagatctgcatatcctgtcttcatatgcccaactttcccctcgatggagaggtcaaccctggatggaccagggcagggtagaggatgaggagagaaggcaaggaaggaaaaaaaaccatgtaaatgctctctctccccttccccattaccctggagctggagctggaggagagctaccaagaggaaggtgatgttcagtttgtgattattttctgtcatcatcaacattgtcttggtgatgttatcgatgcctaagtaccacgctgggagggacagcccaggctctgtagtctgtttcagatga

SEQ ID NO: 20383 - DNA, 1205 bp, Mus musculus
gtttggtctaacctgcgctaggccagtcatgtgaacttggacagggccctgtggccagtagaatcctgaaaagtttgcagtgacccgtgaggaaaagtaggcagttacaccctgacagaatcagtagcagccagagaagtgcagagcaagtgagggacatgtcaggagggaggcctgtcaaaggaaggaatacacaggtcttccctaatacttgaggaatatatgccaagactcccagtacaaaaccgaacctggggaactgggaggagtggagggaggggaaactggttgggatgcaatgtctgagagaagaattaggaaaaaaaaaaaaaaaaccaaaaatgggaactgaagatggatccatatcccgtatgctctctctctctctttctctcttcattgccttttccaatcctgatgagtgcgtatcaggctatcaggccctgtggtctaaactcttgcagtttaagatacaactgcagggctggtgagatggctcagtgggtaagagcacccgactgctcttccgaaggtccgaagttcaaatcccagcaaccacatggtggctcacaaccatctgtaacgagatctgacgccctcttctggagggtctgaagacagctacagtgtacattacatgtaataaataaataaatcttaaaaaaaatacaactgcagaagtagagtgaatccttctctgcttcacaattttcaacaagtggaccctcatgacagcactcaactaccttttgttcattattaaatcaagaactttcaccttttcacttaaaagtggtgctgtatagtttctttttggtgtatttaagtgtcagtctccctgcccttgtgcttcgagactgccaggaggccataagggatctttgagcataagcactataaaaccacgcaggtgaaatgataaccaagatgtctaccaggcttgagcaggtggcctcagccatctgtatacagtaagcaaagaggaaactcacatcccagacaggacaggacaaagatctagtgagttgtttatttttggaatttcctattcagtgaacacatggagagtaaaactgcagagaagaggaatataccaggaagtcaagctctgagcctgggggaaagggagtgggttggcatggggtgcagcttgatattaagacacttgagaatttgaggtcccagaatattgatgtgataggcaa

SEQ ID NO: 20384 - DNA, 1194 bp, Mus musculus
acttcaggcatcaacctctaggaagaactgtgaaatgtgagtgcatttctgcattccccagaagtcctggaggcaggatatggctggccaagggaaaggtgattgtggctggttgatagagcctgcacaagtattgggtgagtgaaagagagaagtgtattgatgtaagagtagaaggaagggcagggggctggtgagatggctcaacaggtaagagcacccgactgctcttctgaaggtcctgagttcaaatccctgcaaccacatggtggctcacaaccatccgtaacgagatctgactccctcttctggtgtgtctgaagatagctacagtgtacttacatataataaaaaataaattaatctttaaaaaaaaaaaaagaaggaaggacagatgtctagatagaagggtggatgaaggcattttgggtggtggccctagtcaataaaggtcacctcccttctgccctggtctcctagcttagcaactgctccatactgagaggatgggaaggggactatgggttgacaccagaggccttgtgtgatttcaggtgagttgagagggtgtgtgcttgaggatgctgtgagttcaatacatgatgttccttagaaacgcatcccccatctctgcagctggggaccatttatcattagcacaggtgggagagggaaggctcctagggaaagggtgaggactctcaggctcctaagatgacgcttgtttggtgacaaatgaggtggcctgacaaaggtctcaaagcctggtctgagcactttgcacgcctccatgctggttctgggtagcacagctgaggttggcacggtctgcccagaccgtagatggtgacctgagaggagtccatagctcaccatgtctcctagagacaccagaccacttcgtgttttgtttctgtaaatgaccttctggtgatttcttcatccttgaaaactggctttccgtgacccttcaacatggctgcccaggactagctctccctttgtttctgtcttggaggcggaaatagaccttatatagtacacattgtataatgtacaaagttggtcgctgtctaaggagaacttggtgggtgtcaagaaccctctttatgctctgaaatccagaacagctctggccttgtctccttcgaggagtctgccagaaagacagacgtttaggtccctgccttggct

SEQ ID NO: 20385 - DNA, 1209 bp, Mus musculus
ccagaggccagctatgctattcaggctgtgtgtctgtgtgtgtgtgtgtgtgtgtgtgtgtgtgtgtgtgtgtgtgtgtgtgtgtgtgtgtgtgtgtgcttcttcctgtttaatgagtaggaagaaaacttctgagtagagcttgagtttgaggtggatctttggtacagaagttaaactggcatgtttggggactttctcacaaatgtccttgtgacatttaacaaatgacctttgtgctaaaattgaggccctgtcagggtgctcactgcagtgatttttgagaagggaccagaaggagtgaggtataagaaggtgaaggacacaatgcatgactgttgaccaaggtcagagcattttagcaaaagggcatggagcggcctggagacaggatgagacgtgagtgagttgtctggggcttttgagtccttgttgtcacaataatttagtgtcctcaggccctgactcctgtcttcagattccttgaagctaacctaagcaacctcggggcttagagtggagccctcacacttgattagacagtctttaaagtaactgcaatcatatgttgatttatgcacctgtagctcaacaccataggacacagagagtcatgaagaaccaggattggaggtaacccaaggtgggcgagagaaaatatgcagacagtggggcatcatgccaagtacaaggggccaaaggggctttgagacctgagcaggagctggagggacaagtcagagtctgtggcaggatagcgagctgaaggttcccacggtgaggaacagcactggctgacttaagggcaactcagaggatggattcggagaactgcagaatacggtacccagagctgaagcgaggcttagggctgggggtgagggggccagtagatggaaaccatgtctcagtggtccggtggagtgtggctaccataggctctctaagtagcatgtaaactctgttgccaaaagttaagattggccgagaaagtagcatgctctcaggcggatgatacagccaggctgtgtcaggaatgtgcttgggtgacagccgatggggtaaggcggcatgctgtctcaacactgagatcctcgcttcttctggcatgctctctgggaaagcaggttggattgtcctgcggaccgaagcaaaggctgagttatcccctcccctcagtgttccattcctctgaaatgggattggtga

SEQ ID NO: 20386 - DNA, 1188 bp, Mus musculus
gtaattctcctgcctcagccaccatgctggccactgtgaatatattagagatgcttttatgtatgtgtgtacatgcagtatgagtgggtaatagaattatatgaccactaatatgtgatattttaaaaatctaaacatcctgccgggcattggtggcgcacacctttaatcccagcacttggggaggcagaggcaggagaatttctgtgttcaaggccagcctggtctacagagtgagttccaggacagccagggctatacagagaaactctgtctcgaccccccccccaaaaaaaaccctaaatatccataatatgtgtgtttatattatatataatataatatatatttaaatataaatatatatttaaatatatattttcagatcatattcttcccctagggaaaaaggagctattttatactctcaacataaatctgggatattagctttgcttgattagcgtttctattgctgtgataaaacactatggcagaaaacagtttgggaggaaagggtctatttcagctcatacttcatcaggtcacagtccatcactgagagaagtcaggacagggactcagacagggcaggaacctggaggcaggagccgacgctgaggccatgaatggtgggatgctgcctcctggcttgctctccatggcttgctcagcctgcttccttagagacccaggaccaccaccagcccagtgaccttagaaaatgtcctacagacctgcgcacaggccagtcctatggaagcattttcttaatttaatagtcttccctcccagatgatcctagcatgtgtcaagtttacaaaaccaaaaaaccaaacagactaacaacaaactagccagcatagaacttagctttttaaaaatatcaacgagtatttctaaaaataaaagggttaatggtagaacatttgcctgacatgcattataggctataggtttgattcctagcactgggggaaaacaaaaatcagaaaaagacccagagctacttgattaggcaaggctgagttttcagccttgagtttcttggtccacttggccctgactttccacattttgttcttcagtgtgtttggtagcctctctctggggcttgttgacctacctaacttctgaacactaacctacttacttgcctaagcagcttacatggttaacatttaccca

SEQ ID NO: 20387 - DNA, 1202 bp, Mus musculus
attatcttcgctctaaggtgggtcaaggtctcccttcccagaggcgcttgcttctttttacgttttcactggatgtcgcccttcctcctccggccggcagtgaagctcggctgcacactgcatccgatctatccatctgacagttaccttggtctctcctgttctagcatagcacgtgtccacacatgtgaaggtccacacccaagtaggagaagcagcagtccaaatcagtgtcacgctctgcccagcatttagttaccaggtgccttttgacaaaagaatcgtgccctctttctggtttcgaatggaagaccttttgtgtatttactgcaaatatgataaatgctagtctgaggggagaccagctgtccccatggtaagggacagtgtgtttaacacctggcagtttgcatttcaatgtggcagattaaaacacacatacatgccgggcagtggtggcgcacacctttaatcccagcacttgggaggcagaggcaggcggatttctgagttccaggccagcctggtctacagagtgagttccaggacagccagggctacacagaaaaaccctgtctcaaaaaaaccaaaacacacatgcgcgcatgcgcgcgtgtgcacacacatacacacacacacacacacacacacacacacacactcactctctctctctttctctctctctctctctctctcacttacactcacacacaccaaagcccaacttaaagcagtgatctttctagtagcctggagggaaacaagaacaggctgtggcagacacaggcatcagcagatgtagagacctctctgagaagttcctgatggcaggagaagtcaaattacttctacttcctgtctccagggcagcttgaagcataccttctgtatctcagacgttgtggttggtaggatattataaatggcagaaggtcagataatgtgggcagtccaacgaatgaccagagggactggcttgtgtgggcaggtcaggacatcctcccaggcaggagactagattagagtctgaaatgtagggtgttgccctcttaggatcaaagtaatatggtaccacaggctgggtgacttcagcatcagaaatatcttgtctgtatagttggggagctgggaaagtccaaggttaaggtttcgggatgttggttcttcaaaaaccagggagaaaagttcggttctgggcc

SEQ ID NO: 20388 - DNA, 1461 bp, Mus musculus
tgtttcgtttaaactgtgtgtatattataaacagttgtaaactgccttatgtgtgctaggaaccaaacccaggcgcctctataagagcagcatttgcctttatggagcagtacttgctctcctctctccagcccctgtctgggattttaaaacctgcgtttacattctgtgtgtgttttcaaaaaatcgtgttttgagttttggtttgatttttgtaacacttttttttctttttcttttttattctgtttgttcctatttatcttattttcttactacttaagaattagaatattatgtttttaagtgtctcactatgttggcctcccagatgctaagattatatgtataattcctgaacattattgcattcttttatttctccaatgtatcctgttactttccccccccctttctccccgccccccaggattgaacacaaagcctcatgcatacttggcaaattctataccactgtgctacattcccagccgctggtggctctttcttagtttcttgatgggtttttccatcttattttgatttggtttagatagatttggtttttctgatacgaggactcttggaaggagcccgtgttggccttgaactgcctctgcctcttaaatactagaattataggtatatgctaccatgtacaacctagctaattcattttagacttttgttttctgatttataagattacagacttctttctaggtaccactcaaactgtattccccaagatatataggtttttagttgtttttttttcaagacaggttttctctgtgtttttttctctgtatagtcctggatgtcctggaacttgctctgtggatgaggctgtccacaaactcacagaaatccacctgcctctctgcctccggagtgctaggagtaaaggtgtgtaccaccactgtccagtgatgtataggcttttaaatgattatctggttaataaaaaatcaaaatttctccaggacagccaaggctacacaaagaaaccctgtctcgaaaaaaaaaaaaaattagaatttctacgaatgaaaagtatttgaaagctgttattaatgtttaaccagactgaattagaatttttcctttttttttttttttttttttttttgagacaggatttctctgtgtagccctggctgtcctggaactcactctgtagaccaggctggcctcgaactcagaaatctgcctgcctctgcctcccaagtactgggattaaagacgtgagccaccacgtccggcagaattagaattttttaaaagggtagtttctacatgcatcagagactttgtgacttactgtagcttgctttggcacatgatcagtattttataaatattttgtacattttttggaaagaatgtatatcacttattgataagtaattttctagatgattcccatcagatcaaacttgctgtttgcattaagatttg

SEQ ID NO: 20389 - DNA, 1638 bp, Mus musculus
gtcatgtaatgggtggtgccatgtagtgtcatgaagctagatgtgctattgaacatgtaacttctgggacggtctctcccaacacaaagtacccttagttccaagcgggggagaccccactctagaccttccaggacctctgtccattgttcctatccttaccatcaagactcggtttcttcaggatgttagaagcctgtgccagagggcacaacatttgagtaagaaccctgttgtggttttatgcgccaggtctgcacccattccctggctgatgcctggagacttgggttgaaggacccacgctgacttgagacctagccccttgggtgccatgcagagttctcaggaattctctcttttttttccaggtggtgttgataaaccggtcgctggtggagcgaggccttgcacagtgggtagacagctactatgccagcctctgaccttggctcctgagttgcttcggtcttctttgcactgttgagagtgggtttggcacccaggacagagttttaagagcagagtaacaaacactgttctcactgagtcttctttccccattctgtagtcctgtggaggaggagggtcctcccaggaggacctgtgtgttctttcaaagccttagagtggcgctacaccggccagctggcttagctgcaggaaggcctcttagccaggctattcccattccatccgctcccttctccccacccaaaccccacactgcagcaggcaggccagggcgggtgtggggctggctgagaggatcaattttagagtctttattcagggagtgagacatggactaattggtatcgattccctggatagctcgcttggatgaattgatggtgtttagcagtttttatatacttcctccgggtctctaggaactcagacttttttaaacatagatgtaaataaggaacagtttgtcacacctgaccccagtgagtggggggaagggcagctgttatcttgccaagcctggttgtaatttgtaaccattttctatttgttcgaactctgtaaataatatgtttaaagatgtaatattttgtacaagacacactggagaacaaagggaactcaaaactcttccacattcttcccgaggaaatcgacgacgtccatccgtcccacagagtgggaccgaccgcccctgctgctccagccagggcccctgcgcttcctgtgcagacaggaagctgtgtgggagactgtcatttgggaatttgatttttttttttctgtacgaatttaaaaaaaaaagaaaaaaaagaaacttcattgaattaccttgcagtggtgttgactcttttatagactgtctttagcattgtgcaatttaagaataacttaaggatcttggactttacataaatcttgaattgtataaactctaaccttgagtccattttttcttcagtggagtggtgacaaagatttggggctgggactaagggtggttgagagtggtgtggccagctgtgactctccaagggccatcataaaagaaagagaagacccaaaatcttggaagacattttggcctgctcttccccctgcccccaccaggtggcaacccagcttactctggctcctgcattcagagaacactgggtgtggtgtagg

SEQ ID NO: 20390 - DNA, 1165 bp, Mus musculus
agcccaccagtgttcttaggcatgttgttctgagcaaactgctcactcccatacttgctttccttgacttcagactcatgttcagcagttaggagcactgcttgctcttctagttcaaatcccagtgtccacactgcagctcacaattgtctgtagctatgcgcgcgtgtgcgcgcaaaatatccatactggagtgattgcatgctccaggagatggacccttgtcacagagtcagtcagcactgcatatacagttggcctctggctgcctattttgggctaggggtctcccctatcttatctgaaggtgagatcgactctaaaggcaggtctgggtattacagtacaacagcctacagacctctgctatctgggtgccatgttcctgatggctatgccagttcatgggcttgccctggggccttgtgacataaacacgagaataacagtgttggctgcctcttcctgtcccctagctcatgctgcctgatggtatcactgtggaagtcatcgtggtcaaccaggtcaatgctgggcacctatttgtccagcagcacacacaccccaccttccatgcactgcgcagtctggaccagcagatgtacctctgttactctcagcctggaatccccaccttgcccaccccagtggaaagtaagtgctacctagagagtcagggggagtcctggtgcctggttaggactctccaagacatgtaggcaaggagggttgcccacattacccttggtctggaccaggaaaagacttgttcaggactcccttgtgtgccagcgtccataagttcttgcgctgttatggggttatactggtttgagttttctggctagccagtgttagcttgactggccaaagcagtacagattggagtgatgtcttgacgggcggactcttcttttaaacatttttttaaagattacatttattcattttgtgtgacgtgtatttttgcctgtgtgtatgtatgtgtaccacctgtgtgcttggtgcccatggaagtcagaaagggcttcaggtcccctggaactgaagttgtggatggttgtgaaccactgtgttggtactaggaatcaagcccaggtctttctcaagaacaatatgtcctcctaaccccagagccacctctccagactgggctttgtgtctt

SEQ ID NO: 20391 - DNA, 2678 bp, Mus musculus
ttccctcacttccctgctttctgggtcctccaggctgctctgtgtgggttggggctcggtcttccctgaatgctagaaaacatcagttggaggagtgagcgccagagcctccctgctcctcactgtaaaggtgtctagatgacttagctgagctcagctgctgtaaaatccagagagcctggggcagaagcgcaggcaggcaggcaggcaggcagcccgccctgagcggctgtgtgtgagcatgctcattcccctcacctcacaccctgtgattactaaacaagccaagattgtggtgtcttaattaatacttctaaatatttaacaatttaattttcccgtgctggtttttaaaaacattgttttaactgcattgtgcattgtatgaatggctggtgcttcaccagcccccagcgcctgagtagttttctagccccttgctgttagaacttaacaacttattagtgtttatcgccggggttcagaagtaattggcagactaccgaatcccagggcgcttggctccatgctgagctggggagactcagtctgaactttgggtcaagactcctctgctgaccccgggctgctggctcccatggtagtttccttccctcgtgaccttgttatcagtcctgccctcagtggtcacagagggcatagtgaggcaggccctgggtgagtagggaccgtgtcccttgccaccctccagggctggggtcattaagaattgttgaggagcttgtcttacattatgcttacggctggcgtcttctgtttgccgtgaactctggtgcactgggcacttgtatatgctgttagtggtagggtgggagtgttgcatgttctcgggctttcactgtccaaccaagttcctctgtctgtggccctgagtgaggggcaaggatggatgttcagaatttgagtcaactcttatagcagtggatcattcagcgtgtgtgtgcccgcgcgcgtaggaggggtgctgtgatattctgggtctgggccatatggttgggatgagatgctgagtcccaggccaggctgtccctttcagctgctgagcagctgtgtggtcttgggtgggttccggagcatgtctcagcctgtttctcttcatgtgtaagacgataaagttgtctgaccataggtcctataagtgaatgtaagtgcttagaacagttctgaaaactacatgctgacagtaacagtgtgggcttgactgagcctgggtcctcgggcctcgaggagctgggttcctgtcaccctcatctctctctttccctggaagcacttagttggtcgactgattggcaagcagggacggtacgtgagttttctgaagcagacatctggtgccaagatctacatctccaccctgccttacacacagaacatccagatctgccacatagaaggttagtggcatcgtggccctttgctcagccccccctccctgaaatgcaaggcagcagcaccctggttgcagctgtccatttggaagtttagcctctaaatagaaactgtgggtttctagttagttggagggcatgctgggtgtcttcccgtcagacctgtccagtttcaggtgcttgtgggagactctatccctctgcaccgtgtctctgtctggccaggataaggatgggtgctcagtgacaggcccagggcctgtcatccacatttccctcacagtgcataggccccttctggctgagtccacttgtgcctttcccatctgccagcttctttatgtgttcaaagcatgggtcagcatggcaaaggtaccagaggggagtggacttacgtgacttcgttcctaaagcaaagccacacgtttggcatcttagagacccttgcacgggaggattccgaggaggccctgggggggggggtgttgggtgtttgctgtcacttttcttctacccacagaggccgtgtgttctgtccttacccgtaggctgtgtgtctgtccttacccgtaggctctcagcaccatgtagacaaagctctgaacttgattgggaagaagtttaaggaactgaacctcaccaatatctatgcgccaccactgccttcgctggcactgccttccttgccgatgacgtcttgggtgagcatgttctactggatctcaattcttgaccctttccctaaacgtatcccagttgagagactcctggcatccgggccaagcgggccgaggggtgtgtgcgctccccgctctggcctccacgcagttctgctggcgtgttccctgaaggcaggatagagtgctggcaagaagccggggcctcttgaccccactgggagggtcatgctttcctgccccccaggcatgctttcttttttctaggtttttgactatagaggactgagctaggtgactgggtgtgggccttctgaaatgctggggctgtacctagagccactcactccccagcgccagagtcctgggtagggtttgccagtaaggatttgtgtgcgacttagatgcacattcttctagtcagctgggctggatagtggccctggcaaaggaccctttcctcgggaactgcctggattttagttggtaaaggcagagtccctagcctggaagcccaggaggttagcagaagagaaggtactgtctgcagcagccatgcctctggtgctccttgggcctcctgttgctg

SEQ ID NO: 20392 - DNA, 1099 bp, Mus musculus
ggccaccacagtgggcaagactgtggcacaagtgcacccaacctcggccactcagcctaaggggaaggaggagagctgtgttccagccagccaggaaactagcttgggacaagacacctcagatcctgcttccaccagaacaggtgccactgccagcccttcagcagaagctctgccaccaaagacctatgtaagctgtctcagcagccctctgtcaggccccaccaaggaccagaagccaaagaactctgcacatcacatctccctggctccctgcccaccgccagtcaccccccagaggcagtctctggagggggcaagtaacccgagaggtgatgacaactttgtcgcctgtatggccaacaacagccagagtgtcctttcagttagctccttggggcagtgctcagatcctgtcagtacttcggggcttgaagactcttgcacagagaccatctcaagctccggagacaaagctatgaccccaccactgccagtcagtactcagcccttcagcaacggggtgctgaaggaggagctgtcagacttagggaccgaggatggatggaccatggatacagaagcagatcactcaggaggtaggaaggtcttggggtgctttcttgatgaatctgggaggggtcccattatttgctagaaggcaacaagctactggccacccttaccttctgccacttgtgcaacaaaacaatgctgcccatccctgtgttatccagccacctgtacagatggatacccgagaagtcaggtgatcacatgagaccctaatggctatgagagttgtccgtgggttcactagccagggaacctccccagacctttagaagggaccacgtctgttgggtccaccagtcagccttagtgcctcttctcctttggacacatgcccttggaggggcctttggggcctccttagtggtccctcccaagtgccaggaatgggtgagcatctcttaatggccgacttcctttacttatgtgcttgttccgtgtctccacctgctctcctcagaagccctcgaagggtaagttcacccaggacagccgcagcttcgagcgctggtgggaggctcgagct

SEQ ID NO: 20393 - DNA, 1097 bp, Mus musculus
gatccacccaccgctgcttcccacgtgctgggactaaaggggaccatcaccatgcccagcgtactacactcttcattggcttctgtaatacctccttttctctccctactttcctaggtgtagctacttcacatcgactgactccaagatggcaatccagttgcgttcgctcttccccttggcgttgcccggaatgctggccctccttggctggtggtggtttttctctcgtaaaaaagatcggctcagcagcagtgataagcaggtggagacactgaaggttggccctgccatcaaggaccgacggctcagtgaagaggcctgtcctggagtcctgtctgtggcccccactgtcacacagcctcctggaagggaagagcagcgctgtgtggacaagccttctacagagcccctggccttgccgaggactcgccaggttcgacgaagatcagagtcctcaggcaacctccccagcgttgcagacacgaggtcgcagccaggaccgtgcagagatgagatcgccaaagtggaactctccctgatgggggacaaagccaaatctattcctcttggatgtccgcttctcccaaaggatgcgtccttcccctatgaagcagtggaaaggtgtaagcaggagtccgcactgggcaagactcctggaagaggctggccaagcccgtatgcggcctctggagagaaagcgagagagacaggtgggacagaggggactggagatgctgtgttgggggaaaatgtatctgaggaaggcctattgtcccaggagtgtgtctcagaagtggagaagagtgagtttccaatcctggcccccgggggaggtgagggagaagaggtgagccatggccccccacaggtagctgaacttttaaagaaggaagaatatattgttgggaagttgccgagtagctttgtggagccagttcactcagagccggttaaggacgaggatgcgttggaaccccaggtcaaaggtagcagcaatacttcggatagagacctggctggagagctggacaaagacgagaccgtgcctgaaaatgaccagattaagcaggctgccttccagctcatctcccagg

SEQ ID NO: 20394 - DNA, 1154 bp, Mus musculus
gcaactagctagctttgccggggagcaaaggtagtgggaagcccttgtgaggatgaagggtgtgtgtatgtatgtatgtgtgtgtgtgtgtgcaggttcggacacagcaggttggtgcatcatttcccacctctactgacctgtcagaccatttaagtctggggtggggttgctgacatgagactgcctggggtgaggaagaagtgggctatttgtttcctggatggtaggaagtagagtggggtggagaggcatcaggtgcctcggagagcccccgtgggtgccccttggcaccggatcccttaagatgatgacactcctaggcctggtgcattgcattcaaatcctttgtgttccctgtagctgctggtccggggctgccctctggggagagaatagctgctgcctctaatctcacccattgtcttggaagcaggggacaaacaaatcctgccctctacagggctgttggggaactccctcactcagaccttggctttgtctggaaacagtcctggaaagaggggctttgtcctgagccgcctcagtagtgggtctttagacccagctcagattgggctgtggagcagtgggcactgagtctcttctaggttccttgtgttggctggtcccaggttagcagtgttcatcaccccctaggaggctgattggcacaagacaggaagtctgtctgggaaatgtcactaccactgtttccttcttcaactgacgaagcctctacaacagactgatttgcactgagtaggggtgagacttggagtcccagtctctggggaacaaattaacagggaggcttaggtagacagtggtggtgataagccgggatatatgctcagagtggcaggactgctggttcttctcagggttgtgtctgagctttgggtgggacagctggtgaagtggtgggaggaggccattggcttggtgggcctgggcctcgggacattgcggattggccaggtactggactaaagcagactagagagcatgctgttgggatgcttcaggggtttggggagatagagtggggtgatctgtaactgaggtagagggtgggactgtgggcgttggtttagtttcaaagggcagaattgctcacagctgaactggaagccatttttgttttaggtacc

SEQ ID NO: 20395 - DNA, 1579 bp, Mus musculus
gaacgcaggacttacgtatgccaggcagtggctttaccagcctgagctacgtcctcagctcttctttctgcaccgtcgtctttcttaaataggctgggtcccaatacctgggctctgcgcagagaaatcaacagattatccccaagtagaatagaagacttctctaagtgccaacttcttcaggccccaacacactggggacccagaactttggtccagtgtggaggaggtcttttctttacagtgagctgtcgccagtctttctagatctcgccctggaaggatcgtatcagtcacccttgaccttgacccagtccttacatcaggaacactaattcaatgcttcttgcttccaggttccttctgaccaaggggagatggccctgaagatgatgaagctggtgaccaagcaggagtagctgagctggctggccctggaggcgctaagagcagagcccaggatgcaggtgctaatgtctatccctggtgctcttctcccctgctctgccatgggatatgactctgggagcacctgctctctcccgtaccgaaagactgtggccttctgtgtctacttagaaatcagttctgcttcccaaagagtatttaaaaccagactcatttaatcaaagtgaagggttgcaatcgattggtctcttactacaaaagcagttgatagcacatgtaaatccaagcacttgagaggtagaagaagcaagaggatggatgagaggttcaaacgcatccgcagctacatcgaaagttcaaaagcagcctatgccaaacagggagagtccctgtcccccacccccacccccaaaaaagagcaaaagcaaaccacatgatttatagacaaaagcagtgggagagacaaagaaaatacttaaacacccactgagctgccaactaggtgtctctgactacgggtcttttatttgctacatatatatttttacaaaaatgaaatccatattgtacgctattttgctgtctgcttcgttcccatgtcgacatgacccgcacttcttttcccatcaataaatgtgttgtgatatttttaatgacggctgaaaattctgttctgtgatcgccccaatgtttagttaccgaattcccaattggtcctgaatgtttccagttcttcctgtcgaagacagccctctgatgagccattcaactagttaatagtttatgcacactccgtttccttcaggtaaactcgtggaaggatggctgtttagtcaaaagatttccacatttccttataattaagatcataagctcctccgggcttaatgttcaaaccacagcttgaggtgtgaataggtgatccggtagcttccggtacaccctcagagagcaaaccccagctctgcatgcagaaggggaaggtttcctcacagattacagcagcattatctaagctcactggataagactcatctcccctggggtcactcttctgtctcttgtgcccctttgttcattagaagcctgtgctatgtttgcgatgcatttgttgttaaggaaagaggcagctcctgagaatcccacacttagttaggcctttgctgtgtct

SEQ ID NO: 20396 - DNA, 1207 bp, Mus musculus
aaggagaagcagcacggggctaaaaggtagctcaggccacctgtcagagtctgagtcctgcccagagtcagtcagcgatggccactgcagtgtcatgatgcaggaggtcaccttttcagagaaactgtcagctgagctgttgaaagatgcacctgctaccaagactgcagctgccaacaggcaggcctcaaagcctggctttaccttcagctccggcaagggcaaggcctccagaacctcgtcatccagttcagactccagttcagagtcggaagaccagttcctggtgtccaagaacatgctcgagggcgcatctgctggcttcttaaagccaactggcctctttgcagggcaagggggttctggtccagggctgtcattggagactccgggtattatgggatggaagtcttctgactcaaaccggggcagacaagctcctggtcctcccagtacgcctgtccccaccagtttgggaagaggatgggggcgaggagaggacttgttgtttgggaagggactgaggggccggggtgtccggggccgagggcgagggcgcgggcaagcggtctcctgtgtctttaatagaagctctgagagtcagaagcagagacagttaaatgatattctaacaaactcatctgtggtgatccaggtaagcgtgtgatgtttgtgagctgccctcctcccttccccatgcagcttttctcaaccttgtggcatggcgtgggctctcattccctcgccagtaatgaaggcacatgtctgttttccagaatccagtagagccccccaagaaggactatagtctattaccactgttggcagctgcccctcaagttggagaaaagattgcatttaaggtatattttaaaacagcactgaccataacaaaaacaaggttaccccccctcccccagcttccttagtgaatctcattaagtaatgttgacaaagacaactgtctgcaattgtcaggagtcatggtggggcctcggatgggtgggagtggccacctctgcaccgcccaagttcttggggtaggaaggaggagtcctaagagactgaagggttttttcttctgttttagcttttggaactcacatccgactactctcctgatgtctctgactacaaggtaagcctgtttctatgaaaataatgaagttagttggtggtggggtgcacctgctgtcccaagcaccca

SEQ ID NO: 20397 - DNA, 1902 bp, Mus musculus
ggttaagagcactgactgctcttctgaaggtcctgagttcaaatcccagcaaccacatggtggctcacaaccatccgtaatgagatctggtgccctcctctggtgtctgaagacagctacagtgtacttacatgtaataaataaataaatttttttaaaaaaagaaaagaaatatgtttaacataaaagttgatgcatttcaagtgattaaactcaaccgggcagtggtggcgcacgcctttattcccagcactcaggaggcagaggcaggcggatttctgagttcgaggccagcctggtctacaaagtgagtcccaggacagccagggctacacagagaaaccctgtatccaaaaacaaaacaaaacaaaacaaaacaaaagtgattaaactcagttttattagctttgaaagtattttcattatctaaccattcttcacagaaacttgcttaactaatctatagattttagcttacgtggagtcaagaatgaattaagtgtggtgttttgtctttttcccttagatcaccgtgctctggagagagttgatcgatccgaggctgatcattgactcttcaggtagcatctcgagtacataaggtgtctggatctgacctctggcctcgccaccccgcgctccgtaaccgcattgtttgggaccatgggtatagcctgaagattttaaaaagaagactaaatgttgtgtagactttctgtttctcttcactttaccatattaggaaaaaaagatctacctcatcatttagagtaacaaagttgttagtttatagatccttatttccttctggctaaattcagtaacccacttgaaaacctgggtgctgaccaaaatggcggtgtgctaggctccttcacacctgtttggctaccagtagcaatcgtccgtaggagtttacagtaccacacacaagaatgtgctgtgcatcttgctttgtttcttttaagtcacattgtaaagtactaaggcatgtttcttgacttaatttttgacatgtgagctgttctgtgaagcatagagcatctcgcccattccacagtttctccctgctctcctcaggagttagtggggttggatttgtcagaggtgatgagttaaagagtcctttcacactttccagatgtgaaacacaggactcctaggagcccgcgcagcccgcagtggggaggcatccttgttgtattgtgtggaggagcgctggcctcccactgccagaaggctgggcgtgagcctcagaccaggctggggcaaggggccttgctgcacaatgcaaggaacttgggctcctcataactgaagagaggatcttaaacagaaatttccttttctgttgttttcttcagcatgaagctaaaggctgaatataaactgcaaaattgctttctttgaacgaaaaatcagattcctccttcaaccttgcaaatttttaaataaaatcatatcaaactcaatgtccactctgagttatgttttcgttctgccaatagttaacttggttcataatcatgttcataacaaggaggcttgctttgcacctgggaggctaacacaggaggtttacgagttcagggacagcctgggctacatcgtgaaacagtatctcaaaaaaaaaaaaaaagatatatatatatatatatatatatatgtgtgtgtgtgtgtgtgtgtgtgtgtgtgtatgggggggtagagagatatggctcagtggttaaaagcactgactactcttccagaggtcctgagttcaaatcccagcaaccacatggtggcttataaccatccgtaatgatatctgatgccctcttctggtgtgtctgtctgaagacagctacagtctacttacatataataataaataatctttagcctggcgtggtggcgcac

SEQ ID NO: 20398 - DNA, 4206 bp, Mus musculus
cacctgatgtacaagttcaaggtggacttcaccgaagctctgtacccagccttctgggtgttctcggccggtaccaccctctctatctgctccaaatagccaggtccctaggctagccacagacacttgggcttgctggggaacatccaagactggagggaactctgaacttgtgagtccctatcagataagaaattgggaggggagctggggaaggggtgggaagaatcaaaggggaggtttaggctcagaaaggggtggggtgattgtcttgtggatggagaagcatatctacctcctcatgcccccgagggcagggtgacctcctgccagtgttctgggaaatctctccaggctgctagttacttgggcagagcctcagagagtaaaattattagtgttcctgttgtcttacagaaaaatctatagctgttagtcatgttctttctcaggtgacagatgtccaccctattctactctctggggtagccttcagatctttgtgttttgattatggcctagatttttgtttgttttaaagccagctgtagtggtgcgtgcacttaatccgagcctttgggaaatagaagcagacgcagcttgatgagttcgaggacagcctgatgtatatagtgggttttaggacagcttgtctctgaaaaacaaaaatccagttcttgagttctgtatgtgtatgtgtgtgtatatatatatatatatattatcatctctttggtgctggggtctgaatctatggcctttacccctgagctacatccctactctgaatttccatataacccttcccccacaaggaaccttttgtagataaggctgcagcctgtgttgatttgtgtcaaggtaacccagacctggttgagacggaagtctctccctcttcaaggggcagttctctggggacatgttgacggtggccatggagttagaggcctttcgtcccatagcctaggccaggggtggaggttgaggaacagaaccctggctggattgtgggagccctgatggctttgctcttactgttatcttgccttgacagctgttcccaacagtaatgtccccatcctctggattgtagatactgggctgatggctataaatgccgccatttgccttttgtggcttctgtcacagttaagtggacagccacaccacattcccaaagcctaccatcatggagactggctgtgtgtggttgcttcaggaaccttgctagatcacctattggtggacagcctgtggcctgaagcgagagacgagcgggagatagctggaatcctgtttatctctagccacagattacaggcccagtgatgagtcagacccgtcacctgcccgaccctttctgctctcttcctcatttttgagccaattccagatgttcatgtagaccaaactacaggttaggaagactttgaaggatgaggaaacagtaaataaataacaaggagagtccaggcagtggctgttttctctgctgtctttcacacagtgaaaatggcccgggccataaagggcaaggatggatggctgactgggatctccccacctcctgtcgtgatgccaaatccagaagatgtgaggatttgacctcttgtgacaggagtccagctctctctttcctaagcggggagctcctgcttgcaagcattcttatgaagagaggtcaccatagggaaggtaggccctagaccttttcatttgatggatatttgagaacacatctcaggtctttatggaattccaggctcttagtattggcattcccgacagacgtgtgatctgtgtcttctcccagaggaatattctattccctttaagcatctttacagggaacatgtccctgtagatggtatgtgggctttgaaagatttcttcctttgccacacaaattcttggcgatacttctccaactttgaaggtgcccaaaaagcttctttgctggtcttgttttgagccttgtttgaggccagatcagacttgggaaacaactaggttcagagaagtggaacaccaaggattaactcaggagtcctgcatgggctcttctgcagaaaaggagccggacagtcaggactctttccccaggcagtgtgcagctcaggctaggaaggcatgcgtccctctgtttatgagagacccaagcaggcaaccaaagcccagagctgtgcaagatgctttggagttgtgagtggaggggtgtacccttgctgtctggtacttttctgtttgcagtgataagaccttaccttaaccataagcatttctgggtagatggactaagagttcatcagagtgcacatctcacttggctctttgcagagtcaggcaggtgggaaggtgggggatggctctgctcaagtcctcttgtcattccaacatggaagagactcctaacgtgggtgaccaagaaaaccccagggccctgtagacatacagaaatttccagaaatgttgatgtaaaatcctgtcgttgatcaagatactggggactgtctcagtcactgtggtgtgataaactaaaggtggaatctttgtatttttctgatcactcagaaattgattttttttacctattactaatagcgatattttatattttctactattgattattaattaattactaatgttttcactatgacttcttgaacctagtgtttttagaggtaattcattaagataatcaatcattcattgtacagggcaaggctggctgctgtaccttactttgtatgcaaacagcatccagcatcctctctggattgaggtgtgggtgaaagatgtcactcaagctgaaatccactgtcgaggtacccaccccctaagagctactgcccagggccactgggtgctcaggccctgctccggaagcctgctatagcgtagctcagatcacatgaaactggataaagaacactcaagagagagaacttagcttcaagacagtgccagggtgggacactgatgagggataagcctgcttgagtaaccggcaagctgcagtgggaacccagagcttgcttgaatatttttcttgcggttgcatagacttgaccatttctatcgtaagttaaatggtgaaatggaaaagtcttgaccagagataaaccctattcatgatcttctctacataggactctttggctgttaaagaattacgcttgcctttgtcgctggtgtgggtgtgtgtgtgtgtgtgtgtgtgtgtgtgtgtgtgtgtgtgtgtgtgtgtgcgcacgcgcttgtgcttgcatgagtgcgtgtttaagttctcggaatttcctgagaggatggagtgccattgttatttgtctgccttgtgcctgacacagcggaatttatgtcaagagatgacccagcatggtagctagccactaccagcttggtgattgattacagggttgaggtcagcccaagacttctgtgaatcctgtctacagatgatggttcaattccagctccagttgagacctagtgcaatttccctgcagatgaacacatagctgtgctttaggctgatgcacccgtgtcctgtgacggcaggacagggaggctgtgtgctcgagacccatctagaccttgccctgtttgtgtctttatttgactgcttctgattctttttcttttgaataaagttcaaatcataagtgcgacattgtcctgccttttgcaaaacgaccaaaatgggagggaggcaggtcacagtctctaccaggatttgcaggtattcggcagtgtgtggagcctgaggccaggcaaagcatggggaaggggggcggcgggggtggaggtactatgtcccttaacatggggcaccacacttaactctaaaatggctggcgtattctccctgtgcagtacagcggtgctgctgggacagagggacctgcaaggatgagcagccgcagccggtggctcgcatcagttcttttaacaaaccattccttagatttgcttcttcacttagcctgggaagacccgcaatgtcagagactctttagagatgccatttcatctgtcccggaacactgtcattcagataagactcaagagtggtaactcagtcaaggcaagccatgtgtgtgaatgtggaaatgtgtccatgtgagtgtaggtgcaccctgaagtctggaagagagctggggtcctctggagctctgggtgctgatgagccccactacacaa

SEQ ID NO: 20399 - DNA, 1143 bp, Mus musculus
tagtacttcttccagcatgtcagaaagtaacttttatctgtaacataaagtaaaatatttctactgtacactgtgggatttttatttgcactagctagaaaacttgaaaggttatgttaatttgcacattaatgtggacctgaatacataatctgaccagaaaggtcagtagaataggtgataatgtcaaaataaagatattaaagcaaaaagccagcactttatattcagaaatgaggtgggagtgttaatttggtttctgtgactttttttttaaacttctgatggtttaggacaggatattaagtagattattttttaagatttatttatttgccgggcatggtggcgcaagcctttaatcccagcacttgggaggcagaggcaggcggatttctgagttcgaggtcaccctggtctacagagtgagttccaggacagccagggctacacagagaaaccctgtctcgaagaaaaaaaaaaaaagatatatttattttatgtgtatgagtgctctatggacacctgtaggacagaagaaggtattggatcccattacagatggttgtaagccaccatggggttgctgggaattgaactcaggacctctagaagaacagtcagtgcttttttttttttttttaaagatttatttattttatgtatatgagtacactgtagttgtcttcagacacaccagacaagagcgtcagatcccgttgcggatggctgtgagccaccatgtggttgctgggttttgaactcaggaccttcggaagagcagtcagtgctcttaaccactgagcaatctcttcagccccctaagtatattttatttataattatttttttaagtctagaaattttagaggagaaatagttctgttacttcatgccagtcctcatgaagtcacacgctcagcgtctgcacggacacctgctttggctcacctctacaaagcatgtcctgggtttcagaccatccctgcagctcaggtattctctgagagccaggagggccacgagtgtggttgaggggtgaattcctactcaattttggatcaagttggctgtgtgtgctattataatccccacacctagaggctgagctcaagggcagcctggctatatatgaggacctta

SEQ ID NO: 20400 - DNA, 1110 bp, Mus musculus
aagggagggcacatgatgaagaacttggggtggcaaggtgtccctccacctgtccgttactacttattgaaggcaggtccatggctgcccattagagggcgctcttctgctgtctgtggcctgcctctgcagttagccgcaccagtgggcatctaacttggtgtgtttctgacaatgacatgtttccactttgtggtcttgtgtgaattagtttctgaaagactagactctattcccaaaaccaccatttatctcccttttaatagtttattatgaatctacagtcagtgaattgccataaacttcaattttagtcacctcaggcctagaccatgtttttgaaaggacaacttagtaaataaaatattagcgagtacattatctaaagtaattttactctgcttcattaacctcttccaccggttcctgggtgatgccagattctaccactgaaaggtgaaggcgttccaccggtttgtaactgccttcacactgggtagctgcagctgaggtttgcgatagctgggaaggtttgcagctttttccttgtgggtgatcctatttggagtgtagtgaaattcatccttagattcatggtctgaggcatactgttagatttactgtagatgcagtttatgtacctgtaattcataatgctctatttgtggtaaaacaactgattagttctgggctatcagtcaaaatagagtagccactgaggtattccaggtagagcggacttggtgtcccctcaccatgacacgccatggtctctctgatgccttactcacattccattatgtaacttctcacactctgagtcactagttacccggcattccagataaatgaataggcacgtgccttgtttgaatacaatttgtagtgcttggtgtttgcaagttatatattagatggtgaacttattaccaggcctctatacttcacaaaatgattcactatgagatccctccgttccatttaaagttgtctccatagcaacaccacttacacattctcaggaaaaactatgagccatctctttatctgtttccacatcgctcatattttctgctctaatacattcctcatgaacttactggcataaac

SEQ ID NO: 20401 - DNA, 1218 bp, Mus musculus
ggattactataaactataccacagaagccacctatacagaagccattagtctctaagtattttccgtgtcagtaaatatttatagataatcagagtccttacatattaggtcattgtgtatttgtcagaatgattttttagaaatttgcactagtgtgttgttttgcttttaaggcataaagaatggaacactagctaaaggtgagcttagccctctatagtgtggtgtgaatggaaaggagtcagacagtgtcatagacttggtttgaattgtagctcagcatctgcagattcaccagcaactgactaaacctcttgggcctcagtgtcctagtcactggaatgaggctggttcctcctttgtaggtcagtggacagggtgagccgcagtgaacaggaggtgtggccctgtctctgagaactgcaaaagggaaataggtaacagcctgtaaggtgaaagacgatattgggtaaaactaatttttttcttgtcctctggtttttaggtgtttgatgtaactaaaactcccccgatcaaagctctgcagctgtgcactcttcttccttattactcagttcgagtccttgtttgtggaggggacgggactgtgggctgggtcctcgatgccattgatgaaatgaagattaaggtatcagtctttgagaactactgtcagggtggctgatgacgcggctcgggtagggtgctgacgctgattaagtagttagcacacttacagttgtatttgtgtctttgttacattagtccttacatcttacagttactattatatactagtaatctaaagagcaaagtctgcagcgtgtcttttatattctagggacaagaaaaatacattccagaggttgcggtcttacctctgggaacaggtaatgatctgtccaataccctgggttggggtacaggctatgctggagaaattccggttgcacaggtcttaagaaatgtaatggaagcagatggaatcaaactagacaggtaagctacattgtgctagcaagtctgttatttgagcttggggttattatttttataaatgaagatttgtatagctataaaatgtaatgaagttggccagctgtggtgacttgcacttgtaatcccagcacttgggacattgagacaggagagaattgccatgaacctgaggccaacctaggccatagcattaagacactgtctcaaaaaccaaaaac

SEQ ID NO: 20402 - DNA, 1376 bp, Mus musculus
gaatgggtgaaaggaggaaggacgacaagctatagaagcagcccttcttggaaagcaggctcacttcaggactctctcttgcacccagaagtggtctttagcccacagttgaccttccatgttcgaatactggagatagagtgatgtctgttctcttgatgcctcgctgattcggataggctggggtttggggtgacaagcaagtggggctgtgtttcccccttgggcggcattagtagctactatgatatcagactcctctgaggggtgtcccagcactaacggagcatatgttgagatgaccaaggcttcctaattgcccacatctggatttttcctttcccatccactgagaaatagctgcctctacctctcgagctgtgcatttgactgcaagcctcaggcttcaaagatggcttgcgcatagcccaatgatagtgtcttcctatgtactaaggtgactttccattctagactgtttggagatgttgaagggacagtaatggtttacaatggagtgaaatggaagtagtgatttgatgtgctctttgcccccccccacccccacaaggtttctctgtgtagccctggctgtcctggaactcattctatagaccaggttagcctcgaactcagaaatccacctgcctctgcctctcgagtgctgggattaaaggcgtgtaccaccactgcccggcacttcgcctttttcttaggaattctacctcttcaaaacaggaactcagaaccctgcgtttgatcctcgatgttagtaggaaaatacattctgtagccaagacacagccttaatgatctcaggggaaaattgtaaccactgtgtgcaaaccttgattaacgaacatggacactcaggatgcaaaggcagaagaaagggattgtttaagtgggattccttaaagtgtacgttcttttctgggaagaaagttgtgttctgtgaataaacgcagtgacttaggcttctctgtgtgctgtctccctcttacctttctttgtggaagaaggaattagttatgttgcctcttctgtttgcagggacacctggcccagctcaagactagaaagaagggaagaaagaaaggaagagggggaaggaggaagggagggacagacagacagacagacaaacagaaaatttgtggctggagagatggctcagctgtttataacactgagtgttctttcaggggacactggttcacgtttagattgccaacacacaagtggcaactcatctccttctatgtaatttcagtttcagggcatgtgacaccctcttctggcttccacagataactgcatgcaaatcatgcccttatggacatgcaggcaaaacacccattaaatttaaatgcatc

SEQ ID NO: 20403 - DNA, 1558 bp, Mus musculus
agtgagcaaacttgcactgacttcgttttaatttttttttaatataattactgtgaaagtataaaagctgtgtctcggagttttcctcttcacaggcaacagatgaggtagtgaatcaattcttcattccattccactatcatgaaggactcgggagagacttggccaactgatgtttacaaaccagaaatttttgtatttttcttttacagattttaactacgatgatttttttctaaattaagtaggtcaggttgtcaaagtcagtgcaatagtaatacaacttcctttttaagaaaacccaaagttgtttctatcacgtttcccgttcactgtgtaaaagaatcatggaaactgaacactactttttaccatgtttcatcttgacataacatggttattttttaaaaaggaggctttagttcttttgtaaatttttaaagaaacgattccattgacgcacacccccactggctcctcatccatgcgaggtttttgcagcaaacggtcaacattccacgaacaaacattatacctcttctggcagttttattaagtgtggagaacttgccaattttttagaaacactgcagttttttccaaccttttctgccaatctctaaccctgaactcagtgctgctttgggctgacatccatgactggtgtgggccaccaggagtaagacagtagtgttttgataccatccactttttcagaagacataacttcgctacatgcctttgccccagtttttctccagggtctctctccacagtcggggaggatcctgtccggattatgatagtattattgggttgcccatctgccatgagctttctgaatcatggcgaattgtatttgccactttggtgcccaacggttcaagtcattgtggttaagccacttaactttattgtatgagtttgatattcattttaattgtgggactagacacataaactcacatttctgccttttcctctgcatttctcaatatattatgtttttctcacgccataaataaaacattgattggcaggttgaagcttgtgtcagttgttgatgggttttatgctgactctgtggagtgatatttatatattatttttagtttcctctcaatgtcttatattaagattgatgtattagttgctttgttggttaatctttcttggtgtttaagagaaatgaagtcaccttgcctttagatcagatgctattataacctgtctgtctaggaacaagctgtcagactaaagatatggtttattcattgaaattctggacagctgtacgtttaaaagaaagtttattttgtatgtgtgtctaggctctgatttttggtaaattgtaaaggaacaactgaagaactggttgctggggatgtcttcagtagtcaggagtacccaaggataacaccagccacaccgctgtatatgcatgattctgaacagttagccgcctgttattttactgtgtatatttgactttaaatatattaactttttgtggattcatttaaagtctgctcatatgcagcactgtcaaaaccactaa

SEQ ID NO: 20404 - DNA, 1135 bp, Mus musculus
caagtcttagaccccagggcttccttaaaccagggtgtagagcctcctggatttagtcagccctgcaggactccagctttcagtcacgaagaacttcccgatttgtaagaaaggaattctccaggagaaaatagcattccatcaggttcctgtgtaactgagcatctcatgtgaatgcagctaaggaggttgagcctctgaattagctgaatcaggcgaacactcattgagaactattctttagtccctatgtcctcacccatgtgttcccttgggatgctcagtagctaccagcggtgtgaccagcactctggtcaccagggcaaagcagagctacagctaaccatttcaaaataaaaatgatcttgaaagtcagaatttgttaacttctaaattttaaaaatagtttcttttcctttcaaaaacgagatcaaagttctgtagaaataagtcgagttagataaatagcccgtctaactttctggaagctgccgtcaccaatatttcagtaactatttcccctcgagggtaagcctgccacccttaaacagctcccccttgaattggtatgttgtggtcatcttttcatggtgatatacgcattctgttgcattttaagtgtctgcttaagctatcacttcccagaatacccttcaccagttgttcagcaactcattaaagaaatcttaggctactgtaaggtctttcccgtaacagtgtcatggcgagcatttgtgtatttattaaaaccttttcttcaagtacccccgcactcaaacatgagcgtctgtagactgaatacttttgaaagccactgtgtcagagtacaaagttttgtcactgaacaaagagcttctccatccctgcctaaaaaacctggatttttgttttaaattggatattttctttatttacatttcaaatgtaaacctggatgttttaatcattgggttttatcatctctttagcatcggagactggcttgctgtgtggggcagagtctggcagtgactaattcagtgttccacacatggcattcctctcagtgtgttctactttacatgtaatgatgataaggacttgcttctaaattagcagagagagcaaaggcatgcatacagcatgcgcaccattt

SEQ ID NO: 20405 - DNA, 1248 bp, Mus musculus
acagcagtccagaggacacctcagagtcatgacccactctcttccttctgcggccccaaccccaccaccaccaccaccaccaccacccttagataccaagcaggacactgctctgtgacttttcagtgggctttgtattttctagactagagacactggctcatggccatgcttaggtgccatgagccagtaggagcatctaaagagagctgacaggagaaaggtatttgtttaaacactgctggagcgcttgtaaaaggatggaggccaggagccaagcaaagcagcgcagcatcacttaggcaagcatagagctcccaagaacacggtgcaagaaccttcactcagggccactttataagtaagtcacggagttcctgcagtggagcagcacctgtgtcagcatcagaccctagctccttacattctctgctgagttttacctggtatagggaatgcatatggaaaatacacatgggcatcgtgctcacccatacctctctgaatacatttaagatgtagggtttaagctgaatgcacttaggattcatgttttccttcatgaggaagaacataaagtcaaatacagactgacaaggagactcgaaccctaacaacgacagaatggctggagcaaacgtatgcctctcctcacagctgtctggatcttaggatgcttcgagaagcggggtaggggtaggtggctttgagagcagctgcagaaggacctgtttcaagtcccaaagaggtgtgaacaggcactcacacgcttttataagaccgtctctgctgtgacaccagcacactcctgttaggagatcattctcctgcctcgcattggagagtgtcctcaattgtttgtaagggaagctgagatgggctcctgaagcatgcagtctttaatctgtatgtgtgcatgtgtgtgtggcactcacaacctctctgctgctagtatcaagtccctccctatttctaccaaatacataatcaaaaagatctataaaaacacatagctctatgtactgagcactctataccatacatttcggtatacaatgaacatcttttgggaggtctttttgggatagccactctctgtgtataccaccctggccttgagttcacaatccccctgcctcaacctcccaagtactggtatttcagcaacaagtaccttcttgaaggtacccaaagtgattccaattttatgaaaaagctgaggtttagaaagaagtggtcccaaggatc

SEQ ID NO: 20406 - DNA, 1181 bp, Mus musculus
taaaaatactaacatgaggattctggaaaagaatatttgctttatttaaaagtgctcaagatctcaagatgacagcaaactgaggacagctatttaatgcatgccattacttctgttttattccaaagtatctttgacattggaaaataaatagcaaaaagataaaaaataaatataagcaatcgcagtagaagtatgaaggtaaagtggtgctgaagaagggttgtaaaccatgccacaggtgccgtaacatcaaacgaggttggatggggcctggggcacagggctctaagcccagcacctgaaatactgaggcagaccagtgcagaccaacttcaaaagatgcccaaacaacagtgccgtagaaagcactgacgagacacagccagccatggtgtcttatatctaaaggctcttgcaagcctgaggcaagaggagttctgggcttttgaggctaggctaggctacataacaattgctagcacagactaggataagtatggaagacaaacagaacaaactattgaaatagttaagtaaaaccatgaggggaggggaaaaaaagattatcaacaggaacaaccaagcccagactctgtggcggtgagccgggtagttcctgaaagggctgtggaaagccaaacaagttctctgctcttcagagctgccaactcgggctgagacaacagcactgtgtgcgacctgtatgatcagaactagggacctttccaacacaggaggagcagaccagtttctgagtaagtcccagcaccagcccagaaccctcagagatcaccctagtgactgggcgtgtctacacttcccccattcggttcccaggcacttgtgcctcatcgtgagaatttcaacttttaataactgttttcagcacgtcatttgttcccctgcagtgaaaatttatacatgactttcctaactcctacattatttataaaagtcaataataacatatccaaagtgaaatagagaagaaataagatgatcaataggtaaaatctttagcccaagagcactaggcattgttacctacacatagcatccctataaaagtgagagccatgcatatagattcctgtgcacaagttcatgggcatctataacatgactgacttgttgagcagttcctacaaagctcgagacacaggaaaatgcagtctttt

SEQ ID NO: 20407 - DNA, 1193 bp, Mus musculus
agtaagtgtagccctaaaccagccaaaattaagaatattttccatttaacctaattctgtcaacttcatttatactctcaagatagcaaccaagtatttttcacgtttcttttttttttcctcatgttatctataaatttgaattcagtaaatttttttgttatttttcttttgaaaaatcacataggctaaaaataattttatatctggttctacagccatgtttgtaaacctggcattagctaaggtgtttgccatggcaggggtgagggttgcaggcaagtagaagactcaagaaggtaatcttttataggtagttaacctacaaacagtcaagagactttgcacggattctaattctggtcacggttccccatgttgattttgttttctactgcactgtaaaacatagttgtagtgaaaagttttaccccagaggtatcaaagctgcctcacatacgtccacttcctcccaggctctcaattacctcggtatacagccaacaaaggaacaacgtgaagccctgagagagcaagtccaggccgactcaaaggggactgtgtcttttggaggtaatgtctgaagtgcatcatgttgcattaccacagacagttgggggatgctgttgtgacctacttttattgagaagattgttctgtaagagggaaatgaaaacttataccatagtccttaattggtactttaaaaatggccattgtcagtcactaccctggctgggtcagcagaagggagacctatatcagaacccatcagctccaaatatcattagtcgatcccactctttttgcatctctttgcatgttttattttttattatataaacattgctttaataattacaaaagatagtacgaaatgtagaaattttaattcactactatggagattacatctactttttttttttttttttagctagtgaaacaggaagtttttgtcatactgcataattatttattcttagagacggcataatacaccagggtttctactcttggcatattaatggtttctcagtagctgttattacaaatctatatttattacagcttttataaatgtgcatttatcctttgaaatgtagcagtttcttgtcttttaataggataagtcccaccccacccccgacacacacggtttggaacttccatgtttgtcactacgttatatt

SEQ ID NO: 20408 - DNA, 1172 bp, Mus musculus
tgagtcaccatgtggttgctgggacttgaactcaggacctctggaagagcaatcagtgctcttaaccgctgagccatctctccagtcctccttaacacattcttagttgcttctgtgttcctgtcaatacagacccattaattccttttctgatgaaggggagaattttccttttccatgatccccttgcattttccctgacctatcctcagcatcagccattactgcgggagtttggcctcctttagtggaggttcatatttagaaataaagtctgggaaacagaagtagtcgttacttctagaccttctcaacacagaactggatgacttgtatatatactgttatggttatgtatatgtgcccaacaagaaaaataagctgctattttgtttaaatatatattcttaactgtttgttcccttcaacacaaagcaaatctccatagctgagaacctggccccaaacattttgagctcacttttgcctggtatgtcaactcaaagagtatgctacattttgagcaacatctaaaagcacagtaggacaaaatcaaagagggcagagtcaaaagaaaagtgaccattcagcttctggcagttctgaagacctggagggaggaagaaaagccatgtaggaagagttcagttctggaaacatagtcctttttcctatctctcccaagttcagcccttactgaggccagtctttccactctgtaaataaaaaacaataaacaaaacaaaaagacagactcagagcaccgaagtaatctacaaacttgcataagcttattcagctgggtagtatcagacttagagcttaagcttaaaatgctcgtgactctgtgcctctcagtattttctgcaccctgtgtagaaaacagctttgcagtgaacagtggcagcaacgaaacacaacgatttccttttcaatgtcagagaaaggttcttctgcgttgattaaaatcattactgtgagaaggtttctctatataaggtagcacatgttaagatgatttctgagcaagaacaaactaaagctaaatatagattgaagtcagaaaatggtatggagacatgaggttatggaccttatattataatacaagattgacatgtacagctataagaatgatacagtattaggaaatgctgaaatttatttatttt

SEQ ID NO: 20409 - DNA, 1151 bp, Mus musculus
aggaaatgaatattgctttaagtaatacagttggcctgctattattcaccaagtatctttctataatttatagtgcttctgttttgaagaacaaaggcttaatccacaagaagaagtagatatgccagtgtttttctacattgatcctgaatttgcagaagatccaagaatggtgaatgtcgacctcatcactctttcttacactttttttgaagcaaaggaagggcacaagttgccagttccaggctataattgaagcagctcccaaggcctgcttcagatttgtgatttttggaaaatcatgtattgctttctcagaagagaaatattctatagtaatgtattttaaagccttgtattttaaatggttttacctttctttctttctttgcaccttcatttatcccacttaagactgaaagaacaagttcaaaactcagtctgtggtgaaaagatgctgctatcctgtgatggtgcttaagggtaggaaacaaacacagctctgttttaagtaatagaatatgaatattgttcatattccaagcctgaagaatatatgactgcccaagtgtgactattaaaaactgcatcatgggccagggatatgaatcagtgggttaaataaagtgtttgccacataggcctgacaacttgatttctattcccggaaccagccttaaaagagtgactacagtagctcctacctgtaatcccagagttcttacagtgagctgggaggtggagccaggagaatcatcttgcctgtatatgcatgctctggctgcccacacacagatataaactgctttaacagttcagtttaagtcctcctgaagtattagcccttcacatctataataatgtatctgaaaacttcgaaacagaatcgacatgcaactgtttagttcataggcatgctggttgctgttttccttcagtataaactgacaccatttaaaaattttaaaatttatcttcttaatatgtggggaggatgaatgctacccatgctgcagcagacaatgggcaagctgtgggagacagctttctctcactgtgagggtctcaggaatcaggggagcacgtgccttcaccggcagagctttctctggctgacccaacagtgtggaggaggagacacttgctccaag

SEQ ID NO: 20410 - DNA, 1147 bp, Mus musculus
cagctgttttgacttgctaattcattacttctcagctttttatctttacaactttttacatgtctgtctaggccaaacatcgtggtgcatgcctttaagcccaccacccaagcgtccgaagatacagctttgcttggactatgtagtaaagatacagctttgcttggactatatagtaaagcccccatttcacagaagcaacaggagatttaaccttccacataaacttcaaagacaagttgtctttggtctttgggtttcaaatacatgaccaataaatgggtaaagccaaaagattttaagtagttccacgcttagatttatattctaataggtcctaatctttaaaggttccaattaacttttatcttaaaaatgcatgttttactgtcctgtacctcattgtggttcataggcatgtaccaccatattcaatttatacagtgatggggattaagtctggggcttgtgggtgctaggtattcttattaactgacactgcatccccagacaagagtttactgcttctttttgtttgtttgtttgtttgtctctctccccctcccgcccgtctgaggcacagtttctctgtatagccctggctgtcctggaactcaatttgtagaccaggctggcctcgaactcagaaatcctctggcctcccgagttctctgcaccaccacgccctgccccggagggttcttaaaaagtaaacagtaaactaaccagggcgtggttgtacgcgcctttaatcccagaagtcgggaggcagaggcctgcctggtctacaaagtgagttccaggacagccagggctaaacagagaaaccctgtctcgaagaaagaaagaaagaaagaaagaaagaaagaaaggaaggaaggaaggaaggaaggaaggaaaagaaagaaagaaaagaaagagaaaggaaggaaggaaggaaaagaaagaaagaaaccaaaaacctccttccctctgcaagaatatactttctcttctgtctttgctagaaagcgtaatgaagggtgaaaaggctataaatccacttgaatagtctctgaatggaagaaagggctgtaatgatagttggggacactgtcagaagaggcttgagctgcacttctgccgttgtcgagccccatggccttgt

SEQ ID NO: 20411 - DNA, 1348 bp, Mus musculus
ggacacatctatgtattctcagtcactcagctctcagaaggcttaaggccagcgttaggcaaacctgcctcaaaataagaaagagtgctgggaagattgctccgtggttgatgttcttccaggggacacaggttcagtatccatcacccacgtggcagttcacaactgtctataactccagttccagaggatccagtggcctcttctgacctttatgaataccaggcacacattcatgcaggcaaaacacccatacacttttttttttttttaagaaatttggaatatttgaaaaggatacagatgttgtctgctaagcctgcagcctattatcgcagcagtttgggaggctgagtgggaggatcacctgagtttgaggccagcccaagcagaaacagaccctttcccaataaacaacaacacaagtatcagtgctcagtactaggttttcacttgtcaaatctgacttagctgaatttgtgttaagggcttgtaaaggggatgtgtatgtgcattgtgtcatgtcactggtttcttctacgaagacagaacattcttcacaatccaaaagaaaaagcagactggttcgggatgtttgacggctatgatagctgcagtgaggacacaagtagcagctccagctctgaggagagtgaagaagaagttgctcctttaccttccaatctcccaatcatcaagaataatggacaagtctacacatacccagatggtaaatctggcatgggtgagtgtctgcactttgacctgttgtgtgactttacctttgagcttgtgttttcattggaccttttgctaagttctgtttcattttattttattttgagatagtgtgttgctatagctcagacttgtctagaacttagaatcgtcctgtctttgtctccgaagtgctgagattataaacaatggcaccatgcttgctctggcccataggtttgtttgtttctcaatatgaatggttgtgagccaccatgtgattgctgggatttgaactcacgacctccagaagagcagtcattgctcttaaccgctgagccatctcagcagtcctcccttagaattcttaaaggactgttttaagagactgagcctcaaagtcaggagtttcaggtgacgtcagagagtttgtgtttcatttctttgtcgttgccatcctatcttccagtggggaacaagtagaacaaaatcataaacaacatattagtacacaataaattcagttaatgactatctctaaagagctgaatgaaagtgggagtgctcatacagtttttaaaaacaatcagtgcttactctgtgataatttattctaatatttgagacagag

SEQ ID NO: 20412 - DNA, 1190 bp, Mus musculus
tgtttgggaaatgttaatcatactgatcatcccagcacttggaaggtggaggaagagtctttagccctgcaatcagtttgatgccagcttcgtctacaagagaccctacctcaaaagaaaactacccattctcaggaaactgtactcccacaccacatgttcccactgtggtgtttgccatcttaagcatgtgagaaatttaggtaaaatagaaatacagaggaaaaagctatgctctgaagcgttgtctttgtattaacaggggattctcaaagttgaacagtagtccaacagatcagtattggccagggacttacagattttccacaccatcccattccctagcatgggactggagtccttggaaggggcacctctgttaataaacagcaggtggttctgttacaaggggacagcaaagcttgacagccattaccttaaaagctgtatcattttaattttgtttcttactatgtaatgattgatttgttgactttaggttataatgcccttttgagatatgaaggatttgaaaatgattcttctctggacttctggtgcaatatatgtgggtctgatattcatccagttggttggtgtgcagctagtggaaaacctctcgttcctcctagaagtgagtggcctcatggtcatttaattctgttttaaacttcagattcatttgtcttataggtatgaatattttgcctgtatgtatcaatgtatacatgaataagtgcatgcctgacctcacagagggcattggagtccctcaaagcttcaattctaaccaattgtgagccgccagttggcactgggaatcaaaccctagtcctacaggagcagcacaagtgctctaaaccactgagccaactccccagcccacggtcatttaaaatgtagatctaagtggtggtttatgcataatattctaaagtaagacagaaattcaagtggatgtttttacgtcgattaattcttatgctagcaagatgtatactttctccatgcttgctacccttaagcaccttaatactcataacttgttgttaaccttgtttctctgtttttgggggggttttattattaatttgtgaaacagttctgtctgctaaaggataactagttatttcttttattttagctgttcaacataaatatacaaactggaaagcttttctagtaaaaag

SEQ ID NO: 20413 - DNA, 1289 bp, Mus musculus
aggtaaaaataggatccttaaagaattaaagagctcttttaaaagaatgatttagaaggacttttacagaattgtaatttctgaactgttaaataccaagtacattttcatacccataatctcagtactgaggagactgaggcagaaggatggctagaagtttaaagttaacctgtaggctaaagagtgaagccctgtcccccaaaacaagagccaggcctggtgatgcgtacatttaatctctgcacttgggaagcagaggctggtggagatctgtaaattcaatgctggccttatctatgtagcaggttccaaaacagccagggctaccttgtctctcattcattcatagatagataggtagatagggttccagtacttgaaaggttgagaaccactgttctaagggaacaaaatttacagaataaacccataaatataggtacgtagatagacagacaggcaagaagggagggcaatattaaagctgcatatagacctttgtcataagtctccaacaagattttttttctgcttttgtttgaaggtttctgagagtatgcaatatcctttcaaaccttgcatgagagtagaagtagttgacaagaggcatttatgtcgaacaagagtagcagtggtggaaagtgtaattggaggacgactacggctggtgtatgaagagagtgaagatagaacagacgacttctggtgccacatgcacagccccttaatccaccatattggatggtcaagaagcataggccatcgattcaagagatcaggtaagcaactgtcaaaaaactttcagtaatattagttaggttgcataactacttggttgtttctcctacaaagtaaagatccaaaatagcattctcatctgattattctacaatagagtactaattccttatgttccttccacttcctctccatttaaaataatgaacattcatgcatgagaccatgagttttatttctagcacaaaaagacaattttaatccctttctctcacaactacaattgtattcctactcattttttttttttatccagaccatttgaaagctataaggagattcctttccacataattttaatctaaatagcaagattgaacttaactaactagacatggtatgaaacacacgaaacattgttctagagaggcctagtggtgtaggcctgtagtcccagctgtgcaggagggtcaggcatgatcattcattataagttcaagaatagcctcagtatcgtagtgagcccctccctcaaaacaaaaagtgaa

SEQ ID NO: 20414 - DNA, 3187 bp, Mus musculus
tataacttttttggtaagataaaagtttaggtagcaggattgaaggaaatgattaagaaggatatagttgtaaatgcaaatgaactgtcattacaaatgaaccttcttggtacctgttgggagattttttggattttagagttaggccagtcacatctccagcttcctttgctgcgaaaatatgcaactgaacccctcacagagggctcatcaccatgtagatcacggaaggggtcattaattgtgctcgctgacgttttattgcagcccatttaactgtttgtacagaaactttttcattctgctaaaatttatttggagttgtatatgaaactaggagaactctggatacttttatatgctctccttcacgtaaagatgattaaaattgtctaacactaaagtgttaaactggaatggttgacaaagtacacaagatctcagtctacataaagggttgggggaaattagtattttcctaagtttattctgttttccttgctagaaaaatcccataaaagggatattcttgtcagacctctgccatttcttccatctgtgagagagcaacgtgatgtaaccacacctgagagcaggtactgtcctgtgttacaaaagaatcacatggaaaattgttaaccaaaataagtgtagatttcagaatcattccagctctactcttaactgtcctgaatttgttagaaactgatttgaaagaaatgtttcttaaaattccatacacacacacacacatattatgaattgtctttaattgtagtcagaatttattataacaatatttgatttggaccattttaaacattccctattttaaaattcatacggcttccttaagaagtagaatgaaagggtaaattggtgacatgtttgctctctgcattttctaaccttctaccgaattgtgactgactcagagagctctagcatttaccagtgaggttcagaaactaaactctcaggaattcattgcatctgttgtagaagtgcttctgggtctgagcctggcctcctcagagtggtaatactgcccacttcctctggaaaataggcagggctaatgagaaactaatcaaatgattaacctctgcggcccttcagcctttggaatgctttaaaaaaaaaaaaaaaaaaaagaaagtaaaaagaatgctaatggaaaaccccaggagacattttaggtaagattttttgtttgacttttaaatgcatagaacattaaaaaccagcaatttattttctaaaatattgctctacttttgggaataatagcattggtaatatgcacaggtttacctcattctatgcaagaggggttaataacataaggttttgtagtagctactggaagtaaaatgtgttactttttagtgtaaaaatgtatggaatcgcatgtcaccatttttttaatactgactctgggggctaaatgcagatcacatcaatgcaagttgattcttgtgtcaaatatatgtgaattcagctgtaaaattactggatatttatcttaacagtgctgagagggacctactgtaaatgtgacatcctcacacttcccaaatctttgacttggaaggatcttcccagaagcttaaagcctagaagaggtccaaagcaaaggtcatagcagtctttattctcaggctcagcatgaaacccagaactgtgcttccatggtaccagggcaagaagcctgttggatggggtgctctcctgccttgggtggaggagctctccagggaactaactttaagccaggaaggatgtgatttcaaggcagccagtcctggtaatcagttctgtgaaataatcatttgtagccaggttttacaagcttccaattctacaccaaaaccaggcttggcgttagaattccccgcctacattcacaaagtgtttatgttctctaatagtgaagggttggtaaggacttgctagagtccaaacagaacccgaagccctcttctttgttaagaccctcgctcctgctgctaacacagaccgttaaccagaggaggcttccatcgtagccataatgcctgtcgtcgtacagctcagtagcccgttctctttcacagttcaacgtgtactgccgaccttggacttgtttgtgttttcctgttagaagcctgggaacttttagtagtttaatctttttaaccattttccttgcagtgtatgaggaaagctaaagctgttatcaacttcttattctgcggatactaacacgggttttcagtgtttgtttgtttttattattaattaattttgtgtgatgtgaataccctcgcccatcaatatttgtattatggtgctatatatttggtaatgatcctttaatattggggagggattttaaaaatactgtgattaaactgggtatcttcctttgattttcatattttaaataaagccacagtcatttatacaaaaaaaaaaaaaaaaaaagcatctgtccctgggcaaacctttcaaggacagaggccaaagtaaagtacgtaaggtttttacattgtttctgtgtgcgtttgatatataaacaatatctggacaaatttaatcttttattttctggtaacttgtgattattgaggaagtgtttgaagctttctcatggaatgtatataatggcgtgaaaaattccttcagagaaatttatgttcctttcatttttaccaaaatgcaaattttcagcatggatgtgaaaagcattaaaattataactttgtgtacaagatgaaaataattcactaaatttgccctttttttacacaaaataaaatgttaaagttaagctttattttatcaatttttcaacattgattttgtttactaggtaatgtgggtagataagccatggcacacatggagggtaacgggcaggcaacagttttctttttccagttccatgaggggtcctggagtagatagaactcgggttgtcattgtatgaatgtgtgtgtctctgtataattcaaagtacaactttctttcactgtggaatcaggattgaactagtcaagctaaccctatgcactctaacctctcccacatgcaattaagacaggtggtagaaagcggctgggtactcaggggacccttctcaccccttcagggtgggctgtaaataatcagcactaggtatggagtaattcttttgcaagggagc

SEQ ID NO: 20415 - DNA, 1294 bp, Mus musculus
cagggctacagagaaaccctgtctcgaaaaaaaaaccaaaaaaatccaaaactcaaaaaaactgagccatctcttctgctgctagtttagttgtttcttgagacaatgtctaaagtaggctagctggcctcaaaattgctatgtagctgaggctatccttgaatttctgatgccccaaacccttacccctctctcaaaggcactggccactccaccaggtttcaggtcactttaaaatattaattttgtcttcctgcctctgaaggcggaagctgatttgcttgcttggtcccattggctgtgcctttcttggacagagagtctgaccagcatcttccctgaaggctcgggctgctcacaggaagtccttctttcatgtcattctgaagtacttgggactctggcttttctgatgccatggccttccgctatccatagtcgagcgcaaggggctatgggcaggcttatctctcccatttgtaatgatgtcacctctctccccacccaggaacatcattcatggcagcgattctgtaaagagcgcagagaaggagatcagcttgtggtttcagcctgaggagctggtggagtacaagagctgtgcgcagaactggatctatgagtgacaggacggtgctggttttctacctgcttactcttgttctcacaggcaggggaccagcaaccctagatatttctggaacttctttgacctggaaggaacctttgggagctgtgactccctgtgcagtgttacgtgccactgttagattaaagtgtttaatctgtactttgtattgctgtacagctctgcattccttacctccttcaggcttctggataatctgagtggacagaatgtaaatgttttacaaattacttatattggcctcatgtgcacacagagattcttttcatttgtggtttgagccaccaccctgagacacaagggcatttctttgtctatctcccttcctatcacctgtgttctgttctctcctggcacagtcagacaacaatttgtgtggaggatgtgtgaggttgtgaaaactgttctgggaacagagaattcattagaaataaagatgccaagccaagcctgttggcccaggcctgtaattctaacactcaggagacagaggcagggggatgaattccaggccagcctagactacatagtgaaaccttgtcaaaacaaaacaaatcaaacagctgggtgtagtggagcatgctttttaatcccagcactggggaggcagaggcactctctcaaaaaaccaaaaccggaaaacaa

SEQ ID NO: 20416 - DNA, 2625 bp, Mus musculus
gcaatgaatgagtctgtgagagacagacgaggatgaggaagttgcctcttctgcatggtttattttccctttttcctttatttaatgctctttttgtgaaagacatttcaccacataataatgtgagcattttcccctgttacctttatattacacaatctgttctatggtaacaatacagaggagcgagctagtttactgcaccagtgttaataggaaatttcagtatatcatgaacaaatcgaagaaggtttactttctgtaaactgataaattacagaaagcaatccagatgtggtttgctctgccacagtctaatgtcactcacttaattgatgaggccatgttttacctgtcactaataatggaactaatggaaaagacttaataaatgaaattgtaccatgaagtacaatagagttttccccagtgtattatagaattgacgcactaataacagacggattatcacgatttgtctgaatgtcccaagagcgctaagagctaactgtaaagtactttaactttcactttcaattctgacaaatcttgtttatatggtatataaaactttgttttcatcagactcggggggttttatattaaagaaattaaggctacactatttaaataaaatttcttgttcctgtctcattagaactctaaagtttacgaagcctgcttctctgaatattctcatattttagatgaatttcacccattttcatactgacatttaagaagtgtattatctgacgtttaggaaataacctgggaagtgtggaggacacttcaatactggaaggatggtctaaaaggaaattatgttttgaattccttgtcctagagaatggtggtagtggattcagttttttccatagaaaaaaatgtacccattagccacatgtccctaggctgctcttaacctatcacggaggggacactgtggtggccgtggattctgcctcgtttgctgagtgcttaatgagtaggaaaggtgatttgttttattctgtataaaactaccaaacacctagtgcttgcttggtataactactcttcagcatttgttccctgataaaatgccatcttcaaggaagtgcggtgggaaagcaggcagagtctgcacctgtctccattcgtggcatccatctgagaaagtggggtcacatctagctttaactggtaaccttaggaggtttcaaaaaccatgagctacaggcttgctttcctctctcaagcttcctgaaagtaaatgatttaccatttcttacccactgctgcaagcaaagttgaacttaattttatgtgatctcttaaaaacatacaggaaacaggtcttcgggtcattggaaggaccacctcatagaaaagaaatcaaatacagatctctaattgtccaagtacgggggatttcccccggactgtcatacaaaaatatgtgtaaaaaatataccagggatttttttcacatgtatatgattaggctagatcctaaaatacataggacctagtgagcatgggaggcttttgtatcattaagcacattgggcacactctaaaattgtggccctgtatgttttaaaagaaaaacacctgttttgataaagctgtataaaggataatcaatattttgtttgatctacttattcattttttttggtgcagaccacttctttagcttgtctgctatgtctttattttaaatctgaatcatttgtggcaaatacttttaaaaagcattattaacatttattggaaatgttgtataaattcataaggaaacacaaaagttttggagagttttaatcccaagaagtgtccctgtcattgttcagaagtgcttttcatgtttgtgtggtccagagtaactcagggaatcagatgctaaagaagaaatattcaaatgtgttaccctggttataattgtttctttgaaatgtaacaatgttgacttcacttgcagactgtaggtgcatggtgattttagctaaagatctcacattactgtggccctgtgaactagctcaaggacgagagaacgcagaggcacccgtgcggcttgttttaagggctgtgcttatatttgtaattctgcttctcttcctcttcccccataacacaaatattcttgtgatgtttattttggtcaagggggtgatctttggaagaaataccaggataagctgattgcagacagtgacagggtctaaaatgccattgtcaccacagggccaagaaggcttacgtgcctctaggcagcctcccatgcaaaaactgacttttaaaggaagaaggcagggcactgagagttctcgttttgttacatccgggttatatgggttatatatgaggctaaaccgtatgaattgccagtggacagccattactggtctatagaaatagcagtgctgtatgtttcaacctaacacgcgataggaagtgcaggttaaatctctgtgaggcaaaaggaaggagactgctttctacaactcaggtttgagaataacttctctaactcatgtagatccaaatttgtctttcttacaagttgcagcttgcagggagtttaaaacatttcaacatagagcgatgcggcccatcactattgaggtggaatgtggt

SEQ ID NO: 20417 - DNA, 1178 bp, Mus musculus
tcacctggagtaggttgtggtaacttaactcttgtctgggcagctcaatttcaatgaagtcattttctctggaatcctgaattctcactttaagcaccagctctggtcacccataaattcaacatagtttttttaagagataaaatacccattttaaagattgttaacatcagttattagagcaaagatgatgctaagaattgaaccataagtagacttgaagtttttgcagatatgctgcgctgaccgtagtttgtgcccacctggccaactactaatagatttgattgcagtttgatgccagccagtctttccaaggtgtgtttttgtttagttatttggaaaagacatatgtctttgaatgccatgtgtgtgtgtgcaggtacctgtggccaaaaagtgttcgatcttctggactggagttagagtcagttgtgacctgccagatgagaaccaaactggactcctggaagagctgtaagcacccagctttctgagccatctctccagcccccatttgtctttaaaagcaggtctcactatacagcccaaatagaccttgaactctggactctcctacctcagccttggaatgacaggcatgcatgccacacctggcatcttcctgtgtctggactggggactaaatacatgtacagcaagtatactctgagtgatatttttagctcttagagatttaaaatacataatggaggattggagagatagatgcctcagtggttaagagcactagctgctcctccagagaacctgggttccattcccagcacccacatgatagctaataactatctgtaactccagttacagggatccactggcctctgagggtaccagccacacatggtgcacatacgtacatgcagaaaatcacccatacatatgaaaggaaagcacacagtggatattttaagacagtgtagcagttgggatatttggccgttggaaagttactatgaaatatttattgggccaggtgccaatcacttagtgtgattcttgcagcatcccttgagagctagtgatttgtgcaactatggcactgaatgtgagtcttgacagtttactctctcaaggactgtatggactagagagatgcggagccatgtggtgagcagtttgacaacatggtccaagagcctaggccttacctagac

SEQ ID NO: 20418 - DNA, 1901 bp, Mus musculus
ggtgttgtgagcggcccatgaaaagccaaattagaaatcaaggattcagtcaaactaagcaggtattcatgccaggtactcctttctctacccacatccgtgtttgaatgctattgcctgtgacctttacgcttaactgttgtgtatcctttttgttctttacaagaagcacagaggggttttttgtgtattgcgtgaaatcttacaaagcctatgttaacagaatggaattttttttcaactgtgtgtagggatgcagtggtgcccagaattagatatctttaaagaattttaaatacaataaacacttcatattacccgccttgttacattcagtgcaattctcaagtctttaagaggtatgtgtttaatgtttcctactgtgtaggagaatttgcagtcagccatagtatagaggaataatcactggctgagacatcgaaagcaacagcatctagccaggacagacacttggatcagtgacacaaagaactgattgactatcagatgaggttgggttcttaaagaactgtttcaagctaggttttatagatattcttaaaacctctaactgttcaatcttcgggctagtggtgtgggatgaaatattcctaatgaaaggaagtaccaattagttgatttattggtggcattcctgttttagaaaagcagtgtagttctgtctgtgtgaaccattcactcataggcagcacacacaggcacatggctctaagcaccacactgattgattgatgccttgatgtaaaaacagtacattttatatacacgtgtcatggttagcagttagcgactgggccaacacttagtcataaaagtttaccttttatatgctgtctaattatcaattttccccaaattttgcattgtaggactactgttgaagagtttttgaagaatactgaaaacggaataaagtgaagatcaacattaaaatgaggtgaaagaaagctatagtggcatagaaaaagtataaagctcagttagttatttggtttttttattattattattaaaaattaattcaggactgttgtgacctaccagatttcagaacatgtgttaatagcacatatgccactttgaaaacttaggtcctgtatcatattttttctttaagactttttaagaaatattacctaaacatgtggcttgctcagtgtttacttgcaagttttcagtcttggactttgaagccaggattccacgttagtgctcatgtggagcagactggggctccgttttacacttgtgctctccttagcctttggatttagaagtgaaaataaagtatctctgacttcctgttgcagagttgattgtctgtgtcattgaaaggctcagtgctgctctcttccaataaagtgacgactccaactactctcttgttttaaatatgaggcatactagtaatgcaggcgcagtgaacttttcctaacctgtcctgttgaaggttaatttttttatacaatttcctgtttgatgttttaatggtgcttcaatcttggctggttatgaataaatttggatttgctttcaatagcaaaggtgcatagtgaactgcaatatatttttacacccatgaggtttctttagtagtaaaaggttctaaataacctcacagtgtcttcctctggtaacctatgaaaaggatttaggcagacattcagaaacttccagctgttcctttcctttaaatcctatactagtaatttcttttaacccagtcttgtttggttataaatgtatatattgctgtgtatgtagtgtgtagtacatataacaaagatatttgagaagtaataaggcaggtatttcaactggaagtagcagcatgtttgtatctagccccatcgactgtataaagtaccaccccaaccaca

SEQ ID NO: 20419 - DNA, 1110 bp, Mus musculus
gtgctaggtagatgtataaggattgaaaggtgagcttcaatcttaagggaagcccccttctgttttggctctctgtatctgtaactggcctagagcttgctgtatagatcaggctggactcaaactcactgagatctgcctgcctttgctttcagattgctgggattaacagcaagattttcaataattttcatcctctaaaaagtgctttgctggtttttcttttttaaaatttttccagacagggtttctctgtgtatccctggatgtccttggaactcactctgtagaccaggctgcctgtttgtttcttaagggaaacttttacttaaatcttttgaattattattgaatagtaataatatatgtgattctctgagcccttttagtaataccagctgaaattgtttcctttttcttaaattattaagaagtagagatcgacgaagaagcagaagccatgacagatcagaaagaaaacatagatctcgcagtcgggatcgaagacggtcaaaaagccgagatcgaaagtcatataagcacaggagcaaaagtcgggacagagaacaagatagaaagtccaaggagaaaggttggtttactatgagaggtgctggcagcaacccgtacccctacttgctgtgctccaggacagccatctcaatttcaagctcgctctctctctcttcttgctctgatgtgaaggtggaagttggtctcattactcagttgccagcctgaccgtcttaaagactttctgagcttgagctgccttgaggatgattagctggtagaattgtttaacttttgtttatttggctacatttattttaagctgcaatagtccattgtgtctcccaaagtgtatgtacatctttcattgtttctactgtatagcagtcattaactcagcggttagcttccgtgtgctcagaaggtggacacctcacttgtcttagcagcctttgtattgtatctgcatgctgttcccgtctgctctcttctggggtctgtagctctcagtagctgctgcgttactgttagtggttaatggactgtaaaattggcccttggcctattttcattaaaaaattctcttttagcctttat

SEQ ID NO: 20420 - DNA, 1195 bp, Mus musculus
actttcaactctgattcatgaatagtaaatctgctcccaagcaagagctcctcccttattaaggtgcagtatttcaagtcaggcttagatgcagctgtttgttgttattccttggctgttctgttttgatttagtggttggttttactgttgttgttgtttacttgttttgtttttgttgattgggtatgtatcctaatctggcctagaactcactatgtagaccaagctggcctggacctcacagagatctgcctgtttctgcatcctgacttgctaggatgaattaattgttttggtgtttgagacagtgtctcactatgtagtccaggctatcctgaaacctctggtctttctctccgcctcccgtgctgggattgtaagtgtgagccacaatccatgcctgcctcctttactgtctgtatttcagtcctgactggactcagtgaatgctgcaggccttaaattacatgctctgtgctacactaccatttctctctctctcttttctagagctggtactcaaagtgaggattcagaatccatctcttcgtgaaaatgacttcattgaaattgaactggatcgacaggaactcacctaccaagaactgctgagagtgagctgctgtgagctgggtgttaatccagaccaagtggaaaagataagaaagttacccaacactctgttaagaaaggtaaggaaagtctgctcagtgtgagtggttgctgttttcatttcaagcacacttaacttctcccttggttattgagccatagcttaagtggaagccaataaaaaggacaaaggagagccaaggccaaggccaggttaaagcttgtgcttgctatgtgcaaggctctgagctccagctccagccttactgtaatcactccataagctttcttccccttcctctgagtccacagagaagcccccaccttactcatgtatttctttccaggcagggtcttgatgtgtagccctagcttgcttggtatttgttgtgtgtctcaggccagccttggatttatggcagtcctcctgcctctgcttcttgcctgctaggattaaatgtgtgaacgatcatactctaatacactggcacttttgaaggttggaagatagcaggatgttacatgggcctgtttcagttgttcccatagtaacctgtagccttatgccatatgatatgcgg

SEQ ID NO: 20421 - DNA, 2084 bp, Mus musculus
gtgcaggatctagagagttgtcaaagcagaagctgagagcgcagacctatttctagccactcctgttgacagtgcgcctgaagggccgggcgtgcctctcttggtgttgcatgctcgtgacactcaagaaattttgaactgatgagggaggaagactggggaaagaaagaaagcacacacaggtactggacagagggattctggtatgacctgtggctgtgaggtctcatatagcatatttataaatgttactcaggtttaaagtatttaaaatatagttacctaattgtaaataggctgttaaccaaaagagcttcccctcccccagttttcttttatgaccactgatgactgcggctgtctcgacagtcatcttcacatctgctcccctccacagtcactagagggctctctaatgctttctaaaggagccaccacctgctccgtggccactcctgtcaccctgtctaattgcaccattcaagaagagcacaggcgctgttggacaaggcgcccaccactctcactccctccaggaacaaagagcagcttttgagcccggacttgttgctggtttaaaggttattgtgggaaactgaactaaaggagttagcatctttatttttgtatcaaagataaaggttattttgaaaattattagggtttttacataactctggaatctgttgcttttataaacaaattgttcaattttaggaattccccgttacctccacagtcagttgtgagggcctgattagactctggagcatggtgtacgactcttctccaagagcgcatgcaagagtctccccccctcagcctcattaaagacgaaaagccacctcggtttgcttaactttagatagataggacctggcgcacacaagagcaggagaacagggctggagcagctgttgacgggacccctgctgtcttaagcttttccccatagtgcctatagtttccaaagaaacttaacttcctgggtattaacttaattttattagaacactgcagttgactgaaaacatgcagatgcactggaagagaaccttgtgctgaggtaatggcctcccactgccgcctgagtgctgaaatgagcttgaggtgttcttcaaagccagtgtcactgtgtgggtcactgtgaggtgactgcatggtgcctggccctggcacagctggtgacttcccttgtagagtgtttgcgtagtggagtggctgtggctcaccaccccctttcccaagtgctttaatgaagacacctcccttgtgtttcaaccaatcagaaactactttaactaaatgtactaacctttttccctcctaatttgctttgaaaaagtttagtaattcaattaagcgtgattctatcttagaagaaataaactcagtattaattcatgtctaaatcactggggttgagactccttcagcctccctggttgattagagattctgagaagcagtagagctggctgggaggtgggctacagaggagcaagcaagcacttcagactgaccaaaggttgtggtggcccacatggctctgcccagtgtcctgtgctttgccacagtcctctggggtcagtgtctcgggcagtgggatggaactgtgtgattgctcttaggtgagttccgagtcttaatctatgcattcagagaaatatttttatatgcgttgtgtaatttataacaaggggttttcttttaggctttgttaactgaatgctcctctcctcctccactgcatagttaaagcatgtgttcacactgtgtaaacattcacagaagacttttcctcgtgtgttgttgactctttaaacataacaggtattattaaaattaactgttaactgacccagcccattctctctcgttttgccctcgttttgccactgtattctaatcatagagggttcaaattgctgtgaagtcccatggggctggcgctgtggaggaaaaagaggaccagatccccagccgagtgtctgccaccccactgttgcctgcctctgccctgtcacgagtgtcactgtctcaccccgtgggtcgtgtctggagatggattctgtgtgatgtct

SEQ ID NO: 20422 - DNA, 1027 bp, Mus musculus
ttggctgtcctggaactcactttgtagaccaggctggcctcgaactcagaaatccatctgcctctgcctctgctgggattaaaggcgagcaccaccatgcccggctgagaagcattgtttttaagggaaacttatttggcctaagctggccaaatactgtgtagctgagggtggcctctgcctcagcttcctgagtgctgggagtatatttttcatacagatattccttatatagcccaaagtagcctaaaactcataattctacacacacgatcagcaactcttccatcctaagtgctaggattatagaccttgctgcagtacctaaatcctaccgtttctatgtgatccgtggtgtaaagaaggcggatgaacccatcccttaaccactcaggcagtcagtctgctggggtgtgtgtgagaggagtcaaattgtgcatattatgttgtagaggcagagaagaagcgtgaggccaagcagcaagctaaggaagcgaaggagcgcgagctgcggaagcgggagaaggcggaggagaaggagcgccggcggaaggagtatgacgctcagaaggcgtccaagcgggagcaagagaagaagcctaagaaagaggcaaaccaggccccgagtaagtctgctttccattttcagggtgcagcgggggtgtgcctattcgtccttgccctgagtgagtgactagtgtcactgctgcttgtttgttgagggtgggagttagatctgtttggcagcagtgaagaataaataagaaaactctcatagctcttgcctaaagtgggcatggtagtactgtgaggtggaggcaggaagaccactgcattcaaggccagcttgctctacatgtcagattgcaggacagctggagagacatagtaacaccctgtttctaaaacaaacaaaacccaattctctttgcctttttcaacctaaaaatgtcaagctttttttttcattataaatgtaatgtgggaagctgggcatgttgacatatctgtaaccttgaagtagagg

SEQ ID NO: 20423 - DNA, 2411 bp, Mus musculus
aactttgtctctgtaactccttagaatgccatttttaaatgtagtccttagagaccatggggaagactgtttctacctgagtgggaggggatctagctctcatttcgatgatcctaaactgtctgctcagggcttgagaaggaagtggctctgcgtggactgactgtagagctgctctccacaaattcacgtattctgtccctccagaatcgaagtctggctctcgtcctcgcaagccaccaccccgaaaacacactcgctcctgggctgtgctgaaggtgttgctgttgctcctgctgctgtgtgtagcaggagggctggttgtatgccgggtgacagggctgcaccagcagcccctctgcaccagcgtgaacaccatctacgacaatgcggtccagggcctgcgtcatcatgagatcctccagtgggtcctgcaaaccgactcccagcagtgagctcaccctcagcacccgctgcctcccagccttggagcttggattcctatggaattgggttctgctggacacaacctctttttagcgtcagacctacctgccatcatcacatggctgctggtggtacttgagatctcccctttgtaggacttctgttccatagtcagggttccctggtggaatgaggagaaatggagaggggggaggaagagttacctgcatgcctaaaggagtaggcttaggggtggggagagagaaggcataggcttttctagttatacaaagctgtgtaaggcaaggttcctttctactaaatggtcagctgtcactacatttatacttttgtatgtcataaaccctttctttcattcctccctgggtaaccaggacaatcggagggcagtgtgttactgggattagaggactagcaatactgggtaacccagcctaagctgggaaggtgacgtaatacgtttctttaaagattcagtcagtcaagcagtttagcaatatccaaaatgtctggctgtttggtccagtgtcacatgttgaggcaggaggtgccgtctcatccatgacttgccagcagtgttcaggctagtctgaggcacaaccaggctctcattccagttttcctccttccctttatgtcattcgacctcctatataatacccaagaggatgaactcacaccagagttgtctcagctaaagcgaatctttcataacagtcttaccacccacaaatagatctcatatcatcagggtcctgggaaacttaactcctgtggaattttgcctcaacttttaaatggcttccacaaaatggcagcaggccgggttccttgcctcagttttagagcattaactcccgaatggcctggaagcagagggaactctgcaaagccgtactgtggctgctccactagcactcggtgtgatgaaatacctcaaaggcaacctagaaacttgacttcatggaagcaggtttagagttgattctggacctgtaacagaagggaaggaaggaagagaacagtgggagtcaaagggaaacaaagtcacatggtggcgctgcagagtgatacataactaaacattagcacaaccagggcagagccgcccacctccctgctgctacaagaaagcattctcccctttcccagtctcttcacaacagctgcatgaagggatcagaaacaactgtgtctcggtgcttacttgctaaaaactcccatttgcaagctccctagaggagcaaggacctgtcatagttcagcagtgtagccctagtggcccatctggataggtctgccattcaaaactgtcctgacactggaagaaaggccttggatttttcctccccagacagttctgccatgtaggcccacacctcctcagcatcacctcctcagcatcactacacgctcctttagtcttcctccaagctccacagccattggtacaaaggctttattgagacaaaatacatactacatacatatggtgacatcatgaaaacaggagtcagcctcatcatagctccctagctggttgaggcagctcagtggctgggcgtagtcaagccaacccgcaggcaagagttcactctgacttcgagatttgatgcttatttcttggatttctacaattattaaatccatgtctgagtggtctgcctttctcctttgtgctgtgagggtcaactgggatggggtgggatggctgtccatggcatctcgcttgccgggagaggaacatgagtgctatggtggaggtagattcaagtgactcagccttctctgttcccagagatgagagacttgctccctaactgtaccaaggaggtacttctggcctgtctactgtcaatagccaaggtgggatatcagtcaacactgtctaagatgagatctggttgcgctgtggtcatttgaaggtagatccgcctggataa

SEQ ID NO: 20424 - DNA, 1244 bp, Mus musculus
ctgaccgtccaaaggccatcagagctgtggggagcagatggagccaatggccagaaaggaacacactctcttcctcacctaagtgcttcccagacatgctgagggctgttagaagaaacaggagtgagcagatgggtactggggtgaagtgataggactctgctcccctagaggctaagcctgtatcccaggcttgcattggatcctaagactgagctcctccctatctcgaccaatgggccacctacacaggttcatccagggaaatgagcagacatgtaaatgaggatccttgcactgctgtctctaagtgggggatgaagtatgtgttagcatcctgcagccaggcaaggggtctgatgtggctagaaggcagtggagggagagatgtcagaagcttgtagaagcaggagcaaggtaggttgggccacagacccatcagtaggagcaaaggaagctgggtagcagtggtgcaagacttccttgctctgcttttcttggtcataacggtgtccccagagaggtagcctgtatgaggctgcccaggacccaccagtaaaccctgtggcagtaggcttgtgtgcccaactgttggacaaaaccactggggcagatttccccagctgactgtgtagtgctgtgtagagtgtggggccctctaagccttgggtgccctgcagaactcagcttttcccatataactttttttgtttttgttttgttttttttcgagacagggtttctctgtgtagccctggctgtcctggaactcactttgtagaccaggctggcctcgaactcagaaatccgcctgcctctgcctcccgagtgctgggattaaaagcgtgcgccaccacgcctggcaaccccatataactcttatatggtgtctgttagtgcccttgggcaggacaaggaaaaggctacaaagcccttaggtacttttgcctctgtggatagaccccagaccaggaaagccttcgagggaccggcaatgggtgaccctgaagagcagtgtgaagggtatgtgtacatggggatggggagagggctaaaacctttgccttctaattccttcaactgccaccaagctatgagccctcaaggacactgctgcacttctatccaacggttgcttgcctacccctcaggaagcagccacctgtcctgtccctttccatctctcttttttaaaatatttatttattttgtttatacgcatacattgttgctgtcttcagaca

SEQ ID NO: 20425 - DNA, 1184 bp, Mus musculus
cactgggccagactgcagtaaatgatagcttaggggccttcggcatcaccgaggcccctccccaaggctacatacatctttctcgctacctaagtcttgcctttgtagcctgctcaggagaggctcttgtggttatggcctactggttagttctgtaggcttccctttatggccctaggacctgagtgaatggtgcctaagttcctgctgccttcccatctgattctcttcttgttgtaaggaagggctcagcattagttcttcatgcctcacataatgtgggagtagggatggaggtttctggacctctaagatcatgtcatcagctgccacactgggcaaggctcagtttagctcagggagtacagtacgttagctgatggctgcgcgaggtgtagcgatctcccagttgccaggagggcgctcctgaccaccaacaaacagcactagggtgggtggttttgcaggttgggactgccagtcttcaggtagcaagtcccgactgagagctggaaaatgagccctagggtcagagcccctgatgctcttcggaaggggtggaggcctccagggccattctgtagctgcactctgcagttctcacagggtgtggctggccagtcaggaagtgctaagggaaggagcacacaaggtgttttgtccagagaagatgcttgctttctgtcacccactttaatgaacatttgatgctagctctccaggtggttagggtgggtggctcctcccccccaacccccttcttatttatttgttctggtaggttttttggtggtggtggtggtggtggtgggttttttgtttttgttgttttgtttgagacacggtttctctgtgtagccctggctgtcctggaactcgctctgtagaccaggttgacctcgaacttagagctctatctgcctctgcccccccccaagtgctgggattaaaggcgtgtgccaccactggcgctttgttttaatttaccaatatcaactcttatgtcaggtacagaaacttaccagctggattcagcagatgagctacaggcggtaaaccatgatagactgcatcggagactgcattgtagcggccacacccgggcccacttaagcagcccacagcacagtagttctgagtactgggttttgttttttttttttttgttttttttaaacaaacag

SEQ ID NO: 20426 - DNA, 1225 bp, Mus musculus
ccatgtatctgaagtctggaggggcacgtgaggtgccatggggtgagatggataagtgtaggagctggcatgtcactgtgcagttacggagtgagccggacgttgttaggtaaaagtagagaggagcttcgagagttcaaggcaacctcagccaagatggaacttgagggagcgaaagaggtaagtgactaaccctgatctgcttgtcttttacagaaagggaggcagaggaagccacggccactagaccctggggagggctctaaggacacagacagctctgcggggcgtaggggcagcgctgggagaaggcacggacgctggcggggccgcgctgagagcccaggtgtgcccgtggccaaggtggtgcgggcagtaaccagtcggcagagggccagccgacgggtgcccccggccccacctccggaggcaccaggccgccagaacctgagcggagcggcggccggggaagcactgataggggccccaggcttcccacagcatggagacacagggagtgtggagggtgccccccagcccacggacaacaccttcactccgaagtgtgagattgtgggcaaggacgcactgtcagcactggcccgggccagcaccaagcagtgtcaacaggagatcgctaatgtagtgtgcctgcaccaagctgggaacctaatgcccaagtctgtgccccggcactgccagctggctggtaagggactagggtaccctggccctttccagaaatggacgggaggtgatgtggcccagatcttcatgcttctttcccagaaggccctccttgtccgcagtcgtgctatatgtaccgattggcagagggggagctgggactagggctctgagtctaggcttctgttaggaggcaagcaggcagccttttcttcatctcactaatgtccctgtcctttccacgcaggcaagatgagccctggcgtccaatgggaagagatccgggcccagcagcctgttggtggccctccagtacgcatcgcctacatgctggtggttcacggccgtgctatccgccagctgaagcgtcttctgaaggccgtctaccatgagcaacacttcttttatatacatgtggacaaggtactgtgaactgggaagacccagaggctctggctgaacagagcagagactctaaaggttgtagacaggtagcctagattgttgttggctagataccaagagcaaggcaggttga

SEQ ID NO: 20427 - DNA, 1107 bp, Mus musculus
caaccctttgagcttccttacacacatctcttggatcaagcccaggaccctggaatgactgcctatcccatcatctctcttgtccttttatttaattttttgtttttattcagataagacccctccccttttgtcctgagagctaagctggattcatgatctccatcccacacttaagactgttgacttttttaagaactggggttggctgtcgtggatgtagagacatcattgctagtgggctgccaatcttgtctggacagcttgctctgccatcctacagcagcacttctgtgcctggaagagtttgaagactgaactgcacagactctgagccatcttccaaccatgcatgggcagagaggacctcactgtccctctgtagcaatgcagaaaacacagggactacgtttccatagctggctgctaagtggggatgagacaaggtcagaggctgaggaaacccttccatcttcttccagtggtgactgactgcactgagcacctgctgggaggatggagcagccaagatgtgagtgaatgcatagaccttcaccttcctgggtcctcgggggcactgaataaagaaactggaaagttctcaggatcctgttctagtcctgggacctgctttcctgggcgaccagacagaacttgattaagcatgggacacttagggagatacaaaccagaaaaccgccttctaggagaagattgggtggagagaaagcctggagaagcaggtgtggtttgagttgtgtggagtgaggccaaggaatacttcctctacattcctccgctggattcccctggaaggagaggggaggtctaccccaccttcctcttccttctggtgagcctgtgttccacactctacagctcaaccctgcccaaagttaactcctaaagggaagaaggttttgtcctgtggctgaggggctgaggacagcttggagcttggactgtccagagtgggtggggagagtgaagacagttcctggtgcccatgccttggcaccttgcccctctgtttactgtgtgtgctgcagagggatgaaggccaatgtttcccctcagacagacaaaactaccaaaatcactgcttag

SEQ ID NO: 20428 - DNA, 1155 bp, Mus musculus
gtgagacgtggaaacccgaggtatgcttgatctgtatctgccacaatggcacggctgtgtgcgatgacgtgcaatgcaatgaagaactggactgtcccaacccccaaagacgggagggcgagtgctgtgctttctgcccggaagaatacggtacggttctggtcctagggttaagggaggttggagtccctccctcgcctatgtcttgaaagcctataacacccccaggtaccttagtaaatttacttctaactgaacgtttttctccccagtatcaccaaactcagaagatgtaggagtcgaggtaataatctgctccctactttcctcccacccgtccacgacccccactgtcctccaataaactgcagttttctttgcttctcttaacggccttttgtttcttcatcctcaaccccacagggacccaagggagaccctggcccccaaggcccaagggtaagcatcgtattctaaatgagctgggaaactggagggggcgtggctctgatttgtgctcatagcagccccctccgtctcttggtgcagggacccgttggcccccctggacgagatggcatccctggacagcctggacttcctggtcctcctggtccccctgggccccccggaccccctggccttggaggagtaagtagatcttggagaccccagaggggtgtgacttcccgttttgtttgtttgtttgtctgtctgtttgtttgtttttctttgctttggttttgtcagacatagttttctattttaaaataattataaacttacagaaaatagaatagaatagaacttctatacactcttcaacacaaccgctttgccactttctgggcacccagttctctatgtcgctgtatgtcctggaccatttgagacataagttgccaagaacgtgcccgtgacttacgatcttaagtgcatttcctaagagcaagggcattctatggaaccatagcaccaaatttaatgttgatctagcctgattaatattgcctgatatgcaatctcatttgcagatttcaccaatgcctcccaaaatgttctttatagcatttctcccgcccccttcctgtctaagaccgccaattgcattccattgtctcattcctttggttcccacaaatgtagactgtttct

SEQ ID NO: 20429 - DNA, 1193 bp, Mus musculus
tttactctatccgttcctctccttccctaatgttgagacatctctccaaagtcgtctccttcttcttctagggagaccgtggtgaggctggtccccctggtcctgctggctttgccggcccccctgtgagtatcaagaccctcctcattttctgtccctagctgagacacgaggcatgggaccttggggtggctgaatgaggacagaagtgttaccctgagtcagaggagaagggtggggaggtactggtgtctccaagtgtctctgcatctccaagtccctatctgtggcccttcctctagcccagaggccctctgctctcaggctgcctcctccactcctccactctccattctccctcctgcctagggtgctgatggccaacctggtgcgaaaggtgaacctggtgatactggtgttaaaggtgatgctggtcctcctggccctgctggtcctgctggaccccccggccccattgtaagtatcttgtcttctgcaccataagctttggatagccttggacttggggctagcctggatctcataccttgacactgtcttacagggtaacgttggtgctcctggacccaaaggtcctcgtggtgctgctggtccccctgtgagtatcatatgcatctctgtcgcgactccccaaaggcagagactggagatgaggccaggtgacaggtgactgttcacttctgaccacccaatgttctctcctaccagggtgctactggcttccctggtgctgctggccgtgtcggtccccctggtccctctgtgagtatctgtggttctggaatgaggatggggtgagacatgtattgtcaggacagcaggcctggctggggcttgccactatgatgctttggaagcctggactctgacagtccttcttgtgcccatctagggaaatgctggaccccctggccctcccggtcccgttggcaaagaagggggcaaaggtccccgtggtgagactggccctgctggacgtcctggtgaagttggtcccccaggtccccccggtcctgctggtgagaaaggatctcctggtgctgatggacctgctgtaagtgctaactcacatctctgtgattgtggagagttccagagttgtgtatgtgtttcctgtgctactgtgagcccttctcacccctgtctgcctcccacagggctctcctggtacc

SEQ ID NO: 20430 - DNA, 1189 bp, Mus musculus
attggccctgcctgcttcgtgtaaactccctccaccccaatctggttccctcccacccagcccacttttccccaaccctggaaacagacgaacaacccaaactcaatttcccccaaaagccaaaaatatgggagataatttcacatggactttggaaaacattttttttcctttgcattcacctttcaaacttagtttttacctttgaccaactgaacgtgaccaaaaaccaaaagtgcattcaaccttaccaaaaaagaaaaaaaaaaaaagaataaataaataactttttaaaaaaggaagcttggtcctcttgcttgaagacctatgtgggtataagtcccttcctgcccacttggcttatgataccctaatgctgccttttctgctcctttctccaccccctcttggggcctctcctccattgctccccaaatttaagtctcccccaagacacaggaaataatgcattgtctgcccagcaaacaaaggcaatgctgaaatgtcccaccagcccctcaaccccgtctacttccctacccagcaccctcaaatcctgctgggacatggggttcttggactgttgaaggaacctaaccatctggcatctccatggcctctgcaacaaaccccccacttttttctctccccccccccccagggagggcctgtgctttgggcagccacctgcccctctcaggggtttggagccaggcagggtcacagcagactggaaacatcggacatgcatgtgcaggctgggtgggagagaccgttctattcctcagtgcaattgtgttgctgaaagactacctcgttcttgtctttgtgtgtcaccggggcaactgtgtgggggcggggatgggggcagggtggcagcacgcccagtttggtatcaaaggtgctacatctctgtgaaggggtggggtgggaaggaatttctggtgctatagaagctgagatgctccctagaccagcaaatgtttcttttgttcaaagtattttttattctttttttttttttttttaatggatagggacttgtgtgaattgttggggttttttttttttttttttttggttttgtttttttttgttttgttttgttttttttcctgaaggtgctatttaacaagggagaagagagtgcggggacttcaccctgcccactctctactctctctccact

SEQ ID NO: 20431 - DNA, 2232 bp, Mus musculus
tttgggaaggattgtggtgctggctgggagctcagggtcgtagcttagggtgggggtaaagttacagggcccgtgctgagtggccaggcctgatgcctcctctctttgttctctagatctcagaactggaaggaaacctgcagacactgaggaactccaattctacttaacaggaataactccttggccggacaataataatcccctcccattatcctcaccccctgtcctcaatccccaccccacccctaccagcctggggacaggtgccccgacttcccctactcctccaccccacctcccccagcttcagggaccagagggcccatattacaggcccctttagggtggccagggcagacaatgctggctggaagagtggtctccttgccctgtggggctgaggcgcagaggccgagagaagctaagagctggcctgggtggtggatggacacgaggacctgcagaccaaactgccagactttataacctccagcctgtgtctctggaccggagtggagctggggctctcccagcatctcaccacttggaggctgctccctgcccacagggtccgtatggcccctgggcctcttgacttgagattctccgttcttggccctttcctcttcccccatcattgtgctgtctgttgcattctggcctcctgcttggaggggttgcctcaacatctcccacccctgctccccatcccaggagggatagagcccacccttgagccagaggctgggcctgggcctgcactgatttgtatccttcagggggaggtgattgggcgtcgggggaagggtcagtccagcacacctggggtccagcacccctttcctaggaagggcaacagccctcaacttctccttgtgcctcccctctcccaggtgccaaacagccataggcgtcctcctggaactgccctgaggccactctgggcttctggtttccttggtctagcccaggaatgccaggagggagggaggtcagcttagatggtgtgcctgcagagctctccctggggagctaggccctgcctagggccacacctggaggccttgtattaccatcgaggagactctgcctcccctcttcccctcccccgctgttttccaacgttttcactggagggcaaaattttactaatctttttggagaccagggctgcttgctgtcagcctgctttctaagtgaaattgactcagtttccccactttaaccccaaattggggcttggaccaagggaggtgagaccccctcaggtaccctcccctttcagaatccatctcttgccacttccacattaccacccttgccctaagcctaaatttctgttcctttttttcttcttttgaaaacgacccagttctatccttttcggtttctccgagtcccctgtaaatagaccatgccatcaatcagtatttcttgcccgtctcttccgtccctagacgtgcccccgactccccggaaagagctggctgtcactgtgcccggcccctgcacttcacccaggcagatggagggggtggagccgggtgggcgggtcctcgatgtacttccggttttgaccggcagcgctcctgccccgcccttggaggaccccgtctctgtatataatatatatatgtatgtattgttcctggttttgtacggaccatgccctctgtcaggtcgtccccataaaagcagcccccagagcctcgtcgcctggtttcttgatgcgctggagtggggaggggaagagatgctagaaagtcctctccttttactaattttgcacatgatctagagaggatcttaatgctggttcggttctccgaccccagcaaactcacttgccaccactccctagttttcttgagctctctagacgatgtctttaggtctgtttttcacgaggtctttagagtagccagggatgggctgcacacagggaaagcaactccccttccctgaaaaccgagcaatctgcaagaccccagaggtctcaaagtaccaggaggaccaaagattccctaggagataagttgtcagagcattgtcctcacggtcaaagagaatgttctttggccctcctgagctggcttgagaggcctcatatagtcctagctgcccccttagctagctctcagttccaggaatcagttttggtgagtcgcagaagtgaattgtaatgagacttctgcagtacacaacacagccatttcttgtacagatcct

SEQ ID NO: 20432 - DNA, 1680 bp, Mus musculus
cctgcttgaattctggatactgacacaatttctcttctgcctaaaccccagtgtgacttctttaagccgacccgctactaccggattatgcccaagtaccatgcagtgcgtatccgggaggaggaccgctacccacctccagggagcacgctacccaccaagaagcactgggtcaccagctggcagattcgggaccgatactactgatgccctccccgacaaaccttccggcgctcccttccttcctatttatcataaattatgactccgacagtccaaagggggccacgcccttggctggcaccagcaggctcaggcatctatccctcttcagtgcaggcatgttttctggggccctggaatctccttcaagaccttgcaatgctgagcccagcacagcccttgcacagtggacacacacacagggcctactgctaatggcctgctctgatatatcatggagggtgccgtatccaagtctctgtctgtgccaaaaccaagccaaagcgcctctactgggagacaggaggaaaaggtccctgatgtggggacacggctcctccacactgaatcccccttgagccattgtcaatggatggagtttactgtccagaataaaactactgatgcggaggagacagtcaggctcagctgcaattcctgccaggcactggagcgcagggctacactaaaggctacccaggggatgttcttacgacctgcgtgctcagacgcaagagcaatgaactagaaagcaggtcgccggaatgggctttatgggtgcatctctaaaatcgtggctacagagagagctggcaagaaacgcagcccgaaggaacaaagagagaccgtgggcagcctggacgcacacactgtgctgggactgacctggagcatggcggcatccttcagagagcagggtcctggcgcagcagacattggtaggatgaagaggagagacttctgatccatcctgaccacctcagcctgggcaaggcctggagatccccacgagaccacgtggggtgtgatacttgaatgtagcatggcaggggagggcccagcccctgccccagttggccagacttaactctgctcccttgaccacagagatgagattctgagctgcctgtggctttcttcccctcccccaggggctgcatccccattctagcagtggaggctgatttcccaggtcctctccccatcccggtccacaggcaggcccactccccagctctgtcccctccaccccacggtactataacaacttccccgatcctgtgccttctttgtatatgggcttctcactaaaataaataaactgttcccagtttgtactgctgtgtctgctcctacctgcccccgccccaacgcccctcgtcctgaccaatctccgttcagtctggaggggtaatacccttccctagctggtcccttggcgatggacctagcaccccacagcaagccacacatgagagattttgattcaagcacagagttcacggaaatccagttttagggagagcgccatacatgggggagtgctttctttacctgtcagagttgtggcctgttcctgctgggttcattctaacatcaaacgctcctggcctggatttggggagggagggagggagggagggagggacggagggagggagggagggaaggagggag

SEQ ID NO: 20433 - DNA, 1169 bp, Mus musculus
tgtaacaggtgccactcggagcagtccccccatgctaaccaccatttaatcctgtccaattgcccttgaggtaggaaattagcattcccagattacagacaataacagagaggttgagtaactcgttcaaggccactcagccagtgtgaatagcaacgctgggcatgagctcaagtagcccaacttcccaacgcatgcttttggccatggctatactgtaaaataactgcaaatagtctctacagagcacatgaaagaactagagagagatgaaattactatactagcccacagtcacacaacttatcaggaacagagttggcacgcaagtctaaatgtgtgtgtgtgtcacaaactcagacatcaggctgcctaccagatctaaacctgcccctgtggccaaatctttgtctaagacctgctggtgtccatgagtactgcgggggctttttaactctttgactgccccctagtggctgtaggtcaaatgacaggaacatgggctgggcagagactgagaaaatggccaaatgtggggtctcagcaggctaacccagcacttgtctctcctctgcagttctctgtggacattgactcagagctggtggaggagctgccggctgagattgagctgtggttggtgcttgtggccgtgggtgctgggttgctgctgctggggctcatcatcctcctcttgtggaaggtagaacctcccagcctactggggcttcccacttcagacccgccagtgccagcactgctcacccaacctccctccatcccgtggctctgcatcccattcctcatctccatcccagatactccctgcccctccccatagcttccagtcccacccatgccccagggagctgcaggctgcaaaggggaataggggctctggtatctggctatccaggaagctgggctcaggacttagctttccaggttcctcagttctaagccccagctccccaagtgctgatggccaggtctaccagcaaccctgatggccacccccacctcctccctccagtgcggcttcttcaagcgagcccgcactcgtgccctgtatgaagctaagaggcagaaggctgagatgaagagccagccgtcagagacagaaaggctgaccgacgactactgaggggtcagcccccctgccccggccc

SEQ ID NO: 20434 - DNA, 2154 bp, Mus musculus
gttttgtgaaatggcacctcagcttaggtccattttgaattttttttttagttacctacacatcataagcataaatgaataatgatttcagttctcattgaagacagaataggaatataaagaggaaactttgcaaatctaaaaataataacatcttgtactttaagtatgttattaggacttaggtgaatctgttgctagtcattttggaatcttttttaaagcgtattggttgcatgtgtataatggttgcttccttattcttcacaggacctgatagatgagtggatagccaaagaggccaaaaggtccaactccaacaaaaccatggatccaagctgcttaaaatggacccctcccaagggcacttaaagtgacctatcattccgagccagcgagccccagcagtaggaatccgtaccctagggatctgtctgtcatttctgttgctcttgtgattggcaagtacagtatcctttgggaaggccaccccctcagcactgttctggctccagccttcgtgtacactgcagacactagttctgaggaactgttgtttcggcctcagtgaggttgcctggacggatctgtatgaggctcgagtacagatccctcatagcactgacccaaggagttgtgttatggtactgtacctgtccagtcactggttcccacctcatgctttttaactccgaggtttgttgtgtcctgacctttgtgctagtgctttttcctgcctggatagcagacctccaaacatggttgccaccaaagggccctttccagttacttctaacacattcttcatgaaggggtgggcaagaggcagcgcctgtgcgtgtctgctgggagggtccgctcaccatgggtttcatctcgcagtcactcatttttctccctttttgtcaaaagacttactacctttgatcaggatcaggctgcccagagctaggaacgcctggcatttcccaggggttcacaggcctggtccatctgcgtgagatggtgaagcctaagaggtggtcccatgctttcctttgtatttacttgtggacactggggcagcattgtgtagaaggaaatgaggaattctttgccacagcagaaaatgcccccacttttttttctgcccccttttatgttggtagttgccaaaatattttaacagtcttttttcatacattaaatgaccaccctgtggatctttccacacctgcctctgccagtctggtgtagggcagctctactttccacacaagttgcactgatcttgtccagagcttcctgggagaagtggaaactggttgaaatgcttgtgtttctcagcccatgactcagcaagacagggtggccactctgctacggtttgcttcgctctcaacagtgcctccctcccccagcagactgaagtgcttctgtctaagaactaagtccattccctttcgggacttgccaccatcatcctgttctctgggttcctatttttggtggtgttaagtgaaggaagaagtgttccctctaatttctccctgtcccagtatataacctgctatcttggggcagcttttgatgtctgacatgtcacccttcccaagttggtctcttccaacactgctgtcttcacgtggcaccctcttaccacaaccctaactctggtcatttgtgcctttctcttgtcatctctgtacactactaatattcactgtgggttggggagctgattttaagcatgttcagtggctcccctccagtttcagtgtaactgttaaaatgtatccaaaagccacttcactgggggttttcttaaggggtaaaggccttttacagatgctgagccctccccacatgtggcagaatgtgctcttctgtatctactcaataaagcatgttctctgctcatgtctgactgctctgaagcttgtttatatgggaatggtgtgattggctcagcacagtgttagccctggggtttggagctatggattgttttcccctgtgaagcaggttgttgacagagtgagtgttttctctgaactcacaagcggtaaaacaaattgagtctgcctccctttggctccaggaagtcgctgtgcgcaacagcagctagctagtgtaatttcattcatctgcctctggtttggggccttgtcaagg

SEQ ID NO: 20435 - DNA, 1194 bp, Mus musculus
aaacatataaaatgaatagataaatctttaaaagatacctgggcagtacagctggcaaattttctgtgaacctgcctgattttccatgctcaagtaataccttagtagccatgtatggatagaggccaaatctagctaagtatttttatagcttagttgctggcctcatagtttttaagaataaaggtaataagggctgaagatagctcagcagttaaaagcatttgctgtttttgcaaagaaactacattcagttcccagaacccatgtggtacctataacttcagttttgggacatctgatgtcctcttctgacctctgcaggcactaggcatgcatgtgagctatagacacatgcatgcttgcacccatgcttatacacaaacaaaacatccatgtatatcatatagataaaaatctaattataaaaccaaagataaagtcttctaatccttatttgttttggtttctttttgccaacaggagaagttaaggcttcaaggccaaatcacagagggaagcaacatgattaaaacaattgcttttggccgctatgaactggacacttggtaccactctccctatcctgaggaatatgcgaggctgggacgtctctacatgtgtgaattctgcttaaagtacatgaagagccagacaatcctccgccgacacatggtatgtctgcttgagttcagctcaccagggtgatgttacacagtttcccagttatgttctagaggcaatgtaaacgtccaaaagatctcccaagtgtccacagcagtcgggtggagacttaaggaactgaaagtcacatttctgggttaaccctctgccagagtcagggctccatagcatcctaactatatcctgtccgagaacgtcttttttttttcttcttcttcttcttcttcttcttgtttttttgtcttctgtttcttcttcaacatatgaattacctctccctaaagtttgtgtttgtaccaaactcaatgagaagacattttattacataggtcagggagtggcttatatataagatggtgggtgtctgtcttgaatgaatgcatgttgtataggatatccacctttaatggatgatgaagataacagtttgcccctttttaacatcctgtatattaaaataggaaaagatgtgcatacccgagtctggtgacttctatgagtatagaattc

SEQ ID NO: 20436 - DNA, 1161 bp, Mus musculus
aggacacgctttttgaattgattctttccttcaccttttatgtgggttgtagggatcaagctcatgttgccagacttgaggtccaggacagccagtgctacatacatagtaagaccagggcgatcattcgattggtagatagatatagatagatagatcgatcaatagataaatagatagattggatgaatggatagatagataggtggatactgcttaaggggctaagaagccagctctgtgggtaaaagtgctagccttacaagcaagcctgataatggaacccttataagtgtatctgtaaagttcccactaccctgaaataggcagagatagacttattgttggaagccagcagagccaggagcactgctacacagcacccgaaacgagagagatcctgtctcagcaaggtgggaggcaaaagaaaaacagaacagaacatgttccctccatctgcagatcttatacacacactgcacatgtagtcagatgtacatatgggcacaaaatgacgtgtagaaaggagagcaagaaagggtaaatactatgtgaagaacggaatgcaagtaatggacacttaagccatgaaagaagtacaaagctaattttccagttttaagtgtggggttttttgtttgtttgtctgaagatttgtgtatatatctgatagtgaaagtgtaaaactcattgtgaagtcccacagcttcaggttggttagttattctaactgttcagaaattcatttgacatgtctggttagtcctggtatgggttttgttttgttttgcgtgcagattctttataataaattttaataaattgcaaacaaacaaaaaggtagaaggcaagaatcaatttccaaatgtcctctttagcatacacatattagtaatgacaataaaaacaacagtaatactcagaaataatgacaatgatgataggacctgtagccgggcggtggtagaacatgcctttaattgcagcacttgggaggcagaggcagacagctgccagcatggtctacagagtgagttccaggacagccaagtctgtgtagtgaaaccctgtctcaggagggaagggagggagggagggagggagggagggagggagggagggagggaaaaacttaaaatggacagagatgtagctctgtgg

SEQ ID NO: 20437 - DNA, 1177 bp, Mus musculus
tggcgaatgctctcccttctctttattggcccagctttgcagtctgttcttgtggcgggtgcggcttagcaaggcctggattggggcgaccaacgccccgcccttccggatagagatggcgataggtgttgtaaaggcgagttgggaagaccactttcctttcctggtggggggattacaacaaagccgaggatgggtggttagaaagccagcgcccacccccaagggatagctcgcaggcctgttgcgtctcagtcaccgtcttccacctatttgttcagtttgacatttcctggtcagtaaatgtttgttgaactgtatgacatttgccccatatgttcagtcgtaaaatgcaaagagcagtgttacgtgctagttgctaggaattcgaaaagtatgcgtgatcactggcttaaagggttatcgctgttgagagaagaacacaaagaaccatagttcatacagtctctgcttgaaattgtatacactgtaagaaagccgttaacgtgggaaataagtaaagagctgattttcagggttaagccaggcagaattgataggtcatggacgggtgtcagggtctttggctgagatgaccctaaagtttgccttttagtgacattctgtgcctctatttacttgtggtcagatttttgaatgaaatatttggatggatagacggttggtattcatatttctgcagagatcactcttcatggaagctttccaagttaaatatttacattaatgtctcttgcaatgaccagagttgacaggtagtatttttttaaaagattaatttatgtattttatgtatgtgagtacactgtagctgtacagatggttgtgagccttcatgtggttgttgggaattgaatttttaggacctctgctcactcaggcccaaagatttatttattattatacatgagtacattgtagctgagtttagacgcaccagaagagggcacaggtgtttgtgagccaccatgtggttgctgggatttgaactcagaaccctcggtagagcagtcagtgctcttaacctgctgagccatctcatcagctcgacaggtagtatttatatccaggcataccaaatacaagagacagacctactggtttgttggaatgatctagtctccttttagcagtttccaaatgtaaaagtggagaa

SEQ ID NO: 20438 - DNA, 1169 bp, Mus musculus
atctttgagaaatgccttactataggaactatacttcatctgtgtttcctgacctgactaaagtcagtgagatgcttttgaacttaagttactaggtttctttagggagttttatataatgacttctatagcatctcttatgtgtaagatttcttttaaggtgggataaggggaatatttgacatttagcatttgttcttgtcagtttctccttgggggctatgcttggctttgcaagggtataggacttataagaaactgtaggagaacttattctgtgaggctgtcactggcctaaggtgtggtaggaaagagatgtgtttgtaataaatggggaaacaattgagccaaaggagaaagtcttgatttgtggagataaatcaagaaaatgaggtatctgactgtctgtagcactaaggtagaagtcctctctccacctgctggtaacaaaagctttgtttctgtctctttatatttcacaggtgagtgtagtacaagactctgtcaatatttctgggcagaatactatgaacatggtaaaggttcctgaatgccggttggcagatgagttaggagggctgtgggagaactctcgattcaccgactgctgcttgtgtgtggctggtcaagaattccaggctcacaaggctatcttagcaggttggtatttattcatgattcactttataattttgattcaataagaagaatagtggctacccaattgcctttagggaacaacttcagcttatgaactctgtacctaaatacgtttttaaaatttactttcattttggtgttttgagatagggtctcactttatagcttaagcagacctagaacttattgttagcctagactatcctcaaacttcaatcctcagccccatcccacttcctgcccctactgctgaagtagtaggtatatgccactgtacctgaactgtattttatattctaacgacagttctcataaccaaaagtgctactcttcataaaaatggcatttctggtttgtcttaggtggacttgggtactattttaagagtataaatggtggtcatacaaaggaactacctatgtttgcactgggcaagtagctcttggagtacctaagagcaagtggtagctcctagctggactttggatgccatcgagaggattctgttc

SEQ ID NO: 20439 - DNA, 1205 bp, Mus musculus
aggcaggcggatctctgttcgagtccagcctggtctacagagtgagttccaggacagccagggctacacagagaaaccctgtctccaaaacaaaacaaaaccaaaaaaaaaaaaaagaattaagtaagtaaatagatgtgattttttttttattttattttttctgttttttttttttttttgaagactgggtttctctgtggaaccctcatttcctagaactttaactacagaccaggctagccttgaattcagaggtctgcctgcctctgctcctaagggtgagcaccatcaaacctggcatttgagttgttatgtgggtacctggaattgagtctgagtcttttggaagagcagccaatgtttttaatcattaagccatcttctcagccccaaataaatgtagttttgagagagaaaatagcctagaggtagtggcacatactttaatctcagaactcaggaggcagaggcaggtggctctctgtgccttggaggacgggctggtgtatagagctggttccaagacagtgaaggctacagagacacactcgtgagttcacacacacacacacttcctcacacacactcacactcacaggggctggggagagggaggagagacctttatctgcatcttggctcccattttactgtagaattcctcagacgctaatgtgtattggaagttttgttttcttctttcttccctcctccttgagacagagtctctctatgtagctctggctggcctagaattcattctgtagaccaggctgtcctctaactcacagagatccttctgcctctgcctcccaagtgctggctgggattaaaagtgagagccaccacactgggtttacagagattttctgggaagcaagtattgaaagttgcatgtctccaactcagttaaccctggaggcattttctcaagaatcacatcagattagaggacctgaggacacaatgggaactggcttgcattgtaaagccacatcagctagagctgggaggctagctgcctgtgacctggagcccatgcagtacctgtgataagatggacagtgtgattgacagttgccctgtatactaggcaggggcagttgatgtaaactgttaaaagggcttccttactactagctggagacctcaggagaaagcagatgctatgctgggagttccgcctctttctgttgtgtcct

SEQ ID NO: 20440 - DNA, 1936 bp, Mus musculus
tgtctagatagctgtttggaccatgtgcacactccctgtactaacctctctctccacatttctcctagtcatgcttcggatgtcttggagacctctgggtggaagtcaatggtggtgtcacatccccacttagtggcagaagcataccgttctctggcttcagcacagtgccctttcctggggcccccacgcaaacgcctgaagcaatcctaagatgctgccagttgggagactccatttattttccagaagcagcagccaccgttgctgccactgactaccaggtagacagcgcaatctgtggagcttttactctgtgtcagggaaaagactgcacgatgacccagactttaaaacagcactaaataacttagggggactgggggagggaagggcccaggactcgggccactcaacctgatgaaaccctgttgctctgtcaccgtgtgccctttggcctgaccaagtttgacactgggattcagtttaggcactggccccaagcacatcccagcagtggtacttcggagaaatgggtgtctgactgagcagaacaaatcgtcagtgcctggagcaaaacggaaaaaaagcagaaacaagcggacatttagtcttcagaggtggaaaaggaaagaagaaagattttttttttccaaaaatcagtttgtggattccagtagtatttatgttgaaagaagcaaattttagtccttccaactgtggatatttgtgaaaactcctcactaccatccaagtatcagaagagctctctcgttagcacttactgtttgcaagaacaagcccatccttttatcctcttatgacaagtgatgcgtgatggcgggggaagtcatctgatctggaaaatgagtgtttggcggtagtggcttctgcaaaaattcttattggtgttaaaaactggaaaaaaataattcatccagaattcatactgtcttgataaaaactatggttctgttttttagatattgtggaaaatggatttttgggggggcatttttctctgattttattttttcttcccttccccttccctttttctaagagagagagaaagagggggagggagagggagaggggagagagaaagagagagaaagaaagagagagagaaagagagagagagagaaaagaggagaggagaaacaaatccagaaaatacataaaacaaaaggaagagtaaaggagattttattattattgctatgtgaaaaaaaatcccagcccagatggcctggctgtttgcacctgactagttgcctgcataggagccggtcctgtcccttctgattagcccctcttccaaaggggagacttccaaatgttaacttttttctttttgaaaatataaataattactattttgtactgtgtggtatctctggtcttttgtttcattcacttggcttgtctcttgggtctgagatgcttgcctgtgagatcttgaagccctggtttgatctccatcgtgcagggattatgttcagaatgtctaagaagcggtaggatttatttactctccatagtctcacgcagctgccagcctgttgtcctccttgaggagctgccagccatgtcctggcgagtatctgggaccaggtcctactttgccaaggcaagcaattgtagtgggcttcttctgcaccctgtgtgtgttaatacccaatcccaaatctcctttctcctaacaaaatcaaaatatatatatatttaggggacatgaatatggagattaaataaagggaaattgttgtgtcttctgggtcctgtcattgatgtatttctggaaaagctgaggtcttaacttccagtgagctcaagagtgctgtggggttccaagcttcacagcactggccagacagtggaacacactaaaagcatacattgtttggccaaggttgcattatttaaccttaga

SEQ ID NO: 20441 - DNA, 2484 bp, Mus musculus
aggaaccagggctcagggttagagaacacggaagtgagggctcagggttagggaacatggaaggagagagggctcaggttaggaactgacaccccttgttctctgcagccctcaagggtgatggcaacctctacagtagcctgcccctgaccaagcgtgaggaggtcgagaagctgctcaatggtgacacctggcgacatctggcaggcgagctgggctaccagccggagcatatagactcctttacccacgaggcctgcccagtccgagccctgctggccagctggggtgcccaggacagcgcgacgctcgatgcccttttagccgccctgcgacgcatccagagagctgacattgtggagagcctgtgcagcgagtccactgccacgtcccctgtgtgagctcaccgactgggagcccctgtcctgtcccacattccgaccgctgatgttctagcccccacagagccgcccccctctcccttggggtggcccaacagtcagaaccgagcatctctgtgtagggcctctgtgtcccgctccccaaaccacagccctgttgctgctcctgaggggacctttgcttctgaccacactctctctccggcgagagataggaccaccccaagcctgtcttgccccgtgaccatctcaggcctttcctttctttctacacattaactgtgtcagatctaggggtctgacactagagaaggtaacaggggcacccctaagactcagggggtactaatgaaccagagccatggactccacactgtgaactggagaacagggggggcattgtggtaggccagaccttcctcaacccctcccttctcccatctggccaaagatgaagaggattacaggcctatctgagctgaaagcaggtttggagcccagtccacactccttctcttacacataggatggtaaagcccagagaggcagggactaacctaggccacccaacaacagggagatcaattgtaggctgacacactcctttctgaatgagggcgtcaagtgcttgttggcagggatggagtgactttcagggaaacatctggaaacgacgtctgccccgccctcaaccacttccaggcccctacccaacccttgtgcagatgaactgtctgttcaaaacctggtccattggcctgttctgatggagtcgggctaatgtcctggggagtggggtgctgccttcctctgtctgtcaggcttagccacagggcatttgtggagggatgaatctgttagcaccctcattcgtgtcataagcctgaagccaacagtggcccttggagtcaaccctaggggtcagggaccaaggacccaccccataatccaacaccacacacacacacacacacacacacacacacagagagagagagagagagagagagagagagagagagagagagagatcatgcttttccccccatggctctttttgggctgagaccagatcctgctggaagtcgctggctgccagagaaagatggaaggggaccgagatgagcttcgtggggctgtcttcctcacctcccggctctggcaggccaagaactgctgcatctgagctggcgtgcgtgcgtccgtccctgtccgtcggtctccaatggcctgtgtgtggaggaatgctcacaccgctccctctcctccccttcttgaagcccaactttggctgcacccagaaaacagtgaagaaaagcaggctgctgtgagaacacaagaaaatgcagatgctggcccgcagtctgaggcaactttctcctcagtttcatggcccctgcaaaggaccaatttcctgggcatggccaggaagggacccgagtgctcattggccggcgctttcacctggctccttggcctgttctgttttgcttgctgttggaatgagtgggctccccctctatttagcatgaaggagccccaggcagggtatgcacagactgactgccatccctccccacccagggtccacccagccctgtaaggagacaaggagccttgtgctcggtggtatttttatggacctcgatctgcaattagtagaaggaccccaccggctggccctccccggacacctgggaagtgggacattctttgtgtatttattttcctcccccagaagctgggggtgggtgggtgggggaggagctgcaggaccagtttagcatgtgtttggttctgggggtctctccagccttattttgggtcaagatggaacctctggccctccagctggcgactatgagatccagacctcttcatgttccctgacacttcccctttgcatcctgtgtaatcatttcttgggccctcccaaaacctacacataaaacatacgtgatgaccattaaatagcaaaaaaaaaagaaaacgatgccaagagaattttttttctggaaataaccacgttttgttagttgggattaaatgcagaaatcatcgacccttccccccgaaaccctta

SEQ ID NO: 20442 - DNA, 1909 bp, Mus musculus
agtcggtggtggtgagtgaacagggtgccacctacaggtggctgggtggccaggagagcatgggagtagtggtgggtaggtagctgggtggctgggagagcgtgggggtggtgggtaggaggctgggtgggcaggagagcatgggggtggtggagagcgtgggggtggtgggtaggaggctgggtgggcaggagagtgtgggggtagtgggtaggagggttatagccatgagtgtgccgcttgtttctccttcctcagtaacctgaccagatttctgtccatccctctgtggccaggctcgattcgatgctggagaattgattacccagcgagagctggtctccaggcaggtgagcgatgacctcacagagcgagcggcaacatttgggcttatcctggatgacgtgtccctggtaaggttcacgggggcactgggggaagggctgcttctcttgcttcagagactggcttagtttctgggcacacagggttaggtcccatgtccacttaactgggtgtagggcttgaaaatctgaaaacgtctcagcgtctgaagccaccgtctcaggtctcttttgttgagcattctttaggtttcgtctgccgcacacattgtcctcttaactctgattgcccccatgctccctaaccactgaactgtctcccacgctccctagaaagtgattcctataggctttgttgggcacagggaatggctgactggtcagcctgggagcgactggcagttttcctgtctagagtaggactggctcagggattcctcagcaagggagtcctgggagcctctggtgaaaggcaatagaaggccagtgagtgactgttcctgcgcctggagcagaggagagggcgggagacacctccgaggcgtaagcaacagtcacctcccgagactatactctctgtattaatgtgaagctgggtgtcataacttcaacggaaggcaatataggaagtatagtgtttcagaccaaggtgaggggaaggggtcgtgtttctagagtctctgggaaaagtcttggagtgatttgtcaggtaacgaggcagagtgcttcctgttctccctgtggccagcctgggaaagaaaggccaggcttcccctcgcatccgtgcagctgttcaaacagccattctctgaatgagcatccccctccaggcacggcctccttcctctgtctctcctaggggaagggcatgtggctccctcttctggcagcatgccaggttgcagcccccgactgcagcaagccttgctccaggctctcccagttaacacaagcaccttggcagtgagaacacactagtaaaaacctaagagaaacttggcatctttctagactctgaccacagactccgtcctggggaaatgtgggctgaccacaagaaaccatagctaagaggtgtgagaagaaaattagatttcctggggaatttgctgccctcagctggccctttcagaaagacattttattctttaattacacatttagcttttcaattcttaggattgtatttccgaatccaagcttcagatgagagtccaggagtggatcagggagagttgggcagctgcagggtaagatttagctggcgtattggcccatgcctgtaactgccgtgcgttccagcctacctgggctacagggtaagactgtctcacaaaaagaacagaaacaaccccaaagacgtgtagtgtgagaaagatgtggggccaagatttttgcttgtattgtacaaggcagagattgggggggaggggtgaagcaaatcgcacttgaacctaaagtaattagcaccgtgtgaacttttttcctagacttactttttttagctcacatttatgttttatctgtgtatgtaagtgtgccacatgcatgcaccagataccctg

SEQ ID NO: 20443 - DNA, 1984 bp, Mus musculus
gtgtaagccaggcttgcttcaggctttcagtgagccgcccatctgccatcgccacgttagtgctaacatagttgttagccaccacaccgggatgtcctggctttgatggaagtcattttgacgtggcactggaaggaaagacggacctaaagattgatttgattcctgctttccctttctgtttccgtggctttggatcagcatataagtgaccatgtccatatagccaagagaagcatgtcctatagtgacacgtggacatgaagggaacgaaggagactgggaggacagttttgaccccattgtaagggaagaacgctcccaggggacctagtaggtcccctctgaaggggcctggctttgtcctggttaggccatggcttgatatgaacgctatggagtaatctcagtctcccctcctcttctgtaggctgagcagcagaagaaggcagccatcatctctgctgagggtgactccaaggccgctgagctgatcgccaactcgctggccacggcaggcgacggcctgatcgagctgcggaagctggaggccgccgaggacattgcgtaccagctctcccgctctcggaacatcacctacctgccagcgggccagtccgtgcttctccagcttccccagtgaggccagccgggccacggcctccatcatgctgaatgacgccttccttctgccccaccccagaaaatcactgtgaaatttcatgattggcttaaagtgaaggaaataaaggtaaaatcacttcagatctctaattatcaagcgaagcttttattgttacacttcttaccctctttcatatccaaaattgccaagtgcctctgcagactggccttccaccctaggcgcgggcagttggcagaagaaaggcagggcagtgtgtagtggatgggcagcctgctggcagcctgcataggcctagggcctccattctgccgtatattgaagatttaaagacagtggcacacacacttgaacaaaagcaagccctcagtgtttccagccatttgaacctggacagatgcagctggggagggccagaggaagtggtctatctcaactgtaaggcccatcccctcttaaccatgaccagcggaagcaggtgtgtgtgaccagggcacggggtgaagaatctgcccatcaaggtgggtgggcctcatgtcgctgcccccaccagagtcctaaaacctggatggacttggacgggacaagaggcctggactgagatgtgagtcccatggaagacttcctctccaccccccacatcggtcctctcaaatacccaatgggattccagcttgaaggattgcatcctgcagggaatgagcacacctgccaaggacacgtgcgcctgccttcccgctccctctctctcagagattgccctttcttcccgagggctgtgggccagcgctccgaaggaagcaatcaaggggagaaaacacagtgtaagccgctgtcaataaatgacacccagaccttccagctgcactcggggtgtgttttcaatttgtgggagcgagaggatcagaacagagtgtcccagcagtcatgcgtgcgtgcgtgtgtgtgtgtttgtgtcaccagatggggagggatgtccagcaaggctagaaatgctttggttttaggaaatgcctagctgtgtgaggtgggtcctaccccatcctgaagtgaaccctggtaccaaactctgggtaagtttttcatgaaatgagttcataggaagtgtgtgtgggggggggggttaattttcttctgtggttttttttgtttgttggttggtttttgttttttatttatatgagtacactgtagctgtcttcagacacaccagaagagggcatcagatcccattacagatggttgtgagccgccatgtggttgctgggaattgaactcgggacctctggaagcagagcagtcagtgctcttaacctctgagccatctctccagccctcttc

SEQ ID NO: 20444 - DNA, 1548 bp, Mus musculus
catgcagaaggaatggcccaggaagagagccatcgaagtcaggcgccacccaccttctaccatggtgccagccaggagctcgacctgtccaccaaagtgtataaaagggagtctggaagcccttactctgtgctagcagacaccaagatgagcaaaccacatctccacgagacggaggagcagccatatttcagggagccaagggcagtgtctgatgtgcatactgtcaaggaagaccgggagaattctgatgacacggaagaggaggaggaagtctcttacaaaagggagcagatcatagtggaggtaaaccttaataaccaaacattaaatgtctctaaaggggaaaagggtgtctcttcccagtccaaagagacgcctgtccttaagacaagcagtgaggaagacgaggaagagactgaggaggaggccacagataacagcagtgactacggagagaacggacggcagaagaaaaaggagaagcaagtggagagagtcagggttacacagaggcgaacccggagagcggcctctgctgccgcagctaccacttcccctgcaccccgcacaactcgaggccgtaggaaaagtgcagagctacccaagaggaagaagcgggccaccaaggaggctaaagcgccagttcagaaagctaagtgtgaagagaaagagactctgacctgtgagaagtgccccagggtgtttaatactcgctggtacctggagaagcacatgaacgttactcacaggcgcatgcagatctgtgataaatgtggcaagaagtttgtcctggaaagtgagctgtcccttcaccagcaaacagactgtgaaaaaaacattcaggtaggtctcaccagcggagggcaaagtttccaggctaggacctggctgttcagagtcatctggtgtctgcccaagaggatagaggctgaagggacagatttcaccaattatcactttagactctgctgcttgggtcttttcaaaaccaaggcttaatcctgtctttcaaaagcattacacttaactgacgatggattagtgagaaccaggtgcactggaagggggattggttatagatgactgactgggatgtaaagtcagcgccgactttgcactgagagtctctgttgtgggacctgtgagataattcattctggcatcttctgtcacggtgggaggtttgccgagtgagggccaggagtagagaaaggtcctttccaattagaaggatgtcagagtctagtgcagctgatggggacagagaccatgactcagacctgtggaaatggaagatctccttacacccgtggagagatggcaacactaaatgtgtcaagaggcaagcccgtgggaatatgcaaaccttaaacagaggctgagctgtttgaaaatgttgcttacctggcagtagggttacataataatgttgctgtacagtgctgctgatgtaacaaagcgtgctattcaaaccactctggtgtcttggaaagattgtactgtgacaggttaagaggtgttgaatttattgcagctatattggtg

SEQ ID NO: 20445 - DNA, 8238 bp, Mus musculus
tttattttactacagaaattattttagagtttttgtatagactttagtagtctgtttctaaaatgagatgtatttcaataagctgtgtaattttttcagtgtagctaaacccatgttgtaaaatagataaatttttataatcatcaaaatgtgattctcaaagatgcatataataacttctatctcaactattcttacatccatacaactcaaaggtgcttctgtgactggatgtatctgagcgggtcaccagaccaggtacaaaagcaaggttcagtacaaagttagtcaatgaattggatgtctctgctgggcattcagtccattgggctcactgacacagccagtgttggtgtccctttgagtactctatggattcagtggggtggtgtgagggaatggggtcactcagagttagcggggcttgcaaatgtgaatgacatttgtgaatgccctcgggagaaagtgacggaggtcgtttccttggatcacgtctgtttctcactttcttagaaactgtgttgtgcgcagctgttaggggaagatggattggaatctcttactttgaggctcctgtgttttccaagagtgttagaagaagctaatagggtgaactgaaatcacaaacgtaattgctggtagtgaccaagaaatgtggatgggaaggcaagttgacttttaagttttaagatgcctgcagtctctaaaacgtggatgtccacactgactggtatctgccattaaaaatgtagtgagaggaaacccccaatactgttgcctgccctctccagaggagggagaccgcagcatcttaggtgaggaaggaacagtgcccttgtctctcgagcggcagcttactcggtcaacatttggggaacttaaacagagcgtggtcaccctggagtggatatacggaaggccagagagaagggctaacatggtggtttcagtcagctgacaggtgtgcacggcacagctcctacgcattctgtgctgctcttctcagaggctgagttccaagaatggcctctgcctcccacctctctcctcctcgtctctctatcctcaggctcttaaatcagacccttagctgttatttatttatctttgatattaaatgtgcagttatgcgttgtgcactttttcctggctacttaactctgcagtggggacacacggactctggactgaggttaggttcctgcttttaaagtatcatactctaaattagtttttttggtttactatttctagatttttctccagttttgcccttgtcttctgtaaacataggaaacattgtgtgtggagtcaggaaagtctctcaggacacactttccctccagcttctagctatgaattttaatgaatggtatttgtaatatttgcatgcattcttgcagccctcacaaacccgaggcaaacaaggaagcaggttccttttctgaatgtcgtgacttagaagtcacccctaccccatttacctccacagtctcctctgcagcttatgggaagtctgcaaatccaccttccatgtagacagatccatatctcacggctaaacctataatattcaagtatttttatcaaaaaaggtataatttgtagctaagttaataattggttataccttattttatactaaatgcttttacaatatgaggcagacattctgaattctagtcttgaggctgttgaattacaaccatttgatggttatactatgaatattcattgaaaaattcaggttgtcagttctgactttattcaaatgactatagccataagaaactgtcctctacataggaaacccaatagcgagtcagtaagcatcactatccttaacagaagcagaaaaaagaatttaaaatagtgacttaggcctaccacactctgtcattcttactcaaatgtgaaacagtgtagaaatggcaatatattttttttttctagagaagtttatcttccctgacttgagaagcctgctctaaaaaatggctctcaaaagtgtacgactaatgggcatatgtataatgagatctatacagaaatgcttcggagtcagaaaccacagggtcacgccttaaacatgcaggtacctcagctgtcacgtgctgaagactcagactcagggttgacagtgtacttggggaagagctgcagtgtgtgctgtgctggcccacatgtgctgcagcgccccaggagttctacagtacctgttacattcttgttacctgtccatggaaaaagacccgtggaagagttggagttctaggcttgtatctttactgttgtctcgtaacacgttacatttcagaataacagattttaagtcaaggctttctctttacaccattctatcttcaaaggctttgttgtggcaaggattacttagttacaagtagaccaggctagccttgaattcacagcctgagtgctgggtctacaggagggaaccacaaccggcccctcccccaagagttttgttgttgttggggttcttgttttgctttttttgagaaagggtctctcactaaatacctacgctaagctgaactccccagtggatacggtcatggttacctcaaacccatgactccctcacctcagcttcccaaatgctgggctcgttgtacctgctccccccgcctggcttccacagcgatgtttctgtgttggtattacgttgttttgggttgagtcatgcatcacttgctttcttctcatggatttatcatttggatacaaacttttttagcctaattcattaggctaattcattaggctgctgctctcaaactgagtcaggctcagactgggttaggttttaaaactgaaggaaaagaagatttaaaggcacgtggcttcattttattttatttgtatattattttgacttgattcttatttttagcaaatggagaagtctccacataaaactttaataaagtttaaagaaacctttgtaaatcattgccaggtactgtcttagtaaccctcagccttaggcctcaccacgggcctttccagagttgtccagtctgagaacctcatctgttgacagtatccttctgagctagcccccaccccatacagcccaccccacaacctcaccccgtctaaccagaggcaaaaatctttgaagtttggaatttttaacttcttgaaaatctttttcagttttatgattgttgagtggatgtggatgtgtgtttagtttcatttttatttccctagaagatttaaattttgagactatgaagcagagaaagaactccactgcggaggcgtgtgtgtgtgtgtgtgtgtgtgtgtgtgtacacatgtgcacatactcatgaatgcacacatctatatggatctagtccctcttggaggtttggttaggaaaacacactagagtaggtgagctttttgtatttaaagagagaaaaactaaaacttccattaaaagaacccctctgtttaagtcaaaggcgccccctttgtttaagctactgtatgaaaaataccacttttgttactttgatggtccacatgctagagattttgatgctgttccgcatgtgtagcatgccatgagaagagagagtatgttagagctaaccattttatcaactaaaaaaaaatcagctgggattcttaaacttctaaccctgagcaaagagtcaccaggtttaaggtttttctctacttaaaaccaaggtagaaaattcccaggagttctcgctctctccattttttttttttctttttcaggaataaagggtcataagccattagaaacagtggcattgttatgcaataacagctcactagctaacctacagtcttgggaagcaatgctgaccttccaacccggaactacctcgctaaagcagcccagaggtccccactgcactctctgtggaagccataaaagtcgccagtgtgtccgttcaccttcacagctgaatacttttgtacccgctaggcctgtttatagacttataatcagacctttccctcttaggggacagcttttccaagactccaaggaaagtcagattcctctgagaattttcctcaagttgcttcaaagagcaactttgtagctctccagcttcagtaaatttgtttaaagaaccagatgccatatcattcaaaaacattacgtttaattcaaaactactgtgcagacctacatattctgaaaacaaactcttcctttttgttcccttagtagaggctgtgttgttataaagtgggtctctctccaccctgttaactcagggcttctggttgatgtgtcgggacagcgtccctggagttgtttctgttactgtagcacagagacctgagtacctggccgtctgatctcctactgtctacgcagctttactctcatcactctgctctcgagtgccttcaaaaaagcccatgtcctggagcctctgtcccggtctgaatcctacctctgattgagtcgttctcctgagcatcggaattcaccctcttcccaagggcttaactacaaactctaacacctggctaggaattgtgaacacagttgtgtattgttgccctgtcattcacggcagggtcacctttgtagcttctttgtatcttattcccccacccacaccacttctggactagagccatttgtccttcaccttctagtctttcaccacagaccgacggttcccttaaaaatcaaaggtcacccagtgcatctctgggtcatctttttctcatctgatgaagtcttcctgagtacctacccttcaaactaaaggagcgcgagctgccgctggggcgcacatagcatcgcgtaacacttggttcttccagtggctagcctagtcataggaggagaaaagtgctctctggggttaacaaattcctttcttgatttttgatcagcccctctctctcatcagccacctgtcccccttgtaagccccattacgtcatttacaaagtgtgattgatgtctaatgtatgaaagacggaggaaaaaggaagctgatgtgtgctctgtgtgtagtatgtgcacttcactgtaaagattactttagcaactggctggtctctcgtgtcccaaattaaagtttgtgctgtgtaatgggttgatagttccctcctaaagcaaaaacagatgagctctttcggtgaggaaacaggatttttttttttttttttttttaggcaaatgaacactaattagagtatcctgacctgagtcaaaagctttgctttctgacttacagtctcttgcatctttccttccagttattagtacccaggcacccaagactgattgatggtcgcacaccgtgggagacttgaaaggcggctgttgataaatttttcatccttttttttgtctgtgaacagacaggatgccagtgggtgggacaataccaaattgtgagaattgggttgaaaatacagaagtcaagacattggaatgccccactggctgtttggattgagagcggcatgcacactggaagaggtagagtctgtggtgcagaaatcattcccaagtgtctaaaggaccctccatgtttgccgctgcggtcagtcttgggaactgggtgctttgaatcggttcctttttctccagtgtcccgggcgtttggatagcgaagagccatagtcacctgtcactgggaagacccatacccttcgagaaggatggctgcgttattgtgtctggattaggatacttttggtcaagtatcaaagagagttgttgcccctcagaggtttccccatcactaaccccagcttaccttcatcctatttgagcttctctggtgagattggggatatggcagattactcgaaaatgattttataggtgatggagatgctcaaaaagggagggaagctggggctttgtttaatgtcaaaaggaaatcggatggtttcagtcgagtcaagagcctgcctgtatgggtctgaaaagagagcagtggcttgtttctgtgtctctggctcccgtgaacgagcacagcctctccatctgccttaccatgtagggagccagggagccagaaacagggtctccatcacaccccgagtaggctctgtgactctggctgcattggaaaatacacatgatcactcacttgagttaagttggaaagaaataaatggtgtagtgtaatgtctgtgtttacttctcaaattgtattgctagatatgtggcctcaaaaaaccaggtgaattatcttccagaatatgaggggttgggagtaggggtgagggttgttttgggtttttgtttcctctgcagtacttgttttggccatacggggcgataaagtactttcttcttagcttttaagtctcttctgggctacctcttggctcactgattggatttgactaaaacattttcacgatcactaagttgagcagttactcaggcctggtgatgtgagcagagatggggtcctgtgtctgaggtccatgtggctcgtcaggcatcataaccagcaagcctttgttaatattggttccatgaaaccgaaagctagcccttatcataaaggctccattgtttactaaacgcagaactaaaggtgaccctcctccctgtttccaccctcccattgcagcccagtctgccctatcacatctgtgacagcagtggggacctctcatgtgtaagcacacgctctctcactttttctgctccaggtgggtaggaaggtctcccagagcaggcctggccctctctctgcacaggttccttgtctttgggctcctggccctcttcagctctcggggaatattgaatgcgtcctttgcagtgtctccagaggaacagttggctatccactcaggaaagcacaggcctgaggctgtttaccttgcagggtcaggaagcattttcctgtggaagggcctcctgctgattttctcctggtcctttcccccagcaagagtctgtgcagtgccagtcggggggtccttgtaattccagcccaggcagaagtggaagggaagcagtgaccagggtagatagcaggtgtccgggtgtccccacagtcctgaggtcacttgcactttctcatttcttaaaggaagtccagtgttcttgccaggaatccttagccttaggtttacaaagcttgctgttgaatgttcgtccggaggagtgtaagaaggcaggaactgcttggttccagtcctgcctgcaaggtcaagaaggtttaagactacgtctaatctggaatccttacctctgtagagggcgttgaaggtcaagctgggacggtgaggggtgctgtaaagaaggtcattgggccttcagttgtgggtgggggtgagtggtgggcaggacagagtcttactaggatgggaaggagggagaggagggcttggcccagggagctggccgcatggtgggtggagccaggtgggctctgaactggtccagatgcctggcttcccttagccatcttttccctagcatcctgtcagacccccggcgtgatgatatgcttccctgtgttaactctaccaatattatttttttagcaatggaaatgcacttttttttaatttcaactcaatcatgattttaagtataaaaatttatagattgttaaaactacttttttgtgtatttttaaccactcaatgtagcattgtatattttattcttattgagactctggtacaaggtgtgccatttaatgattttttccccccaacatgctgggcctttggatgtgtacggtaaccaacttcatgctaatgttcaaagtaaaaaaagaaaagtagccatattcccacgtgtcttctcttcatttcttctccaagctcagatgacattttgagggccccttggtcaatgattgttcattttatgtaatcatgtgacccacgtctgtattattggttcgtatctccaatgctgttggtagtgtgcctaccctaagccccaaatccagcctggtcccttaagaataacattcttcctgtcccccacctgcctgtccagttagttatagtgactgagtctcaagcttgtacacagtaggtaaactgtaccactgagctacatcctgtgtcctcctcttaatttgtgttttgagataggcccttactgagtcgcccgggctagtcctaaactcactcaggaactcagggaggcctttaacatgctgtcctcctgtctcaagcttcctgacaagcctgggtcacaggctgcaccaccaggtccgtgtgagcctgtac

SEQ ID NO: 20446 - DNA, 1203 bp, Mus musculus
ggggttcgttgtgtttctgttttttgttttttaacctgccctctcactccacttgatgtggctggcagtctcaagagtgggccctgggccttcatagtctttaaatgtggctaatgttttaacagacttggtcactgagccacttgctttgggacacgggaagacccaaaggaagaaatgttccagttttgtgctcagagactcttaatatcaccctgccatgtgacactaaccttgggaagatggggacaaacatgtactcactccaatcaggaaccaatgacggatcaaaataagcacaccacccgagtccagtatagcagactgatgagttttattggggttacagacagaagtatgggtgaggggttaccgcaggatcacaaatgactcgaaagacagcggcaccatgaaagctcaccatgtcacaaaagctgtaaacttgaagccctctgtacaacttgcagacagctcaacaggttagagaatgtctgtttcaggcagctcaacttgtctgagagtgcctctcagcagtcttcacagctaatatacttggaaaagagggggcctagtctgtctggtgggtttcagggagtccctgaaccctttgagttgaatggatgtccttttagaacatcctgtgttcctggggaagaggtgttactggatcataggaaactaactcactctctgtctctctctctctcttctggagagatggttctagatcttgaagtagagaaaagactgtgtttgagcatgctaacgacaacccagtcaaaatggaggatgttaacatttgctgtgagaatgcccagggttacagactggcagctatgccttacttctgggaatctgaactcaagtcctcatgcttgggtaacaaacacttcaccttttgagccatttcctcagcccctgattttggttttgttctgaaaacagaacaaaacaaaacaaaacagagctcactgcctagccctggctagaggatctctgaattcaaggctgggattaaaggcccacaccacaactagctggcatgtcattcctcgcctccttacccactggtgtttggctttctatggtctagctcagagcaatatttacctcaggaagtaaaaaataaagtgtaagtatgttcagagtgttgaaatgggctggcgagatggctcagagggtaagaggatggactgctcttcc

SEQ ID NO: 20447 - DNA, 6669 bp, Mus musculus
gtttgcacactgtcttgagaacaatgttccagtgaggaatcctgatctctcgcccccaattgagccagctggccacagcccaccccttggaatatcaccattgcaatcatagcttgggttgcttttaaacgtggattgtcttgaagttctccagcctccatggaaggatgggtcagatcccagtggggaagagaaataaaatttccttcaggttttataaaacctcaaaggatggtttgtttcttaacccctccaaatctttctaaccttcttggttaattcacgaaaattcctcccgttcttaatgtcctgaccagtaacttacctcttcctggatccattcacactgtttcagccttgttgtgctggggtgggggaggggcgggaggagggctagaacacagctttgtttacaatattaactctggagagccctatcctggatagtctaattctgatttttccttaaccaaccattaggaacagcaagatataaaggagagagttaataattacagtatgtaccgatccacgtttaaaaggagtccttgggctaaggatagagctcgccgggcacagtgcttgcccggcacggacgaggccctggcttctatccttggcatcacaaaaagaaaaagaaaaaaaaaagcatgccttatggctgagctcttgcagatcttgaaaaattggcacagcagaaattcctcctggccggccagctggggcttccccacctcacttatgcccctgtaaccctgggagtcctgcacggtgccctggtacaggggagtggtgctgcgtgcttcagggtagggctgaccacggtccctgattcccaccattctctctcaggcggattttatatattttttaaagtctattttaatgatgggatatatgagctctgggaagggggtgtgagctccctttggtaaagtctcggttctgtggaggagttgagtggcccaaaggtgctctcgctccacccgcgtgctttgacaagggctgaggcagctgttgcggtgtgtgtgtccccaccacggcactgttcccttgtggtggtcggactacaacccaaccctgagctcctgataaagcttaaaatttagtccatcatctggcaaacttagtaaattggagaatgtcgcttctgtttttatctagaggagtatttaactgactgcttatgcctccgtgaatgtcattgttattatgaaaggtgtgcctgaaaacaaaccagagtaccagccgcattatgcacagaggggtgagcacacttaatttattaatttaccaggctcactgagatcctgttggaagttaacccttgtggagggcagcggccatcagttaagtgaggctcagcctccctcccgatcctgtactgactgtaatgcatattagccaggtgatgcactttagctaccctggacaatgctgtcaagtgtgctgggaagaaaggaaggcctctctgcctgtgctcggggtccccgcttcctgatattgcaaggacaacagtgacaaagctaccgtgacgtgtgggcggagtcaggcagtgctgtgcgaagtaaactacctcaaggtgtgaagttacctcagcaatggttttccttttgttccctaaatcctggtttttaattttctttcttttttttaatttttttttttttttttttgcggcttgctgatattttatataaaaaaaaagaaaagcgaagcaaaagagaagctgatagtcttgaatattttatttttttaatgaaaagaaaaaatgagaaagttatgtttcataatttcttaaaacatgagccagtaactcttttggggctctgtggagaaaaggccctgtgggggaaaggtgggggttggggcctggatccaggggaggaggccatggtgaagtggaaaactccaaggagcccaggtcctccctgggttctagactctgaccttgaagtaggatttaagatctagcagagctttagcccttgggggtcaaactgtgggcacccctcctcccctctggtgagacagtaccttagccggctcttcccaccagcggtgctgttattttatgatattgcctccgttttatcgaggaaagaaataataactaaaaaataatactgttttaaaagaaacctgtatttctttaaaaatatgggagccaagactccgtttatgggaaagacaaggccactctgttcccatcgggccacctggtttgtcattacagtgcttttcctgatgattttttggttattgtttcattcccaccccaccttgttcttgtctgtgtcattctgcatagaccacaaggccagcggaccctccataactgccctccccgtctccctgcctccttaggttgatctgcttcattctaaaagtggacctgttagggcattcttggttttagagtggtgggtagccaagaggaggaagaggaaatgctgagtgtggttgggacagggtcttaccacttggtccccatcacagccacggtctctcataggctccagaccatttagtccaaagagagaaacagtctttaggatgtaacaggccagtagaattaagcttcccacctggctctatgtgctttgttcccattcaaagcagacaatgttcagacatcggccatttagtgatttcaagtggatttcttgcagcaagcatgctttgatacctggttcaagtgaccatggggggatcccatagtacctggaatgagattgctggagcgtctgttccttggggacctgcccccttcacaccttaagtccaagtccttccctttagctgattgagctcccagaagagatcagaacatgtgtgacaagggacctgaaaacttacatggactaggcaaggttccactcatggctggatttgcccagcagcaagattgtgaaagttggcttcctaatgaaagtaagaatatggactaggggcagaggtcagcaggaagggagagcctggcttatttgggttgtctggtgactcaaaggccagatcttagggcagctccttaccctgcttgtcacctctttttttttttttttccaaaccctgtcctaggtaagatggcaaattattacaaaaagcacttgggatatttggacagttgagaaaagcaacctttagaagaaactgcttctgtgctcagaggtctatgtatagaggtgtgtgtgtgtgcactacacacgtagttttatgaatgaaaggatcatctcttgggtctattttttaaattcttggaaacacataaaaagccaaatggtttgactcactgactgactttgaagctgcatctgccgcttacaccgcagtggctttaaccccctctggggtctggttgccttttgcagtttgtggacttagttgctggaaggaggtctaggtacgagggaagtcgtgtggcctttgactctttccggtcctttctgtctttcatttccctaaactctccgcttttggggaaaactcctgcctcgctattggctggagacaccatgtcaaaaccccgaggatgctgggacaggatgttccagttggttctgtatgtccgttttcctttgtgccaaagacagacagacagacagaggctgagaggctgtttctaagacaaagcagtggccggccatctttctacatctcctaggcctgtctgtgagggggagggtcctggagactacactaaagacaagcaccactcttgttaagttcctgggggattggggtgtggtgcttgcccagggctagggagcagggaaaagggggtcctgttgcactttggggaaggagggactcttgggctccctgtgggactgctctcctcccctgtccccactgcagagatggcaccgtggagttcccttcaggcctggcagactggcagtgaggaggggcctcagttagctctcaagggtgccttcccctcctcccttcccagacaccctctgccaaactgggaaccagcagtgctattaactacctcagccccagagggcgccaagcctaactgagccccaggaggagctgtcgatttaggcaactcttctccccctctctcgggacgaggtcgcctttccttgtcctaagtgctcctgggggagatcctagtggctttgccattcagaccacacaactgtttttgcctgtttgttgaaaaccaatagaaggagaccagcttggcaggacattgcaggaagagaccccctcatcaatgccaggggatgtaaaagccattttccttccagatactcaatggtttaggtgcagaatgttgttcttgtattcagacatacatagagtaataccagctgaaacatggtgtttctttcctttggatacatctcagtgagggttcaagatccgggacaggccacatgcttcatggtctagaggctaggccaaagcctcaaccctgcacggcctgatgtggtatcattacggatgccctcaaatgggtgactatggactgacaaaagaagagaatttgtttttcttaaatagcaggatgctcctggagcgtgtgtttttcataatcacagatgatgaatactacgagtataaatggatgaactacctcagtcctcacagtaagattggagatgagggcagggactcatgcctcggggatgaatcccagccaggagagagttttggcttatgccacactaggtttgtcatggggatcgggcaggcttgcccgggtccccactcacattggtcgggttggcagggttccgtcatctcgtgtcccctcccccccaccccatccccttttctgctctcctcccccactctctcatcccttcactccagctcctccccctctctctcagagcttaagcttaagcttgatgtgaggaaaggaatgggctccttccctagagagctggatggagggtggttctgggtccggcctggaatcccctagtcagctcctaacttgggaaccggggcctcttcaacagggtttcttcaagatcctctgcctccactgagtcccctcgggaggtgtgtgtgtgtatggggggagggggcgcgctctgagatagagcaggatccttctgccctggggcctggtccagtctaccaggctcgctcaggccacctttgtagttgaccaccgccaggtgccctagccctccccacccctaaatgacctccttatagaagcctgtttcacttttggttttaatctacctcttagcaaaacaatatagagaaatttaggtagtggcaactccacttgcttaggttaggcgggggaaagatttctttttccaaaggaaaaactattaccttaaaaatactttccaaaaaatcttaaaaaaaaaaaaaataaaaaccaaaaaaaatttttttttcttttaagggagggagacaatttccagtaaccatgggattaatttcctacactcttttcccccatacatatggtttcctctttggcagttgtcacatgtcacgtaatgatacggctttcccagtgatctccttgtctggtcacatccccaccccaaggagtgccagtgagactcacctgtgcttcctgtcacagctctggccaggtgacctggacatctcaaacaggagcactgggcaggggtgcttctggactcgttagggaacctcatgtgaccacagttttatgtgaaccactgcttataagctcattggaaatgaatttaagcagattataaatttgcatgatgaataaataccttttaccaccatttggagtctcccttctcttcagaaatcgtgattctgttctccgaaaccagagttgaatgagaagagcccactctggcagaatgggttgataggcagtccgaggacacggcttccggggagggctttatttttctgagtggatgtctgggaggcattggggggctgctgcttgtgactgttagactctgtaattgcgataactttgggattgtattttaccagaactctgccggccatcctgaccctgaatttgattgtgccttcctccctcccttctctgttcttgaagctgggggaggggcagcgggctcggacttggctagtttgtttattgaatggatgaacgaacactcccgggggtcccttccgggggaaagctgtttcagccacaaagcaatctcattccactgttttcagcctcaaaataaaaggaaacttatattgaaagctgagtgtgtctgtgcttctgggagttggggagcttgggtgctcgggatgaggggagggctttgctaggaaaagagtcccagagagttgccagggagagcagggagattggcctgaccccctctaggctgggctgggataggatgctcagagccaggttgcctctgctctccctgtcatgaggtgcagctctgctctgccaggcctttgcattgatagacctagaacactgggttacaatactaagttgttttgtcatctattacaggaataaaagtagctaatatagtaagaggtaactttcaaactcagcttttttcccatttggtttttgatgtacattctcactgtgtagcccagcctggccagtcggagcaaacccacccggcagccatttcccttgtgtttcaaacctggtctgcaatgttgtgcctttgaagggtttcccctgctctcctgtcttagtggctcctc

SEQ ID NO: 20448 - DNA, 6669 bp, Mus musculus; identical to SEQ ID NO: 20447

SEQ ID NO: 20449 - DNA, 1220 bp, Mus musculus
gaaggtctggcctttaggtgtgtctgccattgtacaaggtgtacaaaccttggttcttttcagctgtggcacacagggctgcctctgaagagcagtgacaggagtgggttagctgcctgtaagcagcctgcctctccattccttagagctgttgcagagtaactattgcacagtagcacatcaagttctgcctgcagcctctgtgtgtctgctgaccacagcctttcatgatagcctgtgttcccacagacggagttgttgtgagtatgcttagtttccttgccctggttacctgaagcctggagatagggcttccctgccggaagttagacgtcctttagaactgctggaccagtaactcagttgtctccggctctgcccctagctggggtctggctcccgccctgtgctgcccactgcttgacgttgtcttgctctcttgccaggctccaggacctcacgctctataaccctgagaggaccatcactgtgaagggcgccattgagaactgttgcagggccgagcaggagatcatgaagaaagttcgagaggcttacgagaacgacgtggccgccatgagcgtgagtgcgaggcggcaccgtctgcgtgtgttgttgggagttgagtctaggccttggagacaggcgaaagtgatacctctggaggagctatatcccaagctcctcttgcagccttctctgaacttagcaagggttttgctcgcatctatctcaggacactgtgtgcgtcccaggttcccagaggctggaagagggcattggattctccaaaactaaaattacagatggttgtggcccaccatgtgaagtccttgaagaatagcagtgcccttgatcagtgggctacctttccagccccttagtttgtgcttttggacttaactcatctaagtttgtttctgtggaggtggtggtgctggggatgaagtctagcgtcttgtacattgtaggtaaacagtctgttgttggcgtgggtagctgtatttactcacaagggctcgttacatggctgctgggttgggattgggggcaaagtcttgggtttcatggattctgtactttaaccactctgtgatctgtgtgatttgatctagttaagcttgtatactgtaggagatgaaggatcccaacttcagcttttttctgagacagtcctgcgctctgctctgtaggctagaactgaattcactcctgcctta

SEQ ID NO: 20450 - DNA, 1239 bp, Mus musculus
ctactcccgttgtagtacagccacctggtttcctgttgttacagataaacggcggttatggggaagaacagctcagctcgtctacccttaacatacagagtaaatcactgtcatttacttgtagttgggagtgtgtctctgaaaaaggacactagaaggaaaaaaaataacttcacagccacaaacagcttggagtccccatctagtggctgtgaggtgtcctgcattgtcctctcagaggtgggcagagtgacacctggccgtggttctcaggccccttcttgactttccaggcctagtccaaggagggtggattctaggcttttaattgatacgaggtggaggaattcccatgttgttggagacaactaaccagctttctcctggtggtccacagaatagacgtgcataggaaggagaatgcgggcgctgcggagaaggccatcagcgtgcattcaacccctgaaggctgctcctccgcgtgcaagatgatcttggagattatgcacaaggaggcaaaggacaccaaaacgtaagatctggctgtacttggcgcgcgcgcgcacacacacacacacacacacacacacacactttttcatcagggctgaggcccaagcagactccttgctgctgaaccataccccacccagcctctactcattcatgggagcggaactgagattaggagagagagtcacaaactgcacacaaacaaacataggagctggcagatgagatcattcccttgtacaattgtatagaaattttatatagtcacaatgtttatatttctctctctgtgtgtgtgtgtgtgtatggatgtgtatacattagcattgtcataaatggggtatgcaggtaaacttgtgttagcacaaaggtcaggctgaaatccctctctgtgccttttataatttttttgtcaacatatctgtcaatataaagctacagagagagaagcgacagagggcttaaaaattgcacagtagcctgcgggagctgtgcgcgtgtgaggacctgagtgtgggccccacaggagcctgcgggagctgtgcgcgtgtgaggacctgagtgtgggccccacaggagcctgcgggagctatgcgcgtgtgaggacctgagtgtgggccccacaggagcctgcgggagctgtgtgcgtgtgaggacctgagtgtgggccccacaggagcctgcgggagctatgcgcgtgtgaggacctgagtgtgggccccacag

SEQ ID NO: 20451 - DNA, 1184 bp, Mus musculus
aaggagccgcgccgcgtcgtcgtcagcctcccctgcactcggcgggcacttctcccgggctcacccaaactctcccgtgacccccgcgtgccctcaggccgcccacccgcccggagctccggacaacttcaggggtggggtgcgtagaaagtttgcggctcccgccgcccgtctccacgcctctcggcctaggaggctctccgcccgcgcccgcccggctcggccttgcctggaaccgtgtccttgccccgccaccgccaccatgaacaagctttacatcggcaacctcaacgagagtgtgacccccgcagacttggagaaagtattcgcggagcacaagatctcctacagcggccagttcttggtcaaatccggctacgccttcgtggattgccccgacgagcactgggcgatgaaggccatcgaaactttctcgggtaagagcgcggccacctccccggaaaacacacacacacacacacacacacacacacacacgaaatcccggaacaacggggacctgcagctcctcttttccttgccggccaactcttcccgggtccgggagggctcggcctccgtcttcggtccccagcctcgcccggcctccctcgacgccttctcccggcgcggagatattcgggatttcctcaccccttcccccagcccgaggcgctcgtggcggctccctacacccctccccaccgacggggcgggagccccggttggcaactggtgggggtgggggtgggggtgtctcacgaacactggggttcgggtataggcgtggtttccccgattcccccccgcccctagtcagccccccatgcgctagagcacccccaaagcccctgccctccgtcccgggcctttccaggatgggggttcgcgcacctcagctcttcccgctttaactagggactaagccctgaggcaggacgtgggaggaaggggctcccgcctcccgcccaaggcctggggcttgagccattttgatttgaaagtggggcgtgagccgggtggcgcggcggcggtggcggtggcggcggcgggtcgccatgctgcttcccgagacgccgaggctgggccgagaggcgcgcggctaccgcgagggaccctccgccccgggccgcgccgccccgggggccctccgctagccctgtggccccgacccggcctggtcg

SEQ ID NO: 20452 - DNA, 1195 bp, Mus musculus
ataaaataaaataaagatgaagggcatggcagcccacatctttaatcccagcactctggagccagaggcaggtggatgtctttgagtctgaaagccagcctgattcatgatagtgagttcaaggcaagcaagggctacacagttagactttgtctaaaaagaaaggaaggaagaaaggaaggaagaaacctggagtgatgcatggcttttctttttatttatttaaattaattaattaattaattttttgaggcagggttttgtgtgtgtgtgtatccctggctgtccaggacttgctttgtagaccaggctggccttgaaccatagagatttgccacctgcctgtctctgcctcccaagagctgggagtaaaggcatgggtcactactgcctggcatggtgcatgactttaaacccagcaccagaggcaagtggatctctgagttcaaagccagcctagtttataaactgtgttccaggactatagagaaactctgtctttaaaaaacaacaaaaggaagactatactttcagggatcatttctatagttcgttactagagaagtttctctgactgtgtagagcacctgaaaccacgaggacgagacgtagcatcccctactgagcgtgaagccggctctaggtgctgcttgattgcagctgcctcttgccattgatgatcattcttctctccttcgggagggtgagagggagggaacgcagtctgagtggatttggtttattaaaaaaaaagaaaagaaagaaaaagaaaaaagaaaacaaaaaaccaaaagggctagagagacagctcagcagttaacagcactggctgttcttctgaaggtcatgagttcaagtcctagtagccacatggtggttcacacccatctgtaattggacctaaggccctcttctagtgtgtctgaagacagtgatggtgacagtatactcacatatacataaaataaataaatcttttttaaaaaatcctcccagtagaactgctggatcacatggcaaatatagttaaacaacaacaacaaaaggaaatttgaaataaaatttatatcatatatcttatattatatatcatatgtatatttatggggtggggtggctggagggatggcttagtggtaaagagcactgactgtttttgcaaaggatctggggttcaattcccagcatggacaag

SEQ ID NO: 20453 - DNA, 1147 bp, Mus musculus
cacctgcctctgccttagcagtattgagattaaaggtgtgtgccaccacatctggtgtatgttaatttttttttaatgtgctgagattatttatttgttgtcaaggatgctagagcaggcacctaaaggttggggaccaaggtgagggtcaggtgacagggcataagttgacctagttgacaaaatccaagttgagaaaaaataagtaagtgttcccagagaccagacacaattgatgtactgagaccaggaatattaaaaagaaagcaaagtggtggtaggtggtggccagccttgctctttgcacaccaggttttcagaagagtggagctagtgtattcaaacagacttgagtcagctcctgtagggtaccggaagagcattcacaggtgtcctttccctggcaagggctgtgaacctcaagtgtgctggctgtgtgtgagctctacatgtttgtgggttttttttttttttctctaaatgagttgccaactacaatcagaaaatggcagtaatcagctgctgctcctataaaaatgaacaagcactctctagtttgctgtaatccatactacagcctgttgacttctcggtttctgttctgcttactgtatctgagagtcaggcctgacttgccaagggtctttaagctgctcttactcacttcagagacgacctgatcagggccatcaagaagctgaaagccctgggcactggattcggcatcatccctgtgggaggcacttacctcatccagtctgttcccgctgagctcaatatggatcacactgttgtgctgcagctggccgaggtacggggtgtttttgagagtgctgaggggcagcccgggccacagtccagtcaggagcggtttccacctgtccattgcctgagccttgtgcaaagactgtcttagggatgaactactctggcctgtgctcattcagcacatgtattgagcaattgcaatgcaaaatacctgtctaggctgtgggacagaggctaatacaggccctgcctttggggtgcttaccgtataggcaggtagacagacacgcagacaactacttttcttggggcagactgcccttttgatgtcttaaactacttcatccccctgcctcagtttctcagcatgcctgaaaca

SEQ ID NO: 20454 - DNA, 1114 bp, Mus musculus
ttggtgggtaccactggtccctcagtagcaagtgtgcattatcaaggaagaggccagctttagggaagttctgccttctcagtgttactgacagatgctgggcttcttgatacaaagttaagagggaataaagtaagtctgtctctaaaccccaggaccatctgtcacataccagcacttgccgtgctcgctccgtctcccatttaagactggttttgatttcactgacagtcacatacccgtttttctggaggaaggaataaagaggaactaaatcagttaagagtgctgcctggagcccagcacatgcctagaagtaggacatatatctggacaggctgcccttaaacaagcctgagcatgcaggaaaagaatgtgaaagttcctaacaggtgactttcagaatggagagactgtcgagttcatcctcaaaaactgggtccaggggcttggggagatggctcagtggttaagagcgccgactgctcttccgaaggtcccaagttcaaatcccagcaaccacatggtggctcacaaccatctgtaacgaaatctgatgccctcttctggtgtgtctgaagacagctagactgtacttacatataataaataaatctttaaaaaaaaaaaaaactgggtccaaagcactaagataccaaataacacctccatagagaactccagagcacaccaagagactcagaatgatgagccaggaaggaatggggataatcataaatttcatctaaatatttaaatacgaagctgctgtaccacctcaccctacccatcttccagcacagaaagccccttgcttatctaattttgatccatattacagaattaagaaaaatgaacacgtctctgtcatgtttatggggatgtttatgtttcaggcatgctgagaaactgaggcagggggatgaagtagtttaagacatcaaaagggcagtctgccccaagaaaagtagttgtctgcgtgtctgtctacctgcctatacggtaagcaccccaaaggcagggcctgtattagcctctgtcccacagcctagacaggtattttgcattgcaattgctcaatacatgtgctgaatgagcacaggccagagtagtt

SEQ ID NO: 20455 - DNA, 2505 bp, Mus musculus
agagacttaaatcttacatccccttgtggattttttatttgtttcttccacaggacccttttggagagaagcggggccactttgactaccagtccctcttgatgcgcctcggactgattcgacagaaagtgctggaaaggctccataatgaaaatgctgaaatggactctgatagcagctcctctgggacagagacagaccttcatgggagcctgagggtctagaccctgctcccctgcccctcccccaactcgagagtcccagcagagcccctcccctcgccccagggacggagaggcactgtgcatctcccttcaaaggtgtccgcaaggtggcaagaagcaagcaagctcaaccccagggggtgggggtggggctggtcccagtctgacctctttggtgctggagcacctagggcaacagtcaatcctggatcagggccagggtacttttgtgaaagtacctggagtgatggcctctggcaaagctaaacaaccaacacacctctctgcagggccagctaattagggataggagaagacagaaaatgagaacccaagagggagcatgcccaagtggtttatagggatatctgggagtttgggtgggggtgctgtccatgacacttaagcagtctggttggttatctgtttgtcttcagtcttgaagcagggcttcccaacacccttttcttcccctcccctatttcccatgggccagcataactttgtttttcctaatttatatagtcactgttctagacagaccaaagacaaggaacagtggtggagtctgggctgctgatcagtaagctttacctagcacctgagcaccttctccctcacaccatttcctccgaattttaggttacaggtagaaggtaagccagctggaactgagcccaggtctctgtgaagtctgcatgggcgtcaggaagctgctcactgtgtccccacaatcactgatttgaaaggttcccagcacaggcagctgcagcctgtgtgggatttgagccactacataaaatagtctcttacagattgtcctgaatagtagtcaatgagggtggttttcttggggtggagcacggtaagactaatgctagtccctattttgtttagctgttacgtctgtagtccctgtcctcccttctgtcctacccccatccctggggatttgtgagcatggacagccaatggctcgagggattgtggctgggactctggagacttctccctttatctttccctctttgtcactggagctgttcctttctttgaatttagctacagtgacccttcagctggttgagtaaggatatgtgttttcagtggctctgggttagaagaacctatccttcccaggttgatacagttcacacttttcagggttgctgttctggcttccagtggatggttagtgatccacatgatacaggccttctggtcagtgtccagccctgagaaatggagagagccacctgccctgcccgctgctataaaggtctctgacttgtggatcatgggactcccttgcagagatagggagaagatagggcacaaagagggacctcttgggagggcagaaagcagagaactggacagggacaggtcacttggggagcagttttgttttggctacatggtggctgggtcatgtggaggtttgaaaggggactctgcttccaatttccctcttccattcccagagctagtccagggctgaggatgcctttggtctgtgggtccagtgttgtctgtcatccattaagtgttcccactttcaagtgacaatcttctccttggccctgccatggggcagagcatgtccggcatagcagcctgacttttatgccctggttttaagttgaggaaatatatgcacaggagtcaaagagatgtctttatatctgactgtacataaatgaagttttctttttttcctttttggtgcaataaagtttgttttggcagaaggaggaagcgcctgtgggtgtgggagggtttgtgtaaagaaacggagtcacctgggccaacctgtcaggaaggagttttttggcagctgagtagatgcatctgtggaaagaactacttgtggtgggttccctatcatttggaagtgcagggctatactctcagcagtcaatgacagaacaactaaccctgagtggataccaaaagtagctttcaagattgggcgtgagcatgtcctgtgagggcagatgggagtcaagatgggcccaggctacaggatgtcagtgtggaaaagccactgtatttgtgtccagatattgacccagcacagatctgacaagcttgtaagactgggttataaactctaaaaagccttgtttccattaccatctcattcaaatgctgtgagagaattttgctttctaacagaaggtgtttcctcttgattgatcatgagtgcagaaagaaataaccagtgcatgttctgtcctgccagcctgtactgtgagtgcaatgatagggtaacgtgggc

SEQ ID NO: 20456 - DNA, 1235 bp, Mus musculus
ctcttgaggatatgcctccatgagatccagctgcaaggcattttctcagttagtgatcaagggtgggagggcccattgtgggtggtgccatctctgaactggtagtcttgggttctgtaagaaagcaagctgagcaagccaggggagcaagctagtaaggaacatccctccatggcctctgcatcagctcctgcttcctgacctgcttgagttccagtcctgactacctctggtgataaacagcaatgtggaagtgtaagctgaaaaaccctctcctcctcaacttgcttcttggtctagatggtttgtgcaggaacacaaaccctgactaggacagtcttgcagaggaactgggtttgattcctagctcccacatggtaactcacaactatctttaacttcagtttcagggaaccaaggcccttttctaaccttgcagccaccagctacatgcacatggtgcacagaagtacacacaggcaaaacgctcatacatatatagtaatacaataaacacacctttaatcgattttcagccttttggctaatatcaagtgtactatttgttcttatccgttcaatatctgatacgtcctctatccaaggacaatatattaaatggatttttggaagttggaataggagttttctccatccatccatgcattgatctggtattgcagtacctctgggaacggtgcaccctccccccttcagggacttacaaaataaaaaataaaaaaataaacacatctttaaaaaataaatttaagaaattaattaactattaggaatttgggctgttcacaaccacctgtaattccaactctaagggattccacaccctctctggtggcttccgtgggtacccgcacacatgtggtattcatttaaacacacacacacacatacacacacaaatgtgcatgtgcgagtgcacataaaaaattttaaaagggccgggcgtggtgatacctttaatcccagcacttgggaggcaaaggcaggcaaatttctgagttcaaggccagcctggtcttcagagtgagttccaggacagccaggctacacagagaaaccctgtctcaaaaaaataaaaataaaaaaattaaaagaattctttttgaggtgaggtatggtggtgcctttaatcccagcattgaggaagcagagggagaggcaggcagatccctgtgagttcaagaccagccagagctggctcaaaaacaaaccaa

SEQ ID NO: 20457 - DNA, 1435 bp, Mus musculus
tggtggggtgacctgcaccctggggaaatttctcctcacagaagaagttgctataccagtttgatcagtgcaaacagcagatacatttcgctgggtcggtattttgcatccggcctcagggtctcatggtgtgcgtctgttccctggaatatcctgtggttctaaactactacatgcaagttcccagggcttctagctgacaaaattgcttcctagccttcttacactctccagcttctgcccgtgccaactctttctctaaaattacaactgtctgcaccctccatttagacattccttctaaggctccggagcagggagggacctggtgagtatgttggcttctgctcaattgagtgaccacgtagtcttcaaccctagtctcttgtcctccctatctgtgcccacatagctcaggatggtcttgaactcactaggtagccaaaggtggcctcctgcttctccctccccaaaaagaggcattcaggctcataccgccaggcttggcttgtgccttctaattcctcatcgctggtcacttaaatgcgctgcatgttgaacattaatcataatcgagttctataaatgaggaggccgaggcttagggagaggccgggctgtgaggggcgggggcttcagcaccatctagggaaagggtggacccagttgtggaagaatgggagaagtgaatgtggagcctaaggataacttccttccactcaaccagtaaagttcctagtccaggaaattccctgcaagtggcagctgctcttccctgttcctgaagataaagaacaacttcaccagaatctctcgcatctcacaccaagccctaaactcatgctcaaactcaactctttctttgcctgtggtctgacctttccagcttacttaaaacagtttactttagggctggaaatataccccagctgctagagactataacttacctccaaacatcaagattttcttttctttttatttatgtgtatgtgtgtcaggggtgcatatacaaatgcaagcacacttggaagccagcatctggagttacaggcagtgtgagccacctatcatagatgctgagaaccaagccaagcccatctggaaaacaagtattcaaacctctgagctggatctgtctctccagccctgtccagcgcgcctttggacgagggtgtagcttcataaagagatcctggaaaggtcagagctcagctccttcgcaatacctgggaggcctcactgcatctcatgcagaactgcagcgctcccccgacccccattctgtcctgggtggttttatagttctttctgctcccctttaaccaaaaagttaagtagcgtggagacagggattggctagtgttaggtctgaaggcacctttaaaatagaaattcactagtctatgagtataagaataagtagaagacagct

SEQ ID NO: 20458 - DNA, 1393 bp, Mus musculus
ggcctcctgggaggaagagaaggcctcctgggagaaagagaaggcctcctgggaggaagagaaggcctcctgggagaaagagaaggccccctgggaggtagagaaggccccctggaaggaagtgaaggcctattggtggaatgatctgcaccggtgagtgggggaagggccactcactgttagcactgcctgttctggtttggtatgattgcacatcccagactgaggaccagaagtttaaggccatccttagctacacagtgaatctgaggccagcgtaggctacatgatggcctgtcccaaaacaaaacaaagaaacccctgtctcaaaaggactcagccaagtggtcgtgcacacctttaatctcagcactagggaagctgggacagaaggattgccccagttcgggataaatagtagctggccagacagctatatagcaagaccctatttcagaaaccaaagaaaggagaaaaaattgattgttaaatgtggttgtatgattttaaacccactagaagatgtactttgatatgtgtgtgtatcctgggtaccctctgagctcagagagggtatcaggtctctgaaactggagttacagagttatgagctaggtaccaaacctgagtcctgtgcaagagcatcaagtgctcttcacttttgagccatccctccaaccataaattaactttacattcatacattttgtgctgtgttgattttataaagtcatatttgtattttatgtatgtgagtacactatcactgttgctgtccaaacacaccagaagaggacatccggatccctttagatggttgtgagccaccatgtggctgctgggaattgaactcaggacctctggaagagcagccagtgctcttaaccactgagccatctctccagtccaaagtcatatttttaaaaaaggggcggggggtcggggggaggctcacagtgggagcttcacctgcagaggaagttcatctcaggaacttggataaatgttacttctcccagtactgagttgaggtgtccgtgtatcttggactggtgacagcaacaaccaccatttggccaggagcatgagtggtctctgttggggaatttctattctgtggagatggatgtagccaataaaaaggagttacaacccacaagtcctagtgaatcacagtaagagatccagtccactatgtctaatgttaacaacactccaggggactaagtgtgttgttgtttacccagtcagtcaaaacagggactaatcacccacagtgtgcacgtctatcaggccaggatttagagagataaagagtccttgcccttagaaatccacaaaactaatggagacattcacactgccaacagagcaactcagatttttggtctcc

SEQ ID NO: 20459 - DNA, 1162 bp, Mus musculus
ggaaaggtatattcggtttacagagccagctcacagccatcattgaggggagccaaggcaggaactcaagcagggcaggagccatgaagtcagcttgctctcttatacaaggatcttataatacaaggaccacctgtccaggaagggcatggcccacagaaagccgggcctttccacatcaatcattaatcaagaaaatgtcccacaaaggtgaccacgggccaatctgaaggaggaggcattttctcggtccaagctccctcttccctggtgaccccagcatgtgtcaagttgacataaacaaacaaataaacaaacaaacaaaccagcacaacctggcttgtagataaaagatgagctgagaagtctcctatgctggtgtacaacatgggagagtgacaggccagaaagttagcagttccccaggctgatcatcagcctccaaaagcctggagccttgtgctgaggtaggaaacctgacaagcctgcctctcaccctagctcagagaaaagatgcaggggacagtgtttgcttggtgctgtgagcttaattgtagccctcagaagtatcccgagaagccacatcaccagtgggatgggttgtagacgtgggaagaactatttgaggaagaaaagaaaaagacagattgggtgacagagtaaccagagtattgttactgtgtattttagtatcatttgctgctctgacgtgtatcaacttttgtttttgtttttttgagacagtgtttttctgtgtagccagccctggctgtcctggaactcactctgtaaaccaggctggcctcaaactcagattcacttgcctcgctcttccaaaggattaaaggtgtgtgccaccaccacctggctgggtctcaatatttttttttaagatttatttataattacatataagtacactgtagctgacttcagacacaccagaagagggtgtcaggtctcattacaggtagctgtgagcccaccatattgttgctggcacttgaactcaggacctttggaagagcagtcagtgctcttacctgctgagccatcttgccagcccctgggtctcaattttttaaagttattttttattttagagttacgagtataaatgacagcgagctcatatgagtgcaggggcctgcagagttcagaa

SEQ ID NO: 20460 - DNA, 1188 bp, Mus musculus
gtgaaatccggagaggtggggtggttccttgtaaccctggctgctggagtctgaaactcaggctaaatacagataagttggagccagataagtttgggcttcaaagagaaaaatttaaaaggttcagaattccagggctaaaactcaaagaagtctttggagcccaggctctctctgtgaccttggtcaaggtcgtttcctccggatctacttaagctgtttattcagtaggaaaaaagaaaaagaaaagtgacttaggaccctggaagaaagtaattttcataagtaggcaggtggccggcaacctccagcctggtgctgctgtgtctgcgtggagcgcgggaaattgagagggttggaggtgggctgcaacaggccggagggggaggggtggaggagggctctgctcgcccagtctgtcctaaaggggaatcggtagcctcccgcccaaggtctgcaggctttcttccgttcttgggctctttgggcctcgcccctccctctcacattcccaactcccaaggacaacttgtcgctggcttcagacgcccgccctgcctgaggtttccttgtgtcccggactctgctgtttttcttttgtctaatttgtccatttctgcacttggcaatttcttgggaactaacttgaatctacttctcccttgtctgtaatagtctcttctctctctctctctctctctctctctctctctctctctcacacacacacacacacacacacacacacacacacacacacacacacacacacactgtcttcttttcttcctcttagccatctctgggtcttccagctggctctggcctgtccctggcacctcccagctacctactgatccgacggcgcccaagccggtataggctggtaagactgctcccgggaaggaggctccgggatgatccacgcggccgcgccccgcacccaccggcggcgccacggagacgcagagttctccagatcctccaagcgccgtcggcgccaccactccagacactgttcacgaggcctcaaagcgtggaggcggtggcccggggccgactctcgggtgaccgccaatttggtcccaagacacttcaggatctcgcaacggatggaggacagcgcggttccaagaggtaggtgatacggtcccccgcccttgagctcatcttgggtaggattgcgcc

SEQ ID NO: 20461 - DNA, 1152 bp, Mus musculus
aaaggaaggaagcaagaaaaggaggaagaaaggaaaagacagaagagaaatggaggagtctgctgcgcctggttttcagctttggtgaagatggatccaggcttcatctttaatcacgccaggcccgggcccatctgtcttgtttactctgccgaggagaagacgggcgagcgagcttcggtggcgaccattacctcgacacttggctaacaaatgaggccaggctcggccgctgccgccgcctctgctgctgtcgctgctggatcacagcctggatttttctttctttgtcccctactcctgacacccagcgaatgcaccctcagactgccagatagcacagtgttttggccacggtaacaaacacacacacatataactttcctccctgtctgtacccactttggggtgggggtgggtgggaagactgctcactcccttccaccatagacttagaagggggaacagaagggaattgaagggcagtctgcacaacgtgggttcccaaatccgagcccaagaaataaatgaaaatgaaaaaagaaaggtagcaattgggacacccaagaaggccttctgctagaaggtccagctaggcctggcagggtgaggggcagttgagttctgggagctgggaatgtcttctgggcagttcacagtagtagagtcaaggccttctcttaggttacaaatgaatgtgaaattaggaaataaaatactgtggccctcctactctggaaggacaatgttgcagaaccctctcccgttgttatcattgttgcatcgtttattattattattattattattattattattattattattattattattattttatgtcatgtgtgtcctctctcctgttctctttctgacattccaaaaccaggccccttcctacctctggggctgcctgagcctagaaccttttgttggtgtgaaaatttgtgtcctgtacagagtgacaacagaaataaatgtttggtttcttgtgaccatcacatcgtggttttgttggaatgttgaagttaagggtgtgagcaagtgcgcccccccccagtgtgtatgccaagcatcctagagggtatggcctcacaattaagttctctctctctctctctctctctctctctctctctctctctctct

SEQ ID NO: 20462 - DNA, 2285 bp, Mus musculus
gtttctctgtataactctggctgttctggaattcactttgtagaccagctggccttgaactcacagagacctgcccttagaggggatttttaacagaggaatatctttgaggggatcgtgtgacaacacttgcccagtaaatgcttgcatcctctttcctagtttgtttctggaatttagactttaaaagccccattccctgggtggtccaaaacgggaccacaacggctgatctcaaagtctctttgtgctttgttctacaggaaaaactctgatgaggctgacctggtccctgccaaggaagccaatgtcaagtgcccacaggttgtcatatccttctatgaggaaaggctaacgtggcattcctacccctcagaggatgatgacaaaaaagacgacaagaattagccctgttgagtaccagcccctgtcacctctgactgtgggtttcaagggggagggaaggagttatacttgtcttgacaccatagaggtggcttgagaagatgtcctttgaagagccagcatagtttgtgtgtcctgcagctgcccaagtgctttaaattgttcaagctgtgtagtttgcacacccatcccagtggaggggaaagggtaagtgtttcaaggcaacctgttctgcgctttgctaaggaagcagttggccttccatgaaggacaaaacctgcagaactggggtgtgggaaagcaaagatactgtcgatcttcaaagagcatctccacaacccacagccttcttcccgatagtgttaactgcatttttacagcctagcatgtgtgtagtttttggctattactggtatattaattgggggtgggagggttggggcagggaggaagggagatgggtagaatcattttggttaaaatttggggcctgattggggaaatgatgaaatagtagaacagctaactaataaattggttctgtgtccagaatattttgccttttcaaaaaaaatgtcattggcaccataagtaaggactatgagagactgttaaaaaaaaaaaaaaaaaaaaaaaaaagtctgttaatcctaaaacctacagccaaggtgctcccagcctgagctcaaagtggcccacaaaggacaaagccagttctgagttaccaaagctgccatttgatgatggaaactgactggagagggaaaggttacaggagagtatatagaggcagactactctgccatagaggtgctaattcttgaaattggagaaaaaaaaaactttttccaattacaaagttatatcagtttgtccatctaagccattggctcaagtattgcaggatggcctatgggagatggaagagaagggcctttgctcttagggtagaaactcttagagcccctctctctctttcttttttttttttctttctttcttttctatttttgttttttttttaattttttttttttattttcagctttgaaccctgaaactgcttgtggcaggttcagttactgacagcacaaattccattgagtcaattcaaggattgaatgacttcacaagccctggtctcaggagattaactttcatattggggtagtggttcacttgagaatacaaaatcttcagattaactgatgtccaaaatactgtcttgaatcatgagatccatcaatttttagtattgtctagacctacaaatagaactacattgtaaaatctttttcagcatgtgttaagatgtatgtgaaaatttctgtttaagtttaaagttcataccatactgtcagtttttgtcttaataaaattatagatttctaattcttgatttctgtctttttttttccccaaccaggtcttcttcccgtgttgcccagtctggcctagaactttgaatcctatgcctccactgttcagtgctggaattgcatggtgtgtgtaccactgcagcaggcatcttcatcttatcagcagccctcttgcctcagctcagcttctcaaaagtgcctgccacagcttcatgactatagatggacactgtaggctcaatcttgtgccctagtcttttaaatggcctcagtttattaatatagtaatatttgagcatttataattgctgaacatatagttaggaactggcacatcattctatatttcgtattgctgggaaattatttactgataacacttccaaatatagttatttgaaaacatgttttatgaagtagcttagtcagttggatggcatcagcatatgttgtcaccaaaaagtttgaggaattggcattatgtattaaacactcagttgg

SEQ ID NO: 20463 - DNA, 2550 bp, Mus musculus
aggacttgcagcgagataaggcccgattgcttcgagaaaaggtagagttccttcggtctctgcgacagatgaagcagaaggtccaaagcttataccaggaggtgtttgggcggctgcgggatgagcatgggaggccctactcacccagtcagtatgcccttcagtatgctggggatggcagtgtcctcctcattcctcgcacgatggctgaccagcaggctcggcgacaggagagaaagccaaaggaccggaggaagtgagcctggggaggcagggggtggacgctcactaagaccgaaactggagaagggctgggcctggacctaacattggggacttaaatgccttcttatccaatatatcttctcagatgggatgactgcgggtcagtgcaccgaagaggcgggcgcaggcgctgtctggctcagctgcccccttggggtgggcagggaggaccagactgcttgggtgattggggtccccagcctattccctttctcttgaggggagggtagtgtcggcatgctggaagtagaggagctgtgtggagtgaaggagagaaagtgtgggagatctcattgctggaaggagaaaaggaaggaatcccccgaaaatcaaagcagtcagaaaaaccagagcgactgttaagggctttggccagctttctaggcagcgagtgcaggtgacaacggtggtctagggagagttactggtatggaacacagacatggcggggccccagaaggcctttgtaactgtttcttcaactcttgcatccctgaagggaagatgctcttggatgcacctgtaatatcttagttactgaatgggaagctgtaggggccgaggagggcagagggtataggaagtgagaacgaggcctgtgtcgcagcagcccagcatcaagcatgtcacacactgccctgccacagccacctccctccctggccatcccagagccgaggctcccactgtcctcagagagcctgcatggaaatgctgtcctcttccactctcctcctctttttgatacccaccctcactagctgcctccagctctggagtggggtgctattctggcagtatctggaacttggcctacagcttcctctgcagggtctaaacagggaaggcacgtgtggaggagtggtcccagtgacatccaggcaccattcagcacaacactgggaagtgattcttccctcaggcccctctgcctaccaacacctgggctcctcactgggggaaacaaaagcctataaaccccagcaacaaaacctagtcctcttagacgttcttgcgctttgatttttttagggcgtgtgccctgttacacttatagggcctaggatgcttgtgttgagtaaaaaggagatgccccaatattcaaagctgctaaatgttctctttgccataaagactccgtgttaactgtgtaaacacttgggatttttctcctatgtcccgaggtctggtcttgatttcttttttgggtttctttctaggaaaatgagaagtgcatgcaaggggcaggagatgaccctcccctaggctttcagcttcaggcagcttcttcacagcctgttcagcctgggctcctggaggacagccctgggggaggcagtgaggggcagcgccaagatagccaggtggttggttccaggaccacagtgtcttttttttgttgttggttttttgttgttgttgtttgtttgtttgttttttaactgccactgccgccccctgacccccaatcttggtcagctctggagtactgcctgccccagacgagcaggggttgggggggagcactgatcctcctccctgggcagggcagagggctttcctaaccgagcagtagggatagaaagcgtgagcctgggagtgctttttataaattattttccttgtagattttatttttaatttatctctgtgacctgccagggagaggagagaaagaaatgctgtgagcacatgacaaaataaaatcaaataaaatggatgattcagcttaagtgcactttctcccccctctcccttctgaattcagatgagagtcacggaagctgggagactggccattgtgtgcttaggtgggaaggcggggagcactgacaaaagaactctgcagtgaagcccatgccatctcttcctgctggatcaggggagccttctcagaggcttgactgtcggtgctgtgctggagaggcacagagcactgctggactgcagtcatggcctggaaatgggacctgttagccgtgaagtgcgccatgctacagatgtcctgtgtgttgagaactcacactgcctgcttcaacttaacatcctcaatttctaggtaggaagggctggcctttgcctctgggctgctgcttgcagaaattaggcctttaagagggctggtgccatttacccactcacctaagacagtagggagaggtggtagcaccttccgaataatcaggccttagttttgacctacacacctctgcagcaggaccttgggtctgacatggggggaagcgccctttgtcttggttcatc

SEQ ID NO: 20464 - DNA, 1184 bp, Mus musculus
ccacccctttatgcaaatgcagtggcaccacaggctgatgcaagtctggtcactgctaagcaattccacagggcagtttgcccttgcttgccatggtcagacagtctgtgttttcagagtctccaaatcttaaaaggagaggggtctcttgcttcctcctctgtctttttagaggtgatacagccctgacctttagcttgggtgtgactctggcccacagtctaaacctgaaagcctgtgtgatgctagacacattagtagtttttagcaatgcctcttattttggtggaaggttgcctgggaatgaatgatgccttgctggtgcagagggagcaggaaaggagggctaaaaggcacaggcctgagtatgaccccacccaggactcattggagcgtcagtaggtgggacctgtgaaggggtaggaccgggagctttctccctgggatgggggactacttgaaagctaaagtcatcttggtctgtctttcaggatatagatctgattgacatcctttggcgacaggatattgatctgggggctgggcgtgaggtttttgactacagtcatcgccagaaggagcaggatgtggataaggaactgcaagatggacgagaacgagaggacacctggtcaggcgagggtgcggaagctctggcccgagacctgctagtagatggagagactggggagagcttccctgcacaggtactgccccttactgtctccgacactggtcgctgctctccctgctccccagactcaccatgctggaacacttccagaacacttgctctggatcagagttgtgtctttgcagtggacctgattgtgttttggcttagggtctataaaggcacagtggacaatggactcagaagcactaggtcttgacagtagatactgcagacaggcaaagtgtctagcatcttagaatacttctccatccctttgattgtcctgggaatagggtactcgggtctgacattcagaatggctgggacactgcaaacctgttctggaaaaggggtgtttgttatagatagctaaggcccaggccagtcaacagtagttatagatagccagggcctaggccagtcagatttacagttgctattgccacagatgcctggtgacagtttccaatgacagccttgtcattggaaaagtgtcttaggctgctgg

SEQ ID NO: 20465 - DNA, 1205 bp, Mus musculus
ttcatttattttatttatatgagtacactgaagctgtcttcagacacaccagaagcatcagatcctattacagatggttgtgagccgccatgtggttgctgggaattgaactcaggacctctggaagagcagccagtgctcttaaccactgagccacctctccagccccatattaaacattctataaggggagtgttgatgagcagagaagagaagaacagctggggagggctaactgcatggctcagtggttacgagcactcactgctcttgcagaggacccgggttcaattccaagcatacacatggtggctcacaaccatttgtaacactagttctagggaatactggtgtcttctgcaggcaccaggcacacatgtggtaagcagacatacagacagacaaaacacctatgcacatacaaagttaaaagagaagaatacaagccgggcggggtggcgcacgcctttaatcccagcactcgggaggcagaggcaggcggatttctgagttctaggccagcctggtctacagagtgagttccaggacagccagggctacacagaaaccctgtctcgggaaaaagagagagagagagagagagagagagagagagagagagagagagagagagagagagagaacacagctggaatgggaggcgaagccctgggtgtggctccaggcacttcaccgcatggtggggcagtgcatgctcctgatgcagcgcttccagtttggaggctggggcatcaaagaacgagactgtttcaaaaccaaacacaagccagacagtggtagaacactttaattccagcactcgagaggcagaggcaggtgaatttctaagttcgaggccagcctgggctacagagcgagttccaggacagccaaggctacacagagaaaccctgtctcgaaaaaccaaaaccaaaaccaaaacaaaaccaaaccactactgctactcccaccccctagtattcatttgagtcatcctaagcttttactttgccaacaaaaactgaatggcaagttactcagcacctctagggctctagaatagaatttacctggtagagttatattaattacatgattggccatgctgccaaacctggaaaattaagttgtacatcctcaggaaacaattcctctctttctaaatgagcaagcaacaaataaagactggtagggccttgttatgt

SEQ ID NO: 20466 - DNA, 1278 bp, Mus musculus
gtacccccaagtgatggagttttggcaaggccaaaccaaccgcctccatgaccgtattgtcttccgccgaggcctggcaacaggagactcccctttgggacccatgacccaccacggggaggaagactgggtgtatgagagacttgcaccttaacactggacccaagaatgttggggaatcaccagggggcagagagtggggaaaagcagttatgggaataagggaatggaagcccggtctaccttctctgtgtgtggcgctgggtttaaaccttgctcaggctcggcaactctgtaccactgagtgagagtcccagcatttctctctctttaccttttattttaagactaagttgctggcccctgagctgtttggagaagtgcctgattggctccaggagctgccgtggggggccctgtctctgcttcccctaggttagccctgaactcactgtgtttatatcccaggcaagcgttggccttgagttcctcttgcctcagtccctggagtagttgattcttggcttgtgccaccaggcccagctccagttcttgtttttaagctaagccatttcctttcttagcccttctacctacgtctctccgggactcaccctccaagttctctgaactccgaatcagttagtggctggaacaaagtgccgtagggttgtagagaatcacaaatagcaaaggatctcctaagtgttcccttgactttgctcctgggtttgggggaagcctggcttgggagctgtttccagtaataaattaatcaggctgcagatagacaaaaggcttcccagccatggaaaggagccagcccaggccatgtttgctgtgactcagacaaatcattatatgttctggttggccttgaacttatcaccctggacacacttgccttgttttgactttgtggctgtgtgcttcagcctctgtcactaacaaaggctcctcccgaggcaaccttgtcctgtgttgatcccccacttcagcctgggtccaggaaggacattgaccctgtggccatcggccaggtacctttacctacctcaccccttttgctgatgtgccatggactgtgactttattagtataagccgatgagttgttgagaagtgttataccccatggctgttagggggttgtgtgtgctccctcccccgggctttagtgtgatcccaactgtcagtgccagtgcacaagggtgtaataaaaacttgtcagccgtgtgtgatattaatgtttaacttgattccattttgtctgccccag

SEQ ID NO: 20467 - DNA, 1400 bp, Mus musculus
gtccatgatggacaggtgcccacgactgccctgggcagccctcaccccactcctgttctgtggctgtgtccctgcagagagggactctgttcctgtgttctcctccttccaaaggctctgcccctctcaccgtgagctcctggcctgcccaggccatggacactggccatgcccaatgagacgttctaacccaggacgcgtggggacccttatttccaaaggaaaaacatacatttcactccgtcgaggagcaaagtgagcccccatccccaccccatccccttcctcaacactgccggagtcccattgtgccatgccccctcccccaccgtgcctccttgtccccctcaattaagtcctcctgggccgctagggacacccaggggccctgtacccagcctcccactgacaccccccaccggggaggtgggaggctgcctccactccactgcccagccctgccacggctctcctccaaacattccaacttcctatgaaaggtcagacgccgaggacctgccctccctcttttctacggagaacgttgccttatactcacttcagatgatgacactgtggacgtgtgtgctttaaccacattttatttaattgctcccttcctctctttgctagacgcctcccccttgcttgcattcagtttagggttttgggggcaatgctgagcataggagggtctttttttttttgctattttttttctcactttaacaattcttttctaaatgacacatttcaactcaaatctggactcacctgagaacaccttccatcctgaccccgccacgccctcatctccccctgcccaagctccactgtgtacagtgtatattgtataatagactattgtgtctaagacatgttttaaaaacatattgcttgttatttttgaggcttttaaattaaacagaaatccaactttattttcgttgtaactgcttgaggatgttttattaattaagtgaagatttgttatcctttattaacgatgtattttgttggtcagtactgggctgacaaaaagtttcttgctaataaatttagttgcccaaggcaaagtctgcgtttggcagttgggcttcctttgtctgtgatgtcagaggtcttacagaaggattcctgaggcgggaactgtggactcaatttaccctcctggtcctggtcccaaaggagaccggctctcagagcacctgggggcctctggagccagagcccagtgcagtctctgcttttttctcccactcccagtcttgcttcagccacagaggcgaaccctagaagaacttcctgagctggccgactgttgtacctcccaccccagccccgaggaaggcactgcctcccagtctgtgagaagctagaggagtcaaaagccttagccc

SEQ ID NO: 20468 - DNA, 1813 bp, Mus musculus
gaagtttatgaggcactgatgttagggagttttagactctggcggatgtttatttatgttttcaaggaaagaaagaggtgatgcatccccaacagtgggctgaggcacacgtgtgaccctgaatttaagaccaaggtgggcaagaaggcagattcttgggtttggcgtttgcagggagcctgctgaccctatgttcttgcaggtggctgcgttgatgacaccatcctcagcaggcagggactcgtagactatgccaagctgcccagcctggatcagctacaggggcagctggtaggagggcttactcacctcatggcccagacccgctacctgcttcagcaccagcctgtccagctgacttccctgttggatcagtatgtcaaagagcaaaacgagggagattgtgccacgtcagccaatgagaagctacatcctcccgatcctgctccagatgcctagccggcctgttttacccagctctgcccataaacacactctgtccctgttgtctgtctcgttgtctggcagagatctaaaagaatttggagtggggagtggccttgtgtgacttggctctcattcacaatgacctccttggggacaggcctcttgatgatacagagaaattccattccagactgaggctgcccattgtccttggtttcactgatcactgtctttagttgttccaactagggacccgataggagcagtctccttgagttctccctgcacaaggcagggagaacagagactcttgcccagcctcctcacccactaccccatgctgttttcccagtccacattctcagtgctcgtgccatggtggaccggctaggaagacttgtgaatggcacctcctgggtcttgtgccaagcactctacagacacagatgccagctcctttagtcctcaccattcaggaaacagcagagaagcctgagttctggataaggtcttgaattcggttctctgaagcctcaaattctcaaagtagaacacgagtgggtcctggtgggctgacgttggcgttccacccttcgggtgtgctgggctgtggaaagaatagggaaactgcttcgtgataaaaataaaataaattttattgccttttttattttttaagaattattttatgtgtaaaactgtgcttacggggctgtagagatggctcagcagttaacagcactgactgctcttccagaggtcctgagttcaattcccagcaaccacatggtgactcccaagcatctgtaatgaactggtgacctcttctggtgtgtctgaagacagctacagtgtactcataaataaaataaataatatttttaaaagcctgcctatgtttatatctgtaccctttgtatgagcctgtgcacacagaggtcagaagagagcattgatctggagctagagttcctggtggtggtgaaccaccatgtgagtaggagattgaacctgagtcctcggaagagcaagtgcttacagccaagtctccagccctgaactcctgatcttacaaagttattgtctgggttatttcaagtcctctccaaattctcacttttcttccttaaaagccatcttccctagttgcctgtccttccaaatactacatctcacgtgcttttccttacgaaggctgggggaactagagttctcatgtaataggagccctgggggctatggcaggaggccctccctgagtcttgggaagtggcacctcccgcctgtggcctgccactgttcttgatcctgagtggatcagggtgaatgtggagtgactccttagcattccttcccagacttggag

SEQ ID NO: 20469 - DNA, 2492 bp, Mus musculus
tactactcagcctgtgtgtctcaagcacactattgttggtgagcgaaggatgggcttctaaaagggacagaagaacatggacccccttagggacaggcctaccagttccctcctccaagcctcagagcctgggctcctttctgtctgtcggcatggtaacccatttcagggcccgagactttcactaaatcagtgagtttcctgagtgtctcagctaccccttgccacttggaaggactaaaatcggggttgtatgtggcttaagttgactgtgtttcagtcattccagaagcatgcccaggtcttggttcccctccttactgatgtgcctgaggtaacagagcagtgactcttatctgctttcccagccctgtgggcagggcagtaaccgctgagctgctgacttgcagtggatgctgaggatggcgctggagaaaggatagccagactcctccatgcctgcctccatgcctgccgcaaccctccctgatagccgcagctctccctgatagctgcagccctccttgataggagtcctaggaaagggcaggtggtatgtgagaccgaatctaagtgccttcattttcttcccacagctactgatggagacggtgggctctgatatccgcagctgccccctctgccagctgggtttccctgttgggtacccagatgatgctctcatcaaacacatagactcccaccttgagaacagcaagatctagggcacctctcccacaattggctgtttctctgttctctctctcatcgcccccccaaacactcactttgaatgctgcatgaatctcgtggggggcccctgccccttgcggtccccagatacctccactagctaccgagtcaatgtgtgtgccgtcttccctggtccaggcaccactcagctctggctctttcctggaggtcgaccaaggctctccccatcttcctggtttccactggggagcggggatctggtctgggatgaggaggatataccctccacctctctctgcctttctgttcttcaacagggttgtctccaagaggaagtctagtgctcaggggagggagaggaggaggtgtcaagagctctgggagccccttcccaaatgtctgtctttcctgggctgtgttcttccaggaaagacctcttgatagggtctcagagcctgccctgcacactgatgccagcccttctgtctcatgaccgaccagcttggggctcgtggtactggggaaggaggcatcttatttcttgttagtcactgcaggccagctctgttctccccctctgctcaccctgggaaaccaggtggcagaggggtgggaggaccctgcaggccttggatgatccagcccaaaggggctgccttgaggctgggactcctgggccattaccctcaatccagggaactgtctgccagcctcacaggcctgggctcttcaggagcccctggcactaaggtgcagatcaccaaggcagatgcctccccccatcacccccactgcagctcctgacaccacaggttccccagagcccaagtgtgactcagcctgtgtttgctgggtaggtgtcatcagcccctgccttccaggccagaacctgagattgggcccagggtgctgtggagattaatttcaaaagagctaacccccttcccatacctacccacccacccctatattccctctgtgaaatctacctcagagtcctcccctcagaaagacaggggagtgggaggctggggccccaggctgaggtgggagcctcccgagggagtctgctgcccactatgaatccacccctcgctttgagcctccctggggcctcggccagccgatggcagtgaacgccactgtccatcgaatgtgccattctgatccaaatcttccaggccccctccccacacccctccttcctctgtgaagggggtgaggggtatgtcagcagggaaggggccaaggactccagagacatgtcattgtaccctgagtgttccccagggaggggacatggggaagggggcctgtagaggggagagagggccaagtgctctctgaacaagttgaaagtccaaataaaacttacctgttccatctgtgtgcgctcaggctgtgcttccgtgggcgggaccggggtcttggccctcactcggaaggtcttggaaaccactggggagctggggctggcgagcacggtcagatctggggctggctggtggtcacaggtgacccatgtcctcactgaggacaggtttgaagcagctgcccatccctgaccagctgcaggggctcttgagtttttcccctcagcatgtctggctagcagaagttctagagctctgggccaccttaatggatcagtagtagcccttatttttctcagataacttctgaatgctaggaggcaagctggaacagcacagaaggaagctgtgttccaggtcctcatgagtctaaggctatgaggacagggcaaggctttaggctca

SEQ ID NO: 20470 - DNA, 4517 bp, Mus musculus
agggtaagttattctttttccatgtgggtcctggggatttaacagcaggcagctttacccactgagccggggctaccatatagctcttctgagaccctgaggctatactgggacatagctttacagctcaaaggcctagtgcaatttccctttttttgagaaggtcttgctatgtggcccgtgttgacattgaattcatgatccttgtcagcttcttccttgatttctgacattacagggttgtaccatcacactcagtgagctacagccttgggcaaatcttgaactgatttgcccaattgattccagaaatctcttacaaacaatttttaagaagcgaatggatgctaagaaacatagagttgcctcactcagtcattcgtgggtgtttgttttgcacagggacttgtgtacagccttcgggaaggatgtactgaagttagtagaagctaggccaatgatccatgaactattaactgaagggcggagatcgaagactaacaaagcaaagaccctcgctacgtgggcaaccaaggaactgaggaaactgaagaaccaggcttggtaagctcttgtctgcactctcaggtctcaggagggtttatgttctataggatttctaatattcgctgcctactggtattttggctacacactttttggtacctgtgtttgagcaggcagccagacacagccagacaaatatttctaagccatatatttgagtccttgtgttgaacgacaacacaactcactgaccaagacactgaaaatactttggaacctaataaaatgttcccatatttgttctctttctactcctccatgtccttttttatttgtgcagagtggagggtctttttgtagtctgctagcctagatactgctttgtagattagactggcctcaaagtcagacacctgcctttgtctctccctcctgagtgctgggtttaaaggcgtgcacctccgtgtatgtatggccttgcatgaccatttatttgcttggtttctggaaattgaactcaggacatcacaaattgaagtaagcacatttaccactgcactacaatatatgcttatatatggcagcaggtatacagaacaaaggaagagaagaaaaataatcaatctttaagacttgatgggtcccatttttagctttgggctacttggttgtaggagttggggatacatatgacctcagagttgacctcttcgtccttttgtttttagatctggtaccactgggatgatgacctgagacccccactggaaatctccaatcttttgaaaaacccggaagtgaggagtgtgcacggatgctgaatgcttgggaatgagaggatgagtgagtgaggcttgaaaacaccacactgaaaatcctgccacagccaacagcagcagcgctgttagacatgagctaagtaagcactgagtttgtagaaaacataacatcagccatcttggaacagagaaacaatggatttacttacttattaaaaacaaaaaagctgtctcttcccagggaaggctagaactagctttcctgtcttggccggtgccgaatgggtgactgatttgggagaggaggacctgggttcacctgtggggctgtgttgtgaaaggcagcctggcccctgctactgaggagaaagatggagcccgggtcttgagcccaccttcactgtaccgttgcacttggtactgtctatgtgcccttgagaaggcgcgtgggggatttcacagtctgagaatgagtgtgtgtgagtgaggcggtacccacattctcaacttcaagtcattgcagtttctttttcccagaaaacaaaggggtttgatgttgcatttcataaactaactgaagttctggctactgatgcagcacaagagacgtgttttttttttaaatgaggaaagacgctgtttaggtttggtttggtttcattttaattactctagggaaaacactgacgaatggtcagcgctcctgtcctgatcttttcatcaaggcgcctttcctgtactatggttcagctgtgaatgtagctatggggggaggggggagaaaggagaactctggagttagaggatatagaaaataaaagtacagttgttacaaagaaaatgcagacttcaaagacagaaaaagccacaacccaaaccaaaatttaaatgcttgaaattggcatcataaacaagctctctcctgacttgtattgtggcagtcggaatgcccccagaaaactgtgccaaagagtttagaaaacaaatgtacaataaaagtaaatacactcaaaaccgcaaacttcaggtaactattttgaattgcaaatgacgaaaatttaatgttgaacgatctgataaaataaccatttggaaactgcttggccttctgtccctttctttgactgactgcaatgcggtattggtctcttgctgcactccaaaccaactaaccactaagacagtgtgtgtgtatccgtatacacagcatacacacacactaaatacaactgttgtgatgaaaatggcaccaggaagaaggctctatttttccactgaagttgaagattagtaaaatggtgtcagatggtgaccctgctcgcacgctttagtaattttttaaagtgtggtgtgctgtgattataataaatcagaattatttttccttttacaagggaacaaggcaccctgagttttagagtctttcagcaataagaaagcatttcagtaagctggccctcttggctcgtgcagatagtaggagattagctggcgttttgaatatgctgctttaaaaaacagtagacaccgaggaagtttttattgcttcctggtagtgtggaagaaacacaagaccctcattcccatttccatttccattgtagtcaaaggtattggcttaggtttctcccgtgctcctttcatcccctccctgcctgagcctgttcctaagtgggattggctccgcttgcctgtccgtacgaaatgcagcgtctgtagtagctctttacagggtatcagatattgtgccttttggtgccaggttcagagtcaaagtgccgatctgatctgtgaaccagtgtacaaaaaaagtatttgaaggagaaatgctccattatgagcaaagctctctaggagtccaagccctcgggagaagcccaggcctctgaacgccttgtttccatcttagctgtttttttcagatttactaaccattcctgatactagatagggttggaacagggcttagggaagggggcagaaatattgggggaaaggaaaaacaatgtgatcattcctcagtgctacccatttctgtcctgtgtgggctgcttagcgagacagcagaggatgaagtacaccgagaaccctgatgaaaacaagaccttgcctgtgttttgtcgtgttctgttccagggaagcagttgacaagtgctgttactaatcctttctcccagatgcattcagtgctcgagaggaggaaatgggctgattggattgtggtcttggtgccttgctgttctattctgcactggttacgcattttaatcctcttttagttaccttcagctactgttttctatggtttgggtgtctgtccttaatcagttcgtaccacataaggcaaatgaatgcgaaatgcattctgtccactcactgtctgggccttccccaccctgagtcttggcacattccttcaagaatgtagttaccgtctgcttgggaagatgtcagtgcaaatgtgaagaaaatgggcatcggatagacttgggtttgccacaagtggcatctgcctgcaccaattacattggttaattttgcttttcatttttctcagttacccccagtcctccctctctgttgaaatgttgaagatttagctgtcagaggcaactgtgatcctgccttagggactggagaagtggagggacttgctcagtatggtgttctaatgttcagaaccaagcagtctccttacttactattttaagatgtgtgtagtttgactttagaagaagttcaaattccatccactttgatagcatcaatctgtaattggcattcagaatgcccttggcatgccagtctgtgaaggcattaaagacctgttaaaacacttgagcccaactttattaaccaaaactgataccaccacctttatcttctgaataaagtccgctttatttttattttcaacattttgctgcttcgttctttgtttcagatgtcactgctgtgtcagtgaggtgtggtttggaagaagctggagagagtgtgtatatgtgtgtgtgtgcaccctgctggcaaactgaggaggatgtggggcggttgtcctctgcctaagaccccagtgtcagtgcccacccaaacttcctgtttagcctgcaacaacggccagtttctctttcctgaaccttgtatttaactggatcttttcctccctccttttgactaacagtgatacctgctgacttaactgtcctcttttaaagtaacttgcatgtggccctc

SEQ ID NO: 20471 - DNA, 1200 bp, Mus musculus
aagcctgctcttttcagaactgaggagagggtttggtaaccacgagagagctagggagggtgtggtatctagactaacactcgctcccatgagttttttttttaatggtttttcgagacagggtttctctgtgtagctctggctgtcttggaactctttctgtagaccaggctggccttgaactcagaaatccgcctgcctctgcctcccgagtgccaccacgcccggcagttcccgtgatttttgtttctttggtttgctggttggttttttgttttttgagatagggttcctctatgtagccctggctatactggaactcatgctggccccaaaggggttgaaggtgtgcaccaccacacccagctaccaaccatttttgcatcctatttacagttatttgtgataggtaatgtctctgaactgcatccccaacctctggttttatttttgggaaactgttgtctgctttatgagcccctttatcccttcttggctgaggcctgacttgcattgcgtccttgtagacccgatggacaccagaataacctgagaagctctgcgtatgagtctctcatggaaatcgtaaagaacagtgccaaggattgttaccctgccgtgcagaagaccaccctggtcattatggaacggctgcagcaggtgcttcagatggaggtgaggcgactgcagtgttttatcctgggcaaggtggcaaagctttggatgcacacaaaagtgcttttgcccttgaccatgctcggaggtttaatcaccatcacccaaacccaaaaagctctcagcgtgctgctccctgttacattgcagaggctcagctgacatcagcagtggaggtttcactagagcactgtttgttcttttccttcagtcccatatccagagcacatccgacagaatccagttcaatgacctccagtctctactctgcgcgactcttcaggtaggatggcatcatctctctccttttgcttttgttttacacgtgtgggtgttttgcctacatgtatgtctgtgtcccatgtccatggggttgcccaagaagccagaaaaggacactgagtctcttaacaccggagatacaaatggtcgtaagctatcttgtggtgctgggaattgaagccagatcctctggaagaccaggcagtgctcttaagaactgagccttctcgaatccttaacctc

SEQ ID NO: 20472 - DNA, 1099 bp, Mus musculus
tttttattttgctggtataaatgacagaagagctcatggtaatttaattttgtgcataaagaactgagtctgtcaggatagaagccagtgccactgtgatcacttcttgtctttacctgttccatatagactgcttgaaagtatccactacaatcttgaatcatatatggaatttggtgaagggaaagaacattttaaactgttttgtttactgttattattttgttttacaaaggatctaagaacattctatcattatatggggccagggattgttactatttcacatgaggtctttgtaactcaggctggcatcaaacctggtacatacataacacatactagccacgggtgcccttcgctgcccttagatcccaagtgctgcagatacaggcatgtgccacaatgcccgtgagtatttcttctgaatgatagtcgttatgaattccttttgttttgctttattgtatttacaggctatgcccaccctaatagaactaatgaaagaccccagtgtagttgttcgagacacaacagcgtggactgtgggcaggatctgtgagctgctgcctgaagccgccatcaacgatgtctacctggcaccccttttacagtgtctgattgagggcctcagtgctgagcccagggtggcttcaaatgtgtgctgggtaagggattttcttcctggtgaaggcaggagcttgtccgagccattaggaggtgtgggagagaaaggttacttgtctcattgaaaggcgtgctctgagttctgtctcttaatgtcttgagaagccagagggaactgtactccgattcgttcccagagcacttggactgcacctgctgtactcctatgcttgtttttagatgaaaagctttgtttaaatggggttttttgtttttataacaaggaaaaagacagggatgaaagccaaagggggtaggcagcctctgtgctgactctgtaggctgtgtaacttactggggatagagtttgggaaaggaggagtggggctaaaatcctgtggtctgtgtgtgtttgagacagtttttctatatagccccgactgtcttagaactcagtctgtagacgagacag

SEQ ID NO: 20473 - DNA, 1286 bp, Mus musculus
aggctttgcaagccctctaccaacagctacatttccacctgctgttggtttgagacaggatcgttgtacacctggttagtctcaaactaagatagtcctctttcctcaggctcttaagtcttacttttacaggtgtgctccaccagcctgggcattcttataggtagtggaggtttcttaattctattgtacatgataattgtattcttccatctgtttcttggggtgacgtaggttatgctgtgatgaaatgtgaaaaaagttttttgtttttttaaatcagtgttttatattttactccctgattaagctctaatgatacttgggagtatatagcaagccttctaagtgaattcattgcaagaaaagcttacttaggctgggcgtggtggcgcacgcctttaatcccagcactggggaggcagagacaggtggatttctgagtttgaggccagcctggttgcaggacagccagggctacacagagaaatcctgtctcaaaaaaaaaaaaaaaaaaaaaaaaaagcaaagcaaagcttacgtagtgccacatctgtcaccaggatgaaaacgatgacgacgatgactggaacccttgcaaagcagctggggtgtgcctcatgctcctgtccacctgctgtgaagatgacattgtgccgcatgtccttccctttattaaagagcacatcaagaaccctgactggcgataccgggatgcagcagtgatggcttttggcagtatcttggaaggaccagagcctaatcaactgaaaccattagtcatacaggtaaagcccggggaagttttagatttgaaatggaatgggggtggagagtgcgcacatgtaatatatgtgtgactctaaataatcacaaagatttccaaataattgaatggttcgtagcacaggcctacaaacccaaatcacacattcttgtggggattaacaggtcagttgctcaagggtgccacccttaactggataatagtgagaccatcctatgctatgcaatacatttcctgtcttagtatagtttcttgtcattaatggtgaaatatataacttttaaaatttagtcatgaccaagaaacttgaaaaaaagaaaaggctttaccttatatctcttaacttagcacttgttttctgtaatttttggagagcaggatatggagctctcactatgaagattgtcttaccaggatcttttcttattttcttttttttaaatgctacattgtaagcattttcctgttgcttttggactggagagcctccacatatatc

SEQ ID NO: 20474 - DNA, 2197 bp, Mus musculus
cacacatatgttagaaaggatgccttacatgagatcacagggctgtcctgatgtttttgaacaagatttttttttttttaatatacttttcaagaattcttttcgttgagctgatttgcagtactggacattgttgtacatgcttggagaaagttgtcactaggattgccgtgtcaccaggcatcgacttgcctttaattctggggagatatttattagacttgggctcaaaacatgttcttgataggaggaatctgtttcttcatatagcaggtgacttgtccttgaagtggcttttgttgcttagtcaggccttaactttttgaacccaaggaaacctcttcaatgttgagtctaggcaggtactatttcaaagagagatttcccagtttcctgagataccttgatttgatctaaattttgtgtgcttctctagtttagtactttataagcaaggggaaattgctaatatgcttgcaaatgcaccttctccacagcccacgttccttgtggaactgtccagagtgctggcaaacccaggaaacagtcaggttgccagagttgcagctggtctacaaattaagaactctttgacatcgaaagatccagatatcaaggcacaataccagcagaggtggctcgctattgatgctaatgctcgacgggaagtcaagaactatgtaagtgactgtccaatccttgatgtcacatggtctaaggaacagcattgtaagggagtgttcatttacctggcatagagcatgacagatttctgagacctcaactttaactgaatgtaaaaatttattctgattagtctcttggtgtggaaatgggtgtttggtgtgttgttgggttcagcttgctaaggtgacctgcagcagcttgggaaactttagttgggtctcttaaaagatttcactcctgaagtactgggagtgccacactgcactccggggtatctttgagtgtgtaacaaggtgttaagtagcccagtccatcctcggttttattaaagggtggctatgaactcctaacatttctgcacttactctaaaaggggtcaggtgtttgccaccatgcctggattttcatagatatcttaaacatattttctactttaaaaatgtgtgtttatgtatgttttagcaactttggaagccagaagagagtgttgattcccctggatctggagttacacgccatcgtgaggatcagacaagggtgctgggaactgaactctttggagagcagggagggttatgctgttttgctctccccaacacagtcccacagctcccctttgttttagggatggcaggtcctgttgtttgctggtttttacaggataatgtgtaaagtcagggagataaataagtaattttgagtcaaacaaagagcttgaagatttgtctatctatttatgtttcactatgtagtctaggctggccataaactcacaatctaactgcctttgcctctgagtcctgggtgtgtagcttgtctttttatgtacttaaaaccagttatggaaaactttcttgagatctcagcattgtgagtgagttctttgctggttttgcattgtggcctttttatgattttgttgttgttttgttgttattgttgaattagaaagcacaggattcaaacatagatagataggcttgcctttttcttgttttaagtactagttacttagtggtctttatggataggggccaaaggaaacttgataaattaaatagtcacagtcataatttgttcagggtattaaggtggaaatgagaggagtttctgtttgtatttaggcaggtcaagattatgggcatcataattgctggatttagattctacttttaggcaaattagtgtcctgtgaggcaggtgcttccctagcagtgaccccccctcccttttccagtcatcctgtctactgtcacttggcacaagttaggaaaaccaaattactttgattcttccttggagtatataaagttatttttacccaaaattgtgtctactcggaaatgacatttttctgaagtgttacttttagacagagtctcactatagctgaactcactatgttgaccaggttggcctcaaactcacagagatcaacctgcttctgtttctctagggctggattagaggtatgccaatgtgtctagctattgagttattttaaattaca

SEQ ID NO: 20475 - DNA, 2119 bp, Mus musculus
gaggagttgctcatttagcctatgttggcaatggtcaattctcatgatggaggctgatgagtcagttagtccacatgatgcttttagcagtcccagtgttaacttgttactgttgctaacggtgattctgcattccggattgttttcacaccaggctttcttcgagagtcacccagctccttcagctgagcgcaccatccagcagtgttgtgaaaatatcctgttgaatgctgcttggctcaagcgagatgctgacagcattcaccagtacctccttcagcggaaaacctccccaccctcggtgtgaggcctcctccgcacctgggcctcactgcctctctgcagggatgaggtggagctaccaaacagctgactcacatgccaagaatctggagtcttacaccagtgggggttggacaatgaatgtagtaggtccctgctcacactccagaattaaattctattgaaaaaggaaaatcagcagttcagcaaaaaaataaaataaaataaaataaaaaataaaataaaaatgtaaatatgatagtaataaactagagcataacgaaactgtgaaacttcctgaagcctgtcatggtcaaagtgttgaacactctcctgttagtgacggatattgttttatagcctaccagaaggaaagaggctttgggggaagagggaagagggttttgtgaagtgggtgtctgcagcctgacaagccgggtatgtccatcactggggatgctgaccaaaaggctgatagctggctcacatagtggagcctgtgcagaattataagtgggttttctttttcctttttggcatgggaaccgaccaggaaggtatcttttcctgtataactcaatctgaaccaaggattgtagttccctccctgcctcccttctgtgtgatccccaaccccccaaaaagtaatgaaaagctttaaaaaacaaaacaaaacaaaaaaaaaacacaccctccctcccttcccgggttcttctccctttagttctgcccagccctgacctgtccttagataacagaaacatctttgatggccacattaaataagaggagctgatatgcttttatttcctatgataaccttcaaggaaccctgacatgcataagaggtgaaagagtagaaataaagattatcagctaggccttctgctcaaaactgtccggttacctgacaggccaaatgctgcacctcttccgatcagtatcagtgagcctggctcaccacttgtgcatatgaggggccagtggggactgctgtggggcccagatgtccgctgcaccgctgtgtcgccagtgtgctcactaacaagccccgccacctaacccagtgtgtttttactaagtctcagccctttcccccacccctttttcttctctcttccttttatttttttctgaatccttttattttgtgttaacagaaattcatatttggtgtggcttaatgtattttggaaggtcatcagattgtgagactgcttccttgaaacatttttgtgctattgttttaaaaaataataattaaaaaacagttggcgttaataaaaatgtcaatgtgaatttgttggcctggttctttcagctttcttgaaaggaaactaaagtttctctgtgcctcagaattacaggaattcggccgggcggtggtggggcacgcctttaatcccagcacttgagaggcagaggcaggcagatttctgagttcgaggacagccaggactacacagagaaaccctgcctcaaaaaggaaaaaaaaaaaaaaaaaaaagaattccaggaattcaggtagccataggagttttgaaaatttgtattacactttatatgtatagatatatacatgccacggtgtgtatgtggaggtctgaccacaactgtgggcactgatttgccccctcctgctgtgaggaggggagatttgaactcagctcatctagctttgttgcaaaaacccttacccctagccatcttgccaactcctctttgtgtttctgaaacaacctcattctgagcctggctagactagaacttgctatggtagcccatgctgggctcaaactcaaagtgaccctcctgccttcatctccacagtattggg

SEQ ID NO: 20476 - DNA, 1184 bp, Mus musculus
gttagtcagtgctaaaagcactctgactccgcagagccttcccatccctgcccctttagagtgaggcaaggagaggctgacgttgacacagtgggcagagtcagccttgacagagcctttgtcaagaaccagagccccagctgtttttttgcaacttttctcaaagtagaagatattttaaaaaagaaagagagaaatttaaaatatcaaagtgatgccccagaaactgagtagaaacaagaagttaactgatttttattggtcccaaaatatgagattcaatctaagttttttttaaggtgttcttttatagatagcaaggaaattaacaaaagatgttgtcatgataggatttttattctaacagtattctgaacttacttagcctcgttttcttaaaccaagagaattgctagcagtagataatgccacatgcatgtttgttttcttttgtcttgttgagtctgaaggctgagctgatttgtgttttttcctatcccaggctcgagctggcatcattagcactgtagaggttctaaaagtcatggaggcttttgtgaatgagcccaattatactgtatggagcgacctgagctgtaacctggggattctttcaactctcttgtcccacacagacttctatgaggaaatccaggagtttgtcaaagatgtcttttcacctataggagagagattgggctgggaccccaaacctggagaaggtaatagatgaatgtactatctggggaagaatctaaagttagtactttctattcctgtgtggttgacagttagcagcatctctgtatccagattttagagtatattcagttggtcagaaatgtagtgttctgaacctgctagtgaaattgttacaccatcacaaaacagtagctcacgtaccttggaacctatactgactctcctgcctcagcataaatcttcacacttggcagggttcagctttccaaagtaagaattttaattgctttctgcctttctatgattatgtctataatcatgttccttttaaaacaattgtgatttaaatgttgaaagtggtaatttggaggttttaaatccattcacttgtcgccatctgcttactaaatgaggtgttctctcctgaataatcttaatctaggatttattttattttatttctaaagatttatttattttat

SEQ ID NO: 20477 - DNA, 1172 bp, Mus musculus
aagaggaagcatgttatttgtctaattatactttggatttagtttagtatttatttatttatttatttatttacttacttacttacttccttatctacctccttatttacttattgtgaaatagaatttattgtggctctgactatgtgcactagatgtgcctgatctgctgaccaggctcacatggtttgtgcaataaatacatctgccgggcctgctctccagtggttggaaatgcccaggggtttgggggtagggttgtcagtccagcttcatggtccccttggtggcctttttctctgcctgcttggcttccatttctcttctactttcctctcacttttttggtcccagctcctcctttacctgtctgctctcagcctccaagccttcctagttgttttcaccccaggagtctgggtctggcctgggctgagcgctgggaccaacagacagggcagcaaaggggtggtcgcccatgtcactgggctctgcaccaccctagttatactagctagcagtgtgctttctaggggtggctccacagagctgggttcctgccagccctggtcccaggagctgtcaacttccgagctgctccagtgtgagtccagagacttatggtctcggtggctgacctgtccggcttggctcccttggaccttggcactttagtcatcatccagctgtgccgagacagattcagcttcctgttcgatgctgccccagttatcttatatgtgtgtgtgtgcctgcttgtctgtgtgtgtaccaattatgtgcaggtacctgaggatgctagaggaggacattagatcccctaggactacagttatagtgctcttaactgctgagcctaatcactctaggcctaatctttaaaattgtgtgtctcccacaaagcttcagtggcctttaatcccatcatttcggagtcagaggcaggcagatctcttgagttcaagagcagcctggttttgccagggtgatccaggacacctagggctacacagagaaaccctgtcttgaaaaacaataaagtttatagctctcttactgaaagagaataaaaaaggattggaataccccaagaaatgtaaggcagtggttttcagttttcctaatgctgcaaccctttaagacagttcctcttgttgtgactcccctaacca

SEQ ID NO: 20478 - DNA, 1179 bp, Mus musculus
agctctcttggaattcactctagatcaggccggtctcaaacttagataaatgcccattcctctgcctccctcttgctggtattggaggcgcacactatcacacccagctcatgttaccaatttccttatgggtgctgggtgaaggggatctgacctcgtgctagtgtggcaagcacttgactgagtccccagaacagctttttttagtagaatttacttagttgtagccttgtgggtagaccatttgtttgagcctctgtatgatggacctaacagttggtaagccatgcaatgttaaaaggtatgtgaagctgggcatggtggcgcacgcctttaatcccagcacttgggaggcagaggcaggcggatttctgagttcgaggccagcctggtctacaaagtgagttccaggacagccagggctatacagagaaaccctgtctcgaaaaaccaaaaaaaaaaaaaaaaaaaaaaaaaaaaaggtatgtgaatatttgatacaggaaataaacatttccagttattgttttcatttaccttctagaggatctctgggaaagtttggaaagtgccagtggcaaacccatagcagctgtgatgaatacctggaccaaacaaatgggattccctctcatttatgtggaagctgaacaggtaagcctgtgagaatccttgcacagctgggtgtgatgtgtcatccatggaatctctgtactttgaaggagataagcagacatgagtttgagccatgtcttggctacctagccagacagtttggaaaacaaagagaatattagcacaccagaatgattgtttcttctctgaggatttcatttctcaaaactgttatgcttattaatgattacacttaatgcaaactactggttgctatttttttttctttcctttttttattttaaggctcagaacccttttaaacttcagtaggctgctgggtataatggtgcacacctttaagcttaggatgtgggaggaagaggcagaaaagagctcttgtgaattgaggccagcctgctctacatagtgagtttcaggacagccaatggatatgcatgtagagagacttttttttctttctgagactgaatatcactgtgtagtgctagctggccaggatctcttaaattctaaaatgcatgatatctgggggctggtgag

SEQ ID NO: 20479 - DNA, 2102 bp, Mus musculus
ggagttgtacccacaggttaataactgctgttctaaactattaatatatataagtgtgtgtgtgtgtgtgcgcgcgcgtgtgtatgtgagtgtatgtgcgtgtgtgtgtatgtgagtgtatatagttataatactagtggaacaaatcaaatctgtttaagaataaatagaatgttcgcagcttgactttgatttgatcaaaagagagaatctaggctatgaacaataacagggagttaaaagattacatattgttttatttaagtttgttattctttttttttttttttgaggattggcatacttttatgagtaagttaaaagaagaatatcatgagttagaagggttttcctagaaagctttttatgtaattcagtgttacaggctgtctgcttcctgtcataaccctgaatcacactgtctgccaggtcagtgtgggccatccgtctgaggttgatgagatatttgatgctatatcatatagcaaaggtgcatctgtaatccgaatgctacatgactacattggtgataaggtaaataataaaaataataattccaatcctgcattgtgaaatcacagttttaatctgatttttagtttattgacatttctttttatattggttattaaaggttcctagtacaatgatacacaaattagtatgtttgtggtaagaatgggaagctagccgggcgctggtggctcacgcctttaatcccagtgcttgtgaagcaaaagcaggcagatctctttcaggccagcctagcatatagagtgagttccaggacagccagggctccacagagaaaccctgtctcaacagaactaaacaaagcagagaataggaagctgctatacaacttacaagcagttggacatgtaaaccagcactggggagacagaggccagcctggtctacagtagctgagagccctctctcttttcatgacagggattctctgtatagccctaggtgtcctgacactcactttatagaccaggctatccttgaattcagacattagcctgcctctggcgttctgggtgtgtaggtattgttgggaataaaatcatgtacagccactgctggctaagagctgtcctgagacaccaccaccaggcagagagagccaaaggagaataaaagtctgcccctattaacacacctcctccaaaagccacaactcctaacccttctaaaacagttgtgcctactgggaatcaaggtttcaaacacaggagcctatgggaaccattctcataagagcacactgtcaagataaataaataaggcaccacattgagaaagcaaaagaaggcaattttactcttagataaaacttaatgggcttcagaaggatgcatgcttttcagcatatctgatattttaggaattgagtacatttagttttgataaatgtgtgtatctgctataaattctgagatctgactcacttttacttaaaattgtatttttttaggactttaagaaaggaatgaatatgtatttaaccaagttccaacaaaagaatgctgccacaggtaatctttacgtttttaatttttttttatgatttatttatattatatatttgagtacactgtctgcattcacatacaccagaaggagtcattgagtcccattacggatggttatgagccaccatgtggttgctgggaattgaactcaggacctctggaagatcagtcagtgctcttagctgctgagcccctcgttttagtttttccctacccccttgcctccttcccctttttgtcatgctaagggtcagtcgagaactttatgcatacaatgctctactggactaagctgcatcctagcctcaaaggtcgtgttcagtaacttgaagtagaaatacagataaaggctctgagtttgatttcctagtaccagaccatgaggtgctggagataaaatgtcgttctacatttacgatgactcctcagacgtggtgcatgaagacatggtctgcactttgagctacaaagcctagtgtttactgtgtttattccagctactgtggcattcccacagctcagggtactgtggatccttttcatcctcttggagaagtttac

SEQ ID NO: 20480 - DNA, 1202 bp, Mus musculus
gtgcattattagatgtgaattttctgttttataaatccttaaatgtcatttatttttgaactacttcctgctgtgagtgatatttctgctagatttacatagtccttaaggctgtattatatttctatttaattagaaatagaaacccaattcactgtttctcccagtcattgagtaaatgatttctacctttttcatttggccatgagagccatggtttggtttgggttttaagggaaattcttggctgcagatagccctctggtttcctgcccagcctgatcccttttgcagtaaactcaagaatctttctcttggggctggagaggtggctcagtggttaagagcactgactgctcttccacaggttctgagttcaattcccagcagtcacatggtggctcacaaccatctgtcatgggatctgatgccctcaaatatgagttcattactaactggtttctgttgagttttactttacaaaattacaaattttcaagtacaatagaagggagacatgtttttccagtaatgcagtgactattcctatgtgtccttcactcgatctgcctttttcttttttaggaatggtggactcatctctggttgaatgaaggctttgcatcctggattgagtatctttgtgtagaccactgctttccagagtatgatatctggactcagtttgtttctgcagattatacccgtgcccaggaacttgatgccttagataacagccatcctattgaagtgagctatactttgcaatcatttcagtgaaataagtaatttgttgtgtctcaggatgtttaggattctgaaatgcaaaaaaagctgcatggatggcttcctttgggtgactgatttatttttagctcatgcctgaaactcttagactaagttctaagtagcatttctctttaaagtagggaatgtaaagattttttttttttttttttttttggtaaaggcaggaactatgggtatttttattgactgataggagaaaagcagtctattgagccacactatactggttccaacagcagctgtagacaaatcattatccccatcactccactgcgtctgtctgctgtttagcttgtctttatctcttaaagctttttttgtttgtttgatttttgggttttttttgttttgttttttcaagacagggtttctctgtgtagccctggctgtcc

SEQ ID NO: 20481 - DNA, 1134 bp, Mus musculus
tctttctttctttttttttcctcttttcctttttttcttttgagacacggtttcactatgtagcccaggctggcctggaacttatgtgtagaccaggctagccttccattcccagcaacactttttctgtcctgtctctgcctcctgagagctgggattatagatggacgttgtcatgctcagctgagaagttcattttctaagagcagtgactccaagccaggcctcatggtgatgggtctttaatcccagtatacccatttaatctcaatacttgggaggcagaagcaggtagatctctgaatttgaggctagtttggtcaaaccctgtcttgagaaagaaaaacaacaacagctctcggttttagcgccatcttccttgagactcctgagccataagagcgaagtggcagaagaagataatgtgcaggctgaagcgcaagagaagataaggcagtggtccaagttagccagccggtgcagccacgacgcctgcaggagcagaagtgagggatgctgagggccgggacgccgggacaagctatcggactgtgtgctgccattggtaatgagtctcagtagaactggaatgtcacctcgccacgatcgcctggagaaatgacctcctttcttataaccaaaacagtcccgctggccctctgccctggacccccggcactctggactagctctgttctcttgtggctaagtgtagctcgtgtacaataaaccctcttgcagtcagctgaaaaaaaaaaaaggaaaagaaaaagaaaaacaacaacaacaacaatagcgacagcagcagcagcagcagcaatcagaacaacagcaacagagcagagaatcagtaaagccacaatcttgacgttaaccagagagctcactgaagaattaagagccctggacaggaggtcaagtccacagagaagacacagtttttttattttcctaagacagggtttctctgtgtagccctggctgctctggaactctctttgtagaccaggctggcctcgaactcagaaatctgtctgcctctgcctcccaagtgctgggattaaaggcgtgcgccaccacgccgggccttattttggttttttcaagacagggtttctctgtgtaatcttggct

SEQ ID NO: 20482 - DNA, 1190 bp, Mus musculus
tttttacacttctagaaagaatgaaatttctctagtttgtagaagtagaaacagactctaggagaagttaaaatactctttcttttcttcttgttttattttttttttagatttatttattttatatatgagtaaactgtagctgtcttcagacacaccagaagagggcatcggatcccattacagctggttgtgagccaccttctaggtgctgggaattgaactcaggacccctgtaagagcagtcaatgctcctaaccactgagccatctctccagccgccccccccccttcttgttttttcttcctttttttcctcaacataacaaaagatatctcaatagtgcaacacttagttcctggtacttgcacaagtgtaacaaagttttctctatgtgcaagtctacttgattagtccaccttgtatgaccacaagatgatgttgtctaagtctttcaatggtttcttaattttcttctctcctcacagctggtatatttgatccctatgttccaccagagggtgatgctcgaatgtcatctctttcaaaggaaggattgacgcagagaactgagcgattgagaaagaatgcggcatcacagctggcgtacgtgtccgagataattaggcttcaatattctgggctgagaagaacatgcaatatttaattctttttttttttaattgggtattttcctcatttacatttccaatgctatcccaaaagtcccccatgccctcccccgagatatttaattcttattgtgttctatggtatatcatattgattttcctctctccatctttttttttttcaagttcacttttcatttatttatttattcaagggggtgtgaacagggcattagcctaccaaagagcaactttgtgaagttagttctctcattccaccacacaaacttcagggatcaaattcaggcttagtggcataaacttttacctacaaagtcattaccaggcccaagttcatttttcaaaaacaaccctttatacaaacaagtagtgggaagtgatctagctaatctctcagttcatcatgtcctaggaattcccccaatgcactatgcctcattcatttgaatgcagccagttgtggggaactccctacctctccaggatctaaagagattcaaatcatgttctccagtgaaaactgtaaccagcttcac

SEQ ID NO: 20483 - DNA, 3867 bp, Mus musculus
atgttcattcttgcaacccggacatttcctgagtcagaccctgttgcctttcctcactgggaacctgtcagatgctagtttgcctttcagatggatgtggagggagggaagaacttcggtgcttgagtagtctttgtgtcacataagtttgctgtcctacagaactactcaagatggacagtggggttgttgggttcattactcttaaccctgtagtatttcatgtgatggccttttgagttccccctgcttgtgtctgcctcaggtgacaaagtaaatatcgtcagtcttgggtttcctgatggtggggtgaagccctgtgtctaggtaacttagagaactgtcttatctggaaagtggcctgtgggttccctctgtgcgtggagtcaccttcctcctccttgaactaaacacagagatgtgttttctcagccgactataaagaacggagccccaaaaggaacagttatgtgtcagtccatttcactgttaacatagctcatggtcatcctaaggtcaggattcagagactggcgtacctgtcagctctgcctctggagggtgcaggccacttgccatcttgtagaaagggccgtgtgtaatggagtccaacgtccagagtcatagaggtcttcacgggattaatatttgcagtccagagatcgtttctcccatttcagccacccatgatataaaaattccctttcagccgtgtttgcattgcttgcatggctgtgagctaggtagtgtggacggatgtgaggtagaagacaagacccctgccctgagggaactggaaagtaactgttgctcaggaaggaattggaacactactcagtgttgcataaaatcaaggaccatctttaaagatcgagtgggcatgatcagggtagaccagatggtctgggaaagctctggtgataaggcttgtaggtgagggcgctgtgacagagactcaagctaaagtacagagcagaaatgtgtggcaaggtcaacagcatcagagtcctactggaccgcagtctttggacaggtctgaaggctagggagaatgagagtgtgatggaagacaaagccagcgtcagcagacacctctggtcctggggtcacccatggagaatttctatactcaggtgcaagccagacctgctccagagcatggcagcctcaccctttctgtcctgggaacttgtgttgtgctgttcttaggagcttcggtgttccagtcacaactggcctgacccttcctcagcaggatgggccacaaaacagcagtgtgggagacagctctaggaggaggcatggcctggccccaggaggccttgttagaagggagtgagcagttgagcctgttgactggggaagggagggagcgaggcgagagggcatggatgggtcttcatctttcgcagatggtggggcagtgctaatggaagtgcagtctgcaggaggaactcaacttgtctttggtggttatgtgccagtcacaaactgggaaaggcagtcacttttagagactaaaactgctgcagttttctaagttgtggttgggggtgtcgctactcctagatgcagcctatgtaaccttcactcgtttataactgatctactgtaaccttcctcaaacgggtatgttattgtaagctagtgacaactactgctgcaagttgtagttacttgaaacgtgtgtctgtgctggtagtgcaggcatgggggaacaggagcttggctgtggatccacctgtcctgacttgatcgtggttgtgcaccaagtgacatacatgtgcatagaaaggtttggaagtgtctcagctcctgtctctccttgtcccactgtcacttggactaagcctctgaggccaagcagggtgtggtgggatggctacacatgccctgtgatgcatgtcccctgaggactaggaaatggtacagccctagaagagccccagggagccaccctttcagccttgcctcatgtctctaggagggcatggcctgcttgaagctccaatcccatgggaagtagggacaggaaaagcttccctgggtaggagcttccttcccttccttgttgcttttctcttacctttgagcccaggagtgagaggccaagtcggcgagatggaaagagccgttcacaggtctagagttttgcgtaagcgagcgagaaagcgccctcatttgtccaagtcttgtctgcagttggggtgttaggaacatctccactggcggggactagggttcgctttccactctgatgagagaatggcatgcccacgtgtggaggggatgagctctgagttagacattttccctatgggaatcctcttggtttggtttgtggggcgaggggagtggatatgtggtttttatttgtagtcatcaacacagctgtccttacactgaacctgtgctattgcatacatgtagccatctttcttttcactgcagcagtgtttatcggtagttcaaaacgatttatttgctcctggggagtaaaaaccttttttattaaaaaagaaaaaagaaaaaaaaaaagaaagaaagaaaagaaagaaaggtgtgccccattatgatagctgtagaattgttgggccacaagagtcacgtctgcaagtcccctgtggtccatctgttttggcactggagccctcgtgctcagtacagtgtgacaggggcccttccttggaaacgtggagaacattttgggagtgaggttgggttgaatcactgagagggctctggggacagaactgcagttgaaaatagaatactgattctgtaatctgccagagaaaggacctttctttacatacagatttcatgtgtccttgatctttcattgcttcctggtgtcctggataggggtcacctagtttcttctggtgtccctcttgtctttcctgtcctttgtcctgtcccttcccacttcatctacctcccagaaagcccaccctgcatgctgtttgtgacatgctttcactcatcccatcttcagagggttttagagggtccctggagtcgctccctgccccactgacccctcctcatagtgccaagaggcagcaaggagcagacaagcagccaggcagacagcaacattgaatcgcagctggactgtgacggcagctgctcctggagacagatagggaaaacaaggcattcttcagcccacttgctgtgctctgtgggcagtgggctgatgccaccactcctccatccctggtgctcccaagagggacgggcaagagccaggcaccgctctgggcaggccagacatgaggatgcctgcacaggtgctgcactggtgctgcatagcacaggcactgaccgctgtgcattctggtgggttttcagaaactccgtgctgaggggtgtcattctggactcagtggttggagtttttttcaccaccggggagctgtacccccataaccactctgtcctgcttagccacccctgccctccaagccaaagcgtggcctggcttttgtcttcccatttagtttccctactttattctcccttttttgtgcttaatttattaaaatagttgctgtataatttattttcataaagtataaaaaaataactaaatggttaaaatagacttgcaggccaatcttaaatgggggtgggtctggggtgggatggggagagggaaagatgttttgatataaacaaaacaaatgcactttgggtgtgttttggtatttttctgggcatagaggggtgggtgttgggatgtccctgtagattagttccagagtggggtgtctgtaaatactgtactaataggcatgtgtgactcttgtaaagggacattagtagctgctgcaggtcctgtttggaaactgtgtgtataat

SEQ ID NO: 20484 - DNA, 1211 bp, Mus musculus
atcactggtgtgtcactgtggtctgagaaggagagcccaggtagggaagaccttttgagtcacctggtgccagctgtctggagcagcccagggtcccctgcttcgctgccgatgtgatgcatgtcagtggagggggtgggagcttcagcctgcctggcctgcttgtcaacttggcctgttagggcatgtcagaaggggcctctgctcgatcgaagctgggaactgagctgtgaatggggctaaagggtggaggaggcccaggaggcactgccctgaagggaggagactaggccagggggcaggcattgtctgtcacatgctcccatggctaccttagccctacctctggatttgtcactgtgtgtgaggttgtgggtggctacgggtctgtgtttgatggtgtgagagaccagatggataattctcgggggtgggggtgggggctcctattggtcacctgcggttcggggacctaaggtctcggaggaggtgctgagcaagcagaggaaggaagagcgggcgggcctgaccttgagccctgtgactctggcttcctgagctcaggctcagcagtgtatctatcagcttccctccttctgtccctgaccctcgggctctgggcagctctcctccctgcccctggttcctggtgactctgcagacttcttttcctctgctttcaaccctcgtctcctggagggctagcctgggacagcccattacccattactgctcttctttgaagtccaggcccctgacagcatgtcaggattcccctttgggtgtgaggactgcctgacccgtgtcaatgagagcagctggctgggccagagtctggagctgggggacgctggaggcactcctgacacaagggccctgctggcagggactgtgcgtgccttagatttccaaggggtctcaccctggcccatggcaccactccacatgtggtagttgaatggataacccagaaggtaatgtcgagggatctagggggaggggggtcaggccctgggatgcagtcctggtatcacaggggtgaagccttctctttctccatccttgtctttaagggggttgaggtaggagggtggaggtagacgtggcggtgcatgcttttctttccagcacccagggggcagaggcaggtggatctctgtgaatccaaggctagcctagtctacagagttagttcaaagcctcacctcctc

SEQ ID NO: 20485 - DNA, 1147 bp, Mus musculus
agagaggaggagagagagaggaggtgctggccttggtaagcaggattcctgccagggtatctgaaaagagggtggcccagcgggccctgccagcttggcatgttcttgtttgctcctgtgagagatgcctgttccctgtaccccctcctcacttggcctgagggaacatggctctagaggtgtgtccatagattcgaactccaaacaccacccttcaacacatcccacggccagaggtaccacttggtacatatcaggacgctcaatcctgcatagccctgtacaactcagctccatagaagacacagcattgccgggcaggactcacagagcctctccctgtctctgtgccagtgtaccgcagtacccaggtagcacacagtgggacctcacagcagcctcacttgcacctctgtcttgtagcacaaactctgtacacatctggattctgtgctgttgtgacataagcatacactggtgtgttatcgcaatgctgcccacaaatgtcaccgcatgccacagcccctttcaggcatctatgcttagtgatatcatagaatcccaaattcatccacgtgagatacaaagtctgaacttgtcacaaccagtgtctcagcacaccgagaacataaaaccctttgggagggtgctacccaaaggcctgccccacatgtgttgtgtgaagcaagcccagagccttgtgtctggagcctgaaacagtcccccttgcctagtgccctgttcttggtctcttggctccaactcagatgccagcttgcttgcctcttcggtcactgcccctcagaggatggctaagggccaagcccagaggctcggagctgctgtgctggctttggctgtgtcactgtaatgacagggccacacttggcatgatgcctccccggggaacctccattcctgacctcagttgtccccttgcacttcctggagttgagagggaaagaatggaggctcagagaggtgcacggctcacccagagtcttaaagagctgcctgtgctccagttatgagagaggaacagggcatggcaccctgcctcagtccagctgtcaggggcaaggggcagcaagggcagcagccttgaactctgccagacctagacccaagtaggctggcatccccagat

SEQ ID NO: 20486 - DNA, 1903 bp, Mus musculus
tgggccccagctcacatcaccctatagtgaagggaccttggcctcttccagcctccgcctaccctcagaccacccctccttggacacacccactccgtagccagctttctaaggtcctctaaccaccttgacagatttctgcccattgcccccactgaactgcagccaggagctgtgggcatcattggacataaaggaactgtaggcaggggagggcagggtggaggagggcaggatgggggagggccctagcaaacagatgttggaatgtttgtggctaaaggctgtccttgttttaaaagtcttacagaaatctggctattttgagagagagagagagagagagagagagaatgaatcttatctctttgtcctccctcaggactctccttggagcacaccctcatccattcaggatgcccctacttaatcagctcccttgcatttccttgtgagaacctgggtaccctagggctgatgcctgtcatctgagtccggtctgctcatgcttttatgcctctgtgtttccggccaggcctactcccaggatgcctacctaaagggcaacgagccgtattctggagaggcccgcagcatcccagaaccacctccactctgctacccacggaagacctatgctccaccaaccagggcccctgcctgggctactatggtgcctgagcccatctcagcactacccccagatccccggagtcctgctgcctggagtgacccagggtcccgtgtcccatctgccacccgtgcccacctggacaactcttccttggggatgagccagccccgcccaagccctggtgcctttccccacctcccttcagagtcccggacaccccgtgccttcccagagcctggcagccgggtgcttcccagcagactggagtgccagcaggctctgtcacactggctgtccaatcagataccccgcagagcgggggagagacggtgcccagccatgccaccccgggcccgcagtgcctcccaggaccggttggaggatgtgactacccaccacccatggccctgctccacctcccaggatgccttgagccagctgggccaggagggttggcaccgagctcgctcagacgattacctgagccgggctacccgctctgctgaagcactgggtccaggagcactggtgtcccctcgtcttgaacgctgtggttgggcttcccagcgcccatctgcccgcacctctgcttgcccttctcgggacttgacccaggcccctcccccatctggcctgcagggcctggatgacatcgggtacattggatatcggagctatagcccatcattccagcgccggactggtctcttgcacgccctctccttccgggactcaccctttgggggacttcccaccttcagcttggcccagtctcctgcatcattcccaccagaggcctccgaaccacctagggtcgtccggccagatcctagcacccgagccctagagcctcccgcagaggatcatcgtgatgaggtggtcctgaggcagaagcctccaacgggtcgcaaggtccagctgaccccagcaaggcagatgaaccttggatttggtgatgagtccccagaacccgaggccagaggggaacgcctggggaggaaggtagcccctctggccactacggaagactcgctggcttctattccctttattggtgagtggtgttacaagtggctggctaagggtcccatctccctgtctactgtgccagagtctgcgccatgtgccaataggggcatctgggttctgtctctatctgttcgtccatttgtccattcctcaataattgcttctttcctcctgttttccattccttcattcttgtagccatctttccgtccacgcttcttcgtctccctccctccctct

SEQ ID NO: 20487 - DNA, 1329 bp, Mus musculus
gcagaaggttgggggtggggtgtgaagggcggcgctggtgtggcaggctggagttaggtgaggtgggcagagaaatcaaagccagaccgaagtgggagtcctcaggagaggggaggggctattgggagtcatgtcccttggatgaagaaccgagtagcccttttctgtgagtctacttagggacccttggtgacccatgcagtgtgggtggaccgcccaagtttcatacagaaggaaaaatacaggctggatttagggtctgtcctctgcctccccccccaatagctcctagccagggagagagggaggatgaatgtctgaggagcggttatgtggggttgggtgtccatgggagagggggcatgtgtgtgtgtgtgtgtgtgagagtgtgtatgtgtgtgtgtgtgtagtcacagtgcaaaggtgtttgttaccagtagctatttctaccccaattcttttattttccccgccaggaccctgcctttggtgcacacaggcaccttagccccaagtttgtcagaggctgggttgaggccacttccacagaggcaggactgaaccccactactaccggagtcgctcctcacatcctttgccgacctctaagtcacccctctaagctctctgacctgtggatctgtctggatccccttacagctggcatcttcctcctccatgttcaccctgcatccttcggcagcttagcatgcggactcgccttcagtcgggaggaactctgtccggcactgatgtatagagtctcagctgggctgttcttgcagggtgggtgggaccagcttctcttcccacacattgtaaatagacctaaagcactagtccccctctgccctcactcattccaggggagccccagtggggtgacctgctctgctgcccaggtctgtcagtctttcgggtttatgcaaagatttgctgtaaagtctctcccccctccctttcactgtaaatattgtctctaatgtgtaacatattataaagaatttataaggatttttaaagatgttttgctcattttaaaaagtgttgtaacagtgttggataaagccccccacatctgcatggctcctcccactgtgtccttgacacacctctctaggctataactaagattcctgcttctgaaagtcttgtcttaaaagtacagtctatatcttggaaataaatggccttcctcaggcatgaaccagtgtctcgcttgtttggatggggagaagaacagagcagcgctgggaggagctatctgagggatgtgtctcggcaagcagggtagccaggcggagtggcaggatgcagggaaccacttct

SEQ ID NO: 20488 - DNA, 1157 bp, Mus musculus
ctggtatcaacatgattgtgtgaggagagccttgggagtaaggacgtgtgtgatgtgtgtggacacgcctggctgttcacgtgaggaccacatagggatgggtttagataacgtcagctgtgggtatggttgtatgcaggtgcaggcaggcgtgtgagagggtctctgtgtgtgagagtactcgtgtgcatgtgtgtgttccatcatccctgcaccactcgcccggcacccctcccaagctccccaccccacctgtcttctcaaagcccacagcacgtcaatccccgcccccacccccagctgcatgcgcctcgccgctatccatcagtgtgtgcttgacaagagaaactgccacatcgggggaccctgtacctggtcccctcacccctgcccgctgtgctgtgatactcgcatggggggttctctctggccccttccacaatatactcttttccccaggggcctcgggcaaaggctctgagtgaggtcccaagtggggccccccaaggccagcccggctccacacccacccgtccaccctgtagggcctgtgttggtgtagaagtgatggcgtctgtggatattgtgacctctgtcagtgtaaattgacgatttctaaatggaaagggttgctgtgttttctgtctcctttttaatgtcctttctctcttccccacctccccgctctcttcccgtcccttttggtttttctagccgagtgttggggctttaataaaacttgtttcttttttctctcctggatcttcttcctgtgggctgtgcctcgttatttcactggggcatggaaggaagtggggtgaagagcagaggggtggggactctgaagccagcatgccctgagttagagggcatggcacagagaagggacagacagggcaggaagcacttgattcctgctaccatggggaaggacactgcaagcgccttttttttttttttttttttttaattttgagacagggtttctctgtgtagccctggctgtcctggaactggctctgtagaccaggctggccttggctcagagatccactaccttcctctacattcccggtgtgggattagaggcatgtgttaccatgcccagctaactccactaattccaaagagtcagcttcaggctggatgtcacagaa

SEQ ID NO: 20489 - DNA, 1195 bp, Mus musculus
agagcacccaagacactggtgagattgggcaagtggggtctagggagaatatagaactagggtgtttttggagatgggagtctgagacaaggtgccctagttaattgtgcaccccacagctcacctaccttccgaattgtccactcaagatttctctaaggggcctttagatactgtaagccttctctcccagcctctcctttcctcttcttcctgttcccatcaaggacgggctgaggggttgcctttctggtgtctgccagtttactcccatgcaggagtactgatgggcaaggggcccaggatagactggaagaggaaagaacagagcctagttaggggaaagagtggggtgctggcttctcaagcaaggagaaagaagccgctttcgtgacctgctccatgggcttttcgggctgtcttctgctcagagagaaatggtttacgcgtcgcgggagtcgtcgcccacgcggcgcctcaacaacctgtcgcccgcatcgcacctagcatctagctccccgcctccagggctgccatcggggctgccttcgggactgccatcgggctcgccttcgcgttcacgcctctcctatgctgggggccggccgccctcttacgccggcagcccggtgcaccacgcggctgagcgactgggaggcgccccgaccggccagggcgtgagccccagccccagcgccatcctggagcggcgcgacgtgaagccagatgaggacctggcgggcaaggctggcggcatggtgctggtgaagggcgagggcctctatgccgatccctacgggctgctgcacgagggccgtctgagcctggccgccgcggcgggagacccattcgcatacccgggcgcgggcggcttgtacaagcggggttccgtgcgctctctcagcacctactccgctgccgcgctgcagtccgacctggaggactcgctgtacaaggcgggcgctggcggcccgctctacggagacggctatggcttccgtctgccgccctcgtccccgcagaagctggccgacgtctcggcgccctccgggggacctccacccccgcacagcccctactccgggccacccagccgcggctcgccggtgcgccagtccttccgcaaagattcgggctcctcgtcggtctttgctgagagtcctggaggcaaggcccgcagcaccgggagtgcctc

SEQ ID NO: 20490 - DNA, 3338 bp, Mus musculus
aagctcttaagccaccgacgctcggcttcatctttttcctctacgttggttttgagtttgtctctctgaattcacggagcaccattttcttccaaagggctgaaacaaactttcccattttacagatgcggaaaaaccgcgacttctactgggtaaacaagtgactggacctgcgaccagctaaaacgatcccaggccatcaacaggccaccaggagccgtgcgtctggcccctcgcacttccacccgcgcgcgcctagatccacgcgtccctgctctccgccctccagcccagcagctccgggtccacgtgtgtgtgtctgtgtgcggaatggggacgggggccgtgccgccagaggggtggggtctacgtgacgtcagagcagcagcgcccaatcagaggcgggctcgcagccgcggcgctggtattggggcagcgagggggcagttctctataacgcggtctccggagccagcggggaagaaagaagctgagagggcggaaggcgccctccccgccgctgggcccgggcaccgggcgccgggccggggtccttcccgccggcggcgagcgccggctgctttgtttgcccccgcctcggcgttgaggggtgatcgtgccgggcattgcgccgggaacgcggcggcaggaagcgcgaccgatcgcaccggggacgcgcggggacccaggagtccggccgcggcgagggccgcgtgacgataccgaggagagagccggagcgccgccgcgggctcttggtggtgggccccggacgcccgtgagcacagacctccccgtcgacggggggcgatgttcccctggcccgcaggctcttcgggccgccggggtatcccgccgttgggaccagggcccccgcagtgggcgacccccaaggctgctccatggagactctgtgtcctcctccccgcctggcagtgcccgcttccccgcgggggtctccctgctcgcctacgcccctgaagccgcgtcgggggaccccagagttctccccactgtgcctgcgtgccctcgccttctgcgcccttgccaaaccccggccgtcctccctgggcctggggcctggagagctggcgccgcggaccccggtgctgctgggccccccggcctcgccatgcacaggaggctgggccgcggacggcctgaagcacctcgggggacaggccgggcggccgagcgacgtgagctccccggcccgcgaggatgcagacgtcgcggtgtgcccaggcggtggagaggaggaagagggcggaggcggcttcccgcacttcggcgctggttcctgcgcacctccgggccgctgccctgctcccctgcgtcctcaggactctccgaccaaccccgcctggtccccgcccaggccagcccggggtcttgatgcagctagcagtccgccccttgagcccggctccccgcctccgtcgccacctgcgggcctctccccggagcctgcgccttccgagcagcctgtgccggcctccgaggctccagggggtggagaccctgcgccgaccgcgcctgaggcacccgcgctcagcccctcgacggcagacgcagcaccggacccgccccgcgatctccgccaggaacatttcaaccgcctgatccgccgctcgaaactttggtgttacgcgaaggggttcgccctggacactccaagtttgcgccgagggcccgaacggcccgcggccaaagcccgtggagcagccaagaaacgacggcggccagcgccgcccccgcccagtgtgcagccacggcggcccgtcccgacgcttcctacatcgagcaccttcagcctccttgactgcttcccctgtcccccagctctggtggtggaagagaacggagacctagggccggcttcctcgcttcgcctccagggagacgccaagccgccgcctgcccacccgctgtggaagtggcagatgggaggacccgctgtccctgagcccccgggtctcaaatcctggtgggtcaacttggaagaactatgagcgtcggacctcttctacccgggggcaagttgggttccccggacagactgagggctccaggagggagcatcgattctgaaatttggctgatctttgctttgcattttatgggctgtggcccgcgggacctcaaatgacagtgatcttcaagcacccgagaggtccggctgatgctctttctactcatctttgtggaagatccaaggactggcgtccgggaaagcctgcagaaagcttagtgaccatctccgtcctccctgcgggcgggcagagccttcaccgcaggggagcacagcggctaaggcccgaagaccaaaagaaagggacagagggacggaccttggtgatggacaaaccggttgtttccatgtttgaatgagggtcagtttagcggtgtgggggctgtggttggggtttgaaggtgattgacagctccctgggggcatcccccaccccccactgcccagacctttaaccctttacacctccctcttttctctccgtagtcctccccctccccaagttcaggtgattttcccttgtcaagatcttcagtcccagccagcagactttacccttttgtccagttttggagtttccctttgccggaaggttggatgaaggaaagagacctccagcctcagcgttctcctcacattctgagaggaaaggaggaagagggccatgctgtgtggcccaaggctggctttgcccggggaaggagccaaaaactcccggggaaaatgatggaagatggaataaatcaataaaatcagaccaaacaagtctttcgaggtccttgcctccgatttatgaatgggatgggggcgggtgggtaggtagaaggctaatttgaaagcatactaaagacacccaacacgggtgggtacaaaacagactggaggaaggcaagtgaaagcggtctctggggcgtggagggaacctgtgctgggcgagctaccttaaacctttcttggcctcaggcatttagggagttgacagggatctgatggatcagaagggggcagggcctgggggattaggtttggggtcagaggttctgttttccggactgagaggagctaggcctggaccacgccccagtcaggactgactcctttagtcagaagggtggagtggctttctctacaccgagtgatcaggttcagggtaggtgagttatgctgcgagcacgtgcttttgagagctgccggctactgagggctctaatggcccttgtgtctacctgatgcaagtgttcccacgtgacactgggaaggacgtgtgtttgtgtgtttctctctcttttttttttttggtgaccat

SEQ ID NO: 20491 - DNA, 1125 bp, Mus musculus
aaaggaccatgggaaggagtcagagtcctaccatatggactctagagatcacactcatgtcacgcttgcatggtcagcctgactgacacagggtctggaactcaccacctaggctaggctgcccagccagagagccccagggccctaccttcttctctccagtgctgggattgcaggtacttgctgccatgaccagctttgttgtttcaagactttaaaaaaaaatagttctgggtatatctgtgcgtgtgcatttgggtgcctaaggagctgtgagccactcgatagggctacgggcagctgaactcaggacctttggaagagcagccagtgcttttaaccactgagccatctctccagccctgccaggtctcacttttatttcctaaatacagtttctagggatcatatcaagttcaggtcttcatgcttagtggcaagcacttaataactgcctccttggctcaaacatcctcttttataaaggtgcctacttctttgagccagggtcttgctttgtatccccagcttgcttgaaactcctagtgtagactaccctgtctggaacttcctgccattctcctccctctgccttctgcattctgtctggaattgtaggtaaccattgctgtgctcagctctcttaaaatcaaatttagtattgtacaatttatatgtaattgaacatactttattttgaaatggcagaaaacacacgcaggacctcttgtattagattttttttctctaccactgagcacaccctcactctcttgaaattcactgacttaaattttatttatttatgtgtgctatgctggagattgaagccaaggtcttggcgtactagagcttctactattgagtcacactttccatgtcccagaaatgggcacacaggacattgtaacagtacaggtgttaggcatggtggtgtagcttgtaatcctagaactcatgaggcagaagcaagaggattcacaagtctgtgggcatccaaagctacacagcaagatgctattagaaaaaaacaagccagtcatagcagaattggagcacacctttaatcccagcactcgggaggcagagacaggtggatctgtgtgagtttgaggccatccaggt

SEQ ID NO: 20492 - DNA, 1179 bp, Mus musculus
ggactgacaatggaggtgaggggaaccctgaacgcctgctgaggtcagccaggccccccagcaggtgtggggtggaggctggctttccctgctcctgttggtacaggaaggttgtagacgcaggggacagtctacagcttggtgttgggaggcgtggggtcttgtgttgccgtcctgctgaggccagtccccacactgccccaggctgggcccatgtggtgtgcgccctctacatcccggaggtgcagttcgccaacgtgctcacgatggagcccatcgttctgcagtacgtgcctcatgatcgcttcaacaaggttagcggccctcactcctccctttcctggtagcaatcctgggtgccaccgttgcgctccgagctccctcggtagcacagccagagggttgctcataggtcacattttattaagtttataacacatgacaggcacagtacagcaggtacctagtgcttgccgttaatcaagacagaagtgtaaacaggctttgagatagaggataccctgtgaggcttgcttgggtatctggtggtcatggaaggagacatttaggttgggatctggggcatgagaaagaaccgactttgtggaaggctggccagtcccaggttctatgaaaaagacacagtgtgtctgtatgtagtccagcaagtgggacagtaggtacatcggggcctctcaaactttaccaaggattgcactgtctaacgcagtggctgactgcctgtgaatgtggaaattaaattgaatactcgggctgcagagatggcttggtggttaagagcacttgctgctctagcagagaatccaggtttggttcctggcgccctcatgacagctcaaaaccatgtttacatccaattccagggaatcagtctggtgccctcttctggccattaagggcaccagatatccactgtgatatacgtatatatgtacgtgtatacatacgtatggccaagtacacatctaagataagaagagataaacctttaaattgaatacttagacctcattttctcagcctcatcaagctgcatttcaagtgcttggtggtcctgtgacattgcgtttactggcttagattgtataggttagagaacctttccgtccctgtagaaaattctactggacagtactgatctggatggtgggggtcagg

SEQ ID NO: 20493 - DNA, 1149 bp, Mus musculus
aggtgtgtaggggaggctccctggtgtggggacttcctagctgtatgttggctgaccaaagtcaggctgcccgatggagggttcacatgtagggccaggtatccagcaggagcttgcagtggtcagaggtgggctgtagccaggtggcttgtgaatgtaaccaccgaagcgtccaaggccagcagcagccttcaggccggagtcattgactacggatgcctcggacaaagaggcccgtgcagattgtggactggtctctctgttgggtcatgggacaaacatgggtttagggcattccctagacttccgtagctgcctccccgtgtctgtgttctagagcttccttcccacagctctgagtcctgcaggacggactcccagttcaggttgtgcaccctcccgagtcaggctgagccggtctgtgcagctgacataaacctctcttgtctctgtcttaggtctcctcagcgacttcttcctcccaccatgaggccagcactcaggagacctctgagagtagcagggactcaaaggggagaaagtcttccagccatagcctgagtcataaggacaagaaactgggcactgggaaaggtgtgagcagtttcacctccgcttcctcctcttcctcctcctcttcctcttcctcctcttcctcctctgggggcccttttcagcctgcaggtgagtacgggtgtcctagaggaggcagagagcgggagccccttgacccgtgccgtgtggcaagggtctgtgcctggtggtttcccgacatctctcctttgttttttttataagtgctgtgggggtgacaaggcagggaacccctcccccagctggattctccaccctcttttagatttatttatatatcatatgggtgctttgtctgcacagcagaagagggaatcagaccctgttataggtggttgtgttggaacccgttactgatggctgtgggccggaacgtgagttctaggaattgatcggaagccctgtggaagggcagccagtgctgttttacactgttgcactgtttacactgttgcccagccccccccccccaaaccagagcccctttccttacaaggcccattctctaaccccacaatagtgtcccctacctttgtgtcaaaagggccatctgaa

SEQ ID NO: 20494 - DNA, 1156 bp, Mus musculus
tggcctcccgtacctttgggccttcaggaagcttgcccagcttgagcttagagtcatctctgctgggggcaggttagtgtccctgtcgctaaagaatggctccatgtacagccagtcgtgtcagcgggtaggggcataaagaagaaatacatgcatgtggaaactcccaacaggcagaacggaggtggccattatctctaagatgttcctttaaatgtctcctgcatgaagagtttggggtggacaccagcagaactcacagggttctgatagaggaataagaaaacctaagcatttcccagactggggcagagtagtagaatatgtagaaccccgggcatgctgtgttctctgaagaggggttgcttttaccgctgactggaggattctggggtagaaggtgaccttgggtttttctctgtctctttgtacctttaggcatctataccagtaataaggatcccatctctcatggtggagggatgctgcgggctgtctgcagcaccccactctcttccagcctgctggggcccacaggaacctcagccttgccgcgcctcagccggtcccccttcaccagcacccttgcatcctcttctgcttccatctccaccactcaggtgagaccctgctcctggctcctcttcctgggcaggatggggacagaagccctctgtggtccgtggcctgtgtcctcctgctcttccttgttccccaccacacagtacaactgtattcagctgtgcacgaggctctgtttgatcctcccaacaggtgttttctctggctggctcaaccttcagcctcccttcatcccacatctttggaacccccatgggcactgttaaccccctcctcacccaagcggagagcagccacacaggtatgctagtccctgctcctggtccccttctgaaggatgctcctgtagaaagcatgagagtcccctccctctgaatttacctcacatactataaaccatgaggcactttacgggaaaacctgtgcaggggcaggcgtggggtgccactccattgcacagagagacctcaaagcagtaatgatagagaatgaaatgacaaagccagttcagccaatcaggtcccagtccaatgtaaccccacccccaacacacacctcttgctacagcacacct

SEQ ID NO: 20495 - DNA, 3347 bp, Mus musculus
aaaggctaactccatctgcccctacctacccctacatggcttgagggtccttgtctggagtgggcaactgggcccagactctggaaagccaggcccagggcctgtgctgatccccagggagtgcatgcctggcgttccaggtgcacatggaggagagagactggagggagcccttcacctggcccacccctcactgcactggctgcttcagagggtcgggaggacaggctcctagcctgcctaggagaccccatcctccgcagatgcctaggggcccccaaagagcaaagtaggtctcagcatgagagatggagggttggttggacctaccacataaaccaatcagcacttgaatggggaaggtggaagaagggtggacccccaggcctatccctgtgtggaaatttcttacggagaaagggctgggcccacctgaccttccgtttcttcccagcagaagggatccatccctttgactgtttcttatcatcccttcccactgagggtcacaagctgagcttggaaaagcctacagatgtggggggctgaggaagggcaggacagcacttcttggggccccatgatggggctggctggggacgtcccgtgctgacctgggtgccctgcccctttttgcactattggcttgaggagtgccgagggtggggagagggggctgcctgactccacagattgtgagtgtgtgagtgtgtgtgtgagtgagagaaaaagagagagatggttagtctgtttaacctgtctgtctatctgtcatttcttcctctggacctggggcagccaagggcaaggacaggagcagtggccagtactggggcagtggccagtaccggggcagtggccagtaccagggcaggagctcctagctcttgcatcctctaccccctcaccaactctgctccttttccagggcatgaatggttaacttataaaaaacataaaacaaacaacagaccagtacctccagtattggagaattcctaggggctgggggctctgaatcagggtaataccctaccttccctcccctctaccccacctcagggcccctcagggcctcctcccccactgttagtttgatcagtcctggcacaagagagtaggggaggggtaaagtgccacttctttttagcaaaagtctccctctccgaagtagctagcctgcctcttgaatcctttcaccagctagtagagccacttaagctaacaaccaccccttaccccaccagctattttccagggtgtagtaataagtggcagagactttctgcccagggcggtaatgaaaaacgttgagtgggacacggagcaccgccaaggaggccttgtgtcccttttggttgcactggctgggactgagggtcagttccagtttcccttgctcatgtctgtgggtctctgcatgtgtgcattttggtgtgtttacgtttgagttttgttgttgggggttttttttgttgttgttgtttttttttttttttgcttgtttgttttggtttttttttttttttaataaagaaaaggtgtatatttttggcaaggacagaaacgtagtacagatatatttttgcctgtgctgctcaactgttgtccctcactcccaccccccatgatctgggaaatactattcctgttgataagacaggaataagataggataagataggatgggccgggacccttcagaggcaaccctttgacacttggaaggactttgggggacagttgagatgacctcagaaatacttttctaactgctattactagaaagacatcttcatctcttccgctcttgtagacctccttgtctacgagccagtgattcttcagattcgtctacgacctttttatccaggcccacacccttgccccacgcagagccaagtaccctgcattgtggcgcaggggtgctcggggctctggaactctgttctcagcagttccctgggctcctttccctgttctgggccaggcaggatgccctaacagagtcaggtcaggcttgcagaggcctctgggctggatggtttggtgttggctcctcttttttgggggtggggtggggtggggaggcgtttttcgagacagggttttctctgtgtagccctggctgacttagaactggctgtgtagaccaggctggcctcagactcagatctgcctgcctctgcctccagagtgctgggattagaggcgagctggtggtgctattccatatcctgagacatgaggagaggtgtggcctggtgccgcagcacagggagaattagggtccttgggagggaccagggttctgcaaaatggctctgatgacctcaccttttttttttttaaagacaaggtcccaagtgctggggttaaaggcgtgcgctaccacgcccggcacaaggtctactcttaatgtagctttggtcgtcctggaacttgctatgtagaccaggctggcctcagcctcctgagtgctgggattaaaggtgtgtgccactatgtctggctttggtccattttttttgataaagagcttggtagaaggagagaaaggatgcagatttggggccatctctatctgggagggggaggatgtggtttgcagagcggaagtggagtctcagaatgcatgagtggatcttaatgtcaccaccctaagtgagaagaggtgagcgggtgacagatgctgagcctgtgcccaccagggcaggggtggctgggtcatggctgatggatgctgatcagggggtcattggagctggctttacaggctactgctctaaacctaggagtgacgtgacctcagcaacagcagtgacaagcctttgtacctggccttctggtcataactgcctgactgtcaagccttttagctgcagctggttggctggctgtccctgtgtgtgtggtgagtgtggtggtgtgagtgtagtagggttgtgcccgtggcgggaaggtatctatgtagcactgactgtcttagctctgagctgacgaatcctccacagacaatgacactttaagggttgcctttaagagaagaaataaattgtatgtcccatccccctctccctcatcccccagcttgtgggtgtccctctcaagctcctgggtctactgctggtgatcccttcccttccttgtgtgaagacccagggagttcccaccctagactcctaggaagggcctagacaaatgagagcccaaagaggctaccagttccatttcctcttcccaccctggaaatgctgacctgttttcagagacacaggcccgccctgctagtctcagtcatcccaagagtgcagagggccaaagggagtaacagactgctggtgcct

SEQ ID NO: 20496 - DNA, 1195 bp, Mus musculus
ctgccgctgggaccaccacagctaccaatgggggcacttcgaactgcctgcaaacgccatcctccaccagcagggggcgcaagatgactgttaatggcgctccttgccccccttgaggaaagggaccctctccttccgcagccatcttttccctcctttttactttttctgggcccccttttccacttttgactttccctggttcctcccattttcagagtgggaggtgggttttataaataaatctatatatatataaatatatatatgtacataggaaaaaccaaatatacatacttattttctatggaccaaccagattaatttaaatgccacaggaaactcgtgtgtgtgtgtgtgtgtgtgtgtatgtgtgtgtatgggtgggggtgtctaggtctagggggtctttgtagttcactctgctcttcttggggggtgtatctggtggtcttaaggggccattggaagtattaatgtccttccctatgtcccttctgctttccagggcagagggcgtgttgggtcccctagccctagctgactagtgggtccatcttggctgttccccatacctgtccaaacccccacccccacccccccgttgttgaatgttcagagttgctgagacagtcagtgcctttcacaaatgcagtctgtgtcctctggcagtgaggaccaagtggctgtgaagaaggcatttccctcacctcctcagacagtggaagccccccccccaaccctccatccctaccctcctgtgggagacctggccctataaagtctatatgtgactttggcatggtgaacacttcattttctcctgtcctaccccaacccaagaacgcaatctagcaagactggaggtgacactcactgggggcctagagtagagggtggccccagacaagcacagactccagttctgccaaaagccaacagccctccagtccactgcctcaccccccagctgaggccaggcagggataggacagaggcatctagaagcacaagaaaataaaagaatgagctgaccccaactctacctggtggaccacctattaggggcagaccttgctctcgcctgctcttcctcaagtgtacatagatttggggggagggtgggggggaaagaggacagggtgttggcttagtgtgtgaggttctgagcccatgggtctgtttgcaccacgtc

SEQ ID NO: 20497 - DNA, 1169 bp, Mus musculus
acatcccttgctgccctggaaagtagaccctggatcactgagatattgccaagaaaggactctgtgtgtgtgtgtgtgtgtgtgtgtgtgtggtgtggtgatgatggggagtcctggagccagaagctcactcctgggacagcatcagaaacctcactttttctgctatctctggctgaagtttgacacctgtggattcaggggtcactcatttgcactgtcagattggttacaagagatccaggactggtgaggtatcttaccccgctggctcaggggagcctaggacgtggtgcaccttctgtgttgggccggacaccaccctggctcatagagatagaggggcccatcctcccctaaggctaggcaaggtacaacagcccagatgtgtggatgcgtattgccatgttgggcctgtgcgctatcctgagctactgtgagctatcaagagctactgggtcatggtgggaagagagagctgagtgttagcctgggcaagaaggggctctgactgtcttctctttgtccacactccaagtctgcaaaacctgcatcgtacgctacttggagaccaacaaatactgccccatgtgtgacgtccaggtccataaaactcgaccactgctgagcatcaggtgggcttcagaccccataccctgcctcctcgtggctaaggaatgccaggccaggagcctgcatgcctgaatgctgggtctgaagaaggaaggggtacagagctgatccccggctagcgagatgaaggacccgtggttgctaatgctcctgtataatctttcccagatcagacaaaaccctccaggacattgtctacaagttggtgcctgggctttttaaaggtatcatgagcccctgtgttgtccctgctccccccacccccacttcccagctgtcgcccactcattcctgcctcctttctttagatgaaatgaaacggcgacgggacttctatgcagcataccccctgacagagggtgagtgtgtgttcactctgaacccacaagcacattctggttcctgaagcaacgtgactgcccagggctgccccagctttggcccacactgtccctccaacttccaacagatctcccagctacagtactgtccagtggggactgggctcaatctctgagctgccctacttccctagg

SEQ ID NO: 20498 - DNA, 1160 bp, Mus musculus
ggctttctggtggccgagggagggcgccctaactcctggggtcgggatcttgggcacctcccccagaggtccctttcgtcccggtgcgaggcgccccgccccctccctgaaccacctcggctgagcttttccctacctccctcccggggccccaccaaactttggctctagggagggaaggagtggccactcggtcactgggggtgcctgatcctttgacctaggcttcgcggggaagcaagggtggaggggaaagaacgggagtgaggagagatttagcatgctctgtcttttcatgagtggccaaggggtctgatgagctggcccttctgccacaggaggcgaaaagggaagcggctactcttttctccttgagctctgccgctgctagctctgaaacccggggaaccctgagcctgcagacgccccgcgcccttcctgactcccaggggcgtctaggcaagccccctactcttccatccctcacttcccgggtctatccaaaattgctgtggttgcttgatcgagaagggtgtgtgtatgtgtaaatttaaatatgtttaagtatgtacaggtgttacctagagctgtccctgcgtctttgtctctcgtagcccccggccgagctcccgccatcccccatgttgcctcagtctcttttggtcttcctctcgctgagggaggggcttctcttagctggctctcacagtcttgggcctccctctctggacttcttgcagttgtgctgttcccgaaactcatgacaaccccacccccacccccaacatacacacatccctgctccaaggtgttattactgtaatcggaggagcataaagccagctctgttgtagcattttggtggagaggttttcccaggggttcccctggtttgaggttggggcttgcacacttagaactgtgtttggaataaggcaggaaacagcctccaggatccagtccggctgtcgcgtcgcctgatcctgttcaagttgaaggcttgggaggtgagcaggggagggggaaaggaactccctgagtggttgatggagctgttgccatgggaatggagagaggctgaagtggaagaggttacatgttatacaggtcagatgcctactgtagcgcccccctacccccaccccggaccctatagcgga

SEQ ID NO: 20499 - DNA, 2140 bp, Mus musculus
agtctggtgagagtgtctgtagtgggagaatacgtgtggcgaaatgaggctggcgaaggggagggaaccttgaaaaccataccatgtttaaatgcttgccttccgtggatggaacctgagggaccccggctgcagctggtgtggcgagctggtcctgactgaggggtggttgggggcagccagagtcaaggtgcgaagtcagagtggagaattcaggagaaggcaggtttgaggggagggcttgtaaggttgggtgggcgtgtgggatggtctccggctgctgagaagtagggcagaacccagtggagtcttcactttacagagggagtggaggctctaacaggatataatgacacttacccaatgtcacactttcaggtttgaagtgttttctgtgtcctgtttcttcccaagtaaggagctgagaggttcctatagccaaggaaccgtctctcactgcagacggcagggcttagagcagggcagccagagtccaggacataagagggtggaggagccagaatgtgtcccggatctgatcgcttgactctgttggcaggatccagaacacctgtttgaaaccatttctcaggccatgctgaacgcggtggaccgggatgccgtgtcgggcatgggcgtcatcgtccacgtcatgtgagtatgggttgggagaactcaataaatactggacagatgcagtgtccccttccccacagcaccgctgaccctcctcgggtgtgagatcagagaagtgcccccgaagcagagcctggtgactgactgcagccaggtggcaggacacttgtattctcagcactggggaggctgaggctagggggttttgaattcaagattagtttgaggaagaaggaaggagagagcagacaataggcctgctttactaaggtaggcctcgggtgacactctgtgactgagtctcctgacggtggacatttctttccttccctaacagtgtccccaaagtttcaggggtgatgatgggcagcaacttcccgcagatagagtggcttagggctccccagcgtccctgcaccctccagtctgcagcccagaactctgtgtgtgtgtgtgtgtgtgtgtgtgtgtgtgtgtgtgtgtgtgtgtgtatgtgtgtctcacattccagtctctagccagacctgagctacctactgccctctccctgtttgaggctgtcatttcctcgtgggtcctgcttactgaccatgaaaagcagaattgagccatccaagggttttgtgtcttctgtagtgagaccaggtgcttattacacttgctctgtaggcctggggtctccgctctttggagggtgtctcagtcttccccaactatctgcagcaaagctccctgcccccgtctgtcctgctctcagaacaggctgtcaggtaacagactcttggtcgccagcagcctttcccttcacagctgaggctcagaggagaggcagacaggagagacagtagacgtgactctgtgacttttctctcttgacagtgagaaagacaagatcaccaccaggacgctgaaggcccggatggactaacctgtgctctggtcccatctcccttttgtttttctttttaataaaattgcctttctttcatgcctgcctgcctgcctttgtttctgcagctttgtccccatcagggagagtccagtacagagcgagcaactttatctcagttgtctttggtcccatcctacccccactccacccccttttgtggtgcagggaattgaacctgggccctccgacacactgagcacacattctctactgagctacatctcaaccctgtgtttccttttggacttgcccttgctgcgttggcacacctggggccccctactaggcaccagtggatgccctcgctacgctgggctgtgctgtgcagagcaggctgggctgctgtgcagagcgtgccttacctaacgtagaactcagtcattgtgagccaaggcagttaagagcagccttagatgaaaagcacccatacacgtgtctaaatccgcttgctaagtggtggtgtgcaaggagataagcccatgttccaattgtccccaaacctgggtccctctcattcagctcagctggcagtctcccagtcttccagtgcct

SEQ ID NO: 20500 - DNA, 2165 bp, Mus musculus
ggttaacggtgggatttggggggggggttatttcgtttcgttgtatattgtttacaattttgagaggtagctttctgtttcaagctctctgttttcctgacagtattgttgagtgggtcaaaatattcaagctgtggtttggtggattttaggtttgttgtttttttgttttgttttgttttgttttttaggtcattctctgcgccatcttcaaaaccctgaggtttgactttctgattccttggcattcattcgtgtgtttaaaagctatttatcttcatttcagacaagttttctttctctttgtgacaaagatgtgctatttggcttcaatctccacataaccccctccccccatttatctgctcccctcttcctgagtcccaccagtcacgctctgggcagcaggtgccaaggggaagacaagacccttagcttgactcctcagggccgtgaagaacagccagactgtcttatggcatccagaatcatgttgggtcttccagaaatagacatttaagaatagagtcctggacaactgggtgaggtctggatgcggggaaagggggggattccattcccaggcccttaccctcccgattactgtgtggcagccagtccccattccttctgtggaaactgtggaactgagaaaatatgtctcgcatccagctgacacaagggatactatgaacactctgacaccaagcagtggcctcaggccgtgttcccagtctgcagggcagcgccaggagtgcggttcagttccgctgcagtgctaaatccttatctagctcaggggttactggtctgtggctggcgccatgagtggcccccaggctgttctcagtggcactatagtcccccaccccacccccaggcagctgtccccctccttacccccctccccccaaaatcacttttctcagtcctgggctttaggcctgaacaggtcccctagcagtgctcaagggaggagagactggactcctgtcgagacttccccccttcaccatgtgccaggcctccctggggaggtggaccaaagacccaggactttctcagtagccagtcccccaccccaccccaccccaaccccagttgtctttttaacaattcaggttgagagggaaaaaccattagctgtttctagtgcttgaccgactcaagtatttcgggcagaaaggacagtgcaccgagacagccctcagagctctggccttgtggtttcccaagtttagagacctcaccagcagtaatggccggtggggtgggggtagggggtctcaaagggaaacacatttagacagctagccaaaatctgccagccgtggtcccagtcctctgaagtgtgccacttaggatgagtgtcaccaaggggaagtgagacgtagctgtccttcaggttgagtcaccaggaaagaggctgaggacacccgaagagcctgtcccttgcccacagccatttttcaaggtgggagcccatacatttagggggaccatctgcttagcacatctcagcggctggtcagaacattgcacacacgaaatgtgaatgaaatctagagtcatctttgggcccgcaggattaaagttctacccaccacatgtgacttgtccatttccggctgcaagctccatttttttaaaaataggaattttcacccctgtgcttgtctaatgtctgctctgaacagttcgagcctctgttactgttttaaaatgcatgcatgttaaaaaagaatctccaaatgggaggacaaaataaaactcgaaaagctttgtgtacatctggtatgtgagtcctttgagatgcaacccaccctccttcagaattagaatgtttttgtcccagttttagaggcaaaaatcagtatatggtttggagcagcagtgtggcagcagtccgttctgaggtgcaattgttgagcaatactgacctcacagcactgggcagcctgcccacaagataatattaccatgtgccacggccccctcctcccttcagctgtgcatagacagtgcctaggagccatgtatcccaactgcctgtgtagctttgaatacagcatccttgtgagccttcagctatccatctatatacttgtactttaaaggctagtacttgggctggacggtgtatctcagtggtacagcacttagca

SEQ ID NO: 20501 - DNA, 1634 bp, Mus musculus
gctcacaggatgcagccttacttcccgagcaccctcgatccgcctcttttgcccctggttaaaacagggtttcctcttcggtatctccgtaacctatgatacccgggagctggagttgactttgtgggtttctttgggtttgtttcttcaattcactgctccaggattgctctttctaatgctgtatgtcatcaccctcggggccctccctcttcctgtcaggctctcagttcccttcagttcaggccagcacaagggacgagaagagcagttgctcagacacctcagtcagccacggtttgttctcacctagatggactcttttatttcctggagtattgtgcatcacccctccccccctcatgcttccaccttggagccaagtgaaaccttggctccctcaccccatcctcacagaagaacatggcaggttgaccctgacgccttggaccggagtcagaggcctcagaggggaacaggttcgtcttcatgagacggtgaatgaccaggaagcagccctcagacagccggttctcaaagaacccagagatcaccaccccggccacctgcgcctctgagtggaattctgatgtctgtcaaggccgccacccaccggctccagaggaactatcaagcatcgtggcatttattggggcccctgtgtttcgatgactgtttccctttgggaaaatcccagaaactaagatgtgtaaaccgggcccgtatgcaccctccatatcctaactactgacctctgggtgcagtcgcctgtaactggcaaatggtcaatgcagagctcatcgcagagctgccactccaagcctggcccgccgtgcaggtgtgtctggctcctgtgcctgtgacttctcacctggacagctttagccagcaaggtgctccacctgaggttgcctgagtcacctgaggaggtgaccccaggaaagcctgtttgtttggaggcctgacacggggctttgcccatcccccagccccagggctgacggattttccttgtcaccctcactctttctggacttgggatctgcccccggtcctccttggaaagagtgacagcccgcagcctccttcaggattctggcccagggcctcagaagggagctacacaagtcattctgatgccaccagagcaagtggttgccaggaagaaaaacaaaacggtctcgccggcctgcccttggaggaggtaaactccctacctcttcccagctccctcaggaggaatccggaatttaggatgagatggatttttgtagataaccccaaagatgtgaagctggtttgtgaagctgtcgtgggtgaatagatgattcccaacgcctgccccccaaactggcccagctcagcttggggagctggggagtggccactgtgccgtgtcctccctatccctgcactgaactaagacaggaaaagcaagatggcagtcttgggcttctctggggctgccaattgggtgaggcaggtgggggcccactccttcccaggaagagaaccaggtaaggttctggtgggcagaaccacgggggacttggggaaggactcagaaaccatgtgattcgaggagaaaggattttaatgtaggagaggggttacgtaggaataatgtctggact

SEQ ID NO: 20502 - DNA, 1178 bp, Mus musculus
actgttgccagagaagccagtgacaaggaaaaggtatgtgaaaaggtcgcttgcccggtgacaccttctgttggccatctgtcatgtcccctctgtgacccccagcccagctcccaggcatatcaacatagaaggttctgcgtcattaagtcctgcctgcccttggcacactcagcactggcttctgccttcgctgggttctttgtggttctgttgggatggagaaggtgtccgtgtccagcctgagccagtcagtagttccctaagctcggccaaggctcagcaggaggggttactcagtgtccagtacacgtcacgattgctgtcattacctgtctcacactcgcctctctgacgctgtgcatctgtgttaaggatcactcccctctctgcacactgctcccagcagacggccaggtcatgcttcctggttgagtgagttaacctgagcgagttagcccaagtgagttaacttgactatgctgttgccctcccaggctaaggacttgccaactttcaaagataatgacttcctcaacgaagggcagaagctgcacgtgggagaagagagcaaaaagaacttcctggaaaaactgaagcgggacgttgaggtatcctctaacctctgtcttcaccctgtttgccgaccaggagccttgttagccttcagagagtggaactcactgttcctagctgagagagtggtgtcggtgtgagccttgcctaaaacctgtatggttgggcaacactgtcttagttttacttttctgtggctgtgataaaacaccacgaccaactgggcgtggtggtgctcgcctttaatcccagcactcgggagtcagaggcaggtgtatttctgagttcgaggccagcctggtctacagagtgagttccaggacagccagggctacacagagaaaccctgtctcgaaaaaacaaaaacaaaaacaaaaacaaaaacaccacgaccaaggcaatggagaaaagaaagcctgtaattgggcttctggttccagagggctagagagtcctgtaatggcggaaagaaggcatggcggcaggcggagagctcacagctgcctgcaggcaggaggcagagcatatgatgagagtggcccactgagccatctcaccagcccgagagtggcccagtcttttgaaacctcaaagcctacctc

SEQ ID NO: 20503 - DNA, 1180 bp, Mus musculus
tgcacctatcaacagtgacagccagggcaggtgtggcactcgcttcctcaccacctatgaccggcgtttcgtcatcaagactgtgtcaagtgaggatgtggccgagatgcacaacatcctaaagaaataccaccaggtatggggaggcccacgcccgggctgtgtaatgcctgcagctatgaggagtcacaggcctgggctgtggagaatgggttgggagagggaaagagagagctgcagcagcagggattggcggggaggccaggtctactctggtagtggcaggcatttccttgtacattggtcccttttctcattgctgtggcaaaacacctgacagaaacagctcagagaattaaaaaattgggggcctatgcgacatctcagtgggcaagggtgtttgccgctgatctgttagatacttttctagtgctgtggaaaatcaccatgactgagacaccttttagaagaatttatttgggcttgcagttccaaggggttagcatccatgatagtggagtagagttgcaggccgaaagaaagcttacatcttgaactgaaagcaggaagccaagagagcaaactgggactggtgtgtagctttgaaacctcaaagcccccctgcagtgacatacttcttccagcaaggccccatctcctaaagctacccactcaatgctaccagctgaggaccaagtgtccaaacagctgagcccgcgaaggccgttctcatccagtctacccaccatacctgatgacttgaattcagtccacagggttgaaggagagaactggttcctgcaaggtgtcttttgacttccacaagcatgtagtaccacgtaaaattaaccaatcaagtgtaattaaaaaataaaaggggggaaggatcgatctgctttggcttgtggttttgaagatctcagtcccacttgaggagagtgtcacggtgctgggagcgcgtagtgagggagaggcaggctaggagcagagaaaggatgtgtaggaagtggctagaggacacagctcccgggaacatgctccagatactgcttcctctagctgcctccaccttctacctttcccacttgccaataatggcctcataccatggttcatcagaagatcaaatcatctcttaggaccgccctcatgtcctcatggctgtggaatatctatccta

SEQ ID NO: 20504 - DNA, 1216 bp, Mus musculus
ctgggataaacaaacattgactttatttagtagattatgtgacaggatagccaagcatcaggaagagccaagaattgaagaagctggaagagaaaacagaaccaaaagccctaagtgaactgctacccacccgggctttacgctgtaatggtgtgatgtgtatatacaaatgtatagttctatatttgctttaaaaaagttagccttgggagaacattttgttggatgaccttgtcagaaaagtaacacagtagttactggtaacagagggatactgaccttctttgtcatttggacatgactttgtcctctacaaatgtgttaggctacatttataggtatgtactggcttcaggaaggacacacctgccaagggacatacatatcctcctctgttcctcggcatcctacagtgggcacccagtggggcaggaatcaggacccatgttgtccgatgactcctgaaagaaaatacttgggaagctttttgctttctggctaatttttatttgtttgtttgttgaggcagggtctcttgtagctcaggctagctttgattggaccggggagctgacggtgaccctgcactttagctcctctgaccacacacagttgctgctcctgccactgctgctttgtggtttgtctgtgatacagggcccttgctggtccagggcagcctgatggtggctctcctgcctcagcctcctgagtgctggctgcggttaggccatccccatcctccagctgcctttatcctgtaataactaaaaatctaagacaagactcaaggggccacacccatgtctttactgccattcctttctctattctttcaccagaagccctcatttgtttgaccagggaacttctaggtgctttttaaacagacgacagattcaccctagcggtagctgaccttaaactgtagatctcctgttttagtctctggagctgtgattacagaccatctggccctcagaggtgctcttaattcatatattaagccatttcgttgttctaccagttcctaatttctcctaaaatatgtttggatttaagcactaaaattccagtcactgtaattattgttgttgttactttttgagacagggtttctcagtatagatagccctggctgtcctggaactcactctgtagaccaggctggccttgaactcagaaatctgcctgcctctgcctcccaagtgctggg

SEQ ID NO: 20505 - DNA, 1145 bp, Mus musculus
tcaaaccccaaatggacaggtaaatcatccacaaaaggtaggtagggtccctaccaactgccaagggttcagcagggccagcctgccgttctgagtcctgaatatcgtttttccccctcttctgtcttttcttttagatgctaaccaggcctaagtgtgctttctttagctctttggcctgcccaagctttttctaaagatcccctccccaccttgtggatgtgtatagccacgaagctcacttccaggccagcttatcccaaacagtatggcttctgtcccttttgtttctccattctccccctccaggagatttatatagttcatctgccttgattttaaacccttaacaattgtcctcaaacttaaaaaaaaaaaaaaaaaagatcatggagacaggaaacttgcaatctcaacgcttaggaggctgaagcaggagtagaccagtctggactatgacatgagaccctgtctgtactctctaaacagctgtgtaggggccggcatgatggctcagcgggtaagagtactgactgctcttccgaaggtcctgagttcaaatcccagtaaccatctgtaatgagatctgatgcccactttttttttttggtttttcgagacagagtttctctgtatatccctggctgtcctggaactcactttgtagaccaggctggcctcgaactcagtaatccgcctgcctctgcctctgcctcccaagtgctgggattaaaggcgtgcgccaccacgcccagcctgatgccctcttctggtgcatctgaggtcagctacagtgtacctatgtataataataaataaatatttgggctggagcaagcagggactgagcgagtggggccagttggagccagcagaggtcctaaaatattcaatccccaacagccacatgaaggctcacaaccatctgtacagctacagtgtagccatactcccatacatacataaataaatcttttaaaaaagctgtttttattgtatgtattttgcctccacatgtgtgcagtactctcaaaggccagaagagggtgtcagacactctgaaatataggagttttgaagtaattacagacactggtgagcagcagtgtatgatgggaatcaaacctgccctctgagaattctct

SEQ ID NO: 20506 - DNA, 1421 bp, Mus musculus
aagagggcatcagatttctttaaggatggttgtgggatttgaactcactcgggaccttcagaagaacagttggcgctcttaaccactgagccatctcgccagccctggatgtttacattcttatccttgccagtagctgatggaaattttatggtgttgacattctgtggagaggtttttctacttagtgactgctgccctttcttttttgtccttagtacatccagcagtggtaattcgacaacgaaagtcatatcgaagaaaagatggggtgtttctttactttgaagataacgcaggggtcatagtaaacaataaaggagagatgaaaggtacgtggaggtttaagccaccattgtatgtttctgctgggtgactctagaagagtcacaggacaaggaccctgtctgacctgtcttctcttccaaacaggctctgctatcacaggtccagtggcaaaggagtgtgcagacttgtggcccagaattgcatccaacgcaggcagcattgcatgattctccagtgtatttgtaaaatatattcattaaagtctctgctctgagagctggtcttcttgacaccttttccaatatcagctttgcagaaggaaacttaaatttcagttcagggcatgaccttcatgaccttgcagaacttcttcactttccaggttaagtaaaggcgatctttaggggctgtccagatggatcagctataaagattcaattgtagaaggttcacgtctcaatgcccacgtggtagctgtaacttcaattaaaaaacaaaaacagccgggcgtggtggtgcacgcctttaatcccagcacttgggaggcagaggcaggcggatttctgaggccagcctgatctacagagtgagttccaggacagccaggaatacacagagaaacccttgtctccaaaaaccaaaaaaaacaaaacacgcattcttttcaggtctttgctgggaccaggtacacataacacagataaatattagagcaaaccatgcacatatggtaaattatctttgggttttgggtccctaaaataaagtggtgtgttcattgtgtttctgtgagtgcttgagaacgaccttgaaggttgaagcctggatggccacttgagtgttgtgtacaggagccctgtgcttgagtgcagatgtttaggtcatctggtcattagccagaggtcacctttccatggctgtggttgattaaggtacttaacacttgtggacttttttcagaatgaaaaaatagggctggagagatggctcagctgttaagagcactggctgatctgccagaggtcctgagttaattcccagcagccacgtggctcataaccatctgtaatgggatctgctgccctcttctggcctgtagttatgcaggcagagtactgtatacatataaatct

SEQ ID NO: 20507 - DNA, 1188 bp, Mus musculus
tgtagtagactatgtagtcttaccagaaaagatcttcagttggttgtctgtccctagctgtcagtgcagatgacaatgtgaaatgggtgtatttttgtgggttgttgtccgaacacctggaagcagacacattgtccagaggccttgtgatagacactgtactgggagctgactattggtgtattaactaccctgaaatgtgttctcatcaggtagatgaacagacctcagaacctcctctgccttgagtgttccagctgtagaactttcttggcaggatctcactgtaagcttggctgtccttgagctcagacctacccacctcagcttcctagtgctatcaggcactgttctttttccagagatattctcgaagtcctttggtgtagtgcaagtgaggcctgtggggttgcttcctagcaacactttgtttccataggagccaccttgctctcagcatttagttcaaagtctttcactttaatacttgaggggacggtgacattgtagccaaacttaccctagtgtggttacactgaaatgagtctaccagggcttatcctcttctcagaacacttctagggcctggttggtggctcaggaagctgtcagtgaagagcagagcatgtccccttacccctgtggtatgatgacagctccacacactgttgtctccaatagtggggagagggatattcttagtgtgtgtcaggtaacaggcttggtcagtgtttttggtttttttgtttgtttttctagacaggatttctctgtgtagccctggctgacctggaactcacactgtagaccaggctggccctgaattcagaaatgcacctgcctctgcctcccaagtgctgggattaaaggctgtagtctgattcttaactacctttaaacaggccaggtggtactagacttaactccagttgttctggagacctaggtggggagattgtaagttcaaggcttgcctgagtaactaggttttagattgatatatatatatatatatatatatatatatatatatatattttttttttaagatttatttgcttgagcccggtgatggcggcgcacgcctttaatcccagcacttgggaggcagaggcaggcggatttctgagtttgaggccagcctggtctacaaagtgagttccaggtcagccagggatacgcagagaa

SEQ ID NO: 20508 - DNA, 3055 bp, Mus musculus
tagagaggaacctggggcctgggagtgacttggtagagccctcgcccagcacaggagaaggtctcggtgtgggcgagcctacatccgatgtctacatctgatgcccaggctaactattggctgtgctccacagaaacggtaccgtgcagtgtatgactacagcgctgccgacgaggacgaggtctccttccaggatggggacaccatcgtcaatgtgcagcagatcgatgacggctggatgtacgggaccgtagagcgcaccggtgacacggggatgctgccagccaactacgtggaggccatctgaaccctgtgccgccccgccctgtcttcaatgcattccatggcatcacatctgtcctggggcctgacccgtccacccttcagtgtctctgtcttttaagatcttcaactgcttctttatccccgcccctccagcttattttaccatcccaagccttgttctgcccctgtcatgggctccttcctctggcaggttttcccttggaccaatcaactgattgatttttctctctggatggaacaggctgggcactctggggagggcaggattgttctgagctaggtagactcccagggctgggctgaactaggagacccactaaggagatcagtttagactgggtgcagtggcaaacacccttaatcccagcgaagggaggcagaggcaggcagatctgtgactttgaagccagcctggtctacatcgtgcgtttcaggacagccagagctatgtagtgaggccctgtctcggaggaagagtgggggttggttagctctcagcttcacttcctgccttaggctcctcagaacccctgacccagctcccccgactcccttcctcctagagctggggtgagctgtgtcctcctcatacctccaggtgtggctccacacatccccagggggtcggtattaaggcctcgtgctgacctttgccctagtccatcttcctgactctctgcctcctcgggacatccaaaggagagcagagttcctgcttcagactgaatccttgcccctctgtgcagtcctccacataacagagtgtgcccattctgcccccacacacacctagggtggccagggagcgccccagaaatcccagcttgggtcagattcttgccttagttctaggggcagcagcagaaaggaaggaacagggcgctctccctccctgggcctgtttgctccctgcctcctctggccctcccggggctctctttatctccctggctgggagcctgcagtgaagggtagagcaaagggtgcctttggggcctgactgagctgtttgttcctgcttccctgggaaaaggtctccgcgtctctcctgtggccttccttccccagaacaaggctggactggctgagagctctgccaagccagaaaatggccagagtcttctggagcccaggaggccctcccgcctcgctggggaggtgggagaaggcttctgggttagacatgtgcttttctgtcgtcgtgtctgaggctacagagcccagtaccagaagggccgagtcacccacactgtggttggtacctctcacctgaggctctcctatccttgaagcaaaggagagtccagggcttcaaagctggcggcaccatctctgggctggtgctaaactcaagttccctctttgcctctggggcctgggacagtactcactctgcttcattcatctctgggttttcttgtccctcctcctgggtcccctgattctcatctttaccttgagtgagcctgatgtcaggttcctttacatactcagaccctgctacaggtgaggtttgaacctgaagactttgatcaggccagcaacgtggttgtcatgagggcttgctagagtttgcctgcctggtcaatccctttacttccgaccctcgcctgagtgaaggcagggcgtggtctggtgggcagcatggggaagagccttgtgggggcatctcaggagccacggggtggggggaggtgccagcccattccatttcctcttatctcaaagcacaatgtggttctggggaccagagggagcttgctcttggagggcctgtgttcaggaggtgctgcgagcctcctggttcctctcagctgaacctcccttcccaacgtcaagtcagctgttctagtgccctagaaatgggggagacttacaaacacctgaagaggggagaggaactacctaaggtgctgagggccccaagcctgctggagtccatacttttccagaaacatctacccctagaagagcacagaatcccccaagcccatagtctcttcctctgtaaaggtcttttcagccaatccaaacccaggaaagaaggcaccttggctagactgtgaacttaacttttgtggaccaaccccataatgcaagaagccccatggtgagcgacataggttctcccccccgggctgcttcctgttctccctcctcacgtcccttcggggacattttatttcctaatagctggacataagacaaaaagtaccaccccacagagcctatatttaaacagaaacagaagtgaccctgtgaagtccgcctctgtccaacatttcatctgtgtatgaatgtgtgtgtgtgagagagagtatgtgtgcgtgtgtgtgtgtgtgagaagccacccactcatcttttatatatcgggttgtcatctttctttggtcccctccctcctggccttgtccttgggatcatttctttctggcctgttatgattttgaacattgacttgaaccacaaagtgaatctttatcctggtgagtcaaataaaaatgtaatttttacctgcggactaggcttcttcctctttgacttctgaagtaacttctgtgtgtgtcccgtttgtcagggggcattgaccttgtccctcaccgtgaaccctgctaccattcaaagagagcaggattgctctagaaaccagagttgctcactcttcctaccctgacacttgctttctccttgaggacatagcccggcccttcagtgacatcaccagtgacagctctgcccaccctggggt

SEQ ID NO: 20509 - DNA, 1099 bp, Mus musculus
gtctacagagtgagttccaggacagtcaagactacacagagaaaccctgccttgagagagagagagaaagaatgagaatgaatgagtagactgaaatgctagaactggctagactggagttaactagaatagtcacaaaaacacggtaagctttccaataaacagataatttttcctgtctttttccaaatcttctcaagttactgtgatcactggagacccaggctcccagaatgtcttttcctctgtgtgtggatctccttttactagaagggaaagccaatgacatcactgcactgctgttattgttatttctgtacacacaacataccatgttgccactcattttaggaactgaagtttatatcttgtgatgactatgttaactgtgaaatgatgcacttgtagcagcacactgttgtggtgatgccatctgtcctcttagtccctaagtggtggcgtgtgtgttccagtggcaaagttcagcactgttcatccggcaccagcttagaagttccttatcctgtgcgcctggtcgactctgtttgcactcctaggtctttgttaataacagtttattgctaggggaactgttcacctttggagaacagagcaagcaggaggtgcccagtagaaggtgtaatgacagaaccagttcatgtctgaaaagtaaacactaccctctgtgtgtggttagcttcaaggtcaacaacctcctgggaatagtactcagtcacgtgattgcagatttgtacttgcccttgacagcctcctttcgtactggaaactgcattagcaccccactagctgtgggcagtgttatctcaagcgcattgtgttgtgctaaacatctttgaaaactaatattgtatttgttcaactttaatatcttattcattctaataaaattaagttaaaattaagtttaatctggaaatatttcttttcttttttttttttttttttcgagacagggtttctctgtgaggccctggctgtcctggaactcactttgtagaccaggctggcctcgaactgagaaatccgtctgcctctgcctcctgagtgctgggattaaaggtgtgcgccaccattcccg

SEQ ID NO: 20510 - DNA, 1218 bp, Mus musculus
aactcctgaatttaaaatatgtagcccttcaccttcagccagtgtgctgtggtcaccgtcatgctcgccactgccctctgtggctatgccgcagccgcggctgcccgaggcctcctgcaccccgtctcggctctcagccccgccaccaccactgtctgttccatttgctgctattctcatgggtcacacgagacagatgaggagtttgatgcttgctgggtgacatacttcaacaaaccagacactgatgcctgggaattgcgtaaagggatgaatacacttgttggctatgatctggtttctgagccccaaatcagtgatgctgcgttgtgggcatggagatggttaaatgattttgctagtgctgttcgcatcttggaggttgttaaggacaaagcaggacttcataaggaaatctacccctatgtcatccaggaacttagaccaactttaaatgaactgggaatctccagtccagagtaactgggccttgacaaagtgtaaactcccttccatgggcttcccaaggacttaactgctgttgctacttgattgaaacagttgcctggaaatgtttttatttgaacaaattttcctttgagtatccaaccacgtaatagcaacttggactttaataaagggaaatgagttttaactgaaaaaaaaaaaagccttgtgggagtcggttcatttcactatgtgggtcctggggattgaactgagtaaaacaccacagccaaaagcaagggagggagggcagggtttgcgtcatctcacacttgcaggtaacagcccagcaataggaaagtcagggcaggagctcaaacagggcaggaacctgggggcaggaactccacttgttccccataacttgttgttcagcctgctttcttatagatctgggcaccggctgcccaaggttggcactgccacagtgagtgagaccctcccacatcagccattaatcaagacaatatcccatagacttacctactggccagtcttatcagttgagattggctcgttccagatacatccaggtctgtgtcaaattgacaagaaccaaggagcgcagctcttcccccactgagccatcttagcttctctttccctgacacattatgacactgagtgaggcctctgccagatgcagcctcaaatcttggccttccaggactatgagctaaataaacctcaggtttttgtttgtttgtttaa

SEQ ID NO: 20511 - DNA, 1214 bp, Mus musculus
gacggtggtaaggaactgggaattttcagggcagtggctctccgaatgtgactagcaccacgggacttgggctcgtgctagacatgaagattcttggcctcctctctgacccagtgaactatccctgggtggggctagaaatatgcgttctgagaagtacttcccgtgcatgctcaagttctagaggcttacggttagaaacttgtccacgccatttgcttctaatatttccaagttgttgcttttgcctgagccccaatacaagactttatggagaacgggcaccgagactgaccgcgcacgacgacaccagaattgaggctggaggtccatcttggaacactatagaggcccttcgcggcgcctgcgcgggcagtctcttaactcttcaagagatcagctaaacggcagccccgtggctcatcacgggtccactgggtggcggtaggaggccacatctggaagggacggtttcttcgataccccagaggctgtcctgggagaattcaggcaaggaattagaaagtcaatggctggctaggtttggtgggctcacctctgtaatcccttcaataaactgaagagtgatcgtgagttcgaaaccaacctggtcgacggcgttagtccttacctggaaaactaacaaaagtccctttggttgcggggcttgccttggctcatagtattacataatattatattgaggtcttggggagaccacctctaggtttttggacccagaggagagtgacactgggattcatttcctttcttggtccttcttttgacctcagtgccaggccactcacctacttaagcccacactctacttctgtccccagctgcagccttcttctggggataagtcccaggaagcagtctctgcaccctttctttccgcactctccaggtcccctacacagaggaagccaggggcccctcagtcctctccactctctaggccccagttcttctccttcccatgaagtaggtcacaggcaccttcgtgccttgacctgattccatgccgtctattaaatctcctaaattgcgggtatttttattccatacttgaagggggtggggtgggggggaagtgccctattcccagagtccggtaaagtgtggtggcagtgggcgccacttctggctctgggtctatcttggactgatctggcctttctgtggaaggggcaccgagctgtttcaaagtg

SEQ ID NO: 20512 - DNA, 1969 bp, Mus musculus
gtctcttctgtttccactcagatctgcgtaggcgtgagcagaagcaaggatagcgatggcttcatccgcgtcagcagtggcaagaagcggggtttggtgccagccgactccttggcagagatctgacagaaaccgagagaacccagatgctacccctgcccatgcctggctcttgcttctggcctgagaaggaagcgggcatcctggccacacccttcctctcccagtctctctcctaagcatcacccgcccccacttaggagccttctgcactgaggaaggtttatttcttggttggggtatcctgaatggggcttgggaaagggagtcaaaagtgggaagaaacgaggaagttacaggtaggaccacccggagcccaagcaccacctagtcgggttgccatagtgaggcccaccctagggagtcgtctgctgtcttccagagactacccgctcatactgccttgcatgcctgactcctctctgcccacagcctttgcttgggtctgtgtatccaccctctgcaagtggggccttgagagaggacctgttggtgtcccttagccctcccctctggcttgagaagacgctgaggactatgggagagccctaagttaaccacctgtcaccccttcaactctcaggaaagttcaggaatctttccaattacttgaaacctgggcgacagagcagggtcaggactgaggtctgcaagggattgtaacacgtaggagtctgttccttgaaggcagtcctcacagaacagtctcattctcctttgtctactagaaatcggtagccaagagcagcctggacaaagacccaggtggagaacaagacgctggcccttgcttggtcaaaacatttcactgttaggactccagaaatccctaccaccagaagcagacagctaggggagtctgaggttgtgaggtctggtttctctaaaagccctgtcctcagatggaccaaacttaccttcttaccgtttgggctctatagggcccatccctgggaaggataccttggcagattgaggaaggctatggaaagttcttttggccaccatcaaatgatgctctaggagcccttagccctcctggcaggacaaaggacctcttcctcaagaggctgcttcttctttttcctggtgccagcacctgcccctccttccaagctcagatcctccttttaagccctgatcctgtcagccaatgccacccccctcagttctgggcacagtcttgccttccatacaacgagaggacactgattctctacccaacacaccttgccccattttccccctaaaaggggtctaaagccacactgccctgtttgctgccatgagggccccccccagcaaaatccccggggcgggcccaatgcccactgtacatgaggctgcatgacgggtctgcgggggcgttgctgagcccccaggcccataattaaatgtttcttgtctcagcctgcctgcttggtgtatctgattgggatagagaaagcaagctagtatcaggctgggatggaggctaagagtactggaggtattgagctctgagaggggcatcagagtaggacgctagctttggggaccacagaaagaagcagagggacccgagaaaggcgggaaacaaagtcaggctagggaggtgagctgaggtcacttctgggttctacgtgcacttgaatcgcgcaggggactgacccacagtgaccttgttgacgcagacctgcacgcttcagccttggaggccgcctctctccgcagcccctaagcctgagattcagaggtggtggaggggacagtggaggacgctgaggccaggagatgactcagcagcgtccgtcatcagatgcctggcatggggggaggggaggaggagggaacggtggagggaggggtcgcgcacgcccctctggggctgccgcccacctgctccagccaagcggccgccttcccgcgc

SEQ ID NO: 20513 - DNA, 4666 bp, Mus musculus
gagtggggggctcagagtctaccaaggctggagagggagtggggggctcagagtctaccaagcctgagcacctgacaccagagcagagggaacaaggttagtacctatggctcagtcaagaaaaagcctcttcagagaaacacacagagaatgggagaaatgagatgagttttaaggcatatttctaaaccccgatggtagaagctttgtgtgtgttcattagagtattgggagaggggcttttgggacctgagtgtgcaagcctgtgaccctggcatgttaaaagggagggctgtttcatgccataggtgcaggttctgtcagaatatataggaagaaagtctgatggatttctcattactgtagaaaacaatcagatggaaggccctcgaacgctatactcccacatttatttattgtattaaacttattgaaaatcttattttattatgctcttttgaaagctaaattacttgtgtttttattccttttcccctttatgttcaaattaccttgagagaaatctcctttttcctctgagaccgtcttgttacattgctcacctgactggtctcagtcacctggactccagttaccctccacttcagcggctgggactcgtggctagtactgcttccccagactgggtacctcctaccccccctcccccccacacacaccccatcgccccagacaaaggcttatactctgtagctctggctggcctggaatcttgtcttggcctccttactgctaggattataaagttaggcacactagctcacatacacacttgcaaatgtagataccctaggtctttcaaacaaaatcaaaagaaggtgagggactatcagctctaaactatatcgtttggggtttttttttttcccctaagtgcctaataagttgacagtaagacctgaacactgaacaggtagcagactctgattgccccagtctgagtcattcaggaactctttggtatgcattcaagtttgaatgagtttcctaactactagtgtgtcagaagtcttgaaaacgctgtctgcctgctcagagtgttgctacacgcaggtttgttggctttgtcttggtgacccctgctggtaaggcaaatcaccacctttctaggccaagaacacgagtcaaaaggagggatgaggggtctgctgatgcacagctctggccgcacatggtcaagcgggcgtcatattcctttcttaagtaacgcaggcccatcatgcatagaggagcatagagaagcactgacctctgaatccaagtgccagctcccacatgcggaatacttgtaagaattggatagggttttggttgggttgataggtttggggttgttttaggacggaccatgtgtggagcccggggccttctcaagcattaagcagacgctgagctgtaatcatcagttctagtaaggattagcgtgaaaagttcctttttgagaaagctgattgggggctgtgagtctgataccagcactcctgttggcagatgggtggtgggcggaggcaggaaaatccgccagaagcctgagggccctccatctccaacctggagcacataacactgacaagcaaaacagaccccgccgtaccaaggtgtggagggagaattgtcctgtgacctccatacaaggtgtggcatgtacgtgcctgcacttcacagtatggatataaaagagggagagtgaggtatagtggtttgtgcctatatctcgacacaggagatgcagaggctggagggctgctgcctgtacctgaccagattggagtacatagcaaggaggtggggggcggggggaagcctggtggtccatttgtctcattttacacccactcccaaacatgccttttacaatggggaaagaaaaaaaatgaggcctgagtgagatcagcctcagctacactgtgacactgcttaagcaagccaagcaaaaggaagaataaggtaccctcaaagatggtgccctaagcctccaggtggccaggagggattgctaatatggagaaagatcttgaatagacaacgtccattgtaggctccgctcccctgcgtcatctggaatatcctgcccccatttgctgctgccgctttattagacctgcaaatgtagccactgatctctccagttcttccagcacccgccctgccctgtgtctaaagcattgtggcatccagtctagcatccttggattcctttccctgctcacagcaagctgtcgtgggcagaactgagcacagcacaggggagtggcagtggcttgggatagttctcaggtgatggtccgtggggttgggggttggacttggagttgaatttgagatctaactggctctgaggagtaaagggacctaacatgacctctcccccagtgtttgaagtattaaaccgctctgctctgcttaatgttttagaaatgcggtgactggccctgccctcaccctgacagcctttctggaggtgaaagtatccctcagtttgtttttgtagatttccagtgagatttctgtgtctactaggtaggtagcaggcatgtaagtccgagatggtgttttaagcgtttcccagggaatgttgttgagtgacttaccatgctttgtttggggtgttctgtaccgtttggaatgtttgttgtagctgtgggccactgacgtccagtctggactatttgtagctgtgtagactatttgaagtctatttgatattttcagttgtcttctaaaatgtgtttgaaaacatgccttgacttggcattgttagggcgtaggagagttgtcactgaaaagaagagagagactccctgcctgtccgtgggcattgagacttggaaggcctcatagatcatgactgaccttggactgttgagatggctcggcaggtaagcactgtttgcaggccaagtctgacaacctgtttgtgatggtgaaggagcggtaatgccggctgggaattgttgtgacttccacggatgtaccatgggatccatgtgcgttaatagaaaggattatgtaaaatccaaggctgatggctctaaagtcaggcagctcatggagtcataagtgagagggtagacaaggaatgagccctgaaccttctctgagttgtacaggtgggtttctgtgctgtggtttctgctgacagaccagaggataagcccagccttcttgaagacttgaagacaaacaagtcttaagttagagggatgaggggaagtaggagtcacaaacctgctcacatttatttttgtcttaagtctgcatcagaagatgcagaaagcagtgttatctatcaatagggcatgattagccctgctgatttgagaataaaatctggctgtaaatacaatatccaaaagacctgactctacatcttcattctccagcaagaaaaaaaattaaatatatatatatgctatttaagcactggctgctgtaaccctgccttattctttttacctgctggaaaccacaggagacaggagacagagcttctggggtttcccattggagcctggttcacagtgttgtgcgctctgatttctctgcacatcgtttctgcatctctggaaaactctcagttatttagcatcctctcccttgaatgggagtttaagaaagttatttgagagggaaaagcttttgttacacaaaccatgcgtggaaggttcgaggagaacatcctcctgcaggtctttggtctctgccacaggagtgtttgatctaaggctttgtggagtcaagtttacaaagatgtcagtacttctcagccagagtggctcgtagaacaagaaccatgagcaggcagaaacctagtgtcgctttccactgtatggcatgggcaggcaaggctcgtgaggagatgctttgcctcaggaagcgcatctgtcctgtgctcataagacttcctttccatgggacacatttacttcgtttttttcatggtatcaactccatgccctttggtggcaagaagggcttccttacttctggggacagcattagtaccaagacaggagtgtggacagtggacaacagtcctcccccttggaaggggtggtgatagacaggtgtcctctgccaggtcccaggagatctttgaagttacatccttttgctccgtttgtcgtgttatctccaatctgccctggtttgctgcttacatatgtttcttcctgtaccctaacattttcctctcagctccacaaaacattcaaccactcactgtttatagccctggagaccagggacctctaaatgactgcgtggcgtggctcattagttagacaggagtgccctggctctgcagcagtgagaagggccttgctgtctgtcgccatctgggtgtccataggaaggcttgctccttgtaaggatcttttcttacatatttctgacgactgttaatctctaacaagtgctgagcccgattcctgtgacccatccctgccacactcctacctgacacactgacacctagatcctgttggcacgtcccaaaatctttaggccagccagctcttcctccctgctgtaaccccagaactgaccccaagaaccaggacaaccccgaggggaatctgggagaggctcgaggtcacttttccgttggttttatccactctggccacctctgttcttcctccca

SEQ ID NO: 20514 - DNA, 1839 bp, Mus musculus
cagataaaagatttatcttctttcattaaaaaggaagggtggctttggggggtatacatttgttttcagagtctataccctatcgtataaaaatcagtatagaattaatagttctcctacttccacaatgtgccaaaagtctacatcccagcattttgtttgcaggagagctgatgccattcctaagagctggactctttgtttctcttcatcacaagaagaaggagttcagacttaaatcactccactgtatgctccccgagataaacagttaaaaaaaaaaaaagcagccatagttcacttaaaacaatttcaagctcacttgaagtgattagggcctggaatgctaagtgagcatgaagataacccttgctaccgtgtagcacacagtcggacctttttggagaaacaggtctgagtctggattctgagggacatcaaaggaagacctcataaatagagaaatgcaggagaccgttttgagtgcaacagaagttctcagtatttggagggtcctctcaaaagtccgcggccttactttgatttcaccacctgcactgtgccattcctgatgattccgtttgggatctgtatcagcggggtgggggtggggcgtgatccccagcacaactcttctggattacaaaacaagcaaaagccaggtgattcatgtttgtgtgtgttataagtggagtgacttcatcagatacggacgatttctacatccaacactgcaggttgttggagttagcatagacttggaaaatctactgcggctttctttcctagttctcttttttttttttttttttttgttttttttgtttgttttttttgttttttgtttttttggtgttctcccttttctggtcattggttttcaacaactccgccatttctgtgtcccaaggcaataaataggaaacaaaatattggaaagtggagcaagaaaagttatctgttcccctatcagagcccggtgtcttgggtgacatgggcagggtgtattggagtgctttctcttgtggtgctgacatagtagccgtgcggtatctcagataaaaccaggttggatttctcagaaatttgccacctggttgtgaatcctatcttcttagtttctgcaggaaaattgttgttatatggggtttcattttgttgtgggtggggacaatctcatggggaaaatgtactgcatagtataaggggctcaggccccccgagcagagtcaagaaataccaaaatcagtaaactgggaagcttttctctctttctgtcttcatcccagatcaaagaatcccgagttaggatctggatgaaggataagcccctgaattgctgatgggcacaccccacacaatgacccagcatctgaacttgcttaacagggagccggggctaaactgcttcaccctgcctgggaaccagggagcactgcatttctccacagggtggaggagaagcggcaggataaaccaagcctgggacacctccctcccatccaggtgtgctcaccctcctgtttgaaagacggcaaggacatgaagtcaacgtgtacctatttgctgctgctgctgctgctggagtttatggttttttttttcttttttttgacctattcttctgtctttgggcttcatgttaagggtctttggacaaaaatctgctctgatgtacaagaatatttcagtgtatcttaaaacaagtgttttcgaggtgagcaaggggacctgatgtaattgccaaagccagcttgagggtgataactcttgaattggattttccttttgtcaggccaaggcctgaaaaatctgtaacagcaatatatcatgaatttt

SEQ ID NO: 20515 - DNA, 1177 bp, Mus musculus
ggcttatgtaaatcacaggcaaaagtagagccttttgttccaaatgatgattttattcatcaccaatgcagtgttaacttacatggttttctcctatcttacagatgtatgtccattcctgtgacgatgagggctattcggaggaaggctgaaaccatacaggctgacaccccagcactgtctctcattgcagagacagttgaagacatggtgaaaaagaacctgcccccggctagcagcccagggtatggcatgaccacaggcaacaacccaatgagtggtaccactacaccaaccaacacctttccggggggtcccattaccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttcttaaagataaccctgcccaggatttctcaaccctttatggaagcagccctttagaaaggcagaactcctcttccggatcaccccggatggaaatgtgctcggggagcaacaaggccaagaagaagaagtcgtcaagagtcccacctgacaaacccaagcaccagactgaagacgatttccagagggagctcttttccatggatgtcgactcacagaaccctatgtttgacgtcagcatgaccgctgacgcgctggatacacctcatatcaccccagctccaagccagtgtagcactcccccagcaacgtacccacagccagtgtctcacccccagcccagtattcagaggatggtccgactgtccagttcagacagcattggcccagatgtaactgatattctttcagatattgccgaagaagcttcaaagcttcccagcacgagtgatgactgcccaccaattggcacccctgttcgagattcctcaagttctgggcattctcagagtgccctctttgattctgatgtctttcaaactaataataatgaaaatccatacactgatccagctgaccttattgcagatgctgctggaagccccaatagtgattctcctaccaatcatt

SEQ ID NO: 20516 - DNA, 1178 bp, Mus musculus
gtgggtatctgtgcctgtgccactagaatgtttgctagataaccaaataaattttaaaaagaaaaaaaaaacaaaactagattgcctggtgtggaatctggtgtgttcatgtttcctttaatccaagtatttggaggcagaggtaggtagaactctgagctacacagagagaccctttctgaaaataaacaaacaggttaaagttgtagcatgtaagtacagttcttgcctaccactggtgaggcgttgggttgtcagccctgcaaaaaaaaaaaaaaaagcaagtctaaaacaatatccaaaacgaatctgtaatacatgtgtattatgtgtatgtacatgtatgtggtctcagcgcatgttggtgttttgtttggttggcttatgtattcctgtagaccaggctggcctgagcctcacagagatccccgagtttggtggaaggtggaactctgggatactgagaccagcctggcctacagagtgatttccagaagagtcagagctacacggagaaaccttgcctagaaatacttaacaaacaaaatgaaaatcggtgttactcaggctaatgttgtgcatgactgtatgccagcactagataggaggcagaagcaggggcaggtagctctagacagacagtgagggtcagccaagggctgcaccgggaacctgcctcagaaaccaaccaaaccacccttactgaggaagttttacggtaatagtactgattggccacatcaaataaatgaaaagactaattgagagctgggcatggtcgtgagtacctgtaatctcagtgttagagaggctaagacgggatttggggttcaagagtaacctgtgctacacaagactatgtcataagttacaaaatgaaacaaaagtcttggccattcctggtttcagaattcactctcaatttaggctgtttactaattttttgtttttaagtttttctatgttgtaattattttatattcatgaatgttttgcctgcctgtatgtatgtgtaccttgtgcgtgcctggtgatcaactggcgatgttactatttgcataaagacaattatttgtttgtttaatgtcttaaatatggttatgatctttttcctcattgttcagattctcctgggctcctccagtttgaagtgtgtcctctctcagaatctcgcttca

SEQ ID NO: 20517 - DNA, 1198 bp, Mus musculus
tagaaaatatccccctcttctttttttgaaggaccccttctttctccgcagtcactagtgccaacagtgttgatcttcctgcgtgtttcttcttgaaatttccccagccaattccagtatctaaagcatttgttcagaaactgcaaaattgcacaggtaagctttgttttttaaaatgtttgccagcctttaatagaggtaggttttactcattgagttaaaacttgttaaaatcagaatgaaaaacttcagattatcttaaacaatttacagtcttttggcttcaaagaagtgctgctgagtacagcttttaggaaagtactagtagttagtactggtagttagtactggtagttagtactggtgctctgtaagaacttttggagatgtgggcagatgcataggaagatcacaagaagacagtgcagctgtcacagtttgatcttacgtgagcgatacaaacagtccttgtattttcaggaatcccgttgtttgagactccgcccacttacctgcccctgtatgaactcatcactcagtttgagctgtcaaaggatcctgaccctttacctttgaatcacaacatgcgattttacgctgtaagtaggccctgtggacttgcaacaatgttgtttctctatagcactagtgaggtccctccaatagcttccttttagattgctacatcatcctcagttgggcaaaagaagtcatcataaacatgctaaagcagaagagaatcagcttttgagttaaacagccatgtacatttctgtctgtttgtatttgatgtgcatcagtattttgctatatttaagtatatacataacctgcttgcctggtgccaaagaagtaagaaggtcacctaaactggagttatgtacatctgtgagtggccatgtgggttctggtaactgaagctaggccctccggaagagaagctgtggctgtaaagcaaggagcattctttcatgtccttttccttcttcttcctttcttccttcctttcttccttcctttttttttttaaggatgtatttattttgtgtatatgagtacactgtatctgaacagatggttatgagccatcatgtgcttgctgggaattgaactcaggacctctgttcgctctggcacaaagatttattttattattatatgtaagtacactgtagctgtcatcagacacaccagaaga

SEQ ID NO: 20518 - DNA, 1237 bp, Mus musculus
gggctcgcgggcccgaatatcggctcggcgggggtgggcggccgtgaggggcggactcgagcagctcccggcgtcgcgctcctcccgtgccgaggaactcttggtttcttccctctctccttcaccccccacctcatgtaggagggcgctgaggcggcgagagggaggaggagcctcgcctgcggtccctgccctccccacccccgtctaggggctcttcggggggcgtggagtcggggctgggggggagggtggggctttttggagcgccggggaactttttcccctgcttcaggcccggggaaagggaatgcccaattccgagagacatgggggcaagaaggacgggagcggaggagcttctggaacttcgcagccgtcatcgggaggtggcagctccaacagcagggagcgtcaccgcttggtgtcgaagcacaagcggcataagtccaagcactccaaagacgtggggctggtgacccccgaagcggcatctttgggtaccataatcaaaccactggtggagtacgatgacatcagctctgattcagacaccttctccgatgacacggccttcaaatcagaccggagggagaacgaggaacgtcggggaacggatcggagcgatcgcctgcaccgacatcgtcaccaccagcaccggcggtcccgagacttgctaaaaactaaacagacggaaaaggaaaaaaatcaggaagtctccaaatctggatctatgaaggaccgggtatcgggcagttccaaacggtccgtggaggggagtgatgattatgggaaggcccagctatccaaaagcggcagcaaggaatccaggtcgtccaaaatgcacaaggagaagacccgcaaagagcgagagttaaagtctggatacaaggaccggagtaaaagtcatcggaaaagggaaacacccaaaagttacaaaaccgtggctagccctaaacggagatccaggagtccccataggaaatggtctgacagttccaagcaagatgacagcccttccggagcttcttatggccaagactacgatcttagccccccaaggtctcacacttctagcaactatgactcctacaagaagagtcctggaagtacctcaagaaggcagtcaatcagcccaccttacaaagagccttctgcttaccagtccagcactcggtcacccagtccttacagccgacgacagaggtctgtgagtccctatagccggagacggtcc

SEQ ID NO: 20519 - DNA, 1199 bp, Mus musculus
ttccgaggaccagtgttcaatccccagtactcatatcgtggtttgcaactatctgtctctccagtgccagtgtatttgccctctgcagtcacttcatgcatgtggtatacagacaaaataataaaataatcgagataatgagaagaaaaataaaacaacattctgataacataaagcttatactggtgacagaacaagtgaatgaatttggttaatgataattcaaaaagctttttttgtcttgttcatttttgttttttgagacagtgtgtttttgtgtagacttggctgtcctgtagcttgttctgtagaccaggatagtctggaactagcagagatctgcctgtctttgcttcctgtgtactgggattagaggtgtacaagaacatagctgcaactaaaatacattatttcttaaagatttatttttatgtgtacatatgtggcaaggtaatatatacatgagagtaggtgccataggaggccattggtatcagatctctctacagctggagttacaggacagttgtgaaccagcatggaagtgcccagttctccataaacaagtcctctaaactgctaatccatcttttcagccctgtttgtagtttattcctctttgcttgtttgttgagacactgtggcttttgctggcctccagtatactagtagaccaggtttttctgggatttagcatgcaaccccattgaccttgaactcttagaattcctctggtttcatagcatgagcattgaattttcctttttccctccaagaggtggcatatgcctctaaatccagcactcagtaggttaaaatagaaatatcacaggaagtgtactggcagtctgttctgcttcaaagcctttcgggtacaggatgaaacttatctttaaacaaaacaaaacatgcagctgggaaagtggcacattcctttaatcccagcacctgagaggcagaggcaggcagatctgagttcttagcctagatcctgagggtatagttactagctatgtagagagaccctgtctcaaaaacaacaaaaaaattaagtgtctgactgacctgaatttcaactgtagatccatttgcttctgcctcttgtgtgctttgattaaaggtatgttctaacaagtcaggtgacaaatggttatatttgtacctacaggttaatttaaatttaattaacagaaatttca

SEQ ID NO: 20520 - DNA, 3645 bp, Mus musculus
gcaaccattcctcaagtctgagggaaatagcaactctgtggtacatgcagagaccaaattgcaaaactatggggagctgggaccgggaaccactggggccaacagctcaggaacaacgcttcagtgggggggcccagctcagtcttatggaaaaccctacaggggggctgcaagagtcctaccacgagggggaagagggagaggagttccttattaacacagagacatcaaatgccctgaaagattccttccctatccatctttccatctagttctatgaacctttaatgaaatcacctgccagagcaaggtaatcatctgcatttggctactacaatgctgtctgttgttttcacttgctgctagcaggcaagtcaaccatgttggcaccagttcttccaaaatggggcaatagccagaatatttacttccgctctgtgtacgagctatagtagaaatatatggagagaaagacacattcaattgaaaaataattgttccattagctcattgcctgcacttgagcagaagagaactattttgttttgagatggctctggagaggctttgattttttttaaaattatttgttttattttcttgtgtgtgtatgtatgtgtgtgtgtatatagtttgttttgaatttttatttagtttcctaccccaaactccctaccgcccttgaaagagaagagtattcaaaagatctgagctcctctaaggcctttgctagaagggtaacagtggactggctggctcaaatgtttccttcctctctaccatctcatatttttgcttcagtgatcactccctttacccctgttgagtatcttgtacatacctttttccaaataaatcatccttatgtttgctcaattttgacaaaagttatgtccctcttcctgcacacgcagcaggctgtagacagtggcgttctcaggcgaggaggcagacttcacccaatccttggtttttgcttgtttacttgtccctctctccctcttttctttttttctccttcctcccttgtgtgttcacccctattattctctttgtctctttttgaggcatttgtttgaaaaaaatacatagtagagatgcccgggaacctggaataatactttgcccttttctttttccttttttcttttcttttttttttttttttaataaaggaaaggaaattcaaactcctacattgttctccgtaactcttcaattctaagatttttgttttgtttttgtttttttaagccacgttctgatgggaagttgatttgttaatggacagcataggacattgctgctgagccatggttagaaatgataccaccatacctacctagaggggtaataagatcagtaagcatgtttacatgaatatttttgtgttttaaaaaaagaagaaaactttagaacagagccttgtgatattgtcagaggaaattcctgaaaatacatgagcacataacctagtttaggttatatatctgaagatttatcagttcctgatacctttaaagaacaatttttaacagagtccatcagaaagaacagtattgataagtatatgtctcagcatgtacatccaaccatttcttacagggatcatttttgattgtggtaaagagtgtagtacggtatgacttccggaaaagaactttgcctttgcagaacaggaaatggatgagaggaaggatttcagggtggggtaacttgagagacttctcatggcttccatttctcagtatcagcatctggagtattttaaaaacagattgatatcatgtaattgagctgcaccgttttaggcattcgtgaactgtagggtaagctcccttttacaaaggcaaacatacttcaccgtctcagagaatagttttcagaaactcaaataaatttcatgtttcaataccaagttcttatgttaaaatatatttagaaagatatattaattttttaaaaatttagaggtgaaaataccctcttcagctacattaaaaagttatttttcccttgttagtgataaagctaccagtgtgaatatttctttattttctgattttggtctggttttgtcataggccaaacactaagtgaaccttctagccatttggctttgatagctttttatgccaatatgtctggttaaatattctagacacactggcatgctatccatagactgcattacggtttatctataccttcagtcttctgactagttagtcctcagacgtgggccttattttaaaattttttaacgtaaggtattgggccccagactcctatttttgattaaagaaactgagctgggatacattaagtatctgttcagtgaaaaagaattgttttcccatcaaataggaataaatttctctatatattttcattgtattttggttatcaacagtcatcaataatgttttcccttcccctgtcacactatatttttaattatgccaaatagtctaaataatttatgtaagcttccattccctgtccctagggaaggggaatgagtgtatgtgaatgcgtgtatatgtgtgtatgatcccattatgccccgccccattttgggagtctagactttaaaaaatatttttataataattttgactacttctgaaagctgagaaaaatctcatttatatatcctgaaacctgtgtagaagaaaaggaatttggtcatttttttcagctatattacctgtaaacataatggaagtaaaaatttggcttaattttcaacctgaaaagtagtaatctggttaattccattaaaaagtggtttgagttttaaaaaactattacattattttgaacagatttgaaatctgattctgttcatgaataagaagcaaaactggcttgaccatgatctttttttttttttttttttaatgtggttttaatagcagatttgcttaacccagtttctttagttttttcatctgtctatagggaacaggattctcaaataacatcagatctatgtatttaaaaccagggcggtcagcacaaatttgtatgtaggattttttttgttagcttataaacatcaccgtgtgtgtgtgtgtgtgtgtgtgtgtgtgtgtgtgtgtaatatgcatatataagtacagtgctaaagtggttaccagcaggttttgagagagaatggtgcattgggaaagtgtcagttgccacctccttcttcctgatttacaggtctctgacactgtattcctttctctctcttgtttttgacccccattgggtgtaccttgtctatgtacagatattttgtaatatattaaattttttctttcagtttataaagatggaaagtggagattggaaaattaaatatttcctgttaatataccacttttgctgcattgcatttacttctaatttctgtaccccttaagcatatctaatcatgtatgaaggacatttttcctttatcttatgggttctctatttcagaaatgctatagaatcataaactactaaaacaagaaaattcctcagggtttggagagtaggaagtagagcattaaaaattgtgttagagaaatccatgagaatatggttttaaaaaggaaaaggtagcaaacagatgatagtgtgaagccatcaagagttgagcttcatgtaccc

SEQ ID NO: 20521 - DNA, 1195 bp, Mus musculus
gggctgaatggcttcaggatcggtgtctgccgaggccatgaacagtcttgcttggactcgaggtggtgccaaggacctccctgaacttctgcctgttgttcttagttcgttcttgcatttatttcctaccaggggccttcgagattgagatcaatggacagctggtgttctccaagctggagaatggagggtttccttatgagaaagacgtgagtatttaatgtacctcgggagggtggctgagacgagacacaccctcctctcctgtgcatgacactcgcccatgtctctgtccgctagctcatggaagccatccgaagagccagcaatggagaacctgtagaaaagatcaccaacagccggcctccctgtgtcatcctgtgactaagaaatgattcttggaagcttggttctggggtttaaacctttccttgtggttacgctaggaatccctctacctttagcccctcacttggccctaggtaactaagaccctgacttcactttgcctcttagggcacaaggagggactagacatttctgtggccaaaggcagaaaagagatgttctctgtgaacatcaccatcgctctcccgggatctgtgccctctgcagtttggtcctctccccagcgtggcaatacctttcagatgccacggttgctataacttattttccctgaatcctgggcagtgtcggctcttggcaataaagagtaattacaaatgcttgtgtcaactggcgtgtgtttatgtccagcctgtgcggggggcacacaggtcagtctggccctgctaacacctagtgggtgggactaacacctagtgggtggggttttcctggatggatacttctttctaaggcaaggaaaacaagtcacatggcaatgctctccacaagctcccctctcccactgggaggacaggacttcattctgggggtagccttggaatgagtgtgtccaacggagtattctgggggtagccttggtatgagtgtgtccaacggagaatgaccctgttgccaaagggccttcagaaggaatcctaactccccagtccctcaagcccaaagccaaattgtctcaaacttttggaagatctctacacactcactccaggaggagctgtgtgtcagatgagcaatacggtttgacccggcccgggaccactctcagacataggctggggtccag

SEQ ID NO: 20522 - DNA, 1618 bp, Mus musculus
ctgcacaccgtgaaagggacgcccttcgagactccagaccaaggcaaagcaaggttgctgacccactgggagcagatggactacggggtccagttcacagcctctaggaagttcttaaccatcacgcctatagtgctgtgagtactctggctatgggagaataagcagaggtaaacgggtgggctcagctggccctaaaccctcccagctttggcccttgctgtatggatgagcagagggagggaagagacatattcttgggtctcacacggggcctttggcctccctggccctgtctttcctcactggagtaagctgggggggaaggtaggtcaggagggccttgctagctagagagttgtcactccacttcttatctgggaacccatatttcctccttccctccctccctccctcccctccaggtacttcctcaccagcttctacaccaagtatgaccaagtccatttcatactcaacactgtgtccttgatgactgtgctcattcccaagctcccccagctccacggagtccggatctttggaatcaataagtactgaggttgtagccccttccccagccgggttggcaggggaagggtggaaggcctttgctgtgatgctgaagacaggagcctctggacactgccagagatgggggtgtgccctgggcctggcttccccctcgcttccccagtagccgacttggagtagcttgtagtggggttagggtggggcccttgggctctaacccattctgaagtttttgatctttttccttttgccttttgaatagagatgccatgggggtggtcaggaaagaggctgggctctctggctgactgtgggcctgagaaattgggacaggaagccaggaaaaggccctgttggcttgtttaccctcaggcagccatagcactttagcccccaaaaaggggggcagagggacggtacagcttctgcattggttgccctcattccttcagtgtgtgaagcgagactcgctgttctgtatgtattagaaccctgcgccgtgctgcctctgccgccaggcagggagcaggcgggctttgtgggcttcctggcaacccacgatgggtaggctgtggggcaggggagattaggaaaggaagatgggttgatgggacacctagaggtggggacaggatgctgccaccttggtcctggggagaggggagttctgagcaagggttgggtggggatagtaagttgggtcttacttagaatggacaagataactgcagccgatatggatcagtgtaaaaaaaaaagaggtctgggaaggagaagccagactccgcctcctctgagatgtgggctaggaggagagctggcgtggagggttaatttacccacagaacgatgctgataggaagggaggcccctgtgggtttgaactcctgggttggaatgaggatatgcacaggctggaagggcctgtgagtcctcagaagcgggttcacttcgacacttcccttagtggtgtgtgtgggcgcgcgcggaagctttctgagaggctcttccttaagcgttcaattcgtattcttgtgtagattgtgctggggcagtgcctcttgtgtggcttgcatgtgaatgg

SEQ ID NO: 20523 - DNA, 1424 bp, Mus musculus
cctttaatctcagcactcagggtggaggccggtagagctcagtgagttcatggacagcccagtctacatagtgaactgcaggacagccagggcttggtagagagaccccggtgcctttacatggatggatggatggatggatggatggatggatggatggatggtcacttcccgctagacaggagagaaagcatggcccaccatgttcagaccctggtgtctgggacatgcgaaggcccagtgattcctgcttctctttctccacctgctattttcaggccatgcgctttcctcccaaatcctacaacaaggacctggagtctgcagaggtgagcaagaatcaagggtggcccttttcaaaagggaagtgggaaggagctggagggcggggcaggcagccccttccttgggtgaagccctcagcccctctccttgcaggagcggcgagagcgggagcagcaggacctggagtttgccaaggagatggcggaggatgacgacgacagcttcccctgagccaggccgggggaggggcgggctgagtggagactggctttttctcttttccctcaggtgtcccctgcccgggaaactgttctccgtttcccacacacggctcacagactgcatatgtgcaggggtcagggatgctgggagccaaccgtccccttcttgctaccatgcctctctgtagctggtgacagtaccctgtgggcgggagagaggtggcagcctccaggaggcagggtcctgcctcatggtggtgtcggtggcaggaggggacggacagaaccatggattagggtgtggactagggcctggagttgggacacgttgggttctatgtttttgaagcttcaattatgatttttaaacaataaaaagttctccagagctccttgtgcacggtgtcagttactctgtggcacttacttgattgactgcatggttgacaggcccgagcggctttatttttcttggcatcttagccccaagtgtgatcaggatccagcatatcttcaggaacggaagccaaggtgaggtgagccgaagtcaggaggcttggggctctcacgtgttgggtacattgatgaatgccctaggcggctgtgctcctgtcatcaagtagaggactagactcagcctcctggctggctcttcaaatcaggagcctaaacttcccagaggctcctaggggcaaacaacaggaatggaagtcagttgacagagtgtttgccaagcatgcatagaatcttggtttgagtcccagcactgcacaaaccaggcttgatagcgcaagcctgttacacctagcatggcatcaggtgtaagcgcaaaccgggctccatgagaccctgcctcggaaaagtcaaggatgagcggctgacctcaagcgctgtgcacaagagaacaaagcctggcgg

SEQ ID NO: 20524 - DNA, 1177 bp, Mus musculus
ctgggctgtgggtgggagtgaggggttgaaggggcttcttcaccatgagcgtggagcttctgggcccagcttaactatgccttcctcctggctccttttgctagactggctgtgtggtgtgccctgagctcttactcttcccacaagggacaggcgtcctcccgccagaagaagagacacagagaggacattgaggtaggctgctgctggcttggtcatatgtgcacgcagcaagcattttctgatggcttaaagtagagttgccttgccaggcagaggttggggctaaggtcagctgtgcttggcctgtctgattggtcagggtctagaggagagacttgagtgggcccctgagtgtccttgatgggggaggtctttttctgctcaccgggcagagattggggtatgggaggggtcaccactggtagcgctggccaaggattgtagagagctcacttctccagtcagatctgccctccagtcctctccagctcctggagacctaggccgtcaggcatgtgacagtgacccatgtctcccaggactatgtcagcctcttccccgtggaggacatgcagccctcgaagctgatgcgactcctgagctccagtgacgatgatgccaacatcctgtcaagtcccagtgagtgctgggggtgtcccgggcctgcctaggactcacccctccctgacgagctgccttggtttctggctgatggccgtctggctgtcagcagagcaggagcctgcacctctctgtccctagtcggggctctgtcgcttgctagtggggacaggacctgaagctgtcctccaaggtccctccaaacccctcaggtgctcctcccttgtcaccactggaagggtggcgaggcacccagtgagttcccagcttgtactagtgactcaccccctctcccttccttcctaacccagagagacatgccctgtggctgaataccggccccaccaggctgcaacctggggctgccttcccgccttcctactcagagggcagcccatgtcatcctctgtcagacttccttctgccaaaaactcttgtgtggcatccaatttctcttgtttccagatttctcctgaaccctagaactttctctggagctttgtagggaccagggttcgagccacacgcttgtgtaaaggaaagattaggttgc

SEQ ID NO: 20525 - DNA, 1161 bp, Mus musculus
gaggttctcccccaatggtaagatttttgggcgagactgggaaaaccagccttttagaaaccaggaaaacgatccagaacgataggaaatgagcctctcttgtaagtcaatagctggttccctgattcaggggcatccccgggttccctgattcaggggcatccccgggtttctgggtttctgtcccaggtttgcatcacctgggccaacaggtttttaacctgggcaatgagtccttggtgagaaaggagggggatgggaaggcacctactgaagcctgacctattttcattagggtcccaccctcaagtcactcagtcaagcagtctgcccaagattgaggccacttgaggtctgcacagggtgttgtcgtgttacccagaacaacctaccgtcaaggagaataggtcttgggtcatacacccacctggccatgtacactcagtgcatacatacacatgtaaaggtgatgtttatattcatgatcataaacccctagcccctcagaagtatacagaggagctcaagtcagagcttagagtcctccatctttccttttgctacttttctttaaaaacaatttttctttcaagacaggatttctctgtgtagccctgactatcctggaactcaccaggctggccttgaactcagaaatccacctgcctctgcctcctaagtgctggggttagaggtgtgtgtcaccaccgcccagcttattatttttttttttaatttttattttaggtgtatgtgtgttttgtctgtctgtctgtctgatgtatatgcaccagatacatgtctggtgtcagaggaaggcagaacagggcatcagatcctcccagaaactggagttacactcagttgtgagccaccatgtgagtgctaggaaccgaaaccaggtgctctgtaaaagcagctagtgttcttagctgctgagccatctctccagctctggttttctatctttgatggcttttccagttcaaagaatcctgggaaaactaaggatatagttgaaaatacaaacacagagaatccaacaaagcctctaaatagtgaggtcacttctcagaatcccagacttcaaagaaaccgagtggaagtacccacactagggttctggggctatactttatggagtgctagtcattgggtctg

SEQ ID NO: 20526 - DNA, 1154 bp, Mus musculus
tatcttattgattcttttactcagaggtgtgtgtggtatttatagacctggatatttttagaacctgaggtgaatgatttcgtgttcctgaaaactgttactccagcatgctcataggttgcttgtccctattgttcctcttccagaacctggatgacagtgtattttcaaagaggcatgcaaaactggagctagacgagaagaggagaaaacggtaagaccaagacccccatcccaggagcatgtgagccttaggactgtgactgggagagtcctgggccaggcactagtgtcacagttagccagggcggttgtccttacaggcacacatgttggcctttttgtggatgccctccctcagtactactttctttggaacaccagcatataatgcagagtgctgcttcctcagcctggtagtcagttccctttacccggtcaaggaccttctagactctggagagtgggaactgcctttgtaggacagcttttaggtgagtagtaatgcttggtttgtttgtttgtgtttgtctggtttttcccagatgggatattcagaggatcagggaacaaagaattttacagcgactgcagctcagaatgtataaaaagaaaggaattcaggaatctgagcctgaggttacctcatttttccctgagccagatgatggtaagtggtatctatctaaaactgtaaactttggggctgacgaagtgtagctcagggattaagggcacttctgttcttggacagaccaaaatttggtttccagcacccacattgggcagctcagaactgcatggaattccagttgcaggggacctgatgcccttttctgacctcaaagggcactacattcacatgtacaaatccacacacagggacagaaacacaaaatcgtataaaataaagcaaataaaaaatttacaattgcagacttttcaaggggggaaaaagagtgcaagtctccacagcacagctgcttgtgacgggtgagctgtgctgtggaggtggtggtggtggcagcggtggcggttggatatttctcacctctttgctaacaaggctccatgtgattttcttccatagttgaaagtttgctgattacccccttcttgcctgttgtagcatttggacggccattgccaaaatt

SEQ ID NO: 20527 - DNA, 1448 bp, Mus musculus
ggctagccatgattgtctgatgacaagctagaagccaggcgtcagatctcattaggaatgctctttttggtttttcgagacagggtttctctgtgtagccctggctgtcctggaactcactttgtagaccaggctggcctcgaactcagaaatcagcctgcctctgcctctcgagtgctgggattaaaggcgtgcgccaccacgcccggctttaggaatgctctttaatctgaggtagatgacattgccatttggatggtgactgtgtcagctgactactgccttggaagtagccttgtcactttgctgtctttctttttgccaggaactttgaactaccctggttggatgagcgaagccgttgcaggttggagatccagaagaagcacacacctcaccggacctgtaggaagtagctgtgctggcggtagcctgtcttcagatagttgtagcatgctgttccgagagaatagcagagacctgtatgtgtgacctgtgccctcatgtctgttatcattcactggtaatgcctttccatcctccctttatattagttttgttttctttactctgatttcacaaaacaaacagaagaaagctcttgcgttggctgattgtgaattaggggttactggagcggcttttcccattttggggagatgagcttgagctcgtcctatagggggagacttgggggtcccaggggccacttgtaactcacctgcctgcctaacggggtaaagggctcttcattagcgtgtctaagatggagcaacccttcctgtaggagctgtgcctgccctgaccccgtgcctccctggtgcgccttctgaatagtgtgggtgtagtaggtttcaccgtgaactttagggcccgaggaatagcatgaagtaatgaagcaagacattcctcagagggggaaactgcagagttttacctgaaagtttgttctctttaaactgctctgtgacagtggcatgtgggaggagacgtgcagctggttcactttcttagttgatgggtaactgaagttccttcccacccccaacaaagaagatgtttagaaaagagattgggagtgtaagtttccaactagttaacagtgctaaaccgatagagctctcatttggggatggcatgccagagtctgtagagatgtctctgtcatgtcacttttcaaggattccttagtggggcttgatcctattagccaaacttttggtggtgaggtagagatttggggtggggccgggggtagggtatggaaggatatgcttcctctgcctggcagatgtctacagcttgaaacaaacagttgtacctaatgaactttattcgtttagtgaaaatagatttatacacgaaccatcttgtttcccatctcctgcccttgttttgttactgaaaagataaaaaagaaaaaaaaaaaaaaaaaagaaaaaagaaaa

SEQ ID NO: 20528 - DNA, 2436 bp, Mus musculus
gctctgaggagaaaggaggagaaagtggctctgtggctctgagggagtgtgtgttggtttagaaggtaaggtctcactctgagcccaagccagactcaaactttccctcttcctgctcttacctcccagtgctcaaattacaggtgtgggccaccacgcctgactctgggatatttttattgctgttgttttgtggtcattaaagcacattatttagaagcttagggtgtagcatgtccatggtcttagacttgatcctcggcgccaaataaaccacattatttagaagtgggcctctgagaaggcttatataaatactcaggtccaactgacacaccgttcttctcttttaactctcaataggacaggagaggtggaaactcaggagagaagggaaatacagctggctgtctactactcagagggcttcaaaggtgtggggtggccctgccagcaggcggaggatgaggccctccttctctgaggacgggtctgctggagagagaagaaacaggtggctgccttccacctcactcctcacttgagctgcctggactcgaggagcagagactggacaacccaggcgtcagaagcctgtttcttactgtctccccagagactcaagtgtcttctgctcccaagggagttccttcctgcttgtttgtttgaatgttgattttttttttaaagcttgatttacccttcttaagttaatgtttttagttttttctccttttccctgccctgccctgactttacatgaaacaagttcagtttcgtttaccagcctttctgggttccctttgactcccctgctaaccccacataattgagaatgttttgaccaagtgtaaaaatagctggccttttccttgtgattggtctttattagtctttttaatgcctctaaccctgtggaagctgtctgcacgcagtatcccactgtagaggagagctcagagtgggggagtaggagcccttgcttggggtacaggttttataaatctgagccttcaacagtacctctcttctaatgggcttcagtcctccactgaggcagaatctctgctgtggggagagagaacaaactggatgctattgtgagacgggagggtggagtgagaccctctgcgctgagtcctcagggctgtcttggaggtaagtggaagtagtgggccctgcttcttttctttgtagccttccggctacatccccttcccagttgtggaccaatgcatctctagagacagatactatccagccatctgtctgccttgtcttttgcagtacttctccatgccttccctgctacaagtgtttttagatgttattactgtactttccccaaattctgctcctgtacttgcaaactgaaggtaactatacctagacttaaatcctaaggaagcaagttaccttctgggcaaaggctgccttcccacccttcctttcacggcaccacactacatccccatgcccctgtggaagtctgttactgcagcactgtgcctgccagagttcccacagcacccgagggagaaggtgatggctgtctctctctagtaatgtccttgttcttattcttccctcctacagctggcctaaccactcttgagtcggggtgggggtaaccctcaaggaggaggtaactaagaggctcttccaggggtagctggtgggtgtgcttttcataggcttccctttgccttaaacctgaagatgtctcctcaagcctgtgggcagcatgcccagattcccagactaagacactgtgacagttgtctgtcggtccactgtgtttagttgcaaagatttcaccatgtgtgttgtttttgttactgtcttaaagggtgcacatttgtgatcagcattgtgacttggagataataaaatttagactgtagacttgactctgtggccagttattgtgtgtcttgatttgggagggaaggaagactaatttcactacagaattagtcataatttgagcccgactggtaaaatggaagagcagagaggtaaggagcccccttgaggcccaaagcttgaaaccaacagtttcttgtcctccgtttgtttgtttgtttgtttgtttttcacaccagggctcactcatgtagctcaggctgacctcttaactcccctttacctgaggcttagcttcccaggtgctaggattccagctgtgcacggccatataacaatttttgacttgtttgtttgttctatatgttgttggggtttttttgtttttgtttttgttttgtttttttttttttgagaccctgtctcactgtgtaccacgatgcccagctgtagatatctatcttttattggaaagtaaagatggcactaaaatactaaggcctacaacctgaaggacagctaccagactacctaccctgagctggaaggacaaggaaaactaagaccttc

SEQ ID NO: 20529 - DNA, 2937 bp, Mus musculus
cagagtcctgtaagccaagcacaaagacatagggaggcatgccgcccgccatctaggaggtgggtcttccctggcggccagcaatacatcgtttctcagtcttccaaggtgtagggaaacagcacaggaagtgggtgttccaacggaggccgctctgttggccaggaagtgtctcttctccactagcagtgtggggcgcctgaactccacacccagagaagttggtttctgacagtccttgacctgggcacaagctgctcagatcttacatcacggtagggagaccaggctgttctctgagttgggtaggggaagctagtgaaaaacttccagatacaccatggggttaaattatcgtaggggctgtcctttttttttttattattattattatttttatttttattctccgcccaccccactccactcccaccccctaagacagggtttctctgtgcattcctggctgtcctggaacttattttctagaccaggctggcctcaaactcagagatcccctgtctctgcctcccaggtgctgggactaaaggtgtgcgccaccacgcttggctcatagggacctttctaatctagtggaccataggctaaggatctgtgtgtaatgccaggtcagacccaaatcttctaggactggagaaagtggacctaacttagttcatttatttattgagtgttgcccattgccagctcttggaccacttggacttttgggacaggcagtggttagatcttaccggacttttaattgttcactatttatcttcttctcaaatctgttagcagttacgctcccagcatcctaacttgaacaaagggaagagagggaaaaaaagctgacacttggagagttccagggtagattctaatggttgaactgtgaagtcttcccatttgttgttgaaatgggagctgatgccttttgtacaatgttatcaaagtgtgaaaattttcccttactgaagcatagaccatcagatatatgcgtgcgtatttatgtatgtgtatatatatatatatgtatatacacacacacatatagatttgtatacacacacatacatctactcacaaagccaaacccgggctttttgcttgggctgatggtaccttcctcgacttgacctgccaccctttctaatccccagaatcagactgtgccgcgtgggtattgatgatatattttcgttgtctttgcctggtggaaccaccaccaaaaaaaggcttgaatttagatctacatgagtgagtttgctcctccagttaacggattgtgttgatgacacaacccctaacttaaatgtctttgccttattcatcatttggtcctgctgttaataacaaatttattatcatgtatatttgctattgaagatgggagtgtgatcctcaaaattgttggtctgttttatatattgtacacagcttgtaatgcaggtttaaggtagccgggctgtgaaaaccctgacactgttcccctttaaactgtccttgatgtcctcatgggaatgtcgtctcttcagtggaagattgggtggtctcatgttgaggctattacttagtccctttaatccccttgtcccctcccaaaggggagagacattgcccagctaagcagccagaagctctgtcacagctttcgtggtatttttccctagtgggaaacgctggatggctgtttcttactgccctgccctgtcaggcggtggttctgattttcaaatgagctagatgctcctctttccctttctccagtcaccaaacctggaccaaagtacttcatattccaggtgtgggttcctctctcctgggatttgctgcagctgcagagccctgcccttttcgcagccttggccacttgtgtgagccactagggccatcccagcctgatggacgggaggcggtcctcaccaggaattcaattcattccctgccccctttcctagcctaggcagagaaactagtcactggccattgccctgggggaatcccctcacgcagtggcttcccatcttagaacccggacttacctccaggcggaggtgaggggtggggagtactgtaaatagacttgctgcagagcaactcagggttggggtatgtttgagttctcctgatcacttgaaaactaatctgtaggctgaatgcttctggagtgtgggggaaatgtgactccggggtcctttgtcctctgaggctctgcgggtggagggtaggacttcagaggccctttgatagcacggctgcgctgtctgcccttctggaaacccaacctgccatcagctgtaaatcagattcttcacattccaggtgtaagctttcccttccctgtgactctcagtccctagctacatggtcagggggactctgttaaaccacccaaatttagggaatgagaggggagagaggaggccattaggagtctgccttcaagactcatttcttgaaaacaaaatggaaaaaaaaaaagataaccaccttcaatcacaggcaaaaactaaaccaagaaaaaaaaaaaaaaagcaaacaaaccaaaaaacccaacagcaaccatgtaactgaaggaagggtctggttccgctccatcccgtgttcattgtgcctttacttgtgttagatctctgtgctttcttcctccccctctatgacgtcattaattaaagccttccttgataaccgctgtttcctttctgctcctgtttcttacagcttggtgggtttcttctctgattgtcttccatcttactcgcctggtggcagaggggcttagcgcacacacgcaccctctttttttttttctaacttctcctttcccacagtttccagcctggaagttacagtcaacactgagtaagagaccagagtgattgtgtgcatgtgcgcgtgtgtgtgtccatctgcatgtgcgtcagtttcttt

SEQ ID NO: 20530 - DNA, 1184 bp, Mus musculus
tctgtgcagtttattaaaccttaaaaggaaaaaaacaaaaaggaaaacctctgtgtattcttgtcgtgagcaatactgtttcaagtgactgcagggagagaggaggaaaccccatggtctcctcttctggacaaacgtggcagtttgagttcaggctcccttaagagaggacctgtgggtgggtgtggcagaaacacttgcagctttctggggcctttctgcctgtgcgttttatttttgtttttgttttttgtttgtttgtttggttggttggtttttcaagacagggtttctctgtgtagctctggctatcctggaactcactctgtagaccaggctggcctcgaactcagaaatccgcctgcctctgcctcccaagtgctgggattaaaggcgtgcaccaccactgcccggctgcctgtgcgttttttagaagtcacccttttggcctggccaaccagtgattctgttttgtattttctgcttcattccccttgcctttctctcaaggagccccagaggctcctttccgtggggtctgttccttgtgaccccttagactctgtcttcctgtgcccgtgcttccaggccgattcgcgccagacagtggaagaaaaggtgggggcagggcccacatcttgtgaagctctgcatagtcctgctgatcctggaactcactgtgtagaccaggatagccttgaactagatcctcttgcttcttcctgtgcaaggtttggaccaccacaactgccttttcagccgagatcttagccggttttcttgagctttgactttaggtgttaaaattctaccaggcctctttgtttctgtgtttgccactgatagtaactgcagctgagtccactgaatttgactgcactttcactgatagcagaccagccagttacttccctctgggtttataatgggtgtgtgtgtgtagatagctctcaaggaatctaggtagatataatgggggtgtgtgtctgtctgtctgtctgtctgtctcttgctctcagggaatctagattaggaaaacttgctggggaaaggttactaccagagtggctgaattcctgattatttgatccattattgttattaatatgaataataaactatttattgatttcattattctttctgacttaatagcctgcattatggcatttgcttaaatgacc

SEQ ID NO: 20531 - DNA, 1579 bp, Mus musculus
ggtatagaactaccctagtgcattaacaatatgcaagttacttggctcttctctgtttagaaagcaaagggagaggaacaggacttccctgtggacttggaagacacgatagctcctcgagccaaatctgaccgggcgaggaagccaattaagtacctggaggagtccgatgacgatgacgacctcttctgaggcagaagagattgttttagggatggttttacggagccaggttagttttaaagttcttcctcctctgaatttgatttttttttttttttactaagactatccaagtgagtagagcccgtgtggccttcagctttgctctctgtaacatgctgtcgaggtgaccatctcatgggcaattgtcttctctgatttgtctgttttatgtgtgtttactttggtctctaaaatctgcctcaatttttttggatttcacagaattgtatgctcactttagcacaatagtatttatctatcatctattaaactacagtgaaaatgttttcaaaagcacttctgctgcctcctttcctcttcccacaaaataggaagtaacatggtccttgttttcagttttataggtagaattcggtcatatagaactggttagttctagtacagatacagtgctcaacctctgacgtgatgcattttgtttaagccatgagaagttgctcgtaccttttgaacatcggaggctggagaaagtcaccttgactgtgtctttatgactcagcacaagcagcaaggtgaggaaagttaggtcagttacgtagagtactgactctactcgggatgccttcccaacacgagatccctgggaggaggcaggactgctcacggttacatctccaggatcaaccaggaagtgggatccattgcagatctccataattccaacttgtgactgccaagaccttctgtgctgttgtctcttatttaagtgctgttatcaatgtcttttgtaaatatttaatatgtctgtctgttccgctaattccaactattttgtactttaataaatcttctaaacaatgcaagccatccattcctcttattttaacccatctgacatcatctcctgtagtcaggacttgttatagccatggtctgtctgctaagacggtcagcctttggcagctgagggatccaaaagagaggcactgtgacctagatgggtccagtgttacttacaatctcacatatggctgctgaggtgtccatgtcctcggggaggtatcagattagggatgtagctccattggtggagagctttctgagcatgcctgaggcctgtggaactagtactataaaccgaccaggttagcctaaaactcagaggcccaccagcctttgggtcccaagtgttggaattaaagtcatgtgcaaggccaccttgggatacatgagactctttctcaaaaaacaaaaacaaaaaagcatgtatctttaaaaagatgtctacttccattttgatagcttagacaactacttgttggactcagtaaagttatattggagcagcctgcttgatccctctaaataaaatggtgaatccaattcctttctt

SEQ ID NO: 20532 - DNA, 1166 bp, Mus musculus
cttgggtggccattgggctgtggtggcgcatgcctttaatcccagcacttgggagtcaaatgcaggcaaatctctgtgagtttgaggccaacctggtctacagagtgcgatccaggacagccagagctacacagagaaaacctgtcttgaaataataaagaagaggaaaaaaaactgtagacgacatattcctaaaacataaagttaggggctgtagagattactcagtggttaacagcactggctgcgcttggcagtagtggtgtgttcctttaatcccgtcacttaagcactggttgatctccagagtaccttggttcctttcccagcacccacgtgacagctcactaccaactgtaacttccagtcttggggatctaattctctctctggcatccacatagtacgcagacatatatgcaggcaagacattcaaacacataaagtaacatgagtgctgtggtaattaatacacacgagtagcctatgcttaaggtctgtaccctctttgcttattcgtgtatgtattcaacagcaaaagccaaattcacagtggatttagactcggatgaagatttctcaggtttggatgagaaggatgaggatgaagatttcctcccattagatgctactccacctaaggccaaaatccccccaaagtaagtattttatctaatgataactatctggattgttattggtctatttattgatgattggtgttttacacatatggagttggttggagggatgtcttctcagtggttttgttttgttcttttagaaatactaaaaaagcactgaagacccagggaagctccatgtcgggtatgtacttaggtagagttagcaggcgcgtgggagacgctcagtcagtccagcccacagcacccgccgcagagacccatagactttagcactcaggacttagaggcaggaggattgtgagttcaaagccaatctgtgcaagctctgtgccccagaaagtagaaaatttaaattcaattttattattattattatttaaaatagtctaagaaattgaaagtgggactacatatcaggaacagaccagcagggggatgttttcaattgctatcatgactgaccattttcctttctgtttgaagtagttgatcttgaaagtgatgttaaggacagtgtgc

SEQ ID NO: 20533 - DNA, 1909 bp, Mus musculus
tttttatttatttattataagtacactgtagttgtcttcagacgcgccagaaggtctcattatggatggtcgtgagccaccatgtggttgctgggatttgaactcaggaccttcagaaaagcagtcagtgctcttacccgctgagcaatctctccagccccttgatttggcttttttgaagcaatcttaatacatatccaagataagccttaaattcaaaatccttcttagactgcatcttcaggtcacaggattataaacatgtttctgcagcactcatttcttagcaccctaagtaatctcttgcttcattttcctttttagcactctgtctgccccaccaatcttgaacttgagaggattttgtttggtgttaaagcaagatctcactatgttccctgactggtctagaagtcagagagctgcctgtctttgtccaccaagtgcaggcttgtgccaccatgcccacctgtgtgtgaaaaatgacagggtcattttctaaatgatgttctttgctttctttagccctttggctcggttgttgtttcctccaaaagatgatcacacattacggtttctatatgatgacaaccaacgtgttgagcctgaatggtacattcctataatacccatggtgctgataaatggtgctgagggaattggtactgggtggtcctgcaaaatccccaactttgatgtgcgtgaagttgtgaataatatcagacggcttctggatggagaggagcccctacccatggtaagtgctctgggttggaactgtttctcatcaggcacggctgaggagattggacgctaagatagggtacaaggacgagatttgtttcagagtttagatttctttaacatttgagatgaaatatttataaaggtttttgttattaatttagctcccaagttataagaatttcaaaggtactattgaagaactggcttcaaatcagtatgtgattaatggagaagtagctattctggattctacaaccattgaaatctcagagcttcccatccgaacgtggactcaggtaagtaactattgacttcttagttttttaagagaaaaatattgtttttgttattgactgtttaagagactccttgccaaaggattattgtgttttggtttttgttcttgttttttagacatataaagaacaggttctagaacccatgttgaatggaactgagaagacaccctctctaataacagactatagggaataccatacagataccactgtgaagtttgtcataaagatgactgaagaaaaactggcagaggcagagagagtcggcctacacaaagtcttcaaactccagagtagtctcacttgcaactctatggtatgcattactttgtaagagataatatttcaaaactgttattatcataatcctagcactcgggagacagagatgaggagatccttatgaattccaaggttattctgggctatgtagtcagaccctgtctcaaaaagaaaggctgcagagctgactcaacagttaagagcacgtatacttgtacattggatctatgttcagttttcggcacccacatggcagttcacaactgtctcactcagttgagagtcaaggtgtcttcttctggcctccatgggctagtgctacgcgcacatgaggcacatatatacatgcaggcaaacatccagatacataaaataattttcaaatatcaattttaaagggtatatcaggcagcttttataagggttacccaattgactgatcatagcttaaatgttgcttttcttttccaggtgctttttgaccatgtaggttgcttaaagaaatatgacactgtgttggatattctaagagacttctttgagctcaggcttaaatattatggattaagaaaagaatggct

SEQ ID NO: 20534 - DNA, 1225 bp, Mus musculus
agctaaagttaaaaaaaaaagattgcaacctcattctctttattttatatgtgtgaatataaactcaaaattgacttgcacatatgtatgtgcattccatgagaatgcccgggaaggtcagaagaagtcatcagattcctagttgtagtcttctgtatgggtgaggacacctaaatgctggtcctattcaagactaacaagtactttttaaaccatctcttcagtcacctcacagttgattattggtcttattttccattgtttgtttgcttaagtttcccattaatttattttaacactcccttctttaatttctgtacaggtgaaaggattccgcagttacgtggatttgtatttgaaggataaggtagatgaaactgggaattcactgaaggtgatacatgaacaggtcaatccccggtgggaagtgtgcttaacaatgagcgagagaggcttccagcagattagcttcgtcaacagcattgcgacttctaaggtaaatcttaagaaatcttactagttttcttttactatatagtataaaatggtttagacctttgtctaaattatgttatgatctttttttctttagggcggcagacatgtcgattatgtagctgatcagattgtgagcaaactcgttgatgtggtgaaaaagaagaacaagggcggggttgcagtgaaggctcatcaggtgtgtacctatcaactttcccttttctaaacgtgggaaggtgaaaggggctgcatgtagcttagtataggaacttgcttcacatacacaaggacataaaagatatttccgtgactatctcgtcttttattacaggtgaaaaatcacatgtggatttttgtaaatgccttaattgaaaacccaacctttgactctcaaacaaaagaaaacatgactttacaagccaagagctttggatcaacatgtcaattaagtgaaaagttcatcaaagctgtgagtacttacttacatggaaattaaaatagaaatgtcttgtctttcattatcctctgccctatagaagcaaagattgcctgctgaagtatacttcttcagaacttctgtcttattttgttattgctgtgaagagacaccatgaccacattaactttttctccaaaaaagccatggtcaggcctgtcacaggaatttcgtgctcctggtaccaacttgttaggtttctggtgctcagacaaaacaccatgaccaaaa

SEQ ID NO: 20535 - DNA, 1207 bp, Mus musculus
ggaaagtttgtttattatggggaatatttttcctttttatggcttttccgtgtgctttattgaatggaaacactaaaggaagtaaaagcatacaggtgattgatcttcttggtattatttcctgatttttgtcctttctggtagtataattttcttttttgtttttgttttgttttttggtttttcgagacagggtttctctgtatccttggccgtcctggaactcactttgcagaccaggctggccttgaactcagaaatccacctgcctctgcctcccaaatgctgggattaaaggcgtgcaccaccacgcccagctttttctaatatttttaaatttcatgttttgttcagcgttatcagtgtctacccaggtgttagaaaagggtttctgttcccaacgctgcatggtggaaaagactgatctagctagcttcagagggagtaacggtgaaagactcttgtagatttatgtagtttattttaattattaagcattaacttaacatttgttgtataatgcaactttgtatcttttctcagagaaaataatgtaattagcatctggaataatgggaaaggaatccctgttgttgaacacaaagttgagaaaatatatgtcccagctctcatatttggacaactcctgacctccagtaactatgacgacgatgagaagaaagtgacaggtagaggactgggagaaaggaatacttgtggttcagggaaaaaaaaaaaaaccacatcctttaagctgggcgtggtggcgcaagcctttaatcccagcacttacttggaaggcagatgcaggcagatttctgagtttgcgaggccagcctggtctacacagtgagttccaggacagccagggttacacagagaaaccctgtctcagaaaaccaaaaaaaaaaaaaaacaaaatcctttaactcactatctgaggtgtaaggattccagatgggattagtgggctagagagatggctcagtgattaagagaattggctccaccccaagaggactctggttcaactgtgagcatcttagacttgtaactacatctgatgtcttcttctaacctctgtgggaccaggcatgcatatggtacactaacatacatacagacaaaacaattaaagtttaatacagatcttaatatagggataagctaaatatagtgaccaggaggcaaaggttcactgtgtagc

SEQ ID NO: 20536 - DNA, 1194 bp, Mus musculus
aaataaataattaattcttttttaaaaaattttttattcatttatttatttatttatatgtgtacaccatagctgtcttcagacactccagaagagggcatcagatttttgttacagatggttgtgagccaccatgtggttgctgggaaatgaactcaggacatttagaagagcagttggcactcttaaccgctgagccatttcaccagccctaaaaatttttttaaaaaactgagaatgtagcttggtggtagtatatgtgcagtccagacacaggactacaaaaacacgaaacttagcagatgtggtgagtggcatacacacttcattccatcaggcagaggcagatagatctttgtgagttccaggccaattagaattatgtggtgagaccctgtctctcaaaacaaggcaaatttacatatttgctctgaaccatttcaaaataatttgtagacatgacacttgatcatgcagtcatggttgataaagtgcaggacgtcagccagcatttgcagtaatgttctggtcatcagaaagatgttatttcttttttgatgatgctattgggaggggttggttgttcgagacagcgtttctctggctgtcctggaactcactctaaaccagtctggccttgaacttagagatcttcctgcctctgcctcccaagtgctggaattaaaggcgtgcgccgccactgctagtgaaacagcaagccagcagccagtagtagagagtaatttggtatttctggttttaaatgttagtgttcctttgtgggtagcaggatgcctggttcacattttttattaccttgatcagtgctgatgcagactgtttaaggctcctgtagggtgtatgtaattgatgaatgcacatacagacttgaaaacaatcttttcaagaatgctgacctagtttcaactgatagtttttgttttgttttgtttttgtttcttacagataatattaaaccagtattatttgtattctgagaattaacccaaaataactaagtcctagtaactgggctgagcacatgaatcagtttagagaacttggtgttcttgtacaggcacctgagtgtggctgccagcatccacattgggattggggagtccaatgcctctaagctatgtgggcacttgtactcatgtgcaaataggtacatacacctattaaaaataaaaa

SEQ ID NO: 20537 - DNA, 1346 bp, Mus musculus
tgttgccttgttttatgtgacctaaaacttttttaaatgaaaaaaaaatgtggttttttttttggttttaatggtgttatgtggtctgtgtattaattatttacttttccgttgatacaacatgaaggtctttgaaccctcagcatcatagcctaatgccagccgctcacctttcttagctctcaacgtctgaaacctcagagctgagattaatcaagacacccatcattctctgagaactaccttggctgctgcagaatcgactcttccaaatacctgccttcagctcacgtggtgctcaccaaagccatagctttaaacccttccagcccatccacagctttcccagtccctgtcttgtgtacttacacagagtgccctcttgaaatcatgagggggtctcttcactcaccctttctatgtcccatgtcagacaccaggagttctcttacagggtagggtgtagccagaaactggtgagacacagatcacagagatgcctctgggggcactgggggtgggggagcagggggagtacagttgttctttctgtggattccttgttggtgagagctgcgcctgcttatctagagtgctgttcagtgtagtcgatctgggatgtgttctgggaaattcatcctttttgtacaggggaaagaaacacttttttttaccagattggctttccaaagacacgatagatggcagagcttaaggaatggaatgttcttataatggactacagacttcaaagtgattggcccattccaaaaggaaaatgggaatgctgttcatccatgtgagcatacttcacagtgatgaaaacctcaagactcgagatcccatagatcagagccgaacctacttttttgataacccctgtagtggtcttagagactagaaacaagatagtttgtagtgtgtgctccctaaaatctagaatagatttttactgaatagtggtatatatgatggtatatgtttcttaaaggtccaaacataataaagaaattaagacaaaggtctcagtgtttttattgcactgtggaagataatatgtagacataatttggtcactatgatacagggacatcatggaatgatccatggtcataagatgtcacttttaggaaccttgcctcatgaactgtcagtatcaataggactgaagaaatctcagtagtgtgcaagaagtgtggccagtaagtgaatagagcctgtgctcatggagagacggcacctgcacccacacttgagtaactgccggtatagacacagcattgagcagttccctgagaggaagcctgatgtgtggggtcatccttgggccagtttttctgtgattc

SEQ ID NO: 20538 - DNA, 2605 bp, Mus musculus
tatgaacttaaaagttaaaattttaaaaaggtaatccaatcactggtcatattatttgaagaccttttaaaagcaaaaattagaaatgattaaaagaatacatgggagttcgatcggtagcgggagcggagagcggaccccagagagccctgagagccccaccgccgccaccggcctagtcaccatcacacccgggaggagccgcagccgtttccgccggccccagtcaccatcaccgcaatcatgagcagcgaggcagagacccagcagccgcccgccgccctcagcgccgccgacaccaagcccggctccacggacagcggcaggggtagtggcgctcatatcggcggcgcccaccagcggggacaagaaggtcatcgcaacgaaggttttggggacagtcaaatggttcaatataaggaacggatacagtttcatcaacaggaatgacaccaaggaagacgtatttgtacaccagactgccaaaaagaagaataaccccaggaagtaccttcgcagtgtaggcgatggagagactgtggagtttgatgttgttgaaggagaaaagggtgcggaggcagcaaaagttacaggccctggtggagttccagttcaaggcagtaaatacgcagcagaccgtaaccattatagacgttatccacgtcgtaggggtcctccacgcaattaccagcaaaattaccagaatagtgagagtggagaaaagaacgagggatcggaaagcgctcctgaaggccaggcccaacaatgccagccctatcgcaggcgaaggttcccaccttactacatgcggagaccctatgcgcgtcgaccacagtattccaacccccctgtgcaaggagaagtgatggagggtgctgacaaccagggtgcaggagagcaaggtagaccagtgagacagagtatgtatcggggttacagaccacgattcagaaggggccctcctcgccaaagacagcctagagaggttggcaatgaagaggacaaagaaaatcaaagagatgagacccaaggtcagcagccacctcaacgtcggtatcgccgcaacttcaattaccgacgcagacgcccagagaaccctaaaccacaagatggcaaagagacaaaagcagccgatccaccagctgagaatttgtccgctcccaaggctgagcagggcggggggctgagtaaatgccgacttaccatctctaccatcatccggtttggtcatccaacaagaagaaatgaatataaaattccagcaataagaaatgaacaaagattggagctgaagaccttaagtgcttgcttttggcccgctgaccagataacattagaactatctgcattatctatgcagaatggggtttttattatttttacctaaaaatgtctctttttggtaatgacaaacgtggttttttttttcttttttaattttttattaggtatttagctcatttacatttcctttttttccattttttattaggtatttagctcatttacatttccaatgctataccaaaagtcccccatacccacccacccccactcccctacccacccactccccctttttggccctggcgttcccctgtactggggcatacaaagtttacgtgtccaatgggcctctctttccagtgatggccgattaggccatcttttgttacatatgcagctagagtcaagagctccggggtactggttagttcataatgttgttccacctatagggttgcagatccctttagctccttgggttctttctctagctcctccattgggagccctgtgatccatccattagctgactgtgagcatccacttctgtgtttgctaggccccggcatagtctcacaagagatagctacatctgggtcctttcaataaaatcttgctagggtatgcaatggtgtcagcggacaaacgtgttttttaagaaaaaaaaaaaggcctggtttttctcaatatacctttaacggtttttaaattgtttcacatctggtcaagttgagatttttaagaacttcatttttaatttgtaataaagtttacaacttgattttttcaaaaaagtcaacaaactgcaagcacctgttaataaaggtcttaaataaaaaaaaatacatggaaaaatattcaacaccattagccgtgagaaaataccaataaaaagttctttgagccgggcgtggtggcgcacacctttaatcccagcactcaggaggcagaggcaggtggatttctgagttcgaggccagcctggtctacaaagtgagttccaggacagccagggctatacagagaaaccctgtctcgaaaaaaaccaaaaaaaaaaaaaaaaaaaaaagttctttgaaattctaccacattcctgtcaagaacagctgtcatcaagaaaacaaacaataacaagtgctggtgagaatacagggggagggaggaagaaaacctttacacacagttaatgggactgtaaattagtacaagctgtatggaaattagcttgtaagatctttaaaaaaaaaaacctaaaattagaaccaccatatgagcaatctaatcgactatgcaatacataaaacaaagaagcagcttc

SEQ ID NO: 20539 - DNA, 1750 bp, Mus musculus
aggcgtttaagaaggtgggtctgctgtggagagagcacgttgtatggtctaccaagggagagggtgcaaacgtcaagggagtccgtgttgatggcatggcctcttagatgctgcatccttttgtccttgcagaaatttgcctgcaatggtactgtaattgagcatccagaatatggagaagtaattcagctacagggtgaccagcgcaagaacatatgccagttcctgatagaggtgagtttaggccgccctcaatgcattatgggtttcctgaatttctaatccttacagttgagcttttaaatacatgtagacattcccactttcaaacagtacttgggggtggcatagggaagttttagtaacagtggtcaattgaaccattgtgtctactgggatagactgaagtactcttctttattgggactccttgcaaggtgtatatgggagaatctgttgacgtcatgtaacctgtccctctcccttgtcctctttttgcagattgggctggctaaggacgatcagctgaaggttcatgggttttaagtgcttgtggctctctgaagcttaagtgaggatttccttgcaatgagtagaatttcccttctgtcccttgtcacaagtttaaaaacctcacagcttgtataatgtaatcatttggggtccgcttttaacttggactagtgtaactccttcatgcaataaactgaaaagagccatgctgtgtagtcttgaagtccctcatttaaacaggttgagcagtaagccctggcagtgtccaccctggaacaaagcaatgacaaggtttcagccaagccaagaaccccaagatcacaggaggctatgtctgaccagaggctccttggggctccctggacagagtcccctgccctaggagagtgtcaccacttgaacagaatgggtaacactgccccagctatgtcactagagggagtctctggccctggtatctgaccaggtagaattcagaaagggctacctttccagagaagtcatggacatttagttcaccaccagggtggtcttttgaagcagatctatcctagccgggaggtgttgcgacatgaagggtgaggccagcccggaacaaatgccaagctggtgccattggctgtgtggctagctgtagaggcttcaactcagtacgagccagtgccatgtgaaggaacaagctggtcttttggttttctttccccctccagtttcaatgttatgtaatgtatttaaatccttatttaaataaagcttgttttcagaaacgcctgatgtccagattgcacttggtcaagctacatacagagagggatcacaaagacaggctcagttgggaagcatttaccagagctgtgcccatcacttatcaacacagatggaattcattctggagctgatatgcttacaaagcagctggagccctgtggctgttgggctatcttagtaacgtgggggggggggctgctttgtaacactcagcttgaattctagggcaggattaaactagccatgttggattttgtagtgaatttgatcctggggacctatatgatagagaactggctctaaaaggtggccgcctgaccttgcaaagtattgaagtgtagggagaatgaggatccccaaatgatggtcatcctgggtcagcatttgggaagtataaagctgcctgtagtctagtccttgtgtttagtcctgcgttggaaatcctgagggcataaggcaagcaaagttg

SEQ ID NO: 20540 - DNA, 2254 bp, Mus musculus
actttgcatacgatttacatactatttacatagttgcctccagtcccccttggctagaactgctgcctcagtgtttatttatgcaaaatctgcttacaagtccagctgtccgtccaccttcttccttggggggctgaactgggaatcagggttgggctatacacacctttgtacctcaacttcctatctctgccctatccttcatcccgaattcctctacccaccaagactccccaaccccgcagcagcaaacaaacatggggggcgggatcctggagcagcagcccagagtgccgacccaggactctcagaggctggaggaggacagggccactcactctcccagtgccagggaggaagaggggccttctggggccacctaggcctggaacgaaggcctctgccagcaagggccacagttggaccattcccccgggtgagtgtggggctcctgcagggtggtaggggcgggtcagggttccctcagcccatctagaaaccccagctttggggagctacgtgctctgagggcaggcctttccggcactccctctgaggagctgtctgggaaatcagatgacttagcatcggatcttcttttgtgttagctcctttcgtcttcatggccctgtgggtgggtacatgtgattgtgcaccatttattagaagaggaacccgaagttcagagatctgagatgacttggccaaggtcatactaggagcagatctgagcccgtgtctatgagttctgaacccctggcctggtctcactgctgtccgcacctcctgctcccatctttgcgttccacctgaagttttggcagcctccttcagtcgttctgatgcccccacccccgttttggggtgcaccaatgggtggaacatccctggctgcggcacagtaagatggcgcaggttgtaagctgggtcagcacttccgtggctgaccacgggggacctgagtgagggccagtggtggttttctgtcgtctcctctgtcagggccgactgggtttgagggtggtctggctcctgactcccatccacccccttctcttcccgggcttgctgtttcccagcagccggaagaagccccacagacagcttgagaccccctccttctgctgcctggccaagtcccacccttcctttctttcctctgaaacaggaccctaccccccgccccccccatgtctgccagaagttctccctctcctgtcctggtagacctgtctcctcttgtaggacaggctgaaagaaccccggtccctcattctgaaactggggccaaagctgtggctgctggaaccccaggggtggaagcaaactgggcagattggctggctaccagatccagctctgagatgggtgtgagtgggcgtgtccctagggtaggcagttattgggggggggggggtcctctctatcccttgaacctctcacgtaaagggacttccccagtcctggttggctttttgaacctggtccttttcgctcttttttacccttctccgtttctattactgtgtgtgacgtaaagtgtatctgcgtgagggttgtgtccctctgcccagtgctgtctctgtgtcctgtggcctgtgagtttccttctagagttctgccttcctccacatccgtgctcacacagagctgtggcctcagcgcctgccctgcttctgcagcgcttcatagtcttgtagctagtcagcctttgtattgatgtatgtgccaatgtgggaaataaagaacttgtgagatatctgccctgtctcagttgtgttccttagggatcatggtgtgtgtgtgtgtgtgtgtgcctgtgtatgaatgtgtgtgtatgtatgagtgtgtgtgtatgcctgtgtatgagtgtgtgtgtgtgtgtgtgtgtatgtatgagtgtgtgtgtatgcctgtgtatgagtgtgtgtgtgtatgcctgtgtatgagtgtctgtgtgtgtatgtatgagtgtgtgtatatgcctgtgtatgaatgtgtgtgtgtgtgtgtgtaggtatgtgtgtgtgtatgagtgtgtgtgtgtatgcctgtgtatgagtgtgtgtgtatgagtgtgtgtgtatatgcctgtgtatgagtgtgtgtgtatgagtgtgtgtgtgtatgcctgtgtatgagtatgtgtgtgtgtatgcctgtgtatgagtgtgtgtgtgtatgcctgtgtatgagtgtgtgtgtgtgtatgtatgagtgtgtgtatatgcctgtgtatgagtgtctgtgtgtg

SEQ ID NO: 20541 - DNA, 1113 bp, Mus musculus
attattatggactaggttttactccgtgttttaggctggcctgaaattcattatgtagcccaggctggcctcacgtctgtggcttttccccagccttagtgaaatcatcatcccagtgtcattttttttttttttaacactggggacagaacctattgcacctatgagtgctagggcaaggctaccattgaaccacatccctagccctggttttgccgtctgttacattgagatagtctcgctaaactgtccaggctagcctttaacagcctggagtgcagacatgccttgaatttaggatcttcccatattagccccctatagacctgcacagctggagttggggtgggggtcctccattatatttgccccttgcttggctaggccatgctcctccagctacttctaagcaaatgaggaaaaaggccatttttttctggggtcgtagacagatgtcacaatagcacccctgaacttctgggggaggcaggcctgtcaagcacctgacctcggtgtcctcatgtcccacaggcgctgtttctcacctggaaagctctcaagagcagactgtgggaggagacagaaaagtacctgagccccgggggccggcctggacttcctgctgaacacgcgtgctcccgtgctccagagagttcctccatagggattttgggatggtgtctgttcctgcttttctgtcctgggctggggatccaggctcagcactttctccccgtccccactatggctatggccactaaagctttagactcagcctgtgtccctgcacagcaattctctctgctgactccagctgcctggacccccacccccacccccacccaggccttcctttgttttttttcgggggccagttttctcacttgacctcctgggatatccaagacacaggttcaaggccccaacccctgacacccaaagcttcttttgaaaagttcagggaccttcttgggggtcggtggggagagcggagacattaagtgcccctgccaggacctgcccttcccttcaggatgctaagtttttgctttgaccctcccaaggggggagctcttggtgacgctccctccctctcacatcactccacactgg

SEQ ID NO: 20542 - DNA, 1207 bp, Mus musculus
gaacctcctggaactggagttagatatggctgggagccaccacgtaggtgctaggaatggaccctgtgtcctctgcaggagcagtatgtgctcttaatggcagaaccattcctccagcccctaattctttttttaaagactggaaatatagctcagtggtaaagtgcttgctgaacaaatatgtggccctacgtttacttcctagaactgtacttcaataaatacatattctgctgcagacatttttgtaatgataggtgtcagacatgagtcttttaaaatcaaatcatgatcttggttgtcatagagttggatgagctaggagggcctcatgctctcaatgggatgatacagacaagggcgatgatggtcccctaagaccctggttaggttcagaatcatgagtgatgccctgtactttggagaaacatgagggagcttggagccacaccttcaaggcttgccttgctcttcagggtcccagtaaaatctcctgtagctcagtcctatgtcatttggctttcaggtgacctggaataccagatgtccacaacggccagagccaagcgggtgcgggaggccatgtgtccaggggtctcaggcgaggacagttctctactgctggccacccaggtggaggggcagacaaccaatctgcagcgcctggccgaaccatcccagttgctcaagtcggccatcgtccatctcatcaactaccaggatgatgcagagctggccacccgggctctgcctgagctcaccaagctgctcaacgatgaggacccggtctgtgaagggcctggaggtggggtgggatggagctggctgtcctcagagggaggggtcatctaaggatgccacggcctttgccttccttccctctgtggaggaggagcctgaggctatctgctcaaggtctcacacacttcctccaggtagtggtgaccaaggcggctatgatcgtgaaccagctgtccaagaaggaggcatcccgccgggctctaatgggctcgccccagctggtggcggcggtggtgcggactatgcagaacaccagtgacctggatactgcccggtgtaccaccagcatcctgcacaacctctctcaccaccgagagggcttgctcgccatattcaagtctggaggcatccctgccctagtccgaatgctcaggtacttgtttctcggctgcatgggagccagggg

SEQ ID NO: 20543 - DNA, 6024 bp, Mus musculus
cgacagtggcaagatgtggaatctttaccgcttattgacaattactgttttttccagatgtctgtggtcaattcaaacttttatcagacagcatcatgctgtcccaagagttactccttagaaaatgaagaagcagtaagaaaaattgccggtcaggtgtctgatgagatccttgaaagcttgcctccagaagtcctaagcatcgaaggagcagccatttgctattacagagatgatgtcttcattattggaggctggaaaaacagtgatgatattgacaaacagtacaggaaagaggcctaccgatactgtgctgagagaaagaggtggatgctccttcctccaatgcctcagccccgctgcagggccactgcttgccatgtcaggatcccttaccggtacttacatggcacacagagataccccatgcctcaaaatttaatgtggcagaaggaccgcatccgacagatgcaagagatacatcggcacgccctgaacatgcggagagtgccaagttcccagattgaatgctgagctcaccagcgtttgcagctgaaaactgttctccctgttctgtgaggcggggatgcctggactgttacttggaaaagtatgtcaatgacttattttctacttggacttattaccctatatacaagaagtatagttaaaaaacaaatagaaactcagttcaatgtggtaatttttgttaggttgcagtcctgactttggtttgtgtttgtgtgctggtaaataagatcttattaaagagaagtgggggaaagcaggtctagttacttggccttttttctgccaaccactaactcctttgtcttagggacttacgtggggctctaagcaccagtgttatttgcacatttactttgatgctcctttaagttttttatggattgtttgttttcagtgataccaatttatgcgttaagctctcatctgtaggagagacgtgtgcaatagtgaaactggatctgaaggtaaagcacaatgtttcagcaaggatgatctcagaatggagccctgatgctttgctgtatctgcaaatgctggttttgttcattggaaagggtgacaatgagaagtttgtgagtggcacgtcctctggtttgtttggtttctttcacagctgtttatagacttgaagccatcatcctgagatgatagttgggaaggtattaatgtttacctggttgtctagttgtctaaagagggagttacacaggtgaagagaagtgctcagtgtagctgagaaagcaaatgaacaaacatttgaaacactttgaatggttgtgttgatgaggatgcagtgtgccgtgacaatcaacacaggatgccttcagtttgttttttgctccgctgaatattatatagactcttcatcatttctttctacaagtaaagctttcaaatggcaaggaagtaaccgtttagaaaataccgctaagagaagccatgttatttctggcccctgattgttatattttacctagttgccctagacttctactggaacttagagcctagaatatcaaatctgagtacatagttttggcttttaaaattttaaggctttgacataccacatttaacaggaaactatcaaaatgttacataatcaattcaatgtcatcttgcagaaaaggtttttagtatgtacatatttttattgcattccctaaagtcttttttttttttttttttttttttttgagacatggtctcactatgtagccttggttggcctggaactcactaggtagatcaggctttggccatatatagatcctgagggacaagcttccaaggaccaagaagcagtttcagcagcagctgtttctactccctccagttctctgcttttgttgagctgtgacaatgatgttggacattcacttcctctaattctttatatttattattgttttctagagctgctattttatagttcatgttcatgatcttttaatttttcagttggattaggaatatctttgcgccccattctctcttagtatctgcattctttgttgcatatggcattggaggattaaccattttcttttgagccttgtataggttgacatattgcttttgcactgtttttgataataaattcctactcagtacattggatttttttgttcatatgtagatacttggaatatacaatttcccatttttctaatctggatctaatttgtacttagtctctgaactcccttgtgcggggctttagacttggcactctcacccttaagcttttgtgggtaatcttgatcttgttctgtgactatttcaaattttgatatcatttaattctagatacagtattgataaatattgatatattgatagatgtagaaatattttttctcctgtttttgttttgatgcaaatctcaaattagagagaccttccctctcactttgtatgatctaacctgtattcttgctgattttatctttgatgtttttgttttttgagacaaagtctgttatcttggctgacctggaactctctttgtagaccaggcttgtctggaattcacatagatccacctgcctctgcctgggattaaaggcatgtcctgccatgctgggcttgatggctctttagtacactaatttccattttctacttcttcagtttgttttgtaagtagtagttcatggtgtttagtttgtctttcatgtaaattgactgtatctgggacctttagaaaagagacattagcacctcctcagttactggctcagatgactctcattggggtcgtcctggctcttctttcttttctgattagtcattccttccaacttacctgtagatattttcactcccatcacatctttctaaacactgttaatgctggattggctctgagattgtgtgaatattcttcgtattaagaaaggatttccacattgatatttgatataaccttgatgtgatctattgtaatcagtccaaaaacatcttgcataatttgattcataagagcattcatgaaggctcttctctccttatgtcaatagcttgtacataagcataagttcagctataattttcactgacagccagtgtaatgcagtctttgtttctttagtattcacttcatgttcaaaggttttgtagattggagaacacagttgctttgagcatccatgatgtttgggtcagcactgttccagtggcatagaggcacactccctttttgacactgtagagtcttcatcagatctgtgcagccactattcaaggataatcatacacacaagcaatatatagagcagataggagtacagataattcccaagaagctgcatcactgaaaagtcccatcatgtcttggactttgacctcatgggagtcacattaaggaatagccatttttctgactttatatacactcctgagctttttatgcaagttagcattcaagctaaatctttcaacactcggtgtagagagaagacttctgttttaggtactggagagatggatcagcaattaaaggaacacttgctgcaatgggttcccagggcccacttcattaacgcagctcacaagcctaaagctaccttcaggggatcgggtacctttggtacctgcactcacacgggcatacccacattcagacatacatacacatgtatgcataattaaaagtaagcttttcatttcaaaaaggctcttgttgaagttggttatggcagtatttacctgtaatctcagcatttgggaagatcaggagttctgagccagactagttagcatacatgtcaacaacaaaagtgtaactaataataagaataaaaacacataaataaaaaattaactcctgatagcactgtaaatccaatttttttttctatatgaatgtctttaccttctcacacattctggactattctgaaaaagtttaagtactatcatctgtgcctcccttattccattagagttaactttattatatgatagaatatcagaaacacaaccagaaactttggctgtttactataacactaaatgctcttggattccatactgataacttatttccctggagttaatgctagtgttcttgcctaggataaaggtttttaataactgtattggaaatctgctttaaaaccattttgagactggagtgagtatgggaaactgcaagtccctttccacagaaaggttctattctcccctttccctaactcttttgaaatgttcatccttggatttcttttggttggtcggtctgcagtgctgggaactgagcgcagggccttgtacatgctagggaaacactctaccaactgagttgctcccccagccctttctgtagctcccttcattacaagtctctgaatcctaagaggcactccttagttgtaaactaagtctgtgcaactaacagtctttgaagctctgtgaaggaagcttgcctttctctcagtccacaagtcatttaggatctcatcaggatgccagctttctccgggaaaagattcatgtattttgattttggctttttggtcccagagttgtattttgggacagtcaccattaagttgttattagagccatctttgtgttgtcttttcatttcatggcagacagtatgactcctaacttgattgaaaccactgtctttttggctcagcaggcagcctaggccctggctgaatgaaggggtaagtccttccttgcatgatggtgtgcaggtttcctgactaccaactttctaattttcatatgtgaattcacgtgtgtggcttcaccaccataacttgcctcctaaatacttttaacttgttaggaaggaaagaacctagacttgcttaaatctgttcaaggctgacattctgaaattttaaacggacataacagcatttgtaataataatcgtgcaggtctaatgtggctctttgggaaagaaatttcttttatgaaaacagttttttttaaagccagctttttaaaagcttattcaagtgaacctttgttgtgtagcttttgttttcttagctggaaaaagatttgattacaccaaaaagtaagggtggtccattattgtgagtaaggctaactttccacattataatgggacccttcctatcttcctttcaaactgagaatgtcagtcatgaacttttaagcggtcatcacttgcagctgtttgcatgattagtcttgtgtatcctgagagctttgcttttctgtgccagttcaaaataacatttttgctaagaacatttaaaattaactgatatcagttttgttttgatttacctggttgtgtgtagtatttccaggaccaaaaatttaaaactctcagtctaaaaagccagagagagcatttctgtgctttaatcctgtcacaactagtagacaggttcttgtgcacaccttcccctctctgactgcagcatgtgtgtgtttgaaatagttccttctctgcttcacgattctagtgtcaacactataagtagactggagctgtgttacatattttagctacacagactaataaaatacacaggaccttgaactaaacttatgtgcaaaggccatattagtcacgtttcgtgtctttgaacatgtatggtgttgtgaaacgaatattcttctacactagaaaaatccggtgcttcaaccttagaatatttgagcagcaattcagtctgttcttagccgtcaaaccttttggcacagctcatcatctgttactttcttgagaaaaatcgattttgttgttttacttacagcatatgttctggtgattgaaaaccaaacagttatggagggttgtaatacaacaatagtatgtttacaaagtggtcttttgctgcaaggacttcacttagccaaattactgctcactgcaaccctcagagcttcccgcttactctctgacccttgctaggagggcgggaccttgaagcacctgttaatcttccccctcctgcttcctgcacttgtgaaattcaatgcttgctaggtgtttga

SEQ ID NO: 20544 - DNA, 1766 bp, Mus musculus
gtgtgtgtgtgtgtctgtgtctgtgtgtctgtgtctgtgtctgtgtgtgtgtgtgtgtgtctgtgtgtgtgtgttgttttatggttttcttatctgcccctattgctgagggttaactcctgggaaggccttgtgcctggtaggcaaacatctcaccacagagctacatcctcaaccctgtgtctacattttgtacgtcaggaagaagttccctcccattttccgacctctgccatggcttttgaaactaataacagacatcttgactccattttagggcactaccttgaccagaagaggctgaagcaagggctgtatcgtcacccctgggatgacatttcctatgttcttccagaacacatgagcatgtaactgagccaggagccctactgtaggaaaaggaagacaaaaaccccctcctcaacaatatagtggacagatagctggaagcagagtccagtataggctgggcctggagcggaaatagccattgatgtgcaggcatggaaggccgacacccacaggcccattcagtccacacaaagaagcttagtattttttttatatatctctctatatataagcatagaaatttaaaaccaagccaatacctgtgacatttgctctgctacctgctgtatctattatatggaaaagtctcagcaagcactgtcagaatagtgttcttctagggccttatgatgttgctttcttttttttaattagttaaaaaatttatttttcctctagaggaagggaatgcaagttttaagattttaagatactatctgtaggaccactgtctggtatcccatttcccgttcagcttcacacaacgtgaagaacactgtattaatctgatttttaaggatcttttttttttctatgttatgtgttaagggtttatttagtatcccactgaaatgttccatgttacagaccagtgtctacttatgtcaaggggaggagggctgggaccattgtatccttagccattgttgcacatgtggtgtagtaacttaaatgtcaagttgtaacatacaagtgtttaaaatggaaacgcaaagcaaaaagctgtgaaatgtcttgtgtcagtgtcctctgtgttcatgcagccgacttgtctgttactgaagtgtgggtccaaagactcacagctgttctgcatctgtaacccacaaagattctgggcagctgccacctcagtctcttctctgtgttatctatcatgtttgctttaaataaactagatagtaacaatggcgtgatgctcttttatgttccgtgtcctctgcttttgggacaaagctgtcctggaacttgtagacctctgcgtgcaccagctatgcccagctcttggctttatcattttaaaatctgcctttgcctcttgaaaaggaagataatgaaaaccccagtatgtattcagtgcccccaacccctcaaaggatataaaagccctaaaggttaggcttggtggcacctttaattccagcacttggaaggcagggataggcagatcagagttcaaggccagcctagtgtatgtggtaccttctaggctttaggatatagagagcctgacttcaaacacagaaaagactgatctggagaaggggcttggggggtcagagcatttgctgctcatcctggggtgctgagcttagttcccagaaccacagtgggttgtctacaaccatctgtaactccaactgcgggggatcctacaccggtggcctcgtgtgcacataccctgcacatagtta

SEQ ID NO: 20545 - DNA, 1482 bp, Mus musculus
atccgaaaacctgcctcattcatgaccagcatctgtgatgagcgagggcaggagctcatttatgcgggcatgcccatcaccgaggtcttcaaggaggagatgggcatcggtggtgtcctcggcctcctctggttccagagaaggtgagacacatgggcaggggtgatagggcactgggcttagggcagattcactacaattttattttgagttagcttttgattgttgcacattcagaaaccttttatgggctggaaagatggcttggtggttagtaacatgctctacggcgtttaataactgcagccttgcacaggaatcaagaagggtttggcttgggattggtggtggtagtatcaggctacggaggaaagtgtgtccttgtcattgtagctcctggatctcgttccaactctgcgcctctgtgtgccctcctttaggttgcccaagtattcctgccagttcattgagatgtgtctgatggtcacagctgatcacgggccagctgtctctggagcccataacaccatcatctgtgctcgggctgggaaggacctggtctccagcctcacctcagggctgctcaccattgtaagtctggccttcctgggaggcagcagctctggaatcatgctgtctaaatgcagcaggatcctaggagcccagggtaaaaaccccaggccagattctgctcagggcatcctgggatggtctgcagggctgggaaagccatccccctcagcagtgttgctttgtctctcctacagggagaccggtttgggggtgccttggatgccgcagcaaagatgttcagtaaagcctttgacagcggcatcattcccatggagttcgtcaacaagatgaagaaggaggggaagctgatcatgggcatcggccatcgagtaaaatcggtaaactgaggcatctgtggaatgagtggtgataggaggcctggagccatggcatcacagttgagagtgcttgcagctcttaaagaggacgtgtgtttagttcccagcacccacatggcagcttacaactataactgtaacaccctcttctggattctggccaccagcaaacaggtggtggacacacataagtgcagacaaaacacagactttcaaaaggagcaagaaacactcatgctcttgactcccggtatgcagagctctggatctatagaccgatgccaaaggcaaggtgactctcccagtcatgctctagattgatggccctcagggttctttctcaggtctttcagctttcagcttcagttttccaatcgaccttgtaggagaaagatcaggaagaagtgtcaattaccttctaccagactgcacttcctgtcacacagatctgagggaccctcagcagccatacggtgtccatcatggttagccatggctgttctgtcattcaagctaagcagcacttgaatgacagaacagccatgggcttgcggggggggggggggggggg

SEQ ID NO: 20546 - DNA, 1201 bp, Mus musculus
ttatcggtacagattggcttctgggtgaagcggaggtggaatggtggccacctaggagatagtgaaagcattttagaaaagtagttttcttcatgcaaagctccagaaagtgacaaaaagaagccattcttgacatctcattggcaaagacgagaccgtcccatccttccattttcctaaagttagtgtgcatggcaagcaccccaccctcacctgaattggtaccaagtgctagtttccagcttttcatcttaagtgaagaacatgccgggtgcggctgtgcgctcctttagtccagcacctgggggacagaggcagggggatctctgagttgaggtcagcctgatctacatagtaagttccagtcctgcagagccacatattgaaactctatctcaaaaaccagtgaaggagatgcaggaggcagggtcacgtggagggtgtgtccctcaggccagaaagggtgtgtctagcagaatgtacttgtgttgagctcagtgaaaggtgagcagctaggtgaaggtgctgcctctgtgtagaaggaaaagcaagggccgtgccccaaggaagccagctaagggtatttagaaacagcccagacccgcaaggcaggcatggtgctgggcacagttgacaagtgggagaggggcaggctgggatgcaggcgatcagaagtgcgcgcttacaggcttctggcaccaggctgccattggcaccgagacttcctctcctgtcaacaggtgatcttccgaaagactggtttgatggtgaaacttttggcacgtgatctgtagtagatgaacagtcttgtcctcacagtacccagcattgggcaagactctcaagcagcctctgctgtgccctgcagtctgggcattttctccaaattgtgaatcacgagcctctttcttttcttgcagggaagaccactgggatccccatccatgtctttggcacagaaactcacatgacggccattgtgggcatggccctgggccaccggcccattcccaaccagccacccacagcagctcacactgccaacttcctccttaatgccagcgggagcacatcggtaggtgccagccttcctcccaccttaaaggaaggacccatcttgccaccctccactcccaccccccactgccctacacaggacacaatgttcctctcctggcatttagggagataagagactaca

SEQ ID NO: 20547 - DNA, 1168 bp, Mus musculus
cagtgccaaactggatcttctttttcctgcagctttgtgatcgtcctccaaaaatgttgaaaggagaggttaaggtgcaaaggggagaagccaagggtaccagggtctccaaagctccggcaaaggcctggaggaaattatgggcaaggagtccagagatgaagggaaggcttagtttgcagcaaaacagctagagcaggtaacagagggacctcctattgttgggatgagaacttgaaggtggaacccattccagggtgggaccacactgagccagctaaggaggttgaggcctgtctttgcttgtcgcctagcagaaggtagcacacagatctccttggggtgaatgctttgtgttagggtttagaaatgagactatagggcttgggtggtcccactcctggatgaggccttctgacccgcccccctgccagttgggcacccttaccagcttcacgctgtctttacttgcaaggcggaggagttctacgtgtgcatctatgctacccgggaaggagactacgtcctgttccaccatgaagggggtgtggatgtgggcgatgtggatgccaaagcccagaagctgcttgtgggtgtggacgaaaagctgaataccgaggacattaagagacacctgttggtccatgcacctgaggacaagaaagagttgagttctgagagggaacggcgtgggcacaaatggggacaagaagtccagtgtgacacgggagaccagtgcactggactcggtacaggagagagaaagcagagtgggcctccctgcttgggagccacgtgtggggggagggtgcgggcttgcaatcagtgtgcagtatgccaacctcatccctcacctccttgcccctgtctggctggtgccttctctgtccctgagcttgacagcttctttccgcctcagtgtttgaagagtgacagcctaggaaacagggttggccgggttggacagtgggggccaaagggtcaggagtggagacatgaggctgggctgtcagcaacagtcagcctgctggaggccagggagtgggaatgggagtggggtgcccagtcctgcactgacgagttaactggccttctttccctctccctcctagagtcctggccagcttcatctctggtctattcaatttctacgaggatctgtacttca

SEQ ID NO: 20548 - DNA, 1543 bp, Mus musculus
catcttcacggggtactatgggaagggcaaacctgtgcccatacatggcagccggaaggggggtgccatgcagatctgcaccatcatctgagggttcacaccgctgtaccactgtaccactgctgtgggtggacacagcaacatgccttccacctgatttttaagattttttttttttttactcaaagctaacgtacctgtaactttttaggagtctataaaataactaccagttccttgtgcccaccctttcttttcctcttaatactcagctctcaacacaggcgggtgggcagaggaagataccattcaggaacctggaccagaggtggtaataaaagggctgggtcattgggcctgcagcagcatctgcccagatgcatccaagaacttgttaaccctcccttagcccctgcccatccaaagctgggcacacgcctcagagctgccacatgctagggacaaacgctactgccacaggaaaacagtggtagcttagagagggctcagatccctgggtgccagttttttaatcactatagcccttgggaaggcttgggctatttactgggcggtaaaaggggtttacctctcacctttggtcattcctaagttcctatctccttcacactgtacctagggtgatggtttcggtcaggccatctccagcagcatgtctctgctgtgtggatggaggccaaggtcagaaagatgccccgagaagctccagctttgctttctgcccagcccatcttgcctgcatggtgcctctgggtctttaaaggagggtggtaggtaccaagaaccagtggaggggaccctgagctggcaagagtaagccccatctcctgctctggcaaagcctggctcctggagtacctcactctgccttctgctcagtaacaggaccttgctaattgggttgtcacccgagaatctgggatgtatgctcctaccctcaccctgtgttgcccacctcagccaccactaagactgatactgaaataaatcatgttaatcccagctgtgtgctatcactcttggccttctatgtccagcccagtcttccctggggttagggctgcgtacattaagaccagctttgtcccacagcttggggccatcggtcctgtctcccttctgctggctgggcacagctgtgacgaggctgggtagggcaacagtgttggctttcatgaagcagaaaggagaggctggcttcagacacatagagaaggtggggattggctggcagccagaaacttggagcacaaagcctttatctgacagctaaggcaaccgaccacatgcaggtggccatgtcccaaagacctctcagcaaggcccagagttcccagcctgggctttgtggggtacttggggaaggcaaccttgctcctcacacccaagagtagacacattcagcagtccctcctgctgctctggttcaaggcctctctctccctagctatctgtgccatcagcacctgcagtccagcttcagagcctcttgtgtctgcctagaacagcaacttagctgagc

SEQ ID NO: 20549 - DNA, 1620 bp, Mus musculus
ctgggtgcaatgccagccttgaggcactgagagttcattcatcttctttagataagggattctgctgtttgatgaaacatcctaccaaaagtgtgtatctcttgcatgagccataccttctccctagaaggtcccacaggccgttactatttatgtctgagtgctgtattaccctgtacttccttctcagttacatggacacagagcagtttgaagaagccgtgcgggactatgaaaaagtgtatcagacggagaaaacaaaaggtacgaggacaaaggggcagagacgtgttgctcgggggggctgtggtcttctcggttgttggtcgcagcacttaggaccattccatttgctcactagcctggaagccagcagttcctgggaggggctcaggcacctgtgttctggctctgtctcctccctgttagtctcacttcctatatattcagaagaaagcaccaaaagagtccctgttgtggttaccaaagtttctaccccttaggcaggcagctgggctgtctgttgatgctgcctttctccctccagaacacaaacagctccttaagaatgcacagctggaactgaagaagagcaagaggaaagattactacaagatcctgggagtggacaagaatgcctctgaggacgagatcaagaaagcttaccggaaacgggccttgatgcaccatccaggtgagcgctggaggaggtgcagcagagcccacagcgcagatgcagtgggcacccaggagatcgctcttcagtgggaaggagggggtgctggactccctgtcctacaggctgtgggaggtgccacattccaaacttggacaataatagactttgttttcctgtgtccctggtttcactgaatcctctagatcggcacagtggggccagtgccgaagttcagaaggaggaggagaagaagtttaaggaagtgggagaggcctttaccatcctctctgatcccaagaaaaagactcgttatgacagtggacaggacttggatgaggagggcatgaatatgggcggtgagttggtttgggcatctacaatgaaaatggtccctgtaccagaaaagcccccattgaagttaccaaggcttctgccctcggggcagctgggttgggacaccccagaggggaggtctacaagtactcagccagcgacataagccaataaataggctgttaaaaaaaaatgagctagggcaggagccatcagaactgttgtgacctggactaaagcgtcagggtctccaggactggtacagtggctttggtaacactgaatttgagccttctcagcacggccccagcattataggagggcagatgcagatggcgttcctagctaggtaagaagcccactcggaggcaggggaagcttcccttctagacttcacccggaagggcacagatcccagaagcagggtcagcaggttctgcctggctgacatggggagaggcttgctaacatctaggctgaaatggaagagcagagtgagcctcagaagtcttctgcatcaggttcctcagatctttctgatttcccccttttttgccctttccttcctaattaccagattttgatgcaaacaacatcttcaaggcatt

SEQ ID NO: 20550 - DNA, 1196 bp, Mus musculus
ggaatggtggtacacgcttataatcccagtgcttgccagaggcaagccgatgtctgtaaattttgtaggctagcttggtctacagagcaagttccaggacagccagggctatacagataaccctgtgtcaaaaacaaaaacaaaaaagaaaagatgatgagacacaaggaatgtattgggctggattggtgggggagagggggtattctcatcagtaagttcttgcctgtcaggtcccaggccctgggtttaatcctcaacactgctaggtacggggagaatgaaaaaagaaaaacatagtaaagatatataggtagtttattttaacaaggcttgttcttgagaatctagtcacctgtggatgaactttgagtactagagccgtgatcaagaaacagtttgactccagatggtgggaatggccaagacattgtacaccacagctgaacgtgtcctctttatttcagtgacattttacgaatggattccaccaatgctgatgctctgtatgtccggggtctttgcctttattacgaagattgtattgagaaggcagtgcagttttttgtacaggctctcaggatggctcctgaccacgagaaggcttgtgtcgcttgtagagtaagttctaagcctggtgttctgcacgtggtggtagagcttcctttcatgtctcatggtacgagtgaggctagggctgcagctcagtggtgaggtgaggtgaggtgtcacgctgtcattcctgtggccctggattccgtccctcctagcaaagtcgggagaaaagaaaataaagagtagaggaagactcacaggaatgtgacagctccacttgtcagtgtgttaaaccttccctgtgggggccgggcatgcaggggcctgtgtcccgccagacagctgggattgaagagagaacggtgagaaagaaagactgagctgaggttttttgcactgaactgaccgtcccttgcttctctccagaatgccaaagcccttaaagccaagaaggaagatgggaataaagcctttaaggaaggaaattacaagctagcatatgaactgtacacagaagccttggggatagatcccaacaacataaaaacaaatgctaaactctactgtaatcggggtacggttaattccaaggtaagtacttgatctggggtgtcagaggtcttcagagatgtgcttagcaa

SEQ ID NO: 20551 - DNA, 1203 bp, Mus musculus
tcaaaactgcccaacccctggcttatggtggccatattttatgtctcctgtcttcctgacaggaagtcaacattaaacaagaaacttgggtcttgaccttttctgttttcttttaaaagatagggtttcaagtctggaaatgcacctcactggacagtgctggcctagcgtgcgtgaggccctcgtctcagtaaagccttctgtggtagtgcacactttggaatcccattacttagacaatggaaactgaaggacaagttcaagaccatctgcagctacataacaagtttaagctagcccaggctacatgagaccttgtctccaaacaaaacaaaaaatgggtctccatgtagcccaggctaactggtctcgtctgtcttggtattggaggggtctatttgtcactaattttatgtgtattgctatgagagtatcagaccttctggaactggagttacagacagctgtgagctgccatgtgagttgctgggaattgaacccaggacctctgaaagagcggccagtgctcttaactgctgagccatctctccagcccgtcaccagctttttaaggaaatgtttaattcttattttccttggagtgggggtttggttttttgaggcagggtttctcagtgtgtccctggctgttctggaatttgtactgtacaccaggctgacctcgaactcacaaagacctgcctgcccctgcctcctgactgctgggattaaaggcttgcaccacaactgtggctccttttgttttgttttttaaatttatgtgtatatgtactcttgtgctttcgtttgtatgagggcagacttgtactggctgtggcagtgatgttggagatcagggttattgcctggaagatcatgtctcctgttctgtcttgcttaaaacagtctctctagtttttttgtctttgagacaagagtctcacatgtctgtgaatgccctggagctggatgtatagagcaagctgccctttgcttctcaagtggacattacactgaccagcaagataggatctcttgcttgcttgctccatactcactctcagctaactgacactccagctactggagagtcttattcccagtccatcttgccttggcagcactgggtttatatatacacactgccatgtctggtttaacatgggttatggaatttgatctcaggtcgtcacacttgtatgg

SEQ ID NO: 20552 - DNA, 1358 bp, Mus musculus
tacacctggtcctgagccactgcatgccgacagtccctgttctcatctgtcctctccaggtcaccatcgtggtccttggcaacaagtgtgacctgcaggagcagcgtcgcgtagaccctgacgtggcccagcactgggccaagtccgagaaggtgaagctatgggaggtgtcggtggctgaccgacgctccctcctagagcctttcatctacctggccagcaagatgacccagccgcagagcaagtctgccttccccctcagccgcaagaacaagggcagcggctccttggatggctgaatagctgcccttcttgcttcaccattccaagcccattccgggatgggtggcgagcacagggtgcataagcaagctgttcttcccagtcggtaggggagtgaccctctaggacaggaagctgggctggcccaggccagtgccacctttgtcctctcttaactccaagaagtgcaagtgaacttgattgttggccctcccttgaccttccataatagttcccacccctcccccagctgaccatattttctccactgtcacctagacacttatgggttagtgtcccttccatctgcctggtgcaggaagcagggccgtcatgccaacgcgcccagtccaggatctgcctcctatcagggatcccaactctgaatttcctgccactaacatacacacagtaccagccttaaaacaaaagactaggtactgtaagcatacatttgtgcgagctggcttagggttggttcctcatcctccaccctgacctttcctctggcctgttcaaggcctggtaaagtcaggctcctgggagtggcatttcctgtttgacctctacccatctcccagttgtttcacttcctcttcctgttccaggagcagaggtcttattggctgaggtagagtggagtgatgactgggctgtcacatgccctgagacttagcaagactcttctcccctgagcgtcagtcttctcgtatgtgagttgacagaagcttggatgtcacctagagccacgggtagcgctgtgacttttctaaagctggtggcttgggcctcctgtgtgtcttctgcccctgctccaccctctttaaggtgctacacctaccggccctggaggctggacggcctctcttaaccaccagggggcaggggtgcactctgctcagtgctgcgagcgagcggctgtctattaacctgcccaacagggtagtgtccatccctcctggttggttttggctagtagctggactttatatttatactctctctgtatttatgcacctgctgctctggtgaaggtgggataagccgcgcccccagcccttctttcttacctcaga

SEQ ID NO: 20553 - DNA, 1200 bp, Mus musculus
ctgcttgcacttggtggagttggaggcctctccagccaacttcttcccagggtgtaccatgcctgctctcaggacagaggaccgaagactccctccaatgctcacacacacacacacacacacacacacacacacacacacacaccgcttcccttacccacagagcaactccatagctagggatactgatggggaggcaagagagagacagcccaccaagctaagggagaaccatccatccaatgtagtctagaaagttattccagttttgctgtaggagactagagatgaaggagataaagaagtggtgttgaggggagatgggggcttatgctgtccacagggataggctggactcgatggggaagggtgtgcagaatcatgcagtggggtgcactgggaggaggtagggaacccccagctccctccccagggcctccctacctcccttcctccctcgctccaggacaaggaaggtcctggatggcatagactgctatagtatctcaacacagtagagaattttagctcaaattgagtcccgaagacagatgtgattctcagggctcctgagtattttgtgactgatccagggctacaacacccggattctaactcacaggctgctgtcctcaaagcccacagacacctgtatcatcagtacagagctgggcatctcaaggctgtcttcctttccctggcacatctgttgcacatgcgcacatatgggtgctggctcatgttcatgaacactggcatgtgtccctgggaaaggtctcaggaataggctacagggtgaggacaggctttgggctgggctgcagtgagtacaactagttggttgtctctgcctccccaggatgagcctctgagacctgaaggtcgggtccaggtgggtcagatctgcctacggtacctcctagtggtgtgaagtctgtcctcctcttgcgcccagctgcagcaggaccagcaggaactgctgtttatccagtcagtaggaactgagccaggccttgggttaagactgtacatgattccccaaggagaccaagactattactgacagtgggcgggggaaaccaagggactggactaagtcatttgcccaaggtttctcaagccgcaagcaggtgacgtatgatcggaatggtcatcctcctgcagccgtaggccccactgcaaaacacctctcctcccagc

SEQ ID NO: 20554 - DNA, 1232 bp, Mus musculus
tcctgactactacgaggttatccgtttccccattggtgaggacccttgtactcactccccagcctaagcccccagtcttgacagggtagcctgactcctgtctgcatgtaccatggtgggcagccccagttacagcccttcacctcttaaagtcatgtgccttctctctcgtgacccagacctgaagaccatgacagaacggttgcgcagtcgctactatgtgacccggaagctcttcgtagctgacctgcagcgggtcatcgccaactgccgggagtacaatcccccagacagcgaatactgtcgctgcgccagtgccctggagaagttcttctacttcaagctcaaagagggagggctcatcgacaagtagcccccagctgggatccgcaacatccacctccatctcctcagatccgtttgggggctcccggccccctctcccggactcagctggagaaactccagccagggaccccagatcttacagactttctggccagcaggcactcactcccaagccagcagctctctttccaccttccttgcatcccaccttggggagacgtctggtctggggccagcccgttgtagaatgtctggtggccagggcatgaactgttggtccttatagagccatgcaggctgagcatcctgagcctggtccccatgcctgtttcccagggccaggactattcagtgagtagccttcacatggaaacagcccagactggaggaaccatgaggggccttggcttatcctacactgttgtctatctgtccctccaggattgggggcaggaggaccattcattccttggcattaatccctcggagggaacaataaagctttttttttcccctgtgtgattgttttttggggggggggtccggctttagacttagcaggctgacctttgcttctcgagtcctgactcttctaacctgaaagcctaacttcaggctacactggtgccactgacccctgcaatatatagtggggtgatggacctggctgactgccgtccctcacctcctctgcttcaataacttccagcctgtctcccctgcaaagggagagcaagagcttgtccttaatgcctgcctatttcctgactcctggtccaggaaacaggcagccaaggtcagcccctccaggccttaagctcagcccagatggacagggttactgccaactgaaaacagatgaggaaatagggaacccaggagca

SEQ ID NO: 20555 - DNA, 1196 bp, Mus musculus
tgcgcttgggatgcagacagcatcagggaactgaaccttccccctccaggccaatgaaacctgcaagtgtaatggctggaaaaaccccaagccccccaccgcaccccgcatggacctccagcagccagctgccaacctgagcgagttgtgccgtagctgtgagcaccctttgggtaaggcaggcaccacctttggagctggggcggagggcaggagccaggtcctgtttgaacagggtgacataagtaccacagagcttcttggagaccttctaaggaaatattgggtagggaataaatgtgaatgtcccatggaaggaaaaaaggagatctgccttggtagcaggtagctaccaagggctgatgggagaactgagaacactgggtctccctgtctgtcaagaattggagaatcaagggtgtgtcactggctagttagaggaggtacaggaatcaagccccgtggagctcttctgttcttcccagccctaatgtaaccatcttgcagcggaccatgtgtcccacctggagaatgtgtcagaggacgagattaaccggctcttgggaatggtagtagatgtagaaaatctgttcatgtctgttcacaaggaagaggacacagacaccaaacaagtctatttctacctcttcaaggtgagttctcatggagtaaagatggtgaagctttggtgtgtgttggggatcctgctctctgagctctgctactcctgtttctgcccatccctcttccttacagctcttgcggaagtgcattctgcagatgacacggccagtggtggaggggtctctaggcagccccccatttgagaagcctaacattgaacaggtagggcgggcatgtagcaagattaaaggcgacttaagagggtggagagtctggtttatttcctcaagctgagaacaggggagaggttcaaggaagggacatggtgtttgctgacctcagagtgggtgtggaagttggaagggtcagaggttctcttcacagaatccctcctatttgacatgcctctgttggctgtccacacctcctcctgattttgtcccctccttactcctcagggtgtactgaactttgtgcagtacaaatttagccacctggccccccgagagcgccagacaatgtttgagctctcaaagatgttcctgctctgccttaactactggaagctggag

SEQ ID NO: 20556 - DNA, 1738 bp, Mus musculus
attttttaaataaaattaactggtaaaatcgtctgactcccagatgcaaaactttctaatgcctggaccagtctaagtgttattctccctgcccatgtcagagccttccattgccatgtcttcccccataggactttagctcatttgcctcaggaatccttctgtctatgagttcaaatcctggcaatgccggttgtcactcgggttttgggcaagttctctgcttcagtttctagggacacagtatacctggcacacaagccctccagtattctggctgtcactgagtaggggagagtgttagggtgacctcaaaacctacttccccttctctccctaacagctaagaagcttcccaagaatgagccccagaatgcggctggggctccgggccgaaccagaggtgtggatctgcaggagagcaacccagccagccggagccagtgctgcagcaactgagcccccttacctgccactgcccccactcctccaccacaatgacccgactggaatctactctaaccaatcgcacttaacaactcgggccaccactgggggcaggggaagggtccatcaagaattctccgcataactttgatcctaggccggagggagttattccacctgcacctttctgtacaaatactaattcaattttaagtcttaagtcacttttttaatatatatgatcttctgctcttcccaggtccctttctcccgctcccccacttgccctttgctggtagtagccatgctcctgtgctcctcatccgtggggacagggcttggagcagtcaccctttcttcccttcttgctggagagcggactcagcaagagcacccacatcttaacttgttgggagcgtcttaggctggggcagtgggcaggccctgagctggggaagggacaggctgctcttccctcagctggctgtcaatcaggctgcagcctcctccccaactgactcccagctgggagagaaaccgcagcattacttaagcatcattattgacagccggacacccatggcccaggatccctccacccttggtcactctgacctctggctctgagccctgttctgaccaaatcacgatgatgagtatttgggggtgggtgggtaaggggggggagtgggagggatggaaccaactttttctgtattttgtattgtatgttttcttcaccatgtaaccaatcagtatcttgtcaatatagtcagccgatcgatcgacctcacgcttgtcttcctcgtccttctctggcagctgatcaggccatacgtagcctctctgtttttcctgaagttaatttaaatgaatcatccaatctcattaaatggctctactccctgtgtgtgagaggatgctggtggtcatggtaaccaaaagaaagaagccctgctgttggtagttctgatggtggaagaggataggactgacctggggctgacatctgtctccccccagcttacattaaaggatatgcaacctgtatttgaagattgttggtgtctgaagtgacctgtgagggttttttgataggacctaattaggactcagaccttttttttttttttaaatatctcctctccctgacgaggaacaccgagtactggtcgtaaggccggtgctacagcccatcactaccactgtccttcgtgacacctccatgccaggttcaacactgtccatcctggttcagaccatcagctgattctgaatggcaacagctagg

SEQ ID NO: 20557 - DNA, 1183 bp, Mus musculus
gggctggaagtctagcggcaagagcagttacccaggtcctcagggaggcacctgttgacagtctcattctaactccctatttctgatttctccctgcagttggaggcctcccttcccattaagtgcctctttgcatagcaccggccccacccccacgctcactggtactactacagagcagcgcgccatggcgggtcgaggaggtgcagcacgacccaatggaccagctgctggcaacaagatctgtcagtttaagctggtcctcttgggcgagtctgccgtgggcaagtccagcctggtcctccgctttgtcaaggggcagttccatgagtaccaggagagcacaattggaggtgagtgagcaaagcaagtcaggccagaggggtctggaggaaggctgcacacgcagaaaccggacctgtctggcctgggaacacctttttgtcaatgggccctggagttgaatccagcagtcagtcttcatgcttcgtcccaaaaagcaagagtgctaagaattacctagggattgaaaactggcttcctgctctggtctggcctctttattagttgtgtggatgtgaggtcttttttttttttttttcctacagggcagtatatatgtccattcctctgctgctgacctttgttctttctctgattccccattggtcagcatttaggatgtgaataagctctggactcagtctctcacgtccgtagtcagtgtgaacctcaagaggccagggccacccttggttttgagtcatccttcttctctgctctcttggttggtaggagatttccaggcagctggaaacagaataagccatgtcagcagtcttctcactgcctcctcagctctgtcaggagctagagagggggaagtgcgttggcagtccaggctcctcagtgggctggggggggggggggagtggtaacaaggaaaaacagcttcccacagaactgtcataatcctcggctgggtccagggtatggggaaccctacctgtctacctgtctgtcccagctccaggattctccttcaaaacatgtttgccttagcctctcacatctgtagtcagtgtgaacctcaagaggccagagccacccttggacttgagtcctttctctgttctcttggtaggagatttctaggcagcagaattcctgtctcaggtggcat

SEQ ID NO: 20558 - DNA, 1204 bp, Mus musculus
ctgccaagcaggcagccagcactgtacagtgctgggtgccgggtggccgttggggattggggaaatgcagtcagtcagcgggtttcctaggaagcttggaaaactaaaagcaaagtgaaagcctcagggtgatttgttccacagtctcctctgtagtgtctccagaaggaaggaaggggctgcagtgggccgtcagggagaggggcaagcagagagcggttaccactcaggcttgctgagagccctccttggcttcctctcccaaacaagggcagaaccgtgcccaggagaggagcccccaaaaccttatttttatacatgcaagtaaataaacatattttttttacaaaaataacttctgaatttatcagtgttttactgttaaaagaaaatactcctgtgtagtaaattatttattgggagatgagtttttaaaagctgctgtttgccttgccttggttttgtacactgatttttctatgcctggcggtagcctctctgcctcaggtgctggccggatggaggaggtgtgaggcccctccctggcccctcagaagaaagctggaactgccaggggagtccaggcttaagggactcgtccccacctgtcatgcgactgtcccagtaaccctcacgagggtgtggactcgacaaatatctagatatatggtggacatggccccaagtcatggggagagtagagcagcctgggcccccccacccccaaggttctaagctgactttcaagttaggttggagaaaagggtgccaaagaagcgagacttccacatagtttttaagctaccctggatttactgagggtgtacctggacatgggagaggtttttaactggaaagtgtgtcccctatctgcatgctggtctctctctctctctgcccaactcttgcacccaaaaatgaggtgagggcaggtctccacccacctcttgcctgctcacagacccactcgtgagtcgggaaagcctcagctttggggtgtggggctttgtagaagtggaaggagatttgaagtggctatctcctacaacggaaaatatccttttataatttttctttttaacgttttatttcagatacatattttagtgtcgaggcagattagtatatagccaccaaaaaagtattgtgtataaattgaggcagccacaaaattgtgtattttatgttacaataaaggcgtctc

SEQ ID NO: 20559 - DNA, 1672 bp, Mus musculus
gatttttttttttaatttcctacttctgctatctttgggcaatctgggcactttttaaaatagagaaatgagtgagtgtgggtgataaactgttatgtaaagaggagagcacctctgagtctggggatggggctgagagcagaagggagcaaggggaacacctcctgtcctgcccgcctgccctcctttttcagcagctcggggttggttgttagacaagtgcctcctggtgcccatggcatcctgttgccccactctgtgagctgataccccaggctgggaactcctggctctgcactttcaaccttgctaatatccacatagaagctaggactaagcccagaggttcctctttaaattaaaaaaaaaaaaaataagaattaaagggcaaaacacactgacacagcatagcctttccatatcaaggaatactcagttaacagcctctccagcgctgtcttcaggctgatcatctatataaaccctggaatggttgcagatcaaatctgtaaaagagatccgagagctgtggcttggcctctggttcaaacacaaaggctagagagaacctagatatccctgggttttgtttacccagtatgcttgtcggttggaggtgtgaggtaggccaagggcactggaaagcctttgtcatcaccctactccctccccaacccagactccagaccctgtttcagggtcagcctgccctgtgggtgccttactgggcctagggtcaacctgccttcctttcccacttgaccttgctggtagtatgtccccttcccatgtccaaaggccctctgtcctgcttctattgggaatccctgcctcaggaccttgtgtcgagagggattgccttacaggtttgaacctgcctcagactacaggccctcagcaaagctcagggagtatggtccttattctatgcgcttggttcccagggatatctgtaaccacagggcaaaagctgacatatactccaggtctgccctcatatgagtggtgtattcttggcctcccctgagactggcaactgtctgctccccattgggtctcccaggtgaggtggaacacagttcctgcacctactgtggcctccatgtcgcttgcttgcttcgctcactcagcttactggaacactgagtgttcaaggcaagcctttcctgacagaggcatggctagattcagtgactcaaagccacctcattcagctgatcagtgtctgtggaattgtttccttccagttaaccagtgtctgaattaagggcagtgaggacattgtctccaagacgaactgcttgccttgaccaccccagccttctgcttcgagacagttactgctctcccaccccatcaatgttctttagttatacaataagctgaacttataaactgaaagggtatttaggaaggcaaggcttgggcatttttatggctttcaatcctggggacccaggaacaaggtgagggcttctctggggctggtgttgtacctcaggggctctgggaagtctgtgtgcctgggttaaccacccatagtgagcccctggaactgcccactttccctctccttggccccacttggccccagcctcacccagcctgcagactgcttagcctttcagtgcagtggcttgtgttctggccactgcactcagattccaatgta

SEQ ID NO: 20560 - DNA, 1489 bp, Mus musculus
ccccctgctggtgagccaacctgcacagccacatcggggcacagagccctcaggatgcaagggatccctcttcagtccaggagttcttggtcacaccttggaggaggatggtaattggtcctctcctacagggggacactgcttatgaaacacatcccactccactagcagggacagtcaggaagatgctgcggtcatcccttgcccagccctctccagttaatattcaggaaattaggctggccccacctggaccatcccaaaggtcccaggatagccaccaccctcctaagcaccccctcctcgagccctgttggcgcagcatagcatccctgggactgggggggtctcaccgacttgcagcactgggcttccggatcttaggttccctccacccagtctgtaggtgaatgggccttgcccaacactacaccccaaggcagaagttaaaattggcccatctctgagcccttctgcaccctgatcatgatgtcctgaggctgtggtcagtaaggttggttctgctggcaggcctgccttgatctgcccactgagactccctccccaagccccgcactgaccccaggtttcaggagtggtgtcctgggcagggaaggtcatttacaatttgctaagcggaggtgactgttgggctgccagcgcaggtatgggagcgctgcccaggcctgccaagccctcgccggctacctcatgtactgtggatctcagacccttctaatcatgtgctgactcctgcaattcactcactgccttccctgtggaagtgacactaaatcagcaaggcccctcccctcccccacccaggtgctcatgagaactacccccacactcgcccaggcaggaccggcccatggtgaccttgttctgaacccctctgtccttttgtgcccggttacgtgatctttgctctgtttgcagagaggcctgcagcagagctctttgtggggaccctgtccaaggccttctgtccagacatcttatccggaataaagtgtgtttgactctcagaaaagctgcctgtctctgagtgtgtgtgtaggggggtgcggggaggctgtcactctagctctgccctccggagcccatctggtgcccacacccacttcctcctgcctgccagcctttctgcttttcttcctgatctgaggccacagtcgccctggccctggctgggcggtgagtctgtgaaattagcaccttatctcaagtcgcccaggcgccttcccactgccctgagccaagtttgcattgcttgggcagtctctatctcccttcccttccctgtgtatcccaagcagagaagggggcctgggtgtctgccccgacttctctccaagtgcattctccagccctccatggcctggctattttgagccctaaagcctttggcctcggtataagtggaggcttggcaggctcctcagggcagctggagaatgtgacatgctgaagtaggcaagctaagggc

SEQ ID NO: 20561 - DNA, 1148 bp, Mus musculus
cctcactaacttctccgcgaatccggacctctaggtcttcttccttttcccccaccccggggccagatatccccgaagcgctaatgaactatccttgcaaacctaagcacggggttagacgacgcgcaaagaattctatagaaggcaccagacttcgcctctaggtgtcccaaaacactcagaaaaccaatttcctgtgtgtgaaatggggatgtgggtagagatatctagtagcatcgctgggaacattggctcagaacaagcacagcaaagcgatccgactgttcccgatcctggctttgccacctcctcctggcaaactggaagaagcaaacaacactgggaatccgcgaaaagggctttgcagctctctctgctcgcttcgtctaagtggattcggtgccagggtttcgctcagcccggaagcctctgccctcggccccgccccgccccgccccgcctcgccccgccccaggagtctctcggcgatgctttgtttgattgctctgagttcccgtagctccacgctttgaggctggtgggtagtgcttccgggctgcagcctaggacgcctccacggcggtgtaagtagaagcagaatcccaagaactcactgagtagggaagcagcccgagccacagcgtcccctctagtccctcgcctccgagtcttcgcagatggccggttcagcctaacaagaggggctgggattcctgaagccccagtcccatgactcaggggttcctggcgggttccccctgccaggattccggtttctatcagcgaacgctcccctgccctgctccaggtccctcttgagtccgagttcccctacaggcctcggcctcagcctgcctagtcattctcgcttcgtctccctgactgtctgcaggcctggagagcatggccgtgttccgctcaggcctcctggtgctgacaacgccgctggccaccctggccgcacgcctgcctcccatcctgacctcggcgtcccgcctggtgaatcacaccctctatgtgcacctgcagccgggcatgaacctggggggacccgctcagcctcaggccagccctgtgcaggccacatttgaggttctggatttcatcacgcacctctacactggtgccgacctgcacaggcacctgga

SEQ ID NO: 20562 - DNA, 1920 bp, Mus musculus
cacttactgtgatggggcaagggaagaacccagtcttgtcccctgaattttatctgtgtgctgggtggcctggctgatgcagaggcctgctaagagaacgtactcttacctgctgccagtgagacatcgtatctgtgcttagtcactgaagtgagaacatactcccgccccaagggaggcttctctccatcagggtggtacacgggcaacaaagtagggatttgattcccctttgaggaggtagtgctgtttgcttttaggtctgggtgctcaggggccctcactgatacaagagcccatctcttctcctcacctcactggagccacagaagccaggcagcagctacaggagttatcatctgtgtcttttaccatgatttgatttgtgttctcaaagcaagtgtgccctttggttctgcagagcaggcccacttcctgtccctgagcccatcttcatttctagagggctgaccctgagcactccagagtgcttgcagagtttgagaaatgtgaacatgctgtggggctgagcctctgctatatcaccgtgagctgtaggatcagctggctggctgggttggtgagtgcctaccttgaggtctcatgaaagctcctggagctgtgtggttgtctttggtgctgttaacccttggctccatttgaccatcaatctgagcaatgagcaaagcaatatcatatccatgtttatgtccctcctccttcccttgctcctcctctggagaagcactaattacacaggggatagcaaagtagcactttacaaatggccatggcgttcatcccaagagccaccagctcttcttaccataccacttcctaactcctgtaaggatgagcccagttagtaaggatgttggtaatcagcagagaccattctcaagggtaggtgttctgcagccccgaatcaaatcatgtgaaaaccccttaaatgatcattggttctcaacctgtgccagcatactgcctctctgtctcccaaatcagagctcaagccaaattcttctatcctctttccctcttgcattaacctttgctgatcctcagggaccactcccccagcacttttgtgtttgggtgagggatgttggacagagcccatttttatgtgctgcaggttgggggttgtgctaacacttttgctcttggttgatggacaagatagaggccagggagtgaataacagtgagaagaggaatggcaggtgcctgtttcatagtcagtgagtgtgaaagttaggcataataatggcatctccccactttagggttctcaaatactttggacatctctttccttagagccaggtagatgtcttacaggtgaactcgatgatgtggaaaagaacaaaaaaagggaggtgagggaaaggcttggggttttgcgtgtttgcatgagtgtgtgtagcttcatgctttgggagttggcaagaggaagagggagggaaggggagcaagcaaatccaggtcttttcttgtaccagtggaacctgctctgaatctcccaagtcctccactgtgaattgggctgggtgggggggtgcaggggaataaatcttgtatgagaacaatcttttaagagactgctgtttcgttgtgtacttccttgataagtcttctcattaatctgataatagctaatctggtgtggtgatcctcagaagaggaagcccaggtggatgtcagggaccctcctgccctttctgtttttccctcttgaggccacgtctcccccctacaaccaagacataaatataactaataccttgcgggcatttgtcaattgttattttttttctcttttagatttatctttttgtttgtttttttagacagggtttctctgtgtaaccctgactgtcctggaactcactctgtagaccaggctggcctcgaactcaga

SEQ ID NO: 20563 - DNA, 1476 bp, Mus musculus
gggtgtgggataatgccagggcttgagttttcctcagctgccaagccggggaccctcaggaaccaaccagtgctaccattttagctttctcgatcaagagttccatgtcactgactgtgctcagggttaaaggtgagcctggcaagcattgcagacagaactcaaagggagacatgtctccatgccatcaaagcaggaatttaaggatacaggaaggaaaacttaagttctttcatcctgtgaacatagagccagctagacccttgggaaaagcctaccctataggttacaggggtggcagggtggttttcaggctcccaggacatgtgccagtgacccactccttccaaagttctggctcagtggcaacatgcctaagctgcggctatgcctggttgggagtgagtactcggggtcagtgaagctgcagctgtccctaccctccattcctcagcggcttgtccatggagcagcttgctgctttcttcagggtagctgggcctaatctaggctagaggaagatgttgctggtctggtttactccctgtctgtagtacctgctgttggttgtgtttgtgggtgtgtggggtgccattgcacatttaggagtgtgtcacagtgcagggtagactgccaggcagaccaccattctctgggattcatagagaacaaagcactttaactctcttttagaaggtttatagattggagtggagtttgagccaagtctctgcccgaatcccacttctgaaggaggaagaggagagtggaagatcctgcagtttaatatcattttctgagaggcaggaggagctgacttgacacaaaaacaaaaactagtcagcatagctaccttgtgtctggtgtgctgagaataggggcttgtgctggaaggggcgtgggtggatacagactgccctagagtgttagaatggggcacaagctccttgcttcctgaagaaccagagctcctgtggcccttgctaaccattcccttctcccacactgcctcttagagatttgcatgggacgtgcatgcttgtgcacatactccttcactacactggcaggtccgtgtgtgcctcacactcagcacactctacagctcctctccccacacccagttctgaaactgacatctgctggggggttatgtctattgtgtgtatcagggataccctccagcctaacgataggctctgaattactcagtctctgggaaaccagagactggtggaggaggggctggtcatgaggaatgctttaaaacatgtcggttctagactgagctcagccttccctcagcaggcatcactggcagcccctccctccgcagttcaggccaataatactcatgcgctccagccgcccactcttggttcctgctgtcctctatttttaatgacgggtttcacccctcctctccacttctgccccacgtcacgtggtagataaagtgaggtgctgtggactggt

SEQ ID NO: 20564 - DNA, 1243 bp, Mus musculus
ggaggcagtggcggctcctattccatcaaaacccagtttaactcggaggagcagtggacaaaagcgctcaagttcatgctgaccaatctcaagtggggtcttgcctgggtgtcctcacagttctataacaagtgacttgctccttaggggatgtttgcctttaaggttttatactttgtttggtttggaaagatgctttaaattaaatttgggtaatattaaaccacatgtttacaataccaaaatccacaaaagctactttattttcaaatatgacagatagtttccagagtacgccatgtatagcaaagaaccctgccatagttttgactcagccccatgcatcctttccctctttcctgaaaacaactaatttaaatttgctttgttttcttttttaagttgaattgacgttaatgtgttttcactggattttatctctctcaacttcctgcacttaaaatttgaaacagcaaaggtttgagatgagatgcttgtggcacacagttgggtgatgtggggaaaggacaccgggtcaggagttgcaagtttaactccgtcctcacttgtagcattgaatgcctcctgtgctgtctagtgggactacagaatgctgtttgatactgtgtgcgacgtggagagatttaattatttgtaataaaggatttgctatggtctattaattaccaagtggtacgcctgtatgtttttccttaaaattgagtattttgtattctgaaagaattgagttgtagtcagttcagtagaaattctgttgaaacatgtcttagtttaaagagaaaaacaaatgatggtatttagccccagcactgagaggcagagagaggcaagtgaccctctgaatttcagcccagcctggtgtgtatagtgagttgcaaggcagccagggctgagtattgagaccctgtcttaacaaaataaaacaaaacaaaacaaaacaaaacagaacaaaacaaccagctgtagggggagcaaggaaagaaaggttacttcaaagagattcagtcaaggtcatcgaaaatgctctaaagtcccccaaaatacttatctctatctgatattacctcttagttagattaacttaggaaaaattaaaagtattatcaaacaaaaatgaactagtttcatcatcaactcagtccaattctttgatgttttttttagcctaccatgacacaacagatatgtttgtctcccataactatctctgatgtagaaaaaa

SEQ ID NO: 20565 - DNA, 1118 bp, Mus musculus
gtaggtgtggtgattgtaggatgctactttttggaccattagtttcagttttggcaaggtaagttatgttagtgctgctctcaatgttagcccaggttttcattagttctaaactagccacaggcttccttcagctacctggctttccgcctgcttgggaataagccttttctgttcagtgtgctgtgctcacagatgggaggaacagctggttttgctgcacagctgcagtctctgtctttacttgctctttgctttgtttttgagacagcatctgactatgtagccctggctagcttggaactccttatgcaggctaggtagaccaggttggcttcagactcattaagatctgcctgccctgccatctaaatgctaggctattgccagctggcactgatagtgtattagttgcatgtctgtattgtgttagaacgccgcctatgctatagtttgatctagattcctgtggcttggtattttgttgctgttgcttggtttttttttgttttgttttgttttttctgtcctagaagttgagcctagggtcttgtgcatgctatataaatgctgtaccgggctgttgagatggctcaacgggtaaaagcaccgactgttcttctgaaagtcatgagttcaaatcccagcaaccatatggtggctcacaaccacccgtaacaagatctgacgccctcctctggtgtgtctgaagacagccacagtgtatttacatataatttttacatataagatttatttacatataataaataaatcttaaaaaaaaactataaatgctgtaccactgatttatattcctagctttcaggactttcttaattataactaattaagccgagtacggtggctgagcattcagcttgcctggagaaggagaattgtgtgttcatgaccagcctgggatacataggaagttgaaggctagctgggacacatactgggatactttctttaaaaatcaagataaacctgcagttaggagacgcctcagtagtctgaatccttagctcctaacattacttctaccatatagaaggtaatgggctgagattgctgaatcaggaatttcttcatattagagccaaaggatccatgca

SEQ ID NO: 20566 - DNA, 2464 bp, Mus musculus
gtaaaaaacctagacttttaacatcaaggcagcattattaaaggactttctcgtacttctcagtgtgatcaatgcttgagccagcttaggcgtgtaggaggtggtggtgccccccccccccccccagctgtgttaagtgatgagagttgggtaaggtaagcgattgcttggagcatcgctctcttggtgaggtagaggttgaacagatgagtgatctcctgatccttcctgtcctaggtcactctccatgacatgatcctgaaaaacattgagaagatcaaacggccccggagcagcaatgcagagacactgtactgaggccagggccagggccaggggactttgtgagtctggctcaagaccgacattgccttggtttgttacatgactatcgtgatgggaaaactggctggaaatagtaatcacacctctctgtttttagttagagtctaatgaaactctcatctagttctgtgacgtgtttacctcttttttcaggcctcaggaactcttctatctccttccccaacaccccccacccagcctgtcctaatttctggagaactccaggtttgtgcaacatactggcacaagcgtaattgtgggtttttgttttttcttcccttctctcccccttcccctgttttaggttttgtattttcttccttttgatgattagttggttaaaagctggaggaactatagggaaagtgttaggtgtcttttaggaacagggggagtggaggtggaagggacatctcttgtcacaaggctagtgtctcgtttctgtgggactttgggtcctccttgcctgcccaggtgatgccttagggcttcccacctacatccatcccgctctgagcctgactgtggcgaggggtcccctagaccttcacctgcatccctgcagcttctttggatgtttttataactggggttttcacatacacatgtgtacacatgtaaacacgcatagggacatgcatacatgcttcctgctccattatagaacataccttccttcctgcaccaccactccctcaagcccttcacatacaaacatctcagcaggtgatagttgtcttagtcatccacccaggcaaaagtcccaggcccaccctcttctgataatgtagcagttggtgccagggtaagctgaaggagaaccgagagccgagcagcagagggctcatgaaggccttccctctgtggctcaggttctttttggtgttatgcaaaagctggtcctctggcccgcacttgtcttctcctaggccagcatgtgcgctggctggggagcggccggctgtgaggtgcagaggctgctgctcctcgctgtgctttccctttgggaaatgtttctcgtatttatagtattgtgcttccagggaaagcagtaattcatgtgtatacgtgtgtgtgtgtgcacatacacacgtgcacatgtgtgtgtgtgttcgtgtgtgtgtgttaatatgctgcgaaggtcaaacccatagaagagttgcctcctctcttgaatcttccagaggtaccacttgttaaagcgtttgtattaatcgcactagcccccagctttttaagtgagagttggtctctgcaattagcctgccagtgactgactctcagtgtctatttgacttttattcctctccgtcttccaatcccaaatcatatttccacctgggatgcatcactttcactcccagcattctgtaggaaaggaggcgggatgcgggatgctctcttcccaagaatagtgctcagtaacaaaccaatcgcattttcgttgggcagtgcacctatccaccctcagatcccttccagctgagcccctcccctccccccaccatgtgtttcttggttttccttttgtttgattgtccctctgcccctccttccttggattgtaatgtaaaattcttttaccatgtcaagaaattattaaaaatacaggtactttgacctctttctaaagctgcagaccctggtgctgtactctggtgactgagggacataagggtcacacatgagcattcagacacccatcttcacagacactctggctagcctgtcgtgtgtgaacttactagttgaaccttcattcctcttcacagtgcaagaactaatgggaggtggttcctgctgtgtgttgacgctcaattgtgtgaaagctgcctgtcttcaccagattccaggtccttcctggtgataccctgagctgccagcagaggctgctgtggttatgtgtgggaccagcagctcgggctgaccctgtcgatccagtccttttcctccataccagcttgcctctacatacatacatacattcatacatacatacttacttcatacatacttttttgagggaactcctggtattggtttatactgacccacagtgctcataagaggcttacatccctctaaaataacatgtcctcacttccctcctgacagtgag

SEQ ID NO: 20567 - DNA, 1919 bp, Mus musculus
ggccagagggctgagggccctggagagccggggagggagaagatgggaagtcctgtcgtgttgcccaccagcctctcacatttcatcctgtcacgatgctctaccctccctccctcccccagagaaggtctctgctgatgactgcttccctgctctgagctcgctcttgcccttcgctcagggctctccctcccccccaccccttcctgccctcaggagaggttgggaagtgaccacttggatgtctgggccctgccaaggggacagggggggtcagcaggaggctggctgcttcctgccctcccccctctccctgggcctaccatgctgcttttgtgccaaggttagccaatccctccctgccctatcctgtgtgcttccacctcagcctcatcctccctcctgccccacccccacccaaagaatctatgcgtcagctcaggacgtggggccgatctgtgtgagtccagcatgtacctgtgtcccccgtagtatccccgcagcccaggccgacgaggcccacccctggacttgatcagtattcaaccttgtctcctgtccccaatgtcgtaagcacaattagacttcttccggcttgagtttgctgcctcctacagcaaggacaggaatcagaccgactccctagcttacgctctgggaggggtactgggtaccccacccttcactgaggcctttggatttgtctcagtgccttagcatctgaaaacctgtgcttgtatatgtgtgtgtatgtgtaggggcagcccctatctctggctccttttccacccttctccccagtgccttcctcgtcctggtggagctgaggcctactcctccccagtccaacactgccaaaaatctgtgtatgtgccaggggtcgggggtctgggggtaggggacagctccagcctctggggaccaattgcttttactgtggtctgtggcctgtcctgtctctgtcagtggagaagaaaggcagtgagctggatcagccagagttctgggagacaacgctgggtcttattctgggaccaaagtgagaattcaagcacatttctttcctttgctatgtagggaggctgctgccttcccagagcctggaggcagctctgctgttcagccccaaactttgtttacactgctagggaaggaggagctccggcaagggaataactaggctggttaaaagagtcagggctactggagccaaggtggggacctttgaggctaggtgggggtcacctgctgcttctgagcttggattagagaaagctcttaactccagccactgtcagagggagtgtggagggagggacccggcctctctgttgtcaaattgaggcctccatgtgggaagtgtgatttctgcttttgtgtcccatccccaccccaccccattaccacagctgcctttgtgtctgtgtcaataaaaagccaaaccctgagtcctgaccagatgttgtatctgagagttgctggagaatgggtggtagtgatgcgcacctttaatctcagcagttggaggcagagacaggcagcttggagttacaggccagcctggtctacagagggaacgtctggaatatacagagaaatctagtctcaaatgaaagagagagagagagcgcgcgcgtgcacgagcgagccatgggaaagccagtgtcaaggtctgcgttctgccctctctctcagctatcttgaagtaaagaagaccatcacaccaggttggcactttgaccgttcttggtagcattaggcagtaagtgatcctagtccccagcaggtggacatgcaggcctagcttgactcggaagtgaagatagccaggccctgctgccctgaaggcacaactgtcagggcctccacctccccgcccccacgagtgggcttctggaagtggatctcaaggatgtcat

SEQ ID NO: 20568 - DNA, 1194 bp, Mus musculus
agtgtgcagactgcaggctgatagaaaaccccggagtcctcactgaaatcctcttctccccagcttccacactccacagcttccctacccaagaccagctttccacatcatttcttaccgaggaggtttagaaggatatgtgacatctgtatgcatggagcaaagcttttccctctatccctctccacccctctataactctatcttccacctccaaccagtggcaaggagagactcaggagttttgccccaatgccaaggtggtgctggttggctgtaagctggacatgcggactgacctggccacactgagggagctatccaagcagagactcatccctgtcacacatgagcaggtgagacccctttacctccaactgaattcgaacctagacctcacacccatctctgggttttttggttcctgatttttgctctaacctctgaccctaacctttaattctttccccatctccgtttgaccttccaccttagcccacagccctcacgctccttcccaaacgaaggcctataatttccacccatctgctgcttttccagggtactgtgctggccaagcaagtgggagctgtgtcctacgttgaatgttcctcccgatcttctgagcgcagtgtccgggatgtcttccatgtggccacagtggcttctctcggccgtggccataggcagctacgtcgtactgactctcgccggggactgcagcgatccactcaactgtcgggacggccagaccggggaaatgagggcgagatgcataaggatcgagccaagagctgtaacctcatgtgaggggttgcagtggggcagagaggggagagggctgggtgagagacacggttgttcccgtgggtgctcctggactttttgacctcctggccctggctggaaggtcagggcaggcagaggagcaattctggttggaggagctagagggtagaaggctgtcactcctcaccccattctctacacccttatcccttctctgctgctagctgagagagctgacagggtaggcatctggtacatgaacttggatagggcaggtgggggtttgggaaaccaagcaatgactttggttgagtctcctatgtaaagtgtaacttccttgcataccctggtccccatatcccatctgccttccctaaggaaagtgtccatttgatgaccttctct

SEQ ID NO: 20569 - DNA, 1787 bp, Mus musculus
ttcctccacaccatctgctctctcgtggcttttcctaaaacaggttgaagttcgtattatttcagtctgggcttttaccacgctcactcctttggcttttgaataaggtcctaatgtgttgtttctgagtacctgcttagccctaagaacttatatactcagatcttagaatggtatggttggagtctcgtctagaaggatgacttacaccagtctctgcttgtttctgtctgcagatattgggcagctgtgcaaggcacgtcttgtgatgtgggactgggtgttggacagtctatccagctaccggtgtcgggatctggatgcctacctggtacagaatatcacctgtgacagtagtgagccacaagactccaatgattaatttaagaaatggtcttccatgcccggggagcacctctcagtctttggtgcttccacaccctacttactaagtatttttcatgcatccgcctggaaaaaccagcttctacctatgtgagggtgggtgccttaaaggttttctaaccaagtccccctttgaagtctgtcttgaacacaaaaagttttcacctgagaaagctttatcccaccaattgagcaagatgctaatctgttgcatatcgttcttggagagacagtagagtggcttggctgatctgagctgggcatggtggtacttgcctataatcacagcatttggtggaaagagatgggcatgtcgtgagttgtatatgactgaagaacaaatagctagtggtcctgatttgttccttataaaattgcatgttcataaaggccaagagtcaagtccttcaaggagatggcttgagatctgtggtttgacttaaaatcagtgctcctcaaggctccaggtttagtagccagcaccaaacaacacccagaatagggtttgtgcaggacactgaggaaattcagagccagattatgtatttgatgtgaatgtgaggtttttcaagtgccagtgtcaaggagagccttctaattccccatagcttatgagcagtgtatctgttgtagcagctctaagtaacccattcttctttaaatacacggactctgatatgaatatttcatgtctgtacaatgatggattccaccaggaaaggagttgttgctttctttgaagtaatttcttcccttttgctccctgttgctgaggcatactacttcataaataattttgcttgctgaaggaagagaacatatttttcatgaactcataatcttggactgtttatagatattggggggagtaggtcttctctggccccccccagtatgcaagggcaatggagacctgattatataaagtatgtttataaatgctgtgctgttaatactgcaaataaactaaatagcaaacattttgacaaagaatgactgattgggggcctggtgaaatggttcattggataaggtcctgctgccacaactgacagacagccagagttcaactaacccctgggatccacatggtagaaagagagccgactcctgcaagatgtctctgacctccataaatacaccatggcctgtgtgctcatacacttgcatgtctaaggagcccacatgtttcaggtttcatgaaaccaagagcaaggtagcagcaggcctctgtccgccctgaggatgaacctgctttaaattctttcaagttagctgggcagtgatggcccacagctttaatcccagcactcaagagtcagaggcaggcagatctctgagttcaaagatatccagggctatacagagaaatcctgtcttgg

SEQ ID NO: 20570 - DNA, 1170 bp, Mus musculus
cacaagagcagcccttcacaaataaattaaaacgtaagagaagtacatcccttcaacctgaggacttcatcaagaaagcagattcagcaggtgttcaaaggactcctgacaacataaatcagggaactgacctaatggagccaaatgagcaagcagtgagtactaccagtaactgtcaggagaacaaaatagcaggtagtaatctccagaaagagaaaagcgctcatccaactgaatcattgagaaaggaacctgcttccacagcaggagccaaatctataagcaacagtgtaagtgatttggaggtagaattaaacgtccacagttcaaaagcacctaagaaaaataggctgaggaggaagtcttctatcaggtgtgctcttccacttgaaccaatcagtagaaatccaagcccacctacttgtgctgagcttcaaatcgatagttgtggtagcagtgaagaaacaaagaaaaaccattccaaccaacagccagccgggcaccttagagagcctcaactcatcgaagacactgaacctgcagcggatgccaagaagaacgagccaaatgaacacataaggaagagacgtgccagcgatgctttcccagaagagaaattaatgaacaaagctggtttattaactagctgttcaagtcctagaaaatctcaagggcctgtcaatcccagccctcagagaacaggaacagagcaacttgaaacacgccaaatgtctgacagtgccaaagaactcggggatcgggtcctaggaggagagcccagtggcaaaaccactgaccgatctgaggagagcaccagcgtatccttggtatctgacactgactacgacactcagaacagtgtctcagtcctggacgctcacactgtcagatatgcaagaacaggatccgctcagtgtatgactcagtttgtagcaagcgaaaaccccaaggaactcgtccatggctctaacaatgctgggagtggcacagagggtctcaagccccccttgagacacgcgcttaacctcagtcaggagaaagtagaaatggaagacagtgaacttgatactcagtatttgcagaatacatttcaagtttcaaagcgtcagtcatttgctttattttcaaaacctagaagtccccaaaaggactgtgctcactctgtgccct

SEQ ID NO: 20571 - DNA, 1231 bp, Mus musculus
tgtgtgtctggacatgtgtgccttgacatgctggtgagatccattctcttcttcgatctttatgccttctgaggattgatcttaggtctctgagcttgcatggcaagcacctttcccagctgagccttctcacaggctcaacctaaacagtgttagtatttaagtcaagtgtattagtacacccttctctgtagtcacagtgtggcatgtttggaggccattacaccagtagcaagtgactaagcatctgcatctctgtccaggcttcctttgcagccctgtgccccagttatgccaacactcagtgcagcatttgtggatgagaatttgcctgatgggactcatcttcagccaggaaccaagtttattaaacactggaggatgaaaaacacggggaatgtgaagtggaacacagacacaaaggtacgttttccctctgagggttaagacgcggatgtgcaatagcaaagggcgcacctgacaagcatcctcctgttcctttcagctcaagttcatgtggggaaacttgactctggcttctacagagaagaaagatgttttggttccctgcttgaaggctggccacgttggggtcgtgtctgtggagttcatcgctccaaccttggaggggacatacacttcgcactggcgtctctctcacaaaggccagcagtttgggcctcgggtttggtgcagtatcatagtggatccttttccttcctctgagagccctgataatgttgaaggggacaggatcagctcaagcaaagctgacgatttctcctgtgagcaagaggtgagcacttgggccattggcccaggcccaggttatttcctcagtcataggaatgtcaggcttgtgacacgtgcttatattgtagtccatgcacttcggaggctgaagcaagaatattgcaggctcaagactagttcttgctagggactgagagagggacctgaacgtaaaagaactcactggtagcttgttattcttgcagatttcccaacagtttactgtttctgaattcccatcagtgtgtcagaatatagtatagttaacttctgaagagagagggtcatttggatggcagtttcagaagttcctgtctgtgattaggcagatccagtgctttcaggcctctagactggactgacaacatacagcatagcaaaaacaaacaaacaaaccagaaaacacacttaggccaagatgacaagagaaagaggaagg

SEQ ID NO: 20572 - DNA, 2049 bp, Mus musculus
gagcgcgctgctttcagaaagtcctctgaagcatcctctgtcaccctctccttcagttacgcacacacatagtcagcagcactgtcaaccccattgacttgttagggaaacaggaaagttgtgcccttgcatctgatcacccaacactttgaataaggaggaaacactaggatgacagtgtaatacagatttgcaaagaagcaaattatatagaaaaatgtctccttgtctctgcacagcccatcgtttctgaagatcagaccacagccctgatggcccatctctttgaaatgggattctgcgacaggcagctgaacctaaggctgctgagaaaacacaattacaatatcctgcaggttgtgacagagctccttcaagtgaataacaacgactggtacagccaccgctattgaggactgaccttgtattaaataactgcctgccgctcagaggtggtctctctgctgtcattgagtgtgggtggaagcccttgcttgctttttaatctgatgaatctatgtctctgaattgtcaaaacagtacctgttacagtattttttggagcaaatcaaaggccagaacttaaattttcactgtagaaatgggatgaatggtaggaagacagttttcaactcagctggacagaactctcgccgctgtagtccgtggaagcgagtaacttggacttccttagatcgcttttccttctgcttgtattgaaattgagtattttcctttggttcatgtggatgtttttaatgggctgttaaatattagtttggtttttgttttttaaagattaaccttgaatgtttccaagaattattcacctagtttctataaccaatcgcaagcctcatagctacataaagacagcagatcaagaaagtcatgttcctcaaagacttagaaatgaggaacactttgctttcagaaggcctagcaggaacctggaaggacaggaggcattcgggttaacccacagcacccactgagcagtgtctgtcaaagtaattttgcataaattttatttaaggagaatcctgggtagtgtgaaatattttgctaatcctatggggggggcacctgttacagaaagggaaagttagtagtcgtccttttactgactgtcacagtggattggaaggacaagcatgtgcaaatactcatctcagtaaggtcgggtgtgggtgaaaggacacagaactgctgctgactttccgaatgtgtggaatccccttgtgaggtatccagccctagaaagccgagaacaggaagtaatgctttggggctaacccacagaaaggttagtttaccattagaatagatgggaagaaggctctgtcaagagttctaggtctcatttagtttataaagggaagctttgggtccagatggtgaaagaaaaggcaacacaacactaaagattttattcatgtttgagaaaaggtatctgaactccagctcaaaggggatagttaaaatagtattatttaacttagttggtatttataataaatggcgatcttaattactcataatatgtttatttacaatctaactcttgaatgcttctaaataaaccacaattcaaactgcaagccaaccaagctgtttattgtttaaaatgttttcctggggtttggggtagaggcagagccccatgatgtgagaaattgggtatatttggagggacctgtccatctaggtccagtttttcgttccgttgtacttgcacgtagcaacttaaaagaattgtgaatacgtgttatttgaaactcgtacctgaactagtttggtcctggcgatagcaacatttgtcctgtgagactcgcagagccggaagtgtcttccagtggcctctcaggaggagagggcggggcgggagcgaggggcggggccgagcccggcttggactccgagcttgtgttaaatgtgcagctcccgcagtttcgattttgctgagggcgttgtcacctggtaaggcgtccctgggaccccatctctttacccttttcaaagcaagaattcagagacgtttgggcttac

SEQ ID NO: 20573 - DNA, 2049 bp, Mus musculus; identical to SEQ ID NO: 20572

SEQ ID NO: 20574 - DNA, 1463 bp, Mus musculus
cttgagaaatgacgccaagcaacagatctggtggggagttatttgggggaagagaggggagggagggcttggagaaggggttgaggtagatgaacagataggcagacagaggggaacagagtcacgagggcagagaaagcaggggacagagaaggagagaatgggggctggggccagagaccgcaaggaacacgtgggaacagagagagctggagtggtgaagcagtcgttatcaccacacctgaagaagcaccataagctggttgcttgatcctagggaggagcctagcggaatcgcctgtaaactaataaattaagcagaaaatcgaaaggccccttttcctcaaggaccttttgttgtgggtgtggtctgaaagactgcgaagaagaacctggttgtatcgcagggaaaggtcaatacgtcccctctgcgccccggttgcgctctacagcgcagaagcggaaaaagcagtccaggttcgagctttcggcgcgcttgggcggggcatgcaaataactgctctgtggaactctgggagcaaaaacaaaaaactgcaaccaaaacttctcggcctccttgaatcttacaggcttttcgtggcgtaaaggtggtgtactcaatgaagaggagagtctgtgttggctgcatgtttgagtcggttggttggtgactgtgaattaaaggtgtggtcggtgttgagtgtatggggcgtgtgggcgtagttcggtatcgcttctcggccttttggctaagatcaagtgtagtatctgttcttatcagtttaatatctgatacgtcctctatccgaggacaatatattaaatggatttttggaagtaggagttggaataggagcttgctccgtccactccacgcatcgacctggtattgcagtacctccaggaacggtgcaccccctctggggagtaaagttggttttaaagtcagagcatggtgattgtagggcagtccagctttttaaatatgtctgtgttttcttcttcttaactttcgttagtttgtatcctgattgggttgtgtacacgataactgagttctcgtttgcgccagagctggagagatggcttagtggttaagagtaccgactgcttttccaaaggccctgtgttcaggtcccagcaaccacataaataaataaatcttaggaaaaaaaaaaagaaaaaagagtgtagcactggagctaatgtggggtggaaacattttaaatatgtgctttgtgggaagttttaaggaaatcgttaagctccgccctttacttgtgagggtttaaatttcgcggtagtagcttgcgcaggcgcactggctttaccatggcggagttgatctctttcgtagttcccacccagagcgacaaagttttgttggtgtgggatctgagcactgggcccccagccgaagccttaagtgtgaggggctgcgcggagagggcaggggaagggag

SEQ ID NO: 20575 - DNA, 1352 bp, Mus musculus
caagtcagcagtagatgcactgtaggtgaggggactattagaatagattccgtcttcaaaccaacactatgtgtcccgccatggcaggacactggtgtgtgtggctatgtgcacaggagtggagatgccctaggaagccagaggcatctgatccattgaagctagggttacaggtgaggcctcctgggaactgaactcagctcctctgggctctgacgctcttcactgctgagccatctgtcgatccagccccagccccaagatgaaggctttttttttttttaagcaattcacaatatgattattgtccgaaggaggtcagctagttagcttctctgtgccagtgtgtaccagaatctcttgtgaggtagtagctatatctgtgagtgaaggtggggtgcgggtgtttccccaattcacagctgtgagtgaggaaacaggataccagatgatgaggggctagggggacagcgacaccggagcagccacagcctgtactctcccgccatcccgatgggacttcatcttgcaggtcagctgctcctcttggagtcagtccagccaaagggaggaagaatgtctctcggatttcagcctggaggaggaagacctgaagctgtgtgatccgcactagcacctctgaccgtgtcaggtgacctgacctgccttctgactttgacaggaagttctgcgtgtccaatcagtgggttgctgccctccctccctgagcatccaagtgtgaagccttgatcttgctgggctttgtaggagggctctgggggagaggtctaaaggaggcttgagccccgtcactaaggtggaaaaaggttccccatgcaggcgtcccatcctaataaagactacgtaacaaaggtgtcttgtaaatagtgtgtggtttgggtccctgacttcagggagcttcagtaaggatttttgtctactagtgagggctgtgtcttgaaggtccagcctaatccactttgtcctgtgagccccaaggagaaagtggatttccctaaggagaaacagcacctggctgttttttatgttattcaagtgtgtgcgtgcacacacacacacatacacacacacgcatacacacacacacacacacacacacacacacacacacaccaggcagagttggatctcgactttgacttccctgctctttgaacatcttgggtccactcctccctcttagatgttcgccccatctaaggagttcacgacagtttgctttcaaaccaggattccaattcctctggggagctataccctgaatctgggcagttgactgctccaccccagaaggttccagtgctaaagggccatcaaaatatggctctcct

SEQ ID NO: 20576 - DNA, 1277 bp, Mus musculus
aggggaaggcccgggggaaggccaaaaatcccagagcactagttctagcaaaggagctgcaatcccaaggctccgaccgccccttgaggggatgagatccggtcgtcctgggccgccaaatacttagatagataagagagggggagtgtgtgtggcccggtctaggtttcctcttgctgtgagtgttgccagttcagtgcctgaaagattgtgaagaggagcccggccgaacctcggacaccgggtccgtacagcgtcgctctagcggcgccaggcagcgagatcggaaggcgcggtgggcggggcatgcaaataaggacgcggccgggtctccgcggaactctgggaacgaaaagcgcaacaaaaacttctcggcccccttggattcctcgggctttccctggcgtaaatgggtggtgggcaggatagaagaggagtttcggcgtcgggcgcgtgtttgcggtcgcgcgagtgttggggaccgtgagttgaaggtgtgtgcggtgttgagtgtatggggcgtgtgggcgcagttcggtatcgcttctcggccttttggctaagatcaagtgtagtatctgttcttatcagtttaatatctgatacgtcctctatccgaggacaatatattaaatggatttttggaagtaggagttggaataggagcttgctccgtccactccacgcatcgacctggtattgcagtacctccaggaacggtgcaccccctctggggaataagaatggtcagaaaaatagactttcgaagcttcctctctcctgcctgtggctcttacttcgcttttcttactcatgagcgttttggtagctgtctgtttctgtcgtagcttcccacctcggcctacaatataacccacgtctgtcaccgttttctttttctgagccatatactgttattggtcaccctaagaaataaatggcctctgccggccagtgcagtggtggcgcacacaaagttatttctcataatactggggttacaaatcttagcttgaccccggcagtagaggtgctagcctttaaccccagatttctgagttcggcgccagcctggtctacaaactgagttcctaaagctcttggtatgcacaatctggattttagttgttggtttttcgttacaagtttggataggtatttgtattttctcttttgaaggtccctcttcattccacaagtgtccctacattcggttctcaggagcctccatggcatactccaccaccatgtctgcttcatttcttgagttctttgta

SEQ ID NO: 20577 - DNA, 1191 bp, Mus musculus
agttctagactagctcggtctgcatagcaagtttccaagatggctaggctttgcagagagaacccctgtttttttttttttgctgggggaaaaaagagtacttcttgcgtgtaacctaagctggccttaaatatggtgcctcacttaatctttgcccccaaaagtgaacaaaagtgggatgaggaaaggcttcgtatgttgtatgctagccctctgtatgtgtttctctcaggattaaatttaggccctatgtatgttaggcaaacactctatcatttagctatatatttataatcctttttaaaaaaagatttattggtttattgtttgtatatgagtatactgtcactctcttcagacacactagaagagggtatcagatcccattactgatggttgtgagccaccatgtggttgctggggtttgaactcaggacctctggaagaacagtaaatgttcttaactgctgagccatctctgcagcccctgtatttgtaatctttagggtgagacttcaaaatataattgccccataaatccaaagttttttttttaaagattgccatacacatgttcagtgtttgtatcattgtgtgtgcgtgcaccgttgtggggccccacacaccatggacgtcagaagaaggcttcagatcctctagagctggagttgcagaaggtcatgaactgcctaatgggtgaactctgctctctgcagtctccaagaacatgaacatgtgcgtacgtacatacatacgtacatatgtacatacatacaatattatacatatcattttaatgttcagctcattaacctagctgttctgtttccaggaacatatcagttagatatgattgggtacatgctcaaggaacaataatagctgttcacggaaggatgggcctggatcagccagaaggggaagcagcttactccagcatagaataaccatgccatagagtactgtgtggaattaactgctgctgtgtatttatatttaatgttgtaaacgtgaaactggtatattgaaggaagtgagctacaaaatatgataaataaaacaaggcaatttttgtttagaaaacacatgctaggcatttctgggctgagcctatggctgtggcccacactgcaagcctgcaggcaggatgttcgctggggctgctttatggggctgctgtacagattgctg

SEQ ID NO: 20578 - DNA, 1437 bp, Mus musculus
acagaaaatgtaaacccctaggttcccctgtaaagttgctagacaatgaatgaatagtcccaagtgtgctatgattgagatgagacgtgaacaagaaccagaagggagtgggtttcaagaagaaccagtgtaagaggcaaagaggtcctagtgcatatttgtggcccatgagaaggggaaagtctccaaattctctactgaggcagagcgttcgtgtctggcctgacaaccctctctccacaggtggctggcgaacgctacgtgtacaagtttgtgtgcgagccggaggccctgttctctctggccttcccagataatcaacgtccagctctgaaggctgagtttgaccggccagtcagtgaggaggacacagtccctttgtcccacttggatgagagtcctgcctacctcccagaactcactggccccgctccgcccttcggccacagaggtggatattcttactaggcaccagtggcttccccttgacatggtggggttgctcagtgtatatatcaactgatttggtattggtgaaggccctctttctgatgcctgtagaagtctctggggtcagagctccactatcccatctgatactcctggccagactcagctgctaaccagagtctgcgggaaagacagtggaggcaggccaaatctaaaggcagtagccgaagttcgctgtggctcacctgtaccttcagttcagcttggcctctgcctaggtcttgctcagaggccaagttcctcacccccaccacagagatccagtgttctattctggggacatacagggacttcccttgtttattatggcaacagggccaaggggattctcagaacaccctgtgtctcccctctcccaaccccccatgggagacaaagttctgcctgggttctgccctgaacaggggggtcctgtgttcttggtgctgtgctctgggaggcaggagcatgtgggcggcagctgggggggggggttgggtggaagagtagggatggctctctgccctaggcctacccaggcctaattccacctttgcctcttatgccagaccttaataaagcctctgcttctccggttgtttctatttgctctttgcttccatgaggcaaggacctggggtgggaagagctatggccatgcagcagttgaccagagtttggagtctgtcccctacaaggccttccgtgaggacctgatgccctgttcctggagtctagctcaggccctcacttgcgtttctggaaatcccttgccgttggttttcctctagaaaatggattttggaaactctgctcttacctaacctaggaccgtgtgaggatctagaaataatggagtgtactgtttaacccagcagggcttctagaccacgccttgccacggttagcctgtccctagaaacatcctcgggtaaagacgtggtctgt

SEQ ID NO: 20579 - DNA, 1329 bp, Mus musculus
cctccccatgtctgttcctggtcctcacagcccgacacgccctgctgaggcagacgaatgacattaagttctgaagcagagtggagatagattagtgactagatttccaaaaagaaggaaaaaaaaggctgcattttaaaattatttccttagaattaaagatactacataggggcccttgggtaagcaaatccatttttcccagaggctatcttgattctttggaatgtttaaagtgtgccttgccagagagcttacgatctatatctgctgcttcagagccttccctgaggatggctctgttcctttgcttgttagaagagcgatgccttgggcagggtttcccccttttcagaatacagggtgtaaagtccagcctattacaaacaaacaaacaaacaaacaaacaaaggacctccatttggagaattgcaaggattttatcctgaattatagtgttggtgagttcaagtcatcacgccaagtgcttgccatcctggttgctattctaagaataattaggaggaggaacctagccaattgcagctcatgtccgtgggtgtgtgcacgggtgcatatgttggaaggggtgcctgtccccttggggacagaaggaaaatgaaaggcccctctgctcaccctggccatttacgggaggctctgctggttccacggtgtctgtgcaggatcctgaaactgactcgctggacagaaacgagacttggcggcaccatgagaatggagagagagagagcaaagaaagaaacagcctttaaaagaactttctaagggtggtttttgaacctcgctggaccttgtatgtgtgcacatttgccagagattgaacataatcctcttgggacttcacgttctcattatttgtatgtctccggggtcacgcagagccgtcagccaccaccccagcacccggcacataggcgtctcataaaagcccattttatgagaaccagagctgtttgagtaccccgtgtatagagagagttgttgtcgtggggcacccggatcccagcagcctggttgcctgcctgtaggatgtcttacaggagtttgcagagaaaccttccttggagggaaagaaatatcagggatttttgttgaatatttcaaattcagctttaagtgtaagactcagcagtgttcatggttaaggtaaggaacatgccttttccagagctgctgcaagaggcaggagaagcagacctgtcttaggatgtcactcccagggtaaagacctctgatcacagcaggagcagagctgtgcagcctggatggtcattgtcccctattctgtgtgaccacagcaaccct

SEQ ID NO: 20580 - DNA, 1167 bp, Mus musculus
gcctgcctctgcctcccgagtgctgggattaaaggcgtgtgtcaccacgcctggcacctgttgttgtttttaaaagcaaggtcgtgcttattcctttgtcatgaagagctgagtgattgcctcaccacgaagcttacgatatctactccgtcctttacagacaaagtttgccgctctagttctgcgtactgaggcagtgcaggcacagccactctcctagaggctagcaaatgagggctggtttcaccttactttcagtggcaatggactgggcagagagggagtttatcagatggaaagaagtggaggctgtccggagaattcagtacttgcctcagagaacctcagagctggcattctctggctcctgttgcccacagctgccctgtgatgggtgagccatgtctcccaacagatgaagatgtctctgttgcctctgcttctttacctgtgccatggagttggcgtacagcctgagatcccccccacccccacccccgccccgtgcactcacagtgttacgggttacattggtccagagaggagtatgtgatatacagtgatgtagggactttggaggccagggggcaagtggcctcaggtgggcagtgggcagcctctgtagttagcggaatgtatccttctgtgctgacaacaacatgacctctgttatgacaaacgtgaaatgtttgcacgaatcatcagtaacaaacgacaaacgttcattggacactcactgtttccatgggacatgcatttcccttataacaaccttgcaacaacctttcatgttaaatgatcttcctcatcctagaggagccaggctcagagagcacaaggggactctctagctgaggccacaggatttctagtcagtggcctagttgggtatcagtcttggggtgtctgtacttggctcccctcccccctcatcgctgtgctgatgtgggactggaacgtacctggtacaggaaattgggagctcattagtgctttttttttttaatctgtgaaaccatctctttgtgtttcatgggccaaatcctggtcctgatgctctggagggggcataattggttcctgttggcagtaacagaaggcccaggaacactgggactggctcgaggcaggttgagaatttgctagcacatactgtcctcattatta

SEQ ID NO: 20581 - DNA, 1372 bp, Mus musculus
ctggcgtacctgaaccatcttccaggaggggagctgatggtccagctgttcttcgtgctttatggggtcctggccctggccttcttgtcgggttactatgtgacgctggccgcccagatcctggccgtgttgttacctcctgtcatgctgcttatcgacggcaacgtctcctattggcacaacacacgacgcgtcgagttctggaaccagatgaagctactcggcgagagtgtgggcatctttggggctgccgtcatcttggctactgatggctgagttccacggggagagcctggtttgggcacaggaggccaccgccgaaggccaccttaccttcctccttgctggcccagttgttgtttatttatgcttcttggtttgtttgtttactttcttgtttttttttattttaatagttacatttttgggggggaagatgggagcccttgcgctaaagcttcatagggttttgttgttgttttcttgcctgttttaggggagagctgaggccagctgcccctcccccaagtggccagggagggaggagtccctgagaaaggagtaaggcagagctggggtgcaggtagaagttggggacagaggaagatctggaagtaagcaaatgtgaaaattccttttggaacctgacagatgcagctaaactaaacagtgcttttcagactagtgtgtgtgtgtgtgtgtgttcacacatgtgtgtcttcacatgtatagaagtagccctgtaaggaggggcagagtggctggtgctacagacgtcacatgggctctttgggggtctgtctgctggggcaggaataatcccagttctctgactctcgctctagagttgagaacaggcagggcctggtgtgctctgggatgtgcaaggtggagcaggcctgtcagtcagcctgctgctgcatctgttctcagcttcttggttggctggctgagtggagcacccacccaaacaccagaccacactgtcctccgaaaataaacattttatacagacattgtgtctttgcttctgtcttccccgtgggcacttggccattggctgaggttgatttgggggctcttgaaagatcatcttgggttataccccattctggtcccctatggttccaccaccaccccagttctaagagttcccacagttcttcaactatcttaaaagaaaaaaaaaaaaaacccacacacttcctgtcagacgtcattaatcccagcacttgggagatagacatctctgtgagtttgaggccagcctggactacagagtgagatccaggacaactaggactacatagagaaaccctgtcttaacctctttcccaaataataagtaattaaatttaaaaaaaaatcttaa

SEQ ID NO: 20582 - DNA, 2160 bp, Mus musculus
aagccaggcagccaggcctgggaagcttggctcatattgtagaggagaggagaccttgtctccatttctgacttggctgcttggtctcttgcaggttgaaaaacattttagagacgtggaaagccaaaagatactgcagcgttcacaagcccaacaaccacagaaggaggctgctctgtcatcctgagtccacaaacagggaggactcttccagcatccagccacagcgatggtggtggtggcttcagtggaggccggccgggggagggaagggatcctatatttcctgctgactcttattagggtcagtgtttcaaaaaaaaaaacctagacttgaacaaacacccaacaaaaaaagagcaagagaataatttaaaagttgaatcattacttgactaacagacttcggcccaccatgcccttctcagtcctctgaacagtcatcttgttagttttatttttgcaaattccttttcactctgccctcctccacctgtgactttccttccctagtctgtgtctgccatcctgattttataagtggatatacttgccttctgaatgattgaaagaaacttttacatcttttcttccaaaataaaagtaacaagctgactgtgattctgatgttgagaccagagcagaagaaagaggtctcactttgaatttttcattttttttcttttttttttctttctttttttttgcacagggcatggcttgaattagttttatttttcttaactttaaatatatatatggaaatatatattaaaatgttctctaagtattttctgcttcttgcaggtctctttttactagatcatggccactcttcccacctcattcctctgaaaacaaaaatgtgttgtcctttctaccacccagaacccgacgattaacttgacttagttcacagcgaggatctcctgcagccctgcagagccagtgtgcagacgggatttggccttgagggtcctgatggctttctggtctttaactatatgtacctgtctcccattcagtcccagcctcaggactccctctgcctttgtcttcacggtactagacgaactctcagcactctccacccgggagtcagccgcccctcccctgtgcctctgcaggaagaacttgcttgcatggcacatctcagctcctcctcctccgggctgattttctcttctaagaacctggactccatctaccccagtctttcttaagtctatgtccagagcctctagcccaggaaaaagcttgaataacttctagtttctcttctgccgtcctcctgctcttctgccccccctacccctgaaatcttacaagctgatgacagtttgtatgtgctcagccaatgggcagaaaacctggaaagaatttctggactttagcccaccagtttgtctggtttgactaacctgctgagagccgaaactggtacttgttgcccctgcacctccagggtagtctcctggggcagagtgccaccacctgagtatcaggcactgagtgggacatgggtgatgctcatgtgactggctagagctttgggagtagggtggggctaatttttttttcttttttttttcttttttttttttttttttttggccatgatctcttttcccttcctttttttttttttaattaaataaatggatcaaaattaaataattcaagccctgccttcaaaatggaaaaaaactttttttttaagtattgtttagcaaaaacaataaaacccaaatttttttaaccatcactgatgtctcaggtttgtgcggtgcgtactttagcaccccaaatgaggggtctgaaatgtagagggatggggtgtgtctgctgagctcagcctttgtctgtatattgcctgcttttctttttccccactcttcttacccccaagaagtcattcagaggtgctgggtaaggtgtgttataaagagcagctagggtcagagcgatgggtgcacaagcctgcttaccccggtgtgaatcttgggacacacataagggaggagacccaactccacatacagactgcaatgtgcatgattatgaacacataagttttaaagggggaaggacccagggtttctctgtgtgtgtgtgtgtgtgtgtgtgtgtgtgtgtgtgtgtgtgtgtgtgtgtgataga

SEQ ID NO: 20583 - DNA, 1135 bp, Mus musculus
ggcaggagcaagctgatggaggtttattgagagctaagattcctatgaggcttgcttggggatgcttttcctgtaggttggtatcgttttttcctgtgtgtgtgtgtgtgtgtgtgtgtgtgtgtgtgtgtgtgtgaatgtgtggtttttggagacagggtttctctgtgtagccctggctgtcctttaactccctctatagatctgctagcctcaaactcacagagatccaattgcctttgcctcccctgagtactggaattaaaggtgctcgaccccccccccccaacttggattgctgtgtatgatatttatgcaatgtacctttgtcctgttgtccttaactttattttctcaccagaatgtccctcttccagtggaaaacccaaccatgcagacatcttgcttataaacttacagtatgtttcagaagtggaaataattaatgatcgaacagaaacccctcctcccctagcttcactcaatgttagtaaggtaaggactccagggcagctgttgctgtctgaaatgtcgggaaggagggggggtgctctccggtttgtggtgatggacagtgttcttttctgcttttttttttttaaattgatttaccattgtggtattctggtttttttccctcgggataaggcagggactactctcttcccttttgagtcaggttcttgtgtattttatgctaaccttgaacttaatatatagcttaagggtgactttgaacttgagattttcctgactcttcctcccaagtgctaggattacaggcatgctaccacacagtttctggaatgataggatcaaacacaaaccctttttccttcacgctaggcaggcactctaccaacttacttcttccccagcctttttttggtttgtatgagacagggtctcatgcagcctaggctggccttgaactttgctatgtaaactttgtaatagttactttgaactgagatctccctgactacatctcctaaatggtaaaattacaagtgagtgctactatacctggtttggtatcttttctaaagtatatttgtgtaactccttcacacccctttatttctgaacatttttgttgcaccttaagagataccttcgaaccaggcgtggtggt

SEQ ID NO: 20584 - DNA, 1203 bp, Mus musculus
gtacctaggtagtggatttcagttgactatagaagcatgcattaactgtttctagacaagagatatggggtcataacacatgggcgcagcccccttgtgagatggctacaagccagtggctctctggatcccaggctctcctggcaaagactcatcttccccacaggtccatcaacctggcttccaagtggtgtgaacggcccgagtgggtgcacatggacagtcggccttttgcctcactgagccgtgactcaggatctgccctgggtctgggcattgccctccacactccctgctatgcccagatacggcgggcgcacctagggaatggccagaaaatagcttgctttgtgctggccatggggctgctggtcttcctggaatggctgggctacccacctcagatcagcctcttctacatcttcaacttcctcaagtataccctctggccgtgcctggtcttggcccttgtgccctgggtggtgcacacattgagtgaccaggaagcaccgcccattcgctcctcttgatgtgttttgcctcccttgccccaaagacaacactcctcgaccaaccaccacactctaagagacagcccttttcctgggctccggagcaggcccgctcaccttgaacttcatttctgtctcatgctttgcagtcttagctcccttttaaagaaggacctctgtttccaggaggctaagccatcccccaggtccccacaaagcaaaagcaacaggaggcctggtggggagggggagctgctcaggaagaccccaataaagcccttggaacttgtgaattcttttcttgtctgtgctctcatctctaccgacctctataagtaccaacagagcctccaccccattcctgactctacaaagacaaaagtaaaagggggttggaaattctgctgggacctaccccccacctccccgccaaggccatggcagacaagatgagatatggcagtgacagttcactggaacccagccttccacagtaggacagatctcctgccctggccttcagcttctcagactgaattctgggccaagagtgaagaaaaggcagcattttggctaggaaaggagtgagaacttttactcccatttgcgagcccacagatcagacattattcccagaaagcactgccacaaataagtttatttacacgaagacaaaaaccatgtgttggga

SEQ ID NO: 20585 - DNA, 1216 bp, Mus musculus
gtttcccttgcacttcagtggaatgggttctgcagggagataaaccatattcatcccatggctgtagagccagaattcagtgtcacagacccggagccactggtgggctcatcttcagagctaatggtagggtgggtgtggaagagctggcatgctgagctttggattagagcttagactgttgcccaaagcaccctcccatgtccctcatcaggatattcaccatggcaacggcacccagcaagcattctacaacgatccctctgtgctctacatctccctgcatcgctacgacaacgggaacttctttccaggctctggggctcctgaagaggtacagttcctaggccccctttggagtccttcagggaggtaacaggccaggacctgccaggaaatcacagttcgtgatgctggtccccgtgacatctgagggctcctagtgggaggatcacacaggtctgactgccagttgagcaaagcagaggtcaaaggaggcaagggttggggcagtgtttggggtggccaggcagtgatagcaacctctcctaccttattgccaggttggtggagggccaggtgtggggtacaacgtaaatgtggcgtggacaggaggtgtggatccccccattggagatgtggaatacctgacagccttcaggtggggactgagaagggccaaaggaggggtggggcccagagctggcaggggcagcaagcactcagttggggtggtggaggggtatggcctcgatggagaacagagcatggcgaggtgcagcctggcctctgctggcatcagcttgggccatccctttacaggacagtggtgatgcccattgcccaggagttctcacctgacgtcgtcctagtctccgctgggtttgatgctgttgaaggacatctgtctccactgggtggctattctgtcaccgccagatgtgagcctactaggggtctgggagggtgtggaacactgaagtacaggagacagagaagaagttagcattacagggagcaagacttagagccatcttgctagttcaacccactcctctgctggccttggtgtgggccccaggtagaagtggagtagcaacaaagtatctttcactgaagctctctggccttgatcttcccgagatgctcttagatgatccagatacattccatgttagcctgttctccattaagttcactgacatttcacttcgtt

SEQ ID NO: 20586 - DNA, 1205 bp, Mus musculus
cagcccccttaaccggcagaagctggacagcaagaagctgcttggtaagctgcaagacacggtcccacatgtgccctgcgtccgagtgtgagagtgctgtcttagagaccaccaagccagagtaggcagtggtccgagtgggtgtcaccagcatggatactgattgaacatactttggggtgggcgtcaggcattaagggtggacctcttctagaggtaggtccccagaacaggagctggaggctctaaactggcatggaccatgcagtccgtgccaactggcaactgggacacctttcagagcgtttctgtctctctgccctgcaggccccatcagccagaagatgtacgccatgctgccctgtgggggcattggggtgagttgggtctgtgggagtgggagtgggcaagtggctttcccagcttggccccttcctcccccatccccgtggctgctggcctgctctctggtgcccactcccattcctcccctcccccccgcagagggcacactgaagcccgatctcctgcccctgcaggtggacagtgacacggtgtggaatgagatgcactcctcaagtgccgtgcgaatggcagtgggctgcctggtggagctggccttcaaggtggctgcaggagagctcaaggtaaggatgtataaggacataggccacgctgtcctttgcagcatggcaaagcactcagtcttgagtactaagatgggcaggagctgcagagacagccgtggtgtgagggtcgtgagggaccaagtaggcactaaggcctgagactcttgtgtttatctgcaggagagagacagctgtttgcccgaggggcctgcagctggcatttataaaagtgtttcttttcccatcactgtctggcttgtgcttctctcctgagtctgtctaccctgcctttcctgactggtgtccttctgcttgtacttcagaatggatttgctatcatccggcccccaggacaccatgctgaggagtccacagccatgtgagtacccctctgacctgacatccttctgccatccttcccacctttcacttgaagcaaatctcccatccatcgctcaagctgaactccgcgctctcttctcctccccacacccctcaggggattctgcttcttcaactccgtagccatcacagctaaactcctgcagcagaagctgagcgtgggcaaggtcctca

SEQ ID NO: 20587 - DNA, 1238 bp, Mus musculus
ctgggggtaagatcacctctcctgtcctaatggtgaagggctgggaggaggggtggctcaaagcaggcccaggtgacagctgcttctcctgtagtgtcgtccgtgtgtaacagtgcgcccggctctggccccagctctcccaacagttcccacagcaccatcgctgagaacggctttactggctcagtccccaacatccccactgaggtacaggattgaccgaggcccgggggtggggtagggggcacagaggtgcttgctttcttttggaaggaggagtttggctctctctggacttgagtgctcagccaagatgcctctgtgtacatttggagggttcttgcctggatgtgttgccttgaaaagagatttgtcccacaggctcctgaagggctctgatctctgtcaccctcgcttggggctcaggtccaggagtgagagaccaatcagagtccttggccttggtctaggttgctctccttggctgtctctcccttcatgttcttctctcccgactgctcctctagatgatcccccagcaccgggccctccctctggacagttccccaaaccagttcagcctctatacgtctccttctctgcccaacatctccctagggctgcaggccactgtcactgtcaccaactcgcacctcaccgtaagtacagggcacgtatcctagttagtatgttgaccttgccctaagggagccaagacggctcgacctgatctggttgggagggcagagagtacctgagggatgctggtccggagttggcaagacaggggcagtatcagtctgtgccttatctgtcatcaccctccaacttcaccaggcctccccgaagctgtcaacacagcaggaggctgagaggcaggcccttcagtccctgcggcagggcggcacactgaccggcaagttcatgagcacatcctccatccctggctgcctgttgggagtggcactggagggtgacacaagcccccacgggcacgcttccctgctgcagcacgttttgctcctggagcaggcccggcaacagagcacgctcatagcaggtgagtaggcgcatggagtgcctgggaagggttgtttggctctcatggggcctcaagtcaggcctatctcttagggaaaaggagccagggatactctccagccctgccacaccatcaaccatatcagtgatttcttccacattctgaaagcatcaggtaccaatgtttggtatgccag

SEQ ID NO: 20588 - DNA, 1170 bp, Mus musculus
cattggtgactttgaagcacctgatcaagatgaccttgacaaggccctggcaagcatggagttcgagggagctggcttggagctagaagccgacagtggagccacccagatcctgcctgccaagcactgtgaggatcctgtgttggcaaaaaaggcccgagtagctgatctgagtggatcgttacggaaggagcctatggtccactgtagaaatccatggccttccttgagacctacgtcagccacaggcagccttcctgtcccagctacatcatgtgtctccacttcccaacaaaggggctcccctgctcctgcacctcagtatctgccagtggctggaaggaccatccgaagcagcccacagaattatgggccgggccagccacttcagtctcccagagcgtggtcaagtggcaaaccccgtttttctggacctcaacgtccccacggcagctctgcagcattttgtcaggggcccttgtcatcccgagccccagtgtcttctgttgaatctcctgtcagcacccccagaaatacttccaccccagttactcagccagctcttcagacacctgtagttaccaaccacctggtacagcttgtcactgctaccaaccggacaccccagcagccctcccgcccctccattcgagctaaaacccgccgctttcctggcccagcaggacttctgcctcaccaagtgagtgactggttttcctgggctctaagatccggggaaagaagcagtagtctagtcttagaatatcttcactgtcaggagacaggcaagaagagtggagagaaaggacttacgaggccaggagagatggctcagggacggtgacacatgctttaatcctaactctggtgaggagatgaaagcttcctgggacttggtgactaccagtctagcatatggggggtgggggttgggggggttgggagggtcagctccaagatagagaccctgtctcacaaaacaaaggaggagctggagagatggcttagcagttagagcacttgtagctcttacagaggacctgggttcaattcccagccgctacgtgatgattctcacaacccaggggagtggacatactgttctgccctctgtgagcacaggcacatacatacatgcaggcaaaacagccacacaataaagtcatacgt

SEQ ID NO: 20589 - DNA, 1291 bp, Mus musculus
cactgcctctgagcaggagggaaaggagccacggaagcatagggcattccccattcctactggaagggcccaggggttgtatcctgcctgttgttgtgcgtagtgtcatagggagccagggaaaggtagaccaggccaccctcagacccattggcatgggcagactgccccaggggagccacctttctgtcctaaatggcagaggcttcagagctgagttttgtgggatcctgtggttgccactgaattgacccctgtccacctccctctgcagatgacctggatggactcctgagtgagctccctgaggacttcttctgtgagcccagcagctagggctgcctcaagacagggcatccaccatgagctggcagcctctctgctcccagacaagctaggtgcatctgggagagaacgccagtgcactggagacagctcaagcccatggtctgatgcctcccataaccaccttgaaatgcctagtgatgggccagacagtgggctgcctggcttaacgactcgacgacttcttttggcatgggcatcctggaaatctggccagggcttgctcccctacatccttatccctctggcacattgtcctccagccaataagaaaagtgggatcctcccaccccatcctaactttcaagaggctggacttgatttccttgttcctttattcctcaatcccctgccagctgaggagcccaaaggagccacaaccacagcagaggtgacctaaggcctgttgtccaccagggtgactgtgaggtgcaggctgctgtacctggttctgaaataaagcgtcccttcctcatttgccagcctccgtcccacacctccttctccaccctctcatcctctcctggccagggcagccaagctctaaggcagagcaaacggcacggagagagagagagagagaacacgtctccctctgcctccgcctctctagttttggtttgtgtgtttgctttttggttttttatgtgtatgggtcttttgcctgcatgtatgtctctgtgccagctctgtgcctggtgcccttggaggccagaagagggctttagatcccttgggactaaagttacaaatagttgtgagccaccatatggacttgaacccgggacctctggaaaagcaagtgctcttaacaactgagccatctctccagccactcattcttttattcgtatgatgcagacatgcacgtgtgtggacctgtgtgtgtgcgtgtgcaccagaggaatacaacaaaagaacaaaaacagaaacgaggctggggaat

SEQ ID NO: 20590 - DNA, 1187 bp, Mus musculus
ccggtcgcaagcgtcacacgccactgcacaacgcctgtgctaatggctgcggaggtctggccgagctgctgctgcgccacggggcaagccctggagtcaccaatggggcaggccacacaccaatggactgcgcgctgcaagcggtacaggacgcccccaactgggagccagaggtcctctttgcagcactgctggactacggggctcagccggttcaccctgaggtgtgttggggggtgggggtggggggctgaggaaggaggagccaaccggaacgggaatcctagactagaaatgtcctgactgaaaaggtctagaagttcaaaagcttcctccctgactagagatccatatccattttggcagagggcagagaactggggactgggaccaggaacttggaacttgtacacagggcaagctgaggctcgagaaagaccaggttgtctgcggcaatttatattagccagcctcgggcttgcctcagttggggcaacacggaactcctaaactcctattttgatttccagatgctgaaacactgtgccaactttcctcgggccctggaagtcctccttaatgcctacccatgtgttccatcctgtgacccctgggtggaggccgtgctcccggagctgtggcaggtatgtccacgccaagggccaagttctttactagggaggctagagaggccagaggcctctcccttcaagctccaagaccaggttcagaggaggaagatggacctcagacaaaagagggtgaaagccctgggttcctggcctgtctggagcagtgcagacagaactttgatcttctatactgcggagcctcttgctgacagacattcataaatcagtcagctatgacttggtgggaattccaccagcatgtctgggggggggggtaggagtggcccatgactaaaatccagtctatggcagggtgctatgtgctgaaaatttccaagccagaagtggtggtgcatgcctttaatctcagcacttgggaggcagaagcaggcagacctctgtgagttcaaggccagcctgatctacaaagagagttccaggacagccagggttgttacatagagaaaccctatctcgaacccaccccatccccccccccaaaaaaatgagaaaatgcccttctaccacagaattatcttatggaagggaaaatca

SEQ ID NO: 20591 - DNA, 1226 bp, Mus musculus
cccgctgcccccccccccccccccccccgctgccccgctgcccagctttctctgcactttgcatgtcctccaggagtagcttgtccctccactgacatcttaagccacctgctgatcttcaggccttctcagcctgtccccaaagaaacctttcacccacctgccatcaatagatggcctctgtagccacccaagcgacaagcaactgatcccatgcagtttctcctcaccgcctatatgcctgctctgccggtttcatagggacaggcccttagttggacttgatggctcagacctctaactcaggaggctgaggcagtagaattgtaggttcaaagctagcaagattttgggggagggatgaggggaccctgcctcctggcctgtgtgttctatccagacactgggtagaacttcaaagaatggtagttttgcttggttttcttctcagcactaggtatggaaccccaggcttgacataccacgctgaacaagtgtccagttacaaagccacacttctagctcttaatgaaacccatgtcctggaggctggcatgatcttttttttttttctctctccactaatttattcattttaaatatcctgatcgctgcccctcccctgtcagagtccctctcccccatcctcttctctgttaaagccacaattgtgacagctccttttagctcttcccaaccttctggctaaagtgaaaactcagcaggggcctgggatggagctcaatgttgagcccctgcccggtgtgtgtgaggcctaggctggatccggaacggaaccggaaaacagcgaagccaaccttccacagtgagtgacatcatttgggaggtggaagccggagttcaaaaccagcctgggctacataagaccctgtctcaaaaaacgaaacgagaagaaaaacctcaacaagatgtaggcaagattctgttgggtctgtcctccgacctcctccgtatacaggcccagcaacgtgggctcagtaaactggttaccacttccagaactgaacccttcttggaaactgcttggcacagtcttccccactttttggcctggacgacactctgttggtgatcctgagcttgaggctgtagtctttgaagaggcttttataatgtgttttcccttctgcccaaatgtcacatggaatcttaattggcagtcactctagagtggcttcgggggcccagaaagctagaaagctgtc

SEQ ID NO: 20592 - DNA, 2170 bp, Mus musculus
cacagtgctgtctgctacggtgggcatccagaactgcctcacaggaggcagccctttcccctcagtccccatgggcctccttggcagcaggagctgtccttttgttgttgggtgccgggaaaggacctccagcctctacagcttcaaggaatgggaaggggagggtaggaagagggagcctgtatcagagtggccccctgccctccctgccccagggctgtgagatggcccaggtgagagggacggtgctgctttatttgaaatgtttcttacctcattccctgccccaggaaggggcccagcctcaccctcctggggtggccccgtgttctccctcccatcctgccccctgccctgccctgctggggcagcctgagctcccagctgctgcttgccccccaccccctttcccttgaccagcttcagttcctctcagtgctctcgcctctaaagcctgccctctctcccctcccttgccgcttttaagttatttattctgtacttgtggtttggggctctgaggaaaaaccctaatcttgtgcctctctccctttgctaggagtaggatgggatgagaaggtagtctctgccctgggttgtcagtggagttaggaggggtgctcttgcccctctgtgggactgtcatgccagagcactcacctacctgacctgtatcccacctcccagcaggtagcatcacaccttggagctggaagatctggctatgggctgattgacagggatggggttgatcctgagcctagttttctggctcttgctatacatgtcccctcttcccaggaggaggcactcccacattgggtagctagtacccaagactggttggactgatttgggttagggacccagcgggctaagggaacaaccgtgctagggctgcagcgccctgtctggaacccagtctccctggggtggcgctcattgtggctgaggcctgcttacaagttgatttttaacccaagtattgtgattattttttaaaaagtcaagctaattttggcaggagttagaataaatccttggagcctgggcccctctgtccttggccctccatagccttctcgctagagggggaaagaaggttctcgggccggccccactaccaagcatagcttgggaacctgctgaaggtcaggggaagccggcccaggttcttatccctttggagtagctgcagctcaggccaactcactctgctctccttcccacctctcccttttccctctggttggagggagtagtttgggaactggtttgtccacaaaaacttccccattgttccttggctcaccctcagggcagaaccccctgcccaggctgggtgagagatgggcttggtccagcagggaccctgagggaacaaaccccttctttggggagtatgccctccctactgtgtagttgaacaggggctaggaactccccactccctccctctaacagcaggctgtgtgggtttcaattcccatcctccccaccctggctaggtgtcgtccaccctgtatcctatcatgtgtctgtgtgtgggggggttctgtactaatttccatggccggtggcttttccttccatgcatcactcccccccgcatgcccaggggccacccgcctggcattaccgcatgctggggtcattgggggaggggggtggggctcacgctgtcctgtggtcttgagatttttatttttgcatatgtaatccatcctgtacaggtagctaactttgtaaacgctgtgtattcccctctgccctcatggctgctggtgtaaataaactgcatttcccgttggtagcccggcctgcccactctcattgccatgttgctgagggcagagcagtcacaaagaggctccatagccacaaaatggatttttattcattcatactgaccatctaagggcttaggggagggcagtctatacccagagctcatccttggaactgggcagggcactggattagggccagtactcttgcagtctagaggcctaggataacagcagctgtggcctggcctcaatgctgggggcttggccttctgccccactccccttcctgactgagctctatacaggactatttacaaacaaacaaaaaaagagcaagcaaagtgctttaaaagaaagcaaaatatcctattcctgctaca

SEQ ID NO: 20593 - DNA, 3038 bp, Mus musculus
gctgggactcacttcagcccccttcccatcctttctgtcagaaacgtaagaacatgaccaagctccgaggcccaaaccccaagtctagccggaccaccctgcagtccaagtcggtaaggcacccctgcaaggtgggtgggtggctggcaaggtgggtgtatctggctgctgatgcgtctccacacctcccaggagtccgaggaggatgacgatgaggaggaggaggacgacgaggaggaggaggaagaggaagatgatgagaacggtgactcttctgaggatggcggggactcttctgagtccagcagtgaagatgaaagcgaggatggggatgaggtgggcaggaggcgtggtgggagggagggttgttgtagatcaccaggagggccacacacacggtgacggtggggtctttattctcccagaatgatgatgacgacgacgatgaagatgacgaagatgacgacgatgaggatgaagacaacgagtctgagggcagtagctccagctcttcatcctcaggggactcttcggattctgactccaactgaggctcagcctccaccccaggcaggcaggcaggcaggcagccaaggagagagcccctgcagagctcatctccccaactgacaacctttgacaacctttgtctctccctgtgttctgtcccgtaccctccagacttccccactttctttctttctttcttttttgttttttaaatcagtggggggtaggaggctgcatgagcccaagctaggactctgcagccttggagcctcagctccagggttctccagggacagcaaccatcagactgagccagcgctggacgggcccaccctgcccctcttctgcatttgcagttccggcatggacaatggactggggagtttgggggtgggagagagtcttaaagagtttggtgagacctccacacctgcagcctgcagcaaggtggatgttcggggggcctttccttcccagatgggcttgctacctggaccccccacattgaactggagggagacaagggtgctgccttcaagaaagcaggcagtggccctgtccctcttccctgcccctgcaggaaggagctgcctggacccgttcgtgggggaggggcagagtgtttttttatatatgtgtgtatatattttttttttaagctctgagctgtcaacgagacgtttcctaccgatctcggctgccgtctctgttgtcatttctgggactgggagggcctgggatggggtggattgagacttaaaaaaaaaaaaaaggtctaggtatgcatagaatgtgtgtgaggctgtgtgtgtgtgtgtgtgtgtgtgtgtgtgtgtgtgtgtgaggctgtgtgtgtgatgtgcacacacgtgagcgagcgatacagcatgactgcgcctgtggataggagagagagagaagagtgtgtgtgtgtgtgtgtgtgtgtgtgtgtgtgtgtgtgtgtgtgtgtctagagcctgtctctttgaatctggaaaaagggtcggtagaggcctgggagatggtgtccctagcaggaacaaaccaaggctgcccctccctgccatcttccattgtggggttcagggacaccacctgatgcttcctatactagtttgcccctgccaaggccatgtccctgagctgctgcaggtctgtgctgtccagcaggaaagtgggaggggcaaaccatggcatgagccttaaagcttttctctggtgccctgggcttcaggaagttcttcctgccttgccccgtgtcctctggccatccccatttcctttgagttctcaggtctgctccctctttcctgccgccacccctgtatgcagaagatgctctctgcaactgctcctctaactgcttgccagcagtttgggaccttctgaagagggtcagtcccttgacggtgaaatcctagtcacctttacctgtggtgattatcagttttactatgttggccagaatttttgttcgtgctattgggttttgcttcttaaatgaaagccagaggtgggaagtaggctctccacagaaagtaggctgcagcccagctgccagtccctcttgaaagcaaagacatttgcctggactgtgtgatggagattcctaaagagaagattccctcccaccccaccccctgccctcagcgcgcgcgcacgcacacacacacacacacacacacacacacactgtccttattctaaaatttagtaccagggttttaagttcctgagagggcttgcagagaactccatctccttgtttgaacaccctggactgttacacttgagtgaaatgcgttttcacttagaaacaactttgaacaggacatgtgttcctcccactgcaagtattggaaaattcttagaggtagggctgtgggggtgggacatgttggtgctgtcagaggttgcccaggatatatttcagcactgggacccttctccttttttctaatatttaaggagtcttttgtaggtttcaacaaccaccacacttgaatttgtaccacgggagcggcttagacgtgactgtcccagatcaaggcccactgtggaggttttgttttcccctttttttttttttttttgtataataaagtgaaaaaccaaggtttgactttcgtctggtcactggaattaaataagtgggtggcaggggtgacccaataacaggtttgacatagagcccttgaagccagcttgtcctttctcgagccaagtgcaggtgactcgccttcccattgttctcagttcagccctttaacttgggcttggggagttgcagagtagataactttttcacccagagggcagtgctttaggtaatgagccactggggtgaagggttcagccaggctttgcaagccctttcaggtggctcagggagaggcaggcttagctgtggctcccctaactctacccagacttctggtgagaagctgctgaatccagaggacatgttctctggattaagacctgccttgcctgtgcaggctttgactaggttcctggacaggtaactg

SEQ ID NO: 20594 - DNA, 1199 bp, Mus musculus
ccagctaaatgatgctggaacacacttgagtttggaacctcttctgccctccagtgctcttccccctgccgcgtcacataagtgaccttgttttcccgtgtacaagggtacacggtctctccttgcctcaggctgcttcctcctacagaaacagacccctgtccagattctcaggggtgtaggcctttaggtaaacgttgtccgaacctcctgggcagagatggataaagcccaagacaagctcaggggggttccctggaagacagggaagcaaaatactgaagggagttcaacacgttaaagatgggagagagccaaacgtgaggaggagatgctgggtgatgaggccaagggtgtcagtgccgggcagtagggtctgaaggatgcacactggtgggcaaagaacacagagtcaaacgaattaatctggctgagctcatatgctcttactgttaaatccaaaatgggataggcttggttgggtaaaaccagctgtctgtggcccatacccaagcccaagtagcattaactggcagggctgccattgaccccatgggtgaggacttgggactgtgactacacacaccaccagacccctgaggggtgggagagagaggctaagaagcagaagcagggagggacagagaaacttgagtggagaaagcttaggcacgggcacactaatgtgggcctgtcatattgttgccggtcggctgtgtctggtccttcaggtaagtcacttcagtactcctgattgaggcgtggagggtgaaccctgagatgccttttaagttcccgtctgaggaggactgagggtgccctagggaggccgtgctgtttctggtttctgttgggaagcatggtggaaatgagctgcctccttgcttgctcctggtgcctcttacaaggaggagtctagttcagttgtgagcctctggtcctttccagtgctatcttgacccagaattgagaaaggaaggaaggagaaatggatgttatgcaagagggaagaggcataagaggagggaggggtttctaaaagcctggggctccaggagcacagaggaagggacaaggcaggaggggacagtgaccaagaagacaggaatgccggagacccagagctggtgctggatgggaaagaaactgcagatttaggccatttattgggaggtggtttacgttgtgagaactcatct

SEQ ID NO: 20595 - DNA, 1174 bp, Mus musculus
ttcactgggagccttaggactcacacctcaacctcaggccttgcatgtttgacactcacatagagcctgaccacatttagatacgttctttccctgatccctccctttctgatgagccctttgtccataggccctaaatcactagacttcccactccatctcatactgtaaataggggcccatggcagcctagcatgttaaaagtgattgctttgaggtaagcaagacaggattcccagtgtaacttaagtatggtggttattttatctggtccagagtcccttccctgatttaataggaccacggttatttttcttttttaggactgagccatgtactggttcagatgagaagcaaccaggggctttggggaggagggggtgaactcagaggctggggaacagatcaagagaagggcatgagccaggtgtggtgacttctcttacatgtcacagaccgctggtcccaggaagatatgctgactctgctggaatgcatgaagaacaacctcccatccaacgacagctccaagttcaaaaccacagagtcgcacatggattgggaaaaagttgcgtttaaggatttttcaggagatatgtgcaagctcaaatgggtggagatttctaacgaggtaagtgcttcccactttttgactcctgtaaataaatacatattgtatatgctatttttttttccttcagaaacagggtttctctgtgtagccctggctgtcctggaactcactctgtagaccaggctggccttgacctcaaatccgcctgcccctgcctcctgagtgctgggattaaaggcgtgcgccaccacgcccggctgtgtatatgcttttcatctcagagaaaacggggaaagcaaaccagtcactttggacagaaggccttcacgtgttcttctgtcagctctaatgtatgccttaggggaggaagtggcctgggcgatagcaaccgcctagtgctcacagttctaccacaatcttctaggtgactttggatactctaggggctgaatgagatgcaggcatggaagctacgttgaaatcagtctgtgactgctcttaggttgtccccaactacttgggcctctgtagcagatatgagcgagtgcctctgggtcagaagttgcctataatctatgttgtcgctttattttcttcatt

SEQ ID NO: 20596 - DNA, 1186 bp, Mus musculus
ctcagtctcctcctcccgcttttccccggccggttccccccgcctccgcaacccggcggggacccggacgccgcgcagccgccgccagcccgggagcgcagcggccggaccgcccccggggactagatctggattcccgctgctacccccctcccgacctcccaacgcggtccccgcctgtccgggcaggcgagcagtcggagaagcggcctagcttgtcccccgtccccgaaccacccggggccggagacgccgccgccaccacccagccaccccaacacgcacggaagaaacccggcgcagaggcgcgaccgcggcgggaacggccgcctcctccccgagcctgcggcccagccctgccggcgcccccgccccggcctccggggagccgagccaagcagagggcgggaggacggcggccgcgaggcgggggcgcttcgctcaccggccccgccgccccctccggcggccggcgagaactgcgcctgtcggccggagaaacgcgggctcctccacccggggcctcacttgggcctcgcttcctgcccttcctacccccggctcacggcgcccttccccgttccctgatcatcttgtctacagttctcccggtatcgccactcggcgtctaccgcagccgcggctcgctccctagccccggccccggcgcacgtcctccgccgcctcggttacccggcgcagcgcggcctctgagctccccgctccggcggctcccttctcggctctgagcgcggcgccctcccccgctcggccgggcacagccgcaactccctcccgcggcggcagcggctcctcctccgggcgcggcggcggcgctggggcggcggctgctgctgctgctgtggcggcggcggctgtggctgctgcctgctgctcctcgcggcgaaaagcacaaagcacagcgccctccgcctgcaggcagcccgcccgcccgcccgccggccccggcctcagctcgcacaccccccgccgccgcagcagcctccgccgccggagcggggaggagggagaagggaggaggaggagcgggagggggggcgggagaagcggggcagcgagcgcgtccttccccgtagagcgcacaccgacccccggggagcgagcgccagcccgcccgcctcgccggctccgctccctcccacagcctgcccgggcgggctccgcg

SEQ ID NO: 20597 - DNA, 1242 bp, Mus musculus
ctgccctgtttgaccctccctctcctctcccctcccctgccccccacccacccaggttctctgtgaaaaccctgctagagaagtacacagcagaacccattgatgactcttccgaggagtttgttaatttcgcagccattttagagcagatcctcagccaccgatttaaaggtaggccatccatcacctaccccttccaaccccagcctgtggcgcccagctactatcccgggctctaataaccttgatggatttctaacccccattcctggtcctggaccccattctgggctgtacatagaaacgagagcatagaaagcatagtgttgggagactggggagagggtggtgtgcccacagctccatcgctgtgcatgcagcacttcctctgtctctctgtctctctctgctgtcgagcttcggctcaagcttggggtggggggggctggggctaggggaggcattacctgtgtgtctggtggcttaggcttatgcatgcaagtgttttgtgacatggaccttttccaaactccctggtatcgctgagtcccctccctgccctggctcagcttgtgccccagcagggccagcgagctggttcagctcagatggacaacggggcttctgggactacatccggctggcctgcagcaaagtgcccaacaactgtgtgagcagcattgagaacatggagaacatcagcacagctagagccaaggtgaggggccataacgggaacacccctgatccccgccctggacagaggggccctttgcccacagcactccgaatggggaccataccagagggacagataggtccctttgggacagttaaaggtgatcgatccatgcttttcagggccgggcgtggatccgggtggccctgatggagaagcgtatgtcggaatacatcaccacagctcttcgggacaaccgaactaccaggtcagacctcttaggcagcagcatgctcattcgttgcctaagccttaagtccccacagcaaacttcaatacctggactacaagttccggcatgcagtgatagttggcttctcgaagatgacatggttactggactacagaggcctcagtcacatgccattttacttggccttatgccaggacctacaacacatagccctgccagctctgcaaacaaaggcagtcactctgttcttggatcccagtgttcagagcttcagtgcttagagtggggtttgctgagaagttgggtcctg

SEQ ID NO: 20598 - DNA, 2711 bp, Mus musculus
gggtagtggtagatagggttcttcttgtaatagaccaggctggcctcaagctcccagagatccaccttctccacctcccgagtgctgagactaaagatgtgtagcaccaacgtccatccacttccttaaggtttaaggggtggactaggagtccacctagaaccaagttggggggcgtggagtggggtgtgagtgtagagctaactggctcttctcaggactcaagcaagactctaggcagaggctgagccagtccatcgcaggccttgttcatctctgtcttctttccctgggctgcctgctggcttggtcaggatgcctttgtgaagattgtgcggcatgagggcactaggaccctgtggagcggcctcccagccaccctgtgagtaccctagtcatggctgggtagggaagggggtgcttgagaggtttgggagcccttaagtgattttcctggcctctccatactcccagggtgatgaccgtgccagctactgctatctacttcactgcttacgaccaactcaaggccttcctgtgtggtcagtccttgacctctgacctctacgcacccatggtggctggtgccctcgcccgaagtgagcacaactaaccattgaccttctgggtcccagtcccagcctcttgctagcctgggggtgggggagtatgttaaaccctcaggccctggggcagcagctgggtttgaatgcatgacctctttggcctgacctctttctgctgtcttaccaaccctcgcctccttagtgggcaccgtgacagttgtcagccccttggagctcgtgcggaccaagctgcaggctcagcatgtgtcataccgtgagctggcttcctctgttcaagctgcggtgactcagggtggctggcgctctctgtggctgggctggggtcccacagctcttcgagatgtccccttctcaggtaggcgctcggggtcagggcctagggtaaagggctcttggtaatgtttaaccaagtccctccttcgttactaaaatggccgtgaagtcataatcacttccctgaaccttgggtccctcattatataaggacaggtctagcagggacctagggttttgcctaggttttcctgacctaagtcgtgaggaggacctggttgagagcaggcaagcctgcacctgggatggtgtggctgtgggggtgaggggtgagaagtctggagcccacctccctgccccccccatttaatgagtgtgtatctccttctcaagctctgtactggttcaactacgagttggtgaagagctggctgagcggactgagaccaaaagaccagacatcggtgggcatcagcttcgtggccggtggcatctcaggaatggtgagttgactgccctgggggtagggccaccagaggtgacctacagaacattgcaatgcctgccagggagcctgtgtgctttcctcagccgcccttgagatgcgttagtccctctcagggcttgggaatggagctgagccctgtcctcacctgaccaggtggctgccacccttaccctacccttcgatgtggtgaagacacagcgacagatgtcactgggagcggtggaggctgtgagaggtaagctgggctggtgaggggagagggcaggcaggggcctgagctgagccctactgagccgggccttgcatctgcagtgaagccgcccagagtggactccacctggctcctgcttcgcagaatccgggctgaatctggcaccaggggactctttgcaggtctgtctctgtgaatgcactgcatatatgatacatatccatgctgtgtgtgtgaggggacctggacccctcactgtggtctgtctttccatcacaggcttcctccccaggatcatcaaggctgcaccctcctgtgccatcatgatcagcacttacgagtttggcaaaagcttcttccagaggctcaaccaggagcagcctctgggccgctgaaagtcggggagcaaccggctcttgcacgggtgggatcaggagactgagccaagtgccttccctcccagtccagtcacccaggctgtcctcagacctggattcctgctgtttcccttcccaggattgcccctctcccgcctcccgaattcaagaccaaatctgatgatcgcccttttttgtatccccatgtttgttatagcttggcccgaggagcttgggccaggcagtatcttggccccattcattccttgtctaaagatgatggtcttctgtgcacagctgtggctgtagtgtcttggggtacgtgtgcacgtttgggggtccccagtcagacacagtggcccacacctgttattccttcacttgggaggctgaggcaggaggagtgcctccaataccaagccagccaggactacacagccaaattctatcttcacaaaaaaaaaaaaaaccaacagcaacaaaaagctggcatctacaggtatggtggccccgagagttcatggcgagcagatctgaagcctgcctggcctacatactgagctccaggccatccagagaccttgtcttaaaagcttcccaccttagggggtacccagacagatctgggtgaaaggtgcctgtctggtaggtagtaagggcctttcatgtggggcccactgtgttggggtgagagcaagtcttagaagggtcagatccagaaagcacctgcagatgtacagaatccggagccccct

SEQ ID NO: 20599 - DNA, 1193 bp, Mus musculus
agacagagaatgtcctgccatccaggcctcacggcctgtcctctctggccccaggcaggcagtgtgggggagggccagcaatcttgggaaggaaggtggaccttcctctatcagcagatttgtttacacgtttctctcggtgcccgactcgacctctcctcgcccggggcgctcatgtgtccgcccagatgttgggtggaggggctcaggtgtttgatctttcggcctctggtctggaggagcatgtggctgagaaaatagccatcactgtctttggccgacggctattctagcttctttccaaacgaatgacgtaaccttgaaggtcacagcaacctttgagccttagttttcccctcggcaaagtgagcacatttctagattttaaagattatagaggcaaactctggatgagacctgagtgcgctgtcgttaaagtcccagagcaccttagctcatgcttgctccccactccccccactcaggcctgccttgtcagggggtaagctccatttgactgtggtgtgtgttttcaggattgaaattccaagatggatgatcaggaccctgggggcattagcccccttcagcaaatggtggcctcaggagccggggctgtggtcacctccctcttcagtaagacctggggagatgggggatggggcagctgggggttaatgtgggctaaaggttggaggcagtttggttctgataaagaagagggtgagtggtgtcctgaaggaaccttcagacctacctccttccccagtgacacccctggatgtggtgaaggtccgccttcagtctcagagaccctcggcaaccagcggtgagtaccagatcaaggcgagctgcctgacaaaataaggatttcccagagatggggttctagtgggggaggctgcattcctgaccaccagggctgacctttgtgtttcagaattgacaactccctccagattctggagtctctcctacaccaaatgtgagtgccccaagccccaggcccttgggagggcccagggaagaagtgttgagtatccctcgagtacctgggttacccatgatcatagagtagtacatgagcccagcagtggtggtgcacggtgcgcacctttaatgtcccacttgggaagcagaggcaggcggatttctgagtttgaggccagcctggtctatggagtgagttccag

SEQ ID NO: 20600 - DNA, 1198 bp, Mus musculus
gggtggggtggggggacagttgtgggtaggcggtggctggcccatagggaagccagaccagaccccactgaccactgcacttctgtttttacaactttctccactgctcggtttcccatatgatcatgtgactgatgactgtccctctccatcccccaaggcttttgaaagctacaggtggcagttcagtgccggcagtggggctggccatcctcctgtgtctgctgaggtctcctctgcctcccagttagcccacagtcccatagataaagccacaaaagccacatgccttcctgactgccataccccgtgccccccccccccacttacccagagtctcagccgtatgtgaggccatgaatccacacgtgttcatgcccacagtgtgtgccagctgacgcatgtgcgcttgctgcacactggtaggacgctgacacaagcgacacatctgcttgctttcctgttggcttgttgagaagactcaatgaagccagggccttggtcagagcacaggggagtgcgtggcctcagagtagaaggtggcacagagtttaaggtggctgccaaactttgcttggcatttgtaggcagaccatgtgggtcctgatgagctggctggccttcgcggcagggctggtagccggaacacagtgtccagatgggcagttctgccctgttgcctgctgccttgaccagggaggagccaactacagctgctgtaaccctcttctggtgagtgcctcctgccccagttggcaccccgggccttttgaagggctggctaccttggattgaccagagcaaggctggcacagaccctttggttgatgtcatctcttctttccaggacacatggcctagaataacgagccatcatctagatggctcctgccagacccatggccactgtcctgctggctattcttgtcttctcactgtgtctgggacttccagctgctgcccgttctctaaggtgacagtgccattggcttggggagttggggtgtgtgtgtgtgtgtgtgcttaaaatctgtgtttacctctttccttcactctaatagtcccaagcaaaagcgtcttgctcacacagacctctctgtgtccatagggtgtgtcttgtggtgatggctaccactgctgcccccagggcttccactgtagtgcagatgggaaatcctgcttccagatgtcaggtgct

SEQ ID NO: 20601 - DNA, 3151 bp, Mus musculus
ctggttcacacacgatgcgtttcacccacgggcacccacaccctactaaagaagttccctgcacaaaagaccaacagggcaggtgaggaggctgggagccacccagccagcagcacctggggggtgaagccacatttgactcttggatgggaaaaagtccccaccatcctggcaacccctccacatgcctcattgctctttcagtgtctttgcctttttctgtcgtgtgccctgatgctaagacccagtgtcccgatgattctacctgctgtgagctacccactgggaagtatggctgctgtccaatgcccaatgtgagtgaatggctggattcccctgagcccatatatagtcttacaaggaggctccaagcactgggctgatccctgagagctctaaggctcatgctgccccctagtggcggtttgaaatagtgtacgctatcagcctggctcgctccctgtcctcactactggagttcagagacttatacttgtcccaacctaggccatctgctgttccgaccacctgcactgctgcccccaggacactgtatgtgacctgatccagagtaagtgcctatccaagaactacaccacggatctcctgaccaagctgcctggatacccaggtacaggaccaaactagaccccatttcattccctcaataaagaggggttcttgtcagttatggaatggctatcagctgggtgggttttgatggccgcatggagggacctggcagttgtagaccctctccactggccttgcatgaggctcactgtgactgggttagctgtgtgctccgttctccgcacctggtcccactgcctttgatgatttggtctctgcccacctcacagtgaaggaggtgaagtgcgacatggaggtgagctgccctgaaggatatacctgctgccgcctcaacactggggcctggggctgctgtccatttgccaaggtacctgggagcagtgggcactgcagtccaagcggaaggggcagccagcttggtaccagtgcttattggctttgccctgtctaccttaggccgtgtgttgtgaggatcacattcattgctgcccggcagggtttcagtgtcacacagagaaaggaacctgcgaaatgggtatcctccaagtaccctggatgaagaaggtcatagcccccctccgcctgccagacccacagatcttgaagagtgatacaccttgtgatgacttcactaggtgtcctacaaacaatacctgctgcaaactcaattctggggactggggctgctgtcccatcccagaggtaacatagaaagggaggcagccctgagggggtagagatagcatcttggcctgggcaggtgggtggcaagagtcccgtggctttatttcttctgcactctgtctagtccagggtgggtacccagtgctgtgacctgtccccagcaggagaagctatgagctagagaggtagactcccatggtcctctgtagggacattcttctctgcccacccctaggctgtctgctgctcagacaaccagcattgctgccctcagggcttcacatgtctggctcaggggtactgtcagaagggagacacaatggtggctggcctggagaagatacctgcccgccagacaaccccgctccaaattggagatatcggttgtgaccagcataccagctgcccagtagggcaaacctgctgcccaagcctcaagggaagttgggcctgctgccagctgccccatgtgagtctccaccccaccgccctgggggaagggagctgtgttcttgggatatgagtgtgatcccatcccctcgctccacaggctgtgtgctgtgaggaccggcagcactgttgcccggccgggtacacctgcaatgtgaaggcgaggacctgtgagaaggatgtcgattttatccagcctcccgtgctcctgaccctcggccctaaggttgggaatgtggagtgtggagaagggcatttctgccatgataaccagacctgttgtaaagacagtgcaggagtctgggcctgctgtccctacctaaaggtcagtgtgaccctgactctggggctgggtgtggccatgggctgtattctgccctgtctagtacttactctcctttgactatccagggtgtctgctgtagagatggacgtcactgttgccccggtggcttccactgttcagccaggggaaccaagtgtttgcgaaagaagattcctcgctgggacatgtttttgagggatccggtcccaagaccgctactgtaaggaagggctacagacttaaggaactccacagtcctgggaaccctgttccgagggtacccactactcaggcctccctagcgcctcctcccctaacgtctccccggcctactcatcctgagtcaccctatcaccatgggaggtggagcctcaaactaaaaccttcttttatggaaagaaggctgtggccaaaagccccgtatcaaactgccatttcttccggtttctgtggaccttgtggccaggtgctcttcccgagccacaggtgttctgtgagcttgcttgtgtgtgtgtgcgcgtgtgcgtgtgttgctccaataaagtttgtacactttctgaatagtatctgatttgttgcgccagggccctctgataccagcattccccataggaaaaaaaaaatcacacatacacatacacatacacacacacacacacacacacacacacacacacacacacacacacacacagagagagagagagagagagagagagagaaagacagagctttaacctcaccagctttgtattttttttgttgtcaagagtgttatcacattatcctctagtctccaggatcgccccagccaccagccctgtgacatccaagcagcacccctcccctcccaagggtccacagagattgcccctcccttcccagccctcaccctagcagctgaggctggctcgcccctcctgctctcccacaatagatctttctatgtacagccacgtttatacaggcactgctcccccaccccagccctcttccccagcccctcccatgggggaccgggtccctcccacctccctctgtttggaggccaatccagggtcccttcccaagacactcccccagcacataccacagatg

SEQ ID NO: 20602 - DNA, 1195 bp, Mus musculus
agaccagaggatactagagttgggacagttctctctttgttgggaggtgagcacgtttataggtagagagatttttggcttcaaagttctgtgccgtctgcccagctcgattgctatttcagcagtagaggttcctttttttttttttctccagtgacactgaccagaagtctgtccatccctctcccctttgcccttcccccaggctctcagccctccttaacactgacccaaaggtgcttgtaatgcaggtctcatctcctttgttagtgctcttcctatgactagaactggttaagcagtcaactgactgttaaccctgcttgcctaggccaaggttctctgttcctgccttctcaaattcccagcagagtgggctgtgttagggaagtgagtgctgggcacttgaggcccgtccctgcctgagcttctcctaccttctgctcattgtccccttacaagtatcacttttaggataactagccctggaaaaacggtatctgtttgaagtgaagggactggttcttcttgctttcagcccgtgtaaatatttaaataaaacagtattaacatttttgtgctgcttctcgttaggttgtagatctagccatgctctggccgcctctgccatcctggaggtagttttccttaacttccagaatagtgattttaaaactttaaaaaaaaaaagggggggggataacctatccttacatacaagcataacagattgtatctaactttatcacatatgatagagatgtatatgctgtaaagtgaggggaaggagctttctaataaaccagtgctttgtgcaaacttagtggagtctgttgtgattgctgctgcataggctggggcaggtgggagtgtgggttacaaacagtgtcctgttggacgcagtctgataatgggccctctaggctagcttgaaatgttgaaaattgttatgagcactcaggtagcccatgatcaggattagtttaccttaagatgctttacctggatgcttttccagtcttaggcaggtgactggaagtgtgcacttaagattcatctgctgagcctttgacctccaggtgaaattctgtattaccaggcttgagttaccatagtcaactctgattaccgctgtaatgttggagtgcttctgcctggcctataagcctgaagccagcaaaagtcttcatccaca

SEQ ID NO: 20603 - DNA, 1302 bp, Mus musculus
gatttagatttgaggtttgctttgggtttactatcagggatatttaccccctttctattagtccctccctcctgtgtttctaagctagggaacaccagtaagtgctacccacactcctctgcagcaacatctccagactgtcaagtaagcctccttcctccctctactttctgatcctctgcacttcccctctgtaagttcaaaacattttcctcctctaatgggttgtcaccaaagcacttgccatgggcccatctggtcctgccttctcagtgccacgagaaaggccaggctgtctcttcagtggtgaaaactccacttttcggcagtgtctttgactatccgtttgtgacacgttatcccaggtgaggtggaagagggagtctaacctagaaccaaaagcaactcaggctgcaatttgatccactttccttacaaacagagccatgcatttggcactactgtcctcatgcccctcatcccagaagaggcatctacatatcccagaaaagaagatcctatcgtgagtagaagctacactgaacatagggtcacccatgtgcttcccagaaaggagctcgtgtctgaagggtatatttccttctgttatgttgatgttttcttcttaatttataggattttttaatgtaaaattgcactgaactctataaacataaatgctgctttttgtagctcatattaaaaaggttccgtatttgtagtatactgcaataatattttttacatccagctctttaagtgatccttgttctggtggctttctgtaaatatgtttgccctagttgaattaagaaactttaaaggttataaaagaaaaaaaaataaaatatttgttttctgctagatgcaaaaatgactaagcatgtatattttatcaacctcctgtattttttgaagttatgaactatataaaaatgttgacacttttttttgttttgttttgtttgctgggacagtgttaaataatttgcagtagttggttcatcctgcactgggactctcgggttgatgagcagcaggcggctgctgctgtcaggaggatgcacagttgcagtggtctccctgacgtgctttgttatacagagaaaccgtggactccatggaggaggggaggattggttcaacagctttattctctggaagcagtgacactcggtgattgtctgggaaaaggggtcctttggtttccctgggtaccttgttccagacagtcttatttgccttcctagtatttagccccctctgacaattttttaaatgtgccttgtgggttggctagac

SEQ ID NO: 20604 - DNA, 1191 bp, Mus musculus
tgtgattgtgtataccctaatctcagcactctggaaataaagacaggctgatttctgaatttgacgccagattgatctatataatgagtctgtcatctcaaaaacaaaacaaaaactgaaaaattaaaagaaaataaagttgtattattaaaaagatatattgagtgtagagcaggatagagtacctctttaaggatccaagttcttcactactgggaaaagtaaaagacaaactttgagaagagggggccaggcatagtggtgcaggcctttcatcccagcacttgggaggcagagacaggcaaatctctaggggttcaaaaccatgctggtctacctagtgagctccaggacagccagggctacacaggaaaacaaacaaaagaggaggaggaggaagatgggacagagccttggcttctgaatgctcagaaatcttaccactttacctgcaaaagcataataccgtggcgtgtgaaatatgtgtgcacctgtgtgtttcagtcactctccagaggaccattcccctcatattcttggtttggtcttagcctatacttcagatttctattttgtgtttaatttgtttggtgtatagaccaggctggccttgaactcagagatcctcctgcctctgtctccagagggctgggatcagaggtgtgggctaccatgcttggttgcagtttcttatctgacaaatttacaaattgcatttgcttcctgtgtttgtgcaaggattcatgtgccatggtgtgtgtggatgacaggacagcacttcagtctggtctgtttatccacctttacatgaactctagggattaaactcaggatggccaccctgaaccttctgaacctgctgaaccatctcatgagcccgatttgcaactttttctgtagtaaatgcatctttcttgggcatgttctaaggatatcgccacaaaagatgtatgtcaggctactttctggttcaggacatattataacacttgtttttcttcagaagcaactttagctattttataaattagcagttaaaagatggccaggtaaaaatgatcagtgtgtaggttactggtttggcactgggccctgtacatgcaacatcatttgttcattgatatgaggtagactgggctggtgagatggctcagggggtaagaacactgactgctcttccaaaggtcctga

SEQ ID NO: 20605 - DNA, 1209 bp, Mus musculus
cactgtgatagtaattctaagatgaatcgtgtattctgttgtagtctgaaaggttaaagcaacccaactaaacacttataagtgggcatgctgtgtgtgaagagagcattgaaccagatgctggtgcatgcatgacaagtctaaccctgcggaaggaaggtagggttcaaggacagactgagctacatagggcagagtgcttgcctagcttgtagaggcccctagatggagtctccagtgggtgagaggacgcaaaaggtcctgtgctctctgaactgctctagttcgtccagttaaccttgaagctctgcagtatttccctgtcaccagtgagtactatcctggatggtcttgtccagaaacaccaatccctggaacttgaattgggtacaatggccaagtacttgagaggttgcttcagtttggcagaaggctgccactgctacgttataggaaagggagacataaaacagcagggaagcgaggcctgggtttggtgttctaggactgttgataggagaggacaaggaatgtttacaggttgaaggaggtcagagcatccatatccaggaagtgactgaagcataggagcctctccatgttttatctctagctctgcttgtggccacacaagttgcataggaaggggctggtgagatgactcagcaggtaagagcacccgactgctcttccgaaggtcctgagttcatatcccagcaaccacatggtggctcacaaccattcgtaatgagatctgactccctcttctggagtgtctgaagacagctacagtgtacttacatataataataaataaatctttaaaaaaaaaaagatgcataggaagtctgcagtctgtcttcaattcactgacttcaaaaagaagagcaaccaggtggtctgtactctatagacaagtctcacactcagacctctgcctgcctcctgagtgctaaaggtgtgctccaccaatgccaggacagaatttcttacttaaaaagagatttcctttaaatagtagctaattttggtgtgtgaattttttttttattattttcaaggtttttgttttgttttgttttatgataaagtaagaaagaaaagcaatatgagcagttgtgacctgctaggtgctttgttgtggttgacaataactatagagccagcctggggaggtcagtgctagatgccctttctgaaaataaacat

SEQ ID NO: 20606 - DNA, 1190 bp, Mus musculus
gctctggtccctcgcaagtgctcttagccactgagccagctctccagccagcctttaacatttttttttaagcaagatcctgctttataatccagactggcattgaatttttaaaccaagtactaagattatagatgaacaccaacacatctggctgtctctaatcttcctactagaatttaattgatatagataaactcatattaaataattagaattcagtcttcagtaagacattttaattttttttaaaaaatttatctttagagtcaagaatgatggctctttggttaagagcacttgttgctcttacggaacacctggattcactttccagcatccacatagtggttccagccatcagtaattccactttcaggagatctaaagccattaaccttcaggcaccaggtacatgtgtgtacatgcatacatgcaggcaaaacactcacacataaaataaattttaaatttaaaagatgtgtttatgtttatgtgtgtatttctttgagactatatgccacatgtcgagggctccctgtagaggccagagagagtgttggattcctcggagcaggaaatatagttgtgagcttcccgaagtaagtgctggattttgaactccaatccttttgaagagtagcaagcatttttaacaactaaactgtctttccagccccaagaggtttaattttcagagctaagatgacagtgatggggggctggagccctagctcaatagttgagagcatttgttgctcattcagaggaccagggttcagttcccagcacccacatcatcatctgtaactctagagctaggggatcctataccctctttctgtagacaccagccatgtacatggtgcacatatactcaggcaaaacactatgcatatacaatacatatttaaagcagaaaaggcaggcctagtgactcatccctttaatccccgcacttgggggatagatacaagcgtatcactgtgagttcgaggtcagcctggtctgcatagtgtgttccaagacctccagagttagtgagaacttaagcaaaaccagaaaatactagaaagaaagggattggagaacagtagccggaaggaaatggtgaacggtagacaaaaagtacggaatgaaaagatcacttagttttcattataggggttgtctgtttgttgtttttcaat

SEQ ID NO: 20607 - DNA, 2231 bp, Mus musculus
gagacagtcatccagactgaggaaggagcaagagtattgcctacaggacttgggcctgaatcccttaactcactggtagccttgttccgaaacaccaatgtggaagatgttctcaatgctcggaaattggagagagactcacttcgggatgagtcccaaaggaagaaggaacaggacaagctgcagagggagaaggacaaactagccaagcaggaacgcaaggagaaggaaaagaaaaggacacagaaaggcgaacggaagcgataaccttggcccactctgctccttccacccatgaattgtgtgtctgtgtatttaagagaactgagactaatgtattttccaaaatttcctaaggctttcccccgttgtttacatgttgaaaaggaaaatcacaatcacttgtaaatgtgccatgctctggtggtgtgggcagtcaattattgttagaatctttaccaaagatctggagttagggtagcctttctattttagtactgaactcctgtgcccttcttttttaaaaaggtcttccctcattttgtatatttagccagatacagaaagctcacatcctgaaggaaacatgaccattctgagtttaaaaaaaagtacaaattgcttctgaggcactatttgccctaaaatataatgggcttttgttttgagactgggtttcattctgtagcccaggctagccctgaacttgttacagtgtcctttttttctcagcttcaggattatggacatagatctccacacctggcttgtaactattttgaggctgaaagagctaatgaagggccctgcctagatccagactttctgacatcaaattagggaagtggaggaaattatttggaatgtgatctaagtttttgtttttttttaatgtgtcaacttgggctcaggctgtagttgtgttgcgtgcctgcttagcatatacaagggcctgggactgggccccagtatggaagaaagacttaacctgtgggaaaaacaattatctttttaaatagagagctatgtatttttcatgtaatctgtgatttcaagaagatgattggagtataaggattatcattttgttaggtagagtttctttttttctttttgtaatcatgagttcccttgactcccctcttgattttctatcttgatttatcctgcaggcatgtcctaccttttgacattgtgacttggctttgttaaaaacttgcaaaaaaaatcatgttttaaatgttatgattttgtgttaggctgaatttatagctgtccttgacctcgggttggacacacctgcaacatgaatagtaagacctaataattcctggcttaaagaaactgaaggaattactcttttagagaaaaacactggaaattttgctaacacaatacttaaaagtatatagttggtggttaagcttatgagatgagtgaatggaaaacctgggagaggaaagggtggacagaattcaagtctgcttctgtcccagccacatccacttgtcaataaaggccttctgtacctgactttgggcaacaggtatcaaaagcctcaagagaacagtttctctgataagattattttataccaggggtcagaagactccactcacgggccaagtttggcccagtcatttttgtatggggaaaaaactaaaaaggttttttacatttttaaaaggaagacattcgtgactgagaccatacgtggcctataaacctagcatttggagaaagtttgctgacttttgtaacattggctgcctttgtgcagaagaaaaaaacatggtagggaaggagctctgctgcctctttgccctacaaccatggcattgcaaaaataaccacctttttctttttttaaataaactttatttaagtcagtgtcttctgtcttgttctttccaactcctggtggaaaggtgcttgtggctggtcccttgggagtgatctttattgtctgctcagcatagtagccatactctgcaagtggagtgtcttttcccttaaatgtacaaatcctttcaaagttttctgtgaagtaacgattagctcagaggagtaccttggtttttggagcatgagtaagttgactttgaagttttttgagggagtagtggttttagtcctttattatgtaatacctgtgagctctgcagagaagcatatgacatgttttagtaatccttactttatttaggacttggattctcaccttcatcttg

SEQ ID NO: 20608 - DNA, 1291 bp, Mus musculus
ctttttagcctctaagaagattttagagaagcttcaggcatttcccgccatgttaagattttcagaaatgagtctcggcgatgcccccatcctcactgcatccagcctgcttcctacccttgtcgatgaaacacttttcacgcttagtttgagatgtgtgaaggccttttttcccacctggttttccttaacgtccctcactgaagcagataagaaagatgatgcgggtgcctcaacagcaaacgtcagttctgacagaagtatccttctctttgtccatcccttgtgtttctcacggtcctcctggagatgagttgtcattttgctgtcactgctacaggctccctctctccagggaagtcctgtcctgtcagtattgggagccctatgcctagcacagccatggatagccaacttagcaaatactctacccccaaaccaagttaacaaggcctatgcaagcctccaacgtgctagggtgactaagttcctgatctctgtctccacctccaagtactctgtttaaaagcatgccccacacctagcaaaggaggtagcttttaaaattaatttgtatgattttcttattaattaattaattaattttttattatgagacagggtcttactagatagtcatggctaaactggaactatctatatagaccaggctggcctggaacctacagagatatgcctgcctctgtctcttgagtgctacgattaaaggaatgcaccaccacacctggcttcttgttgggtttttgttgatgtttggtttctttgtttgtttggtttggtttggttttttgagacaggagtttcttttagtccagactaaactcaaactggctatattggaggctgtcctttaaggtatgagccatcatacccaacttgagggatatatatatatatatattttttttttttttttttttttttttttggcctggaactctggttgcctgggggctgtggaaaagttttaaatgtgaaggttttatctttattcttaaaaaccttgtaattgaaaagagaacagaggctaaattcttgaagctgaaaatataaaatattaaaatatgtgttgagggagaaggtcccactaacaggtcactctgagatgttccctaagcaggtgaatgtagaactcccctttgaagtaagagggtacagtgcgctatcagggattatctcaggaattcacttttggcgtgacagactgacaggaaggccttgtgtatgcttaggctagtgctcttattgtatagcctaaagtagaaaaagt

SEQ ID NO: 20609 - DNA, 1584 bp, Mus musculus
cactggaaagctttctcttcccatcaaactcatgtttgtctgaaggtgctgagtctctcttggtaccatgaacagagctttaggtccagcagcaagcattttatgtgggtgtcttgctctttctaatagaaagctgttgcaagacacctctcattttgaaattctgaaagtattgttttgtttcttaaatctgaagtactaccaagcagtaatggtgcacacctttaatcccagcactcaggaggcagaggcaggtggatctctgagtttgaggacagccagggctacacagagagaccttgcattgaaaacaaacaatctggggctggtgagatggctcagtgggtaagagcaccgactgctcttccgaaagtccagagttcaaatcccagcaaccacatggtggctcacaaccatccgtaatgagatctgactccctcttctggaatgtctgaagacaactacagtgtacttacatataataataaataaatctttaaaaaaaaaaaaagaaaacaatctgaaatgcccgttctctctcactcacagcctgggacagacccagtgtgtatccgtttgcctttgctgctgcccgtctcttccccatacttaccttatcatctaggcatttatttatttacatttgctttttaaaggatctttaaacttcagcctagggaagatcctcattgtccctaacctttttagcaggtggagttaaagggaacttttcaaaaaagagtatatttttatatatcatgagtaattgatagacaatagggaaatgcctataattctaataagacgggcacgattttaaccacctaagtctagctaagacaagccccagttcttgtattactagctcattcagcagacttctactaaactgaaagacagaaaaagcacacacactctcagccatctcccagagcctaggggagaacatagtagcctgccagcagagtggttgggaattggggtaaagaggaaggactgaagcagaaatgccagaaaccaccaggcaaaggcattggatgccgggagcatccattggtttctaacaatgcccccagtgctgctgcttgacccagaatgatgagaatgttatttttttggtctagctaattcttcagcttctcagagtgtacagaaagttattctaggtcacctccttatgttcatacacagtgaagtttattttaccctcttgctaaagagttaatcatggcaaggattccccaactcctcatgcctccttagcatatttctttcagattttgagcatagactttttgcagaatacagcatttactccttatagagttctatggacctacattaagaaaaatgatcctggggctgggaagaagggtcagcagttaagagcactgcctggtcttccagaagacgggttcaaatcccagtaccacatggcagctaacaactggctgtaacttccattcgaggggaatcttttggcctctgcagacactgcacacgtggtgcacatgtaggcagaatacctgtacacataaaataataaacctttacaaataaatttgatttaaaaagaagtcatgc

SEQ ID NO: 20610 - DNA, 1618 bp, Mus musculus
atggcgaggcagacaagaaggcagctcggagcaaaccctatgccatgcgttggaaacagcaccgggctctggaagaaacggaagaggaccatgaagaggatcctatgatgtatccagagatggagttagaaagcgaaaaagaaaataaagagcagagccaaccaaaacctaagcatgatggccgacgacgaattcgagaggatgggctcatgaaaatctatgtgttgcagctgctggccaggactgtgtttgaggtgggctttctaatagggcagtatttcctgtatggcttccaagtccacccattttatgtgtgcagcagacttccttgccctcataagatagactgctttatttctagacccactgaaaagaccatcttccttctgataatgtatggtgtcacaggcctctgcctattgcttaacatttgggagatgcttcacttagggtttgggacaattcgagactcactaaacagtaaaaggagggaacttgatgatccgggtgcttataattatcctttcacttggaacacaccctctgctccccctggctataacattgctgtcaaaccagatcagatccagtacactgagctgtccaatgctaagattgcctacaagcaaaacaaagccaatattgcccaggaacagcagtacggcagccacgaggaacacctcccggctgatctggagactctgcagcgggagatcagaatggctcaggaacgcttggacctagcaatccaggcctaccatcaccaaaacaacccccatggtcctcgggaaaagaaggccaaagtggggtccaaatctgggtccaacaaaagcagtattagtagcaaatcaggggatgggaagacctccgtctggatttaatcttggttgggcttaaaacttgggttttcatagtttatggtaagcagcaacttgctgaataatgacttccattgagtaaacatttggctctggttatcttcagggatgctgttggctcatgatccaaactcaggggactctgaaggtggagctgggatgagtcgggagagggaaacacagtgttcccaggcacatgttctcagcaataatgcagttgcagaactttcaggttgtgtcttccagatccagagaagaactgatatatttaaatcattcttgttggacagtttttgtatgtacagtattatggtacagtttttttagtataaattttttttttgtatttgtacattggactgctgtagttacacttttttatattaaaggaaaaaatccttgtaaataatgtctgttaaagggtaatgttattactttgtttagcaaatattatcttgtgattagaattttggtagatggtacacttaataaaagtgcctctcgtgtttcaggaaaggtttaagatctatctatagggaaattgagggagaaacaccagtcttcgagtgtttggaagaagatccctgttagaaagaggttgagatctttcttctgtctgagagatcttgaaatctccttcctgttaccagagttgtggccgttcttggaaaatgtttccaaaggaagacagtgatttactgctgctgtgtgctttgatggaggatctatgacttgaaaga

SEQ ID NO: 20611 - DNA, 1193 bp, Mus musculus
tttacttaatttgtgtgtataggtgttttgtctacatgtatgtctgtgtaccacatacatgtcttatgcctgcagtggccagaagaaggcatcagatcttctagaaccagagtaacaggtggttatgagccattgtgtctgcttggaattgaattccagttctctggaagagcacctagtgcaagaataaaaagaaaagaaaagaaaagaaacatcgtacaatagttactgctcatcccatggttcccttgtactgtttttgggaaactattctttttattcagggggtggaaggaggagctaagcaagttgtaggctagctaagtccaccacaagagatgctgaaaatccaagaaaactaactagctaactaaataaatagaggcagctaatcacatttctattgttgaccttttttcctcaaaagaatttgagagccaaatgactttaaacagccatagccaaaatgaaacatctccggggaaccaaacaaatgggtgtctgaaaaacgtgaacaaagatgagaaactgaaacttgaaagtaaaatgcttaacttctagcctgacactagattctgtacaccattctgttttctgcttaagccagccacgaaagccactgcctcggaaaagacgtgttccccttcccctttctcttctctctcctctcctctcctctccactcctctcctctcctctcctctcctctcctctcctctcctctcctctcctctcctctcctctcctctcctctcctctcctctcctctcctctcctctcctctcctcgggagaactggggtgaagtcctttctacatgaaacctgtatgtgatccctcttgtgctggggatgtgagtgatgctgggaacccagccaggccctttagtgtgctaagtgaacactactcctgagctacacctcagctgtatagcacaggtcatcactcgtaagtgccaaaccgtagtgcaagactggctggctttaggatactcggtcattagatgatcttggacaacttgcacacattgtccaattctcactctggagtttatggagacccaggaatagactacctgagattgtcagacatgtgctttatacttaattttgaaaaatcctatgaactctgtttaacagaagaatgcaccaagattttgcttgtttctaatagtacataacagaaaaatgttat

SEQ ID NO: 20612 - DNA, 1153 bp, Mus musculus
ccttctggtgtgtctgaagacagctacagtgtactcacatacatgaagtaaatagtccagagtgacatgaaactcagaatgtagttgagcatagccctgaatccctgatctcactgcctcacctccaccaggtgtgcaccacatcctgttagcataaatagtttattatttggaccacaacagaactctcaacaattaggagctttgtttctagttgctttttatatgtttttcatggggaaacttacccctccacacacacacactttggaggtttgaaattgtatatatatgagcataatttcttaagataggaaaaataaaaaggagatctgtacacagagtagtgttcttaaactctaatagctagtcgtaaagctgtaaagtaacatttgggtttttaaaagcgtgtctaggactatatattaatactgcagaataggcccattgagcttaaactgaatctcatggcatgttgatattccaacaaaagaacacttgatatgaaggaaagtgattagaagatgaaaatttgcataacattcatgttgcaaataaacatttaatggaactcatatttgaaactgatttaaaaaaaaacacctgtatatgtgtagagggattaagccctcagcctcctgtgtgctaagcagtgctctcctctcctgatctaaatccttaacctctggtggctgttttaatcagtttttcaaataaaagtaaattccttccaaatactcaatactagatgaaaatcagtaaagaataacagcagccactgtggattttcaggcactgttgggctgaatgttgcgcagacctttaatgtcagcacgaggcaaaggccgggaggtgagttcagtctttcttggctgcataggaggtttgaggccagcctagactacgtgaaatgctgtctacaaaagcccagcaatttaaaaacaaaacaaatattagatgtgataacttccccttttttaattagaaaattaagttatgcatttgtgtgtgtgtgtgtgtgtatatgtgtattatgtagacaggttcatggcatgatgcacagatgaaggtcataaaacaacttttgggagttagttctctgttaaccctagtgaggcagggtctttcttggtgttgtgttgtgcagcttacc

SEQ ID NO: 20613 - DNA, 1169 bp, Mus musculus
ggtctcgttgactggagttactctgcggacactctgctgtcttgagtctagttttcttcctgaggaagcgcctggagttgggaggaggtgagcgaggtgattgatggcctgcgtatgggagagaagtctgaattcaggtgctaacatcactaaatgtttttcagctatgctatactgacatcctcttcacagaacaagaggtaagtgagtgtgtcttgggaaatcagactttgcctacacagacccaccagccatagttttgtagagactggggaggccttttccggagcacctccatttagtcttgccttatgcttctctcctgccgctttctgtcattccataatgagaactgggaaggcaagctgagtacgggggcagagcctcccagcccttgaatatattcaacaaatactgagaggtgatgttcatacttgtaaaactctatgtgatctctacaatatcccacagttcctaagatgtctcctgtgggaccatctgcttccaggaggggcttctctgtgaagggctgaggtccagtgtgccgcttgtctctttcagcctgaatctgtcccctcctttatcatctgtcccttttttccctaaagaactctgtggaaggctctcatacgtgcacaaagttaactaaaggaattgagggcagtgttccacaggataagccatcccagtagcgctgttagtgttgtaacagttactgttggagtgaggcagagcaccactgttcacaggataagccatcctagttgcattgttagtgttgtaacagttactgttggagtgaggcagggttttgtttgggttttgcttctttcagtggttccatgctgacctcagactccacatcatttgccgcagcctcatcagtgctgctgttagaggcctcattgtgggtttcagaggtttttcccttccctccctccctccctccctccctccctccctccctccctccctctttctttctctctttctctctctctctctctctctctctctctctctctctctctctctttctttcttcctttaaggtggttgtgggtgagatagggtctctctctatagtcctgtcttggaatttgctatgtaaaccatgctgaccttgaactcacagagatcctcctgcctctgcctcctaagtgttggca

SEQ ID NO: 20614 - DNA, 1199 bp, Mus musculus
ctgtccatcccctgccctgggtctcatgcatcccaggctggttttgatcctgctgtctccaccacataagcactaagatcactccgtaacccatcgtgccagcctcgtctgaatttaacctttctttttcaatcattttactgttgagatctgtataatggtaaccatgaaacccagatgacagagaacccctaaagttgtcttccaacctctccatgcactctgtggtgcatgcctgtatactttcatccagagggcactggtctcatgatcttggtttccagcctgtgttgtcttgtgagcaccctgacctagggctctgaatggtctgcagttgatctgaaagttgttgccggctagaaatagctggaccacctctgtgcctccctcctcggggagcttctgccatagtttgttttctctttgtttttccttccagtttcttagcagatctgatggacaactctgagctcatcagaaacgtaaccttgtgtggccatctccaccacggcaaggtgagaggctgttgtgcttcttggaatgggatttctctttgtacctgcttaacttctgagcctttatgaagtgctaaggctgggcaagtgattgggggacatgaagacaatgctccctgcatgttcttatggaaccgttgtgtcattccatccacttacatgcctgagccttgtgtttacatctagacagaaaaagggaaattaaaccttactctggtttttataaccttttatttcctgagggaggactttccaagaaagatttcatctttcattgaaaactaatcttgtggcttctgtgttaatcctttgctgtcccatagttctctttgtttttctctaccttccttcatgcctaaattacatggggcattgggagtgtgggggaaaggcacagattttcttccacaattgcaggtcttatccatctcttctttttcagacctgtttcgtagattgtttaatagaacagacgcatccggaaatcagaaagcgctatgaccaagacgtaagtagaacttgggctgagcgcaaggggaatgccttgcccctccggtccctcagctgcactcatcaacaggggtgtcttccgacggctgctgtgtgattggaatctattaataggcgtaagctttctcaagagcatggaggatgttaacctgcattatttttaggtgatccgtt

SEQ ID NO: 20615 - DNA, 1220 bp, Mus musculus
gccactaggaaggtggaaggaaggccatttgatactgaagcatacactagagttggtgtggtcctcatctctctgcacaggtgttgccatggtgatggctgtggaagacagcgtggttcgggtggtcgtgcgggtgaggcctcccacccctaaggagctagagagtcagcggcggcctgtgattcaggtggtagacgagcggatgctggtatttgaccccgaggagtgtgatgggggatttcctggcctaaaatggagtggttcccacaatggccccaagaagaagggcaaagacctgacatttgtctttgaccgtgtctttggtgagatggccactcaggaggatgtgttccagcacaccacacacaacatcctcgacagctttctccagggctacaactgctcaggtgagaactgcctgctgggtagtttctggcttgccttctgatatctctgctttgggggtggggtccactcattcacttgaattcctctgggtcctagtctacagtagccaatcagttagacaccaagtttgaactcgtggtgcttacaacactctagaagaaagaaacgtggaccatgaaaccacatgtgtgtgtgtatgggagtgtgagtgtgtgtattcacaaactgtggacctgtatcagaagacagccatagcatagggaaggaaggaatagttctcaactccagtgcagatcctactgaccagaagcccacaggctaaacttgagcactgaacggtaccaatggcagaagccttgggactctggtcacaggcagcaggggaaagggacttgggaaggccgagcttggtggaaatgttctgggaccgctttggggagaaagatttggccctgctgccacccgttccacattgtgtcctttatagtgtttgcctatggcgccaccggggctgggaagacacacactatgctggggagggagggagagcccggcatcatgtacctgaccaccatggaactgtacaggcgtctggaagcccgccaggaagaaaagcaattcgaggtgctcatcagttacctggaggtagggctgctcccgctctggcccatgtcacacttcattctcagaacacctggagggggtggggtggggaaaaggctccagggaacagatagagcccagtgagagaccaggtgaaaaggaaacctgtccttctgctcttgtcatcatcacaaagtaccactgcaggg

SEQ ID NO: 20616 - DNA, 1645 bp, Mus musculus
gaggctgggatccatggtcacgtttgctctgccctcagtgaccgtgatacacagctggcgcggctgatgaagcggaacaacctgaaccgggaggatgcagaggcgaggatcaacgcccagctgcccctgaaggacaaggcccgcatggccaatcacgttctggacaactcgggcgagtggagcctcaccagacgccaggccatcctcctgcacgccaagctggaacgctccatggagtatctgccgctgcggcttgggttcctgacgggcctcgcaggcatcgccagtctcctctacctgctcacccgttacctcctcccttccccctagctgggtacacccaggcagcaagccttaggcttccttctccttggaggcctgagttaggtaccatgtccacaacactacaactctcttgactctgagactggcccctgcggtggggcggctttggagtgtaaccagtctgggactcagcaaaagaagcccactaccccccgcgccccacacacacacaccgacaccccaccccacccgagccctaccattcctaactaccactgcagaacaacatccatggtggcaggaaaccagcggttagcaggctctgcggctctccctatggttacgactgtgtagccaaaagtgtcttgggcttgaacctttccagagcatctgccgcatcatggccacaagctgtctagtggaccacagcaaatccttccagactgaaggcctccttcaaatagagctctcctgtgtgcagtgtggttctcctcctgggcgtgccgtggctgggtcgagcagagccctttggagcagtccagcttctgatggagctttcctcacagctagccaccaccccgtgctctcggcattccccaggccccaagctctcctacctctgtgccttccccacatgctccctgccctgcagtatcttacccctggctgccccaggtcaggctccagcagccccagactgagttaggtgctatagagatcaccttcctgtctcatccaaatccacgagagaataacgcgtaacctggttgggttctcccagactgtacgcctctagatggcagggccgattcatctccactctagtgtaccacagcctgccccacaggtgctcaataaatggaattgctctaaaatgtccactgaattccacttggcctttgttcacactgagggggcctaagcataggactctagtcagacctgtgcacctctgggaagtcggtggagccgtggggagatcacatacactcgccacaggtctgctttttttcttccccaacccaattagaccggtgcagacatcagccttcccggccggcgtctacagacctgctgatgtgtagatcttgttcgcagcagcctattaaggccaaaaatgagtgtgactaatgtgaaggcagcagtggccattcttaatgcccctttcacagagctgcctaagcctcggagagcagctcattagctccccgcacatttccaagcaacaaaaaagggctgggacggtcagtgaagagctgtcactcacagagtgtcacagtggcctgctccctcgggtgggtggggtcgagcagaaacctggcagagcagagttgtgaaccccagcggtgccctgtaactg

SEQ ID NO: 20617 - DNA, 1166 bp, Mus musculus
tcatgtgcacttggggggctgtctatgggtttgagtggtacttggtttctgccttgctgtgctttgaaaagccagtgggcctttgcttcagcctcctttctggcagggcctaatctactcattgcctggggtacaaaggggcttttgggccaggccagggccagcatcatctgaccatcctgctccccaccagccggctctgttccccccagctggtttcatttgctctggtctgtctgcagttttcccacagggaaagctggaggtttccatgggttgtctgagaggtccctggcacattgctgcaaagcacagaggagcttagtcaacagctggagagggaatgagtcacccgggcttgctagacaggaacagctggttcttacccatccccttcaagccggcagccaagagcctccccgtgcatgtgttccttcaggcttccagctaaaggcaaagtgactggccatttctgcagatggaagtcgaaggcactcaaaagggtagctgctcatttggttgccatgggagcctgcacttcccatgtgtcttgatcgttgtgagcaagcaccctccctccctttctgcagaacaaaactgtatgataatcaagaaaccagccactgggaatgatgtacatgcttataatcccagtgcttgggaggatcaggagttcaaggtcatcctaggctatatagtaacccgagctagcctgggcaggtcccttcaggctctgctcactatctgttgcaataaaagtgtgaggagccagcacttgggaggcagaggcaggcggatttctgagttcgaggccagcctggtctgcaaagtgagttccaggacagccagggctatacagagaaaccatgtctcaaaaaactaaaaaaaaaaggtgtgaggatcgggctggcgagatgtctcagcggttaagagcactgactgctcttctgaaggccttgagttcagatcccagcaaccacatgatggctcacaaccacccataatgagatttgactccctcttctggtgcatctgaggacagctacagtgtactaatgaataataataaattaatttaaaaaaaaagtgtgaggatccagtctgagccctgccatacaccagagttgctctatccccagagattgtgattgcacccattccgagga

SEQ ID NO: 20618 - DNA, 3841 bp, Mus musculus
acactgaccgggagctgccttggaagccattggcccagtgttcttcaggatgccaccactgttcttccttgaaggaaatagaaacccagcaaaggctgggttaagaggtctgggctcggcatctgccctcccatggcagacattttcctctgaactcagtagacctgacctacacgcctggggaggcaggaaagttcctgcgtattgtcaactcaacatgacctttccccattggctctcctaggttgggttggtgttacagtaaccagttgccagtgagattctggataaagccactgagaattcaaaccaggaaacggaacccttccacttgttggtccaactttcacagatgtgagatctctggcaaacaaaacagaactgaaccggctttaccaaaccgccagcgaacttgacaattatattgcgatggcgtaggctgcgtgatgtcacctttagccatgtttctggtctccctattttcaatgaattaacatgctcatgcagccgtgatcaagggaatgtaactgctgaaacctagctcgtgattggcatattatggagttaacgggtgaataataaaagtatatatattatatatatataaatattctaaatatctttcatgttccaaatgtacaaggatgtttggtctctgatgagaaagaactgaatccagtcattcttcacaatgagagcccaaggacagcagcagacagatgtgcattgcacaattactgtctcttcagaagcggtggctgttgtcaggggcagcaggagaaagaggatctggggagcctcacctgttcccctttggaattggctgccaagcaggctttgagcaaggaggtaaggtctagggactgccagctcaggagagggctcagatctccagcatgacaggacaagctcttagggtggaactggccctgggcagaggccagactactgcatcctgagaccaggaagtggtgacaatcatggaagtagattcattaatcaagtccctcttccatctcctgggccttgtcccggaggacactattctaccaagtgattttagaaggcttctgagctggctgttggcagcctaacaggtgtgtgtcctctgagagactttgtcctcactgcttaggatgggtggcattttgaaaagaactttggaccttttgtagaatctggaacctcgttgagaccacatgagcgcaagctctgtctaaggcatattagagcaaggagggagctggtatcccagggaggctgagcaggcgtggtgtggcgatgcccaggctggtgagtcccagcccctgcctgtgccttcagcccctcagccatctcctgtgctcctttgtctccttcccagggcgtccagcccacagtggccgcaagaagcagtaactagagatgatctagacttggcgacatcgccagtgtctgagtctgattatcatcggtgctgttgtgggtttttgtggtggtagtgatggttattcaatgctgccagtttttccagaagtcgtcaagcccctgaccacgttggccgcccatgtgggcattcttgagtggtgttgagccaagtggctcaggattgggctgaactgtcagcgagccacacccagcctccttgtagcttgtgctacaagagagaaagctccacgtgacacatagtagggaatttctttgctctttctcctcttggcatcttgggggtcagggagaccttataagggaaagaagccttagccactagccaggttcagccttgtccccagaactgaatgacgctgtcgtacaggcgagcaggggtttgaggcatgctgtggcttctggtggtggcctgcagaaactaatgccgcatcgcctctgctgaaggaaactgtgctagggatgcgtcctgcttgctagactgctgctggagacagaagctctgcttggaggagtctcatcagaggcttagggacctccctctccttcactgtcctgtgttgccaactgcaagtgccagcgaaggtggccgacttgtgactccaagatactcagaccaaagaaactattgttcttggcaaaatgtgcactgagttctccagaagggaggggtcagaggcggggctcccctcagcctcagtcatcagacactaccctaagtgcccacactttaaaggacagagtgctcaaggctttccttcttgggcgggcctggaatgtggaaagccttcctgtcttactctctatcagctgcaagccagcccccggctcaaattgcttctggggtttggggaacacaaatctctggagtgagctttggtttcattgaccctggtcatgggacaaaaacagtgaaccccagggagacgctctggaagagctgctggcaaggcctctgtcccaaaaaccaggtggcttgctctgcttctgccgctgccttgagatgggcgccctgcccaggtctacaggagttggctcaggggttgtttttaagtcttatttttatctaaaccgttctggtatcttcatttaaccctcgtgggattaggggctaaagaggttcagagctactccacagtatggcagccctgtgactagcttggaccaaacaagaagggctttggggcatccaagctgacctgcctcaggcagcctctgttggaagaaggccttctgtgagcctaaccctagtcttctgccatgtcctgaaggccaccttttccttccctgcctttggatcgactctccacgctaccatagacactagtttgtaaagtgagctgggtagaaaggccttaactctgaattgaggcctgcgtgggcttgctatccccacccagacctgtgtctgaaagtattgctatctgaggattggctcacaccaagctctgctaacactcctttttttaatggaaaatttcaggccttgccccttctttctgccatttgttgccctcacttgctagcgctctgaagcccagaggcaggtgtctttgtggttttgaattctgtctccagagatgaccagcattcaactaacctgggggccccaaggctctgaagaggtttcatggagctgtctacgtctaagagagaaagagactctcagaaaagggagctagagcgtctctctagccctgtctgcctgtccttgaaccagaggagacccattgtgtcttgctgcagagtgaaggcaggtctacagacgggctgtgcccgaggaggagagctggggcggttttcattgaatgaaactaaagtgttaactgtggccatcaggtgctgcatctgagggtcggagagcttcactctattgtcttggcttttctttgggccgtgctgggggcgttcattgctgggatacccaatgtactgttccactccgggcatctcacttgtttctaataaaggaagttcaacggtctgctctctcctggtgttcttctggtcagcggtaggtggtatgtatagctaggggcccccagggccaccaacacacggccagctttgcaagacttctttcagggtgcatatgactctccccgggctttcccacctaccacagagaggctggtactgatgcagaagagcagccacgagctaaggaagaaccctgccactagccctgcacagtcgtgtgcgtgcatgcgcggcacaggtgccacagggtacggtctcccctcccatgtttccatgggactccagggattgggctcagatcatccattttgtagtgagcaccttaactgccgatatactttttatttgagatagtctcactaggtttccaaggctggccctgaaactcagctggccttgtttgagcctcctaaatagagaggttaagggcctctcc

SEQ ID NO: 20619 - DNA, 1167 bp, Mus musculus
gagctgggcttctctgcgttcagcttgggtagctgctgggccgttaacacctaaaggaggaagggagggagggcagcttctgcctgttccccactaggacccataccccaacccttgcccctctggagctccaagtcccttgtcctcacgctgacactgtccttcctgcacaaatgctcacccgtgggctgccctcatgccaggcccattcctggcctcccttgtctttcttcccctcagactggtgcctccccagagctagccttgacctgaggtggagacttggaccagccgactcacctggattgccagagtagttctggggggtccagggcactcagggtcaaaggtggtgttgagttgcctgaggtaagcaggtttgaggacgtagccacattgcccgtttatgaggaagcgccctgtgttgaggtccatctcataaccaggagtctgaaagttcagagccactgtggagtagacaacagggtcgaataggagcattttagtggctttctcctcccctcagattcagaaaagccaggctggacagatggtaatgcccagtccctgttgagacctattgaggaggggaccatgcagtcacctcctccctgcatttcttcaagaacagcgaagtggggttggaggggggatgtgatgacaaagactcccacccctgcccccaccgcccacccctcggatcagagccaagacctgaaaaagcttggcattgcttatctacctccaaagggaacatggtctcctttggccaggccctttctcccagaatctgttcatctcagtatttacttggcaaaatcgtcaggtaagggagtgtgtgagtgtgagtgtgtgtgagtgtgtgtgtgtgtgtgtgtgtgtgtgtacatgtggaaataaaggttttgaattcctttcttgctagttttgtttgtttcggtccagtctgaccacataacccaggttagcctctataacaaagctgggcttgaattcatcgctctcttgcctctgctccctgcgtgccggggttacaggtatgtgccaccaccccagccagttgttaatgtcaaccttcagaaaaatctaacttgtgggagctgaggaaacagctcagggaataaagggcttgctgggcaagcatgaggccccacgtttgaatcccca

SEQ ID NO: 20620 - DNA, 2607 bp, Mus musculus
tcatggaatcttcttgtattcctgaagcacaatggtatggtccagaacccgccccatctcctctgtaattggtcttccttcctcggagagacgaataactcttgcccaatgactgctcacgtttcttcagcgagagctaagcgatggaagaaggcggcctgggagacgccccctacgcattctatgattggctacgttgcacggcgcgcgaggacggcgggcccgaaagaagggaactacgactcccggctgccccacacctggactccgttacgcatgcgcatgggcggggcttacaagcttctatatataagaggcgccgagggcttggagacagcagttggaagttggcaggtggaaagtcaggttgggaggggaagccggaggaggaggcggaagaagagctgtctgaagggggagggagggagggaggaaaagaggaggaggcggaggagaactgagcggagcatcgagccagaggggagatgagtttgtctgtcctcggctaaggctccggcccggcctgaggaactgggagctcgggttggagcgacacccgtggaagtgggaggtggcggctctgggactttaaccccttgtgggctctgcggcaggggatttaaccctttgtggattcggcccctccgaggcagcgtcatcgggtagttttaaccctttcgggttgggtttaacccattggacttaaacctcctctccttgcgcaccaactcctcgtctgtgggagcactcggcggggaggcgtgaagcccacccctctgcatatttgcatacggtgcctgctgctgaacccccggacctgctagttggccacgcttgtgtgcgcttaaccctttattgactggactccaagttgcgattggagtttgctgacaggacggacggaaggcgtcactgcagaaattactgaccgaagaggactttgttggacatattttgaaaagaaagaaaaacctctttccttaagccagaatttctcaaacttccagaagagaactctactaagccatggccgagccactcttgacagaacatcaacaccagcctcaaactagcaactgtacaggtgctgctgttgtccatgaagagcatacctctgagcgccccccaagcgcggaggaacgggtgcccaaggaggacagtaggtggcaatcgagagcgtccttgcagtccggtagccgtccagggcaggagggagaagggggcctgaagcaccagctgcccccattgcagacgaatgcctgtccagaattgagctccctggagaagggcgagaagggccagaatggggaggacttatccactggcggtgcctccccgtcggcggagggagagccgatgtcagagtccctcgtgcagccaggtcatgactcggaggccaccaagcaggaggctcctgccgccggaggcgaggagccatggggacagcaacagagacagctgggcaagaaaaaacatcggagacgcccctcaaagaagaagcggcattggaagccctactacaagctgacttgggaggagaagaaaaagttcgacgagaagcagagcctgcgagcttcgcgggttcgagccgagatgttcgccaagggccagccagttgcgccctataacaccacgcagttcctcatggatgaccacgatcaggaggagcctgatctcaaaaccggcctttaccccaagcgggcagccgccaaatccgacgacaccagcgatgaggattttgtggaagaagctggtgaggaagacggaggcagcgatggcatgggaggggacggcagcgagtttctgcagcgggacttctcggagacgtacgagcggtaccacgccgagagcctgcagaacatgagcaagcaggagctcatcaaagagtacctggagctggagaagtgcctctcccgcaaggaggacgaaaataaccggctgcggctggaaagcaagcggctgggaggcgtcgacgcgcgagtgcgggagctcgagctagagctggaccggctgcgcgctgagaacctccagctgctgaccgagaacgaactgcaccggcagcaggagcgagcgcctctttccaagttcggcgactagactgaaaacttttggggggagggggcaaaggggactttttacagtgctggaatgtaacattatatacatgtgtatataagacagcggacctttttatgacacataatcagaagagaaaatcgccccggctttggtttggtaaatttagctatgatgttgcttgtgtgctttctcctgttctttaattatgtgaaactgaagggttgcttttcatgttttcctccttagatgttgtttcttaatgtgcaagtaatctgaccaagttataatgcatttttctgttttaaaaaaaaaatcccctccttaagcggagctataaggtggccaaatctgagacccattacattcattctagttataataaatttaatgtttgtaaatgtaacagtttcagtgtgatttctagagattaaaaatcgtgctggtttgtgtgactgcacttttgaggtggggtaccaagattgttaaatttatctatttgcaaaaatacttgaatagaagaaattcagt

SEQ ID NO: 20621 - DNA, 1240 bp, Mus musculus
aagcgagatagacatagagactcatacctaaatcctagaactcaggaggctgaagtagtattgctgtgagttcaagaccagcctgggctataacgtgagactctgtttcaaaaaaacaaaaaacagccaggcatagtggtgcaggtctttaatctctgcatgtgggaggcagaagcagacagatctctgtgagttcaaggccagcctggtctacatagcaagttctaggacaaccaggactacaaagagacaccctgtctccaaaaacaaagtaaaaacacagtccagttagatgactcagcaggtaaaagacactcgctgcaggtctggtgacctaactttaatcccctgtgtaaaagcagaaggagaggaccaactccccagagttattattctctgacctccacaggcatgtcatagcgcatatgcccctgcacacatccacacaatagtaacaaaaccacttgtaacttagtgttccacctggggcagcccaggaactaagttgagtgggcactgaattcatgatgattctacctcccgccctgtgccctcaggggactacattcctggcacggagacccacatggcaccagaagtggtgatgggaaagccctgcgatgccaaggtggacatctggagcagctgctgcatgatgctccacatgctcaacggctgccacccctggactcagtacttccgaggcccgctttgtctcaaggtcagcaatggccccaaacagctgtgcagggaggccggcagctacgggcccaggccacaggctagtgacagttgttcgtctgtgacagatgtgagcaatggcaggtcccttctgcctgttgcccaccagcccaccacccccacccccactcccagcatcctttagactaagtctggaggacatggtatcttgttgccaggcactgtcctgtcctatttggatgcaggtttccgtgttctaggagcctttccactggctgtagtgcagtcctctccctccttatagcagacccccaatcaagcgtagggaaggagggattggtggagagcgaacatgagatgtgacaggggaaggaggaggaagcaggccttgaatgtcgccttttggcctctagattgccagcgagcctccaccgatcagggagatcccaccttcctgcgcacccctcacagcccaggccatccaagaggggctgaggaaagagcccgtccaccgagcatctgccatggagcttcggag

SEQ ID NO: 20622 - DNA, 1204 bp, Mus musculus
cttgtttgaggacaacggcgctccgccggtaggtgactgggcagaaccccgagtcctaaagcgggacgccgagggagcgggcggggaaggggcgcctcccaggcggggactgggttgcagccgggctgtccacgagggatggctgggaggggtggccgggtgactacggtctaacccgctcgcacgctcagcgccatcagcgccacgctcgaaacgccgtgctcgcctagaacctccaggccgcgcacccacgggtcacacgcttgcccggaacgcgcgcgggtactgtctgcttccctttccccaacatccgtgccatcgagttcagccgccctactggcagacctggctcctaagtgtcccccaagagaaggtgatcgctccactgccctagcagtgacatgagcagcctttccctttgaactgcttgggatcacttgttctgagaggatcactgctctgggcactcagtagagcaatgctagtcgctgatggtgctgtcctccctcctcgatggtccttacccttctctaattctgtgttctactcggaacttttggaatctgtttatatgtactagtcccgtcctggaagctcttcccggctctggcaactttcagccacctgtcaccaagtgaaaagaaacatttgtctgaggcagagattcccacctgctttggaacctcatcatgttcattaacttcagacctccccccctccactccccaccccccagttgagattaaaagatggctgacagccctaaaggatggataggggtgtgcatgggctgtcaagtggatgagtggagaaaagtttcaaatatcagtgtcttaatgacatgttgttgttgttgttgttgttgttaattggagacaatgaacactaatgactggattaagggcgctaaaagaatgaactgaacgaggagtggcaccatgaccagtggacttcggaacactggcgagtatctagaaacatagtctctctgaaagattagaggattgtttcctaacttcagttctgcagggttttgcttagtaactttcccatttagtggtaggtgtggtcagatgcatagactgttgtccagttggtaagcgaagtacctgaaccaggtgtgagggatgatatgcctcgtctgtggcctcagagccatgagtgagggtgagttctccagatccctgaataagaacagcataac

SEQ ID NO: 20623 - DNA, 1748 bp, Mus musculus
cgctgctgcggccagagatggaggaggccagcatgcccatgaccatggtgttccagaaccaggtggtggagctcatcctacatcagtgcgcggacatcttcccaccgcactgactgtggaccgtgggttagctggaggccgtgaggctggacctcctctgaggctctccgcttcccacccccgctgcactgtgacttcaacgcccttccattcagagggtacagtgacccctggtgggcagttcatgaaatgtgatttctccctctcgcgtccccattagggccatttccctaattacagcgccgcctattgtgtggatgtgagaacgtgcctggtggagggaaatgaatgtctttctagttccaccaccaccacccacccacagctgggagaggggattttggtgagggcgttctggtttccttaagcctgtacctgtccaggccttggtggagaccctgtaggccccatgctacgcaagaggtcatgaagcagctactgacattgtctctgctgccaggggaggactgaccctggctgccagcccaggccactgactgcctccctcagccttctgctccagtgccaccctgatgcaggcctcctgagaacttttccgatgcttccctctctccttgggccacacccgctctctacagacgttcttcatactaaccacataccaaacctggcaatctggggcttgcagaagtcacagtacttcaggggtccataggtgatctgattccctgcaaaggctatccccacagcaagcccagcttctagaagagggagtcacgcccctgccccactgcagcacagcctgtaggtagaccagagtaaatgctggagcacttcgtgtaggttagaggttgggggccccccgaaggcagcagggaacctaccacagctgtttgggggggcagcatgaatagaagcctccagctgctgtctacaccctggctgggtgcctacctaaagcccccaaccactgtctacatcctggctggctggatgcctacctggtacccacttgccatgcagaggcctgtccgggaggtcacagccttaggcaaacagttgaacctgtgtcaactgcccgcttcctccctcgtgcacctcaatctatggatctgagcccccagctccacccacccccactgactcaacaaacaataatagctaatatttattgagcattcagactatgccagcctttcccacaggcttctcccttggtttcatgcagtccatatttattgtgggtcctcatgtgcctggcactgtgccctggggcaggggttctacgcatgcgttctggagcttggggctcccagtgagtacggctgatgcaagcccagccctgatggtagcagggcgcagaagagaacaaatagaggcctcttgctgtacacctatatatttaaagtcctaaggcaagctaatgactaactgttaaataaaatgtttattctcctactttggcgaatgtactctggtagtagcctggaagactggattctagcttaaacaccttggactctcagcagagcgttgtaggatgtggaaagctactctgaacctcagcctgcctcagtgtacagctgaggagggccttgaacttctgaccatcctgcctccacctctcaagcattgacattgcatcatcaggctcagctgacacctttccttccttccttccttccttccttccttccttccttccttccttccttccttccttttct

SEQ ID NO: 20624 - DNA, 1220 bp, Mus musculus
gtgctttgcctctgccctttctggcacatactgccaagagtgcaagtgtcatgtgccaaatggcctgtcattgtgaggctgggttctgtggccacctttccctccactcctcacgttctcacctgtaaagcgtccctccctctgttggagctcttggcttacctaatagctgtgagtacagcacagcaggagcagggggtgaccagcaccagcactgtcagcactttgagccttccctgctcaggaaggccatgaccttgcccacctcatccccatgcccccttaccctgcagggtagagtaggctagaaaccagagagctccaagctccatctgtggagaggtgccatccttgggctgcagagagaggagaatttgccccaaagctgcctgcagagcttcaccacccttagtctcacaaagccttgagttcatagcatttcttgagttttcaccctgcccagcaggacactgcagcacccaaagggcttcccaggagtagggttgccctcaagaggctcttgggtctgatggccacatcctggaattgttttcaagttgatggtcacagccctgaggcatgtaggggcgtggggatgcgctctgctctgctctcctctcctgaacccctgaaccctctggctaccccagagcacttagagccaggggcctcaggtggaatggagggtctccctggaaatgtgcctgtcctgtctagaggaggttaccccaccctccctgaggtgaatgagctgagtcacctgaagcttgaattgtgcaataaaacataggagtaggaaggcagatggcagaggctgccaagagttcatctgtccgtcatggaagacagcgctcaccagtggttgaaacaccaaagcccccagaaccacccagtgtatctctatctgcacccccgagctagcattaacacgtcccccaaactacaacctgatcagagcctcctttccttgttttgggatcctgaatgggcaagagtctgtcccctgtgggcctgtcacatgagggtattccagaacctgtctaggagatggagccctcccagtgtctgggctgcgagcataagagctggccctgtccttgactaagcgactgactgactgctcaagtgagagacttgcccccaccagaagagtgctcacgtgaacctcagcagtgcccacactattggaaaaaatgctattttatgcaatattctgacaa

SEQ ID NO: 20625 - DNA, 1182 bp, Mus musculus
gccttaggcttacagagatctgcctgcttctgcctcctgagtgctgagattaaaggaatgtgccgcaatgctcagtgtcaataaattaaaatagtagcagtagtagtaataatttgtgaaagtaaaagttaaccaaaattgaaaaatgtggttacttctggggaggatcaaaaatagcaagacaaacaaaccccgaagtttgtcatttaaatcagagaagttagtgtaaattataacttgttaatttttaaaattcaactttccaaacaacaccctctgttcagattaagtcagaataaaagtgaagtatttatctataacttaatacttgcttcaaaccggttcttctgcagttctgtctagttctttgctaaacactaaagatttgatacactcatatctatgattgtatgattttcccaccaacacctggtgtacatttggaattgcatgccttatatatgttattgtatcagacacagtggcaagtgttagagacatgaggagaaaagaaaaaccaatttctgtcttcaagcaatggcctctgcggggcatggtggttcagatagatctctagattcaaggctagcctggtctacaaagtgaattccaggacagccagagctacagaaatcctttaaagctttgctctaggcctaggctcttagctaatataattatacatctgtggtcttgactggtctttcctccccacagtgttggggatctaatggagggctgtaactgtcaagcatactctcttgagccacacttgctggtcctttctttgttattgttctaaagaaatactctgcctccttagcttgtctctgccgagtgcccccaagccaccatttcagtagttaaatacaagattgatgtttagttttaaaaaccaaaagatacgggactggagagatggctcagcagctaagagcacaggctgctcttccagaggtcctgagttcaaatcccagcaaccacatggtggctcacaaccatctgtaatgggatccattgccctcttctggtgtgtctgaagacagtgaccatgtatgtactcacgtacgtaaaataaataaatagatattttaaaaagagagagggagagatagggcgcacttgttgctcttgcagaggatctgggtttgattttcagcatctacatggtgtgtggcccac

SEQ ID NO: 20626 - DNA, 2522 bp, Mus musculus
ttctttgactatctaccccttgaaacatattagcaatatatcaatcagctaagcctccattttccccagccctttcaggccaccctggggatgtccctgggaagtgtgtttttgtgagactttcagggaccagagcatttttactttttgattgaggctgtgtcagtacctggtgcaatgcagaatttgtgtgagggttaatgtatcttgagcacacattgtattaatctctgcaagtactagaacgatctagtgagtttatttgttcatcagtcacaggccctgtccacccaaacagttctaaatttagtagcctcctagtaggaaaaacatgccagaactcctaagaactggaaactggtcagtattaatccatcctttgattgccctacctacttcctatgtttgcttaagcgtcctctgctgtctccctcttcacagtaggtgttacgtctcacccttccccttgtgtagccgtattggtctctcgggtacatctgtggcatccttttggggaactttatcaactatacacactttaaacttgagtttcctgggtattagctcagttctggtcagatgcaatgtctgttgctctttccctgtaggttaaatgtgccatagctggtcagaaagggggaatgtgccccctctagtcctgcagagtggaaacagtggccctagagacaggagacctgcagcatctccacacctcgatctcactttggggaggcagatgggcatgggcttttggctggccatagagtttgtactgcacagacctgactcctgtgccccctggcacctgaagatcccaccagacagcatgctttggaagatgtacaagctgtaattgagccatttgaactcaaaatgtgggcagcaaaggccctagcccctgcccttcattggctgttggagcagtgttttgtagtacataatgggtttccacctttgtagcagtccttggctttagtgaacttgatgttccaccttcacagccaggtctccctttggaatgaatttgtggtgaggtcagcactactgcctgggggcagggaatggacgcagaggatctggactcaaggggcattgagctggttgcccaggctgccctccctcaaatttccattcagtgccttgtgagatgactctgacctgattgggcaaactgtccttacaggctccagcagggaagggcccctagcctgagtgggatgccctctagtggaggaggcctgcatccttatcagagcttgtcagaagctgcagctagcagatgatgtgtgcaccttggtacagtcgtctaagtgacagggtttgaagctagtagggtgccagaaggaatctaagactaagaaaatagatgtattctccatgtatggccacttgaaggaatgctaaatccaaggaccaagtaaatagtaggttttacaggtttcatttcaagctttttctcaaaagccagcttgccttgttgaatttaaatagctttgattggcaatttatttacaccccttgttttcagaacatgtcagctgaataaagttgaggtttatttagaaaactttaaagaagcacttggcattctttgtcttgactacccctttgttcctaggctaggagcattcatatacactgtttcagagccataggctgggtagctagctgtctcagaagcagctgtagaaagtgaaagacatcccagacctgattcagaacagttctgaaggttcccaggtaaactgccatgtgtttgctggagccgctacctcttagatagctgttctcttgatagcattgggaagaatctggaaccagctctgcatatgtacaaagagcaagactggcaagtttccagtgaagtcttagtgtagcctacctacctcattccagaagagttaagggcttagaaacaactgggggctggggctgtcatttggtgccagggtgctagcctggcattcacactgcactgtgttccatcagcagttcaggtcccataattaaagcaaggacgtagggcctggggtgagggctcagcagttagagcactggctgctctctctgggtttgattcccagcaccacatggtggctcacagccatattaactacacactacagttccagaggatccagtgccctcttctaggaaggtccaaggcacacacacagcttgtgcacagaaatacgggcaaaacaccatatacataaaaggaaatagataggctaaaatacaaaattaggactataaacgtgaaggcagaggcatgtcatatcaggagaacttgaacacaggtcataaagccctctcgccatatctctgggagtcctcctgtaactcgcaacggcagaggagcatgttgctgactgaatagggtggggtgtcacctgtcctcaggccaagaccagacagaccctttgtactgccagcttccccatagcctttagtgtaggagacagccttcccaatcctctgagttaggttctgtgatatgcctgctgtgcagacagtgggct

SEQ ID NO: 20627 - DNA, 2381 bp, Mus musculus
gatcctgagtaccgtgtgaggaaattcttggccctcatgagagaagaaggcgcgtaagtacacgcagtgctcacccatctgcgaggtcccaagtcttccccagcgcatatgagcccgctgatggtttccttccttcctgtatagccttgttttcacgcactagcccctcgctgtgctgtgggtctgagggaccaagcaaggaagcaggctgtcgtgttggtctgctctccttggcttgcttcacaagacttccttgtcacagagcagagaaaacttgatggtccatgattcactggaacctgcttttaagtgcccggaatgtgaccattttcttttagaaagtgcccatcaaatagcaaacaaatggtggaaaatgtagagagaacaggaagcctcgagtgtttcttagtgaatagggttgggtttttttgggtttttttgtttgtttgttttggggtttgttttggggtttgttttgttttgtttttgcagagcttacagtttagtgtgtgctttggggtttcttttgcagtagtcccctggactttgattgaaaacggactgtttacaacagtgaccaagggaagcgaccaaggtgcagatggcctgggatcgtcactcctcacactcaagacactggactacgtgaagtgtccgcctctctccacacactcgctctgcatgactagtgcagtgaactccctcgtgcttttgagatgttctcgtgttccctggactgctgggcttccctcccgtgctagctaagatggttcctgcttatgtgggaggcatgtcacacccgtgcacgctgcccacaccgcgatccctaccacctgcccgaaggtcaacttctacatgagaccaagagcaaaggtagaggttccaagggagtcccttggcgctccccatgctaacagctgtgtatcccgcagattaggtcattgtctgttcctaaagaactaggctttgaatatctaagatgctgttctcaatcattttcagagatatttccaagttgcaatcaggagagcttttctaatcggaagtcaaatcattcctggggtggctgtgatatgctctgagtgtaattaatttgctctgtggtaagagatatgctaatcattgccacttggtagatgccgttaaaaccttatgaaagatacatatggaaatctgtacatccctaaacagaaaaaaaattaaaataatttacaagcctctcaattctaattagcgtccggctctaagtgggtcagttccttaggatgacgttagaggcctattagtgccatcgtcttccttttcctcagcctgatgacttacaattcatcctccttgtatctcaagtgatctgtagtgtctgcagcacataaataaaacactactctccagcagaacaagccaccccctagtcctctccctcagccctcgaatatccattccagcgtactcaacacacctcttcccgaagaggaactcagcgagccctttggagggtggtttgcctaatcagtgggttagaaggaatgcaattaggtcgtcacgtcattcgtggagatgagtcttagggcgcatgccactctccccgctgctgcttcaaacacaaagacagccatcagaagccgcccgggaggcttgctgccacaggggcacctgggtgatactctgacactgtccccacagtagaaggcaaatcatctcctagtcttgccgtctgtataccttgtttggggttttcatccctggcttattttgtggctttgaaagagtgaattgtgttgtgaaactgtgattcccgtggctagtaccgtggttccctgtccaccaccgtggtccctgttgtctgcagttctgcctttctcctcccaacaaagtcctacatgaattaatttatgtttcttgttcaacgaagttaatgtcttgtgtttttgtccaaaattatattgaaaaagatattatattgtgtaatgcaaattgaaggaatgcaataaagagtaaatatacttgaaatattgtatagaccagtattttatatggaacaggatcaatcactaatggggctgcatgacgaagtggccacagaagagaaacccctccttgctttgttacagcataggagatttttttttgttttgtttttaaatctctttagaaaaacattaaggaggctggagagatggctcagtgggtaagagctcttaccgctcttccagaggactcagttcaattcccagaattcacatggcagtgtacaactgtaactcacatggcacacagatacgcatgcaagctgacggcacatgcctttaatcccagcacttgggagacagatctctgagttggaagccagcctgctctacatagtgagtcccaagaccctg

SEQ ID NO: 20628 - DNA, 1222 bp, Mus musculus
atccttgctattgcttattttctgagctttttgttcagttagggttttttgtttttgttttcattttgttttgtagtcatagctgctttttaagtgtgaggtaaaatttcattgtagttttggttattagggggttttgaaacagtgtgttgttgtgtatcttatactggccttgaacttgccacgtttgtgcctcagcctcctgagcactggcatgtaccacacttggctttgaagttcactgagaactagtggtgtcagccatcttttcgtgtgctcttgggcattcacagggtgtctggaaaaactctgcaggacactgatgttggccaatgctggtcccccactgtctccattccttgaagaaatgtctgttcaagtacttagttcttgttgggttttagacaccttatatattctagccattaatccctttagcatgtatgatttgcagacatttgagaatttgatatatgaaaatatcctttgtactcttcaattctcaggctgggaatactgctaagtcttcttcaactcttgtgttttgtttaatttctttcaggccagcaccaaagtagaagtagacatggagaaggcagagagcctgcaggtgacaagaggggacttccttgcttccctggagaacgatatcaaaccagtgagtatgtgtgttgagtgaggtgtggccccacagagcgagcctgtgttatcaaggaggggaagcaccggtcagtaggtcagttggtcggtcgggcggccttctgatgtatgggctgtcctctgtagtttcctaacacgagagaatctcactgtagacacagcagtacaggttggttagttgaccagtatttgcccaaacacttcctgcggtagaaagcttactatccattttgagactttctgagttttgtttttctaggttttgcttgcttgcttgcttgcttctctcttctcttctcttctcttctcttctcttctcttctcttctcttctcttctcttctcttctcttctcttctctctcttctctcctctccttttccttttccttttcccttttctccctttccctttccccctttccccctttccctttccctttccccctttccccctttccctttccctttccccctttccctttccccctttccctttccctttccccctttccctttccctttccccctttccctttcctcctttccccctttccctttcct

SEQ ID NO: 20629 - DNA, 1148 bp, Mus musculus
ctttccatgtttcctactaggtaaaaaaaaacaatgctgttcttggtttagtgctgtttggttcgtgcttgacttttgtaagaggtcctcagtgacgttacgattgtttacgtaaactgaaagtatgttttatcttacttttggactctgatcatttgcttaccactcttaatatctgcgtccaggaatgaccaatagaccagatttgatagacgaagctctccttcgacccggaagactggaagttaaaatggagataggtaagtaaagtaggtcacgggtgtgcacgcgtgcatgtttatgtgcacatgtgtgagtgtgtgtctgtgcacacgagacttcacatgtggcttcagactctattaatgatagcaacctcatattaagtaatgttcattgtcagctgtccacagctggcctgcctagaagagaactgcgaggattgtgactgggtctcctgatggatccccaagactaggaaaatgtctgtttttatctcatcaggcttgccagatgagaagggtcgactccagatccttcatatccacacagcaaggatgagagggcaccagttactgtctgcagatgtggacatcaaggagctggctgtggagactaagaatttcagtggcgctgagctggagggtctggtgcgagcagcgcagtccacagccatgaacagacatatcaaggtcaggaactcattgaacagatgagaacacacggcccgtgcaggccaggccccattctctaccacagaagagaacacacggccagtgcacacacggcccgtgcaggccaggccccgttctctaccacatatgccagtgagagtaagctggctcttgatggcgaagagaggcagagtaaggattgctgtccactaaaggacaagcagcactgtctgcccagtggtgaccaccggtttatttgcctttggtcactcccacctggcagatgtggatttgacgattattgttttcaatcttataagaagcggagtcttttgcatccaggagctgtttcttgcagcagacactggatgtctgctactttttaagtttggggctagtcatgaagatgaatcttgaccttttccctcaaggggttcagagtcaggaaaatggactagtacagagtggtggtgg

SEQ ID NO: 20630 - DNA, 1227 bp, Mus musculus
ccagctttgctgcctccaagatacatctctttctcttgggctggtcccacctcctgtgcagctctccttggcagatgtctcccagctcgggcaccccatatattggggtcccacatatgttgctgtctccaacgtacatacccaggcttcacagcttcatgcaacggcttctcgggtgtttcatgcagggccttccctgctatatgcctggcctcagtagcgctctgtaaccacagggcacgattccatggccccctttacttttgtgttcttcttaaccctaaggccagcactaaggcagcttcatctcccaggatgggctggaccttggctaccccgaaacacatttgctgcagcttttgtttgttgttcctttccaggggcagagtattccttagctcttcgtctttcatggctggaggcttgcttgagtggtgtcttgcatggagggcatccctcttattccaatgcagatcggaccccaccttaatggcactaatatgatcgatgtggtgctcctgagttctcttcgggccagggtctaagccgcgccaggcgagggacggacattcatggcgaatggcggtcactcttctcgttctgccagcgggcccctcgtctctccatcccatccgtatgccggtggtgtgtggaaggcaggggtgcggctctctggcccgagcgctgacccgcgcgcacttttctcagtggttcgcgtggtccttgtggacgcgtcaggcgcccggttgcccttacgtgtttcacttcagtcgtgtctcgcttgaccatgttccccgagccggggaatgtggctggtggcgttgcatacccttcccgtctggtgtgtgcacgcgctctgtttcttgcaagcctcgaggtgctcctgaagcgttccaggttttgccccctaggtgcccgcttctgagttggaaagggaaaaaaaagattatatatatatttaatggcactaatataaccaattacaacctcttttctgacataagccttagctgtatagcattaaacttgtcagtgtcctttgctctccacactgtgcattttgtatttctttctgccccttttgctcaccttcactgcaaacctgtgtaaggatgataactaataaccatctgacatagttaatattagtctctcttgaaatatcttccaccaaaatagtctgttacaagttcaatttggcctccaggaggttcttaaggcatggat

SEQ ID NO: 20631 - DNA, 1197 bp, Mus musculus
tgaatccgaggccagcctggtctatagagtgaattccaagacagctagggctaccaagtagagagagtctgtctcaaaacaacaacaaaatagcttagaagcatggcatacatgggtatgtacatgtgtctgtgtaaaacatgtttataacataagacatagttgaacccgggaaccaaatgttcttgtagacccacagatggacgggataggtgagcaaggagaaatgggttagtgtgtttaagtccctaccttaacatagatgggaacgaacgatctacactgcccagtggggaactgcatgtcatgtgacaacatagatggaactatctgatttataatcccaaatcctttttatgtcaaaaatagccccactgctattttttcctcttggtgctttcacatagatgacttcattgcgtgcccctccaggccgttccagagccagtggcacttcctgtttggaaggggaggaaatgggtgctgcctgtctccatctccctaccttcctgggtgcagatgccacaccctgcccctgcacagtcctcccccaggcagctcatcatggtgagcgggactccttcagaatccctgcctgctcacatcacccctgcttcctctgaaggactcagagaacatactggagaccctgcggagttaaaggagccgaggcgatgtggtacctcagtgttctccaagtctttagcaagtacacgcggttaccagccttggcaggctagctgagcacctggcagcctcagccgggagaaccttccagatgggctgtaggcttccagcacaggtgccgagaatgatgctcttcccaggctcagacccttgggctggtcacccatgtggtccaggtcccaggtcttgggcccatttttggaatttctatttggagatgtgggggtggccactgagcatgggacagatggtgcattcctggttcagctcattgcctcagcacaatgagatcgtgccagcatgtttgcagatgctttctggttttctccttaaggaagtcgagctccaaagtggcttgatagctttcccatgggcccttagctcatagcagcctcactgggcagtgcaggggctgcttggcctttttcctgtattgcttcctgagagctctcctcccatccttgctctggatgctctggtcccccaacccagcacccatttaccagaggc

SEQ ID NO: 20632 - DNA, 1219 bp, Mus musculus
agtgcagccgggagggtggcacacagtgcgcagccgcaaccctagtgcgtagcgtggagttgggaggggaagctcaaagcaaggtaagctgaatgaatggagtggtgggagtagggaggccccaccttcagcagttggagtgctcttagcatcggaggtctccgaccctggttcctccgctccatcatcggcggggggctgtgggggagactctggaacatatacagtgagccctcagacctcaagaggaacctgagaactgtgtcctattgagctgtaatctctttagtgtggacactgtagcccgatgatcaaaccaggaagggaccagtgccccttacacaaccatgttccactcttggggttcttggatgagaatgtgggtgagacagggtttctctatgcagacctggctatcctggaactcactctttagaccatactggccccgaactcacagagattggcttgcctctgcctcctgagtgcagggattaaaggtgtataacaccacctcctggtgtgtgaagatataccttttaatcacccaggttcaacggaagcaaagcccttatattgacaacctgacaatgtatctggaaagcctgctcctgcttgagcagaaagccctctctggtcttcccagtggccgctccaccttcaggtcacagctcctcattgttcagctcagggaacgcattaatggctgaaggattttctttgctgactcccctaggctttcgttagcatggctgtgctcgaagcggggataatgctctttgtccagcacgtaagactcatcatgggaggtggccattctggtggtgtttacttcaccttgtgtggtgctttgaatttgcttggtccagggagtggctgttaggaggtgtggccttgttggaggaagtatgccactgtggggaagagcttagagatcttactcctagctgcctttggaacaagatgtagaactctgagctactccagagccgtgactgtctggacgctgcaatgctattcaccatgatgataatggactgaacctctgaacctgtaaatcagccccaattaacctcagaacctgtaagccagccccaattaaatgctgtcctaagagttgccttggtcatggtatctcttcacaactaaggaaaccctaaataagacatcatggttgaagagtttttagggtagctctgtgtatcaataggaatacatg

SEQ ID NO: 20633 - DNA, 1203 bp, Mus musculus
gggtagtgggagcggggacctgcttctatgcctggctcaacagtgtgcgccttgagcatcattatcgtgcgtgttgccctgaatgttccatgcttgaagaagctggtctgtgtagcacagcgaggctcacacacagctcaacagggttcccatcctgaatctgctaccttccatgaccccctcagaagcctccaccttacttttctttcagggattcaaagaccagaatgctcatttggctgaggagggggcaggtcagaagtctcccgctcatctgttaggagcgggttttggtgtggcatcttcgtttcttgggctctggattttgggcatggagtacgtttcatctcctgtaatctgttcactccagatatgtggtgtctaggttgtcgcaaagctcattgtcttttttcctgaaatgctccctggtcggctgtcttgcttcccaagtgggttagttatagtgccactgttggctgctggaacccaaaagctctaccaactgaagaggctttttgccttgcaatcataagatacccggacatgggcatagctccctaacgccatgtatgcgcttctgtctttgtcttctgccatcctacgtggttggactgttgcttcattgttgaagaatagctgctgcgctcccaaacactgtcatctgccttggaacaagaaccatggctggtgagacagctcagaggatgaaggcgtttaccatgcaagcctggggacccgagttcaattccccagaacctttgtaaaggaggaaggacagaaccgactctacaaagttgtcctttaagttcccacacactgtgatggcatgtgcccacagagatgtattacacacgtgttccataataatgaatgaaagacaggcagaggtggtgcacgcctttaatcccagcacttgggaggcagaggcaggcagatttctgagtttgaggccagcctggtccacagagagggctccaggacagccagtgctacacagagaaacctgtctcaaaaaaaaaaaaaaaaaaagcaaataataaaaataagaatgaatgaaattgaaattaaaaacaaaaacaaaacaaacaaaaacagtcaccaaaaggaccccgaagaagccaatgtgttgccaaaactaaatcaagagttttctattataagctcctcctggatgttttcattttcattcactggccagaactg

SEQ ID NO: 20634 - DNA, 1278 bp, Mus musculus
gagcctaacaccgaggtgacaggtgtcagttgcctgcattgtttgccagagaaggggttttaaatgtctcctcctttaaacaccactggggacccccccccccccccccccgcacatcctcagcgagtccctgcaaagagatgttcttaggttccctcaatgggcttagggattccctttgttctcttggctggccggtgcccaacagggcaggatttgtaaagtggccccaggcttctccctgccagctccccctcccctgttctgggtcagtcccagaacggacctgggctctctgattgagctgcaggctccacctctcgagcgtgcgtgctggaatgcaggggtgggctctctttcctgaaagtgccgagcccacagggtttattcttgcaatgtgctcctgcctccggccccgacacctgccctgccttctgcctcttggaccgatggccccagagcagcaagtgctggccctgtggctactgccttctcacgcttactcaccgtgtctgccttttcctctgtcctccactccccgctggccgatcctgccacctcccttacttgttttgcttcctaaggaaaggcggggctgttggctacactgcggttactgccctgcctgccggttgccttctcaacgtatagaaagatatgggttgcgggaaagggtgatctttaagatcgccgtccttgtccctgggctctgtaatgttgtttatgatacgttagcttcccagcccaggctgctgtggttagggagggaagccagaagtgtctggttttgctcacgtctggtctgttgctgggtctgagcgctccagctcccaagggctgcagagggcagatgctcctgtaggggaagttgggaaaaggcagctctcagggcagctcggatcacatgctggttgtctgatgaggctgcagtgcctagggtatcagggaactttataactaaggtgtactgcagtttgccagcctttgagctaacctgtgaccttatatagaatcacaagatagcctggcctgtggcctgtggccactgttgactacagaatggacctgtggagaaagctttcttagggagggggactggtggcatttgggttgtaggattccaggcttcccatctaacttgctcctggctctctctagggtggtgggaactgcagcagggaagctgcttctccatctccacctcctggctgggctgtggcctcctctctcgggctgctctgtgggatctagtaccctagtcagctgctcccccattcc

SEQ ID NO: 20635 - DNA, 4317 bp, Mus musculus
gcagcatcgacatggtggactcaccacagcttgccacactagccgatgaagtgtctgcttccttggccaagcagggtttgtgatcaggctcccagggcagtcaataatcatggagagaagagagagtgagagtgtggaaaaaaaaaaaaaaaaagaatgatctggccccttgccctctgccctccccgctgctcctcatagacaggctgacctgcttgtcacctaacctgcttttgtggctcggatttggctcgggacttcaaaatcagtgatgggaaaagtacatttcatctttccaaattgatttgtgggctaaaaataaaacatatttaagggaaaaaaaaacatgtaaaaacatggccaaaaaatttccttgggcaattgctaattgatttcccccccctgaccccgccctccctctctgagtattagagggtgaagaaggctctggaggctgcttctggggagtggctgagggactagggcagctaattgcccatagccccatcctaggggcttcagggacagtggcagcaatgagagatttgagacttggtgtgttcgtggggccgtaggcaggtgctgttaacttgtgtgggtgtgagtggggactgaaacagcgacagcgaaggctgagagatggatgggtggactgagttagaggacagaggtgaggaaggcaggttgggagaggggacactggctccttgccaagtagcttggggaggacagggtgctgcagctgcctgcagcagtcctagctagctcagatgcctgcttgataaagcactgtgggggtaacgtgggtgtgtgtgccccttctgcagggcagcctgtgggagaaggggtattgggcagaaggaaggtaagccagcaggtggtaccttgtagattggttctcttgaaggctgctcttgacatcccagggcactggcttcttcctccctccccgcaaggtgggaggtcctgagcgaggtgtttcccttcgctcccacaggaaaagctgctttactgagttctcaagtttggaactacagccatgatttggccaccattacagacctgggactttagggctaaccagatctttgtaaggacttgtgcctcttgggggacctctgcctgttctcatgcttggccctctggcacttctgtagtgggagggatggggggtggtattctgggatgtgggtcccaggcctcccatccctcacacagccactgtatcccctctctctgtcctatcatgcccacgtctgccacgagagctagtcactgccgtccgtacatcacgtctcactgtcctgagtgccatgcctctcccagcccccatccctggcccctgggtagatatgggcaatatctgctctacactaggggttggagtccagggaaggcaaagatttgggcctcagtctctagtcctacgttccacgaatccaaccagtgtgcctcccacaaggaaccttacgaccttgtttggttcactccattacttcctatcctggatgggaactggtgtgtgcctgcctggggatgaccttggacctctgccttttcttttatctaagtggatgcctcctaggcctgactccttgtgttgagctggaggcagccaagtcaggtgccaatgtcttggcatcagtaagaacagtcaagagtcccagggcagggccacacttctcccatctttcgcttccaccccagcttgtgatcgctagcctcccagagctcagctgccattaagtccccatgcacgtaatcagtctccacaccccagtttggggaacatacccccttgattgaagtgtttttttcctccggtcccatggaaaccatgctgcctgccctgctggagcagacggccacctccatagatgcagccctttctttcccgtcttcgccctgttacgttgtagttggatttgtctgtttgtctgggttcaccagagtgactatgatagtgaaaagaaaagaaagaaaaagaaaaaaaaaaaaaaaaagaaaaagaaaaaggaaaaaaaaaaggacgcatgtatcttgaaatatttgtcaaaaggttctagcccaccacgtgatggagagtctggatatctccttcctgacgtggctccaggccagtgcagtgctaacctgctgggacatcccatgttttgaagggtttcttctgcatctgggacctcacagacactggattgtgacattggaggtctgtgacattggaggtcaatggcattggccaaggcctgaagcacaggaccagctagaggcagcaggctccgagtgccagggagagcttgtggctggcctgttttgtatgaagatggtcctttctgatcacgacttcaaatcccacagtagccctgaaagacatctaagaactcctgcatcacaagagaaaaggacaccagtaccagcagggagagctgtgaccctagaaattccatgacgacccagtagatatccttgggccctctccaagcctgggccttttcaccatagagtttgggatggactgtcccactgatgaaggggacatcttaggagactcccttggtttccaagctgtcagccccctgaacttgcacgacctcctacagcttcagggactaggcctttgaagattaggaacctcaggcccacatcagccacttctgatgtacagttaaggacaatgtggagactaggaggaagcagccagcctttcccattaaagaactcttgagtgcccagggctacctattgtgagcttccccactgataagactttagctgtccatagaagtgagtccgagggaggaaaagtgtggtttcttcatcatggttacctgtcgtggttctctctcttacacccatttacccatcccgcagttcctgtccttgaatggggggtggggtgctctgcctatctcttgtggggtgatcagcccaaaaatcatgatttggagtgatctgatcagtgctgataggcagtttacaaagggattctggcttgtgacttcagtgaggacaatcccccagggccctttctttccatgcctctccaactcagagccaatgtctttgggtgggctagatagatagggcatacaattggcctggttcctccaagctcttaattcactttatcaatagttccatttaaattgacttcaatgataagagtgtatcccatttgagattgcttgcgttgtgggggagggggaggaggaacacattaagataattcacatgggcaaagggaggtcttggagtgtagccgttaagccatcttgtaaccccattcatgattttgaccacctgctagagagaagaggtgccaagagactagaacttggaggcttggctgtcccactaataggctttcgcaaggcagaggtagccagctaggtccctgccttcccagccaggtacagctctcaggtttgtggaggtaatctgtgaacttctcttcctgctgccttcttgtgatgtccagagcccacagtcaaatacctcctaagaaccctggcttccttccctctaatccactggcacatgactatcacctctggattgacctcagatccatagcctacacactgctagcagtggccaagatcacttcctttatctccatctgttctgttctccaggaaagtaagtggggatgagggtggaggtggtaatcaactgtagatctgtggctttatgagccttcagacttctctctggcttcttctggaagggttactattggcagtattgcaatctcaccctcctgatgaactgtagcctgtgccgttactgtgctgggcatgatctccagtgcttgcaagtcccatgatttctttggtgattttgagggtggggggagggacacaaatcagcttagcttagcttcctgtctgtgaatgtccatatagtgtattgtgttttaacaaatgatctacactgactgttgctgtaaaagtgaatttggaaataaagttattactctgaataaacaaaaatctctgttcatgagttccaagtacaagaaaacaatggtttacaagttctttcccccacttagaaaattcagaacaggaaatgaaggtaaatgccagacactggagtgagagctctcttggttcattctcacattcctctgctggcatactaccctccgacaaacagtactctgtgccttggcttacaaggcagcattcaagagctcctaaagcctgcgccagttcatgcaagctgaagaagtttggcgtgggcttcatttctggaacttaagtgtcgaggactggggctgaaacaaactcaagccaatcagctacaaacccagca

SEQ ID NO: 20636 - DNA, 1526 bp, Mus musculus
tggtcattgttcctagggaagcccaccttgggagcagtctcgataaacttctccccaagtttgaggtcagggccttggctctggaaactggtcatcaccagatcatcttgtctgtccacagtcagtccagccatgggaacgacggaccttccctctggcctacagtccccaggcagaatgtgaggagcagctggatgcacaggacacggcagcccgctgcactcgccgcacctcaggcagcaagactggccgggaggcagaggtggcacccacctcgcctcctgttgtcccgctcaagagtcggcatctggcagcaacagtcacagctcagcgcccagctcacagatgagcggaaaatgagactatacagactcactactattggcattaaagcttcagaaatctctgcgtttgatattcaaacatcatatgctggaaattttcacagtttttagtgaatttaaggaatttagatcctcctttggttggtttggttttgttgtttgttttcttgttctgttttcatgtcacacctgagcacttcctccagttggcagacaagttcaggaagagaccctgctggcctggtcctgcatatcctctgcactgttggatcactggacttggaatgttagatgatcacccctctcccctgcacctgtggggtagggtgggccagccaaatggcagcaggtagatcagcacagcctccttagattaggggagtagagcaaaagcagtctgggctcttcccttccctctaatctgtgacttggcttagctctggttggtcaccccctccttggtcttctaggatggagtacccttccagccagcctctgttggctagttcttgtcactgaactctgggccagcaggatagctggcttcaccttgtcacctaaacctggaaggcccattttcagtttcatctgcatttggtcgtccgtcttggctctttgactgcagtgccctgctgcagctgctcaggtcaccctgccctcccttccccattttttctccctccatgccttcacacagataacggtagtccttccagtcagagcttctatgacccattcccactcccctacaaactaggaagtctgtggagtacacatcatcacttctgtatcatgttttcactgacgagttcacatgtcgtgtctccctcacagccctgtcagacagccacttagaccctcccacttccccacaccccttgcctgtggaacgctgttggtcctagctgtggtttccatcattccccatgaacctcctgttagccttgtgcctgtcttatgtataatcacatcaccaaaaaaggggagggggaaaggaattttctttttctgccattttataatcgtacaaaaatagtaggcagactgcttaatggttggggttttttcacaattttcaacattagtgattttttttttctttctgtttgcaagttaaaaggtttgtcattgtttctttaaacaacaataatgcaccatatccctatgcataaagtgcttctt

SEQ ID NO: 20637 - DNA, 1280 bp, Mus musculus
gagttttggggtcaaccttggctctgtgagttattgttcacattttcataaaaggggataacagaaaaaaacataataattatgaaggtgcacatactattctctagcattgggaattagaagggatttttggtgtttaagggcagtctgagaaacagtttgtctgtttgtttgtttgtttgtttgtttgtttgtttttcgagacagggtttctctgtatagctctggctgtcctggaacccactttgtagaccaggttggcctcgaactcagaaatgtgcctgcctctgcctcccgagtgctgggattaaaggcatgcaccaccatgtccggcttgtccttatatatgttaaggaaatttaaagaaaataatttgtccttgggattagtctaatatagaaattataatggaaacattaaacatccataattttttttcattatgtagtcagaagttgtgttttgtttttttgaaggtagaggacggttggagagatccaggtgcttgggatcaaaagcatacaccactgtgtttatcagagacaaattgtcagttttgttttgcttttcacaggttcaccgtaatgtccgctctggctgtgatgtgaatccctcttgtgcactgtgtggttcaggcagtgtgaacaccatgcctcctgaaatacactatgaagcacctctcttagagcgtctttcccagttggactcctgcgttcaccctgtgctagcatttccagatggtaaggaagacagcagagtttactagagtctaagcagtgatacaaaaggttccagctgaaagacaacagtgagaacagacacttactatcactcactttctgtcaacaaaaacttgtctgaggtaaacctcctgcctcagcctcccaagtgctaggattacaaatgtgtgccaccaagcctgacttttttatgtttattattttaatttttcaaggtttgtttattttattcttttgtgtgagtattgccacatctatgtgtaccaggagcatttctgatgctcagaggtcaaatctggaactggaattaattgtgagcctccatgtgggtgctgggaactgaacctggatcttctataagagccacaagtgctcttttctgctaagctatctttcctaccagattttaattttcttcttttttttaaaaaagatttatttatttatttatttattatatgtaagtacactgtagcggtcttcagacacaccagaagagggcatcagatctcattaagggtggttgtgagccaccatgtg

SEQ ID NO: 20638 - DNA, 1270 bp, Mus musculus
tcattcatactttgtatgttttatactatgccaagtatactttatttagtatgttcatgcaatcccttgtacctaccattgtctaaaagggactggccatggagtaaaacaaagtcctacaaattatttgaaggttcttaataggttccatgagcatatgaatacatattatccttagaattcattatttatagaactgtgactgctcattaatatttgcaaaattgttttcttaccttttgttagtcacatttgtattatggaagaaaaacttacggatgaaaaattgacctttgcaccttgcagacataatagatattgtgcactgacagcctgctgactaagcatagacaaaatattaacacacttagattaatgtgcattgttatccagagttgacctgttgtgtctgtgaacatttaaaagtcaggagaaggaacccacagtacagcctttgtttcctctgtgttctgaaaagtaagtatcttcctccccttttgtagtcttcagcctgtcctggcagaccaagttccaggtgacagctctgatgctgaggaacaattacataaaaagcaaaggctgaatttagtttcttcatctgatggcacgtgtgtcgcagcccgaacccggcctgtactgacctgtaagaaacggaggcttgttaggcccagcagcatcgttcctctttctaagaaggtaggtgctcagagaaccggtctgaggtcagctctgatactctccagagttggcgagcccccaagttctcctgtgaaccttcaaaactactgaatcctaacctgcttcctaggacttagtgtagttgctttgctttttttatttttaattcttttacattttgagttagcatgccgtgtttaaagtgatagtttcatatgtatcattatgctttgttcataggaaggtcatagaccatgataagcagatatgaaaacttctggcttgagttttgaaacaaatggaagagcttaaattctaccatgaacactttgaagggggatttctcatcttctctgttctcagtgaaattggaagttttaagcctggcatgctggggcttacctgcacaatcccagtacatgacaagtagtggaggaatcaggagttaaaggatcagccttaattaaaaactaaataataaatttgaaggcatccagggttacataaggctctgtcttaggtaaaccaacaaaaattaacaaccaggggtggagcagtaagccatctctgccttctcccttccacgtgttga

SEQ ID NO: 20639 - DNA, 1219 bp, Mus musculus
tttttatctgtaaaattgtgttatgatacatgttaagaaaatgaaggttcctactctgctgtaaagttttctattttgatctttattcaaaaactgctgaacttccattcttgcggtcattcttaattcttcaaggattcaaaaaatatatagttgatcaagccatgttgatatatgcctctaatcccagcagtagagaatcagaggcaggtggatctcctgagttccagaacagccagagtcacataatgaggccctccctcaaaatagataagactaaaaggatgggtggttggatggcagggacacacacacacacagaaaataccttttatctcctgagaatctaacacaatttcagaagaacattgtcacagtgtcaggtacagttagcacctctagttaggcaactttggaaggaaattgtccaaagtgacttaaccccatgtcttctatggattgtgtactttgtcttttgtgtgtgtctttacatgatagtccgtctgtataagaacctaccccacactatcctcctccccatgtggtatagatgttagcattgctcttggatttcactcagtttatttctttgtaggaaacgtaggtctgaatggagatgggctgcagaccgagcagctattgtcagccgctggaactggcttcaggcccatgtttctgacttggaatatcgaattcgtcagcaaacagatatttacaaacagatacgtgctaataaggtaaggagtacatttttggtatattctaaccagtctgaatgcttccattaatccccttccatctcttcccattctttcaataactctttaactatgtcaggataaatggtttaatggttcagtataacagtttaatgtaagagtctaatggtactagtgtaggtcaggaaacagtagaatataacccccagctgacatgcttagaaaaaatggtatctggccaaaatgagaaaaagaagcagtatattaacagactgtattgtttattttaatttgggaaaggcatatctactactttttcactttgcttatttcatcagatattttctattaataagctttttcttgaagaaatttttaaattaaaagattatcagaaactaagacacaacatagatgatagaaatgttattttcttgtgttctgtttgagaggactgataattaccttgacagtgacattgagcagtttttcttttttga

SEQ ID NO: 20640 - DNA, 1229 bp, Mus musculus
ttgtggatgtttaacatcctgttccccctcacccccaagtccttaatttctacactcaataccttaatattttctcaccaaaataattgcatcattttacttctgtggggaactgttcattcattgaactagaacatattgcatacatttcctgttagtgagacaggtgttagggtcatctgtgtgtggccttctccatatcttgtgttctagtttactgatgaaagctgttgactcatccttacaattacattctcagttcaaatggcactctgtagtttagcttatcgcaccatattttagtcgtttgcctagacaaccccagaactacatctccctgatgttcttcatcacctacagtataacagtcacatgatttcaaaatgttcagattttcctgtcataatctaaaactcaagactcttaaaatgtactgtacgcacaggatccatgctctgcttttggctgtacagtctgaccttttgtcatttgtgtcattgggcttctgtcaaactgatcttctcaatgagctgagtgtatccctccctgttggtttggggttccctgtgcttaaaaagctttgctccaaattatctgtcatcttgattcaattctttactacccttattcaggtttctgccacctttcaatttgaaagggggaaatatggtgttgatatctagctttaaaagacacacctcattctctcattaaccattttgttttgccttgcagcactcattaaaaaaccacgattttcaataaataaacattagtgattaaaactcttagttactgtgagcatagcaaagcctaagataaggaccccatgagaaggcctgcctttactttggactgtcagtgtggccagaccatagaaacaaaaagtttagtgtgtttcctaaagatcctgatacaggcaggaaccagagcaggtaggaactttgtgggccatgtaaggatgcagaaaaggggattttagctatccctgaagtagttactgtgtctaacatgtgtggtattgtgatctcttatgttcttcacaagcaactggcttgggaagtgtattaatagagtagttgagatttacagagaatgctatatttacctttgacttttaaagactttgttgccattttgaaggtaatgagcacatattttccaggcaattttctgtttttctgctttcttcttctctcactttgaactatggaacctatttccatttt

SEQ ID NO: 20641 - DNA, 1111 bp, Mus musculus
gacacttttatgggtaatagtgccaggtcccacattaggaaggctgtggttgtcaagattgccctacttcaggtgccagttgcaaacccccagatcgttttatatgtgcttttcattacttgactgtaaattaatattcccatagcttgttttcgtatttggtttgcctgagcaagtcagtacagtactcagaaacactgccttaatgtttaccagtttttgttataaatgatatttcaaaggagaaggtgaatacatgtatgtgggtgagctatgaggaagggacactgctttcaaggaactttaatgtgtccagctatccagaaatcttctaaagtttgtccttttttatttttactgggaactttggttatataggtatgaaatcattatttcagttgtcattagtgatttttcctatcatctctgttttgagtctgagactgaaaatttcaatggtttaaacccaccttagtctttttggtgactaacactcatcttgaaattacctctgaagccatcagttcaacgacctaccatccaaaaagaagtttagtgctggaagacatgcaagaccaatatgtatttcatagtatcatatattctaagaactgattagaaatgcttcagaatattttaaacattgcctttttatgtaatgcacgttttacttcttgatgctttcctttaaactgtgtgtgtatacacatgtatacacgtgtatgtatgtacatatatctaacttatacatatatataatataaaatataaatatattaaatatatatatttaaaagttagattcatcagtttttgttttgttttagaagttttttcccttttttcagattttattattaaaagtgtatgtgtatgcttagtgcttgtggaggtcagaagacagtatggggtctcttggaattggtgttaacagacaagttataagctgtgtatgtgctgggaaacaaatcttggctcttgttctttctttatgaaaccagtcttaatgtggagttttagtcctgcctttaactcagaattatcctgtcttctgaggattacaagtgtgtaccgccatgccagcttttcttttcttttttactttttggaa

SEQ ID NO: 20642 - DNA, 2409 bp, Mus musculus
tgggcagaaaaaataaccttagggccatattcagttaataatagagcagttgtgtcccccagtcctccctccccaaccagggtttctccttgtagccctggctgtcctgaaattctctctgtagaccaagctgacctcaaactcacaagagatcagtttccctctgcctctcaagtgctgggattaaagatgtgtaccaccactgccaggcaaagaggttttcttttaaataaagtaattacagccatttgtgattatttcaaaatgagactcctgttttggcactgttcagtctgtagttaacaagtgacatgaaggataaaattattttttgtaaaaggattgtgttcctctcctcctaggtaaaagatatctccaggctccagaatggttccacagttattctcccttttttggaggcagagtttggacaatagtctcatgtgatgcttctgttgaaatgtgtgctgtttttaaatgtgcttgtatttctaacttccttttttttctctttcagtgtgttctcaggggaggcagcaaggggccgtggagctggcctcagcactgggagaggctggacttcctgtctctctgtgctgaatggctgcgatggcgcccgctctcactgacgcagcagctgaagcacaccacatccggttcaaactggctcccccatcctccaccttgtcccctggcagtgccgaaaataacggcaacgccaatattcttatttctgccaacggaaccaaaagaaaagccattgctgcggaggatcccagtctagacttccgcaataatcctactaaggaagacttgggaaagctgcagccattggtggcatcttatctctgctctgatgtaacatctgttcccgcaaaagagtctttgaaattgcaaggcgttttcagcaagcagacagtccttaagtctcatcctcttttatctcagtcctatgaactccgagctgagctgctggggaggcagccagttttggagttttccttagaaaaccttagaaccatgaatacaagtggtcagacagctctgccacaagcgcctgtaaatggattggctaagaaattgactaaaagttcaacacattcggatcatgacaattccagttccctcaatgggggaaaacggtctctcacttcgtcatctctacaaggtggtgaggtggggggacctgactctgggaacttgaaggggggtatgaccaattgcactcttccacatagaagccttgatatacaacacacaactctatatagcaataatagcactgcaaacaaatcttctgttaattccatggaccagccggcacttcaaggaagcagcaggttatcacctagtacagactccagctctaacttgacaaatgtgaagttagaagtcaaaaagtctcctctgtcttccattcttttcagtgctttagactctgatacaaggataacagctttactgaggcggcaggctgatattgagatccgtgcccgaaggttacagaagcgattacaggttgtgcaagccaagcaggtggagagacatttacagcaccaactgggtggatttttggagacgacattgagtaaactgccaaacttggaatccttaaggtcccggagccagttgatgttgacccgaaaggctgaagctgccttgagaaaagctgccagtgagtctgccacttcagagggacttagcaactttttgaaaagtgattcaatttcagaagaattggagagatttacagctagtggcatagccaacctgaggtgcagtgagcaagcgtttgattcggatgtcacagacagtagttccggaggggagtctgacattgaagaggaagaactgactcgagctgatcctgagcaatgccatgtgcccctgtgagtagaacgaataatgatgcagtcattcctgaaaaatgtgggacaagatttaaataaagccccattttgtaaagaatatgattcttgtatattgacaactaggctgcactaatcttttcctagttttaggtaagtaaaagcatatatacctgaaggggagaaattgaaggcatttctgctataatattgtgttgctatgtgctaaaagttttcctttttaagacttagtgaaaagaaactagaaaaaaaacaactgaatacattgcttttgaaactccaggatattttaaactgtaatgtgtaacttgacattttgatgtttctgggatatagggacaagtgttgatttcgttaaattgattgaaatttgtagtgctctccactaaactttaagcatacctgtctgtcattttaatatgaaatttcctttctgttggagaatgactgtatcagcatagagaaggcatccatgaccatgaagagtttaacagtttctccctctcaacaaacaggcagt

SEQ ID NO: 20643 - DNA, 1140 bp, Mus musculus
aagtccagaaaatgttctctgatattaaaccttatttgggaggaaggaaccgatatcgtgctgacaaactagagtcaagagtaattaggtgccactacttttaagtcaacgctggtaagaacatgacaggtttgcttttgttgttcattgttaaacttttagcgggtctgtgaactttaatttggtagtagcaggaaacaaaaaaattactgtgtaatgaatgcgtttttgcctattttggcggatctgacaaatcaagaagcctaaaacaacacgcgggcttaacgaaaactacagttcccagcgggcccggcgctggtgggccatcatttcccctctagctcccagctgcccctgcccgggctagccccgagtcggtcctagctcgcgcctgcgcaatggcgtccgcttattttttggtttggcggctgcagagcgtggcgctagggctagcagccagccgtgtgctgcagtgtacagagcagggtgtaggacaaagggcgggtggcagggaccgcgtcactggtcagggagcttcctgcccgtctcagagcacggttggccctggggtagtgtggccgcagcagcttcttcattcactgcacacacagttcttcgctcacgtcctctagctctgctgtgtcagtccgccctcccctcaaaccggcgcgcagcaccgccagccacagagccgagggaatgtgacggcatcagcgcctcaggttagcctcacctcgatcgaagcgagggccccgcgtcgcttgccgcagtgccgcgtgtcgctgccgcacgtatcaggcaccaggcaccggtttccgcaaacagaggcgcagaagcagcggccgcggctaggagccatgactgaggcggcggcggccgcgcctcctggcagcccgcgggggcggcgaggcgggcgccccctggcggcgcgccggggcggagcggcccgccgcagccgcagccggcggaggcgctgctgtccctcctccccgtgtccccggcactcgcccgctcgcttgctcgctccattctccctccgcttcagattaaagggggggagggaaaaggagctcggccgccattttcccagtgccgccgccgccaccgccaccgctcgctgagccggcgggagaaccaagc

SEQ ID NO: 20644 - DNA, 1177 bp, Mus musculus
agccatctctctagctgtcttctatttctttctttctttcttttttttttttttttagatgtttatttattgttatatataagtacactgtagctgtcttcagacaccagaagagggcgtcagatctcattacgggtggttgtgagccaccatgtagttgctgggatttgaactcaggacggttggaagaacagtcagtgctctttatccactgagccatctcaccagccctgtcttctatttcttagtaacagttatcaccataatattaacagcaacagaaagtaccactggatgtatcctgtggacctctggtcctcagtgtgtgtgttgcctgtagtgcttgctctgggtgttcaagcctaggacatctaatattgagtggccactagttcgcttctcttgcactttgtgaatctcctaagttttctgggatcaaaagctgtttcttgttattttatcttatcttatttttatttttaaaattttcatttcttatatttagtatttggaatgtgtttaaaatggattgcctaaggacattgccagacttagaacttaactctttatagtttttgagacagtcttactctgtagcccaatgttggcttgatttcacgctgtagctcatctggtcccttaatttgtggtgatcctctcacttcagtctcccaaaacacaatgaaatctgcatctttaggaaaggatcagtggaaaagcagaattgttatatctatttgccagtcttagtcttactctttgaaaataaacagagtctggtttgataagtgtaagcaggtttggaatgagggtaggcagtagttatagttacattcttgtggtgttgaggaccaaaccaaggacctaatttgtattagggaagcactccacccctctcctttatatttttctcccctattgaacctatgaccttactatgctggcatacactccatcgttgagttatatcttaacttctccttatatacttgcttttgatgacaattcagtcaatttcaaaaggtaaccagaatggtttcatattattaaaatagagagacattaataatgtggacctgaaatgtaccagccaatcaatgtatttagtagggaactgctaaatttgttctttcatagtaaggagtgatttttttcccttcttttttctagaacatgt

SEQ ID NO: 20645 - DNA, 1112 bp, Mus musculus
atatatatattacattatcagatctagagtttcatagcaagctttaccctgagttctgttgcagacctagaaaatgctaagctcagagcataatttactgaagtgtaattatcttttttttttttagtaggagtttatgtcctgtgccagagggacttctggtgctgattttaagacaaaggataggggatggttgtggcgtggctggctggaaggcactcagacacttggcctgctttcacagtttcctcacacctgcttttaacagcatttagatgcggaagccttatttccacatagtaactgcttcttgggtctctttctttttctttgtgtctttcctttcctttgctttttttttttcccacagaatagggatcagataaacaaacacattttggtaagcaagttgtttgtttcaaatttcagagcttgctttgaagggacttaagaatcctaagtacctccttgtctttgtcacacctacacataaggacacagatacagatacacacactcacacacacgtacattagagcattggggtttttttttccttcgtggaaatggttattattactgcaccaggatgaatattttttttttcaagagaacagatggtactcaaaataaggaaaggtctcttaactctttctgtatttcgttacttaacaattttttattttacccaagaactgcaagtaacatttgaaccatgctgctgttgtaccttaataactcagtgatcaccagtgtttagtccattaaaaacactcttttcgaagaaaacagtttcgaagtctctgattagccagagtacactatgggtcttcactgagaaaaacgaaggcccattttctttgggaaaacctgggaaaatgcaagtgtgggtgtgccatgtgtgttctatttgcattgaaacaatgtacttttgtgtcgtcttttttgcttttcctgacttatttcagaaattgtatagtctttggggggaaagtcttctctgttaatatatttacagttcattaaaggatatggaaaatccaaataaattacttttgaaagcagtttataatcaaggtgttaaagctatgtaaaagctgtgtcatctgcat

SEQ ID NO: 20646 - DNA, 2100 bp, Mus musculus
gttggacatcaatgggagcactgagaaggctcgatgccctagtgtaggggaatgccgggactgggaagcagaagtggatgggttggtgagcaagggggctggggggaggggggaaatagggggttttcggaggagaaactaggaaaggggataacatttgaagtgtaaataaatatccaacaaaaaataaataaacatgggcttaatgcagaagaaataaagatttgaaaaaagtaaaaaagaaaaagaaaaaccaggggaggggcgtggggaatgaacttgaaatgcttttttaagataacatttggaattgtatggtctggggggtctcatctctgaatgtaatgaaattctccttagttttgtgaaccaagaagttatacttgtccctataccttatgtttttgttccatttgtgcagtggggacagatgaatcccaggagagcagcatgacagatgcagatgacacacaacttcatgcggcggaaagtgacgaattttaacttgtggaagtcagactctgactgtgctagtgctgacatgtccctgtccctccatacactgagtctcaactcttgagccgccattgccgtcattcgtcacctagaccatgagtgtgccactttcattggaccctgactgtacacagaatggaaggcagtgcgatacttagctgctaacaagactggctcttttaccagtatgaatgacaatttgggggaggggtgaggaacttttcttttttctttaatctcttcagttggaaatctatcatggaaggaagagttatgttttatcttgaaggaaccattagatacggaaatggtgatgaaccagaatttcttggtcatttttccaaaattgttttttatttggttctattcctgataaacagagtaactggccttcatttctaggtcttcgagaatggtgttagcaagtgccagatggaacaataaaagacattgcctataacagagtaaagttcattgccaaggaacatagcttaccttaagcttggagtctctcctataagcaaatgcagtgggcctgttcggactcatacggaggagtcaaatatccctccatacagtgtacacttattcttggcaagaatgctttaatgtctaaccaagaattttaatttattcgtcttgcttcaaagtgttgatcattgttgtcttggtattgcaaactttaaaattggtcttgacgatactggctttactccttgagctctgggatcgccttcaacactcagagatggtagcgtggttccctgatgaaaagccaagcaggcccttaataaccactgtgtttaccagaagagtcagtatgagaacactaaagagaaaccttcgagatcatgatagagaagccttaatacagctggagctgtccctaaccgtgtgtctgcctctctcccaggagtgcaagcacgcatggtgacctctgttgagtgccgttctttcagctctctacttcgtaattgtcagtagtgtgagtcactgcaacttgtcatgggcgtaattaattgggtttaaaatactgaacatttttaacctaggaaaaagtttcttatgaaagagacaaattctctcctgagttcatcataatatgggtttgtgtgtttggggactggccacaattttaaagatctaattatgcgtataaaaatgggaattattggaatttcacaataacagatttaaacagtcttaaattgtgtatctcctttattgtaatgtattgaaaattttagagaaaccttagttaacattttattaagtgccaatgtcagaatataacagattatagtttcttatgggtgacaggcctgcagttcttattttggaatgtttgatgaaggaaaacctctcctactggtcacttgtatatgtaagtcaagctgtgaaaataaggtggattacagacgatgtggaagaatgttttagcctgtagactcagtcattttctgtcagttacttaaccttctcatccagatgtgaattagacacagaccatcataaagtcaaagtcttgggttaggtattaggtgccagggaaacattttaaaataatttactgactaaatctat

SEQ ID NO: 20647 - DNA, 1186 bp, Mus musculus
ttacgtttcttcatgcctttattgtttttagattaatactggcattaaaaattgttttaatggatatttttatgttttaaaatttgtcttttacctatttctatggatatgcttatcctcaaagaagtccaagtagagcatgaatcccatggaacaggaattgtagatggttgtgagctgccatgtaatactgggaactggacaaaaaatgcttttaacaactgagcccccttaaataaattttttaacttaattacattttattttatttcatttggagagaaagagtgagcatgtgtatgaacattatgtgggatctcagggatcaagcgcaggtcttcaggcaagaacctctaactacaaagcaatcttgtcagcccaaatactggaattttttaaaaaggaataatttgtagttagcagttttagaaaaccaaacttgtatgtatttctcctttgtttatcatgttgttttctcctagaaggtttgatgagccttcttcgtgaaatgggaaaaggttatttagctttgtgttcatacaactgcaaagaagctatcaatattttgagccatctaccttctcatcactacagtactggttgggtcctatgccagattggacgggcttattttgaactttcagaatacatgcaggtaagtatacaaagatacatatatccttctagaattaatttaactttcatgcttaaggctggatcataaaggctaatatttactaatttattatataatgtttatataattattttcctagtatgtataattgtcttagttaggattactattgctgtggtgaaacaccacaaccagaagcaagctggggaggaaagaaaggctttatgttgctcacaattcatcatcaaaagtagtgagagtcctggagagatggctcagctcagcggttaagagcactggctgctcttctagaggtcctgagttcaattcccagcactcatgcaccgatgccctcttctggtgtgtctgaagacagcaagagtgtacttatatacataaaataagtaaatcttaaaaaaataaataaataaaagcagtgatcaggaactcagataaggcaggaacctggaggcaggagctgatgcggaggagggatgctgcttactggcttgatcctcgtgctcagcctgttttcttacagaacccagg

SEQ ID NO: 20648 - DNA, 1221 bp, Mus musculus
acctggtctacagagcaaattccaggccagctgggccctgtctcttttaaaagatatagatctttgtgtgtgtgtgtgagagagagagagagagagagagagagagagatctctataaatatatataagtacatagatatataattatatattatatgtgatatatatatatatataattgtgtctgtgagagattgctccgcagttaagagcactggctgcccttttaaaggacttgagttcagttactagcacataccgtctgtaacttcagttccaaagaatgtgattgatactcttttttttttttttaaagatttatttattttatgtatataagtacagtatagccgtcttcagatacaccagaagagggcatcagatcccattacagatggttgtgagcaaccatgtggttgctgggaattgaactcagcacctctagaagaacgattaaagataatgaaagatagcttcatgaagtgctttttatactgacattaaaataaatttttattttaaaggcttgcagaaggggaacagatcttatctggtggagtgtttaataagcagaaaagccatgacgaccttgtcactgagtttggagattcagcttgcttcactctttccttgttgggacatgtgtattggtaagtgcaagtgactcaagacctccaggaagagtcccctgtatagacgtgctctgcactgtgcccattttgatattgatgtttacagacacagctggctttgtagttcctaacctttcccatcatgacctcattacatttgttaaatagtaaggatgctgatcccattttacccgctacttagcctagttagtgataacagctgtagcagctctagcaagttctaatcactgaggaaagtgagtggtttcttttccttaatattaaatgccattgcgtcttcttagagtcttgaaggcaggtttcagtaatgcaaattaagtattaattattttcttccaatatagtaacctttgaagtgtgtaacaagaatttttaccatacatgaactcagaattagtatataatagtaacatggatcctgttttttaaaaaatacttttgaaattgagaaaaatagaaaatattcaaaactgcctgtagagatatttttgcatgtaataaatgcaaaatgacatgatgttatacattatgagagaagtgattaaagcctatttcctccaaaaaaaag

SEQ ID NO: 20649 - DNA, 1176 bp, Mus musculus
atgtttgagtatatgtgtgtatgtatctctgtgtgtgagtatatgtatgtgagtgtgtgtgagtgtacgtatgtatgtaagtgtatatgagtgtgtgtctatgtttgaatatatgcatgtgagtatgcatgagtgtggatgagtgtacatgagtgtgtgaatgagtgtgtgtctatgtgtgagtgtatgtatgtatgtgagtgtgtgtgtgtgtgtgttttgctgagaatggaacccagggttttgtgcacaataaatgtgcttcactactaaactacaaccccaatcttttgaatccttgcactgatgtccgtcctctgaccagaggatgacagaacacaggggtcctctgaagtgtctcccttttccctgtctttggagggaatcactagaataatcttttctgttcttcccctcaagttcttgagcacgagggcaaaggtgagacgtggcatttgtggcttggaagagcatccaatgggacaaggaggcagtgcagcgaggagagggatctgaatgggactctagaattcccgacgaaaactcttcctttgcagttctccaccctccttggcttctctgtttatcattgcctccagctgcaggaatcctgcccttgttggcagaaacagtcaggaggcatgcccacaggaaccgcaagtcatgaatcagcagacagataattaactgggcaaggagtgtgtgtgtgtgtgtgtgtgtgtgtgactgagcagcttcaggaataaaccacttggtttgtccttagcctctgtgctgcccacagagtggcctgctgtatctcaccatctcctcctctcccttctctccaagtggaaagggtcatgtgcctactgcaaactcaggccactagtggatatgaacctaagatctggagatgatgctgtctaaggcttcttttctttggaaactaccagaatttattagaacttgagactatgtagcataatgataagaacttacccttctctctaggcacaccatgtccccagaaaacttccacttcttttaaggggctaggattggggcctagagatctggctagcagttaagagcactcgatcttgcagaggagctgggttcaggtctcagaacccacatagttgattgccaattgtctgtaacttcaatttcaggggacctgacactttcttctga

SEQ ID NO: 20650 - DNA, 2430 bp, Mus musculus
atggtcagatgctttctcctcaggggagagtgcagtggtcagagctggaggtccatccccactctccaggctttctgctcctctttccgggcacctccacacacctcatcctatgcctctgtgtgcttgctacacccatccatgggggtgcttgtgtgtatctacctcttcggtgtcttgtgaaggagtcccccgagtctcccatgagtctgttgaacaacgtgccagggaggagttgaaaggccagtcagaactgcatgtgtggcctgttctcctgtgggctggacaacctcattttatctcagcctttaatctgggaggccacaagtgcaattttattttattccctatggggacacccaaaactatgatgaggcccgatcactctagaggagcacgtatataaacatacttgcattattatatttataattttgtatgatgacaaaggagagcataaaaaaccccacacagagtgtgtggcaaacattcttagtaacttgccagtcagtggctgggtctgcaaggggcttccctcttcctggaagcatgtgaagatgggtatgtggacacactgaccctttcttgaagaggtttctcgactgggttctgggttctgttggcccagcaagcatggtttgctctgctggcattgacttagatctaatgttaaaaatcagtgcttaccacccagagacaagaggcctataaacagcatcttgatgatctgagacctgagtcctggcctcgggatcgctgtcaaaacacctgaaagttaattcagaaaagccatttcccccacccctctggagttcaatattcttttggatttggtaacttggaaagtctatttcaagtgtcactattctttttttctgaaagacagggtctcatgtatcccaggatggctttgaacttgctatgtagccaaggttgacttgaacttctgatcctttttctacacttctcaggtgctacaattacaggcatgagttatcctgcctggcttatgcagtgctgggaatagaacccaggacatcacacatgctaggcaagaacattaccaactgatctgtattcccagctttagtatcaacatcctaagatgccgagagtaaatacggtatcaagcctgcggtccagattctgtgtgtgtataaggaggctggaatgttgaccagtagtagaacaagcagttaaggaatgtcctgggtttgattcccagcactgaaaacgtgtgtgtgtgtgtgtgtgtgtgtgtgtgtgtgtgtgtgtgtgtgttttgtggggggagaggtggtgttgctcctgtttgtctttcagtttccagactgaatgccttggctttcacgagagcagatgctattcttagaacttgtctcagcgagtctcattccttctcagactcccttcatcttttgttagtgggtgcatctgatgtagcacttagtttttatccaacttgttctttcttgttcactctgcatacagttgcatctgcataccagggaggaccttcagtaaggagtggctgatccagatgttggtgtggtgagcaggcctcgagtacaggagaaagccagcgactgtccggttgtgcccttgggttactcttggcttaggtggtgggagtacagtagagggacagggaagatggtcagagatccatcctttagctactgaggcagagtccgtgagagtagagtggggttttctttagagaagactgtttagatgaggaaactagcagggaaggaagaaaatgtattagaagagtgaaaggtgagtaggaatcttgacggtttctggaatgaggcttgtggtgcttgggcggcaacgccggtcaggactcgggcatatctgtagctgttctctccggaggctgaggaacagtctgagtggtttccaggggatgaacatctaaaattgtgctgggaatgaatgcgcagcacagagcggctgggcccgttctcttacaggtggtttcggtccagtctctgtctgaggacaacaggaagagacagagaatgcctggcaggtagctctgttcccgttctttccctcagagacagtcattctgaagctgcccacagcaacatcagagtctttgtccatttttggttgaaattgcttacgcgccttcctgacaccctccccacctcctctgagttgtgtaacagagaattaaatgtgctttccaaaagaactggcctgagactaccccatgttgttagatctgtttttgctgggtgcaaagagtgtcactgcttccttccaaagggacaactgtatagtaaaagcaagcttccggatgtaacaggatggtgcctgctgtgggagctggagctggcttctgagtccagagctttgctattttcaaaatgagcaggttactactttctaaggctttattattattattattattat

SEQ ID NO: 20651 - DNA, 1177 bp, Mus musculus
aatcgtcccaccattgccctcgtgtccctgaggttctgcgttctgtacttcgtccctcctggaaacctggagtcctccctccagtgcttcaagcctcctcacaggatgctccaggtgcctactcacgctccctgcccgcgaggccccgcccctgaagtcacctgatcagcccgaagctccgcccatggaaccgcctgagggatctggcgcaaagacctagccactgaagtgtccagcccggctccctgggaagccgctgagctggtgagcacctgctgcctgggcgcctcctggaaaacgctgaggtggcgcgcgcattccccacacctcataagggcctgtgacctcatccgatccaaccgaggccggttgtggacatcgttggaagaccgtcctcggacttgggtcacagctgcctcctgttcgactttcagtccttctctggtactcttagtcccgctgtggcctgtccccaacttgaggtttgtctcccatcattcctttgactatcttcaccatcccttctagcaccttccatgcctcctagtctctaaaggatagcaactcaaggtcatctgtcccaccaacttgtttatattaggcctggttgtttcctttgtggggaagagcttggggtctggggatcagggagtcccacagataaaatgaggttggcaatgtataaatcctagtctgtgaatataaatgcttttttaggatgtactgaattttaaaattctgtgaagtaaagagtgttttgagaatatttttctccagaattctgacataaagtgccttaaaaaacaaaacaaacaaacaagacaaaaaccaaaaaaactttatcacattttgtttgatattggggatgcagtactcatgccactgtctacatgtggagatcagaaaaagtcctaaggagttggctcttggtacacacttgtggaaatcagaaaaggatttaaggagttggctcttttcaccttgtggcttccaggtattgaactcatgtcatcaggtttgacagcaaaaacctctcctctctgagccatcttgctggccttcaagtatattatttttataaacagatcaatggattttctcatactgctaacccaaccagaattctcccttatttaacttggagtgaatagcacaggccttagatagatgaatacaa

SEQ ID NO: 20652 - DNA, 1206 bp, Mus musculus
gtcctagaattcagactcaggcttgacagcaaacaccttgagctttttgactgccctcaaattttttaatgactagagttttatataaaactcattctgtgaccaaaaatgaccttgaagtttagatcctcttgccatcatattgcaagatgatgatggtccacacctttaatcctagcactcagaagccagagacaggcgatctctgagttcagggcctgcctagtctacagagtgagttccaggacacccagggctacacagacaaaaaaagaaaaataagaaaggaaaaagaatgctaacacatttgagagttaagaatttaaaatccaagcctggccaagtgtggtggctcacagcagaaatccctgcgggtaaaaagctgagttaggccgggcgtggtagcgcacgcctttgatcccagcactcaggaggcagaggcaggcagatttctgagttcgaggccagcctggtctacaaagtgagttccaggacagccagggctatacagagaaaccctgtctcgaaaaaccaaaaaaaaaaaaaaaaaaaaggctgagtcagcacagggatcccgttaagatcaaggctagcctggactgcactgtaaaaccatctcacagatggtgaatatggctcagtggcatgagccctggagccagccaggtacggggtgttagcttaatctaaattggcatggggggtctgagataggagaactgccttcaattccaggccagcccaagctacatggtgaaagcctgcctggcttgtttgatcctggggcaggatggaggtgatgctgtgctccgctgcaaggtgctggattatgagggccttttactgtctccagtattagcactagaacgaaggctcagcaggtttaggcacttgctgccgagcgtgacagcctgaattcatgtccccaaaacccacatggtggaaggagagagccatcatgtgctgtagcatgtctgtgtcctcagacatacgtaccaaaataaaataattttctatatctttttggtggtgtggcttaatttagatggtgtttgataggttccctcgctgtcatctctagggcatgagagcactctggctgtgccatctgtcaccctattgaccaccaggatttattggtttgctctggtcagctaagcaggtgtcccctttcaccttcaccatcaaagagctggtcttctgtcc

SEQ ID NO: 20653 - DNA, 1872 bp, Mus musculus
ggattttgggaaaggctataaacctgttttctggagggagttctagcactggttttggtgcctcagatacctgtgtaccaggatcatcttttctatgaaacttccttttcaggcatttatcaggagatgtctggcctatcgaaaggaagatcgcattgatgtgcagcagctggcctgtgacccctacttgttgcctcacatccgaaagtcagtctccacaagtagccctgcaggagctgctattgcatcaacctctggggcatccaataacagttcttcgaattgagaccaactcctaaggccacaaactgttgagcacacacagtggacatacggcattcagcagtgggtttggaacatagtgaatccgaatggatctcatgaaacctgtaccaggtgcttttattttcttgctttttttccccatccatagagcatgacagcatcgattctcactgaggagaagccttgggcagctctggccaggcctcataggaaaaggtcccgcccaaagttccagcgtcaacggtcaccatgggtggctgctctgagtgaggaaaaaaattaaaaagagaaaactggttccatgtactgtgaacttggaaacatgcagactcagggggttccctgacggagtgcttcagaggaagaatgtggacttgaaaatacagactgggctagtccagtgtctatatttaaacttgctcttttcttttaataaaatttaggtaacatctcctgaaaagctggtagcacaaggctcggctggggatggtgtttgacttgggaggaaaaagttgctactgccattaaaggcactagagttagtgtgctagccctgaataatctcagtttctaaaaacatgcagcttccttcaccccttttttatttttgaaagaatacatttggtcataaagtgaaacccgtattagcgagtacgtggcaatgttcattccggtcagatgcagctttctcctccatctggtctcccgcgtgaatgcttccctcgcctcagtagggagaaacagtgggagttctgagatgcctgggttttgccatcggacaaagaatgaggttagaagactgcagtttggagtctctctgggttttcagatacttcttcacaatttgaacacttgacggttgtcccttttaatttatttgaagtgctatttttttaaataaaggttcatctgtccatgcagtcctcctggattctctgattatatatagtaactatgggaactgcttccagaagtagacagacggctcgaagggtgtctagctcctgcccacaatcttcttgctcatttcttgctaaccattaaactcgatcaacacatgggcttttccaactctgttagatctttgaggagaacaaatcctctctcaggcatttgaattgtggtgaatatgctctggtgtgtgtgtgagcatggaccctcttcttactcacttagagtttgttttttttaaatctcaaggaatataggtatttcagcttttcttcccccccccccccccaatttggcttatttctgagatgtgtgatctcctggaggtggagctgaaatgggagccgtgtgaccccactgtgccctggaaacagcagatgactctgcaggagagagttggagccagggcctgaacatgtggtagccagcttggaatgttactgacatgtggtaagagagccagccagaaatacttagagctggagagatcagagcaggggcgggagtcaggaagggcagagctcttaaggcaattcatgcctctagtgctctgtgcttgctaaaagtgttcctaaggacaccttttctaaacccctgtgcattttgtagtcctgccccacactccttggtatcaag

SEQ ID NO: 20654 - DNA, 1179 bp, Mus musculus
cctgtattttctactgtaataatgtgatgtacaatgaacaattcactttattccctgggttttctatataaacagttttcaagatatgatttggttaaaaataatttgtcacaaaaagatctgtttgcaaattaaactgtaaaagtattcaaagtctcaaagggcaatgatttgtgtgataacttagtgtgtccagagccctgttcatcagtgaaaatcctgtagatgattgaatccataacatgaatcctgacgttggttatatgtgagcattttcttatattcttaaccccagatgttgtttgatttctgggtatcatccttagtaaagccatggagagcaaacttgagtttgagaactacatgtggcagaggtacgaagaaggaagctgagtctttttccagaaacttctgggttcatttgtatctttccaggtagaacatgttgataactcctcacacaaacgttctaccccaggatacagctagactgttaagagttcccacaaggactgagtcaaggaaatgtcttgtcactaaaccatacgattgttgagaatgttctaacaggatctctgtacgactccattttcctttgtgaaggtgaaggacagtcattcgctgtctgccattcagttgtctgggcctggcctcattctactatagtcaagcacctagtaactcaccctagttgccattttctttttgctatccatttatagttagtagtggaagatgtagccacctttttttgggagaggctaaaagtgaacattttgaaagttttttttaattggtaaaagaaaatagtaagagaataatgacaccagagactttagtggaaattgcccattttgaaggtaccattcttagaagccaagaatttggtatttaaagtttatcttgagagaataacctgtaatataatttgaaataaaggtatagtaaccttaagagcactgtagcaaaaacattggtgggtggggtgaatttgtaaaatgaatgactttgataaagttttatgcacaggcaaatgtattcattagattctgtgtagtgatctgctttccctttgtaatttgtagtcctaaaaagatttaaaaaaaaaaataaagtccatccttgcatttaaaaaaaagaaaagcaaaacaatgtaaggaactacaataaggtatgtgt

SEQ ID NO: 20655 - DNA, 2535 bp, Mus musculus
cttcctggaagcctctctctgagctggcttctcactgggagggtggaaggttgggcatcgggaaacccgaggcatctttaaggcctggactatgattgtcttaactggaacccttggtggcttttcccttcaccctaccctacaggtccaagtacagcacgtttgaacctgagggggtgctggccaacgtgctaggcttgctgctggtctgttttggggtggttgtgctctacatcttggctcaggctgactggaagcggccttcccaggctgaagagcaagccctctccatggacttcaagacactcacggagggagacagccccagtccccagtgatcgccctccttgtcctcttggctctgtgggtttccagatatctttttgctcttccctgcagacactgagtctcttaggtccaggagtgtgagtgtggggctgtgttgttagtttagtggggttccaggctttggagttgttctcagtctcccttcctccccttcctctctgcagcttttgatacatcctgtgagccctgagtaggctctgtctgcctgtacccgctgttgtccgttcacgtgcagaaagcttggttaggggatctggggtcaagcctggccctgatccctattggagctagacaatagctccgccctccatgcagcagatggctgctgggcctgggcctgagggactggcatggagaagtcagaccgctgctttgtgtattcaacccaggagttccagcagcttgggaagcatgtgtccttggcagtagagcaagtgatattatgtgtaaaatatgctggtgttcagaggaaggctccccagaaaggttgactctggctcccaaaggagccttggcgtgtgggttggctacagtctttaggcctttctgttcttttaaaatccctgatcattaaataggcttttcgtggggaaggggattagtgatcaaaactcaggtaaatacctgccctggtggaggagggcaggctgcttgctcacagtgagggctgccctggcagagtacctcccttcagcaggggctaagccctagcttccttctgcgggccagcctgggcagactctgagagtgggaggccacacctccggagtttttggaagagggctgctgtttgccttgttctccaggggggctgctggggtaccctggcttggggtgccctgtcttggttgaagcagccctgagggatcatggtcctcccagccctgggtccatcatcgctggacagtaggactgaagtggaagagaggaacgggattggtctcctgcacttagcttcaaccccctactgcctgttgcgttgttagctgagtcactgtttggcttgagtctagagatattgggattagagcactgatcttgtattctctggcttggcacatgctctcttcttgttttccttctctcgggttttaagcctcacagtttgtgacacacatggttaacttagtgaggaaatgaatggtttctgaacctggcagttctttaagtcactaggctggttttctctgtcagatttctaataactgcgtgggccctgcttctggtgaggtctcttcccccagctgtggtgtagctctctccctgatgctccctcaccttccctcccgtctctccacttgctaggatggtgaggtttgcctccagttccaactgtatatgctgtaaggctagggaatcttaggagttctgtcgtcggttggcacacttgtacagtcaagtgtttacatctgggcgactcggccttagacaaactcacgagtaccatttcgagtctcccttgccagactacacagagaattagaagttaggtctgcaatgagagtctgtaaactagtctttttgccaaagtgtatgatacatgactaaggaccaaagaaagcccccaagcagatgtctgtggtttcttctgtctcttctgtctcctgtgacgtacagtgtgttgttggtgcaacagaggaatcaataaatgtctacagctgaccgcttgccttctgtcttcatttgctgagacaagaaaacgaaccaaagctttaagctgtcatacatgaaattctactagagatgagagacattgtcctcgggttggatacagcagattgtgaccggcagcttctcagccctgggctgacctgtctgaacccgggcagctggacatgcccagtacagtgtctgtttgaccctttcaccatgtgtttctgatccttacaaagaggagtgaagcttttaagacagctgagattagtgttaggttgatttctatgactcaggcaggctctgtgcatatggagaatttagatgggtctcactgtgcctacctatgcatggtgagccttctcatttaaagcaaggtgtggtagtacatgcctgtaaccacagcacatggcaggtaggcagatggatcttgagggcagacatcatcttaaattaacaggactcaaggtgggagatcacttgtctagtgtgagcaaggccctgggttctgttctagtactaccaccacctcca

SEQ ID NO: 20656 - DNA, 1175 bp, Mus musculus
agggtaggacggcagagcccgctggcaggaggtcggggctcagctagagacctacagtgcagtagtgtggagttactgaaccgctgaggcagaagtgtgttgatgtacgtgctaggcctgcgcgtgaggatgggttagcagatgcatggggctgtttctacaaaaaaaaaaaaaaaaaaaaaaaaaaaagtatgtggctgtcagacagaacccgcgaggatgcggagggcttgctttgtctgttttcggagagtgtattattaactgccttggtcctcttttcaaatggaggcgttgctgtcagagaattgggaggtggagctggagctgatcaactggaggagctggggacgcaggcccaagcacagctgggccagcacgggctctagctagggtggggaagtggctgccacagctcctgttggctgctgcgtgcatcttctggtgctcactgctgctgggagaagcagttggctgcggaggccagtcctgcctgcctgtctagggaagggacagtagctggagctctgatgtctctgtgctggtggcattggtggtagcttttgtgttgagtcccagccattgccagcactgaggcaaagggaacagaggccagagccagcctgttccccttccaccctctttacttatgggaacactggggcaataggagaacatgcagaagaagggctgagggctggcctgaggttggatgtcaagggtctcccgatgcaggcggtgcctccttaaatagctgcgtgcctgctgtgtcttcctgcacagatcgccagcagttgagtaaggtagatggggacacatgggttcagaatgtgaggccacagtgctgggaccttcggttctggaaacctcacctgagggaggagagcactccctcccacacttggtttgggaaggaactggaaaggagaggtggggggcgggggtgatgggggctagtgggctagcctgtggtctggtacagtgggggcagaaaggagctatgtagaacaaggggaccctctctggtgcgcccatgctgactcggggtgaaagagcaaagcttctacttctcacccgggaaggactttcccattgacctggacaaagaaggggatttgcttgcattttcaacacatctgtcagccctaccccagaaaatgcaggacctctgaaaa

SEQ ID NO: 20657 - DNA, 1151 bp, Mus musculus
caggcccgcgtgggccagtgggtgctgctcttcctgggcgtcgccctgctcgtggccaccgtgggtctcgcccatcggctctacaacatccgtaaccatcacagcctccgccggccccaccgtgggccccagtttgggtctgaggtggagctcagacactcctgaggtgaccctgctggcaaggccagcagaggagtgtcccataagaaactggatgggggacatggtgtttgagtggaacataccctagctgagccttcctcctttgctgtccccatccactctgccccacccccaccccccaggcccagcccccattctctggatacccagtgtctaacaccgacttccctgcccagtctctgtgaatacaattaaaggtcctcccccacacctgagtctgtgtcccttgtgggaagccagggacaggaccggctgcttgcctgtctcctgacagtcccagcacgaccctttactggttgtcttcgcagtcttcctccaagcaggaagctaatcccaattcctctggaccccatcccccacaacctttcccaccagccttcctaacagcccaggtgaggtggctcctgtcttgcagacccatgaacttgccagggaggagcctaggaaacagaggggaaggaagcaggtaggctgcctcctttatgtgtggatacactatagatggctcatcctgtcccatgtgacctctctgtggctgggtgtcttggaggaaggctctggatgcccttccctgctacagggtgagggccctggaagggcgtgcctcactgagcatgctgaagcggccagtatataagtggacagcctgggttccctgacggagccacgtaggctctgcccacaggaaagagcattaatccgtgaccacacagtgggttcactgctactgcccacctcctcatcccggaacacatcccctcagcctcagccatcctttggaaggcctatttggattttagggggtgtcacttgaagtaactttttatctacatatttatgtagtaaatttggaaaatctgaataaaaagcccatggtagcaacattaagaaatataagcactgttgaagttttggtatcgttcagactttttcttttatttatttatttatatttatttatttttctc

SEQ ID NO: 20658 - DNA, 4792 bp, Mus musculus
gtccaggccagttaccccgctgtctgtgttggactgtgctgtgtggcgccactgcagcccagggctgggttttaaattttcactcctttcctcttctttgcttcttcaattaaacgtttctgtatatttgtttgtcagctgttgtgttcataaacagtacaagcactggctctgtctgtgtccatttgcccatgtctgtctgtctgctgctgaggcagtcatccatctcgtgtccccatctgtgtcgtgctagcacttaagtgggaacaaaggccaacttgagattgtctttcctcctggcaccagtgtcttttaacaaacctcaactttgtatgttttttatctatcaggctagtttttttatgaaaagaatttaacctttctggtttcttgatttcacagatttccctctttgtaccttcctctcttccctcagtgcctgcagtgggtactggaccctagaccccacgagcagtttgctttcctgagtcactgcctgtggggcacagccctgacccctgaccgggagttgacaactgcgctggtgctctgaagtctactgactcaccaaccgttctcagcctgggtctcctgaaggccctcggaggcccaggagatgcaggaggcttctgttcaccctcaagtccctttctctggcttcactagttgagtaccctgtggggctgagataagcagttgactaggggtcatgcggaaggagaatcatgttcaggaaagctgaacttatattgtgtttccagtacctggtttcagaatctatttttccagtttcgaacttgaatgataggcaagagagatctctcagctaagcttctgtgtttctgtttgctgagtctcctctacctggtgggacactggcccatctttggattgagtactctgaataagagacttcctgggagctaccgtctgtgcttgaccctgaacaagatctttagactgtgacagacaggcagttctcataaatgatgagcaaatcagccaaggtagactcagggccagccagctaagactctccacgcctgtggcacctgccctctcttcagttaaggttatgagcagtattggactttgtaggctgcagttggccatgctgacttacaggcctcgcgtgtctgtttccgttaggtgtatgggttccacagaggggacttgtatgtggttctgactttagatgagtccccggcagtttggaacatggtctaggagagggtggctgtttataatctgctgagctgcttgcaggtttcttagacgctctgggacaaggagagcagcaggcctgatggctgatggctggttggccactcatgctgccattgctggagaagtcaatgtcgactcattcttctgggaacatggactgtctggcagagtctttgcttgcttccacaactgatgtagttgtatgccaaaagtcttagatttagattcactatattaggaccttgtcccaaaggaaaggccttttcagtcagggtatttctccttggccttcctaatctgtcattctgattttgggtctctggggttcctgcactaacctgtggcttgtcctggatcagtttgtggttccctctgctcttagtggcgtttgccagccaggtacagactcctcaaaggtagcagacttgctgatggttgctgctgtaggagccctcagtttcttcctgggctgagtctacagtagtaggctgagtcagggcgtcgcagggcctgtagggagcacctgtgctggggagcacctgtgctggggagcacctgtgctgggtggactttagcttggggtgaatgataggattgtcaactagaacttgaaaacaaagttttaaaaggttagcagcagttttagaatacatttgtgtgaggtctctatgtgctttggaaaccaaccacgtgatgactttttccttgctctgtggacacttgtcaactttcttcagtcttccttttctgctctccaactagattaggtaagactcttgctatctctgcctccaagtacgtgtgtacccacagttgcagggttgctggcatttgaagtctctctcttatcatatgcacaggtggcccctgtagctgaggaagaggtttctgtgggcgtgagatgcaggaagtccataagtctgctctcttccctgaagcacagctctgttaaagtttcaaagccagtctcttaatatttgctagttcttagcctgacggtgaggtgggtcagtatctccagatctgtcctctaggctccaggctctggtggggctgcagtgctattttgacgtggttttggcaagctacagctagaggctctggcctgtggtttctgtgtctgctgtaggggaggctgcatgatcggtcagactagcagagagctgagctggtgagtgggtctgaggcttttgtgggcttgcgctgtccccactggagattgatccctttcctgacctccgaggctgggcttgaggaggagagtgacatgagacaagtcggtggggacttcctatcaaaatcagcattaggtcagataactggagacagcccaggaagaacgggaaaaaggcagaatcctatagtattttgatgattgttacaactaagatttgatatttagggtagagtagaaggaaatactagagaacacagagagtctgaggggagaaacattcagatggttctgtctcatagctatgcagcggacctgtgcctcagcctaggttggcttctgcaccattaatgaagcctctgtgtcgctgggtgccaggaggtactgtgggcggagagcccttctggcagcagcgtgatgtctggtggttaaattctaggttttgggtatcccgtgacagtgcatgatgacactgtttgagacaggttctttctttgtagaccaggctatccttgaactgagtgctgggagcacaggatgagccactgccccagcatccgtgcttcttccctagcgcaggcctcaggctaggccagtgacctgccactgaaccacaccctctagcccctgccgtttctttcctttgtccctttctcattacctcgctactgtagaatgttctccctgatgctctgggcccttgattcctaggccgtaagaaaatgtaggactccggggtttaccaaacatggtcggcagttcataagtgcaccctactttccccattgtgaaatagggcaggtcctttgattgcctggctcaggctagagtaccattgcaatagaggcctcagaacgagtgttttctttagagcctgccctgagggtgaggaaggccggcctattcagcatgtgggttttctgagaggagagctggtctgagcagttactgtgaaccctgagccaggtttcccagagttgtcctctcctcctgtgaggcagcagctgagtgtctcacgtctccaatcttgttcacctcgagccatctacattctctctttctcccatactgtcattgctgctaatgttcagagtcaagcatgtggcattacggaatgagcaggtcttcttgggctgctatctgaatgtccctttttaaatgtggaaacgtgcagatgctttctccgagatgcttagactgatgtgtcagccagaagaagcttagactccaaaggatcgatgctgacatctgtgcaacagctgggaagtgtacaagtgaagccgaactgtgctatccaccattggaaagaaacgttctcaccttgggctgactgtgatgtacagtgtgttatgggaattgttgggctgaagctttcgtcaaatctgagtcccttgctttgatcccgtgtatgttatgacccctctgtcagtgactttcccctgagtgtgaattatagcatgattgtataaacctctatgtagaaaatggagatttcatgttctacaaatgttaagctctaactgacccacttctgtgcgcatgtgtatgacctgactttcttatatatttaaactttccttctgttctaaagcttttgtggcattccttgttcaggtggagaggaagctgtccctttgcagacctgtactgtaaccatttctcctttataaatattattttcacagggctgattgtatacagggcttataataaaaatttaacactgtgttgtcaacgagctgcggtttctccactggaggtgacttcaaaagcacctgagggtggagtgtcccttctgtgaccttacttcctagtacgtgaagtctaatctcagttttgtcctgtttcagcctcctgtataagaagtatcatattttctgcccatcatactttgtaataaaacttgaacatgtatagattgaaatttttcttgtgatgaattcagttcttctcagtttgtacctgtggtcatgtttcagaggtgctgggagggcattagactccactacaattcaacacagtatctgacagcccaacttgttacctggtatctcttgtttgttcactctcttcttagtcaattaagaaaacatggacacctacttcatgccaagggccataaccctcagactgcttatgctttgccagagggacatccacagacttgtagtgttctgcagtcatggggctgtgtccaggaaccctgaggccacttctgtctgggtgagaatcagagtgggtcaagaagatgtcacaagaggaaagctatctgacctgggttttgaggcttgagttctctgggactgggaatggcacttaaggcaaagagaatgcagatttttggaaacaagaaagtgtggacatattcaggtcagtaggtgtgtatgaaga

SEQ ID NO: 20659 - DNA, 1165 bp, Mus musculus
tactcatatacataaaataaataaataaacatctttgtgtgtgtgtgtgtgtgtctgtgtgtgtgtctgtgtgtgtgtgtgtgtgtgtgtgtgtgtgtgtgtgtgtgtgtgtgtgtgtgtgtttgtttttcgagacagggtttctctgtatagccctggctgtcctgcaactcattttgtagaccaggctggcctcaaactcagaagtctgcctgtctctgtctgccaagtggtgggattaaaggcgtgggccaccaccacctggctataaataaatccttttttaaaaaaagattgagaaggactgatggatgtacaactctaaatctctttaggaattacttcacattgagaggaaacaaaaccatataatttctgctagatctcttcaaaccccaatgaaaccaatgagattgtttctctctaaaacatattttagattttgttttgcacactaaagcactggaatgggtttgtattttgtatgattttctgtgtcctgttgttgtagctctccatcctgttgaaaaaccaagatgatctcgataaagccattgacattttggatagaagctcaagtatgaaaagccttaggatactactgttatcccaagacagaaaccatgtaagtagcctctgccatggcccagcaactgaagacagagtttacatttcttcattttgccttgcttatttgatagaatattgtgtttcttagccaaagtacgagtataacattcagtccagccccatcagggaccagcaagttttctacatttgatttcattggaagccagattgttagggttaattacaacaaagattatttgactaacagtgttgggggtggggggtgggagaatatttcatggtaaaggagaaaacattttacacacacacacacagtccttctattagatttttgaccttaataagagatatttatgtagcatagaaggtaccaaaagctgtcagggatttgagactcatgcgttttgaaaccagcttcctcaactccaaggccttgccttgccttgccttggagacacattataagaaacatacttttacttctgttcactggggaaaaatggctgtagagtaaaccagcttaaagtgctcatttactagatgtctgggaattttctcttacataatttcctgt

SEQ ID NO: 20660 - DNA, 2769 bp, Mus musculus
ggatagctctggcatcaagactgggagctccagcctgtaagacccaagagctttagcaccttaagctcagtatggcgggaagggctggaaacagtatgcaagactgccatgggtcctgcctaccctcagatgtgtcctaacactgcagacagcactgaagtcaagagggactggggcacaggaggtcctcaagggtatgaatagtgttacttcattcagagtgttactttgtttctctcccaatgtttggagaccaccagcctgtctctgggctgcaagcctgaggtaaagcccagcatcccccagccaacagaaggtagaggtttgggctaccccactatagcttccaggtattcggtgtcagtcctgtcttaccaaagatgaatgaagcaaatgttacactgccttattctgggaaggaggagctactcggataagcagggcctgagagatggagctgcctccagaaactggggagacccagtcttgtcaatgcaattgtctctgttttacaagttggagtcactcttatgctgttcccagttttaaaactggagactttgccctctgagctctggagacccatgtgggcttaggccttggactggatggaagagctgatggcctctgccccctggcctgccctctgttccctcactggagcagagaaagtagacaacacaagtcagggcacctggttctgggcagctcagcagagtgcagggggttgtctcaggctgtctgcatctcaaatctgtcaggcctgagcccactccatgggaaagtccttgagctgccacaaccgtgtccaaagccaccagctgtgttcctcagcccgacctgtccacttgtcatcaacctcattcccttcttgttcctcccacaaaggaggatgccagtaggggctagggaaagagttatctccaagcagcttagagttggccatatttacctcagcctgggtgctggtcctttcttccagcccctttcttcccctccaaatgtgcctatttctagagctcctccctcctaactcccaaatttttgggagttatcattaaaggaaaggaaaaaaaaaaaaaagaagccagtgcccagggatgggcatctccagggagctggggattagtgccaggcagctctttgccagccatgcccacttccccatgggcacagaacaagccaaagccttcgttgtatgttgacgatgcacttttatgaatgtagtttctatcgctgtttttagccttttcacatcatgtaatgtgaggccttgtacttgttaatttatatctcagatccatatttgatggttttatatatatatatcaattctagactgttaccggtgatggactcctgaagagagaacagaaattgaaagcagctggttttgcagatatgtgtgttgcacggtgccaattgggcctgggcccctctgttttatttcctttcccttgggggtctgtcaggccactctctaactgctctgaagccagtgagcaaagtcctgcttccacctcagcctttgcccaaagtagggactggcccctcttctagaccaaagctgccaaaaggcagctgggcctctccatgaccccatcctgatggctatatagcaccctttagcctatccctatccacaccccgaacccaaaggagatagagattggtggggtgacaagatgttagatgagacaactctgcttgtcacaggttcaggctctcacggagctccccccatatccccatggggggggggggggagtgtattacctcataggcaatgtttctaaaatgaacttaaaagtaaaccaacaaattctgcactccaaagggggggtgggggggagacacctttttttgtgccaaaaactgtggacatgctggttcagcagcctcaggaccaagctgttaatttatttttttcttattaacaaatccaaatgacaagttgtgggcctccagggtggcctgggcccaaaggttatgaaggaaggtttcctagcagcccttggcctgctgtgcaaagatgctacaccaccttcatttgttcttcattccatggggtttatctgccttcaccaaccccacatggaagggccaagcctgggtcaggtgcacgctgccaccctccttcccctccctcccacttgcccagctctgtgtctgaattgtggaatgtgcagaagaacctgcagccatagttattgactatatcttgactgagggcttgcagtgcaaagccaggccagtgcattacttacaataaaagggatcatttatatcagaagggtcctgtgaccatgctttcggttaaaggtggtggtgggaatttttacagggatgggttgggtacaatgcctaacacccaagttgaggcctcttaaatagaacttgaaatggctgccaaaagcagcctgtgataacttggccaaggtggcccctctccttcccttttatcccagcgcgtcactgggacagcactggttgtccatctgagccgaatccatcaatagctgagttcctaggaccattcatggcattttgtagtcttcctggccgaggggtttcccttggtcccttacagaacatcagtcagaggcaaggtctcactatgtagctctgctgtcctggaactcactacatagaacaggctgatcttgaatgcacagagacccacctgcctctgcctcctgagtgctggtattaaaagcatgtgctgccacgtccagcccagccactgtttctttactgcagcaagagacc

SEQ ID NO: 20661 - DNA, 1174 bp, Mus musculus
ggactcaggcaccaagacggcctgagacccctttaacacccattccctcccagcacatggcctcccgctgggcagtggaaaggagattaacccgggggcgcggggtgggagaggatgaggctccctcacacaggtttcaggcataaggctctgctccaggattccttacttttcccatgggaggttggcgttgggaaccagaattggaattttcaccatactgtgtcctttagtccacctcatctcaccccacggctccctgggaggcccacaagcccagcttccctacttaggtgccttttctccagcaaggagtcagcatgccctcctcagggtcccaagctccctcactgccacctgggccttgtgtacccccttgtctccccatctacctctgccccttagcctggtaatgagccacagagactggaagagggagagtgccatctactgggcctcatagatgccacctcgctgaggggggagggctggggaagaggcaagacagcctgcagccttcagggtctgggggtcccttgcaccacaaagctaaagctcttgctagagcctcagctgacagggtcggcagtagctatgctcctccatctgttgtgctgttctgttgtgatcaaccctcttttaaaaacatttaaacagctcttgactctcttgtgtggcctgatggggatgctttgtggcaggcatgcagcagactcctcatagcgaggggaatggaggacagcccacaatactcctggccttaaaggggctggtggtctgtgccaccttggggtgttaagctgtcaaacctgaaatcccactgtgtatcctcgtcccagagtagccaggcacactggcttgcaaccacacaaatgttttgggtttttgagacagggtctcactgtagctctgattggcctagaacacagagatctgcctgcctctgcttccaaagtgctgggattaaaaaggcctgtgtcatccatgcctggcttcggttcttcagaggttaattcactacacttgagtacagaagagaacctttctgacttggccaagaccttagtgtctgcctttctgctagctgattccagctgtccaatttcctcctagtcctttaccctagaaatctgcaaagaatggtaggaatccatagcctatcaagtgctgccag

SEQ ID NO: 20662 - DNA, 1167 bp, Mus musculus
tctgttttccttttaggtttaagtttttgaagttgaagtaggtctacacagtaggaacccatgtcttttcttgtaagtaaaccagagcgcattagggtgagtgttcccagtcttctggttttctatttgttttttcttaaaagtgtttgggttggtattacagtgggttgttttgttttatgtgacacccagagttctctggtggaaaacaaaacgggaaaggtggcttatttgatgaatcaattggtcacatgttaaatgggttgggccgtgtctgtgtagttacatagttggtaaagatctctttgcacctgtttctcagggatttctgtttttaaagtcactgtcatactgtagttactggcacacatttctaaatataatcatggagagtctttaaaactaacctgaagaacgtattatatcttaatttttatcagggactagtgagctggtcccgcaagtccaggtgcttggtgctaagcctgactacctgagttcagttcccaggacccacacagtggaaggggagacctggctcccatgtcctctgatccccacatatgcatcatgcacacatgtgcacacacacacacacacaaagaccgtctactcacctgacgggagatgccatgcaggtggtttcccaggtgaaggcttagcacgcagatatgctgacccctgcaatttcccccaattcagaaaactcaactgtgtactttgtggtagtggaaacttggctcctactctctcctgtaaaaattttaagaaaaaatatttgattgaccttaaggacaaatactgggtttaatgccaatgacttcagtacttaaggaccgctagctggctcagcaggtacagaggcttgctatcaaccctggagtcctgagttctatccttggggacccctatagtgaaaggagagaatcccacacgttatcctctgacctccatgtgtgcatctctcccctccccccaacaaaataattaaaattttcttaaagtatgttgttatctttcatcaagtacttaattttaaaatgcaatcattatttaaagattttaatcatttattaaagatttattattttaattacttaatatttaaggattcttaaaattgtatttaaagattttttatttatgagaggtgaatttgccattctc

SEQ ID NO: 20663 - DNA, 2146 bp, Mus musculus
agggtgagtggaggtgcccggtgtggagttcagatgcatcagatcccttggagctggaattaaaggcagctgtgaaccacctgacagatgcttggaacagagcttgggtcttctgcagaagcatcctgaggtctaaccaccaaaccggttccccagcccctgggttttagtgtgtccttagagcttaatttggaccctcttcccctccctgttacacaggaagctgctttgaggagagaacaaaagaagttggagaagaagcaaatgaaaatgaaacaaatcaaagtgaaagccatgtagagctggttgcagaggttgtgtccttgctgccgttagctctccgtccaccggagacaggaaaagcaggagtctgcacctaacagtcacgagtctctgctgactgagagatctttatctcaccctctcctctcggtttagagttctacagaggttatagatacaatgaaagggctctttcagttatttccttccagataatcaaattattttgattattttataaaaggagcggtatataaagtatgtgtagttttaaaatatatttaaattataatgtgaatcatcagtgcgttactttggtgtttgaagaccgatcatgaaatttctaggtagattgttgctctttgtttaaactggacagttgaaataactatggagactgactctaaaccaagaccctaatatctattggaattgcacaataaacattgcttgttttttctgtgtccacattaaacttgtgaaaaaagtggaacgtagaacactatgtggtgataaattcagagacttagagcatagtacagcgtatggtttgtgtgtgggtggtgctatggcagtattataggagggaatctgtcggtattaggatactgtaagtcagtggaagattctagatgtaggtagtacaggagcagtttctcattgcctgatactatgagctaatgacactgtgagtgctggatttgaagtagttatgtgcttatttttcttgagcaagaatgcatgacaaggtgaagtgcttcacctagctccctccgctcagcagcagtcaggtggctgggctctgtgaggtcacagtggtttgcttgcttgctgcagcctggtaggtgttcatggaggagctgatctctgtcttaggcgtgcactttgcttccacgcctgcttttatatcgtccacaaggccggtttgtactttcttgaaacaaataaccaatcgatatacacaaatatgcttttaaaaagtgagctttttttaaatgaatcagaattttgtctgactcatgaggcggaagcgatggtagggagaggttcctctctgtgcataagcatttggcttgttgagatctctgcattttataaatgcttcctactgagaaagcatttcttaagtctttgcttgtaccaggtcatttttgctggggtgggaaagggtggtttttgctttgggagcgggtagtggggttttgttgatgctttctgtgttctgatgcagtaacagtgagttgcggtgaaaactgtgtgtgctgttgccttgggaattgtatggagtttttcacatggctttgtgtaggctaatagaaatatatgcactgggatattcaagtgtaatgttttttaacagttcacaagtttaagttattaaaaataacacaaaattaaatcactttaaggccagataattttagacttaacattgttttacaaatctttaaaatacatttagaatcaaaatttatgtgtttagttatcgtttaagtaatataagctttcttaaagtcccatacatcagaccgtggcagctaattttgtaacaagcattcatatgaactacctatgacatatattaaactgattgacaaaatctgtgtgctgctttgactttttgtagttgtcctacaagaatatgtatactgttctcttattaaaagcaggaaaatcgttttccttcaaaagcattaatcttgaatattcctttatggttaccactctaaagccctgtatgtattgtttcagaaagggtctcactatgtagcccaagctggccacagtcaaactcaggatgattttctctcctcagcctgctgagtgctgggacactgacataccactgcactgtggcccacag

SEQ ID NO: 20664 - DNA, 1244 bp, Mus musculus
agggtggggctggggctacggctgccgaaaggcgccaattaatgccgctcttccgattccggaacgcaacataactacgtcacacaccccggacgggaatctggtcctgggtgaggattgtgtctgggtcgtgtagtgagggagtctgcaatgaagagagccgcggcgatggggaaccgcccgaaaaactcaaggtaataaggtgttgattggaaacttcatttacataagaatgtccaccttcccttagctcttgtcccttgccaaaaaccaaagcaacacaaaaaacccacgactcgggcaacatttcccttcatgcctctgtccacatggccccatagactatggccacctttagcttccggagcatccgatcaaagtgacgtctacccgacggacggaaccctacgggagaaacgcagcctccgctagttagagcacttgtagcccaggggacgctgggggttacgtaattttcccagcagccctagctcgccttgcgcggatgtcctgaaggccgcgccccgcccccaccccgcgcgcaggcgcaaactagctgtacgcattctacgtaacggacggctgaagctacgtgaagagtagggtgccgtgactgagctacctgttctgggctgttcagtgacatcgcggcccgcagattatctttgcgacctgaagacagaaaccagacaaaggcaggctggttggaggtagtggcctcaggagccccgggcccggttgcagcctcgggtgcaggtaggtagcggggccatgacattccagtcggtgtgaccgtgccaggccgagcggtgactaagttgcatggccgcagagccaggtactgtttccctcctaaccaaccctttaagtccggccggtggtgacatgcatcaataccctcaacttatctttccagaattaaaagaaaaaaaaaaagactaaacctctgtccatccttttctgctccattttatgttgggctttaggaagatttgggggaaggtttcgagtagatcccaaccaacaggacaaaatctgagaaaatatctggtgtgtagccagaagaataaaagagcatcgaactaggcttctccgtggtggacctaggactagacactagaagtttcacggaagcaaccgcttctagagtcgaccttacccgaaggtttctaacatgcaagttatttgtaaccaacactttactttgtaaggtgacagtaatgtctacatcatttctagaaatt

SEQ ID NO: 20665 - DNA, 1175 bp, Mus musculus
acagatacacactcactaataaaaataaatcatttttacaaactctaaagttagacgtgaccaatgtaaaatagttattttacagtttatgtttattaatcactgtacttccacaaaggagtaacaagggacaccttaggtaagcaccgaagcacactgataaatttgttatgtcaagctatcaaaaagagggcatattggagttaggaatgtggcttgttgttacagtgcttccctggtgtgcttgaaaccctcaattcaatccctgttgccatgtaaactgtacaatggtggtaaatacttctaatcccagtccttaggaagtggtagtggaaggtacagaaattgagtcatctgtgtcctcaaaaggccaagataggacctttactacgaatggtccctctcatcagaaaagcatcagctaaagatgaacaaagaagctcctccttcctacctaagtgtgtaccctgtctgcttctcttcttgggtttaaccttgaattgtgttctttgcagaatgcctggtttcggaaatctcgcttcaaaggagggaaaggcaaaaagctgaacattggtggaggaggcttgggctatagagagcggcctgggctgggctctgagaattcggtgagtccatcctacagcagtactctagggatcggcctatgtcttaaattatggtgatttgctgtacctgagcctcatgagccccacgtcctgtccttcaggggatttgtatgtactgtgctgatacgagtcagtgtggtgttgtttcacaatgaaactgctatgggagaagcatgtgtgtgcttggctgactaggcttgctcaggaagtctagctttaatggatctcaaattgcaatattctactgacaggggacccagctgattatatatgtatataattttgccccaaatgattggtttggtatggtgtggggttttttgttattgttgttttggctcttttggttggttggttggtttggttttagagacaggctttttgccatcctagaacttgcttgtagaccaggctggctgtccttagagatctatccacctccacctctgctgccacctcctaggtgctgggattgaaggagtgtgccaccacggcccgccttgcagtagcctgtctttaaaagcctctctgtactggcttagaatctgt

SEQ ID NO: 20666 - DNA, 1841 bp, Mus musculus
cagcttcagggaataacagccgtgaagggattgggggtggcaatgggaagagagagagatatactgagaaccggggtggtagccgtcatagccatggagatggtggcaatcggcatggagatggtgggcgccatggagatggataccgttatccagaaagtggtagccgtcatactgatggccaccgacatggagagaccaggcatggaggaagtgccggcagacacggagagagccggggtgcaaatgatggcaggaatggagaaagcaggaaagaaggttttaatcgtgaaaacaagatggaccccaaggtggatagcagcaggatggacaaagtggacagcaagacagataagacacctgatggctttgctgttccagagccacccaaaagaaagaaaagccgatgggatagttagagggtatgtgaaaatcagcgtcgtcagtcgtctttaattttatttttagaaagattttggtaatgaggcgtctcagggctgggttggggtccaagatatacagaccccctgcccttggtggagaactggagagtggattgtaccttcatctggtgttcattcagaggtttccttgggaacctgagctggccctggaaagcagagagctgggaagcttttgtttgttgtgggtgagttttaaggagggtaagtagaatacttagggagaaagggccttttagggcacaaaaactcactctaggtttataatagcttatattttttactaaaatgtcaccttataaacatctataaattggactttttttcttagctgtggccaggcagtcccaacttctgccctgttagggatgcttggggagcagtggtgctttcagatgtttgcagggaagatgcctgagcgctcaggttccccagactgtttccagccctgagacacgtaggaaagacagccttccagacacaggctttgaaatcctaagccattaggactgaaggaatgatcatcttggaaggattccaggataatccaggcctggagtactgctaaatttaccatttaaaaccaaccccaacagtagcattcaaagtgtctatttgttttgttttgtttttttaaacttgccctaatagtagaaaaaagtcttctgctgaaatgattttgatttttgttctatcttgtttataaaagaaaaatatacaaactttgaattttgtgatttttgtgaaggtttctttaagatgtgcattccctctctgcttgctcgatagtaaatgtcttactactgggacctgagggctgtcgtttctaccatacaagttagttgctacatattaaattatggcttggaacagtacagcccatgatgtgaaatgtggggaagtgcttgcttattaaactatcagaaaagttatctcttttatctttttattcaaatactggaaaagggtgggagaggactccgaaggaaccacaggctacaacaaaggccagcaatactgagtccccctgaaggcttcataaaagatttgatccatcacaagccaagatgtgggttgtcagtgtaacacgatgaagaaatgtttcctcagtgctttcatggtactcctctgtagcagctctcccaatcccacaaagcctccagagagaactgtacacctccctctctgtccttcagtctttccagacaattctgctcacttgcgcttgtgttttttcttctgttccttccgttgttgtgctctctgatccttcttcatccgagagtccactaccttgaaatgacctttgactccagctggcctccggaccttacggcctacaccctttttggctacaacataagtgacctggcgtttctc

SEQ ID NO: 20667 - DNA, 1195 bp, Mus musculus
cgctctgccttcaaactgatccagctcaatcgccgctttcagttcctgcagaaagcccgggccttgttggacctgtgtgctgcgcctggcggatggtaacgtttggcaggggctgctatgatgacacgttcctggcactggttggctttgagttgcttttcggggaggatgggaatccgattacacaattcagattaaatattccatagtatgtgtctctctcaaattttggaagggagcgtcattttccccctcttgtggtactgaacctaaggacttaactcatgctaaggacttaactcatgctaggcagcccctccaccaccgagttatatctccaattgctttattttgagacagggacgctgaaaaattgccaaggatggccttgaacttttggtcttaatctcttgccctccttagtggctggtaatgcagccctgtgttgccatgcccagcaggttgcttcttgaatgtatgcatagacatttggccactacacttaacaggtgcctcttaaggggatgagaagtcaccttgccaagggaggatgaaaggtatttaaatctgtctctttcacaggctgcaggtggctgccaagtttatgcctgtatccagtcttattgtaggtgggtgactcttgggtatttgagggggaggggtgggttaggtactaattttgtcctacatcttcctccaccctgtaatactgagttaacatcttttaggagtggacctcgttccaatcaagcctctccccaatgtggtgactctccaggaggatatcacaacagaacgctgtaggcaggtaataagacctctccttcttttctttcctctttatgtgctggtgtcattgcctacttatttatttatttagtgtgtgtggtctttcgagacagggtttctctgtgtagccctggctgtcctggaactcactctgtagaccaggctggccttgaactcagaaatctgcctgcctctgcctcccaagtgctgggattaaaggggtgtgccactagtgcctggctgtcattgcctctgaagagtgaatgaaacacttcccaatttaccatggtttcaagcacgtggccaaaaagactgacaatccttgtgtacatttccatctttatttacaatcaagtgtttttgtttttccctgagatagagtcttgctgtgtactttaggatagct

SEQ ID NO: 20668 - DNA, 1213 bp, Mus musculus
tggttcccaaagccttattactgaccttttagcgctggctttaattgggtttgcaatgagcggcctcagccccctgcaggcaggcaggcctgagtaggaggctggaggctgtgctttaactttgtaccagacatttccaaaccaaaggctgctgggtttgcatgtttacaggctccaccctagggccagtgccagagctggctttggggagctgggcaaggaagagaaggccctagactcttcctggcctttctaaccaaagttttttgccattcctacaagcccagtcttgctgctggtttgtccttctttttgggtatttgcactatttggggagcaggtttttctatgtgggagccacttttttgtacagaggtaatggggtttttcagggagcccacttggtgcctccttcttcctttcttttcttaatctatgcaagcggctgcagccgccatcatctcctggtatgccacaaggctgcccacccatagctgcttgggcagggggaggtggaatctcctgagagtggcaatgccagttctctaacccagttacagcaggggtgtgtgtgcgtgcgtgcgtgcgtgctgcaggggaaggggaaagctggaggactgctgttaccttttgcagtcggtcttaaagaggatgggcctaaggcttggcaaacttggaaaattccaaataaatctttttgtttattggtggtgcccagacctggtcattgaacagtgcaaccgcgtattaacaaactggagttgtagtgtttatcatcacacagacctttattggttggggggggggagcacacaaaggacacagcctcacttccatagcttcttgatggacatgtttttctcactatccttttgcatgacctggagagggagagagaagagagtgcatatacacgggtgagcagggatttaggaactgtgaacacaagcgtgacccctgctccagagccaccacagcaaaggcagacaagtggaggcacatataccttagctactgccatctcaaagtcctcctgagtgacgtggacacgccgttcccgcagggcgtacatgccagcttctgtgcacacaccctaggtggacagagaagctcagaccctgctgctggagccccttagccctgagttggctcttaaggcttcctgctattgccctgctcccctgaagcctccagttaccttcacttcagcccc

SEQ ID NO: 20669 - DNA, 1330 bp, Mus musculus
cagatgtgagcgttctttcagaagtcctagcctagggaaagggtttaatctatccagttaacagcttagacttggtggggtggttgtttctatgcctcacacatattatactagtctagagtgaacatctgtagttactacagttttcttatagatggcagtcagatgtgtctgattcacttcctcattggttggcagtggggctcatgaagtacccttttcctgtcactttgctcaaattttgaatgctacttcagggcccaagactggaccttgagcttcatgattgataaattcagcagcacacccatcttttgtttgtttgtttgtttttcgagacagggtttttctgtatagccctggctgtcctggaactcactctgtagaccaggctggcctcgaactcagaaatctgcctgcctctgcctcccaagtgctgggatcaaaggtgtgcgccaccacgcccggctgcagcacacccatcttatgtagtgcttttccactcccagcctagcaaacagaagaggaagttctcatcattctttaagagccttgtgattgagttggacaaggaactctatgggccggacaaccatctggtggaggtaagaatggttctggagcctgggagggacaagctgccaggggatacagagcagaccatcagtgtgctggtagagtgctgtaacctatctgctagtgatgaactctgctgttctcttgcccgacagtggcatcggatgcccaccacacaggaaacagatggctttcaggtgaaacggccaggagatctcaatgtcaagtgcacccttctgctcatgctggatcatcaggtgacagttgtctaggctcacaaatgaggccacaggtttcaggcagggaaggggtgcagggtccttttaactcagcagttcttaacctgtgggtcatgaccctttgggggaggatgtcaagtgaccattttacaggggtcatctaagaccattgggacacagatatttacaattcataacagtagcaaaattagagttatgtagtaagaaaatgattttatggtatggttgggaaggttaagaaccaccgttctaaccccttcagatgctgtttccgcacaagaatctttgttgactccttctgtccattcccagcctcctcagtataaactggacccccgcctggcgaggttgctgggagtgcacacacagaccagggcggcaatcatgcaggcactgtggctttacatcaaacacaaccagctgcaggacggccatgagcgcgagtacatcaactgcaatcgttacttccgccaggtcagctggaattacccgct

SEQ ID NO: 20670 - DNA, 1211 bp, Mus musculus
ttcattatacttatttgaaaactttgtgtagagctaggtgggacatgagatgctcgggacatagaggaagaatacaggaaagacttctgtctttgaagcctcctgagagtcagcagcacacagtgtcagggcagaaagaaaactccagtggttaggaagggtgtgtatttggggtttgccctgcttgtgccttaaaactgtcccatctcgaaatcagtcaggtctcgtcagctcaccttctgcccatcctctgggtgtgtcatgaaaatgctgtgagtctggatgctcagccggagatgctggctttgggtcagggtagctctgtagcgttacacatccccagaggctgccagattgtctacaagtacagcatcttcagctttagcatggaattgagctgtgtctgtgatgttgtctttgtttaacccttgtcttgtattgaaatttcagtttaggaagtgtgccgtttcattaggtaccaaagcacttgcacttttgggaacataggtgtcacttggtaaatcactaggccatctcgagactgaaggtgaacctctgattgcagaggtgtcccctgctcctgatacagcagtagccgcaggctcttcccatgatgcaatacagaaaggatggaggtctgagatcactggatatggctgagtggtttccaccaaactgaggataggcacgaaactctcctcagtccacctgactttgtggaagttttatgtgcatgcggttcagttagctgtagcagctccttttcccaaagtaaaaggctaatctgttggttgctgctgtgactgctgcagagccatctctggctgcaagctgtcttgtgctggcccttgcttgtcatctgcagggctttggtcccactctccagctgtgccaggattcttttgtctgcttctgggtctgctccgttttcaccactgccttcatcatcatggtccagaggtgtaggaagagccaggagtgcaagcagtagctaccctggagagagccattgaaattcaccctgctctgtggctgattttccagcagtgtccttgctcatccctcttgtctggaagccatggtgttggccatctggggcctgacatcagcttcacctgaaggttatcagacctctacctgaggtctgaattcttttaagccaaagtgcctgctcccctcctctccccttccccccccccatcttggttttc

SEQ ID NO: 20671 - DNA, 1511 bp, Mus musculus
tgcctgctggcccattccactgaggtgtcattccctgcatctggtgactagtatctggtttgtctgatgcaaagctttgactggcaaaggagacttgaactataatggtagagccagagttacagctgactcgcaccatggctttttttttttttttttaagtctaccaggttttatgacagcaaatgagcacattcagagcaaagctgtacaactagaaggcttccctttgccttttgactcctccaaagcttttcctcaggcagctggtgcacaatggaacatttttccactctacactttgtacgcatgactgcggccctccatccttggagaatgtcactgtggtaacctgtgtggagtgtggttttgtgagccatttcattggtggtaaaataggcatagcaacttttttcatattaaattgtgcattttggaagcaagtagccatagaacatacacacccacactttcactggggtgggcttcatgtgaacatcaggcaaagccgtgagatcaaaccatcccaaagacgtacaatcgccttgcttttcaaccaatcctgactcttctgagacatgagcgagtgtgacaatgtcaaaacactgtgcacaacgaccgattgtccctccctggtactgatgggacggggccagaaagtgggagccaaagtgttcttttctggtttttctgtgtgctgtaggatgatcgaacgggttcgggaggtttgtgggcagtccccttctctggtggccaaatggactttcctttctcctcagtggcaagcactacatccacacatgcacttgtgacctttctttaatgttgccaacttacgtttgtgcatttgtgtcagaatgtttagtttacaaactcgggggctctaattgtataatttgctttgaggagatctactaggttttcttgtttgtttaaagctgcatccaatgtcaaaattaccttgagtaacttctgataatttactgtctgtggacaaagctaagttttttttcttaaacagcaccttgcttgaagatgactttaaagaaattaatatattgaaaacttatttgagtctttattttaatcatcccattaaaacatgacaaattatttgaccattccagtcagtgtactgctttaatttctcccatttgcctgtcaagagcccacatgccttgttcattggtctttctctgcagtaactaaaggcaagactagatagacacacaattggagactgaacttattaagcttaaaataatttgggaacttaaaatcacttgcattgtctcacaaaataaatattcatgtcaaacaccagacaagcatgttattttttagagaaacccacaggaccgtgaatgcagagaccctcacaaggctagttttagccacctttgctagcctccagcactgtagaggtgggaactaaagaaatccattattacttcttatggaaccagagggataaccttgttttctagaaaaactggtcagtctatggaacc

SEQ ID NO: 20672 - DNA, 1726 bp, Mus musculus
atctggtgggaattaaaccactaaaccttccaaagtgtgacgctatggccatctgccatggaaaagcataatcgccatccaagtctggccttggagctacatgtgacccagtcacctgtggagaggccactctctgacttgttctcttcttgctgtttttttcagagcctgagcctttgcaaagccggcaatgacaagtctgaatggtcgccatgctgagaaaaccattgacatgccaaaaccatcagcccccaaagtgcacgtgcaaaggtctgtgtcccgagacaccatcgccattcatttctcggcttccggggaggaggaggaggaagaggaggaggagttcaggggctacctggaggaggggctagatgaccaaagcattgtaacggggcttgaagccaaggaggacctgtatcttgaatcccagggtggccatgaccctgcaggccccgtctcgacggcccctgcagatgggctgtctgtgtctgagtcccctgccattttgcctgtctctgagaacactgtaaagctgctggagtcccctgctccagcactgcaggtattaagtccagtgccattggctctgtctccaggatcatcttcatctggacccttagctagttctcccagtgtgtcgtccctttctgagcagaaaaccagttcttcgtctccactgtcttctccttccaagtcccctgtcctgtcctccagtgcctcgtcctcggccctctcaagcgcaaagcccttcatgagcctggtgaagtccctgtcaactgaggtggagccaaaagagtccccccaccccccgaggcacagacacttgatgaagactctggtcaagtctctgtccacagacacttcccggcaggagtcggacaccgtgtcctacaagccccccgactccaaactcaacctgcacctcttcaaacagttcacacagccacggaacacgggtggagactccaagactgcgccttcttcccccctgacttcgccctctgacactcgttccttttttaaagtgcccgaaatggaggcaaaaatcgaagacactaagcgacgcctttctgaagttatctatgagcccttccagctcctcagcaagatcatcggggaggagagcggcagccataggcccaaagccttatctgcaagtgcttcagagctctccagcctgtccggcttgaacgggcacttggaaagcaataactacagcatcaaggaggaggagggggactcggagggggaaggctacggcagcgactccaacacctccaggagcgaccacctgaagcccactgaagacgcctcgaaggaagtggagcccaagggttcccaggcgagtagtctgaaggacttaggtctgaagacaagttctctggttcttgagaagtgttctctgtctgctttagtgagcaaggaggatgaagagttctgtgaactgtacacggaggactttgagctggagactgagggcgaggggagacttgataagaccctcgatctccccctcaagccagaggtgcttgccagcgatggcgtggctctggagagcgaggatgaagaggactcggccaccgagcaccaggagttacctgtaaagacgctcggcttctttataatgtgtgtctacgcgtacctcatcctcccactcccctactacatgagtgggctcttcctgggcgtcggcctcggcttcatgactgcagtctgcatgatttgg

SEQ ID NO: 20673 - DNA, 1296 bp, Mus musculus
gaggtccccaatatccaggatagcctagaactggactttgaagttgtgatcctcctgcctctacctcctgagtcccgggattacagacatgaatcatgtgtggtggtagtggtgatgcagcttagacctcaagcattacacccaagcacccacattctcagcccctttggcgttctcgtgtgctgtactggttcaatttatgcctctctcctccggggtgatctctagtcctcagggtgtaaccctaactcttgtcttctgtcttacagagaacggaaggctcccttaatggaacttaagacagtcaaggcagtgcacgtccctgggaggtcgtccatgtcccgagaagagcagccgattcctggattgcgagagtcctgtgcacgtatttatgagcctgtccccaccgaaagcagtaatccttcaggccaagccatccaattttaaaccccgctgccttgttcatgttgggtatacagagactcagaggcgctagttaatggccagcctgacctgtcttccttgtgtttcggggggtgaaaggaggttccaggagaataatgccctggaatattctgaggctgaaatgttgtgtctcggatagacagagtacttctccgtgggtcctcctgcacagaagcccccttctgctctgttgtcaatcactgggttagttttttgttttgttttgtttctgttgttctcttctttctgggttgatcttaatctttggaaatacacagtgctgctcaggtttgcctggttcccctgtgtgaccttcccccccacacacacacaaagtcaaccagctgactgggagcaatgctcgtggaatggccagtcacttgaagacagacctcaagccagcaatggcaactggagcgagcacttaaagcgcaccttgatcttcctttccgttccatgccgaaggcccaaagaagagaaatggctggctacaacaactgttattatttttttaatagtaaaaggaaatatgtacttttctcactaatttttctttatttattccccactaaagaaacggtttcctaaggtctgagctgtttcccagggtgggctagagtgggtgggcaggagctgccgacattttgtgtactatacctaaccctcctcgccttctccgtttgcctcagccacccggctccagggcccctgaggggagttgtattaaataaaattgatttttactcttcagttatctgcattcaagtgtcatctactggaacagggcacatggcaataaagtaaacgtaggcctagggactctcagtgtgt

SEQ ID NO: 20674 - DNA, 1198 bp, Mus musculus
gccagcaaagggtcaatacttgtggaagccatgcatagcagtgtacacttgtggtcccaacacctgggaggtagagatgggaggaacagaagttcaaggccatctctggctacatagttagttcaaggtcaacctaggctacttgagaccctccctgtctcaataaatgagtggacagatgagtgaatcctcataggaaatgcaggaagagccagcagagagatctcaaggtcagagggagtcctgtcctcactcttttgtttgtttgtttgtttgtttgtttgttttttgagactgggtttttctgtgtagccctagctgtcctggcttcttttaaggccatgctgtcaagtatatgagaagcagaggaagactttttgcaggttcctaagggttaattctgctgaaagtaactgggctacaaatgtctgcggctgaggactgaggtggtacccagacacgtttcacctcccttcccacttgatgttcttcagagctgtttcccaagccgaagttagagttctcctccagtcgtctggaccaaggggagttgttggacctgtcctgctccgtctcgggcacacctgtagccaacttcaccatccagaaggaagagacggtcttgtcgcagtatcagaatttcagcaagatcgccgaggagagtgacagcggggagtacagctgtactgcaggcatcggcaaagtggtcaagagaagcggcctggtaccgatccaggtgtgcggtgagtacactctcagctgctcagatatgcaaaggttgggtagggactaggagcatgatggtcagttagctgtcaccaatgcagtcgcaaaggctgatcggattcaggcaggtcgagaagaactcctgggagggccaggaaaatggcttattgggtaatggtgcttgctgcctagcccggcaacccgagttcagcccctgtgatccacgtggaggaggcagagaaacaagtcctacaagctctcctttgacctctgtatttcatctgtatttgtgtgtgcacgtagaacgcacagacttctgtgtatatctaagacctggttacgaggcatgtggtacatacctataatcctgacatccaggacgttgagctagggattgttgtgaattcaagaccagcctgggatacatagcaagggcctgtctcgatcctccttgactcccaacataaaaaaa

SEQ ID NO: 20675 - DNA, 2600 bp, Mus musculus
gggaagctaatcaagcaattaatcccaagttgcttcagttggtcgaagacagaggttcaggtaaggatcttcgtaagagatgtttctggtaggtggcagttacctcttgtctacaaagtgggatcggaagaatgagtacttcttattttgaaacctaaagaatctaaaagcacttaagacccaacataaatagagctatctaactctctcctatcttaccacacttatgccacagataaaaattgatcaatttccacttactttcttgacaggtcgttccaggggtagaggaggcatgaaggacgatcgtcgtgacagatactctgcaggcaaaaggggtggatttaatacctttagagacagggaaaactatgacagaggctactctaatctgcttaagagagattttggggctaaaactcagaatggtgtttacagtgctgcaaattacaccaatgggagctttggaagtaattttgtatctgctggcatacagaccagttttaggactggtaatccaacagggacttaccagaacggttatgatagcactcagcaatatggaagtaatgttgcaaatatgcacaatggtatgaaccaacaggcatatgcatatcctgctaccgcagctgctgcgcctatgattggctatcccatgccaacagggtattctcaataagactttagaagtatatgtaaatgtctgtttttcataattgctctttatattgtgtgttatcagacaagatagttatttaagaaacatgggaaatgcagaaatgactgcagtgcagcagtaattatggtgcacttttttcgctatttaagttggatatttctctacattcctgaaacaatttttaggttttttttgtactagaaaatgcaggcagtgttttcacaaaagtaactgtacagtgatttcaaatacaataaatgaaggcaatgcatggccttccaataaaagatatttgaagactgaattaagtgaaattgtactttattttacatatataatgtcatgtacaacttggcttagatagtgtttttgggggggatttttgttttggtgtttatttttacacaaggaaagttgactacttcccattcctggatttaggagaggaactcagaaggcccttaggatgatctgtttgtatgggaagaagttagagacaatggattttataattccagatttattggataaaagctttgtcatttttcagtatcagggaagtaagtcatttaatagcctattttccttaagagtgaactacaggacagtaactatataaatacatgttgatttcttttgcaaaacagttttaagtaatgacatttttgctttatcaaaattttattccatctcttggttttgttgtcaactgccgaaatgtgcgaagctgaaagactgttagcccaagagctgtgtgcactgtgtctttagtgcaggattaccttgtaggttcctagtcctcgaggacttgccagagtgcttatagccacacctggaagtcaggaatgtctccacattatttcaggggattttaggggtcttgtaggctagtcacaaggaagacgacataaccaaaagcacagtaaagttttcgggttaggttcactatgggcttaacagctagaaggattggggggaaagctttagatttaagtaggatcaccagcaaacagctttgtttcagaatggctataagtaggtctaaatgtcttcccaaaaaattggtgtgttttttgcccaggacaaaagtcttaaaggaagttatttaactttttgtttttaaaatgggcttattgttaatgccttatttataaaatgttaaaacaaaatagaatgtgctgggggtgggagctgggcgtgttttccagggctgataacattgaaaactggttcatcctctagtactgagtggttttcaatggcatggctagtcagattcatgatttttaagtataggtgtagattggagcatttattacatattttactgttcaatgtcttaatgtggaccttttattttgtaaataattatggaaatgattgtggggcttggaaaaaattacctttgaagttttaaaagacagtccactttttagcatgtgtgttgtgtccagcctgtggttgtcttaactaataaatgtgatttttctccccattctcttcatttatttattcgcgtagaggcctcttacctgggtttttgcacccccgccttccccattccagctatcctggaatttgatacataggccaagctggccttgaagtcagagattgtcccttatgcatatgttaacataggagtgagctaccacaacagtcctgcaccttataatcaaactccagtatcaaaaacacccctttgtcctagtcaggtattaactgatttctacgagaagggaagtacagaggttaagagcactgctcttccagcaaccatacggtgcctcacaaccacctgtagtgatggcctcttctggtgtgtctgaagacagcaactcacaaatctttaaaaaaaaaaaaaaaaattctttttaaggaggtggttaataaattcccgaagccctttttaagacctggt

SEQ ID NO: 20676 - DNA, 1144 bp, Mus musculus
atttcaaataagattagtttgtagcttgataacatcatttgcttgcattaatgattattcatggttgtctttatagaattcaaacatggaaaagctcctattctgattgctaccgatgtggcctccagagggctaggttagtacaaactcgaattcatggcttggtttcccagaagatctccatgtagttttttttaaagaaagtttattgctttctttaacctgcattttttctaagtttttttcacataaaggtgcagtctttgtggcaaggcctaggcatgacaatcggaggactcgagggggatggaggactagtgatcggctggctgcttccagtcgattagagaggtgaaaagctgaaagtgtgccagtaatcttcaaagggcagaacataccacctctgccccataaactgttctctccgggggaaaaaaatggaagttacctcacagttcactgccgtggtatttcatctgtcccatgctttgcatgattgccatggtacagcattgtttcaaactgttcactgtgatctgtgggtctttgagtttcagtgagtttgctgaaatgtcgaagaaatatttccaaacttcaatgttcaatgaaatttttgttcaagtttgaaatggagagagcagctttaaaagccttttacaaattggtgagtactggcacatgagacctagagcaggaccaacttctcacacatagtcagtgggaaaagaaagtgccttgaaagttcctccctcacctacacagtagtcgtcatgtcgagacctgccagagagagacacattctcaagtgaatcctggcttcttggaagcgcttgcctagacgagacacagtgcattaaaacaacttttgggggacaggtatgtttttcttgcagctgcagttgtaaggtcttggcaagacaagcagtgtggccagagttttgaacttctgatgagtgtaatgcaaaggacctttacatttttgttaaaaggtcctcaaaaatgagcacatgaagagattgctgagaaacttttaattggccctactgcgcagaagcattcagatgtcacttgatgatctgtaaggggactgtcaatttgggaatgtgctaaggagaacacacattcccttgataggctgtcagtg

SEQ ID NO: 20677 - DNA, 1119 bp, Mus musculus
gcagaactttactgaacccactgctattcaagctcagggctggccagttgctctcagtggattggatatggttggagtagctcagactggatctgggaaaacattatctgtaagtctaggaaaacttgataaattgtggcagaggtgaccttagatatataactattttaatccaatttctattatttttactcttcaatagtatttgctgcctgccattgtacacataaaccaccagccattcctagagagaggtgatgggcctattgtaagtattatcttaagtttcccaccatatttgctaaaactcctttgactttcatatagggaatatagggttgccagtataaactagccacttaaaattagtatccagcccaggcgtggtggcacacacctttaatcacagcactggggaggcagaggcaggtggatttctgagttccaggacagccagagctacacaaagaaaccctatctcggggggaaaaaattagtatccaaagacagttagttggatcagccaattatagatacttgtcatgagcctgatcaagatcaactaccacaaggagagaccaacttgcaaaagttgccttctggtttctccatgtgcttccacacacaaaaattttatcctgagaatagtgcctgggaggtagaaactggagaattcaggagacactgtctcaaaaaaaagtcttatgaccacctgaattctaattcccaacacacgaagacatagggtcttagtaaactgttttatactaaacacttttttttgtttttcaaacttagtgcttggtgctggcaccaactcgagaactggcacagcaggtgcagcaagtggctgctgaatattgtcgagcttgtcgcttgaagtctacttgcatctatggtggtgctcccaaaggaccacagattcgtgatttggaaagaggtgtgtgaccataaagggggatctttgtcactgatggagatgatggttttgtgtattatagttaaagcatctactcctttttatttatttaattaaaggtgtggaaatctgtattgcaacacctggaagactgattgactttttagagtgtgggaaaaccaatctgagaagaacaactt

SEQ ID NO: 20678 - DNA, 1790 bp, Mus musculus
agatgacttaaaaaaaaaaaaaagacctcatgttcttgaatcaagaagatcaggtattttggatttactttcatcttaaattgaaatactgcatttttatagcttctcagtatgtgatggggtggattttcattctttgctgggtcagcttgtcttttatatgctatttctataaaccaaagtctctaataagtacatctaacttatattttaattaagtttctaaaaggaaaatttttgctctaaaaatcgtttaacaagtttgagagccctgcttttacctcattggttgagctggaggtggtagtgggcatggtgggccaagaatgtcatacatgcatgacgtcagctgggctgaccatgcccgtgatcctggctcctgggaagctaaggcagaagggccagttcaagtttgaggccagcctgagcgacacagcagaccttgcctcacataagagtgactctaaggcagtcgtataatttactctagaactaaagagttcatgaagtgagggactggaggccaggctgccacactgctgacttcaagtgtggaggttacgctttcaaggtgtgtggcccatcctgtgatctagaaggtaacaaaaattctggggtgaggggttgcaaccatttaaaaaaaaatcacattggattttaaaattcaaccatcagaacaatgcactattatttttaaacatggatgtgaaagaagaatagcagattttgctgagcttggcacagggccatgaggagcacttgacaggaagtgtaactcagcctggtggccgacacccgtgatcctgtcactggggaggcagaggcagaagcgtcagcatgccaaggccagtctcacctacacagtggattgaggcttccttgagaccctgtctcagaggacagggatgcagtgctaaggagacgctgctttcagtggttttccatgcagtgtaacacaggcaaatcccactgctttctgagtgccttttaactttattacagtgacttgacagagctttagaggaaactgccctatgtaacggtcttcaatagcacagacatcaaaaacatggtttagatttcgatttcaaaattacattacctgattacttccaaataggtgctaagcaaacaaaaatccccagtgtcacagaacctggacttgccttgtgtttaatgtgaatatttatctgtccccacgtcgcctgcctccaggcgctctgttccatcaggaaagcttcattctgaccaatggttccctgtgctcacatgcagtaagaggccactattttctggcacaaagttttaaagcagtgctgtgtatcctgtacatttgttttgcagtttgttgctctgtattttacagtgctctccccaccccactcacatttacaggccagagcacaaatttctcttctcctaaatccactataatttgctttcctagacaacactaaatctgccctgagcttgcagtgcatcggacagatggcactggtgggtgttagccgcttccagtgcctgcagggtcagcagcacagcctcgcccttcagctgcagcttacggtcggggccacgtgtggtggttaatgttctcacactaggatgatgattgtaccaaatgctgagttgctgattctagatgtaattagttcactttatgtaatattctccttttctctaaactgactttaaaagcaaagttttatcatttccattgtatttattacagaatgttttagccttgatattctttgtaatttcactcatttgttacatgagctttatca

SEQ ID NO: 20679 - DNA, 1099 bp, Mus musculus
attttaagacgaggtctcactgaatgcccaggcaggacttgaacttttttgatcctcctgcttcagccctcctagtgcctgggattgcaagtctgttacagtcaggccccacttgaagagcagatccctgcagctgctggccagcggtggaaggcactgcttttgtagtgcatggaactgtctggacacttaggatccacttgtccctttagtttttaacttgtttttagatattaaactaaactgttacttttttttagtgtcctttttctttcaggccagagattgaacccagggtcttgtgcctgtgagcgggactccccagctcgcctgtatctctgccctattagactaacattttgatgacagacactttaaagtataaagttgccaaagtagatctttctggcagttccacgtctgagtctctgcagtcacatgacgcccgaccaatgtttgcaggctttatgtcaactggagatttctccgaggcatcgaagctcagttcctggcgctgcagaagggctttaatgaagtcattccccagcacctgctgaagacatttgatgagaaggagctggaggtcagtgtgttaggaacaagtctggggctctctgctgtctgtggaggaaagggtgcttcctaatgcttcagagttttgtgattccgtccctgagaattcttacaggaagtattttgggctttggcgtttctgtgggtaagcaatcccttatttatggctttatgagtatgtgcgcacatgtccgtgtgtgtgcagggctgtgcacattggtacaggtgccctcagtgacctgagaggtggagctgtagttacaggtgatcgttagctgcctgtcatgtgtactaggaatcaaacttgactctaaaagtgcagcaagctgagccttctctccagccccatatggagacattcttaatttatatatcctttgccgcctttctaactagtctgggactatgtagatggcgatgacctaaaggtcatttctggctttctgctcccccgccccaactgagtgctgaaattaagcccagggatccgcactccaccagctaagctacctctcaagtcccttcc

SEQ ID NO: 20680 - DNA, 1223 bp, Mus musculus
cagtcctggctctcaggaggctgaggcaaatggattgctatgaatcacagccagcctgatgtacagagtgaggtcttttccccaaaaacaaaaccaacaaaacttctaagttattccattataaagttgggaactgtttgctatcaaattgtagggtgagttgtgtactcaggagctgatgtttaagcataaactgtgttttgagtgacaaagagccatacctagaaagaggtgctgtttccaaggactaaaggtcacatgacttgggcaaattaaatgtgtagaggaacacttacctgtcagaaaccctgtgagagggaaaatgatggaaatcaggtctaactccttctgcttagtgaccaagtagcacatatacaagtatgtatggatatttaaaaaacttaattgaaattgtgtctcctttattcatctcattttcttgcctgatttactatattctcaccatagtgtacatgttgtctagagactctggttttgatgtctaaattggtaacatttttcccttgtcactttccaatagaccggcgtcagaatattctagtcctggcagacccctcagctgctttgtggatgagaatactccaattactggaacaaatggtgcaacgtgtggacattcttcagaccccagactagcagagagaagagtcaggtcccagcgacatagaaattacatgagcaggacacacttacacactcctccagacctaccggaaggctatggtacggtaacagcaaagggaacactcaccttgctttaagaacatcagagacctaactgtttgggtttgtttatttgagacagggtttctctgtgtcaccttggctctcctggagctctctctgtagaccaggttgacctccaactcagagatctacctgttgctgccttctgagtgctgggattaaaggtgtgagcctccactaccactcagccagagaactaacttttaaaaaaattgttattgttgtctgttttgagatggggtctcatacagcccagacttacagtgtaggcagacagcccttgaactcctgagttcctttctctgcccactcatcacatactggggttataagtgtataccaccacactgtgctttaaaatgataacgtctgaaagttaattaggcctgaggatgctaacaccatcaaggcctgtgttcatctgtggaatggtcataggagagacatactacact

SEQ ID NO: 20681 - DNA, 1184 bp, Mus musculus
gttctgaaagagtacatccttggagctgggttgactttcaaagatcagtcaaggtatgttcttcatctgtccaaatcagttaatttcctcatttggaactttgtgtagtacctctttccacttttgttacatctgtatgtctctcactttgagtcctgatatagcccatttctttctttctttctttttttaaatatacttatttattttatgtatgtgagtacaccagacacaccagaagagggcattggatcccattacagatggctgtgaaccaccatgtggttgctgggaattgaactcaggacctctggaagtacagtcagtgctcttaaccactgagccatctttccagcccacacatttctgttaatgccttcttgcatttgttttctaaaaagcaaatttctgccttgttttcatttatgtgcaaattcaggctttgttcagtactctgctaaagctgctgttgccaagggtactctaatagactttcttgtttgcctgtctctctaaaaaaaaaaaaaaatttatttgtgtgtgtgtgtgtgtatgtgtgtgtgtgtgtatactgtgatactgtgcatggtgtgcttgtggaggtcagtggacaatttttttggatttttttttttttttttttaactgtgtgcatttctcacacagaaatggagacaagcacctttacccactgagtcatctcattggccctggtttacctgtctttaccgtgctactttgtttgacttacagacgctttccagagacacccaagtgctatttgagtgctgttaaaaagtaaaaaaatgcacttgcccagttcatctaatggtaggtaaactctgggtagtgcttacaattttctaataccccacccatgttcagagttgagtaagaacagtttaaaacctcttatgttcactttatttcaacactgcataagttgtcatttatatccttctctcttgccatagccattccttaaatacagatttgtaggtttgacagtagtaacagtgctcttgctgtttgcacccagcctgttggaccagtttgggtggggcagcaggaactgatttgcattttggtaggtaagcactctttatacttatagaactgctggctcccttcttctgtggcatttagtttgaataggatcacatattgataaaaattcccaggta

SEQ ID NO: 20682 - DNA, 1191 bp, Mus musculus
aacaacatcccatgttgcctaggctgactttaagtgcacagtctccttttgtctcagccttgtccgtgttgagattgtacgtgtattaaccactgtgatggccagatttttatccaccttttcagtgcactttgaaaaatcaacttcaacttttgatttttttcttttcccttaggaaattgctttctagagagaaacagcctcctatagacaacatcatccgggctggtttgatcccaaaatttgtgtccttcttgggcaaaactgattgtagtcctattcagtttgagtctgcttgggcactcaccaacattgcttctggaacatctgaacagaccaaagctgtggtggatggaggtgctatcccagcgtttatttctctcttggcatctcctcatgctcacatcagcgagcaagctgtttgggctcttggaaacattgcaggtacttgcacttataattctttggactgaatgtgtccaatgtgattaaagaaggtcctagtggcttttgtgtcaagctttgtgcttgctttaggcccttattaggaatggaagaggcatttaagaatgctactgaagttaggacaggtctgacagacagtgcattcagtagctaactaaacatggatgtttgggacagtaggttcattaatcttgcttttttattttttgagacagggtctctcttacgtagcgctggctatagaccaggataacgtggatttcacagaaatagattttggggttaaggtgttcactgccgtgctcagccaatctcgctttctgtcccaggtgatggttcagctttccgagacttagttatcaaacacggtgcgattgacccactgttggcacttcttgcagttcccgatctgtctaccttggcagtaagttgataatatttgactcttattttccccatctattcaaagacaagccttctcaataatttttctctccccctcagtgtggttacttacgtaatcttacctggacactttcaaacctttgtcgaaacaagaaccctgcacctcccttagacgccgttgagcagattcttcctacgttagttcgactcctgcaccacaatgatccagaagtattggcagattcctgctgggccatttcctacctgactgatggtccaaatgagcgcattgagatggttgtgaagaaaggagttgttccc

SEQ ID NO: 20683 - DNA, 1177 bp, Mus musculus
cagtcttaggagaattggctgtttccttgctgtccagggcctgtggaaccatctgtggatagatcagaaggaacaggcccagtagaagtgtctgtgtctgtgagagaagattggagcatctgggggttgcttctctggagctgtcctagatgtagtaaatgcctggacttgacaagatgcagaaacacacacacacacacacacacatacacacacacattatagatagagaataaaattatgttttggagaaagaaattttttcttaggtttacatttgaacgtacatctgaactcctttggtggttggggggagaactgagccccaatcccaggaacaggagagggccactactctctggaataggtagtgagcaacaactttaggctgttgattagcagcagcactctcctctccagtgcttgggtttcaagcctcttacatcacacctggctaagtctcaagtctttattgttgctctgtttttaggtaggatagttgggttagcattctgcctgcctaagtctcaacttttgagctagtattttgacaagctgggaagtatgcacaactcacttctaccaaataccagcataaaatggttaagtgactaagagcacttgtcgcgctcattgcaaacaaactggatttgattctcagcatccatatggtggtttacaactatccataactccagtgccaagagatccaactccctcttctgacctctgcaagcaggaggcacaagcagtccatggtacatagacatacaggcaggcactcaaaaataaatagacccttaaaaatgagcaattcggccgggcgtggtggcgcacgcctttaatcccagcactcgggaggcagaggcaggaggatttctgagttcgaggccagcctggtctacaaagtgagttccaggacagccagagctagacagagaaaccctgtctcgaaaaaccaaaaaaaaaaaaaaaaaaaaaaaaaaaaaaaaaaaaaaaaaaagagcaattctcagcctctggaaagtctcccagaaataacttgcattaagtggtaaatttgttccaactgataaactcacattaatacattgttaacaaaagttcataactgacattagggtttgctctgtgtatactttatagttgttacaaatgtacactgttatgtagtttc

SEQ ID NO: 20684 - DNA, 2759 bp, Mus musculus
tccaccctgtatcctatcatgattcctgtaggtgaagtacaaggcgacctctaggtgtcttttctttctatgaaaggagctgctatgtacacatgtgcacacacaactgggaatcaacaatgagtttattgttcacgggagacacaagtgaagcttgcggaaaggttgggctaagtggtcctggactaacagacttcgttgccttgaatacaccagtacaaattgtcatttactctgcaccaggctaaatgagcaaaatctatttgaaggtatcttgtttgtaaacattgtcagattctaatttttttctttttgtattaaaattcaactatggatgtatacgaatcgaaataaatggagatcatttttctcccacagatggaggtctctttgaatgtgcgctgtgattacctgtaagcctttgtgggggacggggcgggggagagaccaggaatgacaggaagacctggatttctctagaatagcagaggcccttcctttcctaagtcccttctcaccacatcagagaaaatctccagggagccggtcccttgcatctcttggtcatccctgtaataacgggaatatgacacagtacaagctgccttcatccccgccttccaaaactgtagacagattcctgtgtgggatgaagggtgtttgctggccgggttccttgggttttgtttgttgcagtagagcagggtagagggtagagcagacaggctcgccctgcatcttcctcctgcgggtgctctcaccctccctccccttggagctgcttgctgtgttgtgaaaaccagccaggattgagtcaggctgcctcgcagatgttttcctagatttgcactagtccatgttagccctgtcctgctgggttctagaatctacctagtttttgttttttaaaagccgcctctgtgcatttggtgtcgccctgctatgcaaagccttccccagcccttagtttcttgaaaggaaactgtggcagcagttggcaaattcttccttatgacaggctcaggtgtacaggttcttctgggtcacgtgctctatggaagcctactccctctgtacataaaaatgtcactttagcctgtgcttacagctaaagagacttaactgctcaatatgatagcaaagtttttgcttaaactattaaggtggaagtagttaaatacaggctattttgttcttttagtttacaaaaaagaaaaaagaaaaaaaatgttccacgttgtaggcactgtgctgatgcaagaattctacatcctaataatacaaagtgattctgcatctgcccacgtccagtattcctgtactatctattcatatatctaagcatatatgggcttaatcacttaagcttgttgcagcaaaagctttcctacctgtaggcaatagattgctatgtttttaacaaattgtagcaaattctaaataatcctttttgtacgtaataggacatttcatcctaaaaaataaagtaatgtttttgacattggattctgtgcagtttctaatgagacaatgactggttgggtcaatgtttgctatatttttctgaagctgttggcattgccaagttgtacagaaatgggggtgggtatgggttgtggatttctgagaccaggaagatgttaatttcttatttgtgtacttaatgatataaagacttttgcagtttctatcaccatgtaaagacattttatagttttatcagactgtggagttttagtctttcaacgtacatttatttcaaaagctgcttttctacagatctcatttgaccttcttctactcctcaataaaagtgttaggctgtctgctccgtccggcagaccaagtggtccgatatgcgatatgggtaggactcaggttctgtgcctagaagttgtatttctttgctttgatagatttctttggctaaaagtattttttagcatttcctgtgttcatctccagattcacagtttaagaccatttcttaagagatattttcataacggcggtaaggcttttttctcctgtgcaggttcttcagggcttgtatttactgtcctgtgctaggtcaaagaaattgcgaacttttggagatgttttctacagtaaaaaaatgacctttttctatttggagtggcctggagtgctgtgtgggaccctcccaatgtgctgctgtctgtaacctgtcctcttaagagctgcaaataaaacttctctccctgtctccgtccatctgtgtcaggtcagatctcggtccttgcggttctcgtgctgctgatgtaggagcccagctggcggctgcacactcagaatgccatcccttgcccttggtggtggttgttgttgtaaattttatttatttttacgggtatgagtgttttacctgtgtgtgtgtgtgtgcaccatgcgtatgcctgaaagtccttggggagtcagaagagaacactgaatcctttggaaatggagttagtttacttacttaagccactatgtggatgctgggaactgaacccaggtatctgcaagagcggctagtgattttaactgctgagccatctctccagctcccagaattcactgtccctggtgggggcagttttacaggcagtgtctttaacttggagtgttctctcctgaatgaactaatggctaatgccagttggggtgggggcataaaggacactgggaggagagacctcggcgtctggagcagtttgagtttttacatacactcagtgagcttctgagaaaggcac

SEQ ID NO: 20685 - DNA, 1172 bp, Mus musculus
gtttggaaaagccagcttgaacttcagaattctgttcaattggaaaaggtctttcagagtgttttagtttgttttactctttgagaaaatataaacattttcagatttttgttttgttttagcaaaaattaattcatcatgattttttcaatactcctatcaaatttagtaacacagttactgattttgtttttctctgtatttttcatgcagatacattatagactaatataaagatctttataagttgttgtcatatcaagtcttaagataaaatactttagatattatttctgtggcattggaaatgagtctcactgatttaaaattgttcagtgcacattatcctgggagcccaaatgtgttactttaaagactgtaatgccagagtctgacgcagcactaaggttgtagtcagtgccagaaacatctccttcagttttatagagaggaagagaagaaagtgtgaaagagtgtgtgtgtgtttgtagttgatctgggtttttctttcaggtatagactacagacggtaaagtccttggctggagtgagcctgatgttacggttgctgtgggccagtttgagatgggatgacatggcagccaaggctcctccaggaggagggtctacacggacaggtaagggaattgcattttaagtgtaaaagctgtgggctaaggatgtagcttagttgctgaagtgcatacatatctcatgcatgaggacttgtgttaggtcctagtgctgtgtgtgtaacctgtaagttcaaggccaatttagattatataaggctgagtagccgaaaaggtagccagacctggcagcacgggtttataatgccatctactttggaggccaaagcaagaggatctaattaatgacctgcttgagctcaaggccagctagaaaagctgtctcaaaataaaataaaatgaaataaacaacagaagaaacttgaagtgggttggttctgtggctgtcgcacttgcctagcatgtgaaaggctctgagtttgtcccctagccatgcaataaagtcatgtgctgttcactcaatttattaaatacttctcttattttatagaagtttactcttgcttaagttttctggatgccatcaaattaaggttaaggggcaaggtttagattataagtaagtcagcacacataccc

SEQ ID NO: 20686 - DNA, 1323 bp, Mus musculus
cacacgtgagcagtctggaaagcacagaggtagatgtagtcaatgttagtgagggcttccatctaaggactagttacaaaaagaaaacgaaatcctctaagctggacgggcttctggaacggaggattcgacaatttacactggaagaaaaacagcgtcttgagaagttaaagctggagagtggggtgaagggggcggggaagccccccatgggtgctctgaaaagctcctctgagtctccaggctccacaaaagcaagcgaagggcatcagggtgactcgctgagacaggaacaaagccccagttcaagtcaggctagcactgtggacttggggctggggggctcacaaagtgatcccttggttcttggcatcagtcctcctagtctaagcacgcacaaacctgatccaaaagatcaagtattagatgatgtctccattcagagtccagggccaaactgtcagaggcaaaactcagttgaaagcgacctagatgccaggatctctgaacctgccggtaagggactggaactaagtcagactaaaacagaagtgactgactcttcctctgatgactctaaaccaaccagtgcagacgatgttggcattttgatctgtaagagcagaaagctgcactcacaggacgatagcagcaccgttgtgtcttcttccaagagtactttacctgcatcagtacctaaaagtccccgtgacagagatgcccgggccttctcaaaagcagtggacttcgatgggagactaggtggtgactctgaatatagtagcactttggaaaatagctctgataatatgtgtattcgggacagtgctgaagaagatatggttgttcagaacagcagtgaagccacctcgaaacggttcatagctccagaacaaggaggagaaagcgtggagtcgacaaaatgtcaggtagtttctaagtccactgaaaactgtgaagacaaactacagggtaaggtaactgaagcaaacggtaagaaactgggccaacatcctccaaagccagaggagagagcagttaacagatgtactgaccaagtcagcctgcgacacagcgttgacagaaagaacagtgaacctcgagagtctgaaaagaaaggacagaaagcaaataaatttcaaataaacggcaaagatagcaaagctaaggggtacctgaaggggccgggcacgaaggacggctctgatggtaaagttgtgagtagtgctgtagaaccaaaggtcaataatatcaataaagtcatccctgggaataccaagtcactggctgggaaggaatctgctgcgaagccgttcatcaacg

SEQ ID NO: 20687 - DNA, 1699 bp, Mus musculus
gagtgggactgtgtcatagaaactgaagaactaagtcattgaacagcaacaacaactattattattattattattattattgaaacaatatctcactgtgtagaccaggctggcctggagttcatagatttacctgcctctgtctcctgagtgctgggattaaaggctgtgccctcacaccctgctgatgttacttttgctatgtcacaattctggggctgattccactaggtaagtgccctaccacaaagcgatactctaacctctgatcttggtattaatctaacttgcctatagcagaaaaactgactggtgtgtttgtgagagcaaggttccatattaacctgtgatgatatccttatttacaggtaggcgaaaaccaagagtacatcggcctcgttctccaatattagaagaaaaagacatcccaccccttgaatttccgaagtcctctgaggatttaatggtgcctaatgagcatataatgaatgtcattgccatttatgaggtggtgcggaactttggcaacgttttaaggttgtcccctttttgctttgaggacttctgtgcggctctggtgagccaagagcagtgcacactcatggcggagatgcacgtggcgcttctgaaagcagttcttcgagaagaggacacgtctaacaccacctttggccctgcggacttgaaagacagtgtaaactccaccctgtatttcatcgacgggatgacgtggccggaggtcctgagggtctactgtgagagtgacaaggagtaccaccatgtccttccttaccaggaggcagaggactatccctacggaccagtggagaacaaaatcaaagttctgcagtttctagtcgatcagttccttacgaccaatattgctcgtgaggagctgatgtctgaaggggtaatccagtatgacgaccattgtagggtctgtcacaaacttggggatctgctgtgctgtgagacgtgctcggctgtgtaccatttagagtgtgtgaagccgcctcttgaagaagtgccggaggacgagtggcagtgtgaagtctgtgtggcacacaaggtgcctggtgtgactgactgtgtcgctgaagtccaaaagaataaaccctacgttcgacacgaacctattgggtatgacagaagccgtaggaaatactggtttttaaaccgaagactcataatgtaagtacatctggccataatttttgtacatgtttagggaagcctttttccttcatggttgatgtgagagagtgctccccatgttgatgcaattattaaacgtgtggtttaataatgaattgtagttaaagacttgagatggaaggaatgcgggcattaatacggcattttagaaattgtgatgtaaggtgagttcatgtgccttaggtggggttctggggccttcctgcagcccaccgagagagagagctctctcgccttacttgctgttaaaggacttcggcctcctggtcacctgtgtagctcaggcagtagcctggggcagtgggaacaaacctgcctgaggctgggtattcattagtgattaaagttctccaggagatcctgacacacgcaggatcatagtctgagtcctggggtttcaagaaccaatttggaattaggcctatggggcaggaggatcacaagtgttgctttgctctacagagtgagtttcaaggctagcctg

SEQ ID NO: 20688 - DNA, 1236 bp, Mus musculus
tcacttcatttctattcaccgaactatattgtaataagtcagttagttagtgggctgaatcctattaacgatttttcttcaaattactttttctgttctcacatctattaataatcactcatataggttccttaaacctttcttttctttccagagtccaccccgaggaccctgtgttgagccacctcaatttagcaacatttggtgcatgtgcctgcgatttcactttagtgactagcaccctaggtcaaaccaagactggtaatttgtcaggtagacattatttccaggtaacacaaacacataactttgtgaagccaattctagacaggacgccatccttcctatccttaagttctggctgaggtgtggaagttcgtagctgggaagagagaaaggtgcctggaggccgctaggaaccacgctctggaatttaaccccgggctctgagggtgggaactcaggaaagtcagtgaaaccacgctgggggtgtggctcccagcgtgcattcctggaacaacttcaggaccctctagatccaagcctttgggagctctctattgggactgacttagctccagctcctgtacctgcgtgggtggctttgcgtagtgactgcccccagtctgtaagtcgtgcctctacgcgagacgcccctctcccctttttttgcattagtttcccaaaaggaccggcgacttgggaggaaaattccctgttttccggccccggtttgggagacacgcattgaggtctccctaagacctcagctgagggggaggtggtctcccaggaggagaccccagcctggggggacaccccacgctacccatctcgctcctgcgccgccgccgtgcagccgcgcaggggcgctccggggcctccccgcccccgccgcgccgctcccgcgctccccctagcggccgccgcgccgcctcgctctgtcccaggctcgtcgggcggcgcagctcacgtgaccgcgctccgggcctgcggccgctgtcggttcccccagtcaccgagcgagagggaagaaacaagatggcggctgcaggcgatccggagcggggccccggcaattcggactgagccttctccctccaccccgccgctgccgggccgcgcccctcccgcccggaccccggcgccctcccctccccctcggccccggcgccccccgcgcccctcccccaccccttccgctccccccccacccccccgcaagccgcggctccg

SEQ ID NO: 20689 - DNA, 1904 bp, Mus musculus
accgtggatgggcactgagtaccagctgcacttccagaggtcctgagttcaattcccagcaaccacacagtgactcataaacacctataatgagatcttgtaccctaactgggcatgagtaaaatccataatacttttccttaaaatttgcctataaaggggctggagagatagatgattcagcgattaagagcaccaccacatgggatctgatgccctcttctggtgtgtgacagtgtactcatataaataaaacaaacaaacaattcttgaaaagaaaaatttgcctatgaagaggtgggagtcagctcatggtagaggcaacaatacatgattgattccagtgccagaaaacaaaaatgtttttggaaaaaccactagtagtgattggaaggtgtgatgtatgtggagttccagcacagttactctgggtccttgtcgtcttcagatctccatctattccgagctcaacaagatcgcagtcagcttccgggagctgcagagattaaatcgggagaagagcagtagaggactgtactccatcgaagtgctggaactcttctgacagtcttgctggctgttctgaactggatatatggaccaggctggccgcgaactcagagatccacctcccaaagtgctgggagtaaaggtgtggccaccacacctaacttgatggatatatattttttttaatatgaatcttcctgttcgtccagggaagaaagatttgttagtacccatctcactcagtgtccagagagaaatatgagtccctggaccatcacagaccatcactccttagtgtgctgcgggttccacagaatcacttctaggttgcagacatcactggagggatgttgtgaaagtttttttaaacatgaaattgagctgattttaagtaaacgtatttgtgtctaattttttacaatgcattttgaatagtttttctttcaatcaaagaagcaaaaccaggggctggagagatggctcagcaattaagagcactgactgctctttcagagttcctgagttcaattcctgccaaccacatggtggcttacaaccatctgtaatgttatctgatgccctcttctggtgtgtctggagatagtgacagtgtactcacatatatgaaataaatctttttttgaaaaaatgaagaagctgcaaaacatctctgatgagtggatctaaggagaatgtatatcagtctgaagctgttcccagtcatctgtatcatggagcactcagggcaccaagccagcatactgcattgtgcctactgccatttcttcatctttcatcttctaccatctcttctcctttctcgggagttgagaaattccctgttccagcgtggtgtctcagatgaactgtgacaaggatatggtaaagattggtttaaattataaaatcttattaccaaataatgaaaatgtctctctttttaaaaaaaaagtattgaggccagtgagcgagttcagtggataaatatgtgcaagctctataagcctgttgtcttagagagttgatccctggagtccatgtgaagtgggaaggagagggccagtttcccaagagttgttctctgccatccacaaacactacccacaccttcaatcccagcactcaggaataatagcagactaatctctctgtgttcaagatcaacctcatctgcttagtgagttccagggcagcaagagctacatagtgaggccctgtctcaaaccctccccccaaaaaagtaaacaaaagtattagaaaatctttctagggactggagagatgtctcagtgtttaagagcacttccagaggtcctgagttcaattcccagcatccatttggtggatcacaaccatctgtaatggattctgatgccttcttctggtgtgcaaat

SEQ ID NO: 20690 - DNA, 1163 bp, Mus musculus
ttcttttggggggggggggtaattgagacagggtttctctgtgtagccctggaactcactttgtagaccaggctggcctcgaactcagaaatcagcctgcctctgcctcccaagtgctgggattaaaggcgtgcgctaccatgcttggctaggattttctttcattgctggatctagacttaaatttgtctgagatatgagtgtggagcagggtcatgggaagatgagactggcagcagtgagtggacagtaatggaaagtaagggcaggggcttgtgagtgtatgtgcaacagtcagactttagaaaaatggatgcttattttctttcagctctggtatcatggggaagtactattcatgctacatggaaaaagtctaactgtgattccatacaagtgtgaagaatcgtctctagcaggcgctcttggaaaactcaagcacacacaagagtcaggtagaaccctctctactttcttagatcattttattggctcctggttccttttttctttgggtttttctagacatagtttctctgtatagtccttactctcctggaacttcactctgcagaccaagctggcttctaactcagatctgcctgcctctgcctcccaggcgttggaactaaaggcgtgcacctccacctcttggcttagacctctcttaaattgtgcataaatggttttcctttgctgttcattgctttgatgatattagatcaaaataatccagtaattttatgttttgtatttccttaggcactcattctgtgccccactttgtaaactgggaaacatgttcaggatatgaacttgggtcctccggtgcagagcagtcaagaactgtaagttcagtagtgggatgagaaatgttagtgcgaatgtaaaaaaaaaaaaaaacaaggaaaagctgtattattgtaaatgttcctgtgtgtttcttttgtttgtttgtttttgttttttcgagacagggtttctctgtgtagccctggctgtcctggaactcactctgtaaaccaggctggcctcgaactcagaaatccgcctgcctctgcctcccgagagtgctgggattaaagctgtcagctacatcttgatttttaataacggcttcagcattgtaactgtacagcttttacccaaactgatacttggca

SEQ ID NO: 20691 - DNA, 1169 bp, Mus musculus
ctataccaaaagtcccttataccttcctccctcccactttcatgtccacttttttattttgtttttccttttttttctttctgttaacccactgagtccactcagagctgcctactgaagtattgactcaccttgttggcttgctcttatagctgcagggagttcccgagtgcctgtgaccatgtcacgaccaggatgcctttgcatcgccctgccgccctctcttcaggctgttccccagccttggggtgggggtgggtgaatatccatacagatatcccactgagcagtgctcatagcctgggcattccttttctgcattttggccagttatgatatatctctttctgaaaggctaatctttatgtatcacagttggtaaaaagtcttttttgctttcttttggccatggggttggaaccaaagtccttgcacaaactagataagctttctacccaaagggtactccttagccacactggagacactttttgggctgtgtggtttttgttcttgttttgagatgtgtgtgtatgtctatctgtgtgtgtgtgtgtgtgtgtgtgtgtatgtgtgtttattaacagggtccagagtgccatccccatcaactcaaaagaaggaactaaagaacgttttgatggctaagctcagagtttgaatatttaagttaacaatactgtctttctagtggtgaggtttgtggatagccagggactaccaagaattaaacagtagtaacaagtgtcacacggcagtgtctcatttatccctgcctggtgtaattaaaactatacttcatgttttctttcaggacttagaaggagagcaagaatgcgttttcctactcttttttctttttttttcttctttttatttcgaaacagggtttctctatgtagtcctggctgtcctggaactctctgtagaccaggctggcctcgaactcagaaatctgcctgcatctgcctcccgagtactgggattaaaggcgtgcgccaccaatgcccagctgttttcctattcttgaagtatttttaaaaataggttttttatttgtttgtttgttttgttttcgttttttaatgaggcaggcaagatggctcagtgggcagcagtgccagccaccaagtccaaggaaacctgagtttgatccctaaagtccataa

SEQ ID NO: 20692 - DNA, 1213 bp, Mus musculus
agcagtcagcactcttaatcactaagctgtccagacctgtgagcgctgctccttaaatctgttcaggcagatgtgttacatcctaattctggtcctgcttatatgaagaccatttttcctgctgcctcatttctttagcctcaacactatttattattattaagttttgtgtgtgtgccacagtacacagtactctgaggtcagcggcagctcaggagtggagagtgagtgggttctctcctgccttttttaaaaaatttatttacttatttaattttatgtatatgattgtgagccttcatgtggttgttgggaattgaatttttaaaacctctgctcaatcaggcccaaagatttattgtgtttataaataagtacactgtagctctctcagactcaacaggtggttgttagccaccatgtggttgttgggatttgaactcaagacctttggaagagcagtcaatctctgacagtgctctctcctgccttgttgagatatcttgtttgttaatgcaactttgcacactccaggccaacatgagcttccgggtgggtctcctattttcctctcccatctagcagctgaggtgctaggatccttggtgcactgcctcttctggcctttttttttttaagatttctttattatttatatgtaagtccactgtagctgtcttcagacacaccagtagagggagtcagatgtcattacagatggttgtgagtcaccatgtggctgtgggatttgaactcagggctttcacaagaacggtcagtgctcttaactgctgagccatctctccaacccctctttcgccttttacttggagtgtctggtttatcagctaagccatctccctgccccccccccccattggctgaatctgtagatttgatcccttagattaagaacatcccctccctcagtatctccaggtgtgaccttgatcctggggaggtgacccagaggtcacaggacttaggtttcctatagaaaggtgaactgtgactgctaatacctctaacccaccaggtttacctgtgtttgagtgagagtgtgtgagcacccaggcatgtctgcgtgggtttaccattcaatggtttgatggacagggacaatgacagttgctaaaagaaggaagagagtttctttggctctttcaaaacaggggctcagattccctgacattcagctaggacggggtagcca

SEQ ID NO: 20693 - DNA, 1200 bp, Mus musculus
acatgcaccgaatcaacttgcggcctttataagtttctcaggctctgccattttactctagcaacagatgacttggcatagaattccattttatgaggttttgcataatttgctttttgtataacgatatataatgcttttacggaagtatacataaatctaggggaaacaaagtagttttgagcagctgggcccagaggccatcttgctgtcctggttccaggtagaaggatgctgatgcgtcctgagacattcagtttatcctgtatcagttctgggttcaactaggcacctgcatcacccccattggagattgactgacagcactctataccctagaaaggacatccttgtcacctctccggaacctgcctggctcttgaggacagtgcaaagaaagccaggacaacacaggacaacacgccttccctgagcatgactccttcctgagtctctcaaagccctctgtgtggcaaatgtgtggtgtttatagccctggacaaacatctgctccactctgccttgatgcagaagaaggaatccagggccttgcaagtgctggctcaggactgtgccccggagctacttttcccagctccatgaatttctggattccctctgctgtggatttgttttgtatttgaacatttactgtcccctccatcccccacccccttgcttcttctcatgctagggaaagaactgagagttgcaggtccatgtgctttgccgctaatcaatgcccaccaccagtggcccaatgccagtgtatttgatgtatacttttaaaagttccttcttagtcaatgattctgattatagcacatctttttgtgtttgtgtgcgagtgtgtgtgtttctttgtgcttacatagagaccctcagaagccttctttgcatatttagtgtgtgtgtgtgtgtgtgtgtgtgtgtgtgtgtgtgccttgcatgtgtgcagtgtccacagaggccagaagaaagagtcaggtttccctggatacagggaggggccgttggcatattgcaagccaccttattggtcctgagaatcacatccaggtcctttgaaagagcagcaggtgctcttaactgttgagccctctctgctgccccagcctcgtttctgagacagacttgctgactgggaccttgtgctcactatttacactaactaggctgtctgtccagcaagcccctcgg

SEQ ID NO: 20694 - DNA, 1200 bp, Mus musculus
agttctctctgttgtttgtttgtttgttttgagacagtttttctctgtgtagtcctggctgtcctgacaacatttgttttcaattcttttagcgctattccccagggtggggttgctgcagggtcatgtgaaattcctatgttgaagtgggttgaagagctgccaactgtttcccactgtaccttccctctggcagagtgcgaggactccaatttgccaacgctcctcgttttcttttttcttctaaccaccctggagggtgtgaagtggtttggatttgcatttccctaatgacttacaatgttggacatcttttctcatgcctattggcatttttttttaaatcatttttgaggaaacttctaatcctttgtctggcttttaattggcttacatttaaaaaaaaaagagttgaaagtgtatatgtatgtgtgggtgagtgtgtggtgtgtgtgtgtgtgtgtgtatggtgtgtgtggtgtgagtgtgtgttgggtgctagactatctgttgaaggtttttatttatgtgcatgtgcgtttgtacttgaacaccaatgcaaggtgaggactgaagaaggacttcgaatcccctaaagctggagttgggagctgcccacatggatgctgggaaactgaactcaggtcctctggaagagcagtataggctcataacaattaagccagctcttcagcctccaggtcagattctgagtacacatttcgtactcacatggtaagcccactaccaactgaacctgctccttagcctgtcacagagcatggtatctagtgattgatacaaatgatcacaaatcttttatcttttatcttttttttttttttttttgttctttaacacccttcataggaatctgccttatatacctctttgttctctatgccttgagtgattcacagaagttgctgtcaggagcccggttgtcaggaacacattccgattgtctctggcttcttgtgtgtgagagtcgctctctatggcatatgcctaggagtggaatgtacgaacatggttcctttagtgattataatatttatgctgctgtgggcaatgtatgaaaattacatttggggaaacttgaggattctgtttgtttttttgtgtctggatggggaagaaagtcattactaaaaggatgtggtatttgcatctgaaatttgcattttaggcttctggtat

SEQ ID NO: 20695 - DNA, 1196 bp, Mus musculus
agaaaaccaccagactctctgcttcctgaagttgggattatagacatgtgccactgcctagagaacaggcttatttagatttactttgttttatgtatgtgactgttttctctgtatgtgcactccatgcatgtctgatgcatgcttttggagacagaggaggtctctggatccccgagagttggagttacagatggtgtgagctgctgtgtgtactgggagcccccatcctctgcaggggcactgagtgctgaatcatctctccatccctagacttgaaccttcgatcctcctgcctctgcttcttgggtaccggagttacagacatgtgtctccgtgtcggttctaggtattgaactcaggacttgatgaatgccaggcaggcactctactcccaagtttcccatttcccagatgaggaagtgtaggcctggagaaactgcctcgcctgccccaggttatgtgactcagtagtagtgtgaaagccttaacctgcagaggctcaggtcaggccatttggtctatggctctgtctgattgagttaccagatgctgggaataggattcagacacttctgcaatgatatagcaattgctaatttgttcttgtgattttgtttgtcatgtgtgttttggagacagggtagtgacgtatggcccagatcaaatcgggccttaagtcagagtgcctccgtcactcgaggggggttacagatgtgtgccagcacagctggcgatctgtgatatttaaaagctgttctctctttttcagaaattataaagagctctgatgggctatttgggtgttacccagtgcagtgaactgcaggtgagtagagatggcttaggagagcattcctgaggagacaaggctcaggaagcctgaggaagggatgcgggagaggcttcagctcatcttttccttttgttaatttttttttttttttggtttttcgagacagggtttctctgtatagccctggctgtcctggaactcactttggtagaccaggctggccttgaactcagaaatccgcctgcctctgcctcacgagtgctgggattaaaggcgagtgccaccacgcccggctccttttgttaatttttaatgtacaaaggaatgggtttcatggtgacatttttttcttttctttttttttaatggttttagagttttattgtagaaaggcaggggg

SEQ ID NO: 20696 - DNA, 1196 bp, Mus musculus
cgaactcagaaatccgtctgcctctgcctcccaagtgctgcgattaaaagcacgtgccaccactgccaggcctgggttagcttttaaaaactaaaattagtattagtagcctcataatgacagacactctgtagaaactggtgattttgatccaaccccatctgcaaagttcattttgtcagtcataggcagtgtggcgacaatgttattttagatatactcagttagcattaccaccattctttctgtggtataaaacattccaaatttcatcttactatgaggtttcctccttttgagtttgaaaggctgaggtatggctaacaagaagcctggtgggccagttggagaaacaagtaggtgaagtgcaccagggcaggccatggttagttagtagtgacagaagcccaagcagggagaggaggggttggataatactgcagagaagcctggaggccagagtgttggagccgggacagatgagggaagaccagaggagacttgatacaggcgatattaacaaatacccagttggttcagggagaagtaagaaaagggacagggcagcagcatcagttggaaggagagtatgacaggtggagaggtgttctagatctgcctgggcacactgggaactgctcagaagagaggagtttcggatgacttttaagaggccagccggaggctcagcaggcagaactcacttgctgccatatgagttcagttcctgggacccgtgtagtagcaggagagaagagactcttgcaaatagtgctctgaccttcatatgcttgccgtgccatggtgtccatacacttacacacatacaaaacaaagaaaatgtagtaaaaagtgttgagaaacaagatttcagcatgtggctatcttcaggggacgccctttctttgaggtgagccctcgagaggttcagatttggagtgaagttgatgaattttgttttggacatactgtggaacacttacgtgatcctctgtttgcttgtcatgtgagagagtgtgtgtgtatgtgtgtgtgttgatgggaatttaaaggtcagctgtgtgctgctagaggcagatcttccgatcatcagcgctgagccatcaggtatgctacttcagggttgcttactgctgtaggcactggctcatccagacctgactgtgtggagcccaagaggaagtcagagctaagtg

SEQ ID NO: 20697 - DNA, 1194 bp, Mus musculus
gcctggtggaacttgtatcacaaataggaacagatcctgaaagtctatttgaaatttgtctagtccctgtagaggtttgtgtcacctagcagctgttggatggttgacttagctatatcagtaggggacagggtgacagtaccaggccttgtcctcctgggactctggtgcactgactgactgtaagaaccttctggttggctgggtagtttccttggcttgctctggagaggactgagaaccaccaagttggtgtggagttgctttcctcctgccctgccttactgtgacactccatccctttttactttaagaatagagccaatggaaggtgtggccatttgcccagcacattatcttagtttcagtatttctactagtcacattgtattaggattttactctttgaaatgtgacaacaatgttaccttccatgttcatatcaggaatgtgccactccgacttgtagattggtttttaaaaggcatttgctaaaatgtgatcctatatcagtctgtttcggttaccatattctttacccaaacaccagtggtaattttaacatgtgtgcttgtttaaaggtatttgaagtggtggagcgtgtagaagagctaagacggaagtggccagtggcatggggaaagttagatgacggcagcatcggtgtggtgacgccatacgctgaccaggtgtttagaatccgagctgagcttcggaagaagaggctctcggatgtgaatgtggaaagggtgctcaatgtccaaggtcagtgtccattggaatgagtcacgctgttcaaatgccttaaggtgtgtccacattggatttttaattcctttaaataataggtttttaagaaatctaatattaaggaaagaaagaaatctcattactttttttgagctggcagtgatacaagttctttaatattaaatttacatgtttataaaggttccaatacccaaattaaggtagtattaacaacccaagcagctgaaggggtttgcagcctcctaggaggaacaacaatatgaactaaccagtatctctagagttcctggggactaaaccaccaatcaaagaaaacacatggtgggactcatggctccagctgcatatgtagcagaggatggcctagtcggtcatcaatgggaggagaggcccttggtcctgtgaaggttctatgcccccagt

SEQ ID NO: 20698 - DNA, 1170 bp, Mus musculus
tgaccttttgtgactaggttttgttcactgaatgaagtgcctctgagggtcattcacatagtggcatgtctcagctgggccacttgtgtgtaatcacactggagtgtctgtgctccctgggtcacatttcttggcatcatgatcaaggcttctgtgagcctgggagcagcgacctcatggagaccttgcttgcagtttggtaggatttgtctgaagtggacttgctggatcagatggtcacggtggttcatttgtgaggaactggcagagtttcagagcagccatgcactcagagctgcatgtggttaggatctctggtgtctccaccagcagctgtcgttcagccagtacggttttgaagatggaagacttactgcatcagtgatggcagagtgatgatctgtctttctttcaatgtttttctaggaaagcagttcagagttctgtttcttagcacagtgcgtacacgccacacttgcaagcacaagcagacgccaattaaaaagaaagagcaactcctggaagactccaccgaggacttagattatggttttctatccaactacaaacttctcaatacggccatcaccagagcacagtccttggttgctgtggtgggtgaccctgttgctctgtgctctattggaaggtgtaggtaagtgtgtcactgaactgagagaatctaaatagaagtatggagtaatttacatctttatgcatgtgtttgtctgtaccatcacacagtgaattaaagtctggcttactgttacctgatgatgttagtgagagatctgttattcaggtctgttgatggtacatgcatgcttcatttccgtcggcaagcagtcagcagttagacctcagtgtacttaagtctgcgagcagtcagcgatgcccccgagtgcgtttgtactctgcgctctactctccgctccgcactcttccggtctggagatggtcagtgagcaaaacacacagacatcgctgtcgtcatggtggttacactctacagggcaggaaagttgactgacgacaaacggaatgagaacactgtgtagaatttgactaagtaaatgagagtggagggggagggagggagggaggggagaggagcacttaggggtaagagatggggtgttgactagaaaggctgcactcagaggaggcctc

SEQ ID NO: 20699 - DNA, 1148 bp, Mus musculus
cctttgaaatcttgtaaactgttttcctctgaggagagcagtataattgatgtttctgtttcgtcttctgcattttattctcagtcacgaactgttgccaagcagcagggttattggggagccagagaccttcagttctcttagagaccttcagttctcttgggtctcagttggtctggggaatcccacgctgtatgacatattagagctacactacggaattctgaggtttttagagggcttccatctgattcataaattcacttttatttcctttttgaaatgtttggtgatttttttttaacttgtagagacatgaatatctctaaatttagaagttttagcctaagaaacaatttatttgattgaagtgagttaatttcagtgagaggtgatcttgtcagagtgctttgacactcctgcctgtgcccacaaagagaaccgctgaactgcaagcattctcagcctgtggtaggtcacagcctggcagccaagcagagtatggtcggaggcaagggtttcttgcctgtgcctcagcggcttctgattgtagctatttctttctggacagcctggcaacatgatacatggtctgctttaaatagtctgtctgttaggatttctgtttcattttactaggtcacagagcttttaggatataagatctctgagagtctgtgtccgccagttaaaacagtgacaacggcagatatcattttcatccctgtaatgatcatgcatatctaggcaagctcttctgtctctgtgacttaaggtagagttgagtccatcagaagcattcattaaaataatgatctgtgtgagttttgcctgccatgagccctgaatgattgttactcacgtaaggttagagttgggactccttagttttctcctccaaccttagacccagtctgttaagctatggaactgtgaagtttgacttgagaagatcattttcatgatgctctgtgacgtgtacctccatgtggagggggaatgattcaggagtataaactgcgttgatgtcttggggaataagtactagtttcaagtcctcattttccctaacctgctaaggattttgagagccaggttttggctggtaagggcataatcgcagtcctgcccattgctactgtagagtg

SEQ ID NO: 20700 - DNA, 1197 bp, Mus musculus
gagggttctggggtgggggaggtctggcccagagcatctcctgggtctcttgagtctcttacgaactttctctcagggcaactcagtggcctgtgcctcctttctcctctcctgctgtctgccattatgttatttcctttgcacatgtgtatctcctcagatcctttcttttttaagttttaaagatgtattaattttacgtgtataagtgtcttgcctgtatgtatatacgtgtaccacatgtgtgcctgtggaggttggatgaagccatcagagctcctggaactggagtcacagatggttgtgagctgccaggtgggtgctgggaattaagcctgggcaactgatgaaccatcatgtctccgttcggattttcttatttcagcaatagacttgactttatagactcctcatgataaagatgtctcactgagagtgaccttagacagggaaggactgtggcagtgacttccttagtgcctggccttgtcctctctctgtagatccttaactttgtgtctgcccgtttgtctgccattcatgcttttgtgttggggcaggttagagaggaccgtgtcagtggttggattagtgcggctggcagctcgtgtgctctagtgtcagcagggcttggctcccacctttcttgtgcattattcctctctccaggttccttagtgactcttccccagcctgtttcctcatgatgtagagatgactgctgtcaccaccatcatccgttggtgacaagaagtctcactttttatacatccttaagcctctttgctttgtcatcccagccttagatgacatcctctggagtttacagtctcccctggtcccatcacctcactgagtccatgttctcacccttctctgctgtgcagactcttttgcccatcgatcctccccaccctgcttgccgtgcagttactctagcccaggaggttctcagaagacgctttctcctggggctgtagctcagtgggagtgggtgttgatctagcacacacatgacccttgttcaatgcccagcaccacaaaagcttagatagatagatagatagatagatagatagatagatagatagatagataccttcacccctaatgccttgtcttttgtttctccctacactggcacaggctagacctagctctctgcacctcactgtagctgtgagctccatggactgt

SEQ ID NO: 20701 - DNA, 1145 bp, Mus musculus
cattaatccatactcacgtagaatgtgagagctaggtgtgttggtgcacatctgcacccccagaacagggcaggctgaggaggaggttcaagagttcaaaaccagctgagctacatggcaagatcttcttggaaaatgtgttacaagaagggagagtggctgtaacaagtggacccgggtaccactgggccagatgtgagagtagagcgtacagcacattactgcagatgcaggcatgttctggcttacagaaacccaaccgcagcctcccagaccatccctgggtgtttgctgctcccgtgggcatgggtgttcttttatggtgtttcttcaagagaggggtttaaagtgtgttgtgatgaagttgtgtatgcttggactaaactgcccatgtgcttacgctcctggagatggaggagctcgtggaggagtccctaggcgcatgtgcagaatgcacctgtggttaaacctgccgctcttctctgcttgtagctccacccaagactgtcaaaccccctgaggatcagctgaagcccgagagcggggaggtgtccagttccttcaactactcgatgctgcagcaccttggccagttcccacccctcatgcccaacaagcagatcgcagagtccgccaactgcagcagccagcagagcccggcagggagcaagcccgccatgtcctacgccagtgcgctgcgggccccgcccaagcccaggccgccacccgagcaggccaagaagggcagcgacccgctgtccctgctccaggagctcagtctgggcagcagcccgggcagcaatggcttctactcctacttcaagtgaccccgctcgcgctgtcctcagagaatatgcggttcctgtccagtctgcaggatggaggtggcggctctgtgtgcgtgcagccctccattacgttcactgcgctctcagcccccttgctgctagacctgcgcctacgtttaaaagtatattccattattttgcatttttgatgtgagtcagaattttgacagcttttatgtagaataaaaatatttttaaatttgtgtattgttacatatgtttgcatcaagctagcagctaagaggttaactgtgcaactataaaaaaaagaaaaaaaagtttgtctaaaatgtattt

SEQ ID NO: 20702 - DNA, 1731 bp, Mus musculus
cgagtattctgcatgccaccactgggttttgaaatgtgaaaaagaaaaaaggaaaaaaaaaaaaaaagcaaccctggtggcatagtcagttttctttgttttgtttttgacaagcaagacttccagcttgtctttaacattgaggtgagagggtttggtttggtttaaacaaatggggaagctgaagcatttttaggattgttggtgcttagtagacttgataactattttaaaactgcgtgaatttagtgaaaaatattttttctcactctgcatgtgtaagtgttcgtagcctggccccctcctccagggcagaaagacctgtgccaactaacggtttgggttgcttttcctccattaacaatgttggtaccttattgatgtttacgttaagatgatgtgacctacacagagcaattctaagatctttctaagatgttacatacacagagcaattctaagatctttctaattgcttgtttgagggatatcattaaaggaaaaaaaaaacattgtcaaaaattgatgaaaatctagggtatgtttcagatcctttgaatcatctgaaattccccccttgaactcattagaaatatgaaatttaagcaactgtccgcagagatccacagcctgccagttgttttgaatgaacgttgaaggaagaggttgtcctcacgtgttaacacatccgaaacaatgaatgtcctttgtcatttcctgatcccgtagctctaattttgtatttctgagaaatcttgagactacaatctatcttttttttttttttttcctttttaaactaagatgaggccagggggatatttcaaaagaggccgactttcctgccgatcacacatacttttctggaagacttttgatagaccattttaagatgggttggatgtggcaagggggcagcagaattagtctgtgtgactagaggttagtctattgcagccagccacagccccctgtgtgggctacacaggctgcgattaaaggctacgttggttaaggggcagcaaactcctgcactgatgatacagcctctcagattcagttctgcctctgtgctcaggactgggctactggaacctggcttcctgttgttcctgtctcgggctacatgcctcttctgagctgccaggtatggacggacccacagactaaagtggtgttcacagatcccggcaggcacggggatccactgagtcaggacaccacattctgcgtgacatgacatcatcacatgctggcgtgacgcaggcagaatgagacaacttttgccacaggtctctgtttgctaactctgtgcccaagtaggactcacccatgatagagctgtctgtgtcccataggtgagtgcccccacgcccacgcatgcagacacacaggacaaagtacatgccgggcaagagttcagagccatcctgctaattcagacagagttatactgtcagttttcgggtcacctctcgccaggagatcattgcctacttttttgtttttcatacttgaacctttaaaaatatatgagttttttaaattatttatatttagttaaagtcacgtgtgcaccctatcatcttatataagacactgatggtgggaccccggggatggggaacccgtcaggttgcggtgacattctcaacgtggttatgtctaagaaatgacactagctacttccttacttgactgcgctgttgcgagtgtcggtgcgttcccatc

SEQ ID NO: 20703 - DNA, 1347 bp, Mus musculus
cccaccctttatctcttgatctaaaaataaattcctgatgagaattgacaagcctcattcactgtatcatgggtattttctggtgtgtttttttcaaagaagtccattgtggccccacgcttgctagtcacgttatctcgtccttgaccagtcagtcgttagttattgatcatggagactaaggatctcggtcttcctgtcgtcacacagacatgctcgctgtctgggtcatcttgtgtgaggagaacaaaattgtctgctgtgggttctttttcttttgccttgtttctaatcaagatcgtaggatgagttcaggtttgatgtaagcatcaactggtcctttctgttcagagaacttcagggtaaggaaaatacgcggaagtctcccagagtaagcattccccagtaaacatggcggtctctggagcctatgcattggagaggttttcctctttctgaaggccttgaggttctgaggaaactgtctttttaatcttgagctcatatgctgtgttatgttgctgtagtgtagttaatggttctaagtttggtatgtttcattttgagagcaaagctgaaaacataaaagaatgtatctctctagccaccgcgactgcgagtcagggtgtggagaacaattttaggctaaatctgaacattcccacgattgtcatgggaaatgttagatttcctgaactaggtgattttttgtttgtttgtttgtttttttaaggagatgctcatgagcgaaagaatcattgcgtagtggagagttttattagtagaaaaattatgtagaaacataagtttaaaacttcccatagagtaaaacatacacattactgctttaaaatattacctaggctgtccatccctcccccacccacctctccacctcctcacacttaaacccgccttttctcagtgagtagatccgggtttgtttgtttgtttgttattcttgcctttcccataatgtttgacaaccctgctcccaaccgccccatgtgtcctgctcacatctgggcgcaggtgtcatctgatcagtattcacactgcccagaagttagagaagaggcaggtggtgcttgctctccttgttcagagcatcacttggtgtgtccctggtagcctggtacccagagtacccgtcatacgggtcctcagagcatccactccatcaagccttcacatttccctctgcgacttgacagaggcttcgaggttcacacttgccagttttatccctcgtttaactagcaattccaagaccacagaaggaggggatttttactgaagtttagcatcccaataaaacatcagaaagtggcattatatcatcaactc

SEQ ID NO: 20704 - DNA, 2142 bp, Mus musculus
cttgtgagctgtggttctaatccagcccatttgtccagtggtaagcttgaagcttctgaaatgagtttcaagagagcctacaagtcttatagtttcagtcatcagagtggtagaccagactttacttgcaatttgttcaacagagagattttattttgatacaaatattaaacataatgcatagtaagttttatataattctatgagttcattaaacaatattatgagattttcagtattttggggggggcgtctttttggctatttctacctcatatgaggtctcttctgtattttatttagtatactagcatgtgcttgcctgccttagaatgatgtacgggaggggaaatcaatattaccttttaagaaaaattttgatttttatggaataattgttttaatattttaatgtttgaaactgaggggggtaagggtggcagataacatacagtggtaactatttacaaacctatcatattttaagattttagaattgtgagcaagatcaagaaaaataaagggggaaaaaaaagtgattatgaagctgaagctggcctcagttttccctggacgggttgttgagattgctgggcccactgccagggtggcgtcacagccgtccaggaagcgcactttgagagtcaggaggggtttatctctttactcgtgggccattttaatcatcctggcacctcaagtggcccgttcgtgggaagagctctctctccctttggggtctctgctactcctcattagggtgcaggggcgctttcatttctggagtgagtttgttgttagtgacgcagctgcctggctattgttcggaagctgtgcgtttgtgggatgtgcttagagtcgacctcgatccctccacatggagacataattgtggaaagaagccatcggatgccctgagagtgtgcttgcacttgcccaggctcttagtcccggtccttcggtggcagtgacttggggcatcggaaacattagacagtccccaatgaatggagcctatagtttttaatcttatccccccctttcttattttgtatgtgtgttggggcgagggcaaaggatttaccttcgtgttatatgtttctcaggttaacaaagttattttgggttctctgccgtgcctgcaggtgttagggagagcctgggtgttgtatgtggcaggaaaaaagcaattgtttctgactccttagctaccttgaagacctctgtatgtttgccgaagagttgaggggacacaccacccgcatagcatgagtgactcctaagtcagagcagacatgggtgagcacgttagttttgagaaagaaactgcctacaacataatcaacctgacaggtctttggatagttttacatttgtgtgttgtgtttaatgttcagcctgggctgcagcttggcgggtatcgggttctgctttctggtttctagtctggctttgaatttactgggttgctagcaagaaaacaaatctatttttaagggaatagaatgtagaacggcgtaggcgtagaagtataatacacagtgaccatcatagatttacacagctttagagttcttagcccccaggacttcctacataaaaggcccgggaagctctagctgcaggttgctggtgtgctcagcacagctttcctttatgcactcccagcttataagggacttcggtttatttgcgatttgccttgcatgataccactttgtatctttcaggaggtcagaggactcttttgtccaggttgaagtcccaaagtgtcagttttacctaagattgtttctcaacgaccccccctccccccgccgccgccgaagggtccctgatttccatgtatcaggaaggtgactgcttctatctatccatgtatatgacattatgtacatcaagtactgaatctgatttctgtgccagccatctgacctgattctttgagacccataaaggtactggttataggtaatagttgcatcccgggagaatagagtggtccaaatactttctctgaattataaagctaatggggtttgcattttagtaaagcgtcctaattgtcagtgatgcaggatcttgctttttaattttttttttttaaatacaattctctaaatgtggtcagtaatgtatggg

SEQ ID NO: 20705 - DNA, 1134 bp, Mus musculus
acgaagacaaaaagaaccattacaactacggctggtctttttactttggagccctgtcgtttattgtggcggagaccgtgggcgtcctggctgtaaacatttacattgagaaaaataaagagttgaggtttaagaccaagcgggagttccttaaggcctcttcctcctctccttacgccaggatgccgagctacaggtaccggcgacggcggtccaggtccagttcaaggtccacggaggcctcaccctccagggatgcatctcccgtgggcctgaagatcaccggagccattcccatgggtgagctgtccatgtacacgctatccagagaaccccttaaggtgaccacagctgcgagctacagtccggaccaggacgctggcttcctgcagatgcatgacttcttccaacaggacctaaaggaaggtttccatgtcagcatgctgaaccggcggacgactcccgtgtgacccgcccacccctctcggcacaggcctcccccaaggtggctgtttgtgtgacacagaacagggtgacccttaagattatagacagtgaagtggagctgagtgcgatcctccctggcctccagaagacgccatgggctagctcagagtgaggggagtctggagattggaatcagggataaggtagaaacagaaggctgactttctcccgaggtaggctgttctgctgccctctgggtttttggaacttctcaagaggcccaagaattttcaagaagctgcatcagcctgcctcttgggaaccaagaaaccagtcatgccagatgtcaaacgcatcctccctcgctgggcactgggccacagggaggcttcttccgggcactgggacctctggcctcccatcgactgtttcctgcccagatgttcctgtgtcctggagcccaacatgagcctaagctcattccattcccctctgtgtctccctcagcctctgtctggccccctggtggagctggtggttgtaaatatcacccattctgaagagaaagctctatggctaactggtgcttcggcctcgagctgtcctggggcctgctgctctccacctcaggagatcaggaaaccagggcaaattcggaggctctgctggctttcatacctgcttctg

SEQ ID NO: 20706 - DNA, 1239 bp, Mus musculus
ctgaacccagagtttgcatatcaggctgctgtagcatgccagccctctgtctccacatcctggacactgggattacagatggctgccacatttcccagattttatgtgggttctgaagatccaagctcctcacactggcacaaggtgcttcacctgatggcccgtcttgccagcctttgccatttcagtggcatttccataatccaatatggcaaagccagccctgctccctagaacagcatcaccctaactggagatacaccccgttaaacaccctccctgtaccccctttccctgagattctggcgactgccaagctgcttcctctccctgtgactttaccttcaggctattttatgtaaacatgtgatgcgtgactgtgtcaggtttctttcatttcacacattttcaggatgaaacatgtattgagattgtgtgtgcgtgcatgtgtgcatgtgtgtgcgtgtgcgtgtgcatgcatgtgtgcatgtgtgtgtgtgcgcgtgtgcgcgcgtgtgcgcgcgtgtgcgtgtgtgcgtatgcgcgtgtgcgtgtgcgtgtgtgtgtgtgtgtgtgtgcagtatgcacatccatgtacattgtggagacctgtggagagcactgggtatcctgctctatctctgtctgccttattcctttgagacagggtctctccatcaactcagagctaagctagaggccagcaagcctcagcaatccttctgtctgccttcttccccccccccccccagcattcaagttacaggcacatgtggccacacccagctttttatgtgggtgctagggatttgaacttgagttggacgtttgatggcaatgcttttataacaagcactcttactcatagagaaagttcatcaatccaagagattccctccgtatgatggctgaataaaacctccctgtgttgatggaccacactgcttacacatacattaactttggacatctgggtgttcccagctgtggacatttgtaagcagaaagaaacagtctcccaggttcctgcttgagttcttgccctggcttcccttggtgatcaacatctggggagtagcaggtgtggcgccctcagtcacagtgtaggatgcctgggaacctgataggaaaacaacctacgcctctgtctaatcaggacaggttcacagctacaggctcattcccactggcctcctccgcagggtcaactgtctgatcccagatatctgtgggatggca

SEQ ID NO: 20707 - DNA, 1214 bp, Mus musculus
ctcgggggatctgctcacttgaaacagtgaaactgtagcttcaactaattttgacactgggtttttctaaaacagtctctgggctccaagaatgtggcataaatgactcgattaagttcaattcttttctaagaaacattgaaagttaattccccccacccccatgatggctattcttggttgtcaacgtgactatatctggtactaaaaaccaaacctagagggcacacctgtgagagatttttgcttaatttgaaataggaagattgatttctaatttggaccttttagttaggaacacacatcttcagtccatccaaagacatgccttcagtccagatctggagttggaaagatacacctttcatttgggccacaccttctgctggaagcctatacaagtttatacgtggaagaaggaagtttctgctcttggcccgtttgcccttgccttgctagctcatccattcattcactggcattagagcctacttcttcaggaatccagtatctgctgaaccagctgagaccagccgaacaccagatcaggcctcctgaactgagaaattactggattgttggactttcaggtcacagacagccgtgtgtgtgtgtgtgtgtgtgtgtgtgtgtgtagaggaattttcatccagcaaaatggctactctagcaagggatcatatccaaagacctaggtctgtgtgatccagctggagatgtgtatgtgtatgtgtatgtgtgtgtgtttgtgtgtgttctgtatatctttaatccccctgactggaaggaatacagacacatctttagtacacaactttaatcccaaacaatgatgtctatttgaggggcagacaaagtgacaaatcagagaaagatctgacagaatgaatcagagataggataagatgaactcctacaggaaaacacaggaaaaagaggctacttaagaccagcaacagagaaaagggggtggggtgtgtgtgtgtaagttttacagagacaggttgcagagagagcaagctagataaaagtgaagacagaaaccagagatgataatgagccagaagattaaaacatattgccaaaatttatatgagcgattcagtcagaagctgagagaagccagattgaatcagtcagcttggaatattaggttgtatggaggctagaagcttccggggttaggcctaggaataattagaacagacaaagaa

SEQ ID NO: 20708 - DNA, 1224 bp, Mus musculus
ccagggacttaatgataaatgctaggaaagtaactgtacactggctttgtgtgagtcctacaaagctgccccccggcttgtgtctggtgtggggtggggttgtgtgtgttgggtgcccctgcacatatacacacattcatatggaggccagagaccaacctaggatgttgttctaggatgggtgttagacatccaacttatgccctcacattcacgaggcaggcacttggcttactgagccatctccctagccctatgtgcactttatttccaatacttccccccctcccccaattctggggaccgacctcagggacttgctcttgctaggcaaagcacttctgtcaccgagccacattcccagcccaaagcactcattctcaacagccaagcttagtaggcacatcattttgtatcccccatgaccagaagtctactttgacttggacaggcactaggcatgtatgctgtgcatgcacatacatgcaggaaaactactcatacatataaaataaaaaattaatgaatctaaaaaataaaaatcaaggccttacatgaaacaagcattaaacaactaaaaccaaacgaggcgcctgtgggaggagaggtaaagcctccggttagtagggtgctggcggctgggttcctgccgcagatcctgctgtcgcaatcccatcctcttctgcagcagcagtgtgcatgtgtagatggggaaagccaggtcctcctgaaagatctgctgggggctggtgagatggctaacggccaaaggtgtccatagccaaatcctaacaaccaaggctgatgacctaagtttgatgctaggacccacatcgtcctttgatattcagacatgcaatgtggcgtgtgtgtgtgtgtgtgtgtgtgtgtgtgtgtgtgtgtgcacagacatcaaatgtaataaaagccactaaagaatcagctcaagaggaactgcaatggtctgtgggtgaaacttaggaacacacccttttcttctaaatgtttacatagtttgaagtcctgaaatcaaatatggaattcagggccttgcccatgctaggcaaactccttatttgtgaatacacatgcagtccttgaagcagacttaggcaaggcactgggaatatcactgtagcggctgggtagcaatcgcccagaagaggacaccattcccagctcttcctggactgctagtcgctcctgtgtatttgcagtgccttg

SEQ ID NO: 20709 - DNA, 1298 bp, Mus musculus
tttttggatgtttgtatagttaggcattaggaatggctttctctatgttgaaagtaactttattgatgcaaaatttacaacaaaattttacctaaaagcatgtttgatagtattcagagatttttattaactttcaatgatagattataggagttttatttttatgaaaatatgtgttcacatttgtgttgcccaactgcaagtagctaataaagttaaagtgtaggctggcgctatacagcctattttccagcccacacccatctgttgttgttgttgaaaagttttattgaaatgtagccatttgtttgtatgtggtttattaatgctttcttggtaaggtggctagaataagctaagccagaaattacatggcctagaaagcttgaagcatttatagttgggccctttacagaagttggctgatccccgctctagattacagtaggtacttatgcctttataatttaatgtattgtcattgcaacattaggtttcacatggttcttatgtacctacagaacggcagaggtgtgctctttggatcagaaagctgtgtgagccctcaggaacgggtgcaggactcatgggtaggaagaatcgaaacctgtatgcaaagctgttactgcatatgcttaggcgaggaatacttgaaggccctttcacacaccgcccggagccaggaacgctgaaaacattgccatcgtacatggtaggtaccaacagctgcaacagtcttcatttctttaaaaacgagtgtgatttatcatccctttgggagcggaagtaatattgagatatatgtgccgcttaatatgtaagttaaaacttttcttctcattcattctttcccatttcactaggaacattattctgttatattttattcacttatattccattatataaagcaaattttaaaactgatcttacttactaattttcaaatttgactcttaatattttaaatactttaaaaattctaccttattaattctttcatatattatttaacatattatcagtttaatggcttttagaagttcctttctagtcagttgaagcagtaagttagaatttaaacgtggtttctattgttgctttattatcttctttgttacaaggtaattatttactgctggttgatgaattgtctctgtcttgctccttgtaaacataaatttgtcgttttatttgtgtgggttttgagtatgatatatgcctaactgtagttgaatacacacacacacacacacaaacacatgcatagacatataaagttcatatatatatatata

SEQ ID NO: 20710 - DNA, 1207 bp, Mus musculus
aagcagtggtattcaacatatgggtcatgacccatttagtaaatttgtttctaaaaatatttacaattatgattcatgtcagtagaaaaactacagttgtgaagtggcaacaaaaagctttgtggttgggggtcaccacacatgaggaactgtattaaaggtcacagcattaagaaggttgagaaccactgctataaatctactagcacttaaagaaataactactcccagatttacttgctgggtagttattctattcattaggtttcttatatagtagaacataactgaaatgtaaatatactagccatattattttaatatttcataatttattatgcattgaatgataaattttatatatttgtctgtcattgaatttaatttgaatatttgaggagcttttgctaaacttaaaaattgatggaaattttaagtgttttctttatagtaacatttttgtaagaatgatttctctgatatttaaaaaccagtccatctattttgatgaaccaaatcaagcacaacccaaagattcgagcccagagaagttacctgactgggtgaggggtgagctgcagacgggcgagcagaggttaagtgactcatggcagtgctcttctggagaggacaacacgctggtgctggcggccagtgatgctcacaggtatgccaagacattatgttttacggttttaaaaacttactcttcttttgcaatcggctcatatattgaagccttttctttctttttaataataaggatttggtttactttatattttcactaatgttgagtagatgttaggtaggtaaaaataaataacaggctttaaaatttactacatagttaatattatgttacattttaagccatttaatggaatatctgttccctcccttctcccccccgcccccccccccccgccgtgtgtgtgtgtgtgtgtgtgtgtgtgtgtgtgtgtgtgtgtgtattttgttgtttggaaagtgtgcttgagaatctttttttttttttttggtttttgagacagggttctctgtgtagccttggctgtcctggaactcactctgtagaccaggctggcctcgaactcagaaatctgcctgcctctgcctcccgagtgctgagattaaaggcaagcgccaccactgcctggcgtgcctgagaatcttaagtaacacaactgccttagttagggtttta

SEQ ID NO: 20711 - DNA, 1176 bp, Mus musculus
gaggcacagctagttgattggtcttcacacgcctggctattttggaaaaatatgtgaattgtgcactaatactgtagctgtttatgagcaatgggcattttatggttaccgcattatgattatatttgtgttttaacatttcacattagaagctagatatggaggtttttcaggtgagaacacagtagcagatacatagacaagaaaaataatgaatgaaatgtgtctacatatgtggaaaaacaaatgggtaagattgaaagatgcaacatagacatagagagttagatgtggttagagtcagggagagttcaaggaggaagacgttttgctcagttagaaaggcatccttggagggggagggtatgggggacttttgggatagcattggaaatgtaaatgaggaaaatacataattaaaatatgtgtgtgtgtgtgtgtgtgtgtgtgtgtgtgtgtgtgtgtgtatgaaaggcatccttgtagaagttatgggttgaggaagggagaagttcactcacagagtatatcagactgtatcagactcacaccgtttggaaacaaataactaggcagaccggactgcagttataatatgctgtttttaacagtagtagaaacggtgggaaaccatcacaaattaccttgccaatttgaagatgtttatactctgtatacagaacaattcacaactaggttcaaaactcacaaaaatgtgtgtgtgtggacttgaatattctatgggatctttactggtggtgtagctcattaccaagtgcccatgcatggtcacttataccatggacaacaaaattatataaggtcactgcattgtgcttgtatgctaaattaatttgctttggataatgttcttatgggcatacagtgtttaatcattattaaattctacaaacattttataaagttttatatagtgtgcattttacaaacaactatatcaagatgtattaatgagatgtatgcattcatgtgcatcgaagtacaaatccatatggaaatccatacaccatcattagtaataaaagtgtggttcagcaatttaaaataaaagcaagaatgttttcttttcttaagattatttatggactggagagatggctaagtggttaagctcactggctcttctttcagagatcctgagtttaattccaatat

SEQ ID NO: 20712 - DNA, 1151 bp, Mus musculus
ttggttggtatttttaagagactatacctgagctgatactccataagcagaaacttttccacagtagaagaaggatatataaagaagtaggtgatggcattggtagcatgagtgcatgtccacgggagcccgcagagaagttgtgtttacagtgccgttttgtgatgtagaagaaacgagatggagccaagagcagctggattataaagagctgttttcccagttaagcccttgagccatatcctttaggggagtagaactttagcatgatttccagctggtcctcctgtcggatctgccatattagaggagaaatacttgagactagcatgctatttaaatgttctagggagagaataaaggctaatttaatcagtttcttctatgattatagaaatagcaaaaaacaatgaaataagagggttttttttagaaaagtaagtaagtgaaagctatctactaaatgtatcatttagatatcaaattctaatatggttcctagaactggtttaactatattgccattgtttttgacagttcagatccttatccgtgactgtcaggttatcagagaaactaaagaaaaccagataaccgagctgaagaagatctgtgagcaaagcacagagtctctgaataatgattgggaaaaaaaggtaagctctgaaagtcaggcccaggactgtgcccatctgagagagacatgctagcaagtgcagaaaatgcggaaagcttcaggagaagctcgaaattgctggtgctcctgttctggtatactttcatctcaaagtctatattctggaaatagttttgttttaaagtcatatttttgcttatttttaattgaggtaatgttttgtatttttttgtcatagccaataggttttagctaatatgattatgggaataatggtttcaatttgggatttgtgtcatttctctcttaaaatgccagtgtcattatctagcccaggctgaagctgacagtacaaagttgttgtgatgtgagtagaatccgtagtgggtagtttggcttgcacgcactggggaagcatcgaagtgttgatactggggcttagtgatcatcttggatcacttttggttctaagtgtatccctggtatgaaaacagacttcagaaaattacaggtt

SEQ ID NO: 20713 - DNA, 1153 bp, Mus musculus
aaaaacccaggagaggacattacgtgaattctaagaacttgatgttgaatattgaaaaggcagcttccgaggaatactcacaatagcacagtgtatgtattctgaccaggtaaagctaggcagtgtgatggcggttatgggaaatgttcctccccacatggcatttagctctaggtgggaccaggattgaaggacacagacagcaacaaaggccatgggtgggacgtgtaggaccagtggacagttaacgtgtgtattcgttggcctgtggagttgttcctttgtgagttccctatttttatctctgcccatttctccatactaggttattgctgacatggaggcccaggttcataagctgagggaagagctgattagtgtgaactctcagcggaaacagcagttgatagaacttggtcttcttcgggaagaagagaagcagagagctgcaaaggaccatgagactgctgtcaagaagctgaaggccgagtcagagagggtgaaaatggagctcaaaaagacacacgctgctgagaccgagatgactctggagaaggtgaggagtgtctgggaggactgtggttaggctacagtgcggatttaaagcccactgtacctgctctggtgttcatcttggaaaggtggtgggcgtgggctgcactctttagacttagaggagcagtttgaatcttgtgctgtgtcttcagcacgctaaagtgctataaggaactgcttaactttcttttgacttttatggagagatctctttcataggaattcagtacagtgatagaacagtcttgtacactgtcacataccatgcactctagggatatttgggctgtagctctgaattttcttaggcttagaatgagttgtacatttcctctaaactgttgtctaatagtcatttttagacttcatagtctctctttaataacactaacatagtgacaatgtatttttctaggttattattttagtacaaataagttcataaataaatcaatataatatttacacttttggcttggattatattcaagttgcaatcttgaatgttcttttgaaaaatttagatatttatcaggtactaaaagtgaattgctgttcatcacagcagctataattgttccctgagctcctttattaa

SEQ ID NO: 20714 - DNA, 1573 bp, Mus musculus
agcaaagggagtgagactttgactgtcacagccaatggaatttttcattaagaaaatcaatgctcagtttggagagcttgctctgtggagacggtttcctgctttcagttcctagcacccaacttaagtggctcacaacagcttgcgactcctgctgcaggacatccacagcccttttctggcctccccagacacccacacatgtacacaaacatacagtcaaaaatgaaataaatcttttggtgaaaggaagccaacacaaagaacttaaatagcggcatagtgggaaagccaagcacgctctgtgggcaggcagcatggagctctgggtctgaaccttccacttggggccacagtcagcgttgttgtccgcacccctgacccccagtacagggtcaggcaagggaaagctgaagcccagcaaagaccgaccatgtcagcccataagagaacatcttcagtgaatcagataagattgccttcctagagggagaacctcgtgaaggtgatggtcctcatgcaggcatccgacgagtgatagtagcaaataatcattcgagaactttgaaggccgaagtggagaagggttccatgtgaacagcagttaaacatgggtcagtcagtcctgagagatgggtgagtgccgttccgaagggatgggcgatggcctccgttgccctcggccgattgaaggggagtcgggttcagatccccaaatccagagtggcggagatgggcgccgcgaggcgtccagtgcggtaacgcgaccgatcccggagaagccccggggagagttctcttttctttgtgaagggcagggcgccctggaatgggttcgccctgagagaggggcacgtgccttggaaagcgtcatggttccggcggcatccggtgagctctcgctggcccttgaaaatccgggggagagcttgtaaatctccgggccgtacccatatccgcagcaggtctccaaggtgaacagcctctggcatgttggaacaatgtaggtaaaacaggacctggcatggattgagggttctccccactgaggttgcataaaaggctgtgcataagtgatccaggcctaggagctactgaccattcccatcctcctcctgttggagatgaagaagcagaggcaatgaaggggcgtggcctgtccgaggatactcagacagcatagggcaaagccgggacatgtacccactgtgctttactgagtctcagtttctaagaagtctccactgccatttaagtcatcagcctccagctagagctgagctcacatgagagcatagcataactatatgcgtatagctaacgtaacaatggagtgggagagatttggcagcagaagccttgagtgaacatagtgcctgcattgttccatgtgccatgtaccatgtcagatagctgcaaggacatagagtgggtgaaatgatgtgcccagaactctggggcacctgtcggctgtggaggaaacatggtgaaggttcttggctactaagcttgctgtcactgtcaccagcatcttccttctactacaagtagccagttcctaatggaccctcaa

SEQ ID NO: 20715 - DNA, 1200 bp, Mus musculus
ctggaagtgcctgaggagggaggaggtgagggagcagagcagattcacttgaagtcaggcgacttctcatttccctttgcagcactttcaaccacctggcttagttagcgaggtgtcgttttttttcagaccttcttaccattttaacagaccgtggtgtctttgagtagcactcacaaggagaggtacatgagttagttagtgacttaggtaaggttagttgatagactgcttacctagtatgcccaaagcctaggggttgattcgcagcaccacgtgaacggtgcgtggtagtaccacactataatcctagcgcttaagaggtggaggcaggaagtcagttcttttcctcagtgatgtaacaagttcaaggccagcttgggacacacgagagaactctgtttcaaaataattattatgtaaataaatacacaagagtttttcattttgtacagctgttccttcgtatcctcagggtctgacaaccaacccctgggatgacagaatcccagtgtgcagtcgctggtataaaatggtctagtatctgcatataacctaagcacaacctgccatgtgctttaaattacctctagcgtactcggactgtctcttacagcgcaaggctgtgtgagtagctattgtgctttattgtttggggaataatgacgaggagaagagtctgctcagtgcagatgggtttcttgcttttctgtgtagcctaggctagcctctaatttgccgtcctctgtgtgctgccgcgcctggctccagatagaaactttcttcctggcatttccagactgaggtcgtggaacctgtggatacagactgcacttggtgatcactttccaattagtgattgagagtgggatgtgcccttcaggtcttcattaagcatgcattgaagttttgccgaatgtaatatgttcgggccctgacgagaccataggagagtgcattgctgatttgccttcctgggaactgtcatgtgagaggagtgcagcagggcttcagttgacagtgctgttcctcactgtgctgtttgctgtgttccctggcttagaggacctcagagaaggcagggagttcacaattcagacccaaggcagtagggccccatagccgtgcctgttaatcagtccctgcttttctgcctctcttgctaacagagttaatcagatcacagcctagagacaggaa

SEQ ID NO: 20716 - DNA, 5278 bp, Mus musculus
gaggaccgccagaccaatcgccttacagaatctctgaacatttttgaaacaattgtcaacaatcgggttttcagcaacgtctccataatcctcttcttaaacaagacagacttgctcgaggagaaagtgcaagttgttagcatcaaagactatttcctagaatttgaaggggacccccactgcttaagagacgtccaaaagtttctggtggaatgcttccgggggaaacgccgggaccagcagcagaggccgttgtaccaccacttcaccaccgcgatcaacacagagaacatccgcctcgtgttccgggacgtgaaggacacgatccttcatgacaacctgaagcagctcatgctgcagtgatgacaagactcgctgttttaataccttgttgtgattttgattgttttctgtttgtcttgtttttctctttaaatggcagtttacaacagcagttagaagaatctcagttgtgtgtgtctaacttcttggagaacttagttcatctgtggcctttagtttgtggctgacagctgctgaattaacccattgccaatatctgctagaatttgggctttgattggtttcactgtggcttaccttcaagtccaattataacttcctggcaaccttacactaggtgtttttcaggccttgaattctcataactgtcctgcagttctaagaataggcagtatctttaagaacttgtagggatgagagtatgaaaattcagctctaaagagagagagtgccttacccagcaatgacatgcctccctatgtgagccctggtctggaagggctgttagagaaaagttttagggaggagtctcggcccacagaggcttggccccctacacacacagcagtagtttgttttccctcaatttctctaatttctgtagggcagcagtctcagcccacagaggcttggccccctacacacacagcagtagtttgtttttctcagtctctttactttctgaaggtaatgtcttactgcttaagtttacaagatggatctcagcctgatgctgatgcggtcacaaatggtacatgtgctatgttgatctgagatgagcagtgacacgcagtttcctttgccatacatgctgtcactaacttaatgtgccatgttacaacatctggagagggcaagcaccctggtgacggacatcaccatagcagccccagagtgtgactttctggtcctgtctccttggactttgtgccttgctggagagaaccactgttgggtcttcttcctttagccccactgtctcaacctcagcagctctgaactgtggtgctctcgggcttctcttgtccccgagagcttggtgggcagcatttccctgtgaactgttcaaaaaggcatcctttcagtaccctgtccctggttagtgtctctctgtgacagagtttgtatgtgttgtgtgtgtcatcgtgtgtgagacacagcttcattgaggtacattcaaatgtcttaaggatgcatctaaggataagcaatttttttttggcccatacttaaggaggtttgccttcacacacacacacacacacacacacacacacacacacacacacacacacacacacacacacacacaccattgctaacttaaaccatgcccatgaggtagcttgtgataaaatacagtggctggtgtacaaaaccatttggcatgttccaactggcctgggagtttgtagaacctgagcttgtccctgctgtccctggagagcacacgagggcagtgaagcctgttttactgtgtgactattctcaggcaagaaattgcgccctgaaagactggctgactatgaggcccaaaagcagtggctttcttcttttcttgctggagggtgccagagctgggccctagtgtatgtatacttgagagacctgacttgtcctggatttgagctttcactgtcattctggttataaagtccagtgctttcttgccttggtaatatcatgagcttaagacatgtatgtcagtatcacagtgcaggtgttgttagcataattcaccataattcatggttctacatctggtcctttttctgtcaaaaaaaaaaaaaagatatgtcatttaaatgtatggttagcatcactccaatgctgatgagcatttgagtgtgtgtgcagtaatgtgttctgtgttaatttagcaaacattattgtgcattggccacaactaagtgcagtgaaggcagcagaagtcagtcccaccagaaagcagttgtgtctggttacatttaagctctgtggtgagcacagaaattctgcctgacagagcaggatctctgacttcctccattgtgaccgtcaccaagaaaggaccagagctcctgactagagacagcatccttccgggtccctgcagcttccttctggagcgtgcagcatcttagaacccagtgcggtctagatccattctcacgtggtagattacttacatgccgtctccacaggattggttagaacttaaagaacagtgaggcccagccagaaagccacggtccacacttacagtctgacacttacacaccctgaaagtcaggtccttttgtgaagtgaaatactgttgtgtgaagagggcgatggaatttagccaacagaattgaaaaggtgcctaaccctccgtgtgctgacttctccctcctggcccctgagccatgccttggagctgaggctctgtggggcattggtctgtgtatgtctcgggtgcttggagtgactgtgcctaatccagactcctccttcaatcccgcagccttcctgcttactgacagagaaccacacaagtgtcttggttgacttcgaaatctttttatacatttcagagttgccttataaataagagaacaacccagacttagaccttaattttctttgtaatggggaaagggctttgttccacattttcttatactctcaactcaagatgtgccacccagatatctgtctgtaatggcctgagatgttgctctctgccaaatcctgtctgtattcaatagaagcctccctatcaggttttctatctggaaagggtacttgatagccaaagagaagcttcagccaagccagacaggatgtcctgaagaggagcatgttgggtttttttgtttgtttgtttgttttcctatcgcagtgcattgtgggtactccacacccaaagggtcctctggtgaagttctcaagttgggactcaacagggaaatgcttgttacgttagtggcagctgttgctgttactaaagtaagagtaagaccaccattagtaccagaagtgacaagaattgttagatccagcaaaaagcatatgcccccaagtaactcataccttctagtgtgtatgcccaaacgcttgggcatctgttttgatggcatgcatttctcagtgttggtattcacatccggttatgcctcgtttatatgaagaataaaatggccaagttatgcggttatatcctgagactcaagctatttggaaaaccctcaaattggcgctttcattatttaatgatacatttaggcaaaaccccaaacaaaccatctgaaacctgactccgaggtgcaatttgttagcgatgttatttttctcgtttgagaagaccaagcgtcagtgttaatttgaatttcctgtatgaacccctgcatcccacctttaaggcccagtcaaacgtttgtaagacgtcccctaataaacctagagaggctgcttccttaccctctcatttcttttcattttatttgaatgacggagagtgaagcttttcaggtccttttatttggaaaaatcagactttggctatctgtctctttcctgagatttcagcacgttaaattccatgagtcaagggatctttggttcttgctgcttgaatgaaagtttttttctgctttttctttttttccttttctttttaaaaaaaaaaaatgtggttggcttttcagcccagaaagcatgagggcacgtgatgcccgttttcttatggtacgagtttagggcttagtcagtttacaataggattgaattttgtgtcaaaacctgatggtggctcctcagataccatcagctagatgcttctagccgtgcccggcaggcgggcaggtatcagattcatcaaagcagtgttcatccgctaacattgtgccgtcctcccggatgtagatcagcaccggaatttacctgctcatccctccgtagagcaagcagtcaggtctgaccagccagttttgagtgccttgggtggcacatggcattgttttgtatctgttggcttgcatatttgtgcttttgaggcagggtctccttgggtaccccagagtggtcttgaatttgagatcctcctggctcaacttcccaactgcagagattaccacttgttttgtctttttgttttgtttttgttttttaaataaagcactagtcatgtgatagcgtttagtgggctgtgatgtgacttttatgacgtatgctatgttaatcttgatgaaattgccagatggtgtaaagcctacctgaatctacgaggtagaagttttgggtctgtgagggtcactgatggccacaaaccaccttctcggtatgcaatccttgctccattcacagatgcaacgttgccaaagggagtgacgattttgacactaaccgtgcctcttcaatggcaccggggatgacaggggaggaggcagtgtgttcttgttgggtgcctatggtaatgaagcatatactgtgtaccttctcttcacctcttacttgaaagcagattcgcaaaatatcctgaatgacttctctctcttacacgtgagctcacaaggcccaagaagccttagtagaggcacacagtgcagaccttatagacggtgttcctaacgagacatggtttatgctacactcaataaaagtatttgtgtctggtagggtttgtttgtttgtttgtttgtttgtttgtttctccattcatctttctaaaactttcctgaaactaagctggttacagttgtagacaaaaaagatgggttttggtcagagatttggttcaagagtcgccgtaaattattcctgtaggtagatctaagagtccaaaggtatgctttcatttcaccaaacaaattaatatgcataaaggccttttacttttgtacatattttgcaaaagtttgtccctctactattaatatttgctttgtaaaaattactgacatttaataaacatttataaatgacctggtagcacgacgttattgagtatgaaggg

SEQ ID NO: 20717 - DNA, 1406 bp, Mus musculus
gtggccagccatcaccacaagtatttcaatagaaatgataaattgcattcatgtttcctatttttcataatgcaagaaataaatgactgttgtgtctttaacttaaaccactatttattattaagttattctaggatgattaaaacgatcaaaagaaagggccagcgagatggctcagtaggtgaagttgcctgccaccaagtctgacaatctgagttcaattcctaggacccacacggtaggtcaacttctgtgagttgtcctctgacctccacacatgctatgacatgcatgtgcctgcacacagacacacacaaaaatatttaaatgtaaaaatataatctaataatcaaaataaataaaaggtgattggaggtatacaccacatatttttacctctgttctgtggctctttaaatgcttcagagagcttttctggtctcataatgtaagttttccacagcccaagttgtaacgattcttcaggtgttgttaaaggcaatgttgtgctatttaaaggggagggggataacagacgacaaatcgcctcagcttttacatatatcagctaagaatacttgaggatcttctttgatcagaattatatttcattggattgttggaacatttccagtggttttttgttgttgttgttgttgttgttattcgatctgtaactgttgttgaagcctttcttcattcatctgaaatgggagaaacgcagccgtcaccatcactgagttacaagttgcaatttccatcttctgtagaacttgattgccctaagttgccatgggtaccgagtggtacctggtcactgctgctggtgagttacactatacagagttctgcattctagcagatctctacaaaggggggggggggggtgcagtgtgagggtgagggggtctgcttcctcgcctgtgtgatggcatctccccgacagggcggccgatgcctgctgctctacctttcttcatctttactgttaaggacaactcagggggaaacgtagaacaagcctagtctggttacaggtacacacacaagcttgaatctttttctctgcactgagacgaagggggtgtggctcatcaccgcctgccacattcaatacagcatcttatcagccatagaaataggacaatctgtcaaactttggggagggtgagtgacaggacgaaagacaacgtgtctgtccaaaaaaaagcagactgcacctgaaatgggatggatgtagccaagctcggtgggacccctcccccacccccacccccccgagcaatgctttagtttaggctcctgggcaggtttacagatgtatgtgacttcggcactttaaaagctattttgtactacgaatgttcgagacgatttaatatttgtaactgatttctgagggatca

SEQ ID NO: 20718 - DNA, 1186 bp, Mus musculus
ctgcctttgcttcgttgcagactttctcacctcacttgtcatttgttttagtgttcagaatattagttgggtctttggaaacaaaaggtattttctagctccttgtcattcacaaggtaaactcagctgagccgttatatggataaagctactttgaacctttgcaatggtgtgcatggggaagctgttttctttagttacgtgaaggtttgcctcgcttgatggtaatgttgagaattgcattttcttagcacttttataaaagctaacacagtaaaaggaaggctctgagggccgtctgcagaagtaggcgagtcctgctgaggcttggagccactgaggacagctgctgtggctggccttcatgtgctgaggacacatgtgctgtggctgccttcacccggggcttttcctgggatgtgcagtggggactctagttggtagcatctttgtagagtttggttttgctcaacttttatttttttactttattttttagcaatagcagatatatagagaattcttttgattcttctatttcagagtctctggacaagtgggagcgtctcacagtagccgatgcattggagcctgtccagtttgaagatggacagaagatcgtggtgcaaggagagccgggggatgagttcttcatcattttagaggtagagagctctgcgagtgactccttaccatgcgtcacctaaaggaggggcagccagttctgatttgtagctttagttttatttagtcgttatcttttacttcagaatacagcttgctgtgtatagtctgctacagttttaaagaattagagtcagaatcctgcaagggccctagacatgattggtgagatggctctctactacactaaaaagcccctcagccataacagatacggtgattctgagccaaagtgcttaggctagttagtaatgattgacaattctaaaagtcactgttactgaaacatctccctatcatcctgcttgccaagcaggtccagatggcagcttcagagtctgaactcttgtcgcactgcagatgcagccatggagatgtgagccctgagtgtgatagtctttaaaatcttatttccaaagatgcagcaggcttgagcttgaccctttacgtaaactttactcaccggagtctgaactcctttgtaagtgcctgagcttgatac

SEQ ID NO: 20719 - DNA, 1487 bp, Mus musculus
tgtaacattaactttattcagttaatagatgagcacagaccaagcatgcatgcgcacacgcacttgcgcttatgtcctacatagcctcgactgcctggacttcattgtacagtgaagcttgttctaactggtcaccttcctgcctctggctcatgagtgttggtttgtaggcatgactgtaggggctgtgttatctatttgctagtaatactttttaatgtacaaatgttgtgtggcctctactaagttagtagggaagttgcatctttgttcacttgctcaggagtggaccctttaaggaaatagcttccataggtgatagtcgttactgtctcttttccaggtgaaattgccctgctgatgaatcgtcctcgggctgccactgtggttgcccggggccctttgaagtgcgttaagttggaccggcctcggtttgaacgcgtccttggcccgtgctcagacatcctcaagcggaacatccagcagtacaacagcttcgtgtccctgtccgtctgacccgcgcctcctgtgcctcctccccagtccatgcttcactcacgcagactgctttctctccctagccgcagcgcccagtggccactgcttcacagcttcttgtctctttatactaaaagttgctttattgcaccatttttcattgggagcgttattaaatgctcattcacaaataaatagagagttgtatggacttggctgtcaccgcttctctgtgcagtgctcgtgttcaacctgggcagcaagtgccgcgctttttgctgagggcggtccctgcaccactgaattaccgtaatgatgtaatagctgtgcagggcttttaagtgacacaggtttccatttccatatgacacaagtgacatacttagactgtggccatgtttgctgtatttctttatagagtaaatgattttaacctttaaggattagaagaatgaatatagaaaactcctagcacagtagaaagacatctgcctgtaattaagctagtttaagtgtgggagtgcccatgttttgctaatcaccaggcactgcagctagttcagccctctcagcctggtttggtgtgtctgttgctagtgtttcttctccaaccctgaaatgttttggtgtggctggccgtctatccctgcctttaagtttgaaatcatttgtagatggcaagtactggttgtgacttcactgcacctgtctgagctcacagacgctgataactttatttatccagctggtgccaaatcctgaggatgagacacagaaatgtgagaatttgaggtcttcactctggggagttaaccgtggttaactcgtgtgatctgccctcagttacagactagggcgttggaattactgagaatagacaaatagagcaagctccagagagaaggggatggaggcagtgctgctgaaggtggatggcggtcaggtgtccagaagcaggaagctgggtctgtcccctgggtttctgttag

SEQ ID NO: 20720 - DNA, 1896 bp, Mus musculus
tgcattcttacatattacttgtagccgtggcagttagcttctttgcattttctttttctctgcagtggaatgtgcgtgcaagacgagtcacgaacccagacattaacttgtttgttgctctgtcttcagaactacagtggactcgtgagaccaaagctggcattaaaaatagaaggcatatgtaaaaggaaatctatgtctgtgtatgtgtgtgtgtgcatctctatgggtacatgtacgtgtggattggattcccctggagctgacgttaccagccattgtgttggttgatgtgggtgctgggaactaaacacaggtcctctggggaggggggggatctgtaagtgctcttaactactaagctatctcttgatcctattttattttatttttatggtgtttttgagacaggatcttatgtatgccaggctgacctcaaacttgttatgtagttgaggatgaccttgaacttgcaaccctatgacctccgtctcccaagtgctgggatgctatgggtacatcatcacacctggtttttatgtggtgctgagaattgaacccagggctttatgcatattagacaatcaatcactctacccgctgggctgcactgccagttccactcttacccactgggctaaccagaggtgtgtccagcttacccatatacttgtttgtttccctaagagtagtactgaggtagtttagggttcaaagtcctctggtaagcagtgagtgtagaggctttctgttctcattgtgaacagactcatgctgaccacttgaattctgcctctgaacttgggtggggcactcctcttatggacccattagtacattgctgattcaagaggcctatacaaaatatcacctttctgaggtgatttctcttgggttgcaccacccccacccccctccgaatctcagagcctgcatccagaaagccatgtcattgtctgctgtgccagtctttgtacccttcgctctaagatggcggtcatccagagctttctgctatctcctttaccaccttcagaactggacatatttggaagttatagtgtctttattatctacatgatatccacgttatctgtatcatctacctctcagatcacacttagaatgatacacaatgactccttaagagggcctatccaaaagtttgatgaggtagtccatccatcgaaaagaatgtgttttgttttgttttgttttgtttcacctgggaaaacaaaacccgacttcaagaaccttcagaacacagctctcttttcacgggaagcatctcaccaccgaatccagagacgaccatttccctgaggctttgctcttgacagctatgcaaatatcagcctcccacagcaggatctgtggagacagggcattagttgatggttgtctttgcagttcctgatccagacttcacttttcaggcaaaactcccatggaaacatcttcctattcaaaatgaggaggagtctggtttaaaaagatacggaaatcaaggtcaaggactttgtggtggggaagttttgttttgttttgttttgttttgttttgtttgtgtctgaatgcaaatgtgctgatggaatttgtatatttcaggcattggagagatggctcaatgggaagagtgcatgatgttctcaacagccacatgggaaggctcccgactgcctctaactccccttccggggaatcgcatgctcttttctggactcctctggccctggcatgcatgtggtgcatacaacttatgcaaataaatacacacacgggttttttttttcctttttaaaaaagaaatctttaaaagaatttacatacacacagcctactattgggactctcagaaatttgtgaccataggcatcttcatgtgaacttggcagg

SEQ ID NO: 20721 - DNA, 1217 bp, Mus musculus
ttctgagttccatccattttcctatacatttcattttttcactatggctgacccaaattccattcatatgagtaccacagttcattatctcttcaccagttgatggctgactccatgtccttactactgtgatcatagcagtgttaagcatggatgggcaggtacctctgtagaaggatgcagagtcctttgccaacccttatgctttaaaaaggagcaaccggacaagtcattcagttcccttaggaaatgcttatcagcacccgtccttacatcctgtgcactttacgggagacacatttcatttgtaaccatgattgtttctttccctatgtcacaagtcaactttatttgcaaaccaccgtgtgtattctgaaggaagctcttggggtcaaagcaaatatgacttgatgcaagattgagatcacgtggacgactgttcttggtacccccccccaaaaaaaaattatgaaagaagatactagagagatgtccgcctctgcctcagaactcccaattccagcccccttaaacttcatgtgtggaacgtttagaagatgaggccatgccgggcatccccctgtagacgccatctgtgctgcctgtgccctctgcttctgaccgtcctgggctagaatcgtttttctctctgtgggttctaggatctttttctttacaaaggaggcaggctgagtcgcagaatatggaattcattcagacttttgtgcaggaagggcctcctggaaccttccaaagcctttgaggtgagtgttagatttaagtcctggccctccattttcatttatgatatacaagagtgaaggagctgtggaggtaggcttcaccttgtgttttccttgatggagacagacagggctgattttttttcccccacactagaaacatcccttatcactccatggtgaaaggaaggtgggatatcaagtaatggcttctgtagagccttggaattgtgtgttccaaacgcccattttgttgttcagctactatgctttgcctctcgtctgaggtggactcatattcttatgttagctgagctttcttctcatccaagttgaacagggtggttaggtttttttgtttttgttttttgtttgtttgtttttgttttgctttagtttaacagcttgttgaaactggcaataatatctcaaaatcaaggcaatcagtagttcatgtgtagaacttcaggtaga

SEQ ID NO: 20722 - DNA, 1187 bp, Mus musculus
gggcggatgacaccagacctagagattatatatgctcgaagttccccctgttttccaattaacaattcagccaagagcaaggggtgtgaacacttggggtttgtactgtgcactgactggcaaactcgttagagtgatttggaaactgaagagctgaaaactaatagatcctctcagggtctgtgagtaactggactgatttgtctttaactgtagtctatgtacctaaaactaaatcgtgtgtgtggttgtgtgtgtgtgcgtgtgcgcatgcgtgcttgtgcgtgctcgagagtgcacagatatattcaggactctaaataaaaagctgaaatgcagggttgtgctttcgattttgtgcagtaaatgaggcagggagacagagaagctcccgggagggactggcagaagcggccgagttccctgggtttcagtgccaagtggtcctgtggttagaggggagtcaggttgttaggcctggtgacaggccactcctcactccagggctcctctgggggcctttgctctagctttcaggatgactcatgattcagtgctccaaggatatgatggagaacctaagaagacggtgtgtgtgtgtgtgtgtgtgtgtgtgtgtgtgtgtgcacatgagcacatgcatcacatgcatgttctggtctacatgtgtatgtacatgtatgtggaaggtataggagtgagctttgggaccaggtgtagagaagacatagacattgggtggatgcctcctgtgttctagaccctgagctaaattccacaacctcaattactactccaggcaagtcatattatacccaaattataagcaggggaaggggctttttaagggttgtctgggtggaaacagagccagaggacaactcaggatgacacactcaaagcagacattcaccggtctttagtccccctctgcattaattattttcctcatggcagtaactaaaatccctcagcttgttttgctcccaattgggaggctacagtgcatcatctctgggaaggcatggcagctgtgatggatgtggtccaagctggatgaaccttgcagctgctcacatcatggtggtagatgggaagcagagggctcaggctggaagcagaggcaggttatagcccccagcatcagctcatagtgtcctatccggggagggacatgccacatcgaa

SEQ ID NO: 20723 - DNA, 2551 bp, Mus musculus
agtgtgtgtatgtgtgtgtgtgtgtgtgtgtgtgtgtgtgtgtgtgtgtgtgttcatggaggttaaaagtcaaatccctggaactataatcataggctgttgtgagcctactgatgggggtgataggaaccgaattcctaactgctgagccatctcccagtcctcctgccctctcctatttgtttgttcaagcctgggactggagagctctggtcaaatgatttccctgtgctgcagccccgaccgggaaccacagaagaccgtgagagcaggctaaggagggcgtggcttgggatcaagagggagcgttcgcttggtgtatggtacccagccatcagtgctgccactgttggtagaatgctctccgttgtggttggggtcatcagcctaaggtcagctaagtctcaccatcttcctctccttccttcctagtggcaacgggaagctggcatcctgggcctccatcctgggatttgtggtgatgatgtcccttgatgtgggcctcggctagctctgacaaaccgtgggactccgtgaaggaaagcaccaggcttctgtaggaccatgagcctctcattacaacccggttcctttctcccctccgtctccttaccccaaatcagctctgatcacattttgactcttcgttttgctttggagggagacgctggttttctttgtaatctcaaggtgtcatagaactgtagatttgtgtgtggaccactgagtggaaggcatctttcttcagtgggattgtcgaggctaacccctacttgtcccacctccagtctccctcactagactcaacttcaacacctcagggtcacctccagaagtcagctcctgggctagaagtcctgagcatgttggcctgaggttttggagcaggctgccagggccccttgtgctccttctccatagaccctctgtccacctagaattctgggacagaagccacatgaacccagaagcctgctttctgaggctgagccagctcaaacagggtctgcttcctctagggaggcgtgcgcgggaggcatgcgcgggaggcatgcgcgggaggacccacacaccaagggaaggaaggcagcttgtctctctcctttgtcctaagacaaggattgacattgctgatgttagagcaatatggaaatgagggtgaccctgaacacgcagcgctctttgaagagtactgtaagcaggttttaagctgagcttccccctgtcccccgggctctttgtagatgacaagagcaggcactttgtagtggctcccagatctcctagctattaatcttgatgtgtttacagcctttgtttttctgagagacttgtggataccagcaaatggcaaatagtcaatcccctcattgactaacagggttacttcagtcaactctagggaatgatattcagggcctaacaaggctccttctctgctggccacttggaaacttattacccagagcccctcagcttcagcgggctttgtgggaatctggccagcgggcttctaatgggaaaggaagggggctggggtaagaagaggtatttttacattccctttcttaaaaaaacttaaacttctgagatgactggacctagactacatgctaacctaccccatcatacatgtagctccgccatcagctctcccaatgcatctgagccctccatggctgagaagcatgtgggactcagagaacagactctaccccagagcctggcatttgggtactgactgggctatcagtatcttgcctctgtgtttacatgttccgtctctccaaggatggatattgtagtctgtgaatgctcaagaccccagaggccaacctcggcggggtgtgtccattcttctgacgcactggtgatcaaaggcttcaatcacacattgaagccatattcagagatttgattatctggtgaggttagctggtgtggtgattggcacgtgcgtatatatttttattcttaggtctccatgtgtagttctgttgctgcaaatcatgctttctgccggataagacctcgtgactgtgattaatgtcaataaagggaattttgttgcgcatgagctgtgttccgtgcgatcttcaacaccagcgctttctagagctgctgaggcccgtctcccacacaacgccagcaggagtgaaagaggtgctcacagcaggatgagtggtcagcttccaggctgcaaaaagccacatccaactccagcttagttaaacaaaggtgactgatggatagatgttaagaaacgtggaggatctagtggagagtcaggcttgaaaatgaggtgaatctaagacagagatccaggctgtagcccagtggtatttggaaagcagttaactccattagatgccatggcctctggtgatggtgactaaatattgggcagctcttctgaaactctctcccttatccctcccaacagcatcaggagaattaggtattgcccccatccttccggttctgattccttcttcaaggtcagggttaggagagatagtcacccaacagaggtttgcatatacatacagat

SEQ ID NO: 20724 - DNA, 1157 bp, Mus musculus
gtcttaactactgagccacctctccagtccttcctttatgtttggagggtgtcagtttcaagttaataaaattgacaactgacccaagaagatagttcttgcaccatacacacttaggagacgcaccgagctcggtctctgctgctgggtcaggtggctgtctgtcagttgtcacttaaggcgccagcctttgtttgtcaaaacctcccagtagagaagacgaatcgacccctgtatccttgtctgtctagtctgtcacccttagttgcaaatagcaagctaggtcagaggcgcagtgtatccacagagaggtcgtgccgttccagcaaatcctttgggatccctggctaggagatggctcagtgggtgaaaaacacttgctacatacacagtatgaggacccaagctcagctagcacccatgtgaaaaagccaagtttggtcatgcgtagtcctgcaacttgagcactatggggaacagagatgggaggataacatctgctggccactaggttcagctcaaggttcagtgagagaccctctcttaagggaataagaaagaggacgatagaagagacacccagcatcttcctctggcatgtgtgtgtgtgtgtgtgtatctctgtgtatgtatgtgtgtgtgtgtgtcccatacaatacacatgcctaataataaattagcttaggaaatggtgagctgctgtgcctccgtgttttgtaaacaatataaataaaaacgggaaagaggcaaagcttggtaaaggatgctgggcttgctgggaacagactgaggagaccaaggctcaaagtccccgtgtgtgcagacacacagatgatccacgaagctcgtgctaacatcccaccacctcctgcttgtaagccaatggatggtgtgtctgcacacaccgggactttgaggcacagcagctcaccatttcccaaactaaaaaatgagaagttgttgattcacaaaaagagtccaaggatcctggcttcgggcgcagtttgctccaggggcttaacgtacatctttgagcttctgcctatttttctttctcagttctgccttcatcagtttaggcttttattaccaggttctgtgtcctggagcagtggcctcccaggaacaatcccaggttcatgaccaacaaaaatagg

SEQ ID NO: 20725 - DNA, 1195 bp, Mus musculus
tatccatcttccccggcagctggtgtgcagatacttcagggaaggaagctattgtcttccaggacagaccactgaagcggccctcctgtagggagggtggtctgcattcccatagattctgcgtggcaagctgaggtagctttgggacatcagtgcctgtgtagtactgaataagatcatgtgtcaccagtctgtttctaatgattgcttggtgggggctgctgacccaaggcagaggtgtggccattctttagcaagtaagggcatttaagttctgtccaccagattcccaaactcacaaagctaacatttcctgagctccttccacgtggagaccttgtgtctggacacaggacaccttgtatcccatctttgccttccagccttttgtgtgagagaagatgatatactcactttgcagatgtaaaatgtaggttggactgctcagggcagatgtaggttttgaccccaaacagcccaactacggagcctgtgcctctaaccactacccttctttgcctttcaagataacacatctgttgtaacctaaagacttagaaagagtcctccaaagtggtagggaactggggtcagcttccgtgggggcagtatgtcaacccccatcatgagtactttggatgtcctctgttgaaatcccggctcaactgtcaagagcatcttctatctccctggggaggccgggagacaacaatgtacaaaaatcacgtcagtgagaatcagtctacgcggccagtcctacaggaagcagatgctaatgttgaggaaggctttgagtgtgtctataggtgcttgccgctatggtgagaaccatagcccttaatggctcccctgagtggtgggtaaggaagaatatacagaacagagggaggaagaggaggtgaaaggaggaagggaaggatagagaaagggaggaagggagtgggagcaagggaagggacaccccagagaggtgggaccaagatgatctggtggcacctaagtcgtgaactgcttgcctggacccacctagtgggagaggtggacagatgggcaaggtcactgagaaagacagagatacagagcaggggtcacttgtcctagaaagttccagaatggaggtgattgggggtgggggtgatgtcttaactgccagcgctgcggaggttcttccatggcagtgggccctgcctcattc

SEQ ID NO: 20726 - DNA, 1216 bp, Mus musculus
ccctcacttcaaggtacacataactcgaaccagaagggagagcgagtgaagcaatcttatgcttagacgttgtgctttgcaccccgtttccagctttggcgagggggtgtttatagcctggaccgatggctccgaccggtgtccggctgcagggctgtgcagaacgggcagtgctggctgcagatcggacaacccacaaacgggcctcccctggttccctgcacttcgtgctgcatgccccggccggctgctggtgcccagtgttcagacacttaatcaaggatgtctgctgggttaaccaccactttcagaccaagtctgtgcctgttccaagtctgcatctgatagcagatcaaagagtagagaccataaacgacatacatctttcgagctataaaacacaggcgttgctatatgaccaatcatgggatgtgggggtcagaacacactcgtggagtagcgatggctttgttttcctgtctcaccgagcttctgaggagcagcctgtgatagctgctcccagcaagaatccacagagtgcgtgcttgcctctatgggcaccaagttcacctgccttttagggacattccagggagaccctccctgtccccgggttgttgctgtggagctccccctgccctctgtcttagcctctctggaaaccttctctaggctgaggtatagctggtgagttagcaagagggtgtgcaggcaaaagtgcgatgccttttaccctgccggcccctctcctcaccacagcccttcactcgactcccctgctgcaggcctttatctgcacccaaagatcttgtcctccgtttcacctaagcgagccagcctttctcccatgtagctgtcctctagggagatctagagtggtccacccacaatcctcttcccacagttttcccttccaggccactggcattggagaacggcccacagcgccaccatgtggtagtctggcttcaagactcactatgaggcaatgggggagaaaggcttcaaaaaggccagtgaggtgcgtctctgagttgcctcacctcgagaggcttaaatagaacttctctaaattggtgttgggctacatttactctctccataaagctaaagtctatctgtctattaatcttttctatctttatcttctatttatctccttctgtaggagttggtaaacattccctagatgttttgcaaaagtcgtgtttatctc

SEQ ID NO: 20727 - DNA, 1147 bp, Mus musculus
ggcagtgtgagtcagctcctccttaagaacggaacaggcaaagctcagtcgtcggcatggtgaggagttatctcgctttcaaataagcagacggacaggttggctctagcctcccacctcaccccgctcctctttctgcccccttggtccagggctggtaaagcagctcttggtacgacatgctctgtgccatggtgagggacagattaaaagagctggtggaagtcttttaagaattctgcctggcagttggggggtggtgcacacctttaatcctggcacttaggaggcagaggcaggtggatctttgtgagtttgaggccagcctggtctacagagttccaggacagccaaggctacacagagaaaccctgtcttgaaaatcaaccataaaaccaaataacaacaacaacaaagagaattcggcatggcaagacttgggatctatcagttggtagaatgcttgcaagttcaagtctgacccaaactgcacgagcccttctctctctctctctctctctctctctctctctctaatcatgctgagctctggcatctttctgttcactctgttcccattgttcccattgttcagcggagtgaatggcagacactggcactgtgcagaggaaaacacttggctcatgaatcaggttgtaaagatctagagggaaggttcactactgtctctctgccacaggcactcatggttgtttctcagttttacgaggctgctggcctagaccaaactgctgtgcccaaacagcaggatcaaacacaaatggggaaaaagtcaaggagatgattccttgtgatattctgctgtgctcatagactggtgtcttagccctaagtcaccagagaggcttcatccagcagctgatggaaacagacgcagagacccacagccacacattaggcggagcttggggaatcctgcacatgagagggaggaggagttataggggtcaaggacaccacaagaagccccacagaatcaactaaactggaccctcggggactcaatcctttgagtctggcccctttctgaagagaaatggaagaggaatggataggggaggggctgacagggaagggactgggaggagatgaaggaacgttccttttacctttgaccttacacaca

SEQ ID NO: 20728 - DNA, 1214 bp, Mus musculus
gttcttccaggccgctcgccccaccactcacggtggcctccccccatgtccttttctctcatttgttcatgcgaactcttgcccattggacaagcaagtcctaacagctttgttgcctttccaacttggtgagtggacaggggccactctgaattggatggggctgagtcaggttagaaaggatgcgctttggtcccgcccccttcatctcccatccctgatgagccccgaggagtaccctcttggttggtgtgactattgactttctgattcatctggggaaacagtgcatgcatatgtctctcgtgttgtttgtgtggagccggaagactttaaagacgacagtggcatcttttctgctgatttggggcctctacaaaggagtcagctaacacttgttaaatctcagaggggtccagtctgtgcttgcagccagagctcagtagtcttccttcagattctactctgaacacattaaccaggaaaagccttggcagtcttctctctggttgatcctctctgcctcccacaacttcccagctgaaatgtaagcaggaaatacaattcatctaataggaccttaagctagagagggtcagacatcacagctgccctctgccgcctgtaatgcatctcgttcgtactcagcctatgccagccaaggctttgcgtctgttctctcacaggactgtaggcaagggctatcttccatcaaacttgtcatttttttcatgccaagtcccgacagcacaggtatacgggtctctttggggattctcactagcaattctctttgctcaactcatgtgcggatgttacagccctaactcagagtgggtgtggggtgcaaaagttggcctggctctgctgccttgtcttttaagccaaaggagttgggggtttcaggggtggtttgtagcggtggctgtcaatcaaacaaggtaaaaactggcaaacatacacacacacacacacacacacacacacacaccccgggatatggatgtatgagctgtggaagccagaggacagcctttgctgtctgtctgtcattccttaggaacggtttacctctttacttacttgttttgagggtgatcctcttactgaaccggaacttgccaagtagactgggcaggctggccagagaaccctagaatctggcctctctctcagtctccccgaattgggattgcaagcacataccaccatgt

SEQ ID NO: 20729 - DNA, 1178 bp, Mus musculus
gtgcacttaagataggggcatcctcctattcctcatgggagctgggacagggctggcttgcccatagtctgcagctctctctccagtcaggtggctgatgcttcacagaacctgccttgctatatctcactgctcatcggatctcagattgattgggccaaggagtcagagtcgcagggagttggagggaaaaggcagtgtcagggaaaaaacagacagcgaggttttgggacagagatgaggtttggctagtttgtactggggggggaggacccagttaaagccagtgtgataagtcattctctctcacatgcagccttggggatgccttaggttggatagaggagaaacactggacctctgatcacagccagcatctcagagtcctctggaaattccctattcccaacacacaggtgaaaagagggagagttgccgctcccttgatgtgtatgggggtggggtgttgagaacttaatacacaaatcataaaatcataaggttggcaagagtcgtgtgggcctgtgggttcctgtttcttcctgttgaagggcatggggctgagcatgtgtgttttgttatatacacatgtgaccccttgtgaggtgagagaaggccctgagaccaagttaagctggttaccctctggcagcctccctgcccccgtctctgcagcagattcctttgctagtagccatccccatcctcccaggcttcctctctttacgactgggcagtgctccctgtatcccctggaccgggccagctttaaccaaagggctggacttgctgctcactctgaatgcgggaaaaggccctcgtgcatgcccacacctgtgccagcaacagggctgacatgctgggaggattccagttttctctgaacgtaaacctacaaggagaagcagcaggtcgaataccactggagaagctgtgaacagagcagcccagcatccggtggctaagataagcatcctttagagctgaagatctgcctccatagcacaagggctcgcctggtggtcgtgcactctgggtcgcttggctacaaggttttaatcagcggcttgttctctgctgatcatcagcaaagtgagatcaggcatgtgttcccataagtggttgtagacagtggaaatgtaggtgcatttccacacacattgacacttgcatatgtg

SEQ ID NO: 20730 - DNA, 1172 bp, Mus musculus
ctccctggttgctttccactttcccaaagtggtgttgcagttttcttgcttaacatcattttttttcttcatttgcttttcacttctgtcttagttagggttttactgctgtgaacagacaccatgaccaaggcaactcttataaggacaacatttaattggggctggcttacaggttcagaggttcagttcagtatcatcaaggcaggaacatggcagtatgtagtcagagatgagagttctacatcttcatctgaagactacttgtggaagactgacttccaggcagctagagtgagggtcttaaagcccacacccacagtgacacacctcctccaacagggccacacctcctaatagtgctactccctgagccaaccatatacaaaccatcacatctttgaacaaatttttccctcactgtcattttagagtagtgccatgctctgagtgcaaatggccctcttcagctcaagtgtttgaatgcttgtttctgaagttggtggaactgtttggcaaggattaggaggtgtgggcttgttggaggacgtgtgtcactgggggtggctttgacatttgaaaagcccactctaggcgcatctcttgctctctgcttgctgcctgtggatcagctgttgctccagtgccatgcctgtctgcctcccatcatgatgatcatggactatgtaaccctccaaaactgtaagtgagccctcaattgcatgctttcttttataagagttgccttgttcatagggtctcttaatagcagtagaatagtcactaagatgtggattacctgatgtattttatataatattttattttagtgtttatatgtgtggttaaggtcactgtgggtatgcagtacctgaggagaccagaagagggcgttggatcccctggaaatggaattacaggcagttgtgaagtgcctgatgtgggagctgggaacttgaactgaggtcttctggaagagcagcaagtgctgttagccattgaacaatctcttccggcccttcatcttctgtagttaaacagacatcttaacaggtagtctgcatttgggtgctgtttgattttgttaatttgtatgtggatatattttttaaagattggtttacttttcttttgtgtatgagtaccggcagcggtcagaagagggtatcgga

SEQ ID NO: 20731 - DNA, 1223 bp, Mus musculus
ggcccagagataccactcctgggcatgtactcaaaggactttgtgtcccaccacagagacacttacacatttgtgtctatcgttgttcttttcatagtagccaggaagtggagttctcttaggtgactgtcaagagatgagtggatatgaaagcgtggcacacacagtggagttttgttcagctattacaaagaagactcccactcgggcatctcattttaagccccagcaaagcctttctgcaggagactggctgataggaccctgtcttttcttttccttgcagtcttcaagcagcgacagtggtgggagcagcagcagcagcagcatcaacagcccagacagggccagtgggccagagagcagcctgagccacaccatccccggatcctgccccagcaccccccagccgatgcctgagcagtctgcactatgccaaggcccttacttccacatcaaccagaccctgaaggaggctcactttcatagcctacagcaccgaggccggccgccgacatgatgctcctccggcagtttcttgccttctgtgaagggacagcactgtgcagattggatatttcaacttaatgatttgtttttaaaagttgcacacagaaaaaaaaaaaaaatgcctgtcggctttccgtctgtatttgagtgtgagtgccgggtcagcaggtgctgcttactcggggttttgctgcactgttgcgatttcggaggggcttgggagcagttttttagaggattcttttagaggattcttttaagagagggcatcagatctacgtcgtggcagtgtatgaggaagtctcatctgaccgatttccacatctgtcaactagatgctgtactgtatgtaaagagcctcttaaaaatgcgggatcttaattttttttaattcaataaactagtaaagaatatctagtttccatggggaaaaacccctgtaagttttctccctaaatataggaagcttgactctgttgcactgaagctaactgccgtcctacctcttagtatgtagatgtctgtctatgggatgctctcccttggaacagaacagccgtccactcggaagaccagggacgttaagcacatttcctagttgtggtctttattttacatttgaatttccagggagaatatcacttccatatcttattttcttctagtctgtaccccagacgctatagagaacattgcgcagtgctcaagtcaag

SEQ ID NO: 20732 - DNA, 1184 bp, Mus musculus
ctagatgttaagtcttttggttttgtgttgctttgtttttttgtttgggttgttaatgctttttattttattaattttttttttgagatggtctcactatgtgtagctctggctgtactggaactcactatgtagataaaactgcatagtgaacttgaggccagcctgggcctatcttaagcagagcaaacaaaagttaaaaatccatgctgttgacggttactctgtgttgctcatcggctcccacctttaccttccaggaagagcatgggtgcagccgagccccggatggaagtgtgtccttattgtaagaagccgtttaagcgtttaaaatcccacttgccgcactgtaaaatgagaggaccgtccatatctgctgatcaaaatgtttctcagtccaagccagctgcacttgctcaaaaagagaagagtcctaccagagacttgaccagagctaaagagaaggagctagaggtagaccgtccgaaaagagctgtgaaagcagaaaccagcagggcatcgtggacagctgcagcctctccgcttccagaggggatcttgggaagcgtgcggataacaaaagcagaaggagaaaacaaagatcaaaatcagttctccttccaagcactcagccaggccaagccagaggtgactctgcagagagtcacaaccccttggtctcctgcgtcagatgccacctctcctaagagagaactcacccaagatgtgtctgagtccaagggaagtccgtgtccctcagagacagaagcgccttcactggtcagctcagtggaaccttttcttgctaatcaagatagaaaatattcatcaacccagcctcatgctaacccagccacttctgtcgggctcaagttaggcacagttgacccccaaagacagaagcttcgggtaaaattattagatgtgcctcttagtgatcgtcattctccaaagagtggcagccacggggttcagagagtaacaccctcagtgttgagcagggaggaaggttcccaagatggaggccacctcttgggagtctctgcccaccctggtaacaccaagacccagaagtcagaatcactcctcctgggccttcacactggcctgctgggtaaagcaccggtcagagagcatcaggaacttggccttggcatggagttgagccagagcaagggaaatac

SEQ ID NO: 20733 - DNA, 1146 bp, Mus musculus
ttgaaggttagactgggacaggctgctaatccagatagcagttgactgtctagactggagagaggcatagcaggaattcagtgggtaagtcacacgtgctggtgcgtgcctaggcaggtggatctttgagttcagggccagcctggtctacagagcaagtttcaggataaccaatgctacatagtcttgggagaaaggaagaaaggaaggaaagaaatccaacgggtagggctctaagggatgagtggcaggctgggaagcaaggcctgtgggtgcaaagagtatgtcctcagctcagattacctctgtgtaaggtcctctgaagttgtacctggaagtgagcccaccttggccaactagagagaagcaaagtcagggtgccgcagggactctggtccaaaggtggcagttttctggaggctacaccttgtgttttgaggtgagctatgggctttatggtttgtcttttaaaaacaaacaaaaaaaccaacttaatttcaagtatgtctattagggtataaacattggagacagacgtagactgtgccgtgcctgtggaggccggaagagggcatcaggtccttggtgccggcgttagaggtgtttgaaagctgatggatgtaggtgctggggactgaacccaggtcttctggaagagcggtcagtgtacagtcttccctactgcagctagctctccactatttgttttgaagagactttgaccttgcatgagtgtggactgtggaattcgttagaagccagtggggttttgggggtttttttggttggttggtttttaagatttttgttttattgtattttcaagatagggtttctcagtgcagccagccctggctgtcctcgacttgctttgaagaccaggctggccttgagctcacagagattgccctgcctcagcctcccaagtgctgggattaaaggtgtgtgctaccatgcctggctaggagggctgtcggtttgtttgtttaatgtaaatgggagttcttgtgcagtgtgcaccaaagcaggcagtagcccatggaaaccagaaaggggtccaatccccaggaaccacggttttaaaatagtcgtaagccaccacatgagttttgggaaccaaacctgaggccgctgcaagagtaccgc

SEQ ID NO: 20734 - DNA, 2194 bp, Mus musculus
taccgtgacaaggaaggccccagcagcattgtccaggcgccccctgtgctggaggtggttcctcctctagggagacaggaaagcaaggccagctgggaccaggcctctatgctgcccccccacgctgtggaggatgacggatgggcggtggtagcccccagccccagctcagcacgcagtgtgggcagccacaccactcgggacagcagctccctgtccagctacacctcaggcgtccttgaggagcgcagcccagctttcagaggcccagacagggtggcggctgctcccccaaggcagccagacaaggaattctgcttcatggatgaggaggaggaagatgagatccgagtttgaggctggaccgaaagttgaaagtcgcctccacatctctgggctgcatcttttccctgctgctgctgccgctgccaccttctctatgacctttgaccttactctgtaggtgcagctaagagcctcgttggagtagaccctggacctcagggattggggtgccagggaagtaaagtagcaggggcactggtgcctggtggcctgactctgacctaaccttccttaccacaccagcctgggacggatccgagccccagcgggaagccattctcttccaggccctttgctcccagcctggcctcagatggatgccagatgttagtttgagttgctgccgcaatggcagggaagccaggtgtgggcttctctccaaggtcatggacacttggctcccttctgttcaccttgtgtctggagcctacccaggagatatatgcagcaggaggcaggggtgctcacgtgtttgagctcctccttcttccacctctggctcctcactgaagcctggtattctttggggttcagctgaagccaggggacggcctcaactattacactaaatgcagcctgtcccagaggctgcatcccaggacaggatggggcacagaaggaacgaacaccccctgcttctagcttcttgggctctcaagacactaggaacaggaaaggggccagctctgcccatgggtgtgtttgttccttgttactatgttttaaacctgaatagagcactgccaaaatcccctgccaggagactagtgaccgtcttggtggctgagtgactgttatctcacctgaatctggtgtacagaccctgcccaggttggactgtggcggggcagccaccaccagtgtttgtcccggaacccccacctccatagctgttagtggctgaaggagggctgtgtaggaaaagttctggaatacgatgcttaaatgatacattattccccggggtgtgagctacgctttggctagttagtggcctctccttgggctctgggccaggcctcgcaaaaacacaaaacaagacgggactgtatttgattggaattccagggaaatgaaagtgggttttttgtttgtttgtttttggctttttgggatacggtctcactctagcccaagccggcctcaagctcatagcgagcctcccttaccctaggagcttcggttgcaagtgtgcaccactgctcctggctgttttgttcttctgaaagctgttttgctcagctcctgtaactctacccagaccgctagtagaggcaggggcctgagccctgggggtggtagctcattactttcctgtgctgggagcaggctgacctgctccctggtctagcacagccagtgggaatctggggagagagcaagctagattacaagcagagtctggccagatggtggccagccatgggctgctgtgcttccagaggccaccctcctagattcagaccctgaagtgctcactgggcccctgacaggtgctcctacgcaggtaggcagtgactgagctacagagctgtgcctctggccagcagtacacacacaacacacacacacccctctcctaaatctacctggttggttctaaactctaaactttatatttttttccatgacattgaaaaagcagtaagaaaacattaaaatttcctcctaacacttctagtgtctgactcttcttcctggggtcctatttcagggcagggtgtgtgtgtggtgagtgtcttaggattggagggggctggtgatcgtcttagttctggcaaacacaggagcttggagcagctggttgcatccaatccacagtcaagaagagcgaacagtggatgctggg

SEQ ID NO: 20735 - DNA, 1234 bp, Mus musculus
gccttgtcaccccccttccctgcctcggcatcccccaagggctcatggccctcgtacaacttcttcaccaagcatttggcttattttggaagaaaaaagaaaaatcaaatggtaagaatcaatccacttagcaacttccttgttcctacaaaacaatttttttttttttaattataagttcaaagaagagggcctaagggttgggagagaaagaatccctccacagccacataactgagcctcctgttgcttagattcacctcccagaatgctgataaggaaaggtaacatctggggagtggagacccaaggtgctggctccacgctaagggatgcttcagggagatgtcctgcaggaagtcagagacgcaagaataaagccttgactgttccttctgacccaccagcccaacactaagagaaaggaaacaaagggttgggggcggtgcctaggataggaaactcagcgcacccagcctcgcaggaggaaggttgtatgtatgttcagattatcactttcctatgaatgtacaccttcctgctagcccatgcagctgccccatgaactcggaggaaaaggggtccaggggctcctcttaagaggatatcctggaactcttcttgcccaacaactttctcactttaagacctgtgtagccccgccctctgtctctaccacaacatacaggggcccagaggggcggtccagtccctggtcctgaggctttataaagaatcaaaggtcataaggttgtgggtcccgtgtctgctctaccacagggcatgaccgcttggggaagcagaacgcagggagactgcactcatcccacgccatcatcgcagggcgggtgctgggatgcagggaagtcccgggacacccctagcggggagggggagaagaagtgcagtctgaggagtggggcagccggtctctggggcttctagccttagttcaaccgaggaccacgctacctttcacggtccacttccccacaaaaggtcacttcaactccccctaacagctcccaggcggggttcagtgaaggcagggctgggaaggaccaaagaagggccagctgggaagccttgtccaaactgcacacagcaattgagatgcgtggtcagcccagccaggagaggcgggtcagatagcatcaagggacaagaatagctgatggaaggaaagctgttcctcccaggaaagttctgtaaataaccatgggggacctgagct

SEQ ID NO: 20736 - DNA, 1212 bp, Mus musculus
gcataggctgacatctctcaagttgttttcacacggggagcccaaagttctgaaaatgagccctcacaggaaaatcagtggagtcctctgaagattctcaggggccccttagcatgtcagcaacctctccaaccctgaagaaggtagccacactgccccaaaagttagcttatccaagggacagagcactatgtccagagtgtgatcagacaggaccgatcccctgggaccccagatgagggggggtctcatagtctctgaagtcctcaaaataaaaacagagacatgcacactcaaacacacaaacacgggtacaatacacatcacatacacacacacacataaacacacacacattacctgcctggtcccatacctcaaacctgccccttacgccctgagctcgtcatccggaacctttaccagctagctgagtctggtacaagagacaagaaaacgagcaaagggctttttttccactttgagatttcagcttttgtctctacaattggccctccttctgggtccctcccccactcctgtccccaagcctggcgtctgccctccctcccgctccttcgaccgagtaattgctgattgagtggctttgaggagctgttaagaggccagggaactgaagcagtcgcttgccggcctggcaggatggtccctgaaagccccctttgtgcttgcccgctcccgggacaccgcattcagttactgagagagggttgaaagctacaatcggagcccctggctcccctcgcactctttcttctcaccccacccccaccctgaaaagaaacagatgttcggggaggtggaggcggtaactgccctgttagtctgggggaaagacacccccccccttcctccttgaccccagggagctggaggagggactagctaacagctcagaccccacctcagcacccccaacccccacttccagccttcccatctgtcagggctgtcttcccagagggccaggcatccagtgggcgctcaggagatagcagctgctggtctgaggtagtatagataaacaggctttgagatttgggcctggaagagccagagtggacccagcacaacccccaaatcagacgccacccactgttgcctagcaagggaggctgttccgttccagtgacgtcacggaggcactgtccaatccctggccccttgtgatctctcccactgaaactctgt

SEQ ID NO: 20737 - DNA, 1187 bp, Mus musculus
aaaaaaatcaaaagacttttgagagacaggacctcactaaactgctcagactgctcttgaacttgcttggtagcccagcttggcctcagccttgtgattttcctacagatcattgtgagtccttggtgggacaacagtggatgcaaaatccatggtactgacagagcaaggcagaagccacaaggactccaccatagtccacggcactgacatggcaaagcagaagccaagagaggattcttttataatccaagcaaggcggaagccggaaggtcagctcccagccaccatgatggagtggagctggttctggcttcagtgttgaaacatccaagttcattttctaactcgtatttcagagtgattcttgggtctaattccatctgggtagtgtctgcaactatctcctccctgtttcccttgtgtggttatgtgtaaagtccattcctccgtttgctgcataggaaggtgcttgtcttgagagaaatgcccaggtatgacttcttgttggtatttatctcccctcctccacccctgccactacttcagctggggcaggtattgtgagcagggttgtgatggtttgtatgtgcttggcccagagagtggcactactgggaggtgtagccttgttggagtaggtgtgtcactgtgggtgtgggcttaagaccttcatcctagctgcctggaagtgagtttcctcatagcagccttcagatgaagatggagaactctcagctcctcctgcactatgcctacctggatgctgccatgctcttgccttgatgataatggactgaatctctgaacctataatccagccccaattaaatgttctccttctaagagttgccttgggggctggtgagatggctcagcgagtaagagcactgactactcttccaaaggtcctgagttcaaatcccagcaaccacatggtggcttacaaccatccgtaatgagatctgatgccctcttctggaatgtctgaagacagctacagtgtacttacatataataaataaataaatcttaaaaaaaaaaaaagagttgccttggtcatggtgtctgttcacagcattaaaaccctaattaagacaaggaccaaagcccaaatatcacaacaatgttgagcaccagtgttcttatatgccgtgacaatatttgatgaattcacatgtgcctag

SEQ ID NO: 20738 - DNA, 1304 bp, Mus musculus
ttataaacatcagataatgagcggaagtagacctaggtgggcaggaagagcctttgcaaggtccttaggtgtactctgtcacgtcagacaggctgttgcctctgatgtggttgtctgtgggccggcggccaccggcctggcgaatgtctcctgctggtgggcacagtggggtttgctggtgttttccatccggcctgtaacatttggcactgccttctcaagtctcagctcggccacgggccacagttcttttctcctgtttaactttaagagtgtggaatcagaggtcatgcctccagattgctgaggtcaacctagcaggcctgtcagttccttaattagttaagaaaatgaatcaagcgtatgggttaggagaaatgcctttggacccaatttctggtgggtttggttttgttttgtttagaaataggctatatggatctggaataacattggcactcaccttgtagcccaagctggcctcagatctagagctcagggagtctctctccgcctcccaagtgttcgcggattgtagacctgggccgatatttctgacttgttttcccccttatgtttttgtttattgtatatgtgcacatgtggaggccagagaggatcttgagggtgttggttgtcctatggggcagatctcaggaaccagactggggtcattgggtttgacactggctgtctttacccacccaactattacactggcttctctctaaccttgaacttcctgggtctcctgggggctggtattacagatgtgtgggaagccctagtcagcgcttcttctgtgtgggggcaccacattgagttggtggacactgggctgcttgcacattttctgtcagcctgacgcagcatttatttttggatacttacccagaagtggagtcgctatatggcagttggacaatgcccaggggctgagactgtgagggcccctacctagcattcctcgagctctgggccgtttcccagcactgacctaactggacagggaagggcaccactttaacccctgtgcttttggttggaggcagaaggatcagagaagttcaaggtcctctgccacacagtgagttcaggacctgcccggatatgtggaaccctgtctcagacctcactcacctccagagaggagagttagtattcaggagtgcgataatggctggggcagcatagggtgctgccatccatgtctggacttggtaagatggaagccagagtgaccagtgccttgagcaccagtgcctggtgaaggctgttccagcagtagtcagaggtggagttga

SEQ ID NO: 20739 - DNA, 1241 bp, Mus musculus
caggattgccaagcttgtgcctatgcctttgacatgactcttttgggaacattctagacccacatgatggcagaaggcgacaagatctctatccttagccactcctctgggagtctcgtgagttcttgggtctgtgtcggtatggaccatcccttcaaacccagctggccaattaccacttcttcctcctgagactttccagggctatcccagggccaggctcctagcctcttccttacctccccaggtgtctgcaaacacccagaggatgaaggtagacctagaacagcacctggcccggctcagcgagatcattgctgcccggggtgactacatccagaccctgaagtttatgcaacagatggcaggcaatgtcgtcagccagctctcggggctgcccgtgtggagggaggtcaccacgcagctgaccaagctgtcccaccagactgcctatgtggaatactacaggtgaggaaccgggtgaggcgtgtggggctacagatgcagacccatccaaccccccactctccagcctcactgtgtaacctcctaggacagtgaggggctgaggggctccacctcacctgtaccccatctactgtgtactttcttcggtgctatgactaaatatctcggcacagatttaaggaaggaataggagtttattctggcttacggtttgagagcgtggtccatcctgatgtagcagcaggctcatgaggtccctggtcccatcgcatctatagtcagagagtgaatgaggaatgctagtgtccagcttcctccttcctatccggtagctcttcccgcctggcttagtgtcctagttagtgtttctgtttgcttccatgaaacaccatgaccaaatagcaacttggggatgaaagggtttctttggctcacacttccacaccactgttcatcgttgaaggaagtcaggacaggaactcaagaagggcaggaagctgatgcagaggccacggaggggtgctgcttactggcttgctccccgtgacttgtttagcttgctttcttacagaaccttggaccaccaacccaagcaagagtggtaccatccccaaagagctgggacctcccgtattgattgttaagaaaatgccctaaaataggggttcccaacacttcctaacactgcaaccttttttcttttttcttttttttttttgagacagggtttctctgtatagccctagctgtcctggagctcactttgtagacca

SEQ ID NO: 20740 - DNA, 2225 bp, Mus musculus
gagggtacacggggatgggccgaccagcctgctagaacccatctctgggggctgatgtggcctagacagatgcagccgccactggcctgacaacccttcctgtcttctcccagcacccctccttcttccggggccctttcctccagctatggctcttgggcagcctctcccctgggctccttctgggctgggtaaaggcttctagctgctgctggcttcttatctctgctgaggaatctctacactcctcactcatccccgttgactgtgtgcctcctgttcactgccaaggggctcgctcacagcagtttcagatccaagccccccaccaccaccccacccccctgccgccctcctgcttagctgtaggctattgctgctcgttttgaaatgcattagcagctcagaagaggccttaaggtctgagggcggttcatcaattctccctctgaaaaatccaatgacagaaaagggtcctggcagtgtattgtaagctagtgatcaaaccatccaaatatacagccagtgactcactgctattgatctgggcctgagtggggttcattccggggcagccgctggaggccctggtatcagacctgactagacatgactatacatatgtatgtatgactagacataccatggccatgggtgcaccaggaacaaatcacttaggttctctgcaatgtgccctgtctgtcagtctaaccatgtgagctagggatacagaagtaagggagccagcgggggtgcctgaagtaccaccagggctctgcagtccgtggtctaacagaccagccaaggggaccgcactgccggtgagcagtcacggctgttttcttaccacaaacgcagacttgcttggctctggttgtgttgttttctggaactcaattggtgggtggctggcctcaaactcgcagaaatccacttgcttccacctcagtggatctcagccttcctaatggttcatgcctgtactttgctatgcttatgagtcctaatgtgaatatcttctactcaggacatctgatatgtgaccgacccctgggaaagggtcgctcgacccccaaagggtcacaacccacgggttgggaatctttgctcttcctctccctccaaagtgctgggtttaaaggtttccctctgggccaggctagacgtttgtatgccatctaattttaatccttacaagttagattctttctactcatattataaatgggggaaaaagaagctgagattaaacctctcaacatcatgactgtgaagtccagcatagggatttgaactcagcaactccagaacccaggttggtgaccctcagagatgctgtttcggaatgggaagccctgtagacattttgggtgtttgcgtctgatttgctatctccttcttctacatgacaggatatctggtggttttattattaagattttttttccctgagacatggtttctctgtgtagccctggctgtcctggaactgcctgtgtggaccaggctggtctcaaacttagagatccacctgtttctatctctgcctcctgagtgttgggctacatgagaccttgtctaagagaagaaaaaaaaaaaaaaaaggaaaaggaaaaagaagttccttatgaccagccattggatgctaggtactgtgtgatgctctggggatgagtgaatgagatggcctctatatcccaccacattcatgaagcctgctgcccagtgcagggtgtcaaattttgtgaaaagggccagataaatatttcaggtgttgtgaacaatatgatgtctgtcacaacttctcaactgccatcaaagtgtcacagccagatgaacatgcccccaaggctcagggaccactgtggaagagggagcaggaagcctgccagagccagaggccagggtacagcaaagcagagcccagatttctggacatgacaggactcctgcactaataaactcacagcagccagtggctgcccacacaagatcaagccagtgatggttacagaatagaggggcgtctcagctagggtttctattgctgtgaagaaacactatggccactcttacaaaggaaaacatttaattggggctggcttacagttcagacatttagtccattaccatcagggtgggaagcatggtggtgtgcaggcagacatggtgcaggagaggagctgagagttctactggatcctcagagagtaggaagagtgaca

SEQ ID NO: 20741 - DNA, 1222 bp, Mus musculus
tcttgtgctctgtggggcagggctcccagatccaccagctcacgtcttccacctcaatccaacttggcctgatccttggccctctcctgcctctctgtcaggagtccgtcctgctttactatgatgcccagccaaatgggtgatttggggatgtggggggcttctttgttttctctggggcattgccttataatacccactaaagtcccacgaaggaagcccccagagagcccctagggccagggggtgtggcagcgcagactcagtaccttccctggcttggttcagagctgctggttaatcggaccgtaacaggcttgtagttgttgctctgtgcctgagtcctgctcagcaagcttccacgtttcccagcatccaagccaccagctcccgagtcccgacctgccactatccttccgcaagctccctcccctagaacttagttttctcagtcctctgctctacagcgtctagattccacccatcctccctccaggccgctctgaccagcttagcttgcaatacgatccagtttccctgacattctccctcctccaccccaagcagcgtccgtccgttctgtcttctttctgtcttctttcctctgtcgtccttggatcactaggtggccaagtcacattcgctgtttttgctaggtagtcttctatgtctttctgttcgtagtgtagtgaacccacacactggaatccccacctatgagcagtaggaactcacacgtctcagctcacctggaaggaagagccctgtgctgaaattgtccttggcttttcctctttcttctggttttgaattctggctgggctgcagggtcttgtcacaggccacctaggtataatggtgtatgcttacctcctagaccaccgaacagttctgagtgttgtgttttataaaaagatagggaagccacgggtatgtttggtgaaggcgcggtatgatgtcaggggaagggggtgcctctgcgggcccatgctgaggcatccctgggccggtgctgaggcatcccttccccctgagagaccagccacacgacagtgtagtatagaatagagtttattcagggcatagggagggaagttgagggggtggtagagacagagaaaggagagagagagtagaggagtacaggtcggccatgagaacctggagggggtgggaatggggagagaggaggaagagggtaagggagcaggagcaagagagc

SEQ ID NO: 20742 - DNA, 1140 bp, Mus musculus
aggtcctgagttcaaatcctagcaaccacatggtggctcacaaccatctgtaataagatctgtcaccctcttctggtgtctgaagacagctacagtgtacttacatacaataataaataaatctaaaaaaaattttttttaccctcattgtgggagctactctatgcttgttcctgataagttctaggtgcagtagctgatcaggatgctctgccctctacccatccagtagccctgctccataagggtccaagaaggcctcactgggctcgtctgctgcacagcagagagggtagccgaaacaaccacgtatctaaaacttgccggaggttgtggggaggagaggggggctgggtgaggggggaccagaaagcccatctgtctttgagggaaggcagacctatcattatgtgtaaaaataacaccatgtcttattggccccagaagagttgctcttacaaatcttggtccagatttacaccatcggcctagaatgacggctggggtaacaaactgcctcataacgttaaatgataataataaatccgagctttcctgctctgtgcggaatggaccgcgtggcatggcccactgtttgccccacgaatcctgtttctagcaaagagttctcaccaaaggtgtgatttgcactaagggtttaatacaatgaagttaattgtagtttggcttttatttttcagtcctaaacactgagcccagaccctcacacatgccggacaaccacactacggttcccgtcactgaactatgaccccagtcttcttttactgtttgctgttagtgactttatctttattattattattattatttatttgtttacgtattttatgtatataagtacaccattgctctcttcagacacaccagaagagggcatcggatccctttgcagataattgtgagctaccaattattatgtggttgctgggaattgaactcaggacctctggaagagcagtcagtgctcttaactgctgagccatctctccagccctgttagtgactttaaacgaagactataaaatgttgtgtatgaatgtgttgcctacatgtatgtatatgtaccatgtgagtgcctagtgccaacaaaagcaagaagagagcactggatcccct

SEQ ID NO: 20743 - DNA, 1945 bp, Mus musculus
acacttgaaaggggacctcagagccagccattgctggtgtctggagtctcccagaccactcactgcttcttgccagttatgactgtcattcccttcgcaccagctgtaccactcccagaggtctgagcaggccacagatagcccccaccttgcagagcaggaagtttagccaggctcgagtgtatcccctccagccctggcaaagggcttctgctcaccacagatctatagccagtctgaatagaggaagagagaaccccacaacagccatacacgggtagtgtccctttcctctcagagccaagttccattcctggagttatcctctaggcatgaagccttccaggggccgggatggtagggagtttcaccccttcctccctccccaagcctgcaaaccacctttgctttcattcctttctctgcgcctgcccccatctcagggaccatgatgtctcatccagtcctctcttcctcaggccacccagggacagttcacatctgcagccttcagaatgtcctgtaggagtgtcaccaacccaggtccaagtgttcatgcctgtccttcaccagggactgtaggacccttacttgttttgtttggttgggctttgatctgtttttttgttttgctttgttttgttttgtttttttgagacagggattctctgtgtagccctggctggcctggaactcactctgtggaccaggctggtctccaactcagatcctcctgcctctgcctcccaagtgctgggattaaaggtgtgatctaccactgccgggccctcatgttgcgttgtgttcttaagttgaggaagaactgtctcctcttccacctttctacagaatgcctcttctttacctcccgcctctatggggatgacttttgaggccccacctgggtcaagggttcagtattttagtctaaaacttcagaaagtcaagcatcacttaagacatgcccagggctccagcttgccctcagcagtccttcaggacttctggttccttccgccacccttctcaagattctagaaatcaaaggagccatacaatccggcaggaggcagtgactgtggtctcagtgctgggagcccaggaggaaccgtcatgccttacctccttctaatgggtaaaggggctttcttatcaagcatgtctgacatccctggagaggctacgctgttccaggtggcactgggatgccagttggcagctggatccttctgttcacacgacttggaaccttttgtcctttggggctgggcacctccagaccctctgtgtgtccctgtcatctggggatggggaggaattcaggcctgttcacttccccagttctgtagcagccgatcagcgtcacctttgaagtatacatgagagaaatatatttacaaatgctttattctcttctttaataaaaagtgcaccggtattctagaagtccaagtgaccctgggtctatcgtttcgcctccgagtctcacgggccccctgccccttgccatgcagcactgcggatgacgggtgtgtcctttgaggttgctttgtgccctgaaatctcagcgttctcatgactactcacctatgattagacagcctgcaatcagccctcaggaaagtctgtgtctatgaagagcctgctatgccaagcactctggtcaacaaagcacaaagggtctggatcgccctagagtttactttctggcttggggagagtccccccaaagcaactacaaataaaagcaagtgacctaacaatgggggcaggaaggtggagctctatcagacacagcattcatgatcaacagtgtggggggagtgcttgtcattttgagacaggatctcatggacgttaagttagactgaagcttgctatgcagtgagtgatgagggtggccttgaacttctgaccctcctgcctttacttcccaagtgctggg

SEQ ID NO: 20744 - DNA, 1906 bp, Mus musculus
ttcttttcactagtatcttgttcacttatcttgttgatgggctaaatagcaagttagtatatacagtgtttattttgatgtaccaaggccctgagtttgatcttcggtgttacaaaaaagtattcattcccctttagaattactagtttgagacatggtttctgtatgtagccttggctctcctggaactctgtatagatcaggtggcctacagagccacccctctctgcctcctgagtgttgggattaaagatgtgcatcatagagtgagttccaggacagctcaggctacacacatagtgagatcctgactcaaaaagaaaaacagcacagggtggcactgttaattccgcacagaggcagaagcaggccagtctctaagagtctggggcagagtgacttctgagacatccatggctacgcagtgaaaccctgcctcaaaaaaactaaaaccaaacaaaaacaggtgttatccgtctgatcctgttttttggataatggaatcttgggcttttgaaaaccacatacatacacaactgaggaggtaacacactgacaggttccatttctgggtacaattacctcagttggtgactgttgatattttttttccacttgtttgaactattttgaaactgttttcttagaaaatgtggacacagacttccaagccaacctggcgcagatggaggagaagccagtgcccgctgctcctgtgcccagcccagtggctccagccccagtgccatccaggagaaacccccctggcggcaagtccagcctggtcttgggttagcttcttgtgttggaactctgtccttctgtctgtctgtttgttgtcccatgcttgggaactgcacagcgtgagctgactgtacatctctcggattggtttcattaaaggagaagcactttatgtaccgctgtctttccctgcttcctctcttcctttccttctgtctgtctgactcctgggtctgtgcgccatggcatgagtgttttctagtagtagactggagtagtagactgtttctaagaacagatgatctggttcctgatgtgtagagactcttatgtaccagggtttttgacgatgtccttggcttcatgtgatgggaccgacagcagcctcaggcactaccctgctcccagctccacagggtgggcaccactcagcttgccttgcacttgccccaccatcggtgccctttgctaagtgcaccttcctgtgccatgtggagtgatcaaacagctgtacctcacatcctgctgcctgcagagcagacaagctgccttctgtaccctgaagatgccattggccactgtggctggccagctgcggggcagagccacccagcgcagaggatggcttcaggtacacaagcaagctccctggaattgcaaggtgaagcacacaggaaggccgtccgtcccagagtgggactgtgggcgcagctcccacagggacctccttgacggaagaagtgccatgtgcatgatgctgatgcctgaccatggagaaagtctcacccttgacacttgtactccttagtcctggactgttgcttaaagtaaacaatacccaccttttgaagcaccgtgttttgtctttctcttttttggggggtgcggggggagtgagagagtgaatgtgtgcgcgctgtgtagctgaagctgcccttggactccaccttcaagtgctgtgtagtagatatgcaccaccatgcccagtttatgtagaggtggaacccactgagggtttccgacagttccctgcacgccagtggagttgctggaaagatggctcagtggttaagagtcctgggattctcatccagcgactctgagttcaagtcccagcacctcgtcaggtggctcacttctgcttgcaatcagcaggaggccc

SEQ ID NO: 20745 - DNA, 1150 bp, Mus musculus
taaaaaagaaagaaagaaaatgctctttgggcatgtgtacagcctgagcttactgagattttgtaagttgaggttcctgtccctctgactgactataggctgtgatgagctgacatacccaaccagcatagggcatgtctgggagtcagcgctagaagggaggagtgcttgctgactccgggtcccggcggcctggagaagtcagcacttggagtgctgggccttgtgctgcagctcatggtcccacctctctctgcaggtgactgttctggtgcttcagggccggctcgatgaggcacggcagatgctagccaaagaagctgatgccaacccctcttgtgcaggcatgtgccgcgtccttggggacctgatgaggacaatgcccattctcagcgtatgtgggagctgccttgcctacctggtcttgggaggtagggatcagggagcgtgtgggtctgggcagctgagagtctcacagccaacctctccccagcctggcaatactcagacactgacagagttggagctgaagtggcagcactggcgtgaggagtgtgaaagacacttacaagacaacacatttgcagccaacccccgtctggagtctctctgcaaggtgtgggatgggtcaggtcagggctggggaccttccttgggaccctggcatcccaggcatcaaggagctggcttctccttggagagagctgttcagtcacttggctgtgaaagagggaacttcttgtcttattgaaacccatggccccagatgaaggggatcctccccgtgtggacggagctcagacgatgtctctcctcagatcatgctgggagatgaggccgccttgttggagcagaaggagcttctgagcaactggtaccatttcttagtgacgaggctgctgtactctaaccccacagtgaagcccattgacctgcacttctatgcccaggtgacatagtgacagtgtgtgtggcctccatgcatcaggaaggctcttttacttcagtcctttgggaaggaactcctttttagacaccccacccagcagtcttgccctcccctccccctcaagtctcggcttctgtcttggcactgacttggtatccccttttccacagtccagcctagacatgtttcttggaggtgaga

SEQ ID NO: 20746 - DNA, 1176 bp, Mus musculus
ttctaagtatcaggtaagtagagaggaattttgaggtgaactcacacccctcaacaggaaagtaccgggagttccacagactgtacggggagaagcgctttggtgacgctgcttctcttctgctgtccctcatgacctctcagattgcacctcgttctttctggatgactctgctcacagatgcccttcctcttttggaacagaaacaggtaatacttgatcacatctgacctatctgttctgtgcctttggtggtcttcctcagctggcttctgcagccatacagaagctcatttacgcctaagcagtaccgtgtacacgtgtccaaggctcgagcaccaatccactattcatttcagaacagctggaagatgcctcactagagggatggatgtaagacttaggagcataccagcagcccagggctctgtatgcaaatatttctccctgaagactttggagctgtgcctgtggagcagctgagtgacgcagcctctttcccctaggtgattttttcagcagagcagacatatgagctgatgcggtgcctggaagacttggcctcagggaggccagagtgtggtgaacctgatgcccagcgactgcaggtcattttaactcctgggaagatgattgtgttgaagtggggaaagatttctgtctcaggatttcctcccattatcctgccatcttgaaacattagcctttttatgaattcatgtgccttttagctattaacctgttctgtaacaccaacttttaggagcaagtcttcccactgcagagccaaacttagtatgctatactggtcatattctgaactgtaatcgtaggttcagatggctccatgctctcctggaatgctgcctgttgctcctcacactgtttttctgctctttaggatgacgacatagagaccaccaaggtggagatgctgagactggctcttgcccggaatcttgctcgggcaattataagggaaggctcactggagggttcctgagagaagatgaggacagttgcaatatagtaactttgtatggcaatgtaaatagattttaaagaataaattgttttgcaaatataagaccaattgttaatcctaccaaggaggttttaaaattgtctattctgaacctgacattgcaaaatgaacaatagttgcctttaagatgg

SEQ ID NO: 20747 - DNA, 2085 bp, Mus musculus
atgaaggtaagcgtgagagaatctatgaaacccacctgggatcacaggaagtaccctgtgaggctctgtcaggaagtcctggcttgacctgcagcagtaacccctctatcccacgttaagggactgagcatgggtggacatggtgatgcaagatggatccttcctggcagaatcatgggcgtggcagggagacaatgtcttggcagagggaattcctgtactgattctcatctgcagccctcttattacaggaaaaggtgcggcttcgatataaactgacctttgctttgggggagcagctgagcacagaactgggtgaagtggaccagtttcctcctgtggagcagtgggggaacctatgaccccagcatatgttgccatctctacttggaaggcaagcagccctgagacaggctctagctagtccagccactgtacaccctgaacagcgtttatagcttggtgtggatcggagccctggacacttctgtcaggaaccaagctgctgctttggtcacctcttcctgggcccctaaaaggacctgtcttatctacctgtgtgacttgaagtagccgtactgtgtgggtgatgagtcccctgtggcttcattggccactctgggatggtggactctgggcccagagtaggatttcctttttttactggcattccttgatatcagggagagggctctgaacggtgcctctccagcccctgtaagaactgcatctttacactcgaagaggcatggcttaggagactgtacctccccttggcggtccctggttctttgctgataggcactgctgctccctgaactaaagtgggcagcagtggcccagagtgagaactgtggagtactgtagtcttcactttctgcaagcagcagcatcctgcagtggctactgagtgagtgatgtgcttacagtggcaggttgtgtcctatggacatcctagcaggacggggagcttggccggatagcctcactagggacaggaaggaaaacggaagtgccaatgtttcccttcagaggcaggtactgtggctttctgggaaaggcgtacctcctgcagtgggaataggccgtcctactcactacctcttgcttggcatgaaataaactgctgtgctccccataagcctttcaggggaggacacctcctgccactctgcatcctgctttggtcactccttctccctgccacacagtatgtggtgtggcacctatggctggacccaggaagtctcagggtcacacacattgcactagacttttatgctgcacccaacaccctcttttccccagctaaagaggggcactgtcagcgacatgttgggtctggagatgagaggtctgtgattaaactgagtttccagaccctattgcttctacagtgctgtgcctcagccagcataacccagttgctccaggccagagacgtttaggctgatcgggaactcggctgccatactagtctactgggccctgctgtccgtatgctgtcgccactacatctttggagctctgtctagaggtcatctggcctacctcccagctattgtccttagctagcaggttttacagtttccttaggacaggtttaaaagagataatcattttcactgatgatggaataaatccaagagctttccagagactggttacttcggtgctggaacatctatgggatcactgtcaatacggtcattaaagatttaaattatgagtgttgctcactactactgaggtcactgcttcagtcagtacagctgtactggttgtaccacctcctgcccttgttttgctgcatgtgaaataaaaccatttcaccctgcttggcatctttcaatacagagcacagcggtgggacaccatgctatgaattccaactagtttctgaaacttgtgtttaaagaagctaaccaaagaaattagagggtgttccaaggtcactggctgagttgggtaaggcctcaacctcatctgggcaggattaatccccttgcaccagtcccgtgggtccctggcttctctaatgagacggagcagggctattctctatcaatgagctcttaagccagg

SEQ ID NO: 20748 - DNA, 1169 bp, Mus musculus
atgtgtctgtgtagcttgtgaactggaaggaggggagcacgattctgtgaagaaagcgattctcccttggcgtctcagatattagactcttgcttcgttttacttcctagtacttgggagacagggtgtctgaaaaggtgaagactaaggtcatcgagttgctttttagctggacactggccttgccggaagaagcaaagatcaaagatgcctaccatatgttgaagagacaaggtgtgtgtgtagctctccattgacctcagcacggcagtgaaggtggaaagttaaggcaaggaagggaatgttgggagtctgcagggtactgccgaggtcctttcctatagagaagttgtcatgagggctcgactgggcttctagtgggttgaggggagagtagcctgctttttcctactcatcacagggatttggcccttgttgtgtgaaggacaggcgaccattgcctgagcacatgctctgtcctttgtgtctcctctcaggcatagtgcagtcggacccccccatccccatggatagaacgctgatcccctctcccccacctcggcccaaaaaccccgtttttgatgatgaggagaaatccaaggtaaagtgcagcttggacctggatctttaggtggcagttgcgggcggactgggtgtgagctgtgagagcggagggtggctgcctttttgtctttcagttttgagcagtctccctctaacctaagctgactttgtatttgacatcttcctgcctcagtcgcctgagtggtggtattgtaggcatgagccaccctagcaagcatgaagtggggtcttgcttgtattgcagttccttctggtgcctgctggggctgggtacatgccatccccttcacttgccacaccttctcttccagcttttagccaggctgctgaagagcaagaacccagatgacctgcaagaggccaacagactcatcaagtccatggtgaaggaagtgagtggtcctgggcctctgggtggaggcacagacgttctcccccagagatctaggtgcctcttactcacccggcaccagacctgagctgcaggagtttaggaggagcctggtgtttcccatgggaggaagcatagaggagtgctgggtggctgtgttagtggaagtgggaggagtcactctaaaacagct

SEQ ID NO: 20749 - DNA, 1959 bp, Mus musculus
tttattacggaatctcgccgctacccctgttcccctcctgtgtcctttttctcgttctttctttcctgtccagtgcatgatgtttaaggccacatatagtccagctgatgccaataataaaagacaagaaaccaagtgggctggtattttctctatgcaaaatgtctgtggagatggatggactgaaagagccggattcctcacacacaggggcagccagtgcttctggggccctggttggggttcacccgagatgcccaggggtaccgcctccagcctcaggcctggagcattccatcaaagttggaattaggggaaggaggcccactgtcctccccggtctcctgagagtcagactgcaggccctcccctctcccactgcttcccttcaggtgttttgacgtttttttgtttgtttgtttgttttttttaaatagtgcctttgtcttatttcaagggtgttcataaatggtatttgtaccatttttttttttaataagttaaagacagtccagagcttttcagttgattcgtctcctatcctgtgtaaatattttcctctcagggcaggggaaagaggacagagaaaggagctggtagaagcagagagtgtatttcccatcttgaatgggccggaggtctcgaagcctcagcttttactttgtgagctgcaacactcgcttcagctcagactcagtggacatcagagtctctgtctccgtgtctcagttatggtctgctctctctatgcctggagctactgatccaaacacaagacggtcagaggagccctggcatccttcactcttataggcctacatgcagatgggcttgaagagaattggcctttcatttttcacgctcgtatttccccacctgtccaagggtgcagatagcaggattgtggggtcggccgcatctctcttggcagtgggttgtgctgcccctccccccaccccacccctccatcccacaaagcctttcgaggtaggagagaccaagaccagtgcacagctttttaactcttgtcttctgtgagttttccgtcctctgtagtcacgtgcctgcacaccgttctctccaccctgcctccttcccacagcagaagcagggctccacccaggccttcccttggagtcggtgcatccatgggctgctagactcttgcgggtagagtctcccctggacttagcattgtgagatggactcagctcagggcgcccctaaggctcggaggcggccttctgggtccccacctctcctggttccgctgctgctctccctgctgatgataaagtaatctctggagtcacacctgggccatgtgattgttttattttggaattggtgtatatcatgaagccttgctgaactaagttttgtgtgtatatatttaaagatcagtgtttaaataaaaaaaaaaaaaaaaccaactatgtacttactctgacttctgcggacagcaatttggtaggtagtgattaactgtgaataaacgtacaatgagttcttaactgtgtgtcttcatttctccctgatggtgttttcagtttatttttttatttatttatttttttcaaggcagggtttctctgtgtagccctggctgtcccagaactcactctgtagaccagggtaaccttgaactcagaaatccgcccatctcagcctcccaagtgctgggatcactgcccgtcctgattttattttatagatggggtctcactatgttgccctggctggcctcaaattcgcagagattctcctgcctctgctcccaaatgttgaaagtaaaggcttagagtatgttaactctggccggcatctccagaccctgtgaacctaggacgagtgatgtagctcattatgtggaaaatggtttagacaagaactcagaagaacccagagctgggctggaaagctcctcttcccttccgagctgagggtgtggaaaggcta

SEQ ID NO: 20750 - DNA, 1161 bp, Mus musculus
ggagcctagaggggcattttctcaaaaatccaactaggaattgcgcatgatattacatgcctttaatcccatcaattgagagacaaagacgggtggatctctgtgagttccaggccagccagagtcacacagtgagatgctgactaaaaaaaagaatggctttgccctgtctgaccgatcatcctttcctagttaatgggttactacagaagcccaccccaaaattcatctctttttataaaattttttttaaaatatttccttcatttacatttcaaatgctatctgctttcctagtttcctctccgaaagtcccctataccctcccgcttccctgctccccaatccacccactcccacttcctggccctgtcattcccctatcctgcagcatataatcatctcaagaccaagggcctctcctcccattgatagccaactaggccatcctctgctacatgcagacacaagacacaagctctggggggtactggttagttcatactgttgttcctcctatagagttgcagacccctttagctccttaggtactttctctagctcctccattgggggccctgtgatgactgtgagcctccacttctgtatttgccaggcactggcatagcctcacaagagacagctatatcagggtcctgtcaacaaagccatctgctttccttcctttgcctgaactactccaagtagcagtaaaacagctcagggagggagacaagtcagtaggtaggggctggacccttgggcaggactgggccgtgatgtagtgaagacagcaggaaggccagctattccttccatcaaagaaaaccatctaggaatggagacctagggcatcaggtagggttataagttctgggtcagcctgggctacatgagacccaggctaataacacagctcagtgggtaaaggtgcttgtcgtccagccaggtgacctatgtttgattcctaggacccacatagtggaaggagagaactgatttccacaggagttcccctgacccctgcccatcacacacacgcatatctagagaagtgtcctcttaaagttaaacatttaaagatgttaatacgtcatcactttaggaataaaatataagaggtagctggctcggttggtaactaccacgaaacaagaggat

SEQ ID NO: 20751 - DNA, 1214 bp, Mus musculus
tagaggcggtatgcttaatttgcaagggtctcttgactcttgaattagaaaaccacctttatgcctgcaaagtatccctgtcccctaagaaccagttttgtgtggagggtagagtatggattgtgctgtcctggacatgccccaccaggcttttgaaggggaggagtggctgtacttcctgctgggcacacagggcaatcactttttgataaagtcccctgctgtctttcattatctgtctcacacagctctggttttctctcctccattccctagacttactattttttccttcctcttccctccttgtggggagcagttggcatttaattgtggtacttcagccgtcagcagttgtcacattagtaactgggtgagcccaactggaggtggggggctgttctgcccttttgaagatcggcccccacaccactgtacttaggtacccacgctggagcagaggcaactggctgcttcctgagctcagacgtttgatgatgtgcgtagggctcccatagtttagaagatttaaattcaggacaaagcctgtgcacctgacaggctaaaacagaggcagacgcggtttttgttcctgttccgttggtcttcccacccagcaacttacttactcggcttgtaaaacgaaaagtgttcaatacttatatctatagcatcttggtcaaaccaacatgcttaaaaatatctccaggagtgcttcctgactcccgtgtgttctgagtaacgttggcagtgagtgagttggagctttgccttcttggcaagggttgatttctccactaaggggtgaaatctgcttctgagagtttggaggtgggaaaaatgactcataaataacatatccagcagtatataaatagatcggtagtatatctttgatagctgatttttataagagatggtgtacacatttaagcccagcagttagtaggtagaagcatgcagatctgagttcaaggccagacagagctacataatagtaccttgtcttgtggtggcggcacatgcgttgatcccatcacttgggaggcagagggcatggcgctctctttgagtccaaggccagcttggtgtacagagtgagttctaggacagccaggcagggctacacaggaaaaacccagtccagaaaaaccaaattaaatgaataaatggacaggaaagagagctcaggagaagacctgggttggatccca

SEQ ID NO: 20752 - DNA, 1378 bp, Mus musculus
tctgtctgtaccctgaacctgtcacctcaatgtcggcaccctgctcagtcctctgatttgaaggtctacaccagcctgtttgttttcctggtgctggattgagccagctcctgtaatacactccacccccggctatagccctggcaatctttacttagtaaccgagataggtcctgatcttataatcctcctgcctcagccttcaagtagctagaatcacaggcctgagccaccaggccaagttgtcaactgtatctcattctatttcaccagggtccgtgtccgctaccagaagcgccagaagctgcagtttgagaccaagctgggcatgaactcgcccttctgagccactggccatggtggccatagctgcccagcttcctggggacagagccagacctaccaggaagttggtatcacaaatgtttcagggtttgtctttgtgcctcatggcattggaggctcagccgtgggcactggagacaattgtcttcctggcttgggcttctttttcacgaaaagccacagggttgtagccacggcctgcctgcttcggctcttccccggccttgccaggggcactcttgaatgtatgacctcaggcccttggtaaagggatcctcagcccctcccccatgtgttccccatcttaggggccccctcactcggcaccctctgctcttgcatctacggcagcctcagtgtctgttggaaagcagaggctactgctgttcaagatgctgtatcctcctgcccatgtcccatcttccccggcaagggcctgcctgtggtccgaagaccttcccttcctctgggcttgaagatggaaaaggtccacctcaccctggggcccccatgtcagctgaccacaagtcatccacagaggaccctgcccaggcccatgtggcccttgcccttgttctgggagacattttttacttttttttttttttttttcttactggaaaatgagcctttgggggagtgaatgtcaactggtttatattaaaattgtaaattgcttaaaaaacatcctgtggtggatccatgaaacagccaggaaaggctccctcccagggctgcagctctcggcactctacactgatgagtggcccccaggacggggtgaagggatacccccggacttggaggtttgctgcacagatgcaaacacagcccagtcatgtggaatgactctttcattgatgttagttggggaaagaggttaatagttacagagcccaggctagaccaactgggtcctccagcaggaagtgggtagacggttcttctgtggcccgaaggccttcccctactgcatcctctcaggcagttaatagatagaataaattccatttaaaatatatgcatttctctc

SEQ ID NO: 20753 - DNA, 1201 bp, Mus musculus
catcatagccctgtccccaacctgcctcttccccaccgccctcctctgtagccaaggagatccagctgatgcatcgcgcgcctgtggtgggcatcctggtgctcgacggacacaacgtgcccctccccgagcccctggaagtcgcccatgacctgtcgaagagcccagacatgcaagggagccaccaattgcttgtggtgtcggaggagcaattcaaggtgccacgtgacagggtcccctggatgtccctaaggcaccagcagtgttcagcccctgggtggatacaaacaaggacagctggggttgcattggagtaagggccacaggatcacagaaaataaggaagggatcttgtatgtgtcagccttagacccaaaggtcagagctaggaataccaaggctggatgacagtggccttgcatcctcccgacccaagagctgggtgggaagaccatagtctggttatgtgcgactcatgtccaactaccatgtgtgcccaggtattcacactgcccaaggtgagcgccaaactgaagctgaagctgacggccctggagggctcacgggtgcggcgagtcggtgtcgcccactttggcagctgcagggctgaggactatggggagcaccacctggcagtgctcaccaacttgggtgacatccaggtggtctcaatgcccctgctcaagccccaggtgcggtacagctgcatccgccgggaggacgtcagcggcatagcttcctgtgtcttcaccaaatatggccaaggtgtggaggcacggcctgtggcctctgtgaggttgggggagtgggaggggggtctcaggcactgccagggatggagagccaagagtatctcagatgtggagctctgtcgggcaggctctgtccccatccccctgggagggaggccctgtctcagccacagggcccagaagccttggctggctttcctcagggctcttctgcctctccccaggtttctatctgatatcaccttcggagttcgagcgcttttctctctccaccaagtggctggttgaaccccggtgtttggtggattcaaccaaagccaagaagcacaaccggcccagcaatggcaatggcacaggcctcaaaatgacctcctcaggccacgtcaggtgaggacgaaggcccagaggctcctcctgaggcatctgctaactggccaaggtgaactcct

SEQ ID NO: 20754 - DNA, 1158 bp, Mus musculus
taggatcacaggcatacgtcaccacacctggtgagctgttctcttatacagagcccagtcagaagcttggggcccactcatctttggtggttggcggggtggcgcatgctttgctaaatcagcttttctaacaaaatgccagcctgcttatgtggaatccacttatctatttgtatacatttgtagcagtggggaaggagctatgggccagctatggagagagacggttagctgttcaatgataggctgtgttgggcatgtagtcgatagaaccctgtgtgaatgatacccaagaggagtcaatgtgggtggaataatacattccttcttctctgtggaaaaatccggagagctgaggaggcctttggcccaggcgggtcatggttacagatctcatgtcagaagctactgacttgggcttcttgattgtcacgctggatacgccatctcatacatgggttatcttgggttctgtaagaggagcgtctttgggcgaagaggggatgcctgctttcgtgctgttaaggattgaaccaggagctcgcacatagtatacaagccctctaccattgacttacactccaaccacagatattctcatcctgaagccgagtgccaatgaccaactacatagaactcgtgtccacaaggtctacttaggctctcctgtgaagggggaagaggttctgcttatctgtgaagggggaagaggtcctgctcatctggttctacactgggatgctcaacttcttcctattcattgactgaagtaattccttttggaaacggcatctctaatttggtctctgtggtcagatcacatgctaaaaagttgtgggttgctgtgccagctacccaccccccttggttaaaaccataccaccaaagccctctccggccactggtacatgaatgtactaaattcagcctcctccagaactctttatggtgaggaatgaaagaaccgcatgttccagctgtcagtctcctctgcaaaaaatcttagtaggttcttgtctgagaccagagtgctaaaacctaccatgccttagaacagatccaacttgaggcctctgcctttctttcttctgggtcttctcattgccttggtaggcagttgggggtgtgcttctgtggggccgagaagtccatgtgatg

SEQ ID NO: 20755 - DNA, 1236 bp, Mus musculus
ctggccccagctgcagcctctctgaggagggtgcagagcagacatgaggaggagacaggcgtcccatctggaggctgctgtgttggtagaagtgagctgggtttagaggcttcatctctttgtcattgttcgcagagccagtggttctagttccatacaggaatatgggaccagtaccgaacctgctcatggattcttctgttcccttttcagcatctacgagaaactgatccagttctgtgccattgatgagctgggcaccaactacccaaaggtatgtcctatactcagagcccggagagcggtggagcttgctgtagtgagtgtgactgcacgccatagaaggtccacggagcagcactgctggaagtctcagggtcctaaccagttagaagccaggagtgggcccactgcccctgccaccagctgagctcattctctgttcttaggagcttcctggttctgggcctggtggtcagggagccagctgaagccctgtgccttcaaaagggccggggccctgccctaggaagctccgtgtctgggccctgtgcactgatggtcgctctgactgcaacttaaccttctctttccaggatatgttcgatccccacggctggtctgaagactcctactatgaggcattaggtaacctgttagctctctgtatctactcatccacacacccatccgtctgtccatccagtcagtgacttaggtgaccataacttagggtctctatgccaggcagtgcccacagggctgaattaacctgagcaaagtgtggtacagccggaaacctttgacctggccaaaggactggggaggccctgttgaggagactgttagagctaagatttggagaggcccaggggctagaatgctcgaggcagaggacgtgtgtgttctaaggccagtgaccacagctcagagaactgggagtaatttcagagcctgagcctgtaagtccccgtcacaagccagaagcttgtgatccaagccctggctccttagtgcacgtatgtgtggcccttacaagttttgccttattttgagttagttaccagtatttttatttacaataaaagtctgcatctgagtttcttagtaggacggtagttcccactgttaaggtcaggagcagcctacccttccctaggattgcggcccctgtgacagagccttggtccaggcccatggtccatgctgaccagggcctagcacctgatcctgcca

SEQ ID NO: 20756 - DNA, 2158 bp, Mus musculus
aatggcccgaaccaagcagaccgctaggaagtccaccggtgggaaagccccccgcaaacagctggccaccaaggcggctcggaaaagcgcgccctctaccggcggggtgaagaagcctcaccgctacaggtaggcagagggctgggaacaatgacttggccgccggcttgcgggcgggcgctctctcccttctccctgaccgttgacgccttccttcttctggtgactgcaggccagggaccgtggctctgagagagatccgtcgttaccagaaatcgactgagctgctcatccggaagctgccattccagagattggtgagggagatcgcccaggatttcaaaaccgacttgaggtttcaaagtgcagccatcggtgcccttcaggtaaagggacaaaaggcttggtggcactcggggcggcggcttgattgctccagtaggagtgttaatgctgttgctcttgtcctcaacaggaggctagcgaagcatacctggtggggttgtttgaagataccaatctgtgtgccatccacgccaagagagtcaccatcatgcccaaagacatccagttggctcgccggatacggggggagagagcttaagttgaagcggtttttatggcattttgtagtaaattctgtaaaatactttggtttaatttgtgactttttttgtaagaaattgtttataatatgttgcatttgtacttaagtcattccatctttcactcaggatgaatgggaagagtgactgactgttcacagacctcagtgatgtgagcactgtggctcaggagtgacaagttgctaatacgcagaagggatgggtgatacttcttgcttttcatgatgcatgtttctgtatgttaatgacttgttgggtagctattaaggtactagaattgataaatgtgtacagggtccttttgcaataaaactggttatgacttgatccaagtgtttaaccatacatcactgtgatagaatgtgggctttttcaaaggttgaagatacaagttttagccacagtgtaacagtttcctttaaaaaaaaaaaagtaaacctggcagctatagaatacactatgtgcatttataatagctattttatatattgtagtgttcaacatttttaaattaaatgttttacattcacaagtggtggggagtcttgtcattaaggtgtgtgtaatttagtccagttggtatttcctgactagactgcatttgtttttaacagtagaaaaatgctatgcgtattaaaccttgcataagtcctcattctaccacatgttcactaacccctgaccctctggctggtaacacaacactaacggggattttatttataagggctctagagtaaaataacaagctattcacaccagcatcatctattactaatctagttagtgcagcttttcattgtgtttggtcttaggcctagattgagttcggtttcgtttctttttaatctttaagggggaaaactgtacaaggtttgtttttccttgtagagtttataaacatgggagtaagaacacagcttcaacttcttggacctctgccaatgaagatgggttaggttacacctggttactatactggcaaaatcccttttatagagatggccttcaagtggtttttaaaagtatcctattgaagtttttaggtcaattatgtatgttgactaaatttacaaataaacttgtttattcaactaagtgtcaaacctaaattgaatatacaaagcttttaatacatatggaatcgagattcctagattcagctatttgcttggtagaaaaggctaaagtacagaaagcatttgaacatccaatacactctaaaaatgcaagtatttgctgacacaattcatgagtctgacaaaatctgcttgtggttcatgggtgggcttaataactacaatacatgtttgttcccatggttttagaatatttgaaattttaagtttgctgttttggatctttctaataggccttacaaataaactagtaagtttggagtttttttcctggggaaacagtttctctgtagccttggccacaactcccactgtagagcagcaggttggcttcaaactcaagatccatctgcctctaaccagtacggatttttttctttacatatagttgaa

SEQ ID NO: 20757 - DNA, 1172 bp, Mus musculus
agctccgttcaccctgcctttccaggccagaggcgtcagcgtggactcaggtccccacttcccagctgtgagggcttcaggcaggtctgaaactctaaaccagactagctcctgggcttaccaaatatgtatttaactctggggacagccacagagcagggaggccaaagctacaggctagccccactcccacacctgggcccttgaagctcctcaaggcctagttctgtccctcagtgttttgaaacctgggcttctctttgatcacttccttctggaatccctagatagcctctttgaccccacagtcacttgtcaggttggcactgccctcacctgtccctgcctccttccctctggcacacggccgtagagccggccgctccctccctctggcagctagcagggcaattgttgggaggagtgcagtatgaggaccaaggggcacgagccctgcccttcttgctgggaggaggtagtatgcattccttggtgctctcagagtgcagctgacgtactgccgtgctgggcagacgcctgtgtgcatgtgtgtgcgtgcctgtctgatgtgtttagcttcaattttaaaaattgttctgtacagagatgcagtgaatcgggaaagcagagtgggcagagggaggcagccctgttcccagtactgggtgtccagagggctcaagagggctacaaagaatctgccccagtagaggcccctcccttgggctcagcacgaaagggctttcaatgaattacgtgaaaactttctccttttttacaaaaatgcaaaaatcaacaaacttattggaaataaactatgaacttgccgtggcttgtttatatgggatgggactaaggacgaggacatccagacttccaggggcacgagatggaaatggctgctgcccgttctccagggtgaagagacagctgaagcagcctagagtctctgaggtgcaaaggcagctcaggcacccccaagccagaccctcctagccttagacagtgacctcccagggcatgtgactcctgctcagtgctctgtggcgtgctgcgagtgcttcccttattgatgggttccagagagtaacagggtccttcaccatttctctaggcagtggacaagtgttccttcctgagtaatttacatggaaggaaggaggggcggtgcc

SEQ ID NO: 20758 - DNA, 1847 bp, Mus musculus
aagggctgggtgtggttcagtgtgcacttgcttgagtgggctgggcctgggctctatcccaggtgccacagaacacaaatccaaaggtacggtgagatgaggactctgtggcttcttggcttatggtgacctttttggagtcagaagatcacctctgtaactcagtgttctcgcctacaaatgggcctaggagcttggatgagggcggaggaggggctcaccgcttgctgctatctccccatgtgtttgctttaacagccgaggccaaggctgcagaagccgctgccagtgcctattacaacccaggcaacccacacaatgtctacatgcccacggtgagttggcaggggaccgccttcttagtcacgcagcctgggagctggcgttggaagccagcacagctagtcctgtgatgtctcatgtgaactttttttttttttctctagagccagcctccaccaccaccctactaccccccagaagacaagaagacccagtagaccctgcccacttcccgcctcttacccagagaccccttcctgggcctcccgtggggctgcatctgggattccaggaggccagggagggccctgttcttccccaggcctgagtataaagttagcaggagctagccctgatagaaaggtggaactcctggcctctgagaggcacgtcccagcttctcgccctagctcagctcacagcgctcttcttcccagcttccctttcaccatctctggagctcgcaggagcacggggtgaccctcgttcctcatgatactagcccccacccatacagagggactctctggccactcctcactgctgcccagccccttcagcctggtgaccattgttcttcatctcttgggctcctaagaccagccatgtgtctccccaacaggccctgccaaaccctgttcacattccttacccctggtgtgctcctggctctggaaggccgctgtcccagcagactgtcagtccagtcacacttacccggccaccttgttctttgtgagagcttccagggattttgctgggcgcttccagtggctggcatcagaggtgaagccactgtgttacagaggaagcccctctgcccctatgctactgtttctgggaattattcgcctcctctcctctcccctttacagggggctgctctgcaggagggatagagaatgcatgtctgtcccgccaggccctttgatctgggactgaggccttccaactatgtgacctctaacctgcagtctgcccctctgtaagcttcacgccccctggatgcactaagaattgctcttgttcgttcctggtccagacacaaaatgaggagatggttatttaaagagaattcctatttatttgacacaaaatgtccagttaatatattaatgtgaaataaaccctgtttgcaccttgatttgtttgctacaactgtgaaatagtaaaaacgaagtgactggaggttctctgactcttgtgtggtgaccagggtgaggtcttccggaggaggggctgcgggctgctgggggcggggctagaaggccggtttccgtctcagtgcgagtggttggttctcaaccttcccacagagcccccacgcccctgcacctgcctgggatggtgtctgtgccacccactgccagcgggggccaggacgaggcctgtgtcccatctgctcctcccgctcccctcctgagcacaggcgtgccaggacttctacgagggagggtcgctgggctggctaccacagtgtgtgccttcatgccaccttacccaggaaagaagacggtggaatatggcagtccttaagccggacctgcaccccactcacagtgagc

SEQ ID NO: 20759 - DNA, 1196 bp, Mus musculus
gttgggaggagcagacaatgggaaccccttcctgggtctccacagaggggaagatccctggagggtgggcgtaagagaccctcctgtttatgcctggtcagtcaggctttctgcccgagctgaacagcagagtgactagagctggggacccctcgtgctcttgggtcctgactgatatcagttcctgtgttctttttcactgcctttggacttaggcctccagcgtctcggatgcagacccacaggtcttcctgcagaacatgaaggtagcaaatagctttgcctctttaaggctgaggggtgccgggtgtgtgtgtgtcagtgtgtgtgtgagtgtgtatgtatgtgtgtgtgtgagtgtgtgtgtatgtatgtgtgtgtgtgagtgtgtgtgtatgtgtgtgtgtgtgtgtgtgtgtgtgtgtgtgtgagtgtgtgtgtgtgtgtgtgtgtgtccacaccatttgggacttttcctttatagtactttgtatatggaccctggaaagttcatgtcacaggtctctagtggggaccgagagactttcctaactgggtctctgacatctgctgctatctgaagagtagagtaggatgaagtcccctctaacgtctgtccctgcctctcctgtgttttgctccaaatcccttgccaagagggctcatgacggggctggaatgagtctttataccgcacataggctggcctgaccttcagccccctctggcctcactcctcagtcagccccactcttatcctgtgttgtcaaggcagggctcttggttccagccttgtgaagccgtgttcatgtccccccagagccagcagagcttggtgctgggcatgactgtcatatcctcgagttgctccttgtggtgacctcgaggctctcgtgtagtctcatgacccagttcccaaggcccactctgctccccactggcgccatgttctttcctctctcacaggtttcctctctctttttgacctttcacagttctgtgcctgggcccagcagcccctagcccagagccctgctccctctatgcaagtcagctttgtgtcgccacagcggagcactccattacaaaggacatttctttagctcagtctgggaggttctgtgtccgagatgaggtgggagcgggggtttagcttctggtgagggtggcatatggcggtaggggagaaagtgcat

SEQ ID NO: 20760 - DNA, 1106 bp, Mus musculus
attacatcagaacaattggtatatcaatctctgtagacatttatcttctgcgcgcgcgcatgtctgtgtgtgtgtgtgtgtgtgtgtgtgtgtgtgagagagagagagagagagagagagagagagagagatagagagagctcagaataatcaaaatatcctctctgctagatgctttgaaataattcaagtggttggcaacaagtaggcctggggttacacagtgactgtaatcttagctgcccaggaagttccaggcctaccagggatacagagtgagttcaagggcagcttgggtatcttggcaaggccatacctcagaaagtgaaaagaagaagggagctgggggaaggaagccaagctcagtggtggcaacacaaaggtaaaggaatttttctaggagagataggtatgaggcaggagagttacatgtttggtaatgcctgcataactgtcactgagcgtgaggccaggctagccaggacacagaagagtttctagacagacaaggaaagctgttcagtgagaggagactctgaagtccctgtgttacagtgagaatatgttttgtggtctgaggcttctctgtactcatcagagatgcgaccggggagggcagaggctggagatgcatcaggcaggcaggttggaaggcaaaggctgagtcctgcaataccaggaaaatggctgggaggtacttagggccggctgaagagacagagaaggtgagagagtccaggagacccaaggggtgaagaaggctgcagtagtaggagtgaaaggtcaggaagatactgagaacaaacagggtgtaagattctagaacaaaccagtccaaggtgcgaggtgggtgtgggagggagaactggagcagaggtaaactgctgtaaacagttatcagtgggaaggagccgggcgtgtaacaggaaacccgagcagcaggtgaactctggactcacctcctgcacagtaggacctgttgatatggataaagccaggtttcagccaagtcccagagaaaaggtgagactcttataaggacactggaagagggaaacacagtacaacagaggaaggacacaggacccaggagtgtgggcagggat

SEQ ID NO: 20761 - DNA, 1191 bp, Mus musculus
gaggcagggagggagggagggacatggggccagaacactgggtctttgtgctgaggcagttctttgtgggctaagcatgaagcttagtggtcaggcacctgcctagtatacacagaaatctgggttccttccatagcaccccaaaagcaacaaaacaaatgtgaaaagttccttgcttattggtctttgcattctctccaggcctacacggcttacctctcaggaatgttgcgctttgaacatcaagagtggaaatctgccattgaggctttcaacaaatgcaagtaagtcctccagtccagaaacgatggctgctcttagttacagccacagtccggctgcagaaccctgtgactggcttcttggaatctaggacattttctttctcagagcatgccactcctcctggtactcagcagatgccctcagagggctgggttttggttttaaccacatggttttcctgagttttcttttcttaaatacagcttccatattttaagaatgtctgacatctctttgctcccagaactatctatgagaagctagccagtgcattcacagaggagcaggctgtgttgtacaaccagcgtgtagaagagatctcgcccaacatccgctactgtgcatacaacattggtgagcaggctctggtgtggtgctccagtgcggtgctcctcgcctcacttggcttgctgggaggcttgcgtgactttccctgtgtttcagcatctagccatggcctgagagtgtttgtttgtttgtttgtttgtttgcttggttttgggttttaccatgtagaccaggctggcctctcactcatagagaccccttgcctctgcctcccaagtgctaggattaagggtgggcaccacacggtacagctgggttagccttagatgtaatgatagtaatagtagagctgtctgatgtatactgtgttacacacacacacacacacacacacacacacacacacacacacgacaatgatgaagagctgtctttgacagccccactccagtctacagaccttggctgtttggcttctgtttgaatccctttattttctccactccccaagaacagtttagaatttccaaccaatgttatcttacagttttggagaagtttcaggtatacagtatatctaagtgaaagattagagaattttcaaggtctccctgagtc

SEQ ID NO: 20762 - DNA, 1160 bp, Mus musculus
ttcaagatctgacacccgcacacagacatacattcaggcgaaacactaatgcacataaaataaaaataaataaaattttaaaaaattaaataaaaggaaaagttaatcattcgttccatttgtgttgtgggcacacatgtgcgctaaggacaacttacagggcttacccctctccttccctgtggcagtcattctctgagatcaaactcagtacctcaggcatggcagcagacaccgcacccacagaaccattgacctgctatttcatacgtgtccagccatttaccacatgttgatctcttgggttgtttctgcttcttgcccatcgtgagcactgctgtatgaatctttgtctgtgttctccaggcatgattcgtaaatattttctcagtcttttttttttttttttcactttcttgttgataacacttgacactaacttgcaataatccaacttagtcagggtttctattgctgtgatgaaacacggtgaccaaagcaagttagggagaaaagggtttatttgtgtacactttcacatcactatccatctttgaaggaggtcgagacaggaactcaaacagggcaggaacctggaggcaggaactgatgcagaggccctggagggatgctgcttactgacttgctcccatggcttgctcagcctgctctcttatagaacccaggacctccagcccaggggatgggatggctctacccacagtggactgggacctctgccatcaatgaatcactagttaagaaaataccctacagctggatcttaaggaggcattttttcaatggaagttccttcctctcagatgactttagcttgtgtcaagttgacataaaactagccagtacatcaacttacctacttttttctttttcagatttgtttctgacaagcacacaaattaacagtgacaatgaaagaaaaaaaatcaataatgcttgttaagccaagtctggcctgcgagcatcacgtgtttttttgtttgtttgtttgttttgggggcagggcctcactgtgttgtcatggcaggtctcaaactcagagacccacctgcctctgcttcttgagttgtaggagtcagggtgcgcactaccacacttagaatgaccatcagtcgtgagaagcagaagggaaagaagtg

SEQ ID NO: 20763 - DNA, 1168 bp, Mus musculus
tacagtctccccatctgtccatgggttacaggcagcgactacctagctagggaggggcagccgtggcacctgccagcacctgctcctcactcttcctctcaggagtggctcatgcagccagatgtctcacgtcacacacatcctgctagattctgtgttgactcctgtgctgctgtactgggacaccatgtatgcttggcctaaggaatggctcccagaacctctgttgttccttctccaggtacctggcagcatgaggataacactgtcaactgtcgccatacccagcgccggcgcttatcctccagcagcctggaggaccctgaggagaacaggccttgtgtatgggatcctatggctgtctgagggcatctgcacctccacctgggcgtcccctcctgtccttgccttccatctgccctcactggaccacgagccttctggtcatcttcaacaagactcgtggacttcctactcacatgaagggaggacgatgcgcaaccctccacccacctgcctcatcgcctgtaaccgcgattcttaccctctcagaaagaaccagaagccttccctctgtgggctaatacgtgccagccaaacctgtgggccagctgagctgagggtcagggctggttgtttctgtaggctttctcttctgagtggagaccaagaagactgaagagtttggcagccttgttagacgcccatggacaggttttggtctctggcactcataaacaattagaaacctaacttgaactggttgggaacttgctccatgaggaaggccatccactccggcctcccagaacaccaggagctccttgcccacgcctaagggagagggtagccaccgaactattggttggaagccagatctaacagagttggtctcctgcacctccggtgtccacagttaggaagataccccttgcaaggcctgtcctcctccagtgcagtcaggaaggcctactgggccacttccctgcagtgcttgggcaggctcttcccatatcgtcactacagccactgagggggtcttgaacccagctaaccacttctctgccctctttgtaatagctgaagaactaggctaagagctgaggcccagtggttctcaaactggtgcacaggaacaccaaaggaatggtggaggctctggggccag

SEQ ID NO: 20764 - DNA, 1173 bp, Mus musculus
atgtggctgacttgaagcacggccccctgcagggctggctggggtggggggcagcaccacaggctgtggtttgctcttcagttagatttgtctccagtgagcctggaaacgcagcatgccctgcaggccttgggaggaggaagaggggtggttagggaagtcactctgcccatcccagaagccagactccctgtcctctctgctcccaggcagatgtgtgccgcggcctgcgtacagtagccctggatacggttgctccagcagaggtcatcctagatgctcctgctttagcacgggccattgccattgcttgaggggtgtcaggggtgcatgccggcttgactgctcccagggagcacatctgcccagggctaggagcttccctgcctctcaagagatttcagaacccaacatggcttccccaaggaaccttttcttctaagatgcacatggtggccagcttgttggcactcacctcttcatagtctccatggagggtttgcctcctttcttttcactgagaaagaaaggaggagtttaaaaaacaataatgcctacaactctcccttgtcctttcatatgacctcagctctctgggcagtctctgagaacctccagtaacaaacagcctcagcctcctgagagtgaaaatcaccattctgtgaacagtcattccgatgtgctgtgcagaactgcgcaacccagagccatgagtagtgcactgtgtctgcttctgcaggcccttcggtcataagcacacctcactcatgcctgggagtcacaggcctgaacaggggaccatctcacctcagggcctcaggccacagtgtcatcacctcagggcctcaggcctcagtgtcatcaggctagcccgggtgcagctgcccttctgacctatgtctggcagccttccataggaaccagacttattaaggaacaactagaaaggggcacctaaagaaatgagccagggtgtccgcgagaacccgacatgcccacacaactcagttcacaaaccagggtgcccgcgagaacccgacatgcccacacaactcggttcttctgtccactctttacttgattttatcgtctttttttttttgacacatgattttattttatttttttactttttgtctccatcttaaaacttttatttttttttttaaggac

SEQ ID NO: 20765 - DNA, 1192 bp, Mus musculus
tgatgggaaaagaaagtgtgtgaatgatggagccagcactgtatgtgtgtaaatgaggctgacccccaggtgcctgtaggatcagggttaacaaactgctctatgtgatcagctaagggggtttgttctttggtgtttgcaagcctctgccctgcacacttggttgtctcccctgaaggatagatagggcttgcagctcctccctgtcacctgcagtaaaatgcagaagctttttgccgttaacttggccacagtgagtcctttggtgtttagaacttcaataagagttgttagggtttgtttgtttgtttgtttgtttgtttgttttttaaattagttttccaagtattgaacactaacccatatacgcttcatatgaagggagaaaaacagataaatcctgcttttttgacaccatcttgaatcctggttttcccgcacagcaagcttacctacttactgtgttggaggctgcctcctctgtcaggagtgtgcctcctcctcctgcctcactgtttttcattcacccaagagcatcttccagttggggacagccatgtctttataaatacactcctgctcccactttgtctctgacagttcccttacgctgccccgcctccccaagaacctgtgaagactctgagaagcctgatcaacatccggaaggacacgctgagacttgtcaagtaagtccccaagggcgcaggccaggtcccaggtgcccttctgcttgtggggcaacaggtactccacaggagtcagagcagctcctgacagccacggcctcctgcccgcgctcagatgacagctgctgctgctgctgctgaagcacggctcctaagatgaggcctcctcaggctggggtgacttggaacatgaccgtgggcagtgctctctacaggatgaaccttctcctgcctgcaccggcattttaagtactctctctattctgtggatctaaaatcaaagaactctagttagaagaaagggaacgtttgcagacaccccaacaagcctgtgtactgatgagctgcttgagttaggagtgtaaaagccaattttagttggttatggtgctgtgcacttctggtctcagcagtcaggaggcgaaggcaggacaacagggtttgaggccagcctgggcttcagcacaaaacacggaagagagacagagacacggagagaagac

SEQ ID NO: 20766 - DNA, 1267 bp, Mus musculus
gtcacagctgcaggacaggttgcctgtggcaggggctgtactttatgtctttctatcactagagcctaacattagcctagagtcccagggaggttcaaaaggatattaagagaatgagggagcggatgaggccagcagatcagtgtttgtctggcagacagggacaagggactgatgacagttggctggctgtgatgactatgaaaggaaattaattattgtctcaaactgtgaaaaactaagagaagaactgggaattaagagtgcttagtgcactccttttctccggcggccgggaagatggcggactttcagatggagcctgcttaccaaaagcagcctacgatctttcaaaacaagaagcgggttctgctgggagaaaccggcaaggaaaaactcccttggtagtacaaaaatatcggtctaggcttcaggatgcccaaagaggccattgagggcaccacatagacaagaaatgccccttcactggtaatgtctccatccgaggtcggatcctgtctggtgtcatcacgaagatgaagatgcaggggaccattgtcatccgccgggactatctctattacatccgaaagtacaatcgctttgagaagcgtcacaagaacatgtctgtgcacctgtccccctgtttcagggatgtacagattggagatattgtcacagttggagagtgcagacccctgagcaagactgcgattcaatgtgctcaaggtcaccaaggctgctggcaccaagaagcagtttcagaagttctaaggagactctggccaatgccctagaacaaataaagttattttccaatgtaaaaaaaaaaaaaaaaaaaaaaaaaaaaaagagtgcttagtgcagccaggcagtggtggcgcacgcctttaatcacagcactctggaggcagagcaggcggatttctgagttcgaggccagcctgctctacagagtgagttccaggacagccaggactgcacagagaaaccctgtctcaaaaaaccaaaccaaaccaaacaaacaaacaaacaaacaaacaaacaaagagtgcgtagtgctcttctagaggacctgagtttgcttcgagcacacacatgaagcagctcacagctgcctgttaactctagctgtgaggaacctgatgtcctcttcaggtctccaaggccacctgcactatatgcatacactcatacagacatacagatattcgtaattaaaaatagtaaaaatgaagccgggtatggtggcgcttgcctttaattc

SEQ ID NO: 20767 - DNA, 1240 bp, Mus musculus
atggatggccagagatgagactggacgccactgggctggagcagggggcagtccagggttgtggggacacagatgagggctgggagggggggaacgcaagagggcggggggtttcttcacgatcgcactggaagattttataagagttttggggggggggggacagtaaacgtcctgagccacttgggttcttcaggagtttctcttagggaaagtttttttttcctctttttaatatataactataatatatatgaatataaatttagctaatgtttgtgagagtggggcctgcacacgtgttcctgtcagaggcaaggctcacattccttgccagcacctctttctctgcccaattgaggggaacaaaagggtgttcacagatggagcgagcttgcagccgcgtggctgtgctgctctgtgagaaggcgtgccagccattaggaagccccaccgccaaaggaggtgcacccaggagggtcctcagaatcatggacttctaccccattgctggtagacaattttcatctctgctggtggtggcctcttgttgactctgaaacttgtcaccttgtcaccagctagatgtcaagacttggctgccctctgatgtgggtgcttctgccccttccctgttctaactgtccgacaggctcccagtctctgtgtgtccaggccagaggaccagcactcaggagagtctgcctttggattgagttcccaaattagagtcatcgcaccagggtgcaattttaatttaaaaacttaaaagacttttctaacttccctagtttgtgtttttgtttttgctttggtggggaaggtcagtggggtccctggctgggggcagggcattgtcatttggcttttcctaatgaggatgcattgcccaccatgtttggtggtggtagtttctgagccagcagctcttagcctcctgcaggatgtcaagcgggcgacccatccgcagtgagttgctcctggaggctcctgtggagctaaatctctgctgcccctcaactctgaggagccaaacagcagaatgggaaagaccagaaccaaaatgaaatgaaacttacaggccccagccaggaggccaacacgcgcgcatgcgcgcacacacacccctacctctcaggtggagcagagcaatgggcccagctaccttctactgtatgtgacacatggctggacttgggagctgggtctgtcctttcggttttgtttcctagttacaacc

SEQ ID NO: 20768 - DNA, 1240 bp, Mus musculus; identical to SEQ ID NO: 20767

SEQ ID NO: 20769 - DNA, 2002 bp, Mus musculus
gcacctcccagcgttagaccaaagaggaggaggaagagctaccgcagcttcctgcctgagaagagcggttaccctgacatcggcttccccctcttcccactctccaagggtttcatcaagagcatccggggggtcctgacacagttccgtgctgccctgctggaggcgggcatgcccgaaagcacagaggacaagtagctgcccatgcttgaaagggagtgtcatggtgggagaggtcagccgctgcctgctccctcccttcctgaggtcctgcccctcttcctgccccttcctgtacctaattggagccttctgctgccctctcctccctgcggcaagtttgatgctgaagtgcaagaagtgtcccaagatgctgcgttctatccctcagttatgtttcaaaggcaggcacctgaggcactgggaactcactcaggttccccgtcgccccaggcagagagtcctggcacttgttctctagctgtcccttctcaggtcagaggtggggtgttgaggaacctgcagatggcaggagggtgggcgtgccttgcatgaagtgtggctgctcctgcagtgttcccggtccctctcctctccagcttgacagtagcctccccacgtcccagcccctcctgcgccacacaccaggtccctcatcccctgtacctccatctcggagctgtggctgctgtggctggctctggcctgccagtgcgttatagcccttaggcctattgaacttactctctaagagaggataggacaccaggagaggctgcagccctcacgtgaacggagttgagaatgtgctgcctggacagaaatggctacaggtgccttgctcttccagtccaagatggcagtgataatggcagtcctgcccagacctgcctgttatctgctccatccagcctcattttatccccactgaggtgacaggagcatctgcacaaaccaggccagcgacaagggcctctcccatccggtggctcagcctctccagtcagccttggcttatagactctctgcaagggcagtctgaggggggaggctggccggcagcgggagctcccccccaccccacaggcccagaggtttacaagtttctaagcttttgataatgtgaagctccaggtagagaggatgcctgccggtgagcacattacagctcttgtcgtttctggtgtatgtaatatttaaggttgaaaaaataaatctcaaaagcaaagatactaataactcttactagaaaaaaaaaaagacagacaaaatacaaaacacaaaaaaagccaaagcatgatgcgtcttgtcagccttaagtgggctccacacctgtgctgtgccaggaccaccggggcagcagagccttgggaacactcaccggggacatgggcctggtgggccatgcttcccgggccattgttcacgtggagatgtgaatgcctactgcttacaatacctgtataaagtgctgtgtgattaaactttttttttaacttgcatttttttggggggagttggctcattaacaaaacaagatggcacattaaacctgcctctgccattcattcaggctgatgttgctgtctgtgtgccaggacccaccctcctatacagcttccccaagggagactgtggtggtgggtctggctccactgcctgatggccttcatctctcgtcacgtggagtctgttggggtgagtgtgattatccagacaacagccacttctcaacgctgggtagtggaagccagtatcctacagctgcctcttcaggattcccgggaaattgacaccacagcatctagcaatggtcaagtgtcagtattgtgggctccagactggaacggttgcccaggttaggggattggcatctaccctgtcccacggcttccttttcatttctgcctagaattcctgttaagtgcaagcagggaagggctgaggtgtcctgggtggacccagagatagctcatgggtgtagcccagtttattttttaag

SEQ ID NO: 20770 - DNA, 1200 bp, Mus musculus
agacagcacatgcctgggagacatcagaagggagtggggctcagtggggttcagtggctcgagcagggaaaggtggccttctctttacaggactgtctgtccagatccaccgaaatggcccaccgccttgctcttcccagcctcccacttctagatctttgtcttaacacgcctcacagcatgatcaacagtagacaagacagcctgtgtgcccatccatcaggaatggagtcttggtgtgttccatttagtgaggcctttcctgtcaaaggcaaagacgccagtctgtgtgtcctcaagggaaagacgcccagaccagaccagagaacctcagctgttttaaaaaacctgtgctgtttccaggagagagcggccgccctgagggatgctcaatgtctgctttgccacactcagtctttttgtttagtgactgggatatggctgatttgggggagcgcttaccttgcaggcatgaagccctatgcttgatttccagcaccacattcacagctgtaatcccagaggcaggagaatgaggaattcaaggtcccccttagatacagcaggttcaaggccagcctgagacggaaggagaaaatgagaaatcccaggctagtggtagtttctgttatctttctcgttccttcgcttctttctaacagatgtagcccaggctggtccagactgtcctcaaactcacaatcttctgtccttggtcttccaagtactgggatcagaggcttgtacacagaggcctgttatgttgctaggctagccttgaaccccaccccacctccggaaccaaacagccctccctccctcagcctcctgagcagctgggatcacaggtgcacaccactagaagtggcttccgcttaactccaaggagggtctaggcacacttatgggacagaggacctgcatggtgggtttctcttccctctgggaattagactgagctaccacttcctgtgcataactctaggcctgcttccccaggaaatgcacctgccctgcagggttgatcgctggtcacagcagctgatgcctgcccagcaacaccaagagcactttattggcagtagtgtgtctggttgtcccttgagcctctcccccagcaccaaggaagggccctttgtctgtgcccaacaccctggccactgacttgctccgaccacacccacttctttctgctccttt

SEQ ID NO: 20771 - DNA, 1206 bp, Mus musculus
tgtgaggctcccctcagagcaagagccaaatccctctgaggatgggctggaaagaaaaaaggagtccttgagactgctggtcaacttctggagagagtcagccctgagaccctcggctttcatctctcgttggtttaaagataccctttcatgtgtactatttcggtatgtgggatacgccttaaacgtttcagtgaaataccgaatgtgagatgtaaggaagaagtcttattgtttaagtttcaagctgcgggttctgttgagagttctagttctagttagcctaaatgatacccacactccccatttcctcacgaagaattccctggaatccaggtgtggtggcgctacctttaattccagcactatgaggccagcctggtctggtctacagagtgaccaggacagccagggctacacaaagaaagaaaccctgtctcgccgggcggtggtggcgcatgcctttaatcccagcactcgggaggcagaggcaggcggatttctgagttcgaggccagcctggtctccaaagtgagttccaggacagctagggctatacagagaaaccctgtctcaaaaaaccaaaaaaaaagaaaaaagaaaccctgtctgggggggggggggagggaagggagggagggagggagggagggagggagggagggagggagggaggattccctggaagaagccaggcatggtagcataaacctttaatctcagcactcacaaggcagaggcaggtggatctctgtgagtttaaggtcagcctggagtgagttctaggctagccagaacttcacaataagtttctgtctccaacacacactcactcacacacacacacacacacacacaggaagaaaagctatgccttcagccaccttatctgcaaatccatttcctctaataaaattgccacttaaaacggagttttagggctggtgagatggctcagtgggtaagagcacccgactgctcttccgaaggtcaggagttcaaatcccagcaaccacatggtggctcacaaccatccgtaacgagatctgactccctcttctggagtgtctgaggacagctacagtgtacttacatataataaataaataaataaataaataaatctttaaaaaaaaaaaaaaaaaacggagttttaaaaataaacaagtttgaagactatgcagtattgtctggacctcatctgtt

SEQ ID NO: 20772 - DNA, 1203 bp, Mus musculus
ccggtgtaatttggggctatagagtgtcgttctgcaactcaacgtggttgccagaaccggatttccaaaaatgagttgggttggcactggggggtttggggggcctcttgctggttgagctgaggatgatttaagttatccctgtctgaaatgacacttttgtgaagagtcatggtttactgaggctcgacgttttgaggtctgttttgagaatgaccacagtaaggttgcttctgttagaatgaagtgggatctctttattactccttcagacggaggtgttgtctccaggaagcatcatggaaaggcgtggtggtgcacaagggccttcaggatgcctgcgcctggtaagagcttcatagagtcgcaggggttgtggtagctgggaagggttggttgttaggtttggggtgggggtggggttagaggttgttggggattgattgtccagaggagggcgtggtcctccttactcagcactctcacaagctgcatttaacattggtgaatacaaaattgttcctcactcaactgctaagtaaactgacgttcagtgagtgggttctgtttcttttgtatatgcgtgtgccactgcatctatgtgtctggttgacttgagtgagtttggtttcccctttagccaccaagctgttttttggcctagaaattgggttaagtaaagatttgggcctgctacctgggagtagcacagagccttgtcttctgtaacacagaatcactggcttccaaacctggatatctctcagaacacgtaaaaagtgttaaaatacacacatttccacccaggtcagtggatgagacgggtatggagtggaattaagagtcctcgaggtttgagcaggcatggagaaacggtttgatgaccattctcacagcaagaccagagcactggctatgtttaagcacctcctgagataggtttttttaatcctcagtcttaacagacagccatatgcttttgtacatgtgggtggggaaaggagacactcctttgtatagtgtcacctcttagtggcaggtgtggtaatggctgcccttcagtagggtcgctgtagtgggtgacctgtaccattttagggatttcactgatagtctacaaagacttgccaaagactctggctcagctgtaaggcagatgctgctggaagtgacctttttccagagtcttcccttgtaacctgg

SEQ ID NO: 20773 - DNA, 1203 bp, Mus musculus; identical to SEQ ID NO: 20772

SEQ ID NO: 20774 - DNA, 1625 bp, Mus musculus
ccttcgggatgcctctatctggtaagagcttcacagaattgcaggggttgtggttgctgggaagggttagtctgttagatcaggtgctgcagaatcgagtgtaacccttcctccctttagtcttactgtgtagcccgtgctggcctgcaacttgctatgtagacctggttgacctcaaactcagtttgtggcctttcaggtgctgggattttcatgttctcattttgtgttcccgaaaagcccataagcctatgatggattggttatccctgtctgaagatttcagctgagggaaaatactctattctgaggcttaggggtgtggctccatgcttgaagaaatttgagctttataagggatcaagttaaatagactccatagagagctgtgtgccaacctcccaaaacctaaggtctagttgcctgttaatcctcctccttgggtgctctgagggcaaagtccctgagttagcagaaatgggcgggctgccagcacctgtcctgtgctcactggagtgagacatgctggtcacatagttctagaaaatgaatgtcttcctttagaggaggcagggatgtaaggcgtgccatgagaatgcttgacgactctgtcgttgcctctagcggtgctgacatttagaaaagaagttgtggccctggcagcctcctaagtatcgtctccttgatggcacagaaacaagtggcgggcttgggggggggggggctttgctcagcccagccttagtaatgcagtgtacactgtgtcctttttctctatggaatctggggggtggatatgggcttacactaaagtagctgtacttgtggaattctctgcagggtggctctgcttgccttcacttctgagtggactcaggttcaggtcctcagggatttggttgaatataaatactctgatgtttcatgagaaacctttttttggccacttaccaggaacttcttaaaactttcttttaaaaaaaaagttagcagcctgcttctgaacttggctggtgcctgcctgtgtgtagcgcacacagtgccttgtgatggcggctggaatcccaggactatctgataatgcttgttcctaaagtttgtagttttgatcacttagctgcctgtctccttcaggttctttccttgtttctaggttattgccctgtagtgccagagagaaccacatagcctgctgctgctcctgcctttaatttcccaaagagtcatcagacgaccttggagtttgttctgcaagaggagccagtaaggcctcgtgactgtggtcaccctcggaagcctttgacagctagctggtgagggcgctcagtcggaggccctggggaggcccctgctaagccgagaaaagcatttctcacagtggatttcctggaagtcagggttggcctttgtattttgaagcacaaataaactttataaaatttaacttggtagcattgtgggtatatgagtgagccttagaaatacttaaggaccacttgcactgaactgtagagaatcagaccttttctattgacttgctaaaatttacttgtcacttaaagcataggttaacattgcataacacctcaaccatccggtggtaatgtgctggagggcacaggcta

SEQ ID NO: 20775 - DNA, 1625 bp, Mus musculus; identical to SEQ ID NO: 20774

SEQ ID NO: 20776 - DNA, 1129 bp, Mus musculus
tcattggtgttagggaaggcgaatgtccacccggggactctgaagcagctccccaagagcgtattcccagtacatcacagaacccattctcagtccttatgacctatagcagcgccaggaaacaattgttaggtaatcacagggtgggggtggggcaccccgcaggggctagcctgggctctgtcacagcacccattaaggacacgtccaaagctgttctttgggagaatggatcattatgtcctaagaaccatgagagggggtttggtcttctggccacagcagtcacctaagtttctaagcacaagacactaagaggaactcaggccaggtctcagttgtcatctgacatccaggaagtgaggaagaggacatggcaccctctgttttcaactctctggaccgagcctggggaggcaatattcctggctcctgggcagagtgcctatctaccagggtcagtggcatgaatactggatccagctcttagtttacagagccgtgtgttcagtgggccagctgccctgttgcttgtctgtccaccagcaggacagctgggacagtggcctacagctgaggtctgttcacccttcaaggaaagactacctctcatccagtagggctgcatgggccccgagccacctcaaagactagggaaccctgacaaatctgcctttagctttaacggtgacacttgaggtggccaagcattacctcttcattcgcgggacagagtcccatgagccccccacagttcacccaggagttcccagaagacacgcccactgtcagccaggttacagtccccactgctaaattatgctgaatatctagggattattaaattctgaagagagttttctcttcccttcacataacttctcgtgccgtagccagggctagagagccatcagccagctgctccacctagccatgggtcctcagaacaagaggggaagcagctcatgtgcccccacccccactcccttgtcagcagctcacctgtcccctttatcaggaccttctggaacaggcacacccaggatggcggatctcagcatcaggtagtcacggatgctggaggggatgaagatgtagcgcaggttctgtaggggcattggaaaaggcc

SEQ ID NO: 20777 - DNA, 1150 bp, Mus musculus
tctctgggtgtcatccagacacacctgcccgtgaattcaactctgagatcctcacaatctctgcctggaatgctctcctcttttgatgttgccagacagcgctttgttggccatggagtctgcctgtctctatctatgtcccatcagctgcacatctgcttagcttcaaaggggcgctctgaagacctgctgctgctgctgcaatggtttctgagacaaggtctctctgtgtggccctggctgtcctggaactcactctgtggaccatgctggcttcaaactcaagagatctaccagcctttgcctcctggtactgggattaaaggtgtgcgccccactgcacctcttaattatctttttattttatgtgtatggatatttccttgcctctatgttatctgtggaccaaatgcatgcctggagcctgcagaggtcagaaaagagtgtcggatcccctgagactggagttacgactggtgtgggctgcagtgtgctttcagaaagtcaaactctggtcctctgggaaggcagccagtgcttttagccactgagccatctctccggccccacctgagctgctttaggactgacccggctttcccacaagcccttctgcctgccttttatctcaatggctggcactctgtccccagtcactagcctcgaggcataatgcaagcttctctttccttcacaacaaagttgaagcattggagtggagagttgaggctgatttatctccctgtaagcaaagaaatgataggcaggcaggtgttacggtttaggttttccgtgtttctctttgtctgtctgtctgtctctctctttctttttttttttttttttttagatttttatttattttctgtataggagtacactgtagctgtgaagatggttgtgagccatcatgtgattgatgggaattgaattcaggacttctgctctctccggtcagccccacttgctccagcccaaagatttattattattattattattattattattattattaagtgtagctgtcttcagacacaccagaagagggcatcagatctcattacaggtagttgtgagccaccatgtggttgctgggatttgaactcaggaccttcggaagaacagtcagtgctcttaattactaagc

SEQ ID NO: 20778 - DNA, 1208 bp, Mus musculus
ttttggtttgcagtatctctataaagaacattgttcctctgtagacaaacttgacagtgaattttgttgtttagaagagaggaagtgctcttggctaccgtgctctctctccagatgtttctggatgttccgttgacttattacgtgtgtgcctgtacatctgagtatttactgtagcacacgcggaggcagaaagtgacttgagggagttggttctctcctaccaagtgagccccagggattgagcggaggtcctgaagtttagtgtcaagtccttgtcccggccctgaattgtttttcctccctgtgtccagtgtgaatctgggtcagaaggtgatgggacgacacaccgcaggaagaagaggagaacctgcagcatggtgggaaatggggacactacctcccaggatgactgtgtgagcaaagagcgcagctcctccaggtgaccacatgtggccgctgtctgtgccaggatatgctcgcagccaggcttggggggctgacacccagagaacaaggacactcagatgggagttggtagtacgtggtacagtggcttttctctgtggtcatgtcttaggggcaaaggcgtgtggatggtgccaatgaaaccctttacctatttaataaaaacggatacattttatactgtggacagctttctttggggcataccatagtctccctaagctcctttcctggggtgtgtgtacgagggggtgcctgctgctgtgtattctgttgggcgtgactagggcagtcgggaattactggagcagttgtcctctctgagagccatttccaggtgccgtaagcaatggaggccttctctctgagtccgtgtcaccgtgagcgggtgctgccagcagctgtcacagccctgagaacattgcctcatttttccccttggtttttcgagacagggtctgtatagccctggctgtcctggaactcactgtagaccaggctggcctcgaactcagaaatccgcctgcttctgcctcttgagtgctgggattaaaggcatgcgccaccacgcctgaccctgtataacatcttaatcattcctctagacttgtttctgtttctctttttaaacaagattagttctaagtaagccaggtgtgggcgctgggtgtgtttaatcgaagcatgctgaaggcagaggacagccagatctacacagaagaaacctgttccaaaaaaga

SEQ ID NO: 20779 - DNA, 2133 bp, Mus musculus
atgaacttttggaaccccaaaagaaagttacaggtattgatccgcaccgggtggggaaaggatagtgtgtctttaactctaaattgtttggtcctatttttctttttaaaggaaagggccctaagtagctgattaagaacatcctcaactgccaaacgtttcattttcaaacatcttacaaagtgtagactaatttctgatagcaagtttttgtttggaaacagccccaccctgcccccctaccttttttttcttttaaccctcccttgcctccttttttttcccccttttttctttctttcttttttttttttttttttttttttttttggtcttggttatttggccaagaatcacatatatccgaacatgctggtggtaccctttggaaaaactcccatttgggcctttaaaaaaactgataatggccaggtggaaccttctgtaacctacttgtttcaccagagccttagtaagtacatgcctgataatgaaaccatgtgcactttggaacctttttagtagtggaaagtaagctgaacctctttcttttcaaacctagatgaatcggcaagcggcttaacagaggacattgggggaaaggaccacaaactcagtccatcggtccatggaagagtccttggaacaagcaactggctattaaaaaggttattttgtaacatttgtctaactttttacttgttttaatctgcctcaggtggcaaacttcattttatgtgccattttgttgctgttattcaaatttcttgtaatttagtgaggtgagcgacttcagatttcattattggattggatatttgaggtaaaatttcatttttgtttatagtgctgacttttttgtttgaaattaaacagattggtaacctaatttgtggcctcctgacttaataaggaaacatgtacagccattacatacagcctaaagctgtcagcagaatgactcaacattgccttcacttcttaataattaaaaacctatgaaagttggtgtaatttgttcatatatgttatttaccttcaggtctatatgataatctgaacccaaatttgtataaagacttttcaggtgaaaagacttaattttttttttaaaggattgtttacccaacacaattctaatctcttctcttatgtatttttgtgcactaggcgcagttgtgtagcagttgagtaatgctggttagctgttaaggtggcgtgttgcagtgcagagtgcttggctgtttcctgttttctcctgattgctcctgtgtaaagatgccttgtcgtgcagaaacaaatggctgtccagtttattaaaatgcctgacaactgcacttccagtcacccgggccttgcatataaataatggagcatacagtgagcacatctagctgatgataaatataccccccttccctcaaaaaatgcaaaatggtaaatctgatcatccttgtgttgtgaacttttaaaaaaaaaatcaaaatgttaaggaagcaaatggtttgtaactttgtaagtacttaaaacatggtgtatcttttgcttatggatattctgtactataaccattgtttctgtagtttgattaaagtgttttcttggtgttagcttttttgagaatgtgtcctggtcttttgtttccctcattttaatccaagacctatacaattatttactttgaatgttaacagccttaaggtataaaatgtgggttggactgctttttactggtaggtacttcagtgtcagtgtggtcctactttaatgattgggagtagtctaagcctttttgaatgtttaattttgttaaagttatgttgaatgctatcctaggcatgacagcacagccacaaggcttacagaattgatcatcttcatacccattgagtttcctcagataattcagctttatgccaggttattccattttgacactgtcccagaacatattgaggtacaattcattcagaaactgtcctttgcaaaggagatgatcagcatttcaacagtatgtcttcctggaagggtagactctgctatgtcttccttgtcggcatcaaaagactccagaggaatatgcacacatttcatatcccacttgtagagcaagccttcaagtgaccagtcagc

SEQ ID NO: 20780 - DNA, 1112 bp, Mus musculus
gctatgtccctagctcaagaatatccgtttctaatcgttcttgggagccagcgccgatccacacaccaaagttggggacttgctactccagattaactgtcctctatctgacagtccatcaagggctgacccttgctcagatttctacttatatgtgaattcttattattttttttcatgtggtcagtttctttgtcccattgagctgaaacctcctgggccgggagctcgccccacccccgcccctggttcttctgtgcacccccacgctcccttctctcgcttgctggctctttgttggcttgagatctcacttagcccaggctgggctggaacttgctatgtcgttgaggatggtcttgaactcctgagcctcctgaacctcacccagcttctttgctcaagcttagaacatttctgtgcctctcctagttggaaataagacactagatggctgtgcgctctgctgacccaccctgctcctctctccctgcaggctgtttgtcctgggcatcggcttcttcactctctgcttcctgatgacatctttgggaggccagttctctgcccggcgcctgggggactcgcccttcaccatccgcacagaaggtaccttgaaagcaaggagaggaatgtgaatgtcctcgaagcagaggggcgatgcctctgagctcagcccctttagcaggttttttgggaccttggccctctgaacatgcagatgtgtaagagaaggggtcctgagtgtcaactgggatgtcctgctgcttgggatctggtcctatgagtgccaccaggattttcaggccaagaaggaggatctcgaagggtcagaaaggctcctatgtcgttttcctgtgtctgggttgatgtcctttaatacagcatccatctctttgagacccatgttgtgtgtttctcaccaggccaggctgtagtaagggacaggcttgcaaaggcctcacatggttcctgtctgggatgttggtctcgcctggtccttctctgtccctggcccaaatgacacttgctaggtgtggaatggagatgcagagtgtgggcttttgggaccagacaggctggaacctgcacctctagtttctagctgtgga

SEQ ID NO: 20781 - DNA, 1205 bp, Mus musculus
cctacgagctgcttgctgctctcctctgaccccccgccccctctgtcctgctcacccagatccttgtccacattggcttcctgacagaggagtctggggacgtgttcagcccaagggtactgaagggcgggcctctgggagagatggtacagtgggcagacatcctggctgctctctacgtgctgggccatagcctgcggatcacagtctccctgaaggagctgcagaggtgagtgccagagagccttcacatcctggtggggtagggaggggatgaagggcagcctggccaccgggctgatgctctgcctttggggcccacagcctggaggtggccctctgtcagatgccggtactccccgttccctcctccacttgcttatgtgcttcccgcttcctcttccatgcagacacacgtttgtatttagaatccacagaggaagcgtgtttgcatagcagcagtctgcaggctcttggcctttgccaagagactagggtttgggtctgtgctcataggctaatgcataatgttttgagagaggagtcaccatgtccacatgaggtccctgccccgagggtcttcctggtaggatgggcatagtcttcagggggtgtttttaggagctggactccttgggcattctacaagggcattagggttgacagtgatgctgactgccagtgctgggcttgtccaggtccttctggaactgtggaacatagacacacccccaccctgtgtgtggtggtgaagagggtctaaaagattgtttgtgtgtgagaatgggggtaggggttgtctggagagtaagaacatgtggaatgcaaaggaactggagtgagtgagtgtgtgtgtgtgtgtgtgtgtgtgtgtgctcgcgtacgtgtgtgagagagggagacagacagatagaatcagagacagacagcgacagagagacaaagtcagataggtagacagacagaggagtactggcagataggagtgtgtgtgtgtgtgtgtgtgtgtgtgtgtatgtgtgtgtgtgtgtgtgtgtgtgtgtgtgtatgtgtggttttgtgtgtgtgctgtttgtgtgtgggtgttgtttgtgtgtttgtgggtgttgtttgtgtgtgtgtgtgtcttgtctaatgtctaattggggtaatgtttttatcgctcatctgttagatgcagacatagctaagctctctcttacttt

SEQ ID NO: 20782 - DNA, 1126 bp, Mus musculus
aatgggtcacccttagggatgatgaccactgagggctgctgagccagtctgtcctggttctggcaatatggtgtgggtgagagaggctgaggtccagcctagcatcagcacagccgggttatataaactcctagattcttcacagcagtggtttggtagctggaggggtgaggtatggcttcctgggctctcccgggggagccacggtcctattcttagccttgagcttgcttactagcaaagagcattgggaaagatggtgttagccttagacaacccacctgctctgtctgcccagcactgagagaacttgcttcctcagtttcctttttttgtcccttggtctgtggccaccgtggatatctctgaatctatctctgtgatttatttcacctgagccactcctgtggggacctgatagttctccctggcttcaggtcaggaccctttaagagcccctgtacactctggggtgtgggtatctgaggacacctacctttccaggaggtgggaaccgagggtgagctctctaggatggcatcaaaagcccgacattggacaaaggatgggcagccatgctggtaggagactgtaattccctgttagcaatacccctgcttcctaaacagttccacagatgctcagtgaggtctctgggttcctccattgtgccacctgatgttctggggtggggacaatgacctgaggggtcatgggagaggaaagggcaatgccagcgatgctaaggagatgggtagagaccaggagagacagaacattcaagcctgcctggtcacatgttcccagcagtgtgacacatctggggaagtccaggacccctgggtgccctttagctctggagccaaaggtatttgtttgagcactttgtaggagatctttttaattaagtccctgctacacacacacaaacacagagagagagagagaaagagagagagagagagagagagagagaggcagacagacacagagacaaacaaacatatgcacacgcacacacacaaagagagacagagacacacagagacagagacaaacaacagacaaacagacacaaacacacatacagagagagagagagacagacagacagacagacagacag

SEQ ID NO: 20783 - DNA, 1190 bp, Mus musculus
tgggtagggattctggagccatggtctctgagtgacctggccctaggttagctgatcctataggagctctggggtttagactacaagctttggaggggggcagtaaaagtggaggagtctcccatgctcaggtccccgggagaccacccatgaaccccgttcttcccaacaaagcatagcttacaaatgactctggacaatgaaggaaccccaaccccttcagacaccacctctcttcctagcctcactccagtggaggtgatggcttggcttctggataccaaccaggggccctgcaggcatccagagtggcctctgctgttccgttggggaagctggcacagagagcgtgatgtaccgctgtggtcacacggtgaggcagtgcctaggtggagcccttgtcaagtactgtacttccctgacctagccacagcacggtcacaggggcactccgagtccagggacaggcaggaaggtttgacctcagtcctggttcactcttggggaggacaggtgcagaatccgagtcatcgacacctttgggacggagccagcgtacaaccacgaggagtatgccacgctgcacggctaccggaccaactggggttactggaacctcaaccccaagcagttcatgaccatgttccgtgagtgttactggcagagaaaggggtacccctcgtatgtgcaggagcgggtctccccatgcgtgcaggggtggggtctcccaatgtgtgcaggagcagggtctcccaacatgtgcaggggcgggtctccccgtatatgcaggggcgggcctccttcctcctgggccaatgggatggccttaacaagtagagagaagcagacatcacagagactctagaagctgtgtccagagctgggactgattcaaggctgggagctctcagaagcacgtggctcagagcgggggtggggggtgggggtggggcccagtggacttctagaagtttccaggacgaatcagagaaactggaagtgggtggggcaaagaaatgcgggcctttctacacaaagggacgataactaagcagatggacgagcctgaaggttctggaaacatgggagcttagttaggttccaacactggggcgagcctgaagaaaggggaccaactcctcgggagcacagtgcctcaggagcacagcgcctcgggagcactgtgcctc

SEQ ID NO: 20784 - DNA, 1148 bp, Mus musculus
actgtgtgtgtgtgtgtgtgtgtgtgtgtgtgtgtgtgtgtgtgtgtgtatctgtgaatttgtgtatatgtgtgtgagcttgagtgtatgtttgtgtgtgtatcatgtgtgtggtgtgaataagaatgtgtgagctggacagtggtggtgcatgcctttaatcccagcacttgggaggccagccaggtctacagagtgagttctaggacatcccctgtctcagcctccggagtgttgggataacaggtacgcaccacgcctggctaagccttgactttaataaaaattgaaagctgtcttttgcagaccgtgcctctggtgccgtagccaagaactcgtgtttatcccaaagccacagcttctctctggcacctctgctggttctgtggttttagtttttacctttgagcctatgattaattttgagttaacactgcaatataatgggacatgcagatttacattcttacaatcccgtgctgccccacgggacccagactcgaatgctctctcccttgctttgcatgtagatgataaatgccctggactgtttgttgaagaggccatcctttctgctccgaaacacgcccccttttcagcaatgaggactgtgggtgtctgtgggatctgtctggactcagatgcgccaccccaatgatctgtgtcatcctgatgtcaccaccctgctgtccctgcccctcctgctgcacacagacccgggggtcaggtgctctgtctgcctatgttgtttcatttattctaggttcaaagcatttccaatgggttttatcctcaccctgtcaatttctgtagcaaagccttctggattttcaggatttttgtttttgtttttgtttgtttgtttttgttttgttttttgtttttcgatacagggtttctctgcatagccctggctgtcctggaactcactttgtagaccaggctggcctcgaactcagaaatccgcctgcctctgcctcccgagttctgggattaaaggtgtgcgccaccactcccagcatcttgatttctttttttttaatgtgttctagaaaatgaatatgaaaagaaaatcgcagaaataatttgaagtcagacctgatgacattttcttccagagagggttagatctgagtcctggcttgtag

SEQ ID NO: 20785 - DNA, 1332 bp, Mus musculus
ttcagctgtgctggtgccagcaccaagtaccagaggctctgcccctgccgtgacttccgcaagggtcaggtggccttgtgccagggctgcctgtgaggccggagccaccctgcccagaacctgcccacccgcacgtggttggcaagcaccagcactttctgagctccggtcacgctcactacgtgtcccctggctgcagcctcccctggccagggatgggaagaggaagctgaggagacagcagctccaggcctgcagctccctcctaggggcttccttgcctcgccataggacctgaggccaagcatgtgggctgacctccctgtcgggtgtacccaggagcacgtggatggagatccctggctttctgaggtctggaccagctggagatgtggccttgaccatgcttggacccagcataggccttttgatccacaaggctgggagcatggccatgccgccccctattcaccagaggtctcaagggatagggaacaggtcacagccacacttgctgtgagggccacaccctcacatgaggcaacagttcacgcagggccagtccagcctcctcagttgcttgggggggggggggaacgacaaagggacagagagctcagggaggctagtgcccctccctgttgctcaaccctgcttcctccagcagacttccctctgggcctctcctgacacccagttctggcatggcctgtgactggtccacagccttggtctctgcccctctggtggccacctccaccctagcttctgacaacaggtcccaggccccaccaaggcctcctctgcagactctgacaacatttccaaccttcgagcatctcatgccggccaggctgggatgaagtttcacccacaatacactaggctggttctgatacgcaggtccatcagacctcccctggctcccacccttctgggccccatacttgcccctcccttctctttcctccagcctcaggccacttcagtacactcagacttcagtacccatctctgtggcatgccctcctccagtcctgggtcacccttccctctcccaccccagggccagccaggttccaggaacactgccattgctcatatatggcccgctcccaggccccctgggaccagacagttgtaggaaggaactttcctgcgtgggacttgccagtgtcccctgtcctggttggcccctgtctgtggcagcagaatccagagcaacaagagaccagtggttccgaggatctgcctgtcggaggaaagcaatagagacacttatctctctcttctctctctcttttttttaaagatttatttcttgaaataaat

SEQ ID NO: 20786 - DNA, 1198 bp, Mus musculus
gctccgtgcagaggggatgcatcctgcgcagcgtggctcgggggcgccgtggagcctcccgaaggcgatcgtgggattcagaaacctctcccgggactcccatgggaggaggctgaccccgggccggcacgcgatcgcgggatgggctggagttgtaggaaggccctaggcccgggccgccatcggcggggcactggctgcttctgtgttgcaggcgccgcacgggttcgtccgcttacacagaattgtattaaattgtctttttatttccccacccaggaaatgaaccacatcccccaacgactagacggaagcacgcacaagctccttcctcccgaggagcgtttccagtgacttgagcttggttggcccaggtatgtcaatccttgggggtgggacggtgacctgaggccgacggtctgggaaaaggctcctgtgtggctgtacccgcccgaggtgggtgcagccccgtaccagacagcccgaccttgacctaaagtaaaatcccagaggaggaggaacctcttccctggggttagaatttgcagtaacaggtgtggacatcctagcagcagtttggtggtcatgtatgatactgcaaacaggagccctgctgaagctgtggggactgagcacagtcctccaaaagcaaatatttgaccattactcaagcccctcactttagataaaaaagagaaaaaagacgtattcattattttattttattttagagtgtggatgtttgcctggtgcccccaaggggtcacaagagggtaccagatttcccagaagtggcattatagagtattgtcagccccggtgtggatgctgggaactgaacccaggtcctttaagagggcaacaagtgttcagcttcaatgctgagccatctctccagcaactgcaccaccccgctctgagatagggtctcacttagcccaggctggcctttactcattaagtagctgagggcagcctttgaacttctaatcctccttcctctgcctctggtagccgcctggatgaccggcatcctcgagcacacgtggtttatgggatgtacggataaagctcaaggctatatgcatgctaggaagtcttctactcctgggtgtctgtcccacccacgtggagcttaaacaaagatgcatacagttgtgactccagacgtcactggacaagacaccagtacaaccca

SEQ ID NO: 20787 - DNA, 1163 bp, Mus musculus
tcttgagaaggtcctgcttgttacacgggactctgcatctgttcaggtagacatcaacaagtcatggaaggcaattggaaagagacagcacacagggactatggcggtcctgtgagggaggtacagatggggtcaggaacacaggcatgctggagtcagacatggctggaggggagggaggtcaaataggaatggatttcaagttgtgctgagctgcagaggcctcgtttctgcatctgtcaaccagcaggtttccaaggaaagcctgcagttaaatctgggcagagaaggttctggaagtcactgggtgggtggccagccccgggtgtcagcagtttttatccatttggaaggacaggaaattaaaaagactgagcaccttgtacccccaccctggggcgtggtttgcgttctggtggttttaactaaacgttgagattccaggtttaatgacgactggtggtgaattttcttttttttaggtcatttgactagaagctttgtctgcgtgcactgagtgaggatccggccctactgtgtgtatccctactgcgtgctcctggacctgttgggtttgactcttgatttgctgtttttgggtattcactggctgaggacagtggctgtgttcagtggctgtaaataaatggagcttgaactcactctgtttccattgttcaatgatatctcactgcgcagccctgactggcctggaacccagatccacctgcctcccacgtactgtggtgaaaggtgtttatcaccacacccagcttcttcacgctcttggtggtttctgtgctcgccactgtagcaagtgtgggtttgtatggccagtgtgtgttaaatggccccttttccagattttttgggcacaaagcacagggctatccaaatatttcattatggaatgtaggggctgcggagcacagtgttctcaaggaaattgagtagcaagggttgtctggacaggagatgtccaaggtctctgggatcccatggccttctgggctggcctagccctcttcagtaggattacctgacagacattggctattctaggatctgctcacctgtgtgcactgaggatactgaagctggtactgtctctgcactcgggagatggttgtgaggggccatgtggctgctgggaatagaacctt

SEQ ID NO: 20788 - DNA, 2206 bp, Mus musculus
gcccaggaggggctgccagggctcctcgtgaatcctgacaacaccgccatcattaaacattgctttctctttcctcctcttcaaatcttttgatatttttcagagcaaaatttttctgtccgtgaacttggtggaggggatggggaggattctttccctctgctgagtgctgcctttccttctgcaggaggcggctctgtgcccgtagcacccagggtcctcagtcctctcagaacccagggtcctcagtcctcccaaaacccagggttctcagcccttagcacccagggtactcagtcctcccaaaacccagggttctcagcccttagcacccagggtactcagtcctcccagcagcacccagagtcctcagtcttcctagcacccaggatcctcagtcctagcacccagggtcctcagctctcagcagggtgtttggaagcagtaggtcacacttgcctttagaagtgtggcagtgcaaactctagcaatgctctccaggggggtgcatggcttgcagtggccttcggcatgtgggtggatgctgggtatgtgtgtaggtgttgtgtgtgtgcatgagggagtggggtgtagctggggaggggctgcagatctgcacttgttcttctgcgtttcatagaagcaggtcagaggctggggctagtttgccttttttcttctttcttttttttcccctgatcttgactccccagagcctgctgttggagcagatccttgctttacggcttttatggggaaagcatgcttcttagcgaactgtctagaagttgcaggtggctgatctccagaggaggggggcccaggatctacttgtgtgtgtgtggtaacagtgtctaaagatgtgtgccaaatccgagtggccatgagagtgtatggcgggagtggatgcctgtgtagacgctgctctgaggctctgggtggctggctgtgcggtgagagctatggagaggctgtggcatgtcagcaagcatgaggagagccgacacagcagcctggcttggccgatgagccccctggctcctggcaccctgagccgtgcttgagcctctgtttggtggcctttctggcccactgccatgcctttcctgtctgtgggagcgcttgtacacagcacagcagggctgtagctaccgcgtccatgctgcttccagtcagggcttcccagctccgagtgaaaggacctgaagatgcccctgctctttctctcttctctctcccttcccctctccctttctccatgtcccagatggcgattttgctgacatcctccaagaaagcgcttcactcgacagcccacatgtgcccagagatgtttgtagacctatctgagtcgcagccatgtcccaggctgaagagctgttccccttaagtccatgccgaagaggcactgttgaaccccccagagctgagagcatctttaagagctcaaagcacacaactgcacactcacaggccctcagcttccccgagccacagggcactggctgccctgtaaggggaggctggctacgaggtgaccgtgtggctcgcacacggggctgctcctcccagtgcccagcacctcctaaaatgctgctccctccactctgggctctccctgtttctagtgtcttaacccattctccttcctgaatccattctttgcatatcagattctgtaaatgttttgtaaacatattacctcactcttggtaatacaatactgatagtctttaaaagatttttttattgttacaataataaatgtgaactgtttaagaagagtgtccttttcttcttgggaggccccaaggaagaatagagattgagaggagaagctgcccgtgcctaaaggcaaggggaggccaagcggctgagtggatggccagcagtcaccctgtgcctctcgaaggcctgctgtgcagatcagcacatcagacatgtgctgcagagtgagttctaggatagcctgggctacatgccaaaaccccgcctcacagcctggctctcggtatcattgtattacttaatagtaaaatagatttctccaagcaggtgactctggaattcaagacagtaagcaggtgtggacctggggaggctagagtgacctcatcttggctctcttgtttctggggtctgcaaggcaacagagcccgggacagccgggcacaggtctgggaggaggaaggtcatcacggtcttg

SEQ ID NO: 20789 - DNA, 2448 bp, Mus musculus
accagagagcgagtgaacgccacctggttttgctgggtatgcacagagagcctgcaggatggctctaagagccaggaggggcaggcggttgtcatcccaggcaggctaagtggtcaccccctcccccccaatgctggccatgttccctgcaggacgcacatgcaaaacatcaaagacatcaccagcaacatccacttcgaagcctaccgagtgaaacgcctcaacgagggcaacagcgccatggccaacgggatcgagaaggagccggaagcccaggagatgtagatgcgtcccgcccctggaccccacccccagatcttttcatcatccctggcccacccacctaccctgtcttattttatataattatctccttgtcacctgcctccatccatctcttcccacactttgccaggtaacaagagagggtttacctcccaagtgtgctcttattggctgcagcagcagggtgggcggggctaagcctgggcttgcctctgtgctctatttccacccgggctcagcccctgaggggttagaagagctatgtgtccgtcccccgctctgagttctaagctgaagcctgtgggggccaagtcctagggggtgcagaggagcccgttagaccacaagaccccatggccgcagcctcaagcaggttagagactgccccaaaggaggatggagctggccgggtattcctgaaacctcacctgcccctccgggggcgtttcttacagcgccctcagctgcctgcccctcaagggaactagaggcgtcacagccaaagttgccaatcacttagacaaagtgacaaccgtgcccctcgagcttgtcccagagcagaaagtgccttgatctacaagagccagtcacctcttcccagatgtccctttgggtgaaaagcagggacgtgctggagagagggaggtatcttttctccctcgcccttgggttctctctcccctgtgctgtagatatcgctactacactgggctttaattataaaagacgaagcgtgaaagatgctccccgatgttaggaagccccgcccccaatgtaaggaaggtcaaagcaagaagatgagtcgaagccatgagggaggaagccgtggaagggaggcataagagtgtgtgggagctctcctgcccaggtgccgcggaaggcatatccgcgtggtcctcagtttgggccaagatattctggttacattgatgctccgctgcctcaccctgtcccaccccacacaccccaggctcaagccttgatgattcagtgactgtactgggtgggagccagaaacctgaccattttgttgtctacatgagcctagactagccctgtgccccagaacccatcaaaaatacccctaaagagggaaagatgagggggtcagagatggatagccaggctcactcatcttctctcagagggaacattagggaccatccatgcacagctgaccaaagccgtgtccttcctgcctgcctcccattctcatttgcccctgaggagaaagtttggtgaggtgcgttaggttggacccgcttggggaaggtgcctctacagacccagggctagctttctgcagcccagaagtgcagtgggaggggtggggtgcagacagatggagacgaacattgtttcctgctttgggcgtctactccctcatccaagcatggaagggcccctcgtcatgccctgtggccgaacagttcgcttgccagcttgccaagttcttttgccaaaatcaggactttgaaggaaatctccagcacgctggacccagggcactccggccttcaccagcccaagtgaccctggggatttagcagcaacccggtcatcaggatgactttgtgcctctgtaaccaggtattgaaactgttcgtctcaccaggccggtccacgtggccctctgctgggggcttcctggtgggggggcagaaaagtctctctctctctctctctctctttttttttttttgtataaataacaaagtgttgaaatgtatttcctgaaataaatgtttcaaatacaaactttttttctggagttctctttggcaagacctgtctggtccattaaaggtggtgaggggagcacgggagtagaggctcccagtggaaggaagctataggactgtgtgagatccagaattaggaatcagcagcccagtggtgaaaagttagccacacccactgcctgtaatccagcttgtgggacatctgacgccctcttctggcctctggtggtacctgcacacatgtggcagacacatatacacataaatacaaatctaaattttattatgtgagaccctggtaactggccatttataataatgttattccaagagaactaaaccatgtgtggtcccaggaggctggctgagccaaccagttttgtgtacaggaatcaggaaaggggagggtccctctctgtgt

SEQ ID NO: 20790 - DNA, 1108 bp, Mus musculus
gccctcctgctgctgggcacagtggaggtaaagccacagagaaccttgacaaatgagggaaagctcatagctccacacccagagaagcctagcactgcttacctcctctttcctgcgggaggtgacctctggaagtcatttcaccccccaaggtcacttcactggaatgcggatggggctgtcaacccctgctgttatatagaggtgaaataagcccctgaggtgtgtgggcctgacaccacgttttggcgggctatgacttctgatttagctttctgagaggaggttgtgagggatgccgtctctgaccctttatccagacctatcacccccaactcaggtagggctgcaggaaggaagacaaaaaaatctattcatcacaacacttagggattctgtgtgacacagaaacagagacctataggtatgctggtcacatgaccccgacaggcggcataatgttgttgccacaatggctacctcctgcaatgaactgatatgctaagacttgcaacccagctccggaagatttagaatgcctttgctgttcccgaacggccccagagcctcactagagaagggggttgggagggtgtatgggcacatggaagctctcgcttcggggattgctggaacagaaacaagtcaggattcttcagccagccctgggcaggaaggaactcagatctccagatctcgagctggtcagagcttcggacctcagcatctgaacccaggttcttatgtttgcatggcgagtatctggctggtcagctctttactcatgggcacaggtctgtggggactgggctctaggcgcttgcaggtcacagagctgccccagcctgcgtggacaggagaactttgtacctggatttggggataggagactgccaagccatctggcaaaaatgtgaatttctccaccaggagggatgagggtgggaggcaggattggaaataagataagaatctgtcacgacctacggaagagaaactgaaaggaaaatgcccgtctcagggtggaacgacgcgtaaagcattcaaagtgtgctctacccaaccacctctgagctgcaagcacaaggtgaccctgaaccacgtctct

SEQ ID NO: 20791 - DNA, 1182 bp, Mus musculus
catttttaaagtgtgctaattcgcagcttacacatacattaggcctctacaaggacacaacatgtttcagtgtgtaaacaactggtgtcaatcagacgtgtttggtatttaggtgtgtggtgtttaatagagagccgtggcttcccatgtgttttattattttcaaagttgctctgggtactgggtgttcccattgctggcatgtggtgtggacagctcccatgcctgtccctgtaccacactggtttctcgatgtccaggaagaaggaagggcgttctcttggctcagaagctaagctttcctctggcccttggttgccaggggcccagggggaacatccaggggacagtggtaggtctctggtggccacaatgagagaatgtgtgggcaccgggccagaggaagaggtaattccatgaaaaggcccaagcccttcccgagaagaaagcattagggacccttcctctgccctacacagggcaacctgcaaggggtcgagcaatgggaaagatcagctgatctcccagcggcagatggacccctgtgcagccccttcttcccggagcacccagcctgctgagcctagccttcctgatatccttgcacaggttaccagttcttagatctgccccccacaggcctcccctctaaaggaacaggcctcaacccagggctcctgtcatgggaaacatgcctctgactgatcctgcaaattggagcatctgatgtctccaggcatgtgcccggcctgtggaaagatgaagtcaccaggaagcagaaacagtagacagcaggctgctctgcccggcatcagcacctggctcttccctctgcagaatgcacatcgtgtcatgatccctcccctcactactcctccccccacaacccctcccccagccccagggctccagactgcaggtgctacctcccagggtaagaaacagggaggtgcagtgccagtgggcttcctgagctgggagcctgcagggctacctgatgcgtgggcaaggcttgccagcaagcagcatgcacgctgtgcctgcccaggaaagccagttatgatactaagtcttcagcttccatacactccctctaagacaaaggcttcttgatacaatcaaatggatggcttcccaccgtgtcgttatcctgaaccccttccccaagccccatcccacccc

SEQ ID NO: 20792 - DNA, 1099 bp, Mus musculus
tttacagatttgctcttaaatacttgtgctgttttgaggagagtgtttcttacaaaataatataccttttagaaatagactttaacatataaatgtattcccgttgatacattttcaggctatatgcaatttttcagaaatataatcacaaatagtgaagattacttgctagaaatgattgtgtaacccttacagagaatgcatgtgagtgatgtgaaacagataaatgatagcctctgtccagagcttgtttggtttatttccatcctccacttctatataacaaggttttgcatgttcagagtgctctgcaactccctacactttgggccatttttggagttgcactaaaagtgacttcttggcggcctcacatactttcaaaggatgaagaggctttgcggggatggagagctgtttgttaatttaagaatgcattcctcctgtgtagccctcaaaacactatagagttgtgtgcagagctagacagtctgggcacccagccatgaagcatccctgaggcagtgcagacagtgtacacactctcctgagcccgccttccacagctgcacaccactgcaggatcattcctgtgaaagcagccttcctactcctgtgaattctgtggctatgatatagttgggattaagcgaggataagaatgtagcttctgcagtatgtgtctcttacaggccaatgaatttaaatgctttttctaggaatttgaatatggagttgtcaccatcacacacacccctcccttggcctatttgttgcaacacatctttgctgttataaacacatgagctcacctggccatgtatagtcacaaggccgaggagccctttgggagatgcttccctagagagcaggctgagttggtctttccattttgcttcttcataatccacctttctgccacaacagttttttaaattgtcagttctctgtcattgaagctggtagccgtctttttttttttttttttgtataataaatgatcccccgggagccttcagtcttccgtctttagacctctggcagacaatattctttttttttttttttttttcctcctctctccggccccactcgctct

SEQ ID NO: 20793 - DNA, 1139 bp, Mus musculus
catatagaaatagtgtagcttttaaagtagactcttaatctcacttccattgtgtggtgttccacccatcctgctgctagtattgacagcatgttttccaaatctttctttgtattagctagtaagtgtggatcttctggtcatgtatacatatgaggaaccttggctggtatagattgatttgtcagctattagtcatctgtgcctcaggccctccaatgctaggccttttggttccctgctgctgttttctgtgtacacagccacagtgaaagaagggacttatagacttcctagagttgacctgctgatgttacctgctgtgtaaacagacagtaatcaagaaaggtttagaggaagccacatattcgtacagggatttgacaaaaatctatgatgttgtatactatgtactcgtgtatttaacctatcctctttgtaagggtaggtttcaaaacatgcttcccagtcttccatgaccaccaagaagtttccctccagactaacttgtagttcagaagaactaactgcctttgggaaatgctgaggatatgcccatctctcagaagagaaaatggtttgatgggatatggtgtggaaatacacgattggtccagaaaagtcttgatcctaaaagatggaacttccttggaagaaagtgctaactttgcaaggagacaatgagcaaaccaagtgtggtggaacacctcagcggagacagagggggactcattgtacctaataacctatatgagcaccgagacctagcttttgcattattagtgggttttgtgttagttttgtgttggtagtgaggcttagtagggacaatattgggtagaaccataattgtttacctgcttggacactgttgatgcttgttgatgtgcttgacatgagcagtgatggatgaggaccatttcttgaccagatgtagtgttcaaattgtgggcagtgtgactggctgtgtgagacaggtggcctgggtggcaggaaaatgcggtggaactgagagaagttaagattttgaaggacagaatgcacagggatggtgtgggttgtcagaaggaaggaattctaagagataaggctcttggctagctactttgtgtagggtgtgcccaggggacttaaaatta

SEQ ID NO: 20794 - DNA, 1180 bp, Mus musculus
agagggcccttcttgggctggtgagatggctcatcgattaagagcactgactgctcttctgaaggtcttgagttcgaattccagcaaccacatggtggctcacaaccatccgtaatgagatctgactccctcttctggagtgtctgaagacagctacagtgtacttacatataataaataaataaatcttaaaaaaaaaaagaaattgttaaaaaaagaaaaaaagagggcccttcttcctgcagtacctctaccaaggggaaagctccctgtggtgctgactgaaggagaggagagcgtggagcgatcaggagatagtgcccaccccactgacataaaccacctgggctattgcctcccaacacccagctgttggctatcttgactttttaaagcagaattctcccgtgttgcatatcttgtaatagctctccagctgaacagggttctatataaaaaggtaatccttttgtcaaacaaacatgaaattagagcacacataggaatcatctccaaagaacctgacttgttgggtaaggtagatagaagtcacaaatgtgcatttctaataggtaacacccagtgatggcagtctctgagacaaggctttgataatcccttactctgtagaccccatacaaagccctgcacttgtctatttctccacagttgtgggcagaacaaatgagacagttaagctacttcacaaaaaggcagggcagctgctatagtactggaggtgaacctccatttctgacatcctctcaaagtggctctatcctgtttatgacattgtctagctcaagactttctgcacaaataatatcccgatcctgtatcttgagtgttgagtttcaaacccagggcctttcacgtacaaggcaaactagcactctactactgagctacgggagcagcaccctcctacatacagattggtcttcagtttaccctgtaggcctctcaggccttaaacttgtgattcacttgccacagcctcccagacaggagtacagtcctgtgccaccagtcctggttactcttttacttcttcattggctttaaagtagacatcatactaacactgctccttaaatattcaatagggtaaaagaacaggaaacacaagaagaggaacgtttgatggaagaaaagaaaaagaaaaagcaggaagacaaga

SEQ ID NO: 20795 - DNA, 1148 bp, Mus musculus
atgtttgtctgtgtaccaagtgtgtacaaaggccagaatagagccttggatctcctagacctggaattgagatagctgtgagccaccatgtgtgtgctattaaatacttctttttgtcttcccttggacacaattgcacatgtagatacttgcattgtaaggacttttgcaaaggttctgccagctgcagtctgtattaatactctgtgtctacttggtatcttgtagttttgctttgttttttaagattgttttaaaaattcattttatttatataagtacactgtagctatcttgagacacaccagaaaatggcataggatcccattacagatggttatgagccaccatgtagttgctgggatttgaactcaggacctctggaagagcagtcagtgctcttagcctctgagccatctttccagcccagcatcgtttgtgtagttttaaagtcaaaattatgtgtagaatttgaaattgagcaggacttggaataagttcttggttttatttttagtaaatgcagaattggtggaactacggcttttgaccctgtgtatcagtccttggtccttgttaccagagtcacttcaacagatgagtttactgttaaatgggtattgaagcagcagggtaccaggtcatctcctctgctctgttagaatcttttcagaaggctccagaaggactggccatggctgtatttgaatttatgatttcaaataaaacagtgtttttttacaaatatggaactcttcctgcattgcttatatgccccccctctttgtgtgtgtgtgtcccattttcataatctgcttcattgtcattggtgactcttgacttctcaggctgtgactgctcacagctgtgtggtgactgaagtacactgtcctgcctcctcttgtggaaccctggtttctgtaagtgtgctggtgtttgcactgtggatgactgactctgctgggttcttgtatctcctctccgttgatgggttttggggaacagtttgttggtaactgtaatcggcctttggatttgtcctagacacagttgttgtatacttctagaattataaaggatctaaagtcttctacataattttcttttttagttaattatttctgtgttaaatgtatgagtatgttgcc

SEQ ID NO: 20796 - DNA, 1243 bp, Mus musculus
agcttaggctcatactgtggtcagcaccaacctttgaacatagagagcttcgtttcctgcctatcccccagctatgttagtttttacgtcaagcaacaaagcttgtgtaactattttcaaaggttgatattgaacacaatatgttccttctgatgactgtgatagttcttcaagtggtcttgactttccctgagctccatccaaattaggagagtgggaagctggagaggtggcttagaggttaagagcggctgctcttccagaggacccaggttcaattcctagcacccacatggcagctcacaactgtttataactccagttccagaggatctgacaccctcacacaggcatatatgaaggtctaataccaaatgtagatataaaaattaaaatgttagagtatatcagttagggtcctccagaggagcagacttagagcgggaattatgtggggtttgttatacgctaatccagcagtggctgtctaccaatggaaggtctgagattccagcagtgattcagcccacgaggctggatgtcttagctggccttcagtgtacaggagaattccaaagacgtaggctccactgccagtgaaggcacgggctttacagctggaatgagcaggctgttagcaagcttgcttctttgtccttatagaggctgcctgccagggtgtagcccaaagcaaaggtggatcctcccatctcaaaagatccaggttaaaaatgtgtcttcccacttcacatgatttaattcagaaaaaatatccctcccagatgtaaacgagttgacaatgaggaatatccctcccaggtacacacttgtcaactgaacacacagttatatctcagcagatggtattgtaacaggaatagaacctgtaggcatttgggctagtggcttcaggaccttcttgggtccgatcatatatattctgtgtccatttgattggattgctgctgtatacatcctagtttataagttggagggtttggtaatactcagctcatgatagaaagttcaagttgcatgataacttggtggcccattgattgtcaaatgatcaattttcactagcaagccaagagctgtctttcaaagagagaatagttgtctgcagccaagggttggtccttgctcctaaatcccaaaggtctctgtgagtcatctgtaggcctgctaaacaccctaacaacatccctgtctaccactgagacctcaggcaccattggctctg

SEQ ID NO: 20797 - DNA, 1212 bp, Mus musculus
tgaagaagacaaacggcagtcatggcaccaatggcgcactcgtccaaagcccttctaaccagagtgcccttggggcaggaggaaccaatgggaacgggggcgtggccagagtgtggggtgtagccacaagctccagctctggcctggctcactgctctgttggtggtggagatgggaaaatggacaacatgatcggagatgggagaagtcagaattgttggggtgcttctaactccaatgcgggcattaatctcaaccttaatccaaatgccaacccagctgcctggcctgtactcgggcatgaaggaactgtggcaacaggcaacccttccagtatttgcagtccagtcagtgccataggtcagaatatgggcagccagaatgggaacccagtgggcgccctaggtgcctggggaaacttgctgccccaagagagcgcagaaccacagacatccacttctcagaatgtgtctttcagcgtacaacctcagaaccttaacactgatggaccaaataacactaaccccatgaactcttcaccaaaccctatcaatgcaatgcagacaaacggactgccaaactggggcatggctgttggtatgggggccatcatcccaccccacctgcaaggccttcctggtgctaacggatcatcagtctctcaaggcagtgggagtggtggggaaggaatgggcagttctgtgtggggactgtcccctggtaaccctgccacaggaagtaccaattgtgggttcagtcaagggaatggagacactgtgaactcagcattaagtgctaagcagaacggatccagcagtgctgtgcagaaggaagggaatggagggaacgcctgggactcagggcctcctgcagggcctggcatccttgcctggggaaggggcagtggcaccaatggcattggtaatatccattcaggagcttggggccatcccagccgaagttcttctaatggtgtgaatggggagtgggggaagcccccaaaccagcattccagtagtgacatcagtgggaaaggatcaacagggtgggacagtgccagtgctgccagccagacccctgccctgcagcctggcagtgaacacatgaactcgtgggccaaagccacatcttctggaactacagcaagtgaaggaagcagtgatgggtccggcaatcacaatgaaggaagcactgggagggaagggacaggag

SEQ ID NO: 20798 - DNA, 1619 bp, Mus musculus
ttttgttttgaccttaagttttactgtgctgtacggaacctttgggcaattgtccttcttttataggagcaactctgaagcctttctgccatgtggctatagtttttgtctgcttagatcacttgttgatggttctgtgcatctccttggccttggcccagttgatgaagttttacttgatcgtagacaccacccagtcaagtacaagcaagctcattcttctgccctgtgctgtgcatacagtctggggctgcccatgccatagtgcatgcagcctttgcatggcgcccagcactggtgaggaaagaagcctgggacacctcctgttattgtgtgttcttttgcaagatgtcttcattgctagataaaacaagtagttttccatcctggcttttctttaattgccttggcacttgatgagataggctaccagtcccagagaatctgatgaatctacagcagagctgttccactcatagttttaaagttccgccctgaaaatggagcagtctataaaacatgagagtcattatacaagttgtatttttatttcagttgcaagtcaaatgcaaaatcggactgacttatgtttggattctgtgctctgtaaaagtagaaaagaagatgctgggatgatccagctggaagcttaaatagctgtgagagaccaggcctgagttaaaacacgggtgacacgggtggaatgcaggtacaaagtgctgtgctccaagcacagagtaagcctgactcttgacaattgtactcaccaaatggcagcacttgtgtgtccaatttacaacataactctattctgataccagataaaagcaaggaactagaggaagcttcaagagacctgactcacagactgacttcctggcctcctgctcttccttagccaggccccaaaccagccttgtctgtatagtagcatttagaactctgtccttgaagcagtattgcagaacttgagcagtgactgaggtcactgttgtctgtgtgcccattggcaggagctctcctcacgaggcagcagcttcctgcagttgcacttcctggtgggcttagtggtcgtcctggaagcactaagcttagagatgatgtgaaggagctgaaggccctgctgtaactacgtgccatgctgtgcgctgagcagaaactgcagccccttatcccacttagctgcactctgagccctgtcccatgtgcctctaggatcaggcttaaagtcaggttgcttcttggtaaagctactctgtcctgaagactgctcttccttgtgtgtcacagagtctcagatgtagagccctgcttgtggttttagcttttccttcctgttttgtgtgctgaggggcttgagggggtagttctttataaaagtttggggggtgtagtgtgcttatgtgtgtatgtatgttcacgtgtgtgtggacatgagaggaagcagctgtacatgtacattattacttgtagaggtcagaggttgatattaggcatctacggtcacattccgccttgtatactgagactcaagtagtccacctagataacttgctccatggatctcttctccaactcctgagcactgggattgcaggagcctagagtgtagtcctctt

SEQ ID NO: 20799 - DNA, 1382 bp, Mus musculus
agagcagagatgtgaagtctgattgcccaaaaggctacctggcagtgacataccaaatactaagtaaaatcgtccctggcctgtaggtcccatataggtcctataggccagggagggaggatgacaagagcccagggaggccgtgcatggttaagggtcaagcctgggcactgaacagctcctgggttctgattggaagattcagcagctggggtgggaggagtgtcctttgtgtgtgcatttgcacgtcactatcccacacgtgctcccctggtgcctcagtgcaccctctagtatcacttgccacctagaaattcaggatggatctatctgaggctctttgtcctggataaaagttctaagttacagattgtaccaagactcacagatgttgccagttggtacataaattttgtgaatcagcctttttagtgaaaaaacaatgttctgctagaagcctgaaagtaggacacagtggcatcgtgtggcagcatcccaccagagtgaatgaagggctgtgctcccagtcacacacttgcaccagcccagagggccccggcactggaactagccaaaaggtctgggccaacttccttctactgaactcaattatattaactgtctgctgcctcagcatctgaacatctagttcctggtttgattatgtgtaggtttatgtctacgtgtgggtgtgtgctcatgtgaatacaagtgcgctcaaaggccaaagacattggattggatcccttggagaagttacagaccagttgtaaggtacatggtatgggtgctgggagctgagctcaggtcctctggaagaacttcaagagctcttaactgctgaaccatctttgtaactgataaatgactgttgctaagcactccaatctgaaggacttgaaagaatgaagaaaatgaggaggaaaggtaactgattggggtggggtgggggatagaaagaaaaagctaggcatagtggtgcatacctttaatcccagcactcaagaggcagagacgggtagatttctgtgagttcaaggccaacctgatttatatagtgaggtctaggaaagccagaggaagcagaatttgaatattaaaactcagcgtatagagtgtatggtataatgcacatcattgcaatctcagccctcaggaggcaaaggcagaaagaccagagtttgaagctaccctagactatgcagtaagttctaggccagccagaactagatgtgagaaactggttgaaaacaatagtgggggctggagagagggctcagtggttaagagcaccaactgctcttccaaaggtcctgagttcaaatcccagcaaccacatggtgaatcacaaccatctataaagagatctgatgccctcttct

SEQ ID NO: 20800 - DNA, 1224 bp, Mus musculus
agagttaagtcagaagttatttgttttaaaacagattctgaaaaatgccaggcagcctgattatctagtgtacttggagatgggtattccatagcacttaattagcttgcaggcacacaagaagcagtaaatattaataaaacagaacagcagtactgttcagggtactgtcctcagtgatagctgggtctcaaaagtgctactgtaggatttggattaggttttgttctgttgctgttgggtaggtttctgatttctacacaggctggcctcagacctgcagctgttgtctttcctggctgtttaattcagccctgagcatcgtcgtttcacccaaatgctctggtcacttttagagggattggtgttggggaaagatgcttgcagagggcagcatagagatagatgatccagacaagatcagggacctcccccacctcctgttggctattgtccaacagtgagtgaagtcgcagtttgtcatgttctggaacctgtagacgatgtaccaaagtagaatagtagctccctgtgagggtcttgaagtctgagcaagggaagagtgctctggagaagctgattgaagagacctctgcaccctacctgaggcggctgagacaggtttgaggctgctcaccaggttggcagttggcgatggtctggaaaggctgactttgcacttgggtccactgctccttgttccaaagctttcttttcagacacaaatatgagaaggttttatagactgagcttaggtgagttaactacggaaaagccatgtctcattcactatactgaacctcgggagagcttgacttcggcctaggtgggggattggtgccttcttagagcgtcaaaagctagagaacagtgtccttgctcaagcttcaagacctccctccagggaacagtgaatcagaggggctgtgacgcctctgctgttttgacaccaggactctaaaattagcctccagtcaccagccagagggagtccattttcagcaacattgcaatagttttttaacagaagagaggacttttgtcctttttgtagctatggacagggaggagaattctgctttcctgtattttataggactgtgggattagtgtatctgtacagaattgggaaaggtgcctaaatatgaaagcccgtgaacctcatacacaggcttccaccgcaggacatttatttaaaaataaataaatgggtggcagttggaa

SEQ ID NO: 20801 - DNA, 1696 bp, Mus musculus
agctgaggcgtgtggccagtgctctgtccccccgatcgcctgcgcacattaccctcgtttcgttaccttttcatgtcatttttttttatcccaaaaaaatattttttaaaagttaaaaaaaaaaagacatatcaaacatgcaaatacttgaacccagcaggccaataccgaaatgtgaacacttccacgttgacatccgtgcacagaaacaggctctaggaaatgtctacgttcatagcctacatgtgcgtgtatgcgtgagtgcgtgtgcttgtgtgcttgtgtggtgcggtgtgcagaagagtgtgtgtgagtgtgttcttgcacaggcagggcttcctgtgcgtgcgtgcgcacttgagtgtgtgagggacttaactgtgggtttcccttctagtcagtatatgcttttggttttggtttttttgggggtttttgtttttgtttgttttgttttttgtttttggcattggtcaaatgttctcattgttgttatttgcttctaactttgcactgaggtgtctctgcccttcctttagctaatcctaaacagtaaagagaattctcgggacagggctggtgacaattcatgtgtaaatgtttactcaaggactctgttgttgcatttaaagtcgcagtgtatatctctggagaaatgatgtgtctgtctacttcagcagcttgtcattgtggactcatgcagaagattattaccagagtattgcaccacttcccatctgcaatataaagttaaagagaaaaacaaactcttgttgaactgtggccatagatacttgtagagactggtgccgcgcacgaggcgcgggcgggcgggcggccggccgagcacttggacgtggtggtgactgcttttggaggagctgtgtttgggctcccacctgtttacagactttttttttttttttttcctccttcagactttaaaataaaattttaaaaaaattttaaaaatgttaaaaggaataaaaaaaaaagacttccatcatttaaaacaaacaagcaaacaaacagcaacctattttcagatacagatgtgttgctccagagctctgggatgggacatgctgttcccctccagccgtcgcgcgtgcgcggactctgtggactgtcttcacccctcctcaaggtgacagggcctcgtggtctctgtcttgcacacgccagctcgctctcaggaacgccagggctcccgagggcggtgccacaccacttcatgtatttttaaacccaactcctagcactgaagatgttatttaaaaaaaaaaaaaaaaaaaaagagagagaaaaaaaaagaaagaaaagaaaaaaacacacacacacacacaaagaagaaaaatacctaatctctaatgtgtagcagttacatatttaccaaataatggactcaaaagaaatagatgtttgaagagtgctttatatattaaaaattgctttatgttttaaagatgatcaatgttttgattgttttacaaggaagaaagacaatgaaatcacacaccctcaagtatgttttagaaaagtatatgaacattgtactccctgcctacgtggtcgggaaacttgtgcattacattttttaattagctttttaatggttttatcaaaacagaaagcaagcaagcaagtcctgcacggttgcagcaacgcagtgctttcttagaggatcaggaactat

SEQ ID NO: 20802 - DNA, 1222 bp, Mus musculus
tggcactgctctcaggcctgtatgctgccaggccgtggcgctatgctctgaagcagatcggtggccagtttggctccagcgtcctctcctacttcctcttcctcaagaccctgttggccttcaacgcgctgatgttgctgcctttgctggccttcctcgtgggtgttcaggctgcctttccacctgacccagcaggccccgtgcctacgttttctggtctggaactcctcacaggcggggtgaggccttcagctcctgccttggccaagaactggtgccaggcttgtcctgactctcctggtgggctcttgcctgttcctagatatctctatgggtagctttcccttcttctggaggcccaagaatgggctagggcagtggttctcaacttgtgggtcccaacaacccatttggggtctgaatacagtatcctgtgtatcaggtatttacattacaattcataatggtagcaaaattacagttttgaagttacaataaaataatcttatggttgggggtctccacaacatgaggagctgtattaaagggtcgcagcattacaaaggtcgagaacccctgggctaggggaagggagagaggatgtctgactgtgcttggcctcctgacagggccggttcacacacacagttatgtactacggctactacagtaacagcacgctgagcccgtcatgtgacgcccctcgggaaggtggccagtgcagtcccaggctgggcagcctgccctataacatgccgctggcctacctcttcacaatgggggccaccttcttccttacctgcatcattctggtatacaggtataccttaaccacggagccctcactctgagcaccttcctctcacctgtggctcctacattgtctatccagctcttttccactcatccccttatccgttctcccatgtctgcctacccatgttcctattgagacatccacttacccacccatctctctatcctgattacgtcttctgtgcatacagctattgatttttccattcacacccatccacccatccgtccatctgtccatctacctgcctgtctacctgtctacccacttgcccatctaaccattcctgtatcccctacttgtgctttcttctgtcagtccctcgatccatttgtgcatccacccatctgcccacctactttcctgccaaaccatatttcccatctatccacatagccatctatc

SEQ ID NO: 20803 - DNA, 1118 bp, Mus musculus
gctgcgcaggggtggggtgggggtggggggcctccggaggatgcatctgtcagatggattactcaagggcgcccccctgtcaccacggtcctgcagggaactgcgggagcccgagggagtgaagaccaccttctggcagcggtggcatcgcccgaggcgggtggcgcgacaacacctgagggaggcagagcaacggctggcccgcggcttcggtctctgggagggagctctctacgagattgggggtaggatcccatgccgacccatatttcccaccttcctcatcagcccctccatccttgtacacccctcggattcctcctgtgcacacctagctgggttacatacagatctctggagggctgtgggggcgcgcggagccctaattttgccctgggctggtccatattgccacacatcacacagccctgggattctcaacgtggctgactctccctgttttctctcgtaggcctcttcggaaccgggatccagtcctacttcactttccttcgcttcctgctgctgctcaacctgctgaccatgctgctgactgcctgctttgtgctgctgcccctggtctggctccgcccccctgagctaggccctgccctgaaactgagtgagtgctggccctgcctgggcaagctgcatgggctagctttggactctcctccataggaccttctgcccggatgccacccagcacaaactcagacatcctcggtatagggtcgagacagtggagttgggagatagagtgtcacatatttgggggaccctgtcctgatgccattctcttcccacttagcaggactccagtgctccagcagccccctgcctcagagtgacattccaaggtttcacaacccactttggaatattttaacgggcagagtaagtggggtatcttctggcaatgttctgggacatctgggagactccagcctgaaaggacccctgctccctcaagagagatttttggcttttaagggagacttttccctaagccagccaggccagatatagggacatgtccccatgacccacagaatccagcttggagcaagagacaaatggaggaagatgtccaggcctgttagataagcacctcccac

SEQ ID NO: 20804 - DNA, 2009 bp, Mus musculus
ctctcagaggctagcaacaggtctgctttcccaccaaatgcactcccttcccagaagcggggcgagcccccttgtaccaggcgtgcgggggcagctttccataccttgggatgaaaacactgaaaactgagactttagctgccagattgagggtggccccactgcgcccagggggtctgggcctggagccttggaggtgccctggctccccggaatctcccagcctagcggtggaatctagtgactccgtcctgggttgtaccctgtcagtcaggatggcagtgccaggagccctgacccatactccgcgcccagtcctggagttccggcttcatccacagctgggggcggggcttgtgactgccagttccacaatcctattgagagcgtccccgcaggatcgctctggtcctgcaagtctggaggcagccaggtgcccacagactcagttgcatctgccgccttgacgtgggcttggcggtggccttagggtgtggggaggaagcgaaatgactaggacgattccaaaggagctgctttccaaactttggccagtctctgctggtgactttcccacctctgtcctggctcctgcgggatctgagtctggctgtggatctgaccaccccaagaaccttgctctgaggggaaccgttgtgggggtggagactagtagttctctggaggggaggggccgacgtgccaaagaagccggaagtccttgtagggagaaggctggctgactggggagtctcttgctttagggggagtcttggagggaaatagggcagctgttgaagggtgttctggaagatattggttgatgctgtagagttgacttggggcagggtgttggggtgagggttagatgaaacactgagtttcacctccgtgattttgtgtcccatcctatttaaaactcattcaaatgggaggtggttatcagcattgaggcagctgaggcaggattgtcatgaatttcaggccagcctgaacttgagtgagatcctgtcttttttatttctctttacttatttttattttgtatgtatgtttgcctgcatgtatgaaggtacaccaaccacgtgcatgcctggtattcagaaggtggttggttatcttgtcctctggaattggagtcacaggtggtgatgagctaacatgagggtctccaggtcctctgcaagagcagtcagtgctcttaactgatgagccatctctccagcctgagattctatcttaaaacagccaataaggacaggtgtggtggtacaggccttgaatcccagcattctattctggaggcagaggcaggttctctgaattccaggacagctagctaatggcatcctgtctcagagaaagaaaggaaaaccctgaaacttacagatgcacacacgacctcgcgggctggagacgtacgtaggtcagtggggtgagcttaccaacaagtgtgaagccctaggttccagttgccagcgagcaggatggggtagggttgggaggagtccaagcaggcatgccaacacatgattatcccagcattgggaggtggaggcaggaggcaggatcattttgaattacaactaaatgaaactccttcacccaaaacaaacagaaaaccaaaccaacaccccctccaaaagaaacccaaatcttattcaaaatggagatggacggattctttttttaaagactttatgtctgtgagtccactgttgctgtcttcagacaccagaagagggcatcagatctcattacagatggttgtgagccaccatgtgggtgctgggaattgaactcagaacctcaggaagagcagtcagtgctcttaaccgctgagccatctctccagcccaggtggattcttctttgttcttagtcacaaccctaagtaaggtcactctgtagtcaggcagctaggggggtcacctcgtctcgtaataaatagcccattctgtccccagccccttgtggtcaggaactgctttgatgataccctggccaca

SEQ ID NO: 20805 - DNA, 2430 bp, Mus musculus
gactcatcaaccccaccaagtagctgacccccttagccctcacatccctctgtgtctataggttacacagcctacggccctggggagagtcattctctgtccctcctggaccctggggatccaggctgtccctagggccaactctctcccttatttccctagctctctggaccttcctgtggtttgttggtttctgcttcctgaccaaccagtgggcagccaccaaacctcaagatgtccgggtgggtgcggactcagctcgggcagccatcaccttcagcttcttctccatcttttcctgggtaggtggacggggagggcagtttggaggtttgggtgtggactgaggtcccctgctgtgcccataccttgggtctcctccacctgcccacagggtgtgctggcttccctggcctaccagcgctacaaggctggagtggatgccttcattcagaactacgtggatcccaccccggatcccaacacagcctatgcctcctaccctagtgcctccgtggaaaactaccagcagccgcccttcacccagaatgtggagactactgagggctaccagcctccccctgtgtactgagcagccagggacaagaaggcagggaaggggtggttgggagagggccgcccctctaccctggacttctctcaagggttgctactcacaatgtagtcccttgcctgttacagttgacagccaaagagtccacgcctttctgcctcccagctgcagacagagcacacctgaagtgcccatgcccagctgggcttcgccgccgcccacccaatcctcaagggcatttttgagatggttttgactagatctttttatcccccaccatagtactgtagataggacccagggcttggatttgcttaaccagcgcagccatccagctgtgtgcccagctccttgttgcttttagtaaccccgatccccttctcagagagccagaagcaggtgcctgttagtgctaccatgtttttgacccatgctagtttctccactgggagccccaactctttccccaaagccaagcttggggatcctcgtgcctgtctccccacgtcctcactcaggttcaggagccagctctctgctgtgtcttctggggtcaccactgtgccaattgtccccaggctgcctgccaaccgtgggacaggcagagggacaagatgccacttccttctttctcccgctcctggcaggagggacaggatttgcctggagataacacccagctttatgtaaatactaccaagcagcggttagatactagtggggagggcaggaacccctgcactgaatgtattggagactggtggggatggccctgccctcagattctatagactagtttggagatggaataaacggtttttctcagcgtgttgtgctgggtggcgcctcaggctaggggtggagatacactttggaaggtattgctttgagacaaggcctcaaacttacagagccaaggatgacccaccctctgacttcccccaagtgcttggtttcaaaccctggacttcatgccaggcaactaagtcagcttccagcctttcaaaggtaacataacccaggcttcaacttgagacaaacctcctgcctcaccctggttctagttctacaccatgactcactttgtagaccaggctggcctcaaactcagaaatccacctgcctctgcctcccaagtgctgagatcaaaggtgtgcaccaccactgcccggcttacaccatgttttttgttgttttgttttagacagggtcttactgtgtagctctggctgtcctggaactcagagacccacttggctctgccccttgagtgctgggtaaagcttagaccatcatgcccagctagatgttttttgaacttggggtggcagcttccccagtggggtctcattcttcatgctgccttccactgcatcctaaaatagctaccacgtcagcttgtaaaatggattgttctggatagcttgccagggttctgctgcctgccagggcccctgggtgctgcccctctgaggttgactctggcccctcttgacaccttccagggacctggcaggcagtggacccatctctcaggaagcagcataaccctgaggtaactcttgtgcaatgacaaggctgtcgatggtggccggcggtgtctttcaaaatctgaagcataagctaacagcccggctctgaactgtgggcctcctctgcagaacatgcattaagcagttaatgagttagatggcaggcaagctgggcacagcaccagcggcacactggcaccttagacccaggtctctagtcctcaagggtgtcaccccacccactttccaaggcctatctgagtatctgagctgttttctcaactcaagctatcaaatgtctgtctcataaaacctgaccacccc

SEQ ID NO: 20806 - DNA, 1194 bp, Mus musculus
gtggcgcaggtctttaatcccagcacttgggaggcagaaacaggcggatttctgagttcaaggccagcctggtctacagagtgagttccaggacagccagggctacacagagaaaccctgtctcgaaaaaacagaaaaaaaagagaaaagaatggggaagacgggggctggtgagatggctcagtgggtgggagtgctgactgctcttccgaaggtcctgagttcgggtcccagaggccacatggtggcacacagccatctgtgatgaggtctgacccctcttatggagggtctgaagacagctacagtgtacttacatataattaataaatgggtgaatctttaaaaaaaaagaaaagaaaaagaatggggaagacataacagagagaagatatgctgtgtgggatgttcctaggacatgtttgagcctcaaatcttgtccttgacacagatcagggtgcaccaagagacagccgtggagatgggagatagactgtgggtggtgagtagccctggcacttttgacatgtacgtctattttttttttttttattagagaggagcatagaaagcactcccctggctgcgccttcctcactgtcaagaagcagatggaagaactaaccgtcagtgaattcttgaaactggacagacagagagccaagaacaaaattgtatgtatgattgagaataaggactgagcaaattctgcccccagaagccctagggatctgctcaggaagggtgcttcaaaggtggttcctgagcaggtcaccttcccacctgagtggcaagcattgtcagaagcccttgtcacaggctgagcccccagtggtagcactggtataggtagaggcttggggacatggcagagagtattggctgaaggggacactgagcagacaggtcagctgagctttgcctcctgtcacgtgaagttgattgggaagcaggaggcacaggtgagtccacagggaggtggctcccatgcagccaggcatgaagagtcagggtggccagagtccagagctcagagtaaacctgggtccattttgactgagaacaccccacattttgcattggttattcactgcaattgttcgtttatctgaagttcaactctaagcaggcagcctgggtgctcatctgttaccctcgaactgttttagtgggaggagtcggggaggggttcac

SEQ ID NO: 20807 - DNA, 1556 bp, Mus musculus
gagccaccacgcccggcttgaaaaaacatgtttatatatatatatgtatatatataaaaaatcaaggaaggaaaattccagtttgtagctcagtaagtatttgcttattactattgaggccctaggttcaattcccagcaatacaaaaataataactttccttttaatgatttatcttgccacgatggtgatgaaactagcatctcaccctggacaggcaagcctggccctctgggccacaccccagccccttcgtgtctgttcatcattccaggcaaaggagaccaacaacaagcaaaaagagtttgaagagactgcaaagactacccgtcagtcaattgagcagctggctgcctaatgctgagcctttgctgagataacttggacctgagtgacatgccacatctaagccacgcatcccagcttttccagccagggcctcctagcaggatcttagagaaggagacagtggtattttgaaactggatatcaaatatttttggttttgctttaaagtggctacctctctttggttttgtggctttgctctattgtgacgtggacttaagcaataaggaagtgatgaagggacagtgttctctgacaggacctgtgggggtcggggtgcctgtgcaaggtcttggttctgattgtgatatttccatacagggctgctaatgcagcccatgggtaagtgtggttatatgtgtttgtgctgataattttgtcctgatgagttttcctaccacggggtaacggaataaaatcacttgaaaaagtggactgtaagctctgtctgtcttggagaaatggtttgtttggttttttgagacgggtcttgtgtggtccaggctgacctggaactctatatagccaaacctggccttgaactcgatcctgctgccccaacctcccaggtgttggcctgtgccatgctctcagtactgtttgttttgtgttataaggtcgtagactcagtggtatcttaagcttcaatcccagcatgagctgcagagctgagcagtagtgagaaggcactgggattacagtgtgactacatgaacaggacttcctctgcaaggcaggtgtgaaggacagtgctgtcagcttaatcacccgtgagatggggggtattttgattgcattgaggaggaccctgcactaaatgatgcagagctgagcatcagggtgcactcaccattctgtttgctgactcagcagctgcttcatgttccctggcttcccaggaccttgaactgctcctccctccaagtgcttttgtcagagtgttttatcacatcaagagaagctaagacaccagatgggatgccacatactggtaatcctaggactttggaaacaggctgaaggatcaggggttcaaagttatcctaagctatgggtatgaaggttgaggtcagcctgggctatttgacatcctgctcaaacaaaccatgtaactattctctgagcttgtggggaaaagcacagcccactgtgactgacattggagaattaagtcaggcaggggtacagatcccatgcacaccatgctg

SEQ ID NO: 20808 - DNA, 2904 bp, Mus musculus
cacgcgcgagttttctctgggcgtcctcctagggcgggcaggggaagagactgtctggggttggccggcagtgaccgaggacagtcgagttccgcgaggtggctgggcctgagacacggtctaaagcggggcaaaggggtgccccgggcgctaggcggaggctggagggccgggcacgctggagggttccgggcactcacgcgcctcacgctttgctctctgcagctccccgggatgcggtagcggccgctgtgcggaggccgcgaagcagctgcagccaccgccgcgcagatccacgctggctccgtgcgccatggtcacccacagcaagtttcccgccgccgggatgagccgccccctggacaccagcctgcgcctcaagaccttcagctccaaaagcgagtaccagctggtggtgaacgccgtgcgcaagctgcaggagagcggattctactggagcgccgtgaccggcggcgaggcgaacctgctgctcagcgccgagcccgcgggcacctttcttatccgcgacagctcggaccagcgccacttcttcacgttgagcgtcaagacccagtcggggaccaagaacctacgcatccagtgtgaggggggcagcttttcgctgcagagtgacccccgaagcacgcagccagttccccgcttcgactgtgtactcaagctggtgcaccactacatgccgcctccagggaccccctccttttctttgccacccacggaaccctcgtccgaagttccggagcagccacctgcccaggcactccccgggagtacccccaagagagcttactacatctattctgggggcgagaagattccgctggtactgagccgacctctctcctccaacgtggccaccctccagcatctttgtcggaagactgtcaacggccacctggactcctatgagaaagtgacccagctgcctggacccattcgggagttcctggatcagtatgatgctccactttaaggagcaaaagggtcagaggggggcctgggtcggtcggtcgcctctcctccgaggcacatggcacaagcacaaaaatccagccccaacggtcggtagctcccagtgagccaggggcagattggcttcttcctcaggccctccactcccgcagagtagagctggcaggacctggaattcgtctgaggggagggggagctgccacctgctttcccccctcccccagctccagcttctttcaagtggagccagccggcctggcctggtgggacaatacctttgacaagcggactctcccctccccttcctccacaccccctctgcttcccaagggaggtggggacacctccaagtgttgaacttagaactgcaaggggaatcttcaaactttcccgctggaacttgtttgcgctttgatttggtttgatcaagagcaggcacctgggggaaggatggaagagaaaagggtgtgtgaagggtttttatgctggccaaagaaataaccactcccactgcccaacctaggtgaggagtggtggctcctggctctggggagagtggcaaggggtgacctgaagagagctatactggtgccaggctcctctccatggggcagctaatgaaacctcgcagatcccttgcaccccagaaccctccccgttgtgaagaggcagtagcatttagaagggagacagatgaggctggtgagctggccgccttttccaacaccgaagggaggcagatcaacagatgagccatcttggagcccaggtttccctggagcagatggagggttctgctttgtctctcctatgtggggctaggagactcgccttaaatgccctctgtcccagggatggggattggcacacaaggagccaaacacagccaataggcagagagttgagggattcacccaggtggctacaggccaggggaagtggctgcaggggagagacccagtcactcaggagactcctgagttaacactgggaagacattggccagtcctagtcatctctcggtcagtaggtccgagagcctccaggccctgcacagccctcccttctcacctggggggaggcaggaggtgatggagaagccttcccatgccgctcacaggggcctcacgggaatgcagcagccatgcaattacctggaactggtcctgtgttggggagaaacaagttttctgaagtcaggtatggggctgggtggggcagctgtgtgttggggtggcttttttctctctgttttgaataatgtttacaatttgcctcaatcacttttataaaaatccacctccagcccgcccctctccccactcaggccttcgaggctgtctgaagatgcttgaaaaactcaaccaaatcccagttcaactcagactttgcacatatatttatatttatactcagaaaagaaacatttcagtaatttataataaaagagcactattttttaatgaaaaaaaaaagtgacttgagcctttctttccctggttttctcttctgctcactctcaatgaggggagggggatggctgagcctcttgggtccctgctcacagctctgaggtagaatccgatgaatcctttgtcaccgacaagctgtgacagccacctagattgttacatgggtaattcctgccgtctgattcagttctgaccagaatatgcaaagcaagtttgcgaaggaaatgctggcttcaaagggcttgcagggagcaggctgagctgtggtcagaagctgttagaggctccaagctattagcgcacactctggctgggctgcttggcagggaggtgttccgagaaagtctagactcggggtcctgagagtggctggtgatgtcagcaaagcatcacagacgtcatggcatgaagggggaggggtgatcgccacacagggctggaa

SEQ ID NO: 20809 - DNA, 1186 bp, Mus musculus
cacaatgtgtcctgggctctttctccccaactctgagttgtaaagagaaatcaacacaagatactttcatttttctacgtcctctaagagaagccctgtcggtgagtcatgagtttcttccatgctaaccttgttaaccagtaatattggaaggattttaaagaagtatatcttttctttgtcctttggcagttccttccctttattcaaggtgtcttgatcctgtcttttccctggaagaatcttcttatccttcccttatttttatcctccccctccccccagccccagcctgcatgtgaggttcccactggagctacctgtgcacaagcctgcagtggacagaagagggtgtgggtccactggaagtggagttgtggtttgtgagctgccccatgtgctgggaaccaggctctgctctctgctacagcagcagaggcctcagctctacctcctctcctcccctttcttcctttgtaatgcaacccactgagtccccagtgctgcatgctggaatgttgcctgatcttattggcttgatcctggcgctggtaaccatagctgctgtgagtttatgggtgcagccgcctgccatgcccagaagtcagcattttcagcgctccttttcacccaccagctcttaaatcctttctgtgctcttcctggatgctctaccagccttgctgggctggatacagatgtccaggttagggccgagcactcggcagtcactctcagctctccggtcagctataagtctctgcattaatgctggccactacagaatggtttggtttctctggccaaggcggagagcaaaccatggatgtaaccgtcgatatttagaagacagtttaacaacatgtctatgcagcaaacaaaacaccaacaacaaacctggtaataggttcccttagggcctatgacttcccaggcctttgaattccttcctccctccctccctccctccctccctccctccctccctccctcccttcctgtggaacaggcctcgcatctgaacagaaggttacccccaaaaccttcatgccacagttgcactgtggacacattttgcctgacaggccattatagtaacctgcaggggtcactgctaggtaaaatcattgatgggttttctctccatgagataacctaccacctcttagcattgccaccggggagg

SEQ ID NO: 20810 - DNA, 2287 bp, Mus musculus
tgggggatgtatccttgcagttgcagggcgacgacacagtggaggttgtggatgggatggtgcacccttacaaaggtaggaccccatgaagtctctgctgcctgctgtgcactgaaggccagaggaacaaacactcctttggtccctgtccctgtcccagtcccagttgtaggagcatattgaagcgttcatttatctctaaggccagatagatgtgacttactggctcttacatgctctgtaattaagagccagcctgggaaggtgggagtttggttttgggtcctgcacattgggtggatgggctgggagactgccctgttcttacaggaagcagcctgcctagtgaccaccttcccaacttggcctctttccaaaatctcctatcacagcggccccattgaggtcagtggccgcctgcctggacagtgaaatgggagatgttagctctgttgcaggcaagcccttgtgcagcagttctggcacttgcattcctgtgattcctgtggctgtggcttctggcctcacaggatgctgctgagtgtgcaacagtccacagcttagggacaacttggggaaggggtagaacctggcccttaatagaaaactcctcgtatcccgtggtctttctgatggcgactctgctgagtgccagggagctatgactgcccagataggctgtggtctgccccagggaatgtttagttgtcaccactgggcagtgaagtgtctcagtttcacattttgtggaaaatttctttccctgtgggtatccttagatttgttttttggtctccaagattaaagtataggctatctgagccttgaagaatgcataagtcctggtgaactgtgtcaggccaggcgtgactagtagggaagggctgtatttagggacagctgagacatgtcatgcttagggcagggacagggacatttgcacagttggatttttttctgtttgtagcccagccctaagtggaagccaagagtccatccctgacctcagtgcagactgtgtgggggtgggggtgaccaagcgtggcctctgctttgcgctgctcgtctttctgaccactcttgccaaagacttgctgtctcctgcatctctgtgttgacctgcgtctggactgtcaccttcattatgcttagcaatgcttcagaagctgtccgttctcagctttttttttttttttttttgtctagtgatacctgaagttgttgtgtctttccccatgtgtctgtgtctgcagcatgtgacttccatatgtgttcctgcagagcccagcgcccgccccgccctcaggctttctgcgcgtggtggccgcttcgctgcctcgtgcatcctgtgctgtatgccttttctttgttctctgtgtatgatcatgtctttttccttaattcatctttattttctttcttttttaatctcctttgggacagggtctcctacagctcaggttggccttgaccgtagaatcaggtgccaccacacctgtccctggcactgtcttttattcaagcaaataagctttcttactgaagtacacagagtgcaaccagacagccaccatcgattgccctgctgtttgccaccccaccatcctctccctgatttcaggttttttgtatctggaattaactgtgtcaccccctgccatgcttccatgcacgggtcctgtgggcaggccttacagtctgctgcctcttttgctccctgagcgtcgtctgtgttctgcccgtgagaacttgtggcacttgcacttattagatggtgcatgccgtgagccaacagaggcttgatggtttttttagatgggctagtgtagcccaggctgagtctgacctggccctcctgcctccacctcctcctcccgaggactgggattgcagtgcaccaccactcctcctcgtgtctcctgcaggtgaccgggctgcgtactgcagagcagcgaacaagcgggtcatggacgtcatccactcggccagggcccggcagcagatgctgcacgcacagacctttcacagtgattctctgctgagccaggaagaggctgcagctgccggggaccggaggccagcgcccgacacctggatttacccactgatccagatgaagccctttgagattcagattgatgagatagtcacggagacgctgctgacggaggctgagcgcggagctaaggtcttcctcaccactggctacttcaacctgacccaggcctacatggacctggtgctaggcactcgagctgagtatcagatccttctagcctcaccggag

SEQ ID NO: 20811 - DNA, 1490 bp, Mus musculus
gaagctgggtgtagctttgtgaccctctcagtgtgggcagaggtaaggatcagggacagcctgagtggatggtgagaccctgggttgcttgttgctgccgtgttagggaagctcatcacatggcagttggtggctgaagcagcctgctgtggaactcatgtcatctacaggccgatgtcttagcacgctttacttgcagagaaccacagggagcacgcagtgtgtacagtgcatgctttgggcacttctgcaatgtggcttgtctgctgagttctcatttggaatttttagaagtggctcctagagcttagttcacagaacttcgacagtagctccggtagaatggggtgatgatgtagtgctgcctggtgagagcggcagcccacaaccagggagcgctccctgggaggaggctctgagagagagtggatgactgactgggttcaccagggtccccccactccctggtcttggtggagtgttaggcatgagtagtgtggcccttgctgggtgggtggtctctgtagattgctgagcattcctcttaccgtctcagtgctgtgagctgccgccgtcaccagcatggaggagtccatgctcacaagtggaaactgagaggcttggggtagagcttggtgccgggcatttgcctacattcagatgtgtaggctccgtcctcagctctgcagagcctcccaccctccccagctactcagtgtatcctgctttcccaccaccaggaaggccaagcactggtgaactcctaggtgggtcgttttaagctgtgtgtctgtagcttggttgctgtgtctggctgtgaaggagagtcctcgggagcaggcagcagcgggagcaggcaggggggcacagctgggtcactgcagctgtgctgctcactgatggcttgctagtctctggcctggctgtagggagagtaggacaggaacagtctaggggctggggtagtctgctgactgcatctcagacggtcagcctctttgagtaggtgctgtgggttcactagggtcccatctggtcctggtggagtgcgaagcctgcgtgttaaggcacggtgttagcccagaggagtctgttaagctccagcatgcttaacttggtgcctgaggggcagctttagcagaacctaagagtgtgaagtcagctgtgtctcagccctgcccagtggggaagccagcggctttaatcaggccatcatcactttgacttcttgccctgagcaagacttgtccctgctgtgtcctgggagcctgcagccctgttaggcagggaccacacccatgctcactgtacagtaagctgctttgtccatctgccaggccacaggctcagtgcaaccccccccacccccccacccccgttttgggggatcacaaaggactgagcatattgacttggtttcttctggatgaagagttctggattaacaaagccctctgtgtggtcagggatctttggattagagacttctg

SEQ ID NO: 20812 - DNA, 1151 bp, Mus musculus
tagagtctcagggtttggtgttagaggaaaatcttgcttttcatatgtgggaagcagcctgacccatggagggtgtccccctcctttctttgagcaagatcagaaggtggttggcaagttgtaccaagcagacccagtctgggtgcagtgggaaggaaggattcctgtcccgaggattctttgccctggttccatgctatgggaaatctgaggtggggacagggaaacttaaacacatgaaaaacttgaggtgtgcaagagtagacatggcctggatccctggatagggagagctgcctggagcagagctgctggccagggggtgggagggacaccatcctctggcctcttgtcttattgctgaagccggcaggtggctttgctgaggccttcaagggcaggacaccagccacagaagtgagcagcagccctgtcagctgttgcccaagcagttcttgaaactctgctctgcatggacattaggaagcagttttctgctgtagcagcatgtgtgttacatacaggccatgtgtctgtgatgtctcagcatgtgtgtgggctctctgtggatttcgttgatggaggatctgtgatgggagggccacagggagctggcctggtgcagaccaggggagctggctggctttcttggataaacttcctcaggctagtaaggggaagaagggtagaggctgctaggctagcctggggaggacagatgctcaggactagctctgtggggcttggctctgaagccttggagcttgagatcatagaagagagtgcagaatgggacctgccataggcatctagtagtacttaagatcctgctagaacagcagtgtccccatgtgtactgtgacagagcagcttctgtgggacccactggcagcacacttctttatgtggtgcaggtggtaactagagacacgagcaaactcctaggtgtcctgaggtagaaaaggtgggcagctgtatgtaggcaggcctggtcctaccaaatgcctcaaacaccatgtgacagccacctctgctgttaggtagggtagagcctacttgcctgtttgttctgggctcccagaagggatggaggctctggtgagctccgtcttgagctgcactttgccaacaggtgcttcaggcagttgaaa

SEQ ID NO: 20813 - DNA, 1157 bp, Mus musculus
agtcagattcagggtttgtttcccaggatgctggctccttagctgctgggaatcaggcttcactgctgtgtgtggcattgggaactgagtgcatcagacgggcacaatgattgcaagcattttaatctgtacacatacaccccgcccctgacacccccacgcctgctccatagcccaggagcactgggtttgtaagaagtcaaaagtggtaaaatgtgtctgttttctggttagaaccaggcaggatcggtaccggcctagtcacactgtaggtagggctacacctgcaggagcagcgccacagctgccaggatccacttggctgccttctctttggtcttcaggttaaaagtccagacataggtgggtcctcggatacgcgtcttgtatacggggcattcatagatgttcttggtctccattcggtccacaggaatggccttgatgaagatgacgggcatgactggggtcagatccttcaaccgggcttcagcaatgactccggtctgggtgtcccagcgagctcctgtggggacaatggagctgagggtctgggtgccctaggggaggcagaacccactgtttggatgctgaccgtgaaaaagggaggcacggtagggagagaggcctggcctccaacctccccactcttttcagagacaggccagtgactgggagccatgaagcgttcaggccaggtgccagggtctgagagtgccaaacatggaggagtgtgaaccaaggactccgaggtgactctgcatgccgtaatggctctgaggctgcatcttctcagagcttcatctcagccttctcaatgtcagtggcagagaaaactgaccgcagctcagatcccagcaatgttccttcctgatccctcctgtgtaatgtctactctctgtgtacatagggaataagttatatatagatgcacatataaacactatctgcccttagccagactgctgttgtctcttatcctagccaatggtgtttgtgtcctgcgtggcattggaatcacaataaacatggagaatggctgttgtgttgctcaagtgatgtgggtgcgtgacccttgggtggcctggtcctgacacagcattgatggaactgtgattccaagaaaacagccttctggctgcagagtagattctaat

SEQ ID NO: 20814 - DNA, 1183 bp, Mus musculus
ttttcttttttggtttttcgagacagggtttctctgtgtagccctggctgtcctggaactcactttgtagaccaggctggcctcgaactcagaaatccgcctgcctctgcctcccaagtgctgggattaaaggtgtgtgcttccttactgctcggcttacatctattttctcaaaaccttctattcttccagattggaccacttatatagtactttatacttaatattttatccacttttaaatttcatgctatgtattttgatcatattctctgcctacttcttctcctagttcttcctagatccactcttcctcccttccaatttccaatttctttgttttaaaacaacccagagtccaggctgcgttgcccacatcccctgaggcagggctgtccactcccagaacacgatgtggttgacctaccccagccacttccttaaagaaaatggactctccctcctctggagggttaaactgttttaggagctcatagccctcgaatggaattggtgtggtttttcatacgtgcttgcttctctaaaccaatcagaagattctgagcatgctgggcactttgactggggactctcacctgtgcgtgtcccctccccccaaccccgagttcttactgttttctgctactataacggaataccacaggttggctaaattataaagaacagaggtttgggccagtaaaatgtctcagcaggtaaaaacacctgcctcacaagcccgaccccctgagtttgagcccttgactcacataaggatagaagcaacaacacaaggctgtctgctgagcacacttgctgtgacacataagccacacacacacacacacacacacacacacccagcatgtatacacatagtaacagtaacattcttaattcttaaaaagtagagaggtgtatttcatctcgctgacctggaggctggactctcagtctggcatctgaatctgcccggggccttcttactgctctgtaatgctgtggtactgggccattccaacacatgaaattaaggccaattccaacacattaaattgtatttaattaaaatttaattttaatcaaattaaaattttaatttaaccaaattaaaatttaatcagtttttatcaaatccatagcagttgcattgtattgtcttaatgccatggccaggtagctt

SEQ ID NO: 20815 - DNA, 1167 bp, Mus musculus
cctcctgcgtcagggtgctgacccctcctttctcctttcttagcctgtctttgtcacaggctgtggctggcttctccagcctcaggtacatctctgtcacaggctgtggctggcttctccagccttgggtacatttgctttgcaccattgtcaccctgggcctcctccccagcccgtgctctcatcttgctgtccaggacatctcacggtgtcacccagacacgcttgctctgctcataccatagactttcactttgtgaaagatgcttctgtcttggctgtgtcttgtcactgatgtaaattttgccatggtctaaatgttctcctgataccctgccccacccgacaccctccctgggaagaaagctttgtgtgtgtagcatgcacctacttaggtgtcttttgtcaggagtgtctcctttttgctctcaggtggcagggtaaagacctggaagaggcgctggttcattctgactgacaactgcctttactactttgaatacaccacggtgagcatctactggggcagaatgggccaatcctccacttccaaaccattctccccaaacacagccagagggggccctagggagacggtcagatctgtcctacttccgtgggggttagggaggaactaaatctcagagtggaacatcccaacaggatgtagaggctgtccaggaggctgtagaccagagccagcacctagttctagacacacaggaggcacaagtcccaaaactgagagagagccatggacaccatgcttgttcagagctggaaacatggaactggagtcagttgccaaaaacctagtgaaggggataattgttgtgatttggtgaactcagattttctgtggtctcagaaatgctgaagggtttgattcagaacacacagtctcagtgtgagagatgcaacagaggaagaggagcaagacgaaacggagggagcggctcatgtgaggaaatcagagggctgggggtgacacttcctaataccatggaagttcactaggataagatcttccggcaggagcctgtcacttgcaggcgccctttgtagctgtaggaataaaaagtacacagtaaaatgcctccaggcttcctatggaagatcactcaaagccacaggttgttggtctcgggccatgcctccacactggtg

SEQ ID NO: 20816 - DNA, 1898 bp, Mus musculus
tgtcatgctgacagtaaccttggagacctctggaaaggttgagcatcttcctcatagacctgtggtccagtaggaacaccgttcctggcctggggctgtcagataaggaacagaggccagggtggcatttggtggtgccttttctggtgagctgtcctttgctctctgaagctggagctgtctcgtggctctcctctcagaggggcctctgtatgactgactatcagctgcaacaagaacaagccctgctgactgcactgcccccatccccacccccaaagtgcatctccttgaaagaccaccacttcttccagaaagctgcagctgctgggcagggagagcctctgcttccgtggctgccagccctgcggggagactggcaagctcccgcatctgccacaacctgtggatctctgtcaaggtggtggtctttagagacgaattctccgttattttactacttacgataaagcctttatttttgaccaggcctgtggctaccagtagcaatatgtttctctaatatgcagacactggctttgtttgctcaattttgtgagtgctttgacattgacatgatctccttccctgtcttgctcaagctgcccctatggacttagggttaacaaacaagactcctcacccaggagacagaaggtgccagaaggttcctcctcatggggtgcatctcttcgttccccaagccccagcctgctctgggctgggctcctagtctgggcctcttgggagcgctggagctgcctctcatttccatgtgtagcgttctgttcagctgcaggctcagggtcttacttgctgcagatgtgggaagaaagggttgtgttctccgtgggccggagttgaggtcctgtttctgtgtgggtgtttccttcctgtctgtttctttccctttagagaaaaggcgagaacagtgcccctcgatgggtctgctggtgagtgagtcttccagctgtatgcgatggtccttgtgtggctgctgtctggatattgtgtctgggagtgctgtgggctccgtgttctctcagaggggggcagggaccgtccttctgaggtactgccatccttcctgtagcagctgcttcctgggtacattggttttctttacagccttctctagtagaaaggtgtaaagctgccagcacagaactgatctgtcttccgtgtctcctcagattggttccttcctttgtgctctagattacgcagtgtaaagtctcctccaggggcacgtagtccactgcctcttaggcagtcatgatcccccatctactgtcctgacttctggcagcgtgtgttgctgtcagtgatggcaagtccttttcttccttagaagccattaggaacaggtcatgggtggaatgagttcttggtggcgtactgacataaataattgaagctttcctaaaagtagtcattttgttgggtcaaatcaaatcagtttgaactttgtgcttggcagtagacatgttttaggcccatttgcagagggccacctccctggtgtttctgttcttgctcacctgcctgttaggggctgtttccatccaacatcctgtgtggctgcgtctgtatgtgtgcaggaatccccgtactcttccacttcctcttcaggggtccccagatattgccaagatcttggtgcaataaagtaatgcattttttttttgtgatacctttctgtgtctgccttgtctcttcgtttttaagaaggcgcgtggccaggccgcagccccaggtcaggcggatgcttccatgctgctcttgggtgaccgtccacagctgagacgggagcgccaccgctcgagcccaggcaggaagggccatcttggacaaagagatctatttaagtttatcccaaagctgtatttgtgtagatt

SEQ ID NO: 20817 - DNA, 1221 bp, Mus musculus
tcaggtagtagtgcagaacctgcatgctcactggaaggcgtagaaaaaaagggtcagtgtcattggccacaggggctagacctgcctccccagtcaaggctcgagtccttgggtgcttgctcctggatagagatgctggggcgttctgtggtgtgtcagtgtagttgcctgagatgttgtaggggtggggcccaggcaggtagaggttctgtaaggagctcaggagcactgctgggggcttaggtggagaaggttgtcccattgtcagctcataggtggtgactgggggtgggatgctgggtgtgagtagctatcctgtgctgggccatcctcttcacggccgtggcttccttttaggttggatcggcagacacaggctactaccctggtgcatcagatctttggaggctatctcaggtcccgaggtaagcaggaggtgtgctctccacttaagcagatctgcacacattcccagactgtgagaacttaaccacatggtggtggctgaagctcccaggctttgtctttctgcctggctgcccttgtccactataggagtatcccctgagggagccggagaagcatggtgtatgatgatggggcccatccttagagctcctggtcctcgggatgaggcctgtgtgacgctgtaagggcttgcccactggcctgtggcagtggccagtcaggcagaccaggcctgatgacagaacctggcctcacctgtatctctgtctccagttggtgggtcagtcaccttttgggtgagccgagttaaatgctctagacctgtggttctaggttctggacctgggtggtacccccgtgggtcacagctccctgtgcctctgttctgttgcagtgaagtgctctgtgtgcaagagtgtctcagacacatacgatccctacttggacatagcactggagatccgggtacgcttgggcagtgatctgtgttcctgggggcgtgaggagggggctcagcagtgggaaaggtgtgagtcagaatagacatggaagagcagcttggctctcctgcagcctccgcatgctgcacaaggcggacaggccaacatttgcatctgtctgcagttctcctatgcaaatttctgtcagctaaatagagtaaagctaagtttccgggtctgaggcacagaaagtgacagtgcctcactggggcttggggacagcgtttggaacaggcacccattagtctccttt

SEQ ID NO: 20818 - DNA, 1234 bp, Mus musculus
caaaggatctattgccacttgtgtagggtgggtcaggtcagaggagagagttgccatcccagccttcagagtgccgtgaagtcagtgacaggaacctcagaccggtctgaacatttgtgcacaaagagagaggatgtcactgtggcctctgaccctcacgtggctcatagccacagggaagcagaaataaggtgaccgaggaaccgttgtcacctaactgggggtagatacttggggagagaggttaccacaggaacccagcaggggagccatgcccagatctctgctgaccaaggctcacagtgacagcagggagaccaggagatggtggaacccctcaggtgagggtgttcacacacgaggaagaaagtggctgtgggtgtctttgtcaacagttatttgcttgacatccctaggtttttgccagttggtgtgagactgagatgatcaatgcccagggtggcagtaggccaggcacacccgctgtgtggcagggctgactccagacacctggcttccctccctccctccctcaggtacttttactcccgaagaatcgaggtcagcatgtcttctgttaagtgcttgcacaagctagcctctgcctatggggccacagagcttcaggactactgtggacggctttttgccaccctcctcccccaagaccccactttccatactcccttggacctttatgcgtacgcacgggccaccggggactctatgctggaagatctgtgtgtacagtttctggcctggaacttcgagcctctgacacagtctgagtcctggtcggctgttcccaccaccttgatccaggctctcctccccaagagtgagctggctgtgtctagtgagctggatctgctgaaggcagtggaccagtggagcacagaaaccattgcctcacacgaggatatagagcgcctggtggaacaggtccgcttccccatgatgctgccccaggagctgttcgagctgcagttcaacctgtccttgtaccaagatcaccaggcactgttccagaggaagaccatgcaggccttggagttccacacagtgcctgtcgaagtgctggccaagtacaaaggcctgaacctcacggaggacacctacaagccccgcctttacacctcttccacctggagtagcttggtgatggcctccacctggagggcacaaagatatgaatacaatcgatacaatcagctctatacatatggctatggct

SEQ ID NO: 20819 - DNA, 1422 bp, Mus musculus
tggcagggtgagggccaccccttgggaggcacctgcccacactctggagcctctctagcacaggattgcttgcgagctgttgataacttcatttctcccctcaggaggatttttgtgctgtacagccttttaaagtccaaattattaacttatttttactagagcagtttcttttcctgaataacagagtcaccagacttcatcacacagtgacagtggagttcccacatgcacttccaggagcgagggacttgtccccacacccacagtggcgacgtgagcttttacagaaagagtctcagcatccctggcctctgcaacttccaagggctgccatgctttcacccctcagcagtggttgagggaggggctgcacctgactggagacctgccctcattggctcctggtgggtgtttagcagccttctctctagggaggcctcactgttttctgctgtcctgttctgtccatgttcaaaagagccaaggcagcagagtcaggctcagaggtcattctgcaggcagcagcacctcacctgcctccggcacccttagaacaggacaccggtactgctgtaggcacagggccctgatgaccgtcacaaaccccttccacaggaagccactgccactggggcctgactaccctcagtacagcaggctgctgctgacttgtggtgctgaggtcttcgtgtactgttgtgctgggagctcagccaaacctccttgatgtgtgtcaactgtgttcggttgtgtgattctgagctgaaagatgaaatgagagaggttgagagagacctgggcccctcgctgaggagccttccacataccttcctttccctgagcaatgattgtgtctttccattgttttataaacaataaagtgtcaggggaatgtggttctcttgtctatgttggctgttgccaagggctctgccccaggaagtctaaagaggtgggatgcaagccttggggtcatgaaatggcccctcacctctccaaatgaggcccaggaagtgaagccccgtctaggcttcccaggcttgggtctgatgggaagagctgtacggagagactggctccagcccttcaggctctgtcctactccattttcccactctggcaattactagagtcaggacagagcccgaagtgctggatcctgaactacagcagacacaataggccaggcttggaatcccaacctccacaggccacgacaaggaatagtgatgagtagagaaagatttgtggccacatcaggcagtgggacaaggaaaaggtccagactgggctaacaaggaggctcagtgtgaacagtgcctgccacacaagcctgacagacagagtgatcctcagaacccatggtgaaggagggaactgatgacccagaagctggtctcttaaccttcacatgatccc

SEQ ID NO: 20820 - DNA, 1166 bp, Mus musculus
ttgctagccctaacaggtgacccctcatccacaaaaagcctgcctagcttggggccctcataaacacaagataagtaggcctgagctgccatcccctgggctctgaggagtgtgacctttgaatgaagctgaggtgtgagacaaagggcagcagggagccagacccagagagctctcccatgctgcaatggtgagctggtgcttccctcggcctcaaacactgctggtgaaggctgcgggccctgcagggacatagggcagccagtgagggatgctctgcagactcagtgtagctttctggctgggctgtagtggctgcatggttgtcccaggtcgtggagagtaggtgcagagcttgaggttagagggaagatggagtgaagcccccaaagtgtagcctcgggtggcaaggcccttgagaggaaggctgtgccggtcagcagggcgtgtgctgactgcgggtctgtactgctacctcaggctacctcattcacgagtccgcctgctggagcgacacactgcagcgctggttcttcctgcctcgtcgggctagccacgaacgctacagcgagaaggacgatgaacgcaagggcagcaacctcctgctgagcgcagcccaggacttcagggacatctctgtgaggcaagtggggactctgatccccacccacggcttctcatccttcaaattcatccccaacacggatgaccagatcatcgtggctctcaagtcggaagaggacaatggcagaatcgccacctatgtcatggccttcacgctggacggccgcttcctgcttccagagaccaagatcggcactgtgaagtacgaaggaatagagttcatctagatgagtaagctcgcacgcccagaggggcgagggccagcggctgtgttacaccaggactcataaaaaccgggagcgcctccactcgtttgctttttttctttttttaactaagagctgtgttcctggctagagaatttcattatagggagctgagccccggcccatatgggtgtactgctcggagactgggagcaaggggtcctatacaaggaaccccaggtgctccgcccacccgcgctcactctgcactgccacttggtggtagggattgatcactgctgcagctatcttctgagcctctggccttcagaatcc

SEQ ID NO: 20821 - DNA, 1214 bp, Mus musculus
tccaagtgagacagaaacatggctgggggaatgggaccaagctgaactgatgcctaggtaaggggaaagaagagtgcagatgcccctaggttggtcctcggggctgggcagcccttagtgtagagagttctgccaagaagctgatttgataccaattggcctgcctaggggaggtgcctaggctacagagatacctagaataaagaacgtgggacttgctagcccctgggccagcagagacatctccctgtctctaggacagtgtttggagaggcacagatagcccaggtatgcagacctgggcatagggctgtaagaaggaggaggaaagggcgggaatgtgatattcttgaggtggtcggcagggcgctggagcggggcaggagactgctcctgcatggactcccagatcttctgttcacaaaacaagctgagtgctcagtgtccctgagagggcagtccaggagcacacatgagccagccaggtgaacaggatgcctgcaaaccaagggaggggctgggacaccagtgtcagcccattggggtagcccatagagctcttcctgaacaaagatgtggggatataggctgtggctcacaggaatgcagagttattgatcagggacaagtttgagggttctagagactaaggacaatggcgtgtcatggtgtttaccactctacacaacagtcatgtgttttgggcctgtggctcatgttgggcagctgagtggctagttcctcagggccttgatctagagctgtgccctttcagatgactaaaggaacctcaccatggtgttgatcagtcagcccctcagctggtgcatgctgattgtctcttggctcctagctctgagctgcgtgccagagctggagcaggaagccctgacttggtgaggctcccaacagaaggagagcagatgggggagtctcccaggactccttgggtgtgagtgaagcagccatgcagagaggggcaggtgtctgggccagtggaatggtgtgaggcttgctctggaagtgaagactaagagggaggaccattgagccgtggatggttacatagcaagtagtgcaggctggggtggcggcaaagggctctcggaagaatagctgtagaggaactggggactgctggcatgtttgggtgagcggcgctcctgcagatgagggaccactacaggaaggaaaggattgaggccacttcttgg

SEQ ID NO: 20822 - DNA, 1150 bp, Mus musculus
attttctctctgctccatcctggcttccttggccttggcttccaaagttttggcttttgacaagatgcccttggccactgggaatcccaaaggacggtgcgatcccagatctggctgctactctaagcagagagctgccggcagatgaaatcattgggcggggagcctgtgaggatattggggggcctccagctccttctgtgtacacagccttagacgaccctgtgctgtgttgtcccgtggccacagggtgttccagagcacagcccctgtgtgttcccattcctggacacaagtaagcaaatatcatgggtttcttaggaacgaagtcaagcagaaaagagaaagaaaggtggtgttagttttggctttccagccagctggagggagggatggggagagagagagagcgagagctatttgtattggggaaactgaggcataggaaaaacatgaatggcaacagagtagctgcagtttgtgggtttggaaaccacatctgacttaactctagatcacatatgagctttcctggggacagcaggactgacctccgagctctgttgacatgctatagccttgcccaggggctggtcaatctttctgagccacactagtaaaagggttgggggagaacagcaagtgccccctgtggttggctctgggctggtggcagcatcctgcttgccccaactcacaggatcctgacagcagctgggaacctcagggactcctgcagctttctctgtaagaaataaagctcctactatgtcccagtacctctctgctctgctccacttccccagtcactctggaccccagggtgggagggctctcttgcctgttgggacatcagttccccttcctccttcttggtgaattaaccatggaaggaccagggctcggatttgggttcccaaactgcccttcaccatccctagtgccctgcttccttcccagttcagcatcctgtctgggaacttgatactttaacctgctagagcggatgagtctgatagacctgcccagccctgacacagccctagtcagcttatggacacgtgagagggacttcctttgagacccagagctggggtagagctataaaaatctacctattcccgggtcaaccccaagtggtagaagagga

SEQ ID NO: 20823 - DNA, 1182 bp, Mus musculus
aactactatcttagagaacagcgtagaagttcctcaaaatgttaaatatagatttgacgtgactcagaaatcccacttgtgagcacatgctcaaaagaaacaaacaaaatgctcccacatagagccttgctcacatgttcagggaggcgccaccctggagccaaacagaagccgcatgcgcgcatgcaagcatgcacgtggggtaagcatgggagagggtgaatacttagcaacagagggcgtgagttgccagtgtgtgctacagcactggatgagcctcaaatatgctgagtggacaaagccattgcagagggtcacaatagcgtgccacgtgtcgggagtgcacagaagagggagtccacagtggggattatgggctacctgggcctgtgtataccagagagcagtggccagagaacactagtgggaatctgcagtgaactgttctaaagtaaatcgtggtcacagctgcacatgctatcaatatactaaacgccactgaattgggtgctttcctggttgtttgagacagagttaaactggccttgaacttgcaatgtagccaaagctgatgctgaattctcatcctcctgcctctacctctcaagggctgggattacaggtgtgtgctcccacgcccagctgaattgttcatatgttcattaacatatgtttcgatgatgtcagaacgaggcctctggggctggagagacaggtgagtctgtaaaacatctgcagagcaagcgtgaggacccgagatcaagccaagaacccacacgcaaaagctgggtgccgcagcgtgggtttgtgataacagtgccaggaggcagacaagaggctccctgcacttgctggtcagctgcaaaacctacagcagagacagacaagcagtaggaagtacagtaagttagagtcagtgaagctttggaaacaccaacaaaaagagcaagcatcaggcaaggtgctctaaggacaagagggaggatttggcttctgatgccagctgtggggggatgccatcacctcccagtgtgaggcagaacaactgagtctgaggaggtggctcagtggatgagcgttcttgctgcctgtgaatgcccacgggaggaccgtgtcaggattcccagcacctgtgcatacagctgggcgtgcccatgtactcctgtgatgcaagtgctggga

SEQ ID NO: 20824 - DNA, 1466 bp, Mus musculus
ctctttcagctgctatgaggtaaaccttcgtgggtgcctgctccaggacctcttggtgagcttctcacggccgccaggcagccgggaggaggagagcttcatttgtcgccttggagagatccaggtatgtatgtgggagaaaggatggatgggagggtgtctgggcccctagggaggactgggtggaagagggatagatggagcactgaggagtaggtgtgaggggatgtcctttatccctgggcacccagccaggtgaaccttctctctcttaccaggtggttgatgccagcagccttctggcccctctgccccgggtgcagaatgtcaccatttctcagatacgatggcttcctctgatcaccgggtctgagggcctccctacccggctcctcctcagctgcaccctgcactggtcctacctgctgctccgagcccgctgcttccgcattcactgctggaaacggacaggaagcagcagctctgtggcagagtccccagagacagagaagcccacgttcctgggcctggctttcgccaaccagtaccgtgtggtggacttggctgtggaggctgctggatttgggcaggatggtcgtgtggagttcctggtggagcctgtccccagggagggtttcctggtgccccaggctgagtggggaaaggcggtcctgctcttctcggtccctcagtgagcccgctccagagcacagcgtctcctcgcccacctcaagactcgaggtttcctcttggccagccgcccaaggctgcgtggactgccgaggacagccggatccccaggagatgaggtctccaggttctggctgtgactcaggaagctgtgccccacgggtgctaggcgagttccccttccacagtgctctccgtgggatgtggttctcaaggaaggaggagaaagtttgaggtttcttccggaaaattccataaaggctgtttctccgaggctgaaaaggtgcttcttttgagaatggcggccatttatcctgtagctttgacaatcagaggcaaacggcacgggtggcaggcagtaaggatccctgaagactgagaggatagtcaggggaggagtgggagtcagggttgctcacggagtagctggagtggtgctccccaggaccaggagcaccatcaggtggctcctggcaccacacccccacctgtataaggtgggccagtcacatgtcacacttcagactaactgtatggatggtggctctggcagctgaatgtcccagagaagcccaaattcctcacctgtgtgatatgagggtgctaaccaccatctcatgtccctcaagaggcaggtgagccccgcctgcttccaggtacagtggcatccttagctgtaccgaagccctgttgacactaggctgcgtgggaacttcctgctgtgtgactgcaacctgggtgatgaccccaccactttccccccgcctctcccagtg

SEQ ID NO: 20825 - DNA, 1217 bp, Mus musculus
gagccccactgaggatacactctcagaaccgagaacagaaacgggggggggggcggttcagcaccaggaacagcgccattagcgtcccggcacgttctgctttagggatctgcgggtcttgagccgtttcagtaccatggacagcgggcaactcctgtctcgggctgcgggttcagcaccagggacagtaacaacaacctgacattcaaataggtgtttttccacctggatctctctgcactgagatcatctgtgtgtcgcgtgttaaatgcacacacagcacttgtgtttttggtaggaatcttggtactatttctcattttcccattccacccccactacctccctcacatcccttgttaaaggtgaccagaatcccatctaaagccaagaagggctcatcttgtctctcttggcagacagttccaagtactctagggagcaagggtagcctctacacctccacatggctcagtttgcaatttaattgaatagaccaatcttacacatcacttttgcttttgtaaggggcgggggccatgcttgaaaggtaaatacgtcaggagctgatgaagggagtgtacatcgagtgtgttgaggccaatgaagagtcaggataggatgacctcatcctgagcgaaatgatatggtcagccccactaacctggcaaactccaggatgcaggaggtagaagacagggtttttcctcacaccctggtctacccacatgacccagtagtgtgggctgcagactggaggggtcagagatgtcagatccacccaccaggtcattctttccactaggttttttctccttccccagcaaggatttgcccagtgtgcaatgttcccttttgtttttatgattgagttcagacatgggcttctgccagcccagcaaagctctcttggcttcagtgactccccatggacatggtctgagaaaccttgagatctagcctgccaaggtccacccccccccacagccctgccctggcttacaagaagctagctggtatggagcacccagcttctcctggtcaagtgccatctctcttttgaacccctgcccttcgctctgttctgaggtggctcctaacttgtctctgtctgtgtgtgggtcttgtgtcttttcttcttttgcttttaggttatatgtggcagccacacagcatggctatgccagtccagatcagggtctttgggagttcccaga

SEQ ID NO: 20826 - DNA, 2222 bp, Mus musculus
gtgctgcgcagaacctatctgtagctatccagaccagccaggactggaaacctacccgcagtctcatcgaacacgtctttgtcacggatgtcacagccaacctcatcactgtcaccgtgaaggagtcgcccaccagcgtgggcttcttcaacttgaggcattattgagaccattgcccgagccagacctgccttccagtctctggttttgctttgatgcctgacctgggggccaactctgccctgtcctgagactcagggctgggaaatggcttcctgctgattctacctctctgggcctccacttcagtctgtcctgtcatctcaggaaagccgggtggccactgacttaaaagctacctgcttggacatagcatcctttctacacatccctccttaacctagtgagaccctcccctccctggccaactactgtgaggtggattggggaggggggggcactgatacagctccctccccaggccgttgaggagaggggtggggctggtagggccttctcccacatccagccacggcagggtctttctggtgagggagacactctatgctttgcaagtaaggctataacttcagttttaaaaggctaattagttgtgtggttgggctcagggaccctgcggaaatcttcagtctctatccgtggtgtggtgtcccctctagttgcaattgtagtcccaaagcccagtcagggtttggagtcctggcactaaggtgtacctgggtgcttctggacttgggaatagagagagccatgtccttattgcctccttcaagcaggctcaagccccagtgagaagtgaccctgttcctctctgggtctggacccatacccctgctttggcccactaaattgcaccctagttctgaggtctgacactcctgggcttggggaaggagcaggctagacacccagagcaagctgatgtaggcacttggagtcctgggcaagcaatcttccttcatgttggacttttattactaggaccccataagtcaccatggtggcaccagtgtgggaatgcaggtgttttgtgggggcctgtcaccctgctgcctgtctagacatctctaaactactgtggaagcattttctatagtcagtcttggtgcagagctccgcctggtgagtgggccactcttgggtcccatattccctgacaatcctctcccacatttgggagcttgtgtttcctccctcgctgagaagcaatagccctatgccatttgtgtggtggggtcgtttaggagcccacctggcagggggcccctaatttctttcccatcctaggagataagtctagtgctgagcccctttctaaatgccttctcccctgtcccccatcccgggtaactgtcttgaaactaccttgtcagattgctggccgatgacaggattttctgtcctgggatatcacggtgggccgtgacaatctggtcagtgagtctgtgatgccaaaaagtaggggtgctatgaaaccctggttctgcttctgccattgactgatcagccagcaggtgtgggctcttcactccagttgccttgaagggaaatgtttccccttctaaaaccagtcagacagtgggctgaggtgtctgggacctgccacactttcaaagtgcaccccacccccaccccagtagctcaccctgcacaccaaataagatggtctttgtgtaaccaaaccaacctcaatgctgtgccttttggggcagacccatatccacagctcctgagagatgcctgtgatgtgccaggggaccatgttactggcagcaggagctacgtactgggaagaattcagggccaggaagtgggtaacaaaggggaaagggttgcctactgcattatcaatgtccctccctgccctcagccagggtctgcaacctttgtaccagacactgcctttacaaacacctccccgtctctttggggtcccatgagctgttggagaagtgaccctgtttggggatctgggttgactggcctttgtcccctgctgccagtctccaaatcccaatttggtgccttttattttactggttacgtcagtcccaaagttgaaatctacaaatcctttcctctcagccactttgccttcttgtgtgtttttcctggtgctgtgaccccagtggtctatgtcacaaagcacatgtgtgtagtgcgccagcgcgagccccactggagcagcgccattcgctctg

SEQ ID NO: 20827 - DNA, 3112 bp, Mus musculus
gcacctggctggcacagactgcagtccaggttgggtggttctggtcttgtgtagtttgcctcatcacttctggggttgtcgccatctctgaaatccccgtgggtaggtatatgggtgagacagcactggcctctgggtcttaggtcaccccatgacggtagaggcagaaatgggtggtgtttttttagtaagtggatacccccacttgctaaccatgtcaaagcaagttgaacggctgaagccagcatccagccctgggaaggtgaacccttgtcttggggtcttctcttggtagtcatgtgacagaagcctggtaattcagagggggtcccataagcctacctccccaggatcacacttctgtcctgcaccccagtatctacactccaatgttttgattggggacagctggagcagatccaaagacttactggccatggagagtctcagcatttattctaagtctctagctcccacagtcctcccccctccagtgctccccaagacctgacccaacctgttcagtgacagccttgtgccaggtatgtcccctctagtcctatggactactggaccttggtgttacctcaggccagctggggcctctgcagccagacatggtgtgtgggctctcggagccctgctctgctctgaggacgagagaggccccgcgcagagcagcaaccttaatctggatgcaattagaggaaaccagccaaatgccctgtggcagctgttaccccaggattattcccagtcagcaaaaggcattagagtgataattcagtcattagacttctagctgtctcacagccaggacgtacaaatcacgggtaatcagcaagtacaccgtcccctggccacgaggcttatttaacccatttttttaaaaaaatgatgcttaatgctattggccgggcgcatctgtgtgcgcatgccccaccgataatgtctgtgctgacgacattgcttaatgtcaccaaggccttgtcatctagggctctgggagagaaggacgcctttgatgtgcgtgtgtgctgtcactgctgagacatgatgcctaccttggaaagggcgccctcacttctgactcaccctccaaggagaagggagagggcaagggagggggcagcagcagaatgtgtcctcctctctctgggttagaggatgtcttcactgggcacaggaaagacattgcctgcctagaaagttgcacctggagtgccagccaagaggcctagctgtttctgcagaggagggccgaagtccccagagaggctctgttagtaaccttgagctgggcgatctgttgcagagctatgtggttgctgatcaaaccgacccgggttagggaggggcacatgctacattcagaaggggatgactgggggcctggctttgagtgcaggacaccagcccaagagaggctctggagctggtgccttcgatggccagggcaggatggcagtaaataagtgggaagaggaatgcttgctgtcagggtcagctcctgaaaggctcctttgacctctggcctgtatttgtgttttccttactgctttgctggggttttgctgtgctggggaggggggagtagggggtgcagtacgtggaacttgctaggccataagcgatgcagtcgtctttgacaacattaatttagatggcgatcaaccccagggttcctggaatccacctgtgacctccctccgctctgtcagttcccttctactgcagtcaggccaggagtgtcaggcatacccggggctggccagacagagggaaggaacctggcagagatccctggaggccaccctgcctagaacggagacgatgatgacaggttcccccagaaaacttatgcagggctatgctatggcctgggttataggggagccaggactgccacccagctgggccaccagagacgacatagggaaactggctagcctgaggctggacctggcagatccctggagtctctgaagagacaagtggcctctgggtgttagtgttgtgtttctacagaagctgtgatgtgttttgtcatgggctagcctggtctagccggattgtgacaccccaaatctaagaagccagtttctcccagagcttctgcagcagggagcaaggggttcccccagcccacttccttgcctataaaaggagaacaaggccctcccacagactccttcaaaagacttctctgaggctgccatgagggtggctaactatggcccagggacttcacccgccactcagggacgagcccactggccttagccttccgcagcattgaccgagaggggttgtccactcccagtcgaatgccctcccaggtctgaagtcagcaaaccaatgcctctcctgcacttctaccttgctgagtgtcctccgcagagggcaaatctctctgtaacgttcactctgtgccacccacgcctaccctgaagaaaaatgagccacaaagccgcctcagcggtctcggtctgcgcctagctatgcacataggtgtttgcagagctcttccatggacggccctcggagggggagaccctttctgaggactctgcactttctgagcagctgcgtgcagatgcctgctgccaccaggcctttaaatacattgtgttcaattccaggtgggaagatagcatttcaggtttgcagaaatcaagtcacatgactgtcttccttccacactttgaggataaggaggacagcttttttgtgtgtttcgttttgtttttaaagtaaggaaatacccccattgctgatgtctatagcaagtgattcgtttctctgttgcattttgtttttttaagcagtccccttccggtcaaggtcaggactggtcaccatgacccctgtgaataatgattctcatggattcctcacaaaacaaataaaatagtatcaccacacacatggtcctgtgccttgagagaaaaccctagtgagagtggccaggtcaggagccccagggctgggcagagaggctctgtggaagagccatgggggtctttagccacagccagcctgcccagctccttggctgctctgagagtattgggaaggggagtcggtgaggcctgagatgcagaaccagagg

SEQ ID NO: 20828 - DNA, 1237 bp, Mus musculus
gtgtttcagggctccacagatcatttgcacagctgacatccagcacctcctcgatggaggtggcttttccttcataaaccccagtcgcagccacatcagcccaagtcagcacccgcaaaaagtacctataggaaccccagacccatattccagccttcccctgagggtgctgaggtaaccggttggggtgacagccttgaaggagattttgggaaaccctctcctgtgtcctcttatgatccagccgtgagattagaggaagcttgagaaaccccttgcggggttgagagctccatccagcaagccggccctaacacactgctccaggtcctcagggcagctcaggaatggtgtgccaggggtcctctggatccagctgcttggcttcctaggtagagggggtactgagttttgttgactctgctccccacacaagcagccagactcccttgggactcactgtttcctgcctgaggtggctgacagcgggctctgattaaactcggaaatcaaaacctgtgttaatgcgttcacccctccccccaccccgtggcccttcagtgacgaggcttgcacgagtggccagctggtggtggccagccgagagagccaatacaagatttttcactttcaccacggcggcctggacaagctctccgaggtgttccagcaatggaaattctgcacggagacacacctcagggaccaggtagcccagccgacggtggggtgggatgtggttggttacggcgaggggatggaagctcctctctcaggatgccaaccctgtgggtctggggctgtcccagcacatcttcttggggggggggggtcaggggggtctggctctggggattcccctctgaggagaatggcatttggctgtctgtggttgaggtggttgaccgtcagtgtgcctgacggctgaagtctgtgcctaggcctttctggaagtcactttgagcatttgaaggttcatgttttcataaggctttctgccatatttcgctcaatctgcatacagaggtaataggagcctcttaatcacctgtttaagatgctgtatgtgcttattagaacggggaggggggctgactttacagccctaccctcccgtagagcctcccgccggctcctcttattacgatagtggcaaatgccccccctcacccccccgcgctgagcaacctttgatttttgaattaaatgtcagctgcagtttcgccctggactcatg

SEQ ID NO: 20829 - DNA, 1208 bp, Mus musculus
acctctcccagccctgcagcatgaggcagaagaatcctgtgagcaagttcccaaagactcaaaaccagggtggggctggggagatgcatcagtcagtcacaatcatggcagcctgagctcagctccagtgccccataaagagccatgtgagggccatcccaacactcctgagtcagagaggaggatgagggggggggtcactggccagccaaagagaccccgtctaaggccagaatcaatcaaccaaaaccaacaaggcaggctggggctggagcagaggctcgttgggtaaagagcacgggctaggtgcttttcagaggactgggggaggctcggcagccacgtggaaattcacaccatctgtaactccagtcccagggatccaatgaggtcttttggcctccagtggtgcacagacagacgtgcaggcagaacagccattcaattgacactgagggtgacccctgggttctacatatgtgtgcaaacagacacatatacatgcatgcactccaggaagcacacagggtgaccgacgccgtggctgagctatggggagggctgagacctaatgtggctgttcggtgaggctgcaggactctgggcgtggaggagaacactccagatctgagctgtccaacatcgtagcccctcatgccacaacccttgtgaactcctgaaacaggacacatgcaaccaagaattcttgcttatttatatttaggtcagggtctcatgtagcctaggctagccttgaactcattcgtcaagggtaaccttgaagcccccagtgttctgctgcagcctcctgacattacaggtgtgtggtgctactcctaatgtatttggtgttggggatggaacctgcatgccagacacacactgcactaactgagccccagccccagctgcatctaagcacgttaattgtgtgtattgagtattactgatttaaacagcacccatggccagtgttggccagctgggtcaggataaagacaccggagagggtaaacacaggccagttatgaagcagtttttagtgttgcacatattattttgtgattaatattaatcttagaaggtcaattaaaaaatagccctaagctgggtgggatgtcacttagagacagaaacatgtagatctctgtgagttcagaggccagcctggtctacatagggttccaggacaaccagagatacatagt

SEQ ID NO: 20830 - DNA, 1241 bp, Mus musculus
caaaacaaaacaaaacaaaacaaaacaaaataagagagtagacttcagaggcatggcaaacctgaatgaatcccagtgtctgagtctgcatgtaattcagaagttgccccactgggcaactccagagtgggtgggttagggaccagagtcctcctgacttccgaggacagacatagggtctttttcccacacagaaccttctggagatcgtgaccctgcagacccgtggcaagcacctgcaggccgccattgaggggaaatatgtgttcctgcaccgcaacagcaggtcccagctgatggagcgtaagcgcctgagcgtccggctgtcccagctcaacaaggtcctctccagcgtgcaggaagactacccccagtaccaggaggtgctgcagagcattcaacagaagatcgccaccaagctggagaccccagagccctcctagacagcaccgggcctgcacctttcagggctgacttgcgggcagacccagggagtcaccacatgttctgaaaaagccacgtgtctcctagagcgacacccagtctaagaaacaccggcaggccagacacgtgattcaaagcctctctgctgttcacaccaggtgtaaagcagccaccggatccgacgctctgagcacgcccacattacctgggtgtgaaaaaaacccactctcctgttggacttaaaaccatcctgttggcagtcctacggtcacatcagtgcctctcactgtcctgggacagaccctcaattttgcggagcaagtaatgcagagaagaagccaggagtaaggtggacttatttgagccctgggaatgcctgttccagccctctgaagcccagaagataccctcattctccactccacagaaagctcggccttctcctgcccccatttcccaggaagccttaaattagacagaaacccaaagaccgaagccgtgggacccagaagtccaaggatagcaaatgcctatggagcagaaactacttcagaaaagggacacctgtctctcatccaccgacctctgacctctcttcttcacctctgcctcccctaccctggggtttctgggcaccagttacctttttccttgtgtagatgagaaacggattatttcagttttaaacttgaacagcagaaaaaataaagtttacaaaagctgtttctggtcagaagagttaagacacatttaccttaaaatttatatctatcagggcgtggtggcgcacgccttta

SEQ ID NO: 20831 - DNA, 1146 bp, Mus musculus
acagaggcaggcagatttctgagttccagcctggtctacagagtgagttccaggacagccagggatacacagagaaaccctgtctcgaaaaaacaaacaaacaaacaaaaagattgatatctttttcttttttttttttcttttttgtttttttgtttttttgagacagggtttctctgtgtagccctggctgtcctggaactcactttgtagtccaggctggcctcgaactcagaaatctgcctgcctttgcctccccagtgctgggattaaaggtgtgtgccaccactgcccagcaaaaggttgatatctaaaaacagccaagcagctggggagaccccagccccacccaccctattcatccctccacaaacacacacacacacacacacacacacacacaccctgctccaacacaagagctccactcacccgcctaccccgccctggacacacccaccgaaacgtggccttctccagtacttgctgtttagaaatgaaagctagcctggagagatggctcagtggttaagggcactgattgctcttccaggttccctgagttcaattcccagcaatcacatggtggctcacaaccatctgtaatggaatctggtgccctcttctgacgtgcaggaagaacactgttcatagtaaataaatttttttaaaaaaagaaaggagcgacggagggagggagggggggagggaggatggaaggaaggaaggaaggaaggaaggaaggaaggaaggaaggaaggaagaaaggaaggaaggaaggaaggtgaaagcagcagctgtttcagtagtgcacctgtaagctctggctgggcttgttttagagttttctgatcgtctgacagccctagggaactaggctcagccgcctgtctccagtaccaattaaagagacaacagtgaacagcagagaaagggggtttagttggtgtggccactttgggaggtaaaacagatgggaatggaacaaattgggggcgggggtgtgtcctggtgtgagctctaactctgaatagggcagaagagctgtgtagccaagcatgcttggtcacgggacgctcctgtctgttaggagacctctgcagagcaggggtttccctgtcggaccccagaataggcacaagccac

SEQ ID NO: 20832 - DNA, 1154 bp, Mus musculus
ctccacccacaggttgagtcccccatctgtggggcacttgttcctgagcccaaacacttctttccagatgtcatcctgcaacccagcccagccctaacctggaggtcaacgggcgggatcctggatgtgtatgtgttcctaggcccagagcccaagagcgttgtgcaacaatacctggatgttgtgggtaggcctggcccctgcccactgagctcagacccctgccccttgctccttgccccatgtccccagtccctgctcactcgcagtactggtcctcaggataccccttcatgcctccatactggggcctcggcttccacctctgccgctggggctactcctcgaccgccattgtccgccaggtagtggagaacatgaccaggacacacttcccgctggtgagtggcagtcagggtgagggcggccccagcttccgtgctcttggctcccgacctcagcatcagctcgcgtcctctgcttcaggacgtgcaatggaatgacctggactacatggacgcccgaagagacttcaccttcaaccaggacagctttgccgacttcccagacatggtgcgggagctgcaccaggatggccggcgctacatgatgatcgtggtaagcaggtttgggcacagccattgctgctgcttccgtgtggcctcttcctcctacctgagcagtttcccaggacactctctgatgtgtctgctgcccaggctcctggacacacccatgagctcggggctctttggttaacaggcgggatccgcagaactgctctgccttaaagcctgcggcaggggccgtaacgagctggtactgagctgaggacctagatgtggtttgtgcgtcctcctggccctgctcctctctcaggccagctatgtccatgtgggaaggaaacatacttgccctgtgcctgtccccgcagcaggaaggtccaagaagaccaaacagtcacagccatgggatgtccttgaggggagggagctaagccctggaagatacggctttgtaaggaagggctacgactgcctcgccgccaccaccaccaccaccaccaccacggggcagtgaatagtggtacaggcagtgagggccacccagacattaggcaagccctccaccactgagctgcactgccaactctc

SEQ ID NO: 20833 - DNA, 1200 bp, Mus musculus
ctccctggaactgtcaggatacacccctggcagtcagggtgacaccaaaaagaacaaacttgggtctacgcggcactaggtcaaggtagtcctcgtgtcatgcaagtgtccagggtctgaggtatgacatgtgccccatcctcttcccagggtcccagcctcacaaccacggagtcccgaaagcagcccatggctctggctgtggcattaacagcaagcggcgaggccgatggggagctgttctgggacgacggggagagcctcgcggttctggagcgtggggcctacacactggtcaccttctcagccaagaacgtgagtcccaaggcctgtccaggctggtgggtggaaacatgggggatgggattgtcttgacctgggggagggaaggactgggccagagtacccagtggccagcatgtctcttgtgtctgcacagaggaggctgcctgtgacgcttgctttatagtctctatcctggtgggctcacggtcatggtccagtgacactcctttttcttttctcttgacattaccagaataccattgtgaacaagttagtgcgtgtgaccaaggagggagctgagctacaactgagggaggtgaccgtcttgggagtggccacagctcctacccaggtcctttccaacggcatccctgtctccaatttcacctacagccctgacaacaaggtatgagggcaggctggggattggggatcaggcaggagcgaagagggtgctaaggactcccttggtgcagccaactcagacacgctcctgggagggagacagggcatttggacctcacagagtagaatgggccgagtggatcctcacccctcaccatatctaccctgagatacagctccaatggtggaggctataccctgagatacagctccaatggtggaggctatgagctggtaaacagagccttgctcccgatggaatccaatgctgattccaaggcactggactctctaccttggggagggatggccaggtgtgtgctcatcacctgcctgtctccagaccatctggagcctggctgggggagggaaccacttgccattgaagcttctttctgacctccagagcctggccatccctgtctcactgctgatgggagagctgtttcaaatcagctggtcctaggagagtccgtcgtttacagaggcctccagggaggcagagggagc

SEQ ID NO: 20834 - DNA, 1200 bp, Mus musculus
ctaggcacaaacagcacaggccggggccgggcaggcctgtgggggtgcaccagggtgtacggtgccagggtgaagcagctctctgaccagaagcacacgctaggaccacctgcagaggacagaggttgtgaccatctcccacctgtgtccctgccccctctctcccaggagacactgattgtggggggcattctcaatttcagtgctgctaactgcatgctggcacagctgctatgctaactgtgcatgctggcacagctgctatgctaactgtgcatgctggcacagctgctacagagctcacagctcttcagaatgaacctctgaggataggaggagcttggttcctcctgaagggtgtgagggtcctgcccttcaccccaactcttccccctcctcatccatgccgttcatccctgcccctcaggccacagcgtcctcagcctcctccctcctggaccctgggttatttaggtagctcctgttttcaatatcaaccttatttttgaaaaggtttatttttacttttacatgttttggtggtgtgtgtgtgtgtgtgtgtgtgtgtgcgcgcataccattgcttgcagaggctagaagacagcattggatcctgtaggatggagttacaagtggttgtaagctgtctaatttgggtgttgtaaccaaacccgggccctctccaagggcagtaagtgttcttaacagcagagccatctcctaggccccagtacccagcttagattaggcatccaaactgtcttaaagaaaacgaattatttccctactaccagactcacttctgatcagcttcactctgtagttgttacccgtgggcttacaccagtcagacctctagcatgaccacgtgcatacactggtcacctagtgaccttccttacagaacactgggcgattggtaggttttactgttcctgcacacacttgtgggctagtagcttttgtatagtttcactgggtcgggcctcagagtggggcacggccatttagaagacatcaaatgtgatgctcagttgctgttcagaaggtgggtagatatttattatgatccgtaaaaaacagcctggggtggggggatgttggagagatggttttgctgttaagagcactggctgctcttcaacagactttaattccaattacccacatagtgactcacaaccacctgtaactcaatca

SEQ ID NO: 20835 - DNA, 1148 bp, Mus musculus
gaattgaactcaggacctctggaagagcagtcaatgttcttaaccgctgagccatctctccaacccttgaaaatcattttttatattataatgaatgttttatccaaatcttaggaaaatggcttacattttaaaatatacctgtttttacaagcactggtgctggcaggttttttctttgtgcagagtgggacaaagggctctacaagttttgggtttttgaaatggcctcactctattccaggctggcttcaagctcccagcaattcctcttgctgtgccctctcaggtgctgggacagcaggccagagccaccatgtggcgctacagacactcttttccttggatagcttgtgaacttgcacagtatgtgtgctcacagagacagtgaagacccagggtgttcccctggggtgtagaagtgaggtaccccgcagccctcattcctccctccttgtctgcaggagcctccccgtttgcagatctccttcttctgcagcagtcagtgtcgtgacggaggactccatgacagtgtttcgaggagctttgagaagtgtgtcatcgaggctgtgagctctgcctgccaggtcactagcctttcctgcatgggtttacagggggtttctgatgtggcctgtcaaggtctgcttaagcctgcttgttctgaggccctactgcattggctcaccctcctttgtgcctagagacaaacatatgctaagatccagtattcgcttccaactgctcgagaaatagcatggtttcctcttctctgggctgttaggtgtcacttagaaccacagctgctaggctaggtgtggtggcatgtgcctttaatcctagtatttgggagacagaagcaggtgggtccctgagatcaagaccagccttgtctatgtagccagggtcaggccagtcagggctacatggtgagactttgaatctcaaaagaaaaacaaaaaaagcttcgcggccacctgcacaggccctgccccagccatctccccagctgagcatcagttacccctgcccagccatctccccagctgagcatcagttacccctgcccagccatctccccagctgagcatcagttgcaccccctgagcagcactgccggtttgtgtaaccctgtgagcagcactgcc

SEQ ID NO: 20836 - DNA, 1153 bp, Mus musculus
gtttctctctcatcactaataaacccagatgctctaacgccctgcacctgccatctagggcttctggagcagtgggggaagcctgactggtgaagatgctgcacgacagagccccaagggacacgcccaagcacagacactgcatgtgtgctgggggtggggcatagacagacacttcatgtgtgatgccaacagggtgggggtggggggcagctgagtgccagtgaggacatgtctactcactccagcctgttctctgcttctgtcccaatagaaagattctgccagaaatttggagtggctgaagacagtgaaggaaagccatggatctgtggagctctcatctctgtccctcgccacagcaatcaacagcaggggcgtctacgttattgaggcacccaaagatggccagaaggtgagcctcccaaagtcctggtgcagttttgtatggccctgtggtcttgctataaagttatgggactctgtgcaggaactaacttataaatgtgtgctgccccccagatttccccagacactgttctccgcctcctcctccctgatggccatggttaccccgaggcattgcgcacctactccacagaggaactgaaggaacttttaaataagctgatgctcatgtctggaaagaaagaccacaacagcaatacagaagtggagaagttttcagaggtgagcagataggtttgtgctgctgcccacaggggccactttggcgtcaagctaggccagtcacttttgttactgagctatggaaagggtctgtgtaggcttttggtcaacacagctctgccatgggtctgcaggatgtagtaccccgattcacaacgccagagacatatctgaagtagggtagaccctatgagcagcaggtcctcctcaggagcctcaggaggaactgtgaccagctgtggagaagagatggccaacagatattcttagaaacaatcacctcactgcctccatactcctgttgaggtaggagggtcttgaatttgaggccagtctggaaatacgagaccatgcctttacatacaaacacacacatacccatacagtctttacattgacatcctttgtctttccctggacatggtggcacacatctttagtctcagcatttgagaggcagagg

SEQ ID NO: 20837 - DNA, 1197 bp, Mus musculus
ttcccccaggtcttcagcaacatgcagcggcttgtacatgtcttcataaaactgcactgcgcgggcaacatgctgttcaggacttggactgctaaggtctactgttgccctgacgggggcatcttcatgaactttggcttggagctgctgagccagctgacagagaagggagatgtcatacagctcctgggagccctctgcaggcagatggaggacttcctagataactggaaaacagtggtcgcccagaagagagctgaacacttttacctcaacttctacacagctgagcagctggtctacctaagcagtgagctcaggaaacccagacctagtgaagctgccctcatgatgctatccttcattaaaggcaaatgcactgtccaggacctcgtacaagctaccagtgcctgtgaaagcaaggctgacagatactgcctgcgggaggttatgaaaaagttgccccagcagctgctttctgagcccagcctaatgggcaagcttcaggttattatgatgcaatccctcgtgtacatgagtgccttcctgccacactgtctggacctggatgccctgggtagatgccttgctcatctggccacgatgggtggcactcctgtggagcggccactccccaaaggcctgcaggctggccagcctaacctgatcttgtgtggccactcggaggtgttgccagctgcactggccatctacatgcaggcccccaggcagcccctgcccacctttgatgaggtgttgctctgcaccccagcgaccacaattgaggaagtggaactactcctgcggcgctgcctcacttcgggctcccaggggcacaaggtctacagcttgctgtttgcagaccagctgagctatgaagtgggctgccaggcagaggagttcttccagagcctgtgcacacgagcgcaccgtgaagactaccagttggtgatactctgtgatgctgcccgggagcactgctatatcccctccaccttcagccagtacaaagtgcccctggtgccccaggccccgctcccgaacatccaagcttacctgcagagccattatcaggtcccgaagcggctcctgtcagcagcaactgtattcagagacgggctgtgtgttggcatcgtgacctctgaaagagctggcgttggtaatgaaagaggtcccctctcccagatactgcccact

SEQ ID NO: 20838 - DNA, 1220 bp, Mus musculus
atatgttttcttcaatggtgaccacatgaccatgacattcataggttttcacttggagaccaataacaatggctatgttgatgccatcaatccctcaaatggtaaggtcatcaaaaaagacgtcatgaccaaagaactgtttgatgggctgaggcttcagagagtgcccttcaacattgactttgataacttgcccagatatgagaagcttgaaagactctgcctggcactaggtattgagtggcctattgatcctgatgaaacatatgaacttaccacagacaatatgcttaagatcctggccattgaaatgcggttccgatgtgggatccctgttatcatcatgggagagacaggctgtgggaaaaccaggctcatcaaatttcttagtgacctcaagcgtggtagtgtggaggcagaaacgatgaagttagtgaaggtccatggagggacaacaccatccatgatctactccaaggtcaaggaggctgagagaacagccttctccaataaggcccagcacaagctggataccatcttgttctttgatgaagccaacacaacagaagctgtaagctgtatcaaagagatcttgtgtgatcggacagtggatggtgagcacctacatgaggactctggcctgcatatcattgctgcctgcaacccatatcggaagcactcccaggagatgatcctccgcctggagtcagcaggtttgggatacagagtgagtgcagaggagactgcagacaggctgggctccatccctctgcggcagctggtctaccgtgttcatgctctgcctccaagcctcattcctttggtatgggactttgggcagctgaatgactctgcagaaaagctctacatccagcagatcgtacagagactggtggactccgtctctgtgaatcccagtgagacttgtgtgattgcagatgtgctctctgcctcgcagatgttcatgaggaagagggagaatgaatgtggtttcgtcagcctccgggacgtggagcgctgtgtcaaagttttccggtggtttcatgaccatagtgatatgctcttaaaggagctcgacaagtttctccatgaatccagtgacagcacacatacttttgagagagatcctgttctctggtccctggtgatggccattggggtatgctaccatgcctctttagaagagaaagcatcctaccgcactgccatcgccaggtgct

SEQ ID NO: 20839 - DNA, 1145 bp, Mus musculus
ctggaagacgggtgcattgaagatgaccctgccccatacaaaaaagttggctttgttggcatttccaactgggctctagatcctgccaagatgaaccgaggcatctttgtgtcccgcggcagtcccaacgagaaagagctcatagagagtgctgaggggatctgctcttcagacaggctggtgcaggataaaatccgtgggtattttgcaccctttgccaaggcctatgaaacagtgtgtcagaagcaggataaggagttctttgggcttcgtgactattacagcctcatcaagatggtctttgccaaggccaaagcttctaaaagggggctttccccacaagacatcacgcatgctgtcctcaggaacttcagtggtaaagacaacatccaggccctgagcatctttacagccagtctcccggaggccaggtacaaggaggaagtcagcaccgtggagctgatcaagcagaacatttaccctggcccgcaggcgtccagcaggggcctggacggcgctgagtcccgttacttgctcgtgctgaccaggaactatgtggcgctgcaaatcctacagcagacgttctttgagggtcagcaaccagagatcatttttggctccagctttccccaggaccaggaatacacccagatctgcaggaacattaaccgggtaaagatttgcatggagactgggaagatggtggtgctgctgaacctgcagaatctctatgagagcctgtatgatgctctcaaccagtactatgtctaccttgggggtcagaagtacgtggaccttggactaggcacccaccgagtcaagtgccgagtgcacactgccttccgcctcatcgtcatcgaggagaaggatgtggtgtacaagcagttccctgtgcccctcatcaaccgtctggagaagcactacctggacatgaacactgtgctgcagccgtggcagaagagcatcgtgcaggagctacagcagtgggcacacgagttcgcagatgtaaaagcagaccagttcattgccagacacaagtacagtcctgcagatgtcttcattggctaccattcagatgcctgtgcctctgtggtgctgcaggctgtagagaggcagggctgtagggatctgacggaggagctgta

SEQ ID NO: 20840 - DNA, 1154 bp, Mus musculus
tgagcacaatcatctcatggagctccaggaggaaggcgtctaggcctgcctcattcaggaatgtgcccaggagtctttggtgctgtgtgctgagctcctctttgtattgcacatcaatttcccgaaatagctcctgaaatgaaggatggacaagggtgggtagagagataaggcccgggaagagtgccgccacagcctcacagtggaagcagaggtgagactcactttgttcagtcgcagccgctgttctgacttatgtgcagataggaactgccagagagcaatgatgtgtctcagctgacatctactgaaggcctgaaagaaacagcgtcatccatgtgcatcacggaatccaaatgccacaccataggcacattcccccatttctgtcttgagctcattctagttcccttgtcatgacctatgcctgtctcttcatgacatcacacattgtacagttgcagtgctcacagatggtgggccctgcctagagatgacatcatagagcatatgtcagtctactgatccaagtatatggtgtacagggcagactgattgtgtgagcaatgttcttgattcttcctgctttggggagttcctacattaatgcatggtggaattaggaagtaagcaggagcttttgacaagggtcatgctgattcccatgcaacactttccaacaggactcccctccctcttttgagacatggtcttactcagaagcctagtatggcatggaacttactgtatagcccaggctggcctgggagttgcaatctccctgcctcttcctcctgagtaccggcaatactggtataccaccaggcttggcactagtgcttacctttaagacctgagctgtctgatcacacatccgtaggacttcttcgatgtacacattcaagtccatgccaggatccccaccagctgtgctcaggaaacccagagtgatttctatgatagacagggcttcacaggcatcactataggactgtagctgtccgctgatggtactgattgctaagttagggagtgagctctggagaataaaatggaaggctcgggttagggttgggcttgtttctcaccaactgagaagagattagctttgtcactgctgaagctagagctgggacaggctctccagaaggcac

SEQ ID NO: 20841 - DNA, 2031 bp, Mus musculus
tggctgacctaagattctcagcatgtctggtcttggcaagcatcttggcccctcttgaaccacaaagcatgaccactggcctggctatgatgttacaaaaactttctcttgttccttgatttcacagcctcaaggatactctagtaagttacatggagactaaagacagtgacatcctttcagaagtggagtcccagttccctgaagaaatactcatgtccagctgcatctcagtgtggaaaatagctgctacacgaaaatgggaccgacaatcaaggtagagcagctcagccttcaaacccagctggaaaggaaggtcttcctcacctccctccacagctcccagtatgggctgtggcttttgtgtgaaggaaagtgtgggcacagactggattcaaggcctacactcaccctacaatgtgatagctttttcaaagccaagctgtttctggatcatgtgcctattccaaaatttccttaagtctgatgaatgattgtcagtcaactgcctcatgaacattccagaaggaacaagagaactgcactaaggtcacacccaataccgatccttcttaagactgactgcctcttacctcaaataccatggccaccactttactgcatagagagaaaaaactcagggtagtcaattttttaaatttttttacttatgtatagaaggacctcaatttattctttctcccagtcccttaatttctaagtagtatactcatatctcttggtttgcaagatgcatgaaaattgccacactaacccaaggaaatccaaggtgctgataaaagctgtaaagcctcatgaacaacccaccatgtaaacccaccatgagccactgccaaccactcactgagatcaccggacagagagtggagaaggatgagcgcactggtgagctggaactagagtgcgctgtggagtacttgcctaccatagcaaagccctgggttctctccccagcactgcaagtgggaatagggacagacaaacaaagcactttccagttctcatgtcttgagatttcaagtaaagatgtgttagtgtaagctcagatccgaggtatttgggtgctgggaacatggcagagcccttgcctagcatctgtggtgccctaaagtccaattcctagcactgttagaaagaaaggtattaggatcacagtggtgagcttttattctaaactatgagagtacctgtcctccgatgtctgcatcccaggtttttgggggtacagggcttaatgaacttgccaacttggccttggagctcctgtgatccatcagagggcagctcagccccacacgtcttgctgtaaggccccttctggctttgaactaggcattattttttttttctgtcatgaagaatttttaattatgatgctttattttgtatgctctgcttttaaagtcataactgtctgtgtagtattacccactgtgatgtacaaaatgcatggatctaacattggcaaagtagactgcatcatgtttaccatacctattttaataaacttgaatttcacagctaagagtcctgtttgggctgggcagatggctcggtgactaagggcacttgctgctgagcctgacaccttgagttcagtccttgggacccacacggtagaaggaaagaactggttttccaagttctccaagcatttgcatgtccatgcacaagtacacgtgcgcacacagtttctttggaaatggtttagttttctgtgacagtgtttctgctgtagtatccagtagggttcagaacaaagcctactctctagattagcacatggggtgatgcggactcttgtttatgatagagacaacactgcttagagtcttctgccagaaggagcctccctgaaaatatctaccagcaaatgaagatgagctgagttcagtgaactgggctgtgggtaaggaaggccccttaggaataggaaacaaaggcagggaagtgaagcctaaaccattgtgagacttgctatttgttagctgaaatagccatgagcttctt

SEQ ID NO: 20842 - DNA, 1130 bp, Mus musculus
tctttaaccctcgaggcccttgccgtgatctttggtcagtagagtccatgcttgttcctgtgacttagaggcctcttggactctgtcgtcacctcctccactgccttcagcacttcctacacgctatttgtcagaactttaaatccttcagtggttctgctggcctgtgttggcaggcacacctctcctagagtggtcgtcacctgtctggcttctactttctgtagcgcccaggttagacattacttgctctactgagcctcctttatcccacaagaccagcgctgtctctcagcgtcctttccagtctctgtggtggggcagagcaaacggcctccagctgggtcacttgtacgtgagtgtttctcacagctgtgaaaactggaaggtccacgatcagatactaggacgagattgtgaggttctgagactttcggatacagacaagcccttctctgggttctactggttctactgttgtggggtagtcaccagagacgactgctcagacctgggcttaagccagtagggaatattagctgggtggccgtttgagatcccattgtagcactgagcctttctcagcgtgagctttcaagcacaaagccattttctgggttgatatacttcatttaacaagagcagtcagaagtggagctacagaagttaaaaggcgaggttagttcatcttgaaactttgctaaaacgctatggacgttgttgatggattaggccattgtcttagtgctgtttatatgctgagttgtgcagccgaaatggtgttgtcttcatggattcagctgtgctaaggtctgggggccagttacacttcctgtgtcctcacaaatgctacccacttcttagtacaatcatcttgtatgttaaaatgtcagtatatgggggctggtgagatggctcagcgggtaagagcacctgactgctcttcctgaaggtcctgagttcaaatcccagcaaccacatggtgactcacaaccatctgtaatgagatctgactccttctgaagtgtctgaagacagctacagtgtatttacatacaataaataaataaatctttttttaaaatgtcagtatatgaattggaagaccgtagcaaccctgaccctctcct

SEQ ID NO: 20843 - DNA, 1512 bp, Mus musculus
gacatctagctcttgccctgccccttactggagtctgtgccaagccctcctctccgtcactgtgttcacacttggcactttgctggccctgagaaaggtaacgacagccgcaaatctaatccgcatatttcccatcgactccgtaatctgattgatgttccctcttgcactgaataatacatgcctctctcaggtaagccattttataaaataagagataaaacgcactgtcgagacagtgtttgcttctgccgatggtgtccgacagcaccctgggcattagggtggtagagctgccacggaggctcccaggccctaggggctgagagctcacttgaattgtaagccttcttgcttttgataacacagtattatttctcttactgtagaagaaaaagtttattaccaaacaagagtatttttatgaaagaataggacaaacctataaattatctcaacctatatctcccttgaaaatactttcaggctccgccaaaacctaggactgaaagcaagtattttggaagaaagagatacatttttgtatgctttcttttccttttgtagacgcccgacttattttctaagactgcaaagatcactttgtcaccagccctgggacctgaggccaaggggttgtcttgtgggcagtgagggggaaggacaggctggcctgaggttcacagtcattccagtgagctctgatgaggggccaccagatcttgagggtgtgtaagggaccaggaggttaaaaagaaaggcccctgatggtgggctctttgtgttggagctgaaaggttatatggaaggagataagaatttggataccagttctgagcttgatagaaggaattagggtcactctggctaacataggggtacagcatccttagtaacccgagcgtggctcgaagtggtcatgatttcatccaaaacacaatgtgtaaacttactcagctaacaatgggaaatgtattgcttctgtgcgcagtggacttacgtgcaatttgttcaaaagggaacaagtcattgaggagaaacaaaagcccaatacttagagtcccaattttgtcttatttgccaaaaaaaaagcaaccccccaagagttgatattgttacaatgtacatactgtaaaatatgaaagaatcgatgtatcttactttttcattatttgctaaccaaagctgtacatttttcatacaatccgcagccttttgagtatcaaaggggtaaaccacacccatcagccattctggaagtgcactatttatactggtatccttgctttttttttcccattttcttgctgagatgacatgaattgttaagtttatttttacacagtaaagagtgaagaaagactgtggtctcattggattctttctcatgtgtgtgtgtgtgtgtgtgtgtgtgtgtgtgtgtgtgtgtgtgtgtttgcaagaacatattcaggcaaatgtgtatgcatttgaaggccagcgttcaacactggtatctccttcagtttctct

SEQ ID NO: 20844 - DNA, 2316 bp, Mus musculus
ctgagcccccagccccagcgcctgcccaccctgcttgtgcggtgacccatcgtctctcttctcccctccccccaggaatgactcaaggccatggcccctgcacacgcacacgcacacagcctggttgtcctccttgtgcacttgaagcagtcccggctcttctctggcccccaaggacacccccttctctctaggggccccactatatcctgggcatacctagctaaagcaggcagcatcagctttgacaatgcagaatttcgtgagaaagagagagagagagagacagagagagagagacagagagagagagcgcgagtgtgtgtgtagggaggctttcttctagaatgagttagtttgttcccttctttctgtgtgattgttgtaagtttcctgatgggtcggctgcctgtgtgcctcagggctggtgcggcttcctggaccacccatttgtccttgtttgcagacctctttgggagtgatgtaggtctctgttgacataagtcaacaatggtttgtcaaggttgggggggtgctttccacaggaatatttgggggggatgataagtggagtctctgaaattcaaaggctggttgtccagggatggcaccacctaccaatcagccccttcccacgtccccatcaggctgtctgctgtctacatctgagggtggcatgggctgagcccctcagcagctctaccccaggactgctcctcacctcacccttggccttcctgcctccttgtatcttatcaagggacctgttattccctttcagcttccaaagctacttcagcccagtggttctgagaggagagtgcccttccagagtcccaggacacagggccttggcacccacccttcttcctccctctggcaatgagagaccagaggcttcaagtgggggtctcacgtgctcggtctcagcgctagagaataccgagacctgatccacagtccgtgggaatggtctcccacggcatttttcacagccatactccctccccccagcgcacccaggcccgggtgagctagctcagacccctcaggggccaggggctcagaaacctctcatgtggagcctgctggccggggtgggtcctgccatccactcctgcatttcatggggcacaagcccagcagcagccccaacctgccaccggcctgagacactgagcccgtggcttttccttattgaaagtaggcatgagtacccccttctgggccttctgaggagggggacgaaatgcgtgtgtgcacatgtgtctgttgaatgctgaggaggctgtgtccaggcagggtggacccctgcattgttcccccccgtgttgtgggcacacacccagtgacacctggactatgtctccagtagcctgactagcaggaggctggcaagtctttctagaaacctacgcactgcctggctcgtctgcagctgcagacacttaattcctcaacaggagcaggttttccacctgctgttccttccaggggcacctgtctccttccacacaggtccatgttgtgtctgaaactagtgcatccgtgtctgtctgtgtgctgtctgtgtcactgttcttgtgggtgtctgcacagttccctggtcactgctctgtggtgcatcctctctgagggtgcggatcaggctgtgctccacccgttgtccagcagtggctttttcttagataattgtgcttcctcagcgcccgccgggttgtggcatccttggatctgcggggatcttctgtgtttgcatgttcctcagggtggtgtgtcccttgctcccttggtctgacgcgtgttcccttgcctgcatggacttctctggttctgtgtttgtgtgctgaatgccacccagtgttctgtgatcacccatgtagctactgaaaaatggctgggtaagcaagccaggggtgttggggaggtcaggagagagatcaacatgcctctcccctccccctccccagacatagcaagaagcatttctaacatctaggttgagaacaagcctgaatggtacccatggttgggagagagaacttgaacttcaaatcgactttccagaccagatcgagccccacccttacttttagccttctgggagccaccaccaggcgaggcccagagccggctatgcccggtgtactcctgccaacccctgccaccagccccagcccctgccaatgcggaccccagaccacttgcacccagacgggtggggtgggagctgtccgttcaggaccacaagccatcctctgccctggcttagagggcagagcacaccccaatgcttctgcctctgtcacttcatct

SEQ ID NO: 20845 - DNA, 1144 bp, Mus musculus
cccaccccccaccccaagtcaggctcagaccctctcacttcatgtcctgctacatgtcactcactgggagctgccattctttccaagggagtgtccttttaaaacatgggaaggagttaagatatttcaaagaggttggtgattatgtagctgagaaatgttcaaccttttttacaaccatgttcttcctcaggctgttggtagtgaagtgaattcagtcaggaaggttgcaatgacgttctacctgagcttcttagattagcctttactctgttaataattttagtgccaaagattaggactgtgggagtatgcccaacagtgttgtgtggagtcaccggacacatctgtgattgactgctctgtctgtattttagagctggaacttgaaaatcatctcttgacagccatttggaaaagcagggctggtcaccatgtgtgagcatggcctccttactcctggctctttcctgattgatcttagctccatcatctgggggatttccttggaatcatacatttttaactacaggggtaactgtcatgtatgaaactcatttctactgttaggcaggctgtttctggatttttcaataatttaaataattttatgtggctgtcatatagttcactgagagcatttgcctagcttgccaaagccctgggcactgaaaaagaaaaaaaaaatcagcaacttggggctggagagagagctccacagttaacggcactggctgcttttccagagaacctggatttggtttctatccaccacatggccacttagaatcatctgtatgtaaccagttccaggggatccagtgtccttgtcagtccgttgtcatttctgtgggcaagaatttggaagtgtgctgatcaagttcattgatgacaagaaatgggaaagtacaggaacggagtgggcgtgcacaccatgattagcatgattcagagtgtgaagtggcaggaagtagtgaagtgtaatgtgtgctctagtcgaagtcctgcctgtagagcactagttctcaccctgcctaatgccggggccctgtaatacagcgtctcttgtggtgacccctaaccacagagtgatttttgttgctacttcataattgtaatttgctactgttatgaacgtagtgtt

SEQ ID NO: 20846 - DNA, 1095 bp, Mus musculus
cgcgggttcctctcaggctcaccccatctgattagaaggcatttttccctctgaggcccatttccagctcccattccttcttgctgccattcatcaccccctgcccttctgcagtatttatggccaccgtggggagcagagaagccttccctcagctcttccctggctaattaggggcttgaggagagagctaacgaggctccctccctgccaaaatgtgcttcgcctttcttttcaggaaagggagagattgctgggaagattaattggcactgagcaccaggcatccccacagttgccttccaggctgtgcccaggcccaggctcacaggctctgctccacctgcctggtaggccaggctcagggcagactctcacgcagatcgcagatcagggcatgattgacgccctgtgaaccctgcactacccttggcccagttcctctggcctgtgagagccttgcaggtggagaccagtttctcagcctgagagagaagaggatatctccacagaacaccctgcagccagctcgaggctcctcactgctctctctttgggcttaggacatccccacgggtgctgacagctgtgtgacaagtctgtcttgtgattcgcaccgttcgctcattgtggctggcctgggtgatggctcgatccgtgtctacgacaggaggatggcactcagtgaatggtaactgtcacatctcccctctccttagcactattcaagctccttccagatggcagaggccaccccactgccagtaataagtccagattgctcagtgagcatgaagtgtcttcggcagtgcacagtggacctctgataccagacaagaagatggcacccagggctagagagaaggctcagtggggtcaaccttcacctttcactgtctggctgcttcaagttgaccccacagacagaaacagtgacctcactaaactgctgactaaggcaggaccaggtcttcctcatctcaaaatggcacccaggcttcaagaccctaactgggtaaacagaggagagagaaatgagggggtggcctaggacagcctcgctagcccctcctccttctgggtgtcctcttgagg

SEQ ID NO: 20847 - DNA, 2939 bp, Mus musculus
tgtctataactgtagtcactctacagagtgttgtgtcggttagggttttgcagagtgggctccagaggcgcctgtgtgtatcactgttgaagtgcacagcatcagattcccagaaccatcccaggggagcaatcctaaaacgaagctgcagggaattgtgggtagtatgcaaatcacctgtaatggaatttgaatgatacattattcctgctagactctggcagttaacgaccctcattgctgtgcctgtgcagtcagaggtgttactgtggtatgtcctcacccccactagagctcagcacagagtacaagcagcctgcacccttcctctaccccagcggtgccgcctgccgcatcacaggccctgctcacgtgctctctgtctctccacacagcctcatctggccgtaggaagcaatgactactacatttccgtgtattcggtggagaagcgtgtcagatagcggcacctaggaccactgccaggccgcagccacctctgctgtacatagtgagccagcctgcactgctcggatgcagtgcccacctacccacccacctgcaaaccccggctcctgacttggccgtggccagctgaggaggggcttgcacatccttccttctgtcttcactataacagcgtacaggtccagagcaggggaggggttggcctggcttcccatcaagaaccagcacccaggcaccaaggacctcctcagtgcagcatggtcctttcctgccctgttttcttctgaggttttacaaagggacacatttgatttttccatgtgatcaaagcattagttacagagcagacagcgccctgtagaatagccgtgctggggctcctaagggccatggcccagccccactgtcctctcagagtgtgctgccagtcctgggaaatggataagagcaattgggggaagagagagggtagaagagagggaaggcctctcctgctacaaggtatggaagtctgagcctggccctcctggagcaccgaggcagtccagcacattgtgtatgtcatggtgctatgaggaaagctagacctctgaggtccagcctggcgggcgccctcaagtgagctagctgcaggagagggtctggttcagggcagatgaggcagatctgtagttagcggctgcctccatctatcaggcatattctgaagtgcttctctcccatagggcagtaacagtggccacaggcctgtctcctgcttgtgccacacacaggtacacacgcatgcaggcacgcagcctccccatccataattacatggatgccctggtcttcctgcccatgtacacttaggtgtgcattcatgcaggcccatagtttcccctcctgcacatatatgggcactgtggccggccacatgcacgcacatgctggcctcaccatgcatagggctcagacacttcactgaactcagaggctggagggcagcatcagctctgttgatggtggaactgaggttacatgatgcagtatgtgctgagcacgagttccacagtgtcctggtgtgcctgacacgtgtctgcgtgcacaggcaagagaggaccatggacactgtagccctagatgtcagcactgtccccgtgtgtccgacatgtgtctgtgtgcacaggcaagtgaggaccttaggcactgcagccctggatggacccagcattgcagagcagttgcacacaaacaggacacaacacaatgatgttttgaaaagcattttccgttttccctgggaatcaggatctttcagaggacaagtgccaacaggagcccagggacacgggttgggacatctgtggcagaggctgggtccctgtgctgtgttcagtggacctgttttagccaagagcatcttccctgtgagaggatcctacaggctgagctgtcctgggcaagcagaacaggagaccctggcacggcccctggaaatgcattctcccaaccgggtggggctcaaggaagccagccccttggttgggccatagagcagtgtggcgacaggaaggccctagagccacctgacttacccctgctcagttctgcagagagcttcaggggctgagtgtgcgtcagctcagtccttgtccaactggtgactcagttttggccgcacagggccgcctgatgggctgggctgcttccctgccctggtggaaccagtgtttgcatcttgcccacaggctgggcctcacaagtctgatgcggaaattcaatcatgaagctaagcaaagctcgagagagcgctgacctagagcgcatttctctatttattttaccaaaatgagagttgaaaggactgacaggacacggaactgcagtggcgtccagagcagtgacagcaacagagtgttaataaagaataaagccgtgagatgtcgctgcccttgccagatgagaatggtggggtggggtggcccaaagggctgtgcccttgtggcttctgcagtccccgggtccctggggtgagacagtcttggccagagacaaggctactctatctacccctccaggcctgggtggaagtgaagacatgctggttgccatggagatcttgaggcatcgtgactgggattcctgtgctgaccctgggcttgtcattagtaaggtttccccacatctacacagaccagcttcacgcggctgtccgtttccctgttagtattgttgcttctcagcaaaaccaagtgctcctgcaagggatgggcggaggtgtgcagccagtcctggagagacaggtcccagctttgtggtcctgtgaggggcagacagcaaactatctctgggtgtgtgtcagggctccctcagccagtctcatactggtcactgtaccaggctgggcctccactacccactgcgaatgtctccatccccatcccgggtctcctcagcagaccttacttggccagaggaattgggcctct

SEQ ID NO: 20848 - DNA, 1149 bp, Mus musculus
tgcagctgcagggcccaggaaatgggagcgagtttgcgccagatcagggccgagtctagctggatctggatcgggggatgttccagtacctggctgtgaccagtgggatgggaggaaggtgtggcacagcgtgacctttgagcagggttcactggtgccgagtgccagggagtgcctgcctgcccacagagctcaggaagcagcactgggtggtgagtgggccggcctttagctgccttctgggtatctgagtagggtctggggtgcattgtatcaggccggcatctgtattgtactgactatagacagaggaagtctagacaccacgcaggaaggatttccagttttgacctggtttactctcaattgtcggggttgttcagggcctgggaaggtctgggcagtggaagactggtctggctcaacgccaagggcaggcccacttccctggctttgctgaaggagagacaggatgagggtgtggccttgctgtgggctgtcctctcccttgctgagcagctctgaaccttcatcaggtgatgtccatagaggaggtggagaggatcctggacgagacccaggaggcagtggagtaccagcgggtatgtgttgctgggcacaggctcacccatttgtgatcaccaagttggcatttgtgtggcgatccactgcttcccgggggaacccagaggcccagttggaaatacccttcacagtccattcatgttcccgggggcacccagagcccccccagacacgcccctcgatacctctccttccacagcaaattgatgagctgctggccggaaacttcacccaggaggatgaggacgccatcctggaagagctgaatgcaatcactcaggtacagtccccagggctgtcttgtcccctgggggatgggaccctatgggcctctgcttggtggtgtgtcccactgttgtgtctgagcccagagtcctggtttcccgattcccttcctacggtgattcctttgtacggaagccaagcagcttccacactccgtgcggcgctgagggatctgtgcaggagtggtttggagtctgacccggcagtttgctgctggccggcactcgtgacccatgtgtggactgagaggaaatgctgagcctggcctgcccagtcagc

SEQ ID NO: 20849 - DNA, 1194 bp, Mus musculus
tgggagaaggcttgtccgtcattaaggccctgaagggcttagatcccctggaactcacagccttggagagcgctgcccctacaccatcacagtcatggctcagaagcctccacacaccctagtcagtggattaagtggacactcaaactcagggtagctccacagttccctctgttccttggtggcttctgggagctccaggctgtgcccctggcctgtaggtccatctcacttcctgcctctatataactcacattccctgctgtgcatgccctaccccagcccctggcctcgtcctctgaaagctctgtgctcaccatgacccattgtttttttccgcagaagcccctgccaaggccagatccaggcaggcagagctggtggcggcttcataacctggtctctccaggcactcatagggattctctgaggactggcccacagagcctttggctgcgagtcaaccctgagggctcccgggaggcctggagggctggactggccagtgcaggtgctgatggctggagcagcagcttacatggaagctgacatcagggcgccttgaagtttagtctggatgcacctttgtctctttctccttctggactaagtggatccccggccagccaggcccagctttaggcagctgtggaccccatgctggccgcagcccactactcctggtgctgttctcatgctgccccagcccatgtgagctgcgctcagacctcggggtccctgtgctcccctctcgtgtctctgctgctcacatgagctggtgggggcttcagctgagcagttctcgccttgcctggcatcctgacacccctcagttaccctgcaggctagtggcagaaaccctagtgttctccaaatctgttggagcatctttgcacctcagatcaccttgagcctcttctgttgggggaggtgggccaggggccatcccacagaatggacaaatctaggagcccggcttggggtctgttcgcagaagaaaaacatgttgaaggtggtaacaagaccctgttttaatgggcatgtaccccatggagtcctggacacactaagccaccaacgcccaggaggcacggaactctgaactgacctccagagccctatgcttgtttcatcacggacaatctctggtcctcgggtctttgaggaacaaagggtcttatgtacccttagggc

SEQ ID NO: 20850 - DNA, 1167 bp, Mus musculus
tcctgcccaggcagcgacaaggttggtgactgactgggaatgaatggggaccaccggcaccctacagcatcctggagaagcaggtggacaagaggcctgtatctagccctagacgcattgggctgtgtaccttctctgtgctgccctgatgacagaatgtgtcccgagtggatgctggggtttgctgctagcccctggagatacctgtagcctgggggggtctatgggtgtctgtaagcatatgtgtacacactcaagaagggccccctgactcttaggtgactctccactcctgggaagagcctccctccccaatatgtctgttggtggtaaactggcctcaggccaggccaggaccaggcagtccaagggcctgtatgcccttgttggctaggtcctgccatgtgttcaaagggcacttggccaggtttcaggatggctttaagcctgcaggtcccttttgggttcccccacctttcttacctgggtctaggtttgctcagagcaaggttggacctctgggctctaagcccttatctcagagtccgtagctatttccccttcactgcctctgtggacgcccttccccacagggtcggtctggattgttctggcccaggtcctgcccagtagtaggggcttccaggctgcggctggctgcctcagagatgccctctgcagggtagtgtgggcagctctctgttgcagggcagtgcctgccccacaccctggtggctagaggagagtagggggtaccctacagccactgggggctcctgcctgcaggcagggctgggagaaaacagggctggggtgggcagtacagggaatatttttgtaacttgctggagtgaatgaaaatggggcgattctaagttattgttgccaaagacatgtaaagtatattgttgctttgggggtgggggcaatgttttctgttttgtttttgtttctgtttttagtttgaggcttaggatggacgctggtgcaatgattttcttgttccttgttttttaagagaaaccaagctaagaaaaaaacagcctgtgtgctcagtgttttcttttggggtctgtagctaacaccctgcggtatggtagatggggaactcagctcttttgcccccatatgccaggtgaggtccctccaaccctctcctgtccctta

SEQ ID NO: 20851 - DNA, 1311 bp, Mus musculus
tttctgggcccagctgtacagcgtcccctctggtcctcatataaaaggccccaggaccttatggtctcctgtcctcgtgttcaccaaggagccatcctttggtgtcctctggctgtcccttcgccctctggccccttcctttcaactaggaaactggtacagcggcctttgagccaggtgagccctggatgggcctcccagtgctcagaacagtcactgaagaagggatctgggcccttagtgctgaccagccaacatggaggtgtggaaaatacagtcaactggtgcctcagaagatgtccgcacacccattgcttcttgggaattgactctgagactggcttctctcttcctcccagcaagacccacacagaccttcttagcggtctgtccatagctggagaccaccttgtacatctgcagggcaggacgtccccagggctgtcgaccacagcccctccgccccatgctgctctgtccctaggaggctgaacactgactacaactcccacccccaactcccaggctacctcagtcccagttggacctgtcccattgctaggtgctggcaatgattgtatggacttgaattcctatggtgacagctggccagtagcaaggctgccgggctgaccttgggtaccctgggcaagccctgtgggcctgaccctcagaaatgagcacttgagagggttggaaacaccaacttggctcacagttaggttctgatctctggtccttcctctgggaggtcaaagtagctgggagccacagccttgaggataggggggctgggcgggtacctttggttctcagagtttcctcagacaagtgccctgtggccgtttccagtgtcagtcactgtagggcccagcgctggatgccagcttgccacagttttctgtaggacacgggagagagtcgtcccatctcagaagaacctgtggagatgcaatgtgcactttctcaataaacacatgtttacactgcttgtgccacttgggctggttgattttgtgctaagattttatttatatgatacattgtctccgtcttcagccacaccagaggagagcatcagatcccattacagatggttgtgagccaccacgtggtcgctgggacctgaactcaggagagcagtcagtgctcttaaccatttagccatctctccagcccctattattattattattattactattattatcatcatcaataccttaagggcttgttttcccgagtagagcaggtgcttcccctcgagtgtttggtggaccctctcagcggtgctgccttgccctccccgtc

SEQ ID NO: 20852 - DNA, 2255 bp, Mus musculus
aggctcagagcctggagtgtgaaggaggaggtttcagtcttgatcatcctttttctatttacttttactacatgtgtgcttatgtgtgtctgtattgtggcggctagaagaggatgtcaagtcccctagatctctagttacagactgttgtgagctgcctggataggtgctgggaaagtagctctggtcttctccaagaacagcaggcattcacacatgttgagtcatctcccagctcttagtgagtcttaactgcttgaaagtttctttttagtcagtgcattagcaacttgtgtccatttctttggctaaaccaatgctcaccttccttcacagcagacgtgcagccagagcctggggtggctgtactccgaggacaggaggaggaggctgagcacgctggggagacactgggagatgacccttcacagcctttgcaacccgtgcttggagctcctaggggtcgccccgctccatcccaagacatgggccagcacctcccaggggaagtcaaggtgctgccaggcagagaccttgctgaccttcctgctggtggctctgaaacagagccccagggggccccgattgatctgagagaagacccgaaagctgccatcaaggcggctggagctgggaaggagctggtcccaggggacttggaagcagtgcacaaggcagcccctcctgaggtacccaagagtccagagaagcaggttgccaaggcagttgccgggcagcgccaagatgtctttggtgaaggctccgaagaaaggaaagaaactggaaaggaagcaatggcccctggtgctgatactcagaaagaggctgtccagcccttggtaggagcagaagctaaggacacaaaatccaggcagtcgggacccaccaaggccccagttcagacccaagccaagtttcacccagaaccccaggccatctttgacacaggtcagggttctcacccagaggtgagaagtgaggccccccgagcggttcacatacctcctgaggagcagcacaaaggaaaagggggtgccgccatccaggaggcaaagcagagaccagatcctaactctgggcccaaactagctgtgcctgcgggtcagaagccagagaatgccaaacccaaccgagacctaaaagtgcaggctggctctgacctgcggaggagacggcgggatctggcctctcatccagagcaggagctggctccaaaggatggcgtcatcattagctttaactccctccctaatgttcaggtgaacgacctccgcagtgctctggacacccagctccgccaggctgcaggggctgcgttgcaagtggtacacagccgacagattaaacagttgtctggagatctggaggaagcctgagggcctggtcagggaaaggctgccactagacattggacggcagctggtgttctctggtgccaccctgattggaggccacgttcttatgttcccagggactggtatctaagtccctcatgatgagttgtgaaagtctaacctgccaccccaccccagacatcacttgctccaaggctacaccaaagcactcactagcccgattatggtttgggttttgaggcagcccaggaaagacagtgctaaggttcagctccgacgcttgtctgttcagactcacggtctggccagaagcagtgctgacagcatggcaggcaactttgaagttgccagtcttcctctaacttgcaacctgtgacagccagatttcactgactccataaggtgggaaacctacaacaggcatgtctgtctgccctggggtggccggggggtggggggtatgacttgacttgggctggggaaagaggcacacagctcccctggtttttatcacccacattcttctgaaggctgattatgaaacaaaaaaataaaacgccactgacaagtctcgagtcgagttggtttacctgcaggaaaacacattcagggtcctggacgacaccagacaggctggaggtcacggggacacgtgccccggccgagtgcagctgggagaccaacaggctcccatgctgatccctgttgtagggaggaggttgcacggtgagtacaggcttgccaccagcaagccctgggatgtctcatttgctgttctgtatctgtgtggcctcagacccagtcgagctgccctttgtcagccagtactgctgccagggcatgcccctgttgtctttgagcagagaacaaggttatgttttgtcactcttttgtccagta

SEQ ID NO: 20853 - DNA, 1197 bp, Mus musculus
actgctgtgattgcactgcactctcacgtggtacacgtgactgctgtgactgcactgcactctcacgtggtacacgtgactgctgtgactgcactgcactctcacgtggcacacgtgactgctgtgactgcactgcactctcacgtggcacacgtgactgtgctgtgactgcactgcactctcacgtggtacacgtgactgtgctatgactgcactgcactctcacgtggtacatgtgactgtgctgtgactgcactgtactctcacgtggtacatgtgactatcgagtgcagccaaagccccatgcttggcctcgtgagcctttggtaagcctggccgagtccctgtgaatgctcaagaagacagttatccatttaaaaagcctagttaggctctttatctctgtgcctgatggtgccctagatggtcttggggacagtttggactttgtagagttctggctcctcctcggaacacttttgtgctgttgcttccttttctcctcttgcccacccaccttgtgcaccctgggacaggacagctcaagccattccccaggcctcctgcttctgcagcatgtgggacagcaccggttagttagtgggaagtagaagttagggggctatgccacgtggccatggggtgccgtgggtgccaggtacaggtgaccttgggtccctgtcaggcacatgactgtatcccagagtcttcgaatagacctttcctctgtcttcttgtcatcgctcttctctgggaccttccatggtttctgctgccacctgccttggccacttgtggaggttgcagaggtcccagagccttagatagtgtcaagattcatccaggatagaccctgctgctatatgttcctccctccttggctgacctcctgtcacctctcttctgtgcctcatgaggttttaaaagcactttacatcatgtgctcctttgtcctactattttcacgttcagtttttctgccaaactatctaggagatgcagtgggctcgtttcacagccttccctggggtggtggtcttcatgggacctgctggatcagaagggttccccttgggtagctgctgacctatgtcagacctgtgtgtgctgtggctgaggtgctgctcaaggggcgaggtgctagctttcccttgcacctgcttcatgtgtaggaagaaccaagagtgaagggctcag

SEQ ID NO: 20854 - DNA, 1231 bp, Mus musculus
tggaccgtcttgtatttttttctggttttgtagaaagagtcttactttgtattcctaattggcctggaacttcctatatagatgaggctggtctcaaacttggagtgctcctcctgctcccccgccccccgcccccaagtgtgaggcatacaggtgagcaccaccacacccagctgtgttgacactgtccagtctgaagagcttaggcaccttggccaggactggtccccgatgctttaactctctccacgccattgttaattctctacagaaagtattcccactaaaaagaatggtgctgaggtagctgcagccagctacacttgtgtgtggtgcatggggtacccatgtgagaagacacctagtccacaaacattatgaccatttttcatagttccctcccgctccctctgagaaagggtttctctgtgtagccctggctgtcctggaacttgccttgcagaacactctggcctcaattcagagatctgcctgcctctgcatctcaagtgctgggatcaaagatgtgtgccatcaccacctggctcttattaatatatttaagtgctgtagttatttattatctctgtctatctgtctgtctgtctgtctgtcatgtctatctgagacaggatctcactgagtcactaaagctggcctgaagctcacatgtagtttaggccttgaactcctcctgatcctcctgctttctcctcccaagagcagggattattacaccacacccgcttctctgtgttgtctttaagtaaaattatagagatcagtaagctgcctagttggtagagagcttgccttgcatccatgacccagaggtctgatccctagaaccatggaggggagaaatcctgtctgaaatgagaatggaagcatgctaaggttgtgccttagctcccaccctttgctatggtaacagtcttctgagtggtcattggagcatcgtctagtcctggtcttcttctgtcctcttaaccccacagttatttgactatttgggtttttttttttttttccccagttttgttttttcgaggcagggtcttactgtgtagcccaggtttgcctggaactgtctccatcctcctgtttatgcctcctgaaagctgagatcacagtcctgagcccctacaccagctcctgattgagcttgaaaccagattaagagtggctcctctgagctgggtggggtggcgcataccttaaatcccagcac

SEQ ID NO: 20855 - DNA, 1141 bp, Mus musculus
agaagggaggctctaaattgaaatgccactttttttttttttttggagagtaaaattttaatgagttggaaaaatttgtcagaaaattacacttttaggcttcttaatcaagggattgtgaacacagaagaaaacagtttttagaagcagttgattattcttttaacttatctaatatttctgtacctgaaagagtttcggaagctcctgaggaagggaactaggatagcacatagagactagttaagtgtgatttggtatttacccaagagagactagttgagtatggttcagcatttaccccaagagcagtggaggtcccccagacacccacggtcacagttgcctccagcccagccagtttatggcagttccatgtcagcaaagcccaggaactggatgtggtcctgggtgtcagactcggggtacctgagtcttgagtctgcaaaggtgctcagctttgatcacaaagcagcaccttcttaaatctgacttcagagccctgggtgtctttcttcacagcatgattgggctgatgctgggatcctgcattaccttctatgtcgtgatcggtgacttggggtccaacttctttgctccgctgcttggattacaggtaagacactgttagatatctggtctgttttaatccttgtggttgctgcctgatgcctcctttccttaagccacctgggacctgtgcctgccagccactcaagttccctggcttggatttcagaactttgctcgagtagtgtctgagaggcaccaggagagggagagagagagagagagcaggctgtgatacagcctgatggtgtacaaggtggaggcagggaggaggaggggtaggacacagcaaatcattgtgcaggtcagatgcctcagccttccagcggtgctcatcaaaaggcaaaagaggccaggccctcgtgcagcttctgtgctgggctgttgatcggtacattgaggctgggagttggggcccaccctgctgaggaagactcgagggcactgctcccagggcctgtgacatagctctgtgcatcctccaagcttgccactccctgactgtgaaggtcccacctgtgaactggaccccacacaaccttcctcccctactggggagcagagctgtaac

SEQ ID NO: 20856 - DNA, 1335 bp, Mus musculus
ccaccatgtacccaggcattgctgacaggatgcagaaggagatcacagccctagcacctagcacgatgaagattaaggtgagtggctaccacccggcctgagctggccttaggacctgtggctgggaagtgggacccacaggaagggcatgagtgctcattcagtgtttttcctccacagatcattgctccccctgagcgcaagtactcagtctggatcggtggctccattctggcctcactgtccaccttccagcagatgtggatcagcaagcaggagtatgatgagtcaggcccctccatcgtccaccgcaaatgcttctagatggactgagcaggtgccaggcatctgctgcatgagctgatattgaagtatcaatttgccctggcaaatgtacacacctcatgctagcctcatgaaactggaataagcctttgaaaagaaatttgtccttgaagcttgtatctgatatcagcactggatcgtagaacttgttgctgatttttgaccttgtattcaagttaactgctcccttggtatatgtttaataccctgtgcatatcttgatttagtccttagttcatgtggctcggtcacttgggggctggggagagcacgctgtagatgagaaagccccagcctggtggatctctgtgagcaccactgagtgatctgtgcagggtattaaccaacagcagacttccaggatttcctgaggctggcaagggttcctgaaccagttaccactccttcttgccagtctaacagggtgggaaagtccgagccttaggacccagtttcagttctggtttcttccctcctgaccaccatcggttgttagttgccttgagttgggaacgtttgcatcgacacctgtaaatgtattcattctttaatttatgtaaggttttttgtactcaattctttaagaaatgacaaattttggttttctactgttcaatgagaacattaggccccagcaacacgtcattgtgtaaagaaataaaagtgctgcagtaactgaccattgtttttctggtttggcacagggctgtggggtagggtggagttgggaaatggaaaggtgtgtctggttgcctagcagcagaaagccttcccattggtaagaaagcctgtaccccagcttaaagccagccatgcttggagcagattgttcactccctgccacattctcaaagggtaaggaattaggccagacaggcagccacaatgaagggcctcacacagaagcattggtgaggagagcaggcagctctggtgttatcaagtcatgaacaagtaaggaatgtagccatggtcaaaagagaagtaacc

SEQ ID NO: 20857 - DNA, 1099 bp, Mus musculus
gctcctctttggactgcccactacctcccaagtataagctgttcccaggtggggacaaaggcctgagcttgctgcccacccgcaggaactgctccgtgaggtgcaagcactgcgcgaccagctgtgcacagaggatgagctgagctcctgctccacggcccagaagctcctgcacatttacaagcagctgcgcaaccctagcctcgtcctgttgtgaccaggtaggccctggcccactcgctctccacactttctccagtatgctaaccctggtgctttacctagagtagacaaggctaccctttggttccctggctcaggcagctacacctcttggatagtcaggaaggcagaaaaaaaagggtgtgtgtgtgggggtggtggtgacataggttcaggcatgtctgaacctaacagactttagtgcctcatgccttcctccttcccaacagctgctggccggctccacgtcactgcaggacacacttggggcttgcctggcagcattcctcaactggaacctctgcaccctgatgggaaataccgtcacccaagaactcaggccatggagacacagggtttctggggctcagacttccaagtttgctgaccccagcacaccccaggagtgctggctgcctctctggggccaccagggggcagagtgctcactgcaaccaaagcacaaagaccatgggagagctcccggcgacacctgccaggcatgggctgcccccagcactgtgctgctctctggtccctgtcccagcctcctccttcagctgggccctgccctgctgctggtgctgtcgttgccgtgggaggggagcgtgtccacagagctctgtgcctgctcctgttgtctgtctgtgaggtgctgtgctgacaagctgccttttgtgaagttccaggtgtccactgaagtccactcagttctaccctctgcctctgtgttgtgctctgtgttctgttgagctctatgcagttgggtgggcaacccttcccagcttctccttgccctttggccaaaggacactcctcagggcccacgtacactccaccaaggctcctgtggccatttggggccaaagatctgccc

SEQ ID NO: 20858 - DNA, 1227 bp, Mus musculus
tgacctgaccggccctgcgtgtgtccgtcatcaggtagcaccgagctcctcgccctgtcttctaaaggacgcctgatcacctgcagtctggacttgaactctgaggcgcctgtgcctgccaaaatggccatggcaaatgcaggccagaaaattaaggagctgctcttggacatcggtgatgtctctgaaaggtgagctgcagtgtctggcacaagtacagcttgtgccctgtccttaaaggttagcattctgtgtggagctgacccaggctagggaggttttggttaacaaccatctatgcggctgcctctgcctctgtctccatcagggacaaaaaaagaaatctacacacaaatcctcaaaagacaagagacccctctcccctctgacaggactccggaatcttctaacaccaatcccttgcctgcttctgtggactctcagaggccagtgggaccctgctctcagcagagcttccagcaccagacccagggagcacatctttccctagcctgtccccccagccaccttcagtgctagtccctcgtgttcttcctgactttgggttttatggccttgtgacttgaggatattcccacaaagcctaacacctactgtcactgtggagcggagcgttgcaaaaggaaaagaggcccgattgggacatgtgaggtgacctatggggctagcccatccctaggcgtcaagggccggttcagcacctccatccttccctgccttgtagagccaagagtgaggatcaggtcaaaggatttcacagtcagggcaggcagagaaagatgtcctccttcggcctgggagctgcttgcatcctcagagagagagctgatacttgaaccatgatctggttccttcctccccagggagtctgcagccatggctcctaccctcggctgtgagctccttctcctgggtgccatgactgtcctttgcagggtgtcctttctgaagaaagctgttgaccaacgcaacaaggccatcacaagtctcaacgaggccatgaacgtgagctgtgccctgctgtcccatccagagggcgatcggcccatcgcgtgcaccatcaccacctcctggagccgcctggagctgcgagacatgctgatggccacctgcacactagagaacagcagcagcttcagcctggaccagggctggaccttgtgtattcaggtgctgactagttcctctgccttagacctggatggg

SEQ ID NO: 20859 - DNA, 2344 bp, Mus musculus
gagtttgtgtgagagtgaatctatgcagatgctcactacggggtgtgaggttcccgcagaaatacctagcaacagggagcagacttcaagtgcaagtaggaaggtgtttgctgactggagccagaacacttgatgtgctgacagtttgggcttacgcagtaggggctttgagccaccctgccctgccatctggctctaaggagatgtctttttctgtgcaggcatgacgtgttctcactttaccctacaggcaccgttggtgtgcagctcccaggcctccacgagtttggtgcagtcgggggctctgcacgcgctgctacctctgccatgtgggcctgtcagcactgcaccttcatgaaccaacctggcacaggccactgcgagatgtgcagcctcccccggacctagggctctgggcctctgctgcatgggactgggccagcccagccctctgaagtctggagcgccacatgttccctataaggcctgaagcccacagccctgaaacagtggggccagctgccctggtattccagataccctgaagcgtctccgtgcagatcttgaagagaaagaacctcggctgctgtgctggggttgaacagagcctcccacctgggaaggcagagcagacctgcccaagagctccccacacgcctcacgtgttggagggactgaacacgtccagccaatcacctgaaattggggtgtacagagagggtgctgctgtcacccagctatctctccttcctctatgatctttgttttctgccttcccaccttctcccccagtgttcggatgaatgttcctggctgtctctgttcccttgctgtggggctgtgtccctcctttgggagcatgtgtggctagggtgtggcagcctttgtctgacatgcagtatagtaggtccctgacctttacttgcctgaaatcagcagttatcaataattcccacccaggaaacttttatttattgttttttaaagataaaactgcacagatgggagtgagagatttacctctgctccttcctccttcagtgcagcccctcttgggtggtttattgggcaggaggccaccatcatttctcctcagaagcaaacctcagtgcctgagactttcctgccacgctgcagacagtggcagttggtagcatgggtggttcatcagagcagtggtggctcttgcctggcagtcagccccttcaagtctggacagccctggagttctggtcccctctcctagcactgtacctttacccagcgagtccccacactgtggtcttcttgcacagtgtgtggcagttgagaaagcctagaaaaggtgcccatttgaccactgtgaggcaaatagaaacagtccctaagggtcctatgtggctgtgttgtgacagcccttacccaggtaagagatggatgtcgtgatgcctcgttgccttaatgagagctgagtcagctgtccttcaccctgggaaagtccatgccagctgtggactgctgggagccatgtttgtcaccttagtagaatgcaccaatgttcccttctgcatctctggccctgtggacagaacacttattgctaggttatctatcgtgtggcagggctggccagcaccgttgggtctcacctggcatgagatctgaagctaaagccctgggactgtggagccattgggcttggtttggtattgacagggtcatcctgaggggttagcagtggtagagagcaaggcaagtgatctctccagctacctgccagcagtagagagagagagagagagtgctgagggctggtagtgtctctggctagggcttcacctttcggttttttgttttttgttttttctggtccctgagtctggcatttctgtctgtgacttagctatgtttctgatgccaatcacactagcaccattacatgctgggcaggtgctgggcagcacagacgctggagacctgtttgccactgcttgtcccccattcatctttgtctacaaagttaattacgttctcatgttctggcatccacataattcttgttttctctgacttatagctaaagaaatttttgtggtttctctgcttatggttttgagttactctttgttcagtaatgcactttattttattgtccaaagagagtcaagctaaagctaccaccttggggtgagccctacagaaggttcagacccgggcagctcagctacctccttctacatggaggtggccctggtcccacctctaatccctactgtcatcaggcactacagcccaaaaagaggtgcttgtgagcacacccacccaagtgaacccagtggctgccatggtcctcttcaggctcaga

SEQ ID NO: 20860 - DNA, 1227 bp, Mus musculus
ggtctccatagtgagatccaggacagccagagctacataatgagaccctgtgtcaaaacataacaacaacaatttatttcatttcatttgtgagtgtgttcatgtgcacacatgtgtgcatgctcttgagtgaagaggtcaggacaactttgggaatttaattctctcctttaggccccagggatgaaattcaggttgtagggcttgtcactaggccagtgagctgtcatctcaccagctcgccgagtcaagtcatttctcaggagttttgagtttatgttcccattctttccctccctgggccttgtcatccctgtaactgccttttccacatggatggagggagcctgtgtgctaagatacagtggacagtgaaagagtggctgtggcttgttggctacatttttttaaatttgtgtgagtgtgtgtgtgtgtgcccacgtgcgtgtcataggtggttgtgggctgtctgatgtaagatgctgccaagctaaagtctagtttgtttggttttgagtcagggttttcctgccttgagctgactgttctgcccccttcctctcagtgctggggtcatgggtgtgtgtaaaaactgttctcatgagtagataaagacgagaaatggagtataactgggtgtactcagaacttactgttggaggcaggatgattgcaaatttgaggccatcctgggctatagagcaaggccttgtcttaaaagaagaaaaagaaagcaggcaccaagagagcagttttcaggtgaaccacgtgggccgctcttttgctgctgcaggtgagccatgtggcccgctctgttgcaataacagtaagagaacagaaggtatttgaaacacctctctcagggctatcctaggcatttctgttgttactgtgaaggcagggtcttaccatgtgttatccttcttgccctggaattctgtatcatccaggctggcctgaaatttgcaccctgcctccttcctgctgggattagaaacctgtgctactctgactgggtctagattgtatgttgtaatgttttacctagacattagttgtttatttccttactgtcttagagggtcaagatccaaggccaaaaggtataaagtatttctcattggcctgtgaaaagctgctttcttactgtgctcgtatggctgctgtgtctagagaatacaccataataccgttgaaattgaaagtaactacaactttattttactt

SEQ ID NO: 20861 - DNA, 2161 bp, Mus musculus
tggtggcgggtccccggctccagccacctcactggcccgccagcggatcctgggggaagagcgggaacgggctgtgcaggcttacagagccctgaagaagctgcatagacaggaaatgacacctgcacagccaccaggcagctctttccagaggcagggccacgcttgtctgtgatgcagagacccaggggcctgatcccctggaaactggtctgggagctgctagacctgggtaagggagaggcagcggatgctctccttgcatagggtcctgagagtaagctttcaggtttggaagagtgcttttccttcctctgaaggttgtccttataagagtgaccaccatggtatcccatctcatacagggcaaacccccgcatcccagcacttgcctgagacacagctggaagggctggtattttccttgagcctaagttcattctgaaacaagtctcggctgagacaagccaggaccactgtagaatggactcaatcccttaatccagccaattactgaagctgctggtgtaggtcagcctacaccaatgttttaagaagctcccatgggcttactgcaacctttggaaggcagggacagacagcaaagcaggttagtgggctggtggaagggcaagtgggggcggcaatcagcactttttttttatttgcctgcagggttctgtacaaatgaccagaactcccagcccactcttggtttggatagagagggggtttcagtactgactgagtgccttgaggtatacacatgaaaaccaggtttcaatggttgacagagtagagtatttataccaagagggtagaggcgaaagaattgggtgttcaaagccagtcttgacttgaagcaaatgtatggcctgcctgaacaggttgagagagtctcaaaaaccttacttagacatcaaaagagcgaagcttggaccctgctggggaagcccacagtcctctagcagacctaggagcctccgtccagcaaagctggtcctggagcctagtggagtgctccaaatgtgcattttccagagtgaagtttattaaagttttgctctttgaagtctgggccgttgctctccaacatgcttatccacggccctagtcaatgcgtgtcaatgtgacaagatgagtgagtgtgcagacacacacccaacagtagcaagggccagaatagagcagggtgcatcggccacttgactttccactgcacatcaggactagggccagggcccaggagccaccattatcagagtatgtaggcttctgagttctttagaagcaatgtggccacacatccaaagctcaactgtgcgctacatcaaatgactctgggtaattatccctcagagcccatgcctatatgtgcctgtgcctatatgtgcttgactcctcccactttctgtaatgtttattaaagatgcccacacccatgcattcagggattgttttctgagtgctgctttttcacaaaatatcccagctaaatggatgttttcctgctgtgcttaagccatctcagattgaccttggccagaacgatgtgtggagccacctgtctggcttccccattcctcacttctggtatggaagatgtggctgctcttgttccctgcccactccaaggtcaggtctggtctctgctgccatcttggagtcctgaccctcagaacactaaatattggcaggtaagctggagcctgtccaccattatatcattactgaataattggtgattcatatagacacataggtacatatatgtcttcatgtgtgtaaaggtcttcatggtgtaaggggcaggagacataagggcttccccagccctctccactttgtcctggttgaaaatcaggcaccctgatgtactgctctgctgcaggtttttcctcagcagatgagcctagaagattatcatgctgatgcacctgacaagctatcccagtagaatgttaccacctcctgtgtgccttctcttgtccacttgtgggacctcatatacccctgtacatgagaaataaaagtttattgaataaatccatcaatgagaacattcttgtttctggtgaggtcacaaccacactccccctcccccagagttttggctttttgttttttgggttttttttttttttttttttgagacagtttc

SEQ ID NO: 20862 - DNA, 1186 bp, Mus musculus
ttgcactgggtgcatcaggggctttgctcagcagacagaatcatgacatgccattaagtgcacgtatgtacacatgcgtccatattgcacaggagacaagtttacaagagatcacacgtgccattgccatattggtaacaacctgatctactatgtgctaaggtgaagcttgttctaagccgaaggttttgtttgtgaaggggggtgatgagcctatctgctctttctctccagatggcccccagcaccggccctccccagcagcaaccccctgtggcccagccagcgcctacacagggaccgccagcacagggcagtgaggcccagctcatctcctttgactgaccttgagtctggcgctcaccatgcagagtaacactacagttcaccagaaaccacttatatgtctaactagccattcctcccctattactgccctgtagtgtcccttctgtgagcaaggggtgggccttcccccttggccctcttccctgtcctcggtggtctggctcctatcactggttccctgcttcagtcctgatgccgtctgacctccccgggactggggctctgcagggcaagtagaaccttctctggagagtgcccggctgtgttgggtgccacaggtgaatgctgtggggatgcttagcctggcccggagtctgatgtgaactaactgtgtggtgtccaggcctggccctggtacccagaagaaccatgtggctcctgcacagcaagggtagaagctttaggtatctctgtctccccttctccttggatgtcatctctcagtgcagagcagtgaaaataaaatgtatttcaaaactctcatgattgattgttcgggcagcaggctgggttggaccaacaatttaatagtctgcatctgttgtggagtgtgctgggtactggctgagaaaccgtggacttgccaacagtctccttcctggtggggattctgcagactcatctggtgcaggatacatcaccaggcgggtgaggaagggtgcaaacgcgggcttttgcagcccaactgccctcaggattacccactgcttaaggttttagctctcaatagctcaccctgaaatatacggttcaacctgacttctgtgaggtctcaagttttgctctttccctccccgctaagcgcccgccttagtgtgcactcaaaggaggcggttcc

SEQ ID NO: 20863 - DNA, 1623 bp, Mus musculus
gagctgccatgtctcctgtgcctatgagtgagaggcctcctgcatcctttactgtttcttgcagggtgttttccactgtgccatggagacagcaaagcttggaccccaggcctttttcaaggtgtgttggggcagtggggatgctgggcagtgggagagcaactgggctgggtctccctgggcctgacgtctctccctctggtgtctccacccagggtctctttcccgcgggcatccgtctcatcccccacactgtgctcactttcatgttcctggagcagcttcggaagcactttggcatcaaagtgccaaccacctgacatggccagggacacctgggccaggctcggtcgctgtgctgagctccttggaagagtgggaagggaacgggctctcttccttggcctgggcccatgctggtccccagcaggctcctgctcttccctgccttgggctgctggctatgccttccgaccctgccttggccccactcaagtggcacctctgccctacttactcccaggctctccccactgggtcaccccgtcttcctatccgatgattcactcagaagaggtctggcctggctggtgtcactgtccccacctccctggctgctaccgtgccctgcctggcaagcccagcgaagccgagttcgtttcctgctcccgctggccctctgtgcagggagcagtttccgcccagaacttgggtagtgtggcagggtacggcccgtggcagcttctgcttaccaaatgactagagcacacacacaagcactttgtcacaagagggaccaccgtgctgtgttctggaaggtagtgccttcaggagaggggacaggcaggcagcgcagattaccagcagaagccatgaccgtggagtccagagaaagtgcctggggttcccgagcgcacctcctgtatgcagccttggctgctctaatggtcagttttgctgaaccctcctgctcagcggctactgccgtcaccaggaactgtctgtgtccctcacacgcctgtgccctcccttgcctggcttccccagggccaggtgggcatgctggcagagctggggcagtgatggattcatcgtttgtgccctcccaggacctggcttcctgtatggcaggcatcacccttcaccatccctcaggcttcgaagcagcctgttttccctcaaatggggttgtgtgtatcaaaacgaggttcggccctgtgcctcccacaggtcctcccccaggaagtggcagcagcccaggggcactgcctacacctctcttcaggatctaataaaccaagtggcctgggaggcctttctgtcttccctgcacacttgggggctggcagatctttgagctccttcaccgctaaggacaatgctgtcacctttgtatccactaagtcaggactaccttacaggatagagcctatgggaagaattcttagacgtctgtgagcaggaggaaatggaaataacaacagaagcaggcctctctagagccagtcccatgcagctgctcactggccagatggccggcaagcatgggagaactaaggatgccctggggtgcagacagactgagatgcccaggctatgacagttgtactggcttaggctggg

SEQ ID NO: 20864 - DNA, 1179 bp, Mus musculus
gcttctgctgaatgcctgcactgtgtcctttccaaggcacctgggtttgggagcctctagtagtgggaagcggatgggggggggggtcctcttcccagcaccaaccagactgtccaccaacagccttcaagcccatcgacctgagtgacctgaagcgccggaacacgcaggatgccaagaagtcctagagctcctggcgccctcccctggcctccagaagctcaggtgcacttgatggtggtttcctgtgttcctgtggcgctgctcctggggggaagagtgtgctctagcaggccgtgatcccagagccagcaggattgatgaccagggcccttcctttcctctccagggtctcaagttgcccctgtcactgggggaacaggggcctggctgtaaccgcccctgtccttttcccctggccagctgcatcttgggtagcacctggcccgacctatctagccctctctgctgttacctgccatgccttgcccctctccttcctggctacttaaggtcaggaaggaaaaaggggacctctgtttcttcggctgttggaaccttgaaatgaccagaaagtaggacatgtgcagtcccacctgcatccagtgtggctctctccatggagacttgctcttcttctgccctggacatgtggggagctcccgcttccacccccactgtccatcctgacctttccttgccccactttcagagtcgaatcagctctgagcctaggacagtgctggctctctgagggcaaccaggccttgtgtcctggtacctgtgacactgttgtggtcacagcagtgcccttggacagggcattaaggctgaccctgaaggagtggtgctgccaggcctgtcctggctttctggggtgtgctgggaggattaccaaggccccctttttttgtgccctcttgaatccaagtgtctgtagctttggagactgagggtctgtgaataaaggcggtggcactggaagtggctccatggcagtctgtcaggtcctaccctgaagcccgcagagctgccttgcaggtctgtaagcccctggccgccagagtagtctggtgggtagtaaagttacattgcccacgtggagctctggaaggcattagcactcttcagccatgctatggactctgaggagcactgttggctccttggctgcccagg

SEQ ID NO: 20865 - DNA, 2056 bp, Mus musculus
tgttgtttgctctgtggataccacacactagttactagactagagagtagacataggctgcctcccactcagtagatctatacctaggaagctcggcttgcttatgactgttaaccttgatgttgctgatatggaggaagcagaaggcagatcaggatttgatagggtggagcttgaggtccacctagaaatcctgttgaagtgagaggtatactggccccaagggacctattggggagtagagtaagtgctgccttctgtccatatgcagtactctgcactccacacacagcctggcaaagtaaccaacggctgctgtgctgcagcttgtgctgggcctgttgtccctgcctgggctggggctctgcaggttcctagcaccattcctggttggctggggttcctgactggaagacatgccgtgtcttgccttatacacaaccaggccactgctggtgatggtggccaggtccttggtgatcagcgagtgctggtttcactgaggacagccagagtgtagctttgttcctttaactgccccttccttcatccaggacctcgacctagaagaagctttagagccagacatggaggaagacgacgatcagaaagctgtgaaggatgaactgtagtgcagaagccagatctgggcgcctgaacccaaaacctcggtgggccacgctcccagcagcccacatctccggagcctgagcctcaccccaggagggagcgccatcagaacccagggaatctttctgaagccacactcatctgacacacgtacacttagacctgtctcttcttttgcttttcaattttggaaagggatctctgtccaggtcagcccctcttgaagggctaccttttgttttaattggtggtgtacttttttgtatgtggaatttgtcccatgtgcttgctaaaatgtttggggatctcctcacactggtaatgtctttcctgttagagaggtttatgctaccacttcgcatttcatctgtgaggcatttcatcttttagacatgtcttcatgtccagctacttgtttcaccatggcagacctccctgagccttcttcctgccctgggtaggaagtgtggctctgggtctgtggtcactctccaccttgtcctagtgttgccatggtagcatggctttgtagtttgcatttaacctggggatctatgcatcctgtcaagagggtgggtccccatccccgtgtgtggaaaagagacagtgtggcttgctgccaggctcaggccaggtctggacagctctcactctcctcaagccaggactaccgaccagccggctatgggcacattactctgtggctgctggattcttttccagcatggcctgtggcctgtgtgaggcagaactgggacccttgattcccagattgggagtcagccaaggacactggggctgaatgaaatgcccattcttcaggcatttctaccataatattggaattgaacacattggctaaataaagttgaaattttactacccattgtcactgctgctttattttgagctaagggagctgagctgaaattctgccaccaaaagggatagcgggcatctgtcatgcatgctgtcatacaataaccttacattcacaataactttaaattcaggattgagcctcaagaaggtgtatccttgccaggtggtggtgacacctttaatcccaccacttggggggcagaggccagcctgatctacagagtgagttccaggatagccagggctacacagtgtctcgggaaaaaaaaaaaggtaccctccagagatcaggaatgcaactccccaagaaaaaaaaaaaaaaggtgttaaaagtaagatatttctgccaggcggtggtagcgaacgcctttaatcagcacttgggaggcagagacaggcagatttctgagttcaaggccagcctggtctacagagtgagttccaggatagccagggatacacagagaaaccctgtctcaaaaaaacaaacaaaaaaaagtaagacatttctgaagctgtggatgaagatggttggtagagtgtt

SEQ ID NO: 20866 - DNA, 1159 bp, Mus musculus
atgcaacacgaggggcttcggaggcgcaagcgtagccccgcccaggggtccgggactccgcccactgccacgttcgacggagaatcgggctgggtacgcgcatctctccaccaatcaggagccacgaggccgggcagcggaaagccgcagccattccagacgtgtggaaggcgtgggaaaagtcgccagtcagaagtccagaaagagaaagttggctttcgccagcgaatcagacgctgggggacattgggtttgtgcgcgcgcgcgcgcgccgtggccaatcccaggcaagaaccgaaaggcctccgggtctttgtcgacttggtggcccagccttgagtgggtgtccagtccccgcacggcgagggcgggtctctcagctccttggccaatcggagggcgcggcggggcgcatgcgcacggcggctgacgcgcgcagcgagggggaggcgtgggcgcgtccccggcccaggatttataaaggcgaggtctggaccgacgcgcgctctcgtcgccttggctgtcccggcggcgccaacccaactgccccgcccgctgcagacgtccgacatgctgagccgtgctttgctgtgcctagccctggcctgggcggctagggtgggcgccgacgccctggaggaggaggacaacgtcctggtgttgaagaagagcaacttcgaggaggcgctggcggcgcacaagtacctgctggtggagttctgtgagtgcgccgtgggcctgggcggggggggaagggccccttgtccacggactcctccgggccgccctctgcggcacccagcactgtcctgcgcggccggcccctcttgagtacggtggcccgtagccctcagcttgccccacggaacacggactggccggtccagagctgcacctcgcgggtagcacctactgtaagcttctctgcttccagttgtcccaagagcatccttcctacccaaagtagaagtcgttgtagtcagagctcattgagggggactgcgggattgagaatcaagaaggtatctttgtgcacgacgtccacatggccagaaccttctgttagctgggaaaaacagagtgggctgtgtgagcagttagcagttccgatagagtagatcaaacgctctttactatgcccaccctacctgtaacttgc

SEQ ID NO: 20867 - DNA, 2196 bp, Mus musculus
aggggctggggagagtgaatgtagcagggtggagagcccttcaagcaagcagtcagcggagactcctcctcaatacaggtgatctggagagcttcaagaaacagtcgtttgtcttgaaggaaggtgtggagtaccggataaaaatctctttccgggtaaggtgggggctttgagaggcctggaaacaaggggcagaggggcaagcctgggaaggcagctgaccctggctctgtgtccccacaggtgaacagagagatcgtgtccggcatgaagtacatccaacacacatacaggaaaggggtcaaaagtgagtgggcgggccatagagtggggagccattgggcctgggaggggcgtgcagcaccagtaatcctgcctctcctgtccctcagttgacaagactgactacatggtcgggagctatgggccgagggccgaggagtatgagttcctgacacccatggaggaggctcccaaaggcatgcttgctcggggcagttacaacatcaagtcgcgcttcacagatgacgacaagactgaccacctgtcctgggagtggaatctcaccatcaaaaaggagtggaaggactgagctccagctgggagacgggcagggcgacggacagacagaaggaccgacatgccccaccctaaccccctacctaccccaaaccaaagtgctgacaggacctccctcacccgtcattcctccctagtccactcaggcagtcagctctcctgtctgcccctcctccacctcctgcccgcaggcccctgtggtctccagtgtcacattgctgcttctgcctgtgcagtgggggaggggttccagcccaggcctccaatctgctgtgtccctccaggttccctctgtcttcccttcctcaggccctggcttctagaatggaacagaacactgtcagggttgtccagcccaccttgtctctgtcgcagcatggggaagggctgggctatctgtcctctagtcccaccactccctggccaggtcatccatcactgtcagtcactgtctaaccatgatgccttaacatgtggaacgtgtgctgggggccgtcgctaactcttaactccctgtctgcatgagcatgtgctctccctgtcctcgcctcgtctgccatccccatcccagtgacccacccaagggaggcctggggtgcgctgctgttgcttcctgcgagcctggccagctcttcccctccccgtggccagggttgggggtggctccagtagctaggggagggtcaattgccaaaactcgatgcctccagccccatctaggaggcagggtagggtgcctcattcctctgccttctctgtcccttgtaggcagtactcggagcccctgtccccacagagagcccctgagggacaaagccagccgagccttacttgtctcacctgggccacgtggcctgaacctcgtgcctggcctgtcagtatttattgcctccatttgggccagctggcctgatgcctctgccctggttcttggtgccaccatccctgggccgaccctccctggacccagccaggacaaatgtgggaccaagttcacacagttgggagctgtctcctgtgcctcccctccctatccccagtccctgtgtggtgtctgccaggcccagcctcaacaggcagaggagcctgtccctgcttctcttctgactgggaaataaacacccctgaaggagtctgggattgtgtggtctgtgcagcttgtgttggggttttgtagggaatggtaagaatccagtggagggtggatgtccctcagatcagatgtcctggctacaaggttgtctgctgctaacagccctgttttgtctttgctcctggcttcctgtggagatgtgaatatagaacaaaccccaggcccatgggtcacagtgctggccctgggcatagagggattgcctgagtcagcatatctaaatttcccctggctgggacttgccctcagtatggagccctgctggaagatcaaactgatctggctctgaacaacttgcatgtgtaggtcgacctggtgagagagttccctatgcctgttagtgaggctagttggaacaggaaaccgagcctctgcacatctccagtactgtgctctctagagcacccacgaacctagggagaaagggcaggaccactgaaccatgaagcttgtagcagaaccct

SEQ ID NO: 20868 - DNA, 1868 bp, Mus musculus
ttcaacgtagggtaacttttctttcctttggttaagaatgggaaagtcactagactgatctgggagtggcagtcctcttgccacagcctcccaaatgctgggattaccggcaagtatcaccataatcaacttttgagaaagtgaaaactcttccaaatagttgtaacatgttaggtttgagattcttgagcatagggctggctctgtagccctgcctgactgacctagtacttgctatgtggagtccaggctagccttgacctcaatggcttacagttcttcacttagaagcattgaacttggtgtctagtggatttataagaagttgattttgttgctgggctcagtggtgcatgcatacttcctgtgaccctagctactcaggagcctggtgtgggaggatcatttgaaccctgtagttcaaaactaggatgggcagtattacaagtccttcttttttaaaatttggatatgatgaataaatgtttgtattgaagtgtacaaaatcagagttgatcacacctcgtctctttatgttgcttaatgttatggctgtaggatttagatctggggtgtctgctgaaagcctgtctgctgaaagcctggtcactagccatggtgctaatcagagtacgtagagccccagcctttatcccagtactcagaaggcacagggagggggaatctctgaacgtgttcaaggccagcctgttctacagagcgagttccaggacagtgaaggctacctacacagggagaccctgtctcaaaacactcccaccctccaacccacacaacctctactacataaagtggatagaacttttaggagattgggccttatggagagtatataggtcattggaatgatagccctgaaggagacattagcactctttctattcattttctttcgtatttatttattgggtatgtatgtgtacatatatttgcaaatgttgtatagcatatgtgtggaggtcgtccatctgtgggttttagcaatcaaacttgatgtttgtaccaattgtctacccaatgagccatcttgctaataattcctcttccattcctggcaactgtgaaattagcttcctctgtcatggctttcacctttaccctgctgttgccaggaccaaagaaagattcagaacagccaaaaataatctgttcttagaggaatgattctttttgtgagatagtaactcatgctataatttaatttagactgtctttgaacttgacaacaatccccctgcctcagcctctttagtgtagaactttagacatgagatgttttatcctgtaaagttgattatctcagatatatttgtcatggtaatgaaaaactgattatcacaatgatatcatttacatgaatgtgtgttgatgtgcatgtatgtgaatatgtgagtgcctatgcacctgtgtgcatgcatgtgtctgagccccagtgagtttatgtatgtctatcatacatgtgcaggaggccaaaaaagatatcaagtttcttggaattggagttacagccgtgggtgctgaagtccaaagctaggtgattccagtgatttcttcctcgggaggaagagggggtgcggctgcatgatttgaagccagcctgtattacatagggagttcctggtcagccaagctacatagaaagacttgtctccaaaaataaaaaaagtgaccatgcctatctttttttgtctaagaatttatttttaattacataaagatgaaagtaggatgcatatacatacatgtggcacccgtggatgtcagaaaaaaaattctctggaactagaattatggatggttgtgagctgccatgatgtgggtgctgtgacctgaacctgggtcttttt

SEQ ID NO: 20869 - DNA, 1652 bp, Mus musculus
cttgcatggagatcagggtgtggtgccctctgagtcagcttcagagcctctggagtgagacttcttgtgttctttaccataggccgccctatgaacatccagcttgtcacatcacagattgatacacagcgaagacctgcacagaggtgagttctgtggtcctcggatggggaaagagacctgtggtttatgatagtgccaccctcaaggccttgccagacagctcacagttctgttttttgttagcataaacagaggcggcatgacaagaaaccgtggctctggaggttttggtggtggtggcaccaggagagggacacgtggaggcagccggggaagaggtagaggcaccggcaggaactcaaagcagcagctttctgcagaggagttggacgcacagctggatgcttacaatgcaagggtgagttgagtccttgggctcagaggactgggtggaactgagtgactactgtagtagtctaaaagccagtagagtcaggggcctccttagtgaccttccccctctcttgcagatggacaccagctaaacaactgagcaaatccacacaagtaacaggacccagaagcctcgcctgtgatgcctagagggagggttggcaactgaactgtgcagacaatggtggatttgttttgtttctttttatttcttttctttttttttttcttcctgttttaaaataggatctaaaaactcatgtaaagtttttttttttttcttttttggtttttgttttgttttttgtttttttttttaattctgaaacagacctgttttgtactgagttatttttgggataaatattactggttgctgttgtggagaaggtggcattttcacctttgccataataaaatagaaatgtgtgtagaactggagctgtctggtccatcctgctattagagtctctgtggctgtagctagtacctggtgtgagattagagttggtgcctgggaggctgtgggtgaggcctgtctccttcccactgtcctcatgccttactccaactggataggtgggagcctatagagcgcagtggtctttgggcaggcactgcctggatgttttgcgtgcaccatgaggtgatgagggggcatggggaggtctgctgagtgatatctagagagatgtggcccataaattcctggactactcctttgccttatgcttcattagagaaacctggtttcagctttgaacctgtggtgtttcctttgtgtttttctgtcttcttactatattgacaaggaaaaaaggtgcttccttcctgatttgtgtacagtcagtccttgtgtgatgctcactggcagtatcaaaatctgaggatccccaaattttcaggtaaagtgacatagtgtttgcttagagtctatgcacattttcaggctttttcaaagtatattgtgttgtttggggaaggtaaatgtctagcatgtgtaatcttcaattgggatatttttgttcctggttggctctggagacagagttagttgtataatagctaatgcaagctgaggcagaaaccaatttccaagagggttgggtttaaagataaggtattttggctcctttagggggttagaggcaggattttgagtagtgtggctgagcaatggaagcttgaaacttgcc

SEQ ID NO: 20870 - DNA, 1228 bp, Mus musculus
acctccgcatccacgcaaaacattggttttcactaaccagggcctcgcttttaaagatatggaaagagtgactgtcactaatccgcgaagttaaagcaggggtgaggacgccagctcgtcaggagaccgagccttcgagcaaaaacaaccaagtcggacccacggaccggccgggacccccacgatcgcacggtgaggagggacgcgggacgcgcacactgcgctgcacccaggcgacgcccgaggatcttccggcctcccagggaggcgcccgcaggccccgccccctgctcgccctcgcacctccgcggcctaatcacgaggcgccccgcccttccgttgcctccgcgcgggaatgtataaaaacgaccgcgccgcgtcgggctcctccgaagtagcgccagccaccgcggcgagccgtacgcaggcgctctgcggaatcgcgcgcgcccagaccaatcgccgctcgcttcgggcccgcgacgccggaaggcagggggaggcgccggaagtgacgccgcggcgtgctgacgcgcgggctcgatccgaggcccgaatccgcgcccgccatggccgacaaaatggacatgtctttggacgacatcattaagctgaaccggagccagcgaggaggccgcggcgggggccggggtcgcggcagggccggctcccagggcggccgcggcggcgcagtgcaggccgccgcgcgggtgaatcgaggcggcgggcctatgaggaaccggcccgccatcgcccgcggcgccgcaggcggcggcaggaaccggccggcgccgtacagcagagtgagtgcggggacctgcggcgcgggccggggagggtgcgcccgggccggccgggaccgggtgagcgtcccgcgcgggaccgcggccgaggggtgggcgggggcgaggccgtcccgaggccaggatcttccgggacgctttgtccggtcgtggtccagcctcgtggcggcgggggccgctgcgagagaacttgggtgtccgtagcggagcggcggggctgggggactctcggggctcctcgaccttggccgcggggccgacgggagagcgtcgccgaggtgtcgcgggctcccgggacgagtctcacgagtgtctctgtgcttacggtttctctccagccgaaacaacttcccgacaaatggcagcacgacctcttcgacagcggcttcgggggtggagccggcgtggagaccggcgggaagctg

SEQ ID NO: 20871 - DNA, 1180 bp, Mus musculus
gacgagctggcgtcctcacccctgctttaacttcgcggattagtgacagtcactctttccatatctttaaaagcgaggccctggttagtgaaaaccaatgttttgcgtggatgcggaggttttgtttttgtttttttgtttgttttcgtttcctgtttggctgatctgcttctgccccgggattagaggcgtgtgccaccgtgccagactacatgagtgcagatctttaaaggcatccttaaaggtggcaaaataaactcgtgccattaatcccacaggctctccttgccgtctttaaagacaaacacgtgcctttttctttctttttggtcgggacgcacggaattttggaagatgccgttcttgacgagtgcagcacttgccgcagctccatgactttgagcttaggtgctttcgtattccgtactaactccaggtcatcctcttccctcaggtcacaggctctgttgtcatgaaggtgaaaattaaatgttggaatggtgtggccacttggctctgggtagccaatgatgagaactgcggcatctgcaggatggcgtttaatggctgctgtccagactgtaagtgtcttcctatgcgctctcagaactttagcctactccaccagcctaaaaatccctaggtttcccagcactgggtaggcagagactggaggatctctgagtttgagtttagcctggtcaacaggacaagttacctaaccctaaccgaaaccccaccggacagtggtgttgcacgcctttaatcccagcactctggaggcagaggcaagtgaatctctgagttcaaggccagcctgatctacagagggagttccaggacagccagggctacacagagaaaccctgttttgaaaaaaaaacaaaaaacaaaacaaaacaaaaacaaaaagccaaacagtgcaagttccaggataaccagggctacaaagaaaagccctgacttgataaaagaccaggtaaaacaaaaacaaaaaattgtgggttttagtttctattatctgaggggaaagtcgacagaaaaaagaagcagaatacttcaagcccaggtttgtctaaagaccccatccagcatgatggcaaacacctgtaatactagcatttgagaggcagaggcagagactagtggatctctgagttggtggccagtctgggctcca

SEQ ID NO: 20872 - DNA, 2985 bp, Mus musculus
cccccacgctgcttccacatccaccacctctggccctgggtggtgacattgcagggaccaaggtgtcactgtgggtgcccacagggctgtggcctacctgtccttggccgtcttccttctggcctcagcttagttcctataggcttcgttggggtctccgccccagggccctcccttgtgggttgggagacctgtcactcacgtgtttctgaagccccgttctgtggggtgttgtttcccaggcagattggtcgggggccccactgagggcaaccattcttccctgtgtcactgtgagagcctggaggcctccaccatcgccagacaagggctttggccctagggccaggtctgttcttccccagtgtccgcagcttttggctctgggccctcactctgcctccttcaggatctgcgtcttccagggatccgctgttcgacttggaggtgcttctctgcaggttccaagcctgcctcctcaccccacctttccagtggaggctgcccaccttccaggcttggctcaggaagctcctcataagcggatacccacctgcaagaggctacatccctgtgtgggcggtcacatggcctcctgctgacatagctggtgtcttctctggggcccctggatccctgaaaagcacagaaatgtggtctggtgaaaggaaagactggcctgacaggcctttacctcgtaggcagcaggatttttactcagtttgacgcagcgtgcagggctctgaaagcaggacctgtgccaccctggcgttttggtgggctactatggctcaaggtgctcagacagtcccattgatgcctgagttggatatgagtgggaatctggactgttgattctgagttaccagatgacctcatcccctccctttggttctgtgactggtatacagaagtgctgcctggcagcagagctggtgtggaccgtgcccatgcctggaggacgagaggctttctgagtgttttggtactggctgggctgctgtgtaaagctgagaatggcccagtgcctcagtccagcctcctgggaggatgaggaagaggaggctgcggctgggtatgtgttaaacaggagtagtaggtctttgcttctgaacaggatagagctatgctcaaggctttcaggtttgcagcacctgcttcttgagtctggggaactttccctgttgagccagccctgcagctccactccctgtcccttgcccttgatttcctgacagtaaatcctgtgtccatttgtgactgttggctgtttctctgatcattgttaattccgttttcctactgtgagggtgttgtgtttgactttctgacacagcgaatggagagcttgggctgaggccaggtctcccaaacttctccgctaagtaaaccataatgtgtgacttccctcctaccttgactctgcctgacttcttccttggacatagacactcagatttcaaagaaagtccacagtttcctctgtagagtatggtcccagagagtcccccctgtgttgtgtgcagctgggtgtggtgcctgctgtgcagggagccagtggcaacactgtgttaacagggatcaccaccatcacccggcttccagcaggctggtctcagctcatctttcagttctatgtgtgctctgttagccttggtgatcagggccagggtttgcagctttgataaactacttggagatggtgaggccacttccctgctacctccctctctggtgtggccacttggctaaagctcccatccgcagctgggatgtctgagccacagcctgctacactgtttcccctctgggatcttctgagttacttttttaggctgtggtttagtgaaaggaaccaacacattaacaatctccccagaagccactgaataattcttggcatattttctcagtgccattggccgcctggtttgggagcagttgtggaacagaggacagatcggtaccatacagaggcatgggttcgctgtagctgctcacagtttgcctgttcctggcgtgtgtcctaggtgtgtgctatacctgctgggccagctacacacatacgtaccctgcccctggagcaacggcattaatatagcacgggtgtctctggaagtgtgaggtagagtgttctaggaagtgttcctgataagatttccttgttctctagggcccccgttgggcttttggcccctccagcaactttatgccccaaccccacttttcctcccattctctgtctgctagtctctgaagcctttaaccaaatgggaatgggtacagaaagccttctcctggcaacttagggcaacaggacaagggctattgtgtgtccagctctgttggtctcctggtgctgagaggtgtgtccaagcagagttgatcagcccctgcctgccctgcagggctgaagccagggggaaggttagtagagagtaccctaaatggggtgagggtccttcaacatccaagtgaggaggggctgtggtgtggctgcaaggtgagaccctgtctcctgcacctgggtagggccataggggatctggctgcaaggtgaggcctggacttggagagcaatcagtctcctggcctcagcaggcagcagccttggtgcccacccgtgccctgcgcagtatttattgctaaattattgtccaggaggggcggcactgggcctggccccccgggtatttattgctgtacatagtgtatgtttgtgatatataaggttttctttattttgtatatgatcaataaacgccttttaaagagatctggtggtatttctttgaaatcccgaaggagcaagggtgggaagggcgagccggaagaggtggaaagggccgggcccgcgcatgcgtctctgtagctgccggatgaggcggaagcggaagccggaagcgcagtcaaaggagcgatggcagccggtggcggtctgagccgctcggagcgcaaagctgctgagcgggtccggaggctgcg

SEQ ID NO: 20873 - DNA, 1212 bp, Mus musculus
gggttccctgggaattcctgaaaggccactcagcaaaaagttccttgtttgcgagattcatgcaataagcctagaaagcctctgagatccagctcctttctcctgcacgcgttcccagggacaagtatcccgagcctgtctggagatccagggctgagactcgtctgcccttcagcagtggcccacacatgcttgggggcttgttccagtatgggctccactttcctttagcacacaaacacattagtctcctctacaggtggaggacctcagctatccctgggaagactccagagcctgagccacctcctggaatgacaccagcttcaggattaaccccagagcccagggctctgtacagcatggaagcagctccacaccagcccccccatctccaggacagtccatcttttgattatttcttctagccccttgtggccctgggtgtgtgcagtctaaaactttgctccaagactaggttcctatgactgctgaacaaggaatagggagcggacccccgacccaccaaagtggaaaaccttagtaaagatgactcacaaattatctctcagtgctgtgaggaccaggatgtaaggcgggtgtagctgtgctttgctgctttatgggctctgctttcttccacccttctccacccctttcaaccccttaacaccaagagagaaaaacagagaggaaagagattcctgaataaaggggacgacatcatgattagactacttcctgctgattaagggtgtcaagttcctcagggcaactttgatcttcaccatcaggatatctaatttcttcttgtctcttctttgtgcacaactacttaaccaactgagaccaacaaccaaccaaccaaccaacaaccaactaaccaaccaacaacccacctctcgggggccctagcatttacataccctttgaaaagtccccagaattccaaacatcacacgatcacagaaactatctgtagctggcaaaatcacacccctgtagagcatgagggaaaacacagtcagcttctgcggacattccacacatgggattaaaacgaaaacgcgttcccgtaatatttctgtggttttcaaaggagccaaaactccaaaactgtcactacaggagggtgggtggggttgatcagtgagaattagcctggcaatggctatcctgtagtagctgcccccgggacccacggctggtgct

SEQ ID NO: 20874 - DNA, 1636 bp, Mus musculus
cagggtgaccctgactacacctgagtggtgtgagaagtggccttgcagctgtataggtggggaaggggcaggatggggcggggctggcagaagggattgtgggtgccagcatagcactccccaccaaagctgctgctggaactgtgggttctgggaggcggaggggctcagagtcagggtctcattgcttttctagggagctgcagaccatggctgaccaggagaccatctctcctgctgccataaagaagactgtactggataaggtgaagctggactcctctgctggggcctctctgtcttctgaccatgtcaagccactgccctgaaacctggtcccagcaggcaaggaatgatttgtctgccagccttcctcctgttccctactttcctttcctttcctctcctctcctctcctctcctctcctctcctctcctctccagcagggttttgcagtgtactccaggttagctctgaactagtcatcccccactcttgtgtcccaagtgctgggatcatggataagtgttaacatgccaggatcctcttctatctttaagtctaagatagtgacttgatgttgcccagacaagacttgaacttacaggctcagggcatactctgatttcaattcccgttaggtacacaacacctgagagactcagttcttctctttcttcttttcttgcttgaagcttctgtcccaacgctctcaaacaacaccgaatatccccatagcaggcccttgcccacagccaggtcagcaaggaaggggatatcacttacaactggggacctccattgatactcaagtgccagctagacactaggtggcttctcagacctccccctcttcagcatcctctggagctcaggcctgtggggtctttactctccctagtttcagggtcagctagctagttagccatggcctctccctttctgtgatgaccagctggcccaagacatcgtgtacctccttctagggacttaacgctttagcaatgattccctaggcactggggaaaagaacttctcgggtagctgacacgactcctgcatcttccccaactcaccaaactgctactgctcttcctatcctttcagttgaataaaaaaagaaaaaaaaatcccccagagctccagtcaacctatttgtcagctatggagagaggcctgcctgtacagggggagtatgacaccgaaggagaagccaggaacacgggtcctataaagccggctgcagccaggctgaggtgctccagagaacagagggctacagatcctccgtgcctgtgccatagctgacctgcctgaagactggcactgtacacaggccctggcacacatatgtagtgaggggcaccaacctctttagtacctgtccatatagcttgcccagggagatgtttagctggctgactcaggctgtgcaggccaagttcctggtgaggaggaaacctttagaggaactgttggagtttcctagatgggcagattcaagagccatgacacaggggaaatcctgtctggaaaaagaaagaaagaaagaaagaaacaaagaaaagaaaaaagaaagaaagaaggaaagaaagaaagaaaagaaaaaagaaagagagaaagggaaaaagaaag

SEQ ID NO: 20875 - DNA, 1108 bp, Mus musculus
gggcagagagcaggttgcacagggtcagttgggttgttcagccttctgtgccaagtcattcactacaaagcaggtccagagagcagagactccagactttgccctgctgtatagaactttccagagctgaggactaagtgatcctgactgagagacttgtttagttccagacagtaggcagaagccctgtatcaagggatgttgtgaaatacacagtctgggaacagaaatgctgctgctgctgctttcacagcggagggcagagctggaccccatgaggacagagtggcgccttcaaggtctacttgtgctagaattctctcttcccaggttgtcacggaagagtgaggacagaacagacaaacttggatgtgaacggtcccaagtttactctgcatatccatatccttaggaaaacctgttggtctcctgggaaggagcacacagacttgatgttagggtgccgggcagcttccctcaaggatcaccaggggtggtacagagaaaagtacgtatctgtggggaaatgtcaggaaagatggaaggctcagagaaaagacctcagagccatggtgctcactgcaggatcaagacaccaaagccccagctgcttctccttcggtgtgtctgtgtcacaggagaatgaagatgaaacggcccagagtgtcttgtagtgtctcctggggaggagctgaaggactggaggaggtggggaagccctggggtctgtatccctcagcatgcactgactcttacctgaagtgcaggtggagacagtaatagcatgatccagaggactatgcagccctgaggccagtgcctctgggcccaggacagctgtcaggtctgtccatggatgttacagacacttttaaacatgggaatattggatacagggtgatttatacccgcctttttttcattgtactggggacagaacctagggcatgtgcatgttgccgtctattgagtggatagcctccatttgtaccagtgctgacaggccctgctcctcactgtgtggcctgtgtcagcagagctggagtagactgctcagctacccacagtcctacttcttccctcaggataaatttagagatagactcag

SEQ ID NO: 20876 - DNA, 1105 bp, Mus musculus
ttaaccaccacctggtggtgcatttctccatctggagcttgaggtcctgtggctcaggcttgcctgggggaaaggagtaggctctgagaggtctgtgtgggtgtgatggtgacccactggtacatgaggtcttgagtcccattgctaggactggcagttctgcttgctaggcaggggtggcagatctggaagctattttggctgccccttcctgggcctgtggccacacggcatgtttatacactgttctcagatgctgcatgggggaatgtgatctgcctgcttgctctggagaagccacacatcaaagctggccactgtctaataatttgatgtcgggtgggctctgtccctattgtaatttgttatcctataatgccccaagcaagggcttgtagtcagggcactgcattggcctttcccttgcgctgggtcaggtagcctggcagcatggccttcttgtagaagtgtgttccatgtctgctatctgggaggcaaagcctcttgtgttctcgtcttccttccctgactgtccccttattccctggcctatcttcttgggcagtaagggcagttccaatacacagttgcacaatgacatgtgtggatggtgctgtgtggttctgcctggcctttcatggagagtaaaccagctgagaatcccgtggagccagaagcctgtcttacaggttgggctttgtggtttccttaagatctgttttgctgtcctgacaaggccctctgggagcaggtgaagctggagtgctgggctctcaggaatgtgttctagagtggggaacattcaagggcagaagtgcagaataccaaaggcaagtgtgctctgcacacaggccagaggtctgattgtggcttcggacataagtgctcagtgttcctgagctggaccatgggcctgtgggctgatgctcagtccttctgtaatagacttactccatgccaccagtgccaggctcactcctgtggacccctactcattggagctgtgtttgccacatgtgtgtcccacaggtcctttgagtacgtggggttgatcatggtgcgtgtctcgtgtctagatgatccttggatactggcttctaactct

SEQ ID NO: 20877 - DNA, 1156 bp, Mus musculus
tatcagtctgggagacccagacacccctgcccacaacagccttatgtctcctcagtcataaactgacattgacagtttgctggtgctatagctgggcagtgggactgaaggacacagttctcacatgagaagtggggttcccaactggtgctctgctgtggtccatgatgggtggagtgctagaggaaagggtagacttgcctctgggagaccggaacctgctgaacactgcctgcctgtctggccctctgagcctccctgcttcctgccctccttgtaggcaaacctcttccctgctgcgcttgtgcactttggagctgaagaaccaacaggtgagtgaggccagcaggaccctccctgaatcctgctttctctgatgcccgaagcaagaaccttagaaggtgttcactctgaggtacctaagtgggttggggggctgcagcccaggacccacctccctggtgcggagcacctgcctagcacaccactggcagcatgtgggtgcaagtgcaggtctcatctgtggctgagggtaggctctggcttctgaaggtctctatctggaacctgggctgctagaacacaccgtctccccatctacagctgatgtgctggtggccaggtaagttcatgaggggttgggagcccctccaaggctgtgcccaccacctggccttggcctctcacctctaggtgtatgtcccgggcttccgggtccccacctctgctgccagcccctgaccctgtatccctggagtctgagccaatcgctgaggatggggcactggggcccccagagcccatccaagggacagcccagcctgtgaagagaagcctgggcaaagtacccaagtggctgaagctgccaggtgcctgcctgcctgcctgccatggactagctgggtggggcagggtggctgggcaggaactcaggggtttgtgattattcttgtgtttgcatcacagccagcaagaggtgagagctaccagcctggagatgcctatcaccagccacaggaccctacccccacccaccccgagcaggaataaagagtcgcgcttctctcaaagctgagtttcttttctgcagaaaaggccctcaggcctccctcgagctctctcatccactgcttcccaaagaaccctgggagtttgg

SEQ ID NO: 20878 - DNA, 1182 bp, Mus musculus
gcctacaagtggcagttgctgtggcctgtggcagatcctgccacatgtgtgaaggctccagttttactgcagcatgtgcacacatgctgtttgttatcctgtcctttctgagagctctgcattcgtcccactgagatggatggaagggagcacggggctcaggctttgaagcaactagactttgggtgattaatggcaaagagaaagcaggcctcagagagatggtgttgatttattgatgttgctttgtaagaacaaatttacagctcagggaggcatcctgggggtgggggtcaggtggttaaaaggctacacagcagctttgatgtagggtggcaagaaggaggcactgccagcagctggtttatttataatgcaaggctgctgggggcgggaggagggctgtgtctggaggcaggctggttcacctttccctgcacctgtcttgcaaggactcttggaggtaacagctgctgggatcttcccatcctcctgaagctggagagctcaggagttgatgctggtgtggattcactagaccttgcaggccacaggagggaactctagaagtccaggagctatggaggagaaacgggctcaaagtgaccacacaggcaccattctggagagctgcagactgccccacctgcatcccacataccagctgagggagcactttctccagctgatccacttccacaacatccaggtcttctgcctgggcctgccagaccccacggacagcagcctctggtggaatgtcatgaagtgagctggggaaagcggggcagctctaaccctgcccttgttaggtcccctgcacccattgtcagccctcagagggggcctaggtggctcttgagtgtttcagggacaggacttaggcttgattgtagctgagaaaaaccttagtttactgacaaaccaaacaagaaattgtcatctttctggtgttgtgggaacccttggctcacctagtacgaagatcctcaggaactccgccatgagctgcagtgcatccccgctgactggagggaagggggagggtggtggtgtcataggacagcctccctccctgtgccccacatattccccaccccactggtgccccaaacctttggtcttgcaatccctgaagtgcaaatggagtagtctgctcaccagttcctagaaggagggcag

SEQ ID NO: 20879 - DNA, 1250 bp, Mus musculus
tgggactgagaagcgaggccggggcaggccacgcaagcagcctccggtgagtcctgggacggcgctggtcgggagtcagaaagagcccagtgaagtgccaactccgaagagacctcggggccgaccaaagggaagcaagaataagggcgccgccaagacccggaaagtcaccacagctccagggaggaaaccaaggggcagacccaagaaactggagaaggaggaagaggagggcatctcccaggagtcctctgaggaggagcagtgatcaccactcgcagtgccgcctgctccatagccactgaggagcagctgtcccctgggactggaagccctgctcccaggcccctccccgcccccactgcacactaccgcaccaggcaccagctgcaggctctgctccgcagcacccaagggagcaggattcggctcagtccctgtgccctcctcccgaacacacctgccccatcctgacaaggctaacttcccatttagccgcagcccggcctgctgcgcacctccctcagagccgtggctctctgggcgctttgttttgcgggtcccttctgccctgctgttcctggcttccccgtagagggtcctgggagcattccctggccttaaggggccccggccccatctcactctgacaaggcccagtggctgacctagcagcagcagtgtggtcagggcaggggatgcttagatcccagcatgtccccaccaaagtatcaccgggtgggtttctcagcccctcctgccccaccctacagagatcatgcactgggttggctgagccccttgacaacaggaagtaggatgatgttggctccacccactttaatgttctcacctgagactagacagatggggttaccgcccatctccagagtaagggcctgttctcgcctccaccaaaggcaaacgggcaccaacacgcctcccccagtccactctaggctgttccttcctcccgcagggcactaaggagctagccttgccgccccctccttttcgctcctccctgccccccatggttctggttccatcttctcctctgttcacaaactacctctggacggttgtgttgttttttttttgttccatgttcattcttagatacccactattgctgctgctaccagcgtcagatgttcatcctcctgaatttgcctgtattctctcccccacacaatacactcgaggggaaggggggctggggcgcagcagactggttacctaccccacac

SEQ ID NO: 20880 - DNA, 1306 bp, Mus musculus
gccacaggtccttccctggacaaagtctaccaccccaactaccccagagacagtggttcccagcccagccacaggtccttccctggacaaagtctaccaccccagctaccccagagacagtggtttccagcccagccacaggtccttccctggataaagtctaccaccccagctacccccagactgtggttcccagcccagccacaggtccttccctggacaaagtctaccaccccagctaccccagagacagtggtttccagcccagccacaggtccttccctggataaagtctaccaccccagctacccccagactgtggttcccagcccagccacaggtccttccctggataaagtctaccaccccagctacccccgatggtgcttcccagcctccaactgctgcggcttgtcctcacctgcagaagatggggccaggtgggctagtcgttaaggggtgggcttcaggcctggccaccggctcatagagccaccactaagtaagaatgtacagactgtgtgaccagaggagacttgggaccagccttgggaccagccttgggactgtttttgtgtaggggctgctgttctcccattacctccatctgagccctcccagagacactgctgggagacttccttcctctaacgtggtgttcaggatgcttccctctgagcttcccatcgctagagccttccctttgggctccttggagtgagatgcaggctcatccatcagcttttacggggaggccgaggggagcggttgcaatgttgagtaaaggcttccttgtcattcctagtgtggctcctcttgtcatacatgacccagacccctggctgctcagctttgtaggcatccacacagcagctcaatcttcaggaaggcctgttcctgctgcactgcccgcctccttagccttccacgctgtgcagccaagcgggcctagtgtgatctttctctacacgtatgatggaagcactgatacacatgtgtaagcatgactccatgtgcgtgactgtgtgtgtgtactaaggccgatgtgggcacagatgttatgtgcatgggcacgtgggttatatgaaagagtggagacatggcagccatgtgcattggtgtacttgggtacacgggcacatgcataacatagtgtttgtgcgaacatgctgaggaagggtgtgtaccctgtactctggcatgtgtgcttgtgtaggtgtggaaaggtgtgtatcagtggccccaggcttagaatggttcaactaagaacttttgtgtttttaaagacagggtctcacttagtagc

SEQ ID NO: 20881 - DNA, 1177 bp, Mus musculus
atctgggtgtacagtgtcctgacgtgaggggccaggtacatgtccaggagcaggttatcctgcagaggagagctggtcagagacccccgaggtgtgcacacctagctcagttccagtgtgccttacccttgcgccttaccttcatctcgtccagcatcttcaagcatgaggcatacttggattcatagaatttgaagatgatgtctctgacctgtggctccagctccaggaacagcttgaaggaactgaggataccacaatgctcaactaagaagggacggaagggcctggctggacaagagaaggtgggagcccactacccaacttacctgctggagatgacatttcgttgcagctcctgccggtcaaaggtggctaaggcacacaggccaccatagacagccacattgctgggggacagcagctgggaggcagaaggggaagtgggtccagaaacctggggtcctgggccattgacgggcacacagaccaaggaggaagcccaaagttggggcctactctacctttcccactacccataaagacgatgcttagaccctcattgacgagaggttaaagcccaatcaatccacgagcgcgcgttcacttccccttacggacttggacaacctgaacagtgcctgcccctcctcacctctgggaagtcacagtgatcaaaggaagccagaaggaagcacttggctgcttgcttatacttccgtgcggccagctcagccaagcctacaggcagggaggaaactggtgaagctaggggtctggagaaggcgtgggagccccaggacaccatggccatcagtgggtcgcctctgggctcctaccccagtatgccccagtttagggacagaaatctaactgaaaacattccaagttaggcctacagggaattctcaaaatgtacacacacacactcacacactcaggctcagggaaaccagctcacctacttccccagaccccactagctctctctatgaacttgagcaagtgccacacagggagaaggagcgggagcagtggctggaagccttacctgcagcacacttgagcttggtgaggatggcttgcgtctggctgtcccgctctccccgctgctgtaggagaagacagcagatgtgagcccccaccctgcgctccttattcaagaagctctgttccc

SEQ ID NO: 20882 - DNA, 1198 bp, Mus musculus
gctggtttccctgagcctgagtgtgtgagtgtgtgtgtgtacattttgagaattccctgtaggcctaacttggaatgttttcagttagatttctgtccctaaactggggcatactggggtaggagcccagaggcgacccactgatggccatggtgtcctggggctcccacgccttctccagacccctagcttcaccagtttcctccctgcctgtaggcttggctgagctggccgcacggaagtataagcaagcagccaagtgcttccttctggcttcctttgatcactgtgacttcccagaggtgaggaggggcaggcactgttcaggttgtccaagtccgtaaggggaagtgaacgcgcgctcgtggattgattgggctttaacctctcgtcaatgagggtctaagcatcgtctttatgggtagtgggaaaggtagagtaggccccaactttgggcttcctccttggtctgtgtgcccgtcaatggcccaggaccccaggtttctggacccacttccccttctgcctcccagctgctgtcccccagcaatgtggctgtctatggtggcctgtgtgccttagccacctttgaccggcaggagctgcaacgaaatgtcatctccagcaggtaagttgggtagtgggctcccaccttctcttgtccagccaggcccttccgtcccttcttagttgagcattgtggtatcctcagttccttcaagctgttcctggagctggagccacaggtcagagacatcatcttcaaattctatgaatccaagtatgcctcatgcttgaagatgctggacgagatgaaggtaaggcgcaagggtaaggcacactggaactgagctaggtgtgcacacctcgggggtctctgaccagctctcctctgcaggataacctgctcctggacatgtacctggcccctcacgtcaggacactgtacacccagattcgtaaccgggctcttatccaagtaagcgtcggtgttggggcaagggggcttggatggttagggctgtgtggaatgcagaccttctgaggagcagtggacagcttgtggcttctgtcctgtagtacttcagcccctatgtgtcagctgatatgcacaagatggctgcagccttcaacacaacagttgcagctctggaagatgagctgacacagctcattctggagggccttattaatgccc

SEQ ID NO: 20883 - DNA, 3557 bp, Mus musculus
ctcactccccaaagcacctcacctgctgcctcccttgctcacaggccttgccgtgcagtggggtgccattggtgacgtgggcattgtcctggaagcgatgggcaccaatgacacagtcatcggaggtacgctgcctcagcgcatctcctcctgcatggaggtactggacctcttcctgaatcagccccacgcagtcctgagcagctttgtgctggcagagaagaaagctgtggcccatggggacggggacacccagagggatctggtgaaagctgtagcacacatcctaggtaagccagctttggggtcctgcccagcccagttgactaagtatcagctgtcccatctgtagaagcagaggacagagttctgtggtctgaatgcttggctgggtgattgtcagtaatgctggagagccacagcatgtacctggtccccatgtccccttctacataatggccacttatctccttcggcaggcatccgagacctcgcaggtattaacctggacagcacgctggcagacctcggcctggactcgctcatgggtgtggaagttcgtcagatcctggaacgagaacacgatctggtgctgcccatgcgtgaggtgcggcagctcacgctgcggaaacttcaggaaatgtcctccaagactgactcggctactggtgcgtaccaggcagcaggctgagaaagtcctgctatgtcccatcaggggcagccagtagtggaggcaacagctctgcccttttacaaagagcactggggcctgtgcttagtctgtgtgcatgtcctcacgagcccacaagccaaggctaccctgtctcctccgtctttacagacacgacagcccccaagtccaggagtgacacgtctctgaagcagaaccaactgaacctgagcacactgctggtgaaccctgagggtcctaccctaacccagctcaactcggtgcagagctctgagcggcctctgttccttgtgcaccccattgagggttccaccaccgtgttccacagtctggctgccaagctcagtgtgcccacctacggcctgcagtgcacccaaggtactgtgcacattgcggagcagtactcactgcctcgggccttggtaccccgctaactgctaagctattctgcttgttgttctagctgcccccctggatagcattccgaacctggctgcctactacatagattgcatcaagcaagtgcagcctgagggaccctaccgcatagctgggtactcatttggagcctgtgtagccttcgagatgtgctcccagctgcaggcccagcagggcccagccccgacccacaacaacctcttcctgtttgacggctcacacacctacgtgttggcctacacccaggtgagagctgggccaactggtcctaagtgttgctacctgtgtcttggctttgaattcacttctgggagggtcctggttccttcagcacttgccacagcaatctctccttccctgacagagctaccgggcaaagatgaccccaggctgtgaagccgaggccgaggctgaggccttatgcttcttcataaagcagtttcttgatgtggaacacagcaaggtgtgcctggagacaccctagagagggcagggaaggcaaggctgggcggagtggggtctgtgtgcctttaaagtggaccagggagatctgagtgcctcttcagaaacccatctgctcatgaaggcagggcagactgtgtggccccgccccacatgctcagaactgtcacccctaggtgctggaggccctgctgccactgaagagcctggaagatcgggtggctgcctccgtggaccttatcactaagagtcaccacagcctggaccgccgagagctgagctttgctgccgtgtccttctaccacaagctccgggcagctgatcagtataagcccaaggccaagtaccatggcaacgtgacactgctgcgtgccaagacaggcggcacctatggcgaggacttgggtgctgactacaacctctcccaggtgagtggcacaggtgaggcaggtgtactcgcacaggtgggctgcttggtggtggtcacagaatgacacctgagtattttcaggtgtgtgacgggaaggtgtctgtgcacatcattgagggtgaccaccgcacactgctggagggcagtggcctggaatccatcatcaacatcatccatagctccctggctgagccacgagtgagtgtacgggagggctagacctgccgaccaccatgaagccacgctccacacctgccaccagagatgctccgatccccaccacaccctgagtgcaggaactggggagggtcctgctggtgggacccctccccccagtggcccagcaccacccgctcccctggtggctgctacaaacagaccatcacgcgtgtgtttcccagccgcgtagtggggttcccagagccactgacttggagacaccctggtctgtgaagagtcagtggaggcaggagccaaactgagccttttctaccgtgtggcatttgccacgctggtcgtttctccattaaattctcatatttattgcattgctgggaaagacccccaggggtgactcattccagaaccccctaaaatgggagaagccatgtggggaagatttctgggaaagtttctagactcaatacacaggctgctggctggagcccctttttgtcttgtcctgtccctgctcactgcagggcaggatatggagagggctggttcccagggaacaaggaccccagcagacactgtagcccgtggcccttggtccccagcatccccggctgccccatgatgcagggccatcctgactctgcggaccgcaccgggcactgactgtctgttttccaagacgaaaatgatgcttgggttttgacttttctgcagctgtcagtgtgaagaagtgtctggactgtgtcatttttacaccaacctggtaaaaatgctgctcttgatgctctcctgatcccacaattaaactgcacgtgagcgagcactgccttcggttcagtctctttccagtccaggcccggcttcaggctctgatacttatgggtattccccacaagtggcctccacagctcttccagtgagactccttggagggtgtgccattctgtcagtataaggggagtatgctaaaatgtgtttcagcatggagggctggctggaggccttgccactgtagtacaagcagaatttgtccacctttaagttgccctgagggcatcagcttagtcacagccccgccccagcggtagagaatagcatcatcctctacttgtagtcaactgagtgttggtgcaagccctctagagaaaaacgtaagcagtatgtgaccactgtgagaagcatgtccctggaaacaggtgacatgacgagagcagagggcctgagtcacacagaactgaccatgtgtgtaagcagaggagtggaggttgcttggaagaggaggatcaagagaaaagtaggctcagtttagtggacccacagtagcagccaatgtaattacattggcttggagctaaggca

SEQ ID NO: 20884 - DNA, 1173 bp, Mus musculus
gatcctgctggacgccctttttgaggaggccaatgacagctggcgggaggtggcggcactcctgaaggctggcattcgtgatggagtcgtgaagcccctcaagtgcacagtgtttcccaaggcccaggtggaagatgccttccgctacatggctcaggggaaacacattggcaaagtccttgtccaggtgaggtgaggcgaggtcctcgggcgcccagcccgccttggcctttcttagtttgttactgtgtgtggcgggcgtgtgtgggagggaggacagcgtggtgtaggagttggttctctacacacgcacgggtcagcaggcttggtaccagcaccttcagccactgctacttatctgcaggtacgggaggaggagcctgaggctgtgctgccaggggctcagcccaccctgatttctgccatctccaagaccttctgcccagcccataagagttacatcatcactggtggcctaggtggctttggcctggagctggcccggtggctcgtgcttcgcggagcccagaggcttgtgctgacttcccgatctggaatccgcaccggtaagcaagtaggggcggctggtaattaatgtaggcttccctttgatgggaggtgttctaggatgggctgcaggccacgcttatcctctggtgcagctccatagccctgtgtcccataggctaccaagccaagcacattcgggagtggagacgccagggcatccaagtgctcgtgtcaacaagcaacgtgagctcactggagggggcccgtgctctcatcgccgaagccacaaagctggggcccgttgggggtgtcttcaacctggccatggtaagaaaggcaggcaggactctgcgtacctctagagcctgagacccagggtagctgctaagtggggttagaacctcagagccgcagcaagcactaaaacctctgcttccaggttttgagggatgccatgctggagaaccagaccccagagctcttccaggatgtcaacaagcccaaatacaatggcaccctgaaccttgacaggtaggctgtcagtccctctgttgagttttacgcatgctcgcaatgtgtattggttcctgctgtgccacctgtggccttcgcactgccctggggaggttatgggcttagggacatgagagctgtctgagctgt

SEQ ID NO: 20885 - DNA, 1785 bp, Mus musculus
gcaggtaatggctgggtatggttcggccagctcagtacttaatgagacttcatacacgtaggaggagtgggagagcctgttctcgaggaaggcactacacctggtgggccttaaaaggtccttctacggtactgcgctgttcctgtgccggcgagccatcccacaggagaaacctatcttcctgtctgtggaggataccagcttccagtgggtggactctctgaaggtcagactctggggctgggtaccttgccttgcctggcatatgaacagccctgaggctgaccctcctttatcctgcagagcactctggccacgtcctcctcccagcctgtgtggctaacggccatggactgccccacctcgggtgtggtgggtttggtgaattgtctccgaaaagagccgggtggacaccggattcggtaggaaagactctgagaggtgcctacccttcctcctcccctccctccctccagtcttggtatccttactcactttgccccacaggtgtatcctgctgtccaacctcagcaacacatctcacgcccccaagttggaccctggctctccagagctacagcaggtgctaaagcatgacctcgtgatgaacgtgtaccgggacggggcctggggtgccttccgtcacttccagttagagcagggtgagcccactgatgccctatacctgacaggccaaggaggaggtgggggacaaagagctggccaggtaggcactgtgacacacatatccttgctttcttttccctcagacaagcccaaggagcagacagcgcatgcctttgtaaacgtcctcacccgaggggacctcgcctccatccgctgggtctcctcccccctgaagcacacgcagccctcgagctcaggagcacagctctgcactgtctactacgcctcactgaacttccgagacatcatgctggccacgggcaagctgtcccctgatgccattccaggtgccaaccaggatggggtcttgtgactgggtcgctgtggaagtagggaatgtgcctgtgccatagcagcccagcgagaaggaagttgtcctgcacagctcctggggcagagagggtccccagcaccagggctgtacttgcaccctgtgcccctgacaacctgtcctagagtggggtctaacgcgagcctccctcctgtctgctcaggtaaatgggccagccgagactgcatgctcggcatggagttctcaggccgggataggtgtggccggcgtgtgatggggctggttcctgcagaaggcctggccacctcagtcctgctatcatctgacttcctctgggatgtaccctccagctggtgagtgggtggctgcagttgggagatgatgtgatcttggttggtggccaggctgagtcgatcttgtgctgtgtaccctcaggaccctggaggaggcggcctctgtgcccgtcgtctataccactgcttactactcgttagtggttcgcgggcgcatccagcgtggggagaccgtgctcatccactcaggttcaggtggtgtgggccaagcggccatttccattgccctcagtctgggctgccgcgtcttcaccactgtgggtaaggccccttacctctcccaaacccttggagcttcttgagccccgtgccccaaactcactggggtctctcccctgacaggctctgcagagaagcgagcatacctccaggccaggttccctcagcttgatgacaccagctttgccaactcgagggacacatcatttgagcagcacgtgttactgcacacag

SEQ ID NO: 20886 - DNA, 1146 bp, Mus musculus
tgccacccaccgtcagaaggtgtacaggctgaaggaggacactcaaggtagctctggccctagctctatgcccttgcatcctgggctgggcattgcctacactaaccagcgtgtctccatagtggctgatgtgacaacgagccgctgtctgggcataacggtctctggtggtatccacatctcaagactacagacgacagcaacctcacggcggcagcaagaacagctggtccccaccttggaaaagttcgttttcacaccgcacatggaggctgagtgcctgtctgagagcactgccctgcagaaggagctgcaactgtgcaagggtgagggtcccaagccttctcccctcctccttcactctctgcctctgaaactcgccagacaaggcctggacagtggggagcttggggttgatgagagcagcctaccttccatgggcctccagcacaaaactactgcatccttcctttttccttcccgtggctgtttctgctgtggacaagctaggaagtgggccctggaagttggcgggaggccttagagagagaacataggcctttctccatcccaggtctggcacgggctctgcagaccaaggccacccagcaagggctgaaggcggcaatgcttgggcaagaggaccctccacagcacgggctgcctcgactcctggcagctgcttgccagttgcagctcaacgggaacctgcagctggagctgggagaagcgctggctcaagagaggctcctgctgccagaagaccctctgatcagtggcctcctcaactcccaggccctcaaggcctgcgtagacacagccctggagaacttgtctactctcaagatgaaggtggcagaggtgagtgctggaaagaaggtggacaggccatgtgcatgcatctggggcagtctcgggcccgaacccgaaacaggcagtcgtgatgtagcagcttactgtgcctttgtgctttggtttgttccaccctaaaagactggaaatattttcactgctaccagcccaggggatgagatatcagaagtaaggcttatgggaaagaatcctgggatgctttgggctctcagctggggtgtcataggcagagtctacaggagagtagagtagagcactggtagagcctcctgg

SEQ ID NO: 20887 - DNA, 1186 bp, Mus musculus
gctctctttcttcttcgacttcaaaggtgggtgggcagcccagccttgggcacgggcccagctgcatgagtgcattcacctagacaaccctttaggacttccttattcctgggggaacgctgagtggggtactcaaggccccagcggggtgcggggggtgcggtgtgggacagcatctgcccttgtccacaggaccaagcattgccctggacacagcctgctcctccagcttgctggcactacagaatgcctaccaggccatccgtagtggggaatgccccgcggcccttgtgggtgggatcaacctgctcctgaagccgaacacctctgtgcagttcatgaagctgggcatgctcagcccggacggcacctgcagatcctttgatgattcaggtaagggtggcctggggagcgatcattaggctctgctttgcagggctccagcctgtaccctgagtgtggtgtcttggcttctgatgggcgcacacatgtatagactcacaacacacacaccccatcaccccagagcacctagctgaggtgttgacctaccctagggagtggatattgtcgctctgaggctgttgtagcagttctgctgactaagaagtccctggctcggcgggtctatgccacgattctgaatgccggcaccaatacagatggcagcaaggagcaaggtgggcatggagggaaaagaaagagcatggatcataagaaatggggaagaggggcatgcaaggcttcataccataccgtaccactacccatctaccgtaggtgtaacattcccctctggagaagtccaagaacaactcatctgctctctgtatcagccagctggtctggccccggagtcgcttgagtatattgaagcccatggcacgggcaccaaggtgaaagccctttctgacccatacctgtgactcctctacccttgttagaggtccttccggctgcagccttaacctactctgtcccctgcaggtgggtgacccccaggaactgaatggcattactcggtccctgtgcgccttccgccaggcccctctgttaattggctccaccaaatccaacatgggacaccctgagcctgcctctgggcttgcagccctgaccaaggtgagcagactgggctctgggtcaagagtccctgttatgtggatagctgtgtagtgtaaccatt

SEQ ID NO: 20888 - DNA, 1159 bp, Mus musculus
cgtataggtattatgtttttaatctttaccaatataaattttaagatttgtatctttaataaaaatgtcttggagctggagagatgactcggtaattaagagtacttgtttctcttccagaagaactgagtttgtctcagtcagctcatagccaactgtaacttactgtagctccaggggatgtgtctcagcttactttctattactgtgaccaaactccagaaccaaaagcaacttggcaaggaaatagtttaattggcttctgagtcccagtcctagtccctcctaaagggaagtcagggcaggaacctgagagccagcccctgaggcaaaggccatggagtgagggacattgctcccagtgtgcttcttgtggcttgctcagttagcttttgttttgttttcttaattgatttgtattttatgtgcattggtgttttgcttgcatgtttgtctgtaaatgtgtgcatgcctggtacttgtggagatgaggagagacatttaatcccttgaaactaaagtcccagatggttgttaaccaccatgtgcataggtcctagaactcaaacctgggcctctggaagagcagcctgtgctctcttggagacagagtctcctcctgctcatgggctgttgagccgtctgtctcctcagccacttgtcatatacagtccaggaccacttgccagagagtgggtgtggcgcatccacagcgggatgggtgggaccctctcacatcaaccattaatgaagaaaatgctcccatgacttgcctgtaggcctcctaaagtgggcatttttctccattgagattctccttgccagatgactctagccaacattaatccacacctttcctttctgtttcccgactgttagtaaatgtgtccctctgctgctctgtgcagctgtctgagggacggctgtggattaggattagactaggaagttgtgctgtgtgtccctgagctctgctcatgttaatatcacaatataatatatattccaagccaggtggtggtggcacatgcctttaatcccagcactcaggaggaagaggcaggtggatctctcttgagttcaaggccagcctggtctacaaagctaattccaggacagcctgggctattacacagagaaaccttatattgaaaaacaa

SEQ ID NO: 20889 - DNA, 2014 bp, Mus musculus
catgtctgaggcacttcctcaatgccaggagatggagccctggcccagggtggaggcggggcactccctggagcttctagtgaccctgggtcttctttgcaggcaagctgctggatgcaaccaaagtttacaagtatgtgttcatcctggcgggggccgaggtgctcacctcctcccttgtgctgctgctgggcaacttcttctgcatcgggaagaggaagaggcccgaggtgacagagcctgaggaggtggcctcagaggagaagctccacaagccccctgtggacgtgggagtggactcgagggaggtggagcacttcctgaaggcagagcctgagaaaaatggggaggtggttcataccccggaaaccagcgtgtgagcagcctggccgggcgggcagggagcagggaagaggtccagagactggcaacgctcatatttatttcacaaacaggaccagctgagggcgggcggggccatcggctcagctcttggctgcctggtcagccggtcagtgttttgcggggagaggtggcggggtgggaaccgcgtcattccaaagtggatctgcggtgaagccaaggaagccccatagttatcagccacctaaaccagggacccagcctgctgagcccaagcagcctgtggctcccccgccccctccccaccctccatccccactgtggccaaggacctagaaacccacacttaggagacaacacgactttaatcagagggcagggctgggacaggctggcaggtggacactgcctgcagggtcttccctgatcccaccatcctacctacgccccccctcccctcagccctagtctcctccattgacagtcatccatctctgcctaagggacaaagaaatccttctacctgagaaggcagaaatagacctgcccgtgggaggagcatcaaggggcctgtctctaggagctgtgtggttctgggcagtggtctgttcaccctgagtcccaccctttgttaaataacaaactgctgattcttaaaaagtggttctggccctcattagctcttccaggtctgcctgctgtaacattctctgctgcccctagggtttgttcaatagccacagcattcatacagcaggaagaaagggggagaggggaatagcaagggagggagccccatgctagagaggggtgcctgggtggcatttggaggccatggggaacccccaagggcgagctgaagtatagcataagctgttcactgtgtgtgggcttccaacctaagtttcctgccttctgtttattcgaccctctggagggctggtaaatttctctatgtggtcagcacctgctgacctctgtccagcccatgctcagctcgggctcgccctgggcacctcacacccacctgccctgtggccggtggcggcctgtgtggctggaagcccggtcagaggccgctggggccgcctcagtaggtggtacgtcgtgggcgctggggtcggcagcgggcaccttggcgggccgcgtgcagccggagagacgccatgtccctgctcctctgcaaggaaaaggaggcgagtgctcatatctgggcccagcctcccatgccccatgttgggtctggccctgctcactctgggatgcctctcccatctggtctgttctctgtactaggaggtcagttggtgggcactgcttatagcagcagcagtcacatgcatcctgggagtctaatttgccaatctcaccagactagtggcaatggcaaggcttcaagataggccgagccccagaggcaaagtggtgataagtgggtagcattcttgtgcagaggcactgggcctctccacatcactgctctgcgtgtccccccccaccccccaggcttcaggcttcctagttctagacctggctgtggagagtggatcttggaggggaaggctcctagagctatctgtactgctcaggctcagcctggatgagagcagtaggctgtgctgcacgcccccctcccccctgcttgtgtcac

SEQ ID NO: 20890 - DNA, 3861 bp, Mus musculus
cttttctaaagcatgaagttaggaaacagcaatgtcacttttatcaagggtcatgagaggcagatgagctgtgcactgtgtggagagacttgccgtgagctggagtccccagagtgtctgtctgtgtcttgacctggtcaaggcaagggacacatcaggactcaggctcagtacaagcagccaggggaccaggacctcatgtgctggtgtggccagcaggacacttaccaacagctgtcttttcccccacctcagaatagcattcctttcgaacaccacggcaagtagctgctcgtctccatcggaaggcagcactgggtgagtgtgctcgtggtggggctctgcaagtagcaggtgccaggcaaggtgggaacaactccccacccatcatctgggctcgctggtgggctgggcttgcatgccaaatgctggagatagagtgaggcttcttctgcttgtttttctttgtgtgggtttggagtagttatggtgagctacccagtctgggggaatcagtggcatccttagaatctctggactgagtgaccttagagaaccatcctgctgtgcctttgtcctctgacctcctgtaattgtattcagtatgctggaactgcccccagtcctggctctgggccaagcacatgtgtctgttgtactcagctgagtggtccatgcttggtgttgggctttcttgagctcttgctacatgcagactcccagtggtctgtgctcatcctggcttttttagtcatccctcttcctctttcatttatctttgtcctcattttgtgtttctttccaaacttggtacctgcccagtcatcttgtccatgcagctgttgtctgtattaatccagccacagccgcctgctaccctgccgtcagtgcatggctgggtgtccacgctgagctcctttcttgttggccacatggtatttggtggttccttccttccatcaggggcttgagctttggtgggggttgtgctgctgggagatctgctttgtttaacacatatgtgcactcttggaagtgtccataagaatttttccgtcttccctaaggggtgtgcctgttctctctaggaagggaggctgggagcaagtgtcgctgctccactcggatctacaggagcacagctctgcagtttctttgcttgcatgccctttcttccccatcttcctgtcctggctagaggcctttctgtgcagccaggggtgaaggtgtttagattgaagccaggtggcagtgtgtcccttccctcccaggctctattgtgttatgtgcacccaaatgcctggctggcctattcctctggccttatgctgaccttgtactgtgctttggctccgacagattcccggtcgggtggcttccagtggtcttcagtctgtcgtgcaccgatgagaactctcctttttgctgtgaagggcagacaatgcatggctgatctactctgttaccaatggctttactagtgacacgccccccggtctaaacctgaaatgttaacgccgggagctctccaggccactcacccagcgatgcacatggggaatcaaaacacaaactaaatggacaggctccaagagctgccatcgccaggggctgccaccgtggccccgtgtgagctcagttatcatggggctgggacgaagagcagaggctgggagaccattgcagagagaacccgactccctgtgaagagcctctcagctcccaccagtggtggcggacctgcgctccctgatgatcccaccgcagctaccagtcttctacttggttaagacagttttgtatcattttgctaaaaattactggcttaaatctgtgtaaagaaatctgtctttttattgtttctttcttgtctgtttttgcggtcttaaacaaagaaggatgttgaccttaaagaatcctaagacacgctggcttggagcttctatgtaaaatggaggcaggcaagagaggggcacatgtgagtgttgaggatgtgtgtggtgttctgttttgttttctcatgttgtgctgttcactttggaaaggaacttctcatcagttgtgtatgtgtgtgcgtgtgcgcgtgtgcgtgtgtgtcttgtggctcccatcagcctaatttgggcatcttgcttactctttcccactgtaaactgatagcctgcagtcatcagagcaggtacaactgccatggcgtgagggctcacagttacagcctcagcaaagcaccacggcctggcagtcctcccaaaggaggcagaaggaagtcagagctgaagaacccacatgctgggacggggggcccctctaggctgctggagagctccaagattcaaagctgagcttgtgtttgtggtttctagggagaggattgctgttggtaggattggtttcctctatgcctttgaacttgggaagttgcagaatagactgaatagtctcatgcagatgccatttgggtttgtcatgggctctctgctcagagccagggagctggctgtcctagaaacacaccatggtttgcccagagggaccagtggccaaagggaatcaaccctgaagtgccaagaagcaggtaactgcctatctgactctaaaacaaaccttcacctccacatgctgcgtgacctccagaaaggtgtggtgccacacactgcgtggtcttcagctggacacactgcgggctgggctgctctgccgctggcggttaggatgccaccatgctcttccccaccatgtgcaccggatatgaagagacggcaggacctgagctccccatctgagaagtgggtgcagtacatgtgtgtgggtccatctctgattttccctgtcagcctatggagagttatgctggttacctcgctcccttggaggtttggctctaatggtgccaccatggcttctcccttcttcccagagttccctggctctgagcactggcccggggttgggagggacacactgctgatgtgtgatatagcacctcagaatgtggctgttaattgtgcctgccagccatctgagcctgtgggtgctgatttctgaatcctgaactggttactctgcaagcattttagggtgcagagacttgactccgtgggactgtgtgtctaggagtgcagagggaggttgggagggtcgggcgagtttgagatttttgttgcaaatcctttatcagagttggtcctcccctctccagtggcaggcctgcccggcaagtgttcttgttgatacctgtggttctggaggggtatggggtggccttgagactaatccaggttcagcctggccctgctgggttgtgccgagactaggaccattggaagtcctccagggtgtgttctgacggttcttgcccgatatgtaatcccatcgtcactcgcaggaagcgtagttagaatgtgtgtatcaacctgtgtcttggtgaccagtctctgagctgtgcgtttgtactaccactgtatttgtgtactttaacaattgtgtaaataataaattcataatgacttctacctttcttccctcccctttgtgtggtctttctttcagcagcatgtgtaagctacatgaaagctaacttggtgtgggttggggttctgaggttgatagtttctatagcttaggctggcctagaactgagcaatccttttgcatcagccttctgtgtgttggttttacaaacccaacagagtcaactttttcaggatgacattcctgcttgtccatttgtgggtattgggaagctagtggagtaggtgccagaaagatgatttctgcttggactctggtgtcatgagtagatgtgagttcccttagtgatgttgtgacagttctgtgagccctcctaagtacataacctag

SEQ ID NO: 20891 - DNA, 1197 bp, Mus musculus
ttaccattggcctgtatgtagaaaggctggcattgccatggcgtctgaactctgccttgctctactcccggtcttaggcagtcttctttcctttctctaatgcattcacatgccaacactgataggtagggattaaggtggcaggttgtacctgtgagttctagtatggtggagagtgcagagggactatggccttcctggtactgtgcaggcatcattcctgtgagagcatggactttctggtgtcgctgcctgctgtaggagacttcaaagggcactcttctcttctccttttgttttgttttgttttgtttaatttatttattttacttatatgagtatactgtagctgtcttgagacatatcagcgttgatttccattacagatggttgtgagccaccatgtggttaccaggaattgaactcaggacctctggaagagcagtcagtgctcttaaccgctgagccatctctctagccttttaaaaaaccaccaaggctattttcctcctgtttattctaatctttcctcatcagggtgccagccgggctgcagatgatgctgagcgggaacgccgggatcgagaagaacgattaagacactcccggaatccagccactcgtggcctcccttctacagcttccggccgtctgcggggaacccaggaagtggctcccccaacgccccttacccctacctcacacacgggtaagcacacctcttactgtgcttcaccaaactaggacctctgtttgctgtgttgatgaattgctaaccatcccagtatgtgactggattagtcagttaaggccagcctggtttacatagtgagatattgtctcaaagaaaagaaagaaatttcccttttataagacttgttttaaagttaatttccctgaaagttgttgctcatggggctggagagctcgctcagtggttaagagctctagctggtttttgtagaggacttgggtttatttcctaacacccacatgtcagtttttacactgtctctctagttccaagggaactgacactttcttctggattccttgggcacatggtacagagatgtgtagggaaaacatccacacacgtaaatttttttaaagtctagctctcatagattttctcaaacttttgaatactcggggctgacttttatattgataaatgtagggccttagaatgcattc

SEQ ID NO: 20892 - DNA, 1231 bp, Mus musculus
tggcagtggggacctgccactacaccacatcatcccactcccagtccctaagcacttttgcccaggagagactggaacgaggcaggactgggccttgggaaatgacccctatggccgggaggcctaagtacatctaaaactggctgtctttacctcttctacctcccagagctattttcctagttaatgctcctgggatgagaatgctcgaaataactaaattttgctctgtagtcttgactgtttaggggatgtggaaggtgctggatatggaatccaaggcctcacatgttctgtgtaagctttgcaagattctaccattgagctgtacctctacttagatgctgaatttatttttcaaacagtctcccaaaggccagatatgactagtcttcagattgtgtctctagtgtctttagtgtatggcatgtgggaggtgaactggatgaacttggccacagctggtagctccaggctagctttgagtttcttgtttctttagctgaatttgccacatacctgaatttctgccgttccttacgttttgatgacaaacctgactactcctacctgagacagctcttcagaaatctgttccatcgccaaggcttctcctacgactatgtgttcgactggaacatgctcaaatttgtaagtggaattgttagagcatgaaatgacaacagcctggtcctcaggacactggcgctggtggctgggctgggtctgtatgtaaagctttgctgtctgcaagactcgggtttgcaagtcacagtagagttgtgaaagccaaacacactggtagaactttggcctacagatcactttgcctgtgggttcagagtactgagaaggaagatgctggataaggcaaaaacttctatagcaaatggggctggagagatgacacagtagttaaagccacttgctgcttttccaaaggacatgggttcatttctcaggacaactaggggatccaattccccttcataccctcttctggcttctgtggttactgcacgccggtagtgcatttacttaatgcaaccaaaacactaaattaaaacaatctctggcatttatggatgtgcataataagaagcccaggaagctgtggtgaaggtctgctcagagtcagctccttctggattggtaagtcctccttagttcttagttgaaaggcttgcctgctgtccttcctatattttcctcctttctttaatttttaagg

SEQ ID NO: 20893 - DNA, 1371 bp, Mus musculus
gtgtccgctgggtcgtaaggactcaggtccagcactggcaggtgttgctggaccctggtgagatgtgggtggcccattttcggaaagaagttgggcagcacggcctgtaccatcagagcctgaatccctggaggctgagcatcctgacagcttcagaattagggatggagttattgcctgccacctgctacctgtggaataaaggcttctgggtaggttccttcttgccctggcacattaacatgccagagacctggagctgggagccaggagagaggctgtttatcacagatgctactatttgtggtactgactaccaccttgctcagtctttccttgattcccaccccaccccccaccccctcctgacccttactccctgatgcacattcctgagacactaaagctcagacattccccagggccctggggactgtgaagagcaagaggttgcctgttctgagcagctcaggggaacagttggtccaggacttgagggggcatcttgaacatcctgtgagcttatgaacctcagagggaagtctggcatgttcgtgtcagtgttcagtgtttggtaggtgaggcctagctgtatgtttagctgtatggagtgttgtgtggtgggtgttatgggggctccggtcacagatctacgtatgtatggactctgaggcactagttgaccttactgtcataggggtcatatgcttactgtcttagggtcaagatacctgattttagggttcactgtttttgttgttttactttgttcgttactcgtgctccttttgagggcttttgttgaataaagttggtgttttaaattttattgttttatgtgtatggttttgcctctacagtaccggcttcacacctgatacttgcagcagccagtagagggcatcagacctcctgaagccaaagttactgacagttttgaaccaccatatgggtgctggaaattgagtgtggctcctctaggagagtaaccagtgcttttagctgcagagccatctttgtagcctcagttttcagtgtttattggaggccttgtgcagttttcctgagtgggtcttggtggagtaacctccccaacttctgggctcgggcttgtgggatggtatcccacagagctgggaacatggtacagtgggttttgccctttcctgagtcctgtggggagtttgtagtatgtcctgtgacagtctacataaccagcaagtgctcaagggtttaaaatgagaaagagccctgtgtagaagttgtatgtcgtcatctagttgacgtaagtatgtgccctagaagttggaagggatctgtggaccaatccatgtgtcagatctactactatgagccagagtcacacctcag

SEQ ID NO: 20894 - DNA, 1190 bp, Mus musculus
gaacctgatggccctggtggccagagttgacagtgtggactggctgcaggtaaatgccatccacttctgatgcatctccaaccgacttgacaattgtaagggtacaggcagatcttgggcacctgcctgtggctccttgggcagttctactatgggccacctgccttttgcttgtttatgcttctacactttgcagaaccttgggctagacctctgccacaacccagaaaggttgcatctatcaggatgcagggtgtggatgctacatctagggggggcaaggtctcagaaatgagtgccttctccagagttacactgcagctctgggttgggcagcacagcctggtctggataagctcacccaagggcaatctgaagcagaaaatgccaagctctcttcagcataggcctagtgcctgccttggagacaccttgccactccaggctactgtaagcaagactccattcctagtgagtgagacacctatatgcacgtgggcagacacactcctatgcacagtgatgtctgttccctctgaccatccctcaagatggacactctcagtggtcaggggcttccctgaaggcaactctggatgctggacacctgaccacagaactctcagaggaatccgagtgctgctgactacccagttccttcttagaccatgtgtctgagagcccagcagtgttggagcccagctgtcaggaatggaaggctctcccaacccagcctggaaagaaggtgctagcagaggaaagatcacctctcctggcatcctgcagcctttaagacctgggggatcccttacagaaacagtcttagcctttcgagccttgaaaagacctgaagaaaacaggcatgtggagacacagcccaataaatcccagtgttgagaactgcagcgggaagaacgttcaaggccagcctgggccatggcctcttctaagaaaagttggtaccaaccactaatggtccttttctgctcttctagtctccttctgggtggactcaagttgctcaaaagtacattgtttactaagttcccagcctggcctctaggcctggaagctgtggctctctggcctaacacagctcctcgaagcctcatacgcatacctcatcaggcagaactggggaattgaagttacatagacaaaggccttgaggccactgtacctaagccgag

SEQ ID NO: 20895 - DNA, 1180 bp, Mus musculus
tgacctcttatcatttcctgaaaattacagatctagccaggaggcggtggcacacacctttaatcccagcattcgggaggcagaagcatgaagatccctctgagttccaggccagccagagctacacagagaaaccttgtctggaaaacccaaaaaaccccccaaaaacaaacaaacaaaaaaacccaatccagatccactcactccccaggcttctaaaccacgcccatatcctgcttaactaggaaacctccttgagtgacatctttcttggttggccaaggggctaaattcaggtgccctacctgtccctgtccccaggagtgtgaagcacaaaggcacaacccccgactgcgtaatcactcagtctccacccctgggaggttcccacccagctcttatcccggaagtctgcggaacagaagtccggaagttcgaggggctgttctctcccactcattctcctacaagtccctcgttgtccgcataggtgcgtgtcctacaacttttcgggttccgacccgccgagccctgtgcgggtcatcgcttgcggatctggaccaggcgcaaggcaaattgaggaagccgggcgtgtgcactccggaggaggagccagcgtaacgggccgctagtggagcttgttggtaactgaagccagagggaggcaagttatgtgcctaactaggattcttgaggatgtagggtatgaagcttgattgcccctgggaatccaaggagccactcagaactggggccttgggtgttaatctccagacgtcctgccgcagtgtcccattaattcggcgcatttgggccattgttaggtagtctggcgtcaataacagggatctgacagcttatgaatgtagagactcatacacgatggtactttcacttcccgttcttggtgggaagagttgtttctggaagattcgggtaaggtgccggaagcctgagttgtgtgtgtgtgtgtcggggcgggggagggggagggggcttactaatggaacaacttaaagataagagttcagtcaagaaaagggttcacaagactgggggcttggaagtgagttcagaccaacaccaaatttgtgagctgtgtagccccgatgcccatacataattgtgagttaagtgggctcataagagaaaggtgttcggggtctgctgtggaccttcc

SEQ ID NO: 20896 - DNA, 1194 bp, Mus musculus
gaagaggtccacttgtgtgtatctttcaggttgcttaaatggcagaggccaagcacagacagaggacggccacacagatcgtgcactgctgcagcaaatggaagggatctactccggcatccctgtgcggcccccagagagcagtacacatgtgcaggagttgtaccaggagtggctggagggtactgaatctcccaaagtccaggaggtgctgcacaccagctaccagagcttggagccctgcacagacggcctggatatcaagtggtgacaaagcctgaagggcaggaggggacagctctgagtggagagtggtgggtgcttcaaggaacaacaggtccctacagctttgccagcgcttcaggacacagttttcatgtggtgctatctttgtagtgtgtgagggagtggaatgtttgcacatgggagaggtattttccctctctgcgtagcctttcatcccaagattgtgagaaagatcccaaagaggccagggacagatccctgatttgcaggtttaaaaaaaaaaatcaagatgtgtttttagagaaccaagacccaggggttgtgatccacgagcctaagattattgctgcagaaatggaggcatcaggaaggccaggctgctgtacagtggataactatggccttcagagaggcccagtcttctggcccaatttggctctttcatttgtatacatttttttaaaaataattttgaattctagggccagcaagatggcttattggtaccaccattagtttgatccatggagcccacatggtggaaggagagaccaacgcctacaagctatcctctgactttcacacaggcacatggcatgcatatgtaccaccgagaccacaccccgaaaataaccgtaaagaaaattacactagttttaagtcatagtaacagtgagccatattttttatagtccttgaaggccggcagtcattacagccctgggccactggtgtgcctgagtcattcttttacttgacctgccatcagcgttgagctggactcacctcagaagaaaggctgctgagaatggcatgcatcacaccctgcatttgatgcaatgtatatttaaaaataaacaagtagagaattaagagggtggcccacctaggctttggggttctaagggtggtgcagctcatagttactgctgtggggccggaagacag

SEQ ID NO: 20897 - DNA, 1117 bp, Mus musculus
ctcatgtcttggtcttcctgtgagtctgtctaggagtgtaactggatatgttattgtaaaccagtggttctcaacttgtgggctgtgtccccacaaaggggtcacatatcagatatttacattataattcataacagtagcaatactacagttatgaagtagcaacagaataattttataattgttgggggggtcaccagaacagaagaaactattaaagggtcacagcataggaaggttgagaaccactactataaattatgattttttttttttttttgctttcagtctatatgccttgggtatccatccccaaagtaactggttatggaataaacaatgcaatggggtcttgagtgtggcattgaaggagtcagctgttctcctgtcctggactacaccccgcagtccgcctccctcaccaggccccagcctgggtgatgatacctttttcccagtccctctctaataggtcaggagaaggttcagaacacggggagtcagcgtgggaagggactgacttcctgcaaacttcatggcaccacccatgatagcaacataggctaggggctaagatgtgagatctatgaccttctgtttcactgatgctaggccgtggccctgtgagcttttcaagactacaggtgcctttctgtcccagcacttggagccagaggcaggtggatctctgtgaattagaggctagtctaggttacagagtgagttccaggacagtcaggaatacatagagcaaccctgccttatcccccaactccctcccccctaaaaacaaagcccaaagcaatggaagtatgaagtgagcaagttcttgacagacaggacccagtcaaagcatcacgacagtcagagtggacaacgtacgctggtgcaggcatgaggggcataacccaagctcctatctgcccagtgctctgttgtaccatgcttctgctctgcttgggcagaggcccaatcttagtttgattcctacctggcccgagctgtatgggtttgcactactgtgggtaaccgtgcttctacatgatgagattctgtctcaaagactaaatttggtttctgttacaggtaatttagaaatagttctgtcagggcttgt

SEQ ID NO: 20898 - DNA, 1219 bp, Mus musculus
gtgaacagttctttaaagtgacttccagttttgtaaactcaagatttctcatttgcctgattttaaaaccatatgtttcacattcattaagaatgtttttaacctgaaagaaatgaggttattagaagccttaaagccccacagtctgctcactgcggagtcctgctgactggttccttagaaacactgctctagagggtagcagccttctcatggaactgagcaacctgtgtggcatgcgtggcctagcgctggtactgtccattgagcctcactgggtctccacagagaaagtcagccacacagacctgggctcagttggcaggagacagaggcttccctttataaagattaaatgaatggacacatcctttttagagcatcactgtaaaatacccctgtcttcttttggtgacccaggagtgccccagcttctcccaaccatgccggagtgctgtctgctcactccagtggcgcccagacccccgagagcctgtcgagggagggctccccagcccccttggagcctgagcctggcgcctcacagcccaagcttgccgtcatccaggaggccaggtttgcccagagtgcaccaggtgagagagaccccaggagaaggaagaggggcaaaggggctgggagtggggccagacagagatgcctgcatttggcactttgtgtaagtacctgagtgttgtgtggatggaaagttttggaaaaaccggtggcactgggatttttttctttccttttttaaatcggcatgcaggtgtggtagtgagtgactatagtattacccaagaggctaaggcaaggattgttgtgagtttaaggccagcctggcgtatatagtggaaccctgttcctaaaaacaaaactaaaaagaatcggtatttcttaatggctttcttaaaaaaaaaaaaaaaaaaaaaaaaaaaaaaaagccctttcctcaccaaaagaagttagagaaactaggcactgattggaacaaagatgtatcccatttagtgagtagatgaatatttccagtttagttgcagatccacaatatagaataaaatgtgtatcttagtaaagctagaagatgggcattctggcggctaggctcaatggcccaaagagaccctgccctgccacctgtctccagctgctgatgtccacttgctgagaaccaggagggcagtggctctgactgcctgtggctgtttctgagttt

SEQ ID NO: 20899 - DNA, 3648 bp, Mus musculus
ttttcttactgatgggaattgacctgccgcggctttggccatgtagggctatccctggggttttgtgtaagactcaagagggtttggcatgccagtgtggactctgtggtcaggggtttatgcagtagcgtggggttctgattcactgtgtccttcagcagcagcaagtcctctccatatgttggccacccatgcatcagcatcggcatccctgcccacaaagcgccagaacggtgaccaggcagagcagccagagctcaagcgagttaaagcagaagatggcgagagcattgtcattgccctgagtgtggatgcaccaccagcagctgtgagagaaaaggcaatccagaactagctgtgggagaccttttcttcagacatcaactttgtggtgccaaaaggagatgctgcctctcattgaagcagggagcgctgcctctctctcactgaagcagggagcgcatcctcggtgggtaaagggccctgcggttggacttcacctctcagcactgaaaacatgaacccaggtggccttaaaactccttaatttaaagacatcttacacttgaacagacccacaacagcaaccctggttccagaggtggtgtctccgacagagcacttgctgggccgttgtctgtgggctcagcttttactacaagcaagaaatccaggtcccaaaggactgagtctcctgggaggacgcagcacctgctacaagtggatcgcgctggctttcctttaggggacagggccacagccatctgctgccctcataggacctgctggctgtggctgagagacaagacagtgttttgttgttcacatacggaattagaatacttggcagtgtcctttctttactgaataatggggtctttgacatttcatatcactccatttctactctggaaatttgagattcatttgggggaaagagcgtcattctgtttgtttctgtggtttgattttagcccgtgggatggtttgctctagtctgtcctgcctgtgtttgggtggctctcccttaggacacctacctgcccgtttccgtttagagcagttacctgatgaatttgacctaccttgtgccattgtagagggtgggtgggctgaggctgcatggacccatgaggccagggggcattgggacaagagaccctgggagccttccagccgtcaggctgcacgcacgtacctgctctagcttgctgggtttgttgtttgtttctttatgtagactttgtccttggcgtaatttcccactctagtaaaacaagtctcctaaatattgtgtatgcttaaagcaacagatccctccctcctgggaaacagatccaggcctctgtcacgccttttcagaccaaggtcataaatctctctctcccagaacctggggaatcatagaggtcagctctggcctctgactggctatctgtatggcacactcgcagcaagagctggtggagagatgttgccagttaacttgagggtcttgggagtaagaccctgcagccaagtatcaagcattcaggccattttatgattctcaagaggtttctctggattttcagaatgacgtcccacactaatcctgacttatgtcacatagcaagtaaactaagagggaagggtgaggagaagtggggaggccagcagcccagcccacactcaggatcaccgctcacctttccagagcattctggactgagctgagcaacaggcagagggcgttagcctcattgtgaggtttttttttccctgatgtcatcatcataacgttatttatttaaatgtagttattttggtatttaattttttttaagagagggggggaaaccctgtattttcctggtagaatgaaatggctcagaatggtatatttaggcaatttaaaacattatttacataaagaccaaatatgataagtctgttctaagtattgcttcacccacagtatggagctgtcacaatgttactgcagatgatgcgtgttgacatggagttactgcacccaagctggatttatataactcagccacttaaacaataaaggtgagacatgatgcgagtgagaacatgtgtgtgcccaccgcagtctgcctcctccatcgtttctgcaggtaacctcggaatgtctgtctcgtaaaggtttgcagtttgcagagtactttaatttgggttatattgtgcccagcatgtgcatccagactatgggcctcagttaacgtggtacactggcaggccgctgccctagtcaagggtgggctcaggtaccaccaactggacatactgtgtatctggagatgtgtgtgtatagcatgcttgcccaggacttgttccctatgagtgagatctgcaaactcgttacctctgagccccaaacagaccttatgggtctgtaggagtttcttttggggatcatagaaaacatttaaagatggaaggaggattttttttttttctttaaggccaccttctcagtctcgcgtgagtgaagtgtgccaataggcacacacccatcttttctccttgctgctgtatcggccttgctgctgctttggtccataggaatgtaacgctgccaaggagagggcagaagctggacccttaggttattaactgagtactaaacccagggtttcttcccagtgttgaaggcactactttagttttatgttcatctaagttcccagaagcccctccatacaccagagctgggctcacgtgctttggccctcagcagaggtctgatgtgggaacgtactatcctgacacaaggagctcacagcagtccccagtgcctgtggcaccactgctaaatgcttatggagtctcactttgacctttaccaaacttctgagctccctcaggaacgagataacttcagcagcgtaggcttgaaccacaccgaccacaaagggaagctcacctgtgtcctgggtacggtgcattccagaatgtgtgtggcataacattgtatagctatttcccacactgtagaatgtgttcacagacagcagctggtctccgtaaataccccaccccacttccttgtcctctgctggggagctggtcacagagtagccgtagtagttcagaaggggtcggggagcatcaggacttgggttttctatgctgtgtgacacaaggagagaagtgacaatcgtgaaggccaagcatctgcagctcagaggaagcagagtgctgatctgtgtgcaaagatttggaatttttaaaaagtaccaagttcctgaaattcaataaaatatttttattaattttaatgaatacagagtatcattgtcttctgataagcagatacatctatcttactttttagcttgtgctggggagactggaccaggaacacagatgggcggcagcacaggctcccttagaggtgagggaaggcacagggtcttcatgatgctacggctgtacagtcaactgtgtggcatcttactgacattccgttgttagagttataaagtgttctaagttgtgattgtcccccactcccaccccactcgccctttgaggttcccaggcggtaacactcatcttccagctgctgtcccaggccacccacataaccaaataataaatctatgggcatggagtcagtctgagctacatgagacttgc

SEQ ID NO: 20900 - DNA, 2171 bp, Mus musculus
gttcttatagtttggcatcagccagtttccttccaaaatacttcagctccaagtggagtttttccaagtttcaggttccttcaggctcaccatgcatctgtgcctttggaacagagcccaatgcagtcattggtaagtgccccatcttgtgggaggcctcagcatgtggtccaggctgtaccaacttcccagattccctttcttccttctttaactgggctgggtcctactcacagcctccaagtgttcagggcactattagtacctgcctgccaggttcccagggatgctttgagagcagatgtgggcattgtgaagatgacccaaagactatttgcaaagtcaaccctcattggataagcatgagccttggcttggtgtggctagctgtgctcaggttgagtcatgtttgctttgattctgggaagtaaccatgaatcaatctggtctcctttcccagctatctgtgcagatggcagctactacaagttcctgttcagtccgaagggcgagtgtgtccgggacgtgtgtgcacagttcctggagatgaccgatgacaagctgtgactgtgcctgtgagcgcaggtgatgccaccacccagccgccctgtggactcctggggctggtgccagtgccccaggcctgtgggtgaggggctcaaggcccccctggaggaccttggtctcgaagccatacgtggttgtctgccttcctgagcaaggcttctcatcccatattaaaggatcatcatcatggttctgcagacactccgtggctctgggcggttcgtgcccttgctagccactacccttcaattcacctgtgatgctagcattaatggcaccaccatattcatgccagtaggctccctgcagtccttgggaactatccaagcacgaatcagcagaagcttgtaggatgagtgtgtcggggcttaaatactagacagttccaatgagataacactatcagcttgtctggtagagcaccccctgcctcacatggggagcactgttcagagcacacactggggagttctgactttggccattagagtgagtcacatcccagacctaccagagagcagaatgcttgtggcacccatttgaggcacagccctcaggatgcagggtgctgggtcttctggttttgtttgggttaaaacagaactttcccattatctgtagggaacagagtaacgcatagtctttaaaaatcagtcccagaagagagcattgctttactgaggggccttctcagtgcagtgtccatgtgcctctagctcccgttggtgtggagggtactgccttggcctgtggcgtttgtcctgtctcatctctcccagcatccataggaacacactaacattgggatggcaggcacatcctggtactggcacagactgaagagtctgtgtttctgtaccacttgaggtatatgtttagtttttttacgtatcttctaagaagctcagttttgcggttttgatttcaggttgcaaacatttaaattgtgcacagcaacaggttctcagttctgccagttcctttatgctcctgtaatcggctaactgtggatttgatgtcaagtatgcatgttaccttatgtgtatttaatcatgaaacttaatttttgcacacttgtttgtactgttttctttgaaataaaagtgactaattttgtcgtactctatctgtaaagagcagagccatatgtaatgtacccacaaattctctcttcctcctgtttatgtaatggtattggtgttcctgtacctgctgcaggacagacttgtaggctgttgacctgatagtagggtgcctgttatgtgggaccttaccagcatagccactgaacagagaagctgagtttgtaaggtttagggttagccagggagcaggtacagatgaaataaatcatgaatgtttagttttgggcatctctgccctgtgccctgccagtgctgtgtgccctggtttcatagaagtcagcatgctgccctggtagaagacactaatagaccgtcatctgtggatgttggctggtgtcactggtttgcgtaatatttttgcaatgttggggggcaggcggtgtttttctagcttgtgttcctgaaggtaccctaagagaatccatacagaagagtgggtcttcccacagtatgacttga

SEQ ID NO: 20901 - DNA, 1232 bp, Mus musculus
cttccctggcactcacactggccacgtacagcttgtggacctggccagcactgaaaagccacccgtggacattcccgcacatgagggtgtcctgagctgtattgctctcaacctgcagggaacaagaattgcaactgcatctgaaaaagtaagttcaggccatctatgtgagtctaattacaggacgggaactaggccaggccttcagacatcgtctgctttatctcctgttctttacaaaccagtttgttgttaaagcatgataaagatagaacgaacgctaacctaggtatagtgacacaggtctataataccagacagaaaggatattaagttcaagaccacttagtaccttagtcttggttgtctgatgacacgtcagaagtatctttcacacctgccgaagaatatttcctcattgaattatcacaatcttaaaatttgaagtattggccgttatattagttactttttgttgctgtgataaaacaccataagcaaaagcaaccctggaagtgcttctttttacttacacttccagaggggcaatccttaataactgggggagcatggcagcagacggctagaccagaaagcagagagaacaaagggtaaatgaggctagccagcggaagtttcaaggctacccccaagccagcagagtttcgggctacccccagtagtacttcctcaaggaagattctgtctcctcaaggttccataatctccccacatagtaacagcagctgggggccaagtgttcccactcaagcctgtggggaaacattgcttatctaagcccctataactatgtcatcctcattttgtctaaagtgaaaactgatcatttatacctggtttagattcagtggtaggggttgggggcagctcagggataactttgtgaagttggtctctttatacatttgtgtggtttccaggaattaaactgtagttgccaggtttgtgatgcaagtacctttacctgctgacgattgcacacatctctgaaaattgcatctttataccgtggtttccatttgataatacgtctagtatcactttgtctgaaactattaattggaatatatctattagtgggttcagcctcctgggagaacaggtcacagttgtggtctgccctgtctagttgtttcctgagctgtcacagacagcagtggtcgggaggagagaaaaagccaggcctgcttcttgtcctggttaccaggagg

SEQ ID NO: 20902 - DNA, 1193 bp, Mus musculus
tcgcgaggtctggggatcttttctgtgaggttatgtcctattatgtctctttggaaatttgtgtctgtgagaggacgtgtcagatggttgggaaagctcgggaagaaataggggatagtctgtctgtgtttgtctctcggggaaaatgcaggtaccattacacgaaggctgcttctggtcgaacacgatgtgtatcgtgggaacgcggtgagggtttcaggagactgtgttgtgggcaggagcgttggcgcagtctcttctctgccctgtccttggtcccatcagtcctgccctgcttgtgtgagtgcggggcacccagctctctccgcagcttcccctcggctgcgtcctgccccgccccttatggacgcgcccggcgagccctcgccacctacttcccgccacctacttccctgcagtggacgcgtctgtccctcggcgcttgctggttgcgcgcacgcgcgcccacagatccgcgcgcactgatgacgcagcactgacgacacacgcacgacgcaagtccccaggaccctggcttccggccgcggcggccctagcgccgcgcgaccggagagatcgcctggttgcgagcggtatgcggtgctgaggagccacagtccctacgacggcgccatgaacctcctgccgtgtaaccctcacggcaacgggctgctgtacgccggcttcaaccaggaccacggtgagaccccgggcccagctccgtggtaacaccccagcccttccgggagaccccgacccaacgctaccgcgaccgcagggccccggagctgtcgcgagcgtcccccggaccctaaccggagactcggtcgcgccctgagagctcagactctggcggctctttcaggaaatctccgaaccgctctgtagggaggaccccccccccccgcggtcctttccagcccgggcacccatagcggggagaaacacccaccccaccccacccctccgcgcgctgccgccgcccgggtcggcgggcagtgccacttttttaccgggtacctaagaacccgcaggcttactgctgggcgtcagggtctccagcgcttacgttgccagcgggtggcgtagcgggacctgcccgtcgcggggcggcagtttgtcgtggttcttgcggctggcaccttcgtggagtgtaggttcttcgccttgatgtcttagctgtacgcctctcc

SEQ ID NO: 20903 - DNA, 1364 bp, Mus musculus
gggtcaggtgacctgactccaacgatttggtcaaggaggttatgattcttcatagtcactctcctcatgaatccttcccatttattccatggtaggacttgcttaagatcccttgtttctttctctttttctcctcccttttttcctattctctcatatattacatcctgactgcagtttcccctccctctctcctcagaatctcctctgccacgccccccagggacatcaaccaagcacagtataacaagctacaataagccaggcacataacatcacatccaggctggataaggcaacccaggaggagggaacgggaacgggaacgggtcgcacagtaggcaagagtcagggacaccctccattcccactgttaggattcccacacgaacaccaagctactcagccataacatatgcagaggacttgctcagactcctacaggctcctgatcactgcaagcccccagtaccggtcagttgattctgtgggctgtaaactgtgaagtatgggttctctcagaggaaaggttatgaaattctgttgtgtgcatagtaagactgcctggctaaattaggcctcactggcgatagaacagacttactgaagtttaggtatagtgagccacactccactgccaaggtagagaactgtgagtgactgttggtgtggtgaagggtgttgaccatgcagggaagtggccaatgtgcccacttcccatctcttccttgcgcattgtcagcatttctgagtgattcacagtgatgttttatgatggttagacttctggacatggactcatcttgtgagaagatttgaataatgaccaattctaaaatcaataacgttccatttgcttatgtagcacttctggaccctgctataagctgagaagtctagaggttggtttggggaccaaccaagctaccaaccttaagggtaacttggtctcgatttaggagcctggaaatactccgttatacaagtttgtgctttctttctttctttctttctttctttctttctttctttctttctaatttgtttttttctctttctttctttctttcttttttttttttttttttttttttttttttttttttttacaagacagggtttctctgtgtagccctggctgtcctgaaactcactctgtagagcaggctggcctcgaacttggatatccacctgcctctccctcccgagtgctgggtttaaaggtatgcaccaccaccaccacctggttttatgttattttctaaaattgtcattcctttgcaacatatgagcattaatatcttttctcttttaacattgaagaaatgggaaatttcattaatgacattgttgttgataaatct

SEQ ID NO: 20904 - DNA, 1186 bp, Mus musculus
gtgactgtgctaggtctccaagaccgtggcaggtccgtggtgccctagaaaggcttacagggcacagcacagagctgcgcttattgtaacagtgggcttagtgacgtcttcgggcctatggtaggcactgggttggtgggaaggccacttgggtggcaggggagtatggttggatctctctttaattattacttgggatgggttcttgttatgtagtccagactaacttggatcttactatgtggtatagactggctttgaacttgagatcctcattcctcagcttcctgaatgttgggaggacaagggaatgagtggatgccaaaacgcttggctgctttttccttcccttccccttcccttcccctttccctccctcccttccagatcaggttttactatgttgccctggctggcctggaacctcaggctggcttggaacgatctacctgcctggccttttgagagcaaggattcagggcgtgcaccaccatacgcagcagctcccttttctattgggttcattctgactgtgatttaactccttagacgtgggaaacacgctacatgcttctactgtggctctctgtgacctgcttgatcccttttgatttttcacgccttgatgggaacctgtctactcaaactggagaaacacgagtacccaccatggaccgaattctgcaaatagcagaggtaacgatgggcacacaaacctttttcagttagttgtgcacttgtcttgagatgagagtttagttatatttgtttcactgacatttccgctttcagtgataccccagctttgaaactgtgatgttatgtagaggtcagatggattgctttagcaaatctcatttctttacagataatacaaatgtttgttaaacataatggtaatatgtaaggggtttgggggcaagagatggttagagaaactattcattttacatttaattttgaatattgtgtaaataatacataattgtaggaaatctagaaagtgaagataaaaatgctaaattgaaacctgtcaaattcttgcagtcttacttggtggtcagtgacaaggcgcgagatgcagctgctgtccttgtgtccaagtaagttttgttggctgtgcaggactgttgactgagatgtgactgcccattataagcctgtttgttttacatactggtgtgtg

SEQ ID NO: 20905 - DNA, 1211 bp, Mus musculus
gagggaagcaccttgtatcggtcctcacggggctcgccgcagggtagagagccaggcagaagctacctgcctcttttgaattccctttggaggtaagctttggttactgtggcataatgactcttaggagcgagttgcttggtcaaggctagtggtcaaggcttggctccaggtggtggtgcagtggtgaccatgagccacattttcattggctattcttttcttgttcccaggcaagtgggagatcccttttgcctgggctgaggccaaaaagccaagcaggtggagaaggcagccacttgcttgtgaacaagggtgaggccctggtgtctttcatgtgcacgtataggtgttgccattgccttctgttatgaagctttgctgtagaaggctcttcagaatcagggcctgcatctgacctaggttggctttcttttgaggtttgtatgaattgagatttccgctggcatcatgtatgattattctgagggatgctaagttgatgacatcagttaccaaaaattttattttcagggccaggctgaacctaccaacttgagatggttttgttgtgcataggtatcagcgtggctgtcggtctttggctgctaacctgaagctctgtgccccgggtaagagtgaccagaagctgctgtctgatagtttgacctctgatggtgatgaagactatgatgtcccagagggggtagaaactgtgataggtaagtggagcctacagcagatctgtgcatgcctctctctgcagtacagtctgggctttctctctgtttaccctcccttttttcctctcctggttaccttctgctacctcacctagcatgtggtcagtgactgacgtcatggactcttggtccagcagtaccacctctccactgtctcttcaccccgccctctagcctatcggacacctgaccttaagtttctctctctgggtgtcctcaggtacatggacttgaaccatgggaccatggttctctgcctcctccatattcttgtcttgtccaagcatgctttccttgggcatcatctcagaccactttaggtgtccatactgatgaggaatcttgacccagtgtctgttcccagcagtcctttactgtgcccaccctcaggttccctccctcttcctgctttcttgcctcgtgctggatgaagtgtgatcccgactgggaggcacaaagccagcggcc

SEQ ID NO: 20906 - DNA, 1146 bp, Mus musculus
aaataatactaaattagttaattctctttcccagcagacaagacatctaagcctgtctcacacatggcctcgtcagctgatctcagccaggctttcttctgctcccaagagaaaatgctgagcttaggaaagaggtgtttgagactggaatgaagtgtgaaccaggccgcaggcccctagaagtccctgccaccagggcagcacagcaaacctgcagacccaggcctggaaagtggctcccagtaaaggcagcagcctgtgtgctttcaagtctggctattacactgaggggacacatactaccatgacttggcttgaggccctggccacttcactgtgagctgttaccttgaattctgcccatctgcaacagcttaatgagcctcaggcatcagatacaaagaggcagaggaggcagacatgggactcccacagcaggacaggtaggcatgcaggccctgggaccagaggtgccattcatatgcccacagggatgctggcttctgatgatctctcagactgttgtagcattgttggtgtcttggctggccgagcacgtgggagctgcctgtcacttcatctgcccagcacttcagactacaccagggtctgaaacgcccctcatgctacaggaatcacacagcaaagcactgaaggggagagagccacagcagatcctccagctccttgtgcacggacgtcccagagataggcagaggctgggctgtgtgatacatgatttaatgagaagcacgtctgtgacagcaaacgtatgggcagtcccggccaccagagcaaagcacgcatgaggaattactgctctccagggatggcctcccaatgaaggtgctaccttcctcagatgtctgtggcaccaagtttccatgatggtaaagcttgttgtggagcctcagggcgagacatcccagctaggtaggcaaggctcagcttcctggaataggctgtaaagagacatggcaacatcaggctggttgctacctcaccctctcttgatagatggctaaagcctgccatgtcccagaatcctggcagcttgaattgtgtagtaatagctctgtggccttgtcagagtacattaataaactgtttgcatatgtttaaacttttctaacaatgtaaagggca

SEQ ID NO: 20907 - DNA, 1219 bp, Mus musculus
atcaaataattcatacaggagagaagccctatgaatgtaatcaatgtggtaaagcctttgtacgtcacgatactcttcgaagacatgaaagaatacattctagagtgaaacgttatgaatgtaaacaatgcataccctcttaatctttgaattctttttttattttttagatattttctttatttacatttcaaatgctatcctaaaagttccctataccctccccccaccctgctcccacttcttggccctggcattcccctgtactggggcatataaagtttgcaagaccaaggggcctctcttcccaatgatggccgactaggcgatcttctgctacatatgcagctagagacacgagctctgggggtactgattagtttatattgttccacctatagagttgcagcccccttcagctccttgggtgctttctctagcttctctgttgggggccctgtgttccatccaatagatgactgagcatctacttctgtatttgccaggcactggcatagcctcatacaagacagttatatcagggtcactttagcaaaatcttgctggcatatgcaatagtgtctgggtttggtggctgattatgggatggatccccgggtgggatagtcctggatggtccatccttttgtcttagctccaaactttgtcactgtaactcctttcatgggtattttgttccctattctaaggaggaatgaagtatccacaatttgttcttccgtcttcttgattttcttctgttttacaaattgtttcttgggtattctaagtttctgggctaatatccacttatcagtgagtgcatatcaagtgacttcttttgtaattgggttacctcactcgggatgatgtcttccagatacatccatttgataggctttcttctaatgagctgtttctaatctcccaatggaaagccttcctgtgctccagtcaaggcccaaactaaggactctcacctgcatggggacctctcttcctctgccctctctcctgtatccctgggctgaggttgtcacctcagggcccctggtattagggactgccccttgtcctccaccccaccccccgcccccatcgactggggtcagtggcttagatgcccacccggagtcaagtggaaagtgtctggcagccctcccatgtctgcctgcccagagcataggaggaactctggccagacatgggatctttccct

SEQ ID NO: 20908 - DNA, 1148 bp, Mus musculus
catattttgggctcatttgaataaatttgtataagttaacaccagttctctcaggacaaatttgcatagatttgtgtgtgacgtcttgggcaaattagcataaaccaaaatgatgtcatagttgtgctctgcatgcgttttttgtgggttttgcatgaatttgcatacatcagcttctttgaagtaggtttgcatgagctgaggtgactttggtggcttcctctgtgaatttgcataaatttgcataaacctgaatgataacacagtgatgctctgggtggatttgcatggcgtcatgctttctgtctgtatgactttgcataaatttgcataaatcttcatgggcaagggggaagcttccatggctgtcagctgcaccagcgaagtgacgtcacatgacctcatttgcatgaccagagtcactttgcataaattaacataaactagtgatcgatcccccttgagtgctgtgacctcgacgtgacccctgacctaccgctgaccccggtgtgaccccacaaccccaaggtgatccctgacctccccatgaccccagcaacctcgaagtcaccatgtaatcccaccatgaccctgacccaacagggacaaggcctggggcctccgccatccatgcgtggggagtgatgctggtagagggcaaattggtgacgtcatcaatgcagcgggcttcccactcaaccactttagccgcaagcttgcaagggcagctgccagagacaggaagtgacatcgctgtggagagggcagcaggaagtgaggtcagagtgggggtgatgggaagtaatgtcatgggctcaggaagtgatgtgctgctgctctacatgtgtacgtatatgcctggtctgtgatgctgcagaatatgtgtacatgtgtgctgggtgtgggatgtacatgtatgcctcatgtttgcctggtgtgtgatgccactttacatgtgatccaggtgtgagatgatgctgtacatgtatacatgtgtacctggtgtgtgatgccagtgcattgtgactggtgtgtgatgcggatgcacatgtgtgcttgttgtgtgaagctacttcacatgtacacatgtgtgccaggtgagtgatgctgtttcccctgtgtatatgtatgcctgttgtctgatgctg

SEQ ID NO: 20909 - DNA, 1208 bp, Mus musculus
atgcgtgagttttctatttttctagtaacaaagagtgggttttatagtgttcacgtgtatttatttattagacatattagagtacgttataattgtatttttatgatgaaaacaacacagttttactcaatagatgtgagtttctaaatgtgataagaaagatcgtactcgaacattattttcattcctgggctatactgtatgccattactttgacgtattttcatatgtacattttaaataatactgtccaatgtgttaagaaagaaaaatgttttaacacagatgctacagaaaagagtgttaatcctgaatgcctgtgtgttctactctatgctagtaacaacaagagtgttttttttgagagttcacctgcgtttatttattagacatattagactatattatagctatctttgaaagaagaaaaccagacagttttggcaatagatgtcaatttctaaatgcaatgagaaagattttattgaatgttatttcctttagtgggctacactgtatatcctttgacgtattttcatatgcacattttaaataaaactgtacaatgcgccgggcgtggtggcacatgcctttaatcccagcactcgggaggcaggggcaggcgaatttctgagttcaaggccagcctggtctacaaagtgagttccaggacagccagggctatacagagaaaccctgtcttgaaaaacaacacaaaacaaaacaaaaacctgcacaatgcgataaacctggaattaaagtgttttaacacactctagtgaaaaagagttcatcatgaatgcctgattgttctactgtgtgctagttacaagagtgattttttttagtgttcatgtgtatttatttattagaaatattatactacaatgtactgtctttttatgaagaaaacaagacagtttcacacaatagatgtgaatttataaatgtgataaaatggtgtttttcgaatgttatttcctttagtgggctacactatatgtcattaggtttaagaattttcatatgcacaatgtaaatgaaactctacaatgtgttaaggctggatgaaaagtgtttttacaaagatgctacagaaaagagaattagtcgtgaatgcctgagtgttccactctgttagcaacaagagtgttttgttttttattgttcgggtgaatttatgtattagacatattagactacattat

SEQ ID NO: 20910 - DNA, 2619 bp, Mus musculus
tcctgtccatctgctgccatccaccatccggttctcttcttgctgcaaaataaaacactctgtccatttttaactctaaacagatatttttgtttctcatcttaactattcaatccacctattttatttgttctttcatctgtgactgcttgcggactattataattttcttcaaacaaacaaacaaaaatgtatagagaaatcatgtctgtgagttcattttgagatttacttgctcactcagccctgcacttcagttgtattatagtccagttcttatcaacattaaactagagcaatcatttcaactattctgcaaattgtataagaataaaagttagaattaacaattttattttgtacaacagtgggattttctgtcatgaataatgtgcttgatccctataatctatagacgtgatagcaaagaaacaaaagccaggaaaacactcattttcgccttgaactgtatgtgggttaatttgtcctgtgccttatgtggaaaggaacgtctttggttttctttttttgttttggtggaagcatgagcaggagacatttcatcccagcataaactccttcagatgcttgtggtttgcttggctgtatctttcacgatagttaactgaggacaaagggtaatgcagaagtgatatttgatttccattctcattcccagtggccttgatatttaaactgattcctgccaccaggtccttgggccaccctgtccctgcgtctcatctttctgcatgctgctttgtttgcccctactactcctggtgtgagttatttaaagatgaaaggtttgtcaagtttaacatacagcactgattttaccttgctaagtaaacagaaagataaattctaactgcctattaactgtcagttaattcgggtcagcccctcatttactctctccccaaacctgccccgctgttggccttctgtcccccaccccttcctgtctatccatggagtttatgaaatggaagagttaattgcatgcactagtgtttggagggtgttgtggcttgtctttctaattaggtatatatcctattcactttcctagagtaaacctcctaacctggatttgactagtctccattatgccagctcctctggcagttcggcagcccaggaaagactggttttaaaaaagagcaagaaggagtgggtcttagtagcgtttgtcaaatgtattgagatttggcctttgaagaacacatttggtattaagttgtctttactgtaagatttagaaatgcattataatattattaatttcaagtcctatctttacatcctctcagaaaacttctgataccatgaatattttaaaaaagaaaaaggaccgcaaaaggcttctcgtgtaaagctgagcactctggctctgtctgacccgcccttctctcccctttctagtttggcttcattgcttctcattaggatagggtaggctaagttccctatgctgctagcatcctaagatgatacctttgtggaaataattgtgaatagcatgattcatttcaagcagaggctgagtttaggacagcagctaccattgagaagatttctgtgacatgcattttaatgacctcttggctcacataaacaatatagggacatatctgctaaaagaacccatgaatttttcagatagtgtcccacagacaattctacatgcctcactggtggctcttagggtttcttccctcacttgactttatcattgtttactagtaaaaagcagcattgccaaataacccctgattttccactatgaaaaatgcgatgtgtaagcttttaaagttgtaggttaaacctcctgttgttatctttgctgtttgtgttgcttccttctatctggaatgtggtagccacctctttaaactttttttaacccttaattcagtgacttaaggtttggagatacacactgggattttggctaacagactgacagttttgttgtttgcataattataatcgacattgtacagagaaaggataaggctacctttgttaaatctgcactttctgaatatcaaaaaaaaaaacaaaaaaaacaaaaaaacccaccaaaagggaaatggaagtataaatcaatttttgtataatctgtttgaaacctgagttttatttgcttactattagggctttgtcccctttctgtaagtctcttgggatcctgtgtaggagctgttctcattaaacatcaacagttcagtccattctctggtactagctacaaattcggtttcatactctacttaacaatttaaataaactgaaatatttctagatggtctacttctgttcatataaaaacaaacctgatttccaactgtgtggtttggttttcatttatttttggagttggagatggagggttgcttctaacaactgtataggagggtatcctgtgaagcacagtagagagaagggcaaatactttgtcagtatcaacacttggaagaaaccacgaggagcaagcatctcctcatacaggaagaccaccaagccctctcccgttcacacaagttcaatgaaccaagagaaaccgggtccactgatgggcccagggctcccaggtcccatggctctcggtcc

SEQ ID NO: 20911 - DNA, 1146 bp, Mus musculus
ttcatctctggcaagagagagatacatcaggaagtatgctttgactcttttctaggcctctcacctcagacaagttaattgacacagtagttgttttgtttctttgtggtactggagattgggcctgagccttgggcatactaggcaagcactccacatatatggctagtgatgaaaagaattgtatacatgaactttattcttattagtaaatgtagtttctcacagagtatggacttacataaatacaaatgtatgaatatagaaataaatgttttagttttttattttatgttgaaaaggtttacaaataggaaaaatgctggaatgaactctggggttgggttagaactgaaggcgtatgagctttatatattacatgtatatggaataaataattatagatatgtaggcatacatatatccattggctaatacacacaaatgcctgcctataggaaaggcatagaaacaatgttattccagtaaccatgagcatatttcaaatacaaccccccttttaaagatttatttatttatttgtttatatattatatgtaagtacactgtagctgtcttcagaagagggcataagatctcattatggatggttgtgagccactatgtggttgctgggaattgaactcgggaccttcagaaaagcagtcagtgctcttaaccgctgagccatctctccatcccctcaaatactctctttaagagttcttaaagagttgctgaagagatggctcagtgtgaagaacacttgctgctcttacaaaaaacctatttggttcctaactaccatgtgtctgtaaacacacacataatctttaaaaaaaaataaacaagccaggttctctgaagaacttgtttttagagctaaagtaagagaaataaaaggtactgatgattctagattatatgatgccagaaaataaagaagtacttagaaattgatagatggaaaagagcacaggagcaaatctaagtagcatttaatggccaactgaagtgaaataatactactgggttgtatcaatggaatatactatctattagttcatattggtgagcagttgaggaaataaaaagatgaacattatagctacaaagagcaaatctcaaagaactttaggtcgtgta

SEQ ID NO: 20912 - DNA, 1176 bp, Mus musculus
tatagtacagtgataccctcttcatacagaacatactggaccagggctaacttattttactactttacttttaattttctttctgagtattgtgaagtaaataaattgtgatcagattttacttaatagtaagtattagctgtttgataattgagaaatttgtggggtgtgtttgtgttgcatgtggaggccagaggatgaggtcaggtgtgggcctctgttctctccattgtgctttttgagatagggtcgctcattgaaccctgagcctgctgattgattgctggcaagcaagccctcaagatcctcctgtctcatttttcccagtgctgggattccctatgccatgcctagctttttacttggttgttggaaatctgcactcaggttctatggttttacatcagacactctagggcaaaactggtcttagaaatttaatgattgtttggaaagtaattaagaaagtaagtaattactggttttagatgtacacaaatttcagtggttgatttgaccgtaattttcttggcagtatgcactctggaaagtattactcaatgataggataattacaagaatttgttgttgttcttctttttcttcttttttcctctgttaagatttattaatttattttatgtatatgagtgcattgtagctgtcttcagacataccagaagagggcatcatatctctttatagatggtcgtgagctaccatgtggttgctggtaattgaactcaggacctctggaagagcagtctgtgcttttaatgcctgagccatcatactagcccaagaatttgttcttaaagtacattttttccccccatttttgtttttttgaaacagtgtttctctgtccttagctgttctggaacttgctttgtagaccaggttggtttcaaactcagggatccacctgcctctgcctcccaagtgctgggattaaatgtatgagccatcaccacctggcaaagcacacgtgtccatgtgttttgtgtgtgtgtgtgtgtgtgtgttagcttaatattatttattttatgtgtttgagtgttttgtctccacgtttgtatgtagactttgtgcctagtgtcctttgaagccagaggtggtagatcttccagaactggggttgtagacaggagccactatgtgggtgctgggaactaa

SEQ ID NO: 20913 - DNA, 1184 bp, Mus musculus
tgcgtctcaggctgcgcgcacgccggcgtgagagggcacggggaaaaaggtggctctggccggggcggctctgtttcctggggttatgtagcagggcttgtcggctcgcgagacctcccgctgccctcgcccgtgtcctagcgcggggtttctgctccgggcggaggccgtgttcaagcccgccgcgctccctcgacgtagagctcgctcgtccgcccgtgggagcgtcccggccgagctgcgctgaggggggaggggaggccattttgtcccgaccgactccccggaaccgggcggagcggctgggagaggctgcggagccgcgggcgccgcccctcggaggcacgggcgccgccaccgtcggggcttcctcgacgaggccgttcggaaggtctcctgctccgtctcgagagctgctttctccttccgcacacgctacccggctgctgcggccccagaacgcccgggtgaggagttggttgtagtgagcagttccgatcccttggggctaccggcggcgagcgcccgagccgctcctcccaatggcgaagaagacgtacgacctgcttttcaagctgctcctgatcggggactcgggagtgggcaagacctgcgtcctttttcgtttttcggacgatgccttcaataccacctttatttccaccataggtaagacctgtgggaggatggtgtgggggctctgtagccgcgagccgttttcttttattccagacatcttgcttcccggaatttacgcctttgttccagtgattccgattccagacgacagacctaagttactgttggaatcggaatagccttactggggcggggtcttcccatgcttaccatccggtctcaagtctccttctctgttcggtgccttctggcacaaaatatgcagcatttagcagcgttccagaatccggtttctttaagtgacttgcctggccttaccataattgcatgaagttacttgatgtgctatttgtaatagacgtaatttagtggttgggattgaagcagtactggctatgtggcaaaggcccgaattgggggtcaaagagaaaatattctatctgactgtaacttggagtaaacttgagagttgcagaatcattaaggaaaatgagaggggcgggggaaagtgagttggctgtcttgactgaaccattgatgtgtca

SEQ ID NO: 20914 - DNA, 1197 bp, Mus musculus
tattttggttagagttggtggattatgctggtttgtgagtgtgcctgtttaatttctcccttgttttgcttctagggatagaggttaaactcagtgataggcactgagtgtctactttggtgtctactttgtcacacgagaaaatggttgggcttgactttgttttaaaaaccagtcttagccaggcgtagcggcgcacgcctttgatcccagcactcgggaggcagaggcaggcagatttctaggtttgaggccagcctggtctacaaagttagttccaggacagccagggctacacagagaaaccctgtctcgaaaaacaaaacaaacaaaaaaacaaaacaaaacaaaaacaaaaaacaaaaagagaaagaaaaaaaaggaagcataaagaccagtcttagtccattgctcaggctggtccccaactcctggtctgaaaggactctcctcccttagctcctcaaacagctggtactacaggcacatgctaccctgttcaactctgagaaacttctggcatttatttacttatttatttatttatttaagttagcctctcactctatagccctggatggccctgaatgtagcatgtagctaaggctggctttgaactcctgactttctgcctccccagttctgggatatatatgagggtgtgagaccccgtgcccagacttgacccagccatagaggagccagtctacaaacattctccatgccatcatattgatgaagacaccaatctcctgagtcacaagttggcctcagatgcccctcatcttctgagtcttctgcttctacctcccaaatgcggagagcataggcccgtggcagcatgcctgtttggtacagtgcttaggatcaaacccaggacttcatgcatgctaggtacactctctaccatctgaactatggtcccaccctccccactttgctttcatagttttgagacagggtctcctgtgcactaggttggccttaagctcactttgtagccatggatgacttagacctcctcatccccctgccttcgccacccaagaacctggacagaaacatgagctcccacacctggctccgggttaggagagcattccctcctcctacaggagggaagaaggccaaactgggtttgttacagaggcaactttatttttaaaatcttggtaaaaacattccttaaatcatatg

SEQ ID NO: 20915 - DNA, 1231 bp, Mus musculus
tctggttttcctaatctttcctttggtccatctcattgcctctctacaggtgccagagtcctcagcggatgcctccaccctccacagctcatgcatccatgacctctgttcctttgcaccctgcaacagtggtagaccatgactgataccccccagtcaggctgcccatccctggttcatcccatctgatgcttggtgcgtgtgtgtttgtgtgtgtggtatgtatgcatgtgtgtgtgaactagtgtgtgtaccagtgtgtgtgaaggggcaagaaactatcaggtgatgtctctgcctgttctctgtgcctcctttatttaattcatgttatttattcacggagcttggttagtgagaagagatccccctgcttgagatgcctggtcctgccatggtcacagcacagcctcctgttctcttggctagggagagacttaggcaggccccaagctccttatgtcagctgcctccaagagggaagatggctagtgcctgagaagacagtgcttcctttacccatccaagtccacagtttccatcttcttgtgtgtgatggtgagcagccgtggatgctttctggctctgggagactgctggtgtcctctgaaggtgagaggtgtcctaatggtgttgggcttgcactcccggtggactgagctgtgctcgattctctctgggccctagactcttccagcctccagggctctttcccaaggactttcagtagcccaagactcatgccaggctttccagccttggcaggaacttgtggcttccccaactccacttcattgccagccctctctgcccttggattgggaattgtcaaccaaacagttgttgccaccatgagacctgcaggaaatggagcagtgtggagaaccagtggcctgccgtcaggggcaatctttcttcagtgccctctcttctccaagaagctcctttggagaacaaaccatcaggccacctctccagtgagatgtggctccttcatgttctcatcactgttccctgaagctgtcaggtctcggtccacagcggagagaaccagagcccttctccccttactgaatgcagataacaaaatcctttgctttgtgcctccagctaagacaagaaacaaacccaggcccaatttttgccagatttaccttttactcttacttcttagttacatcttgggggagggggcactattttgttgaaaaatcaatccattctttaccac

SEQ ID NO: 20916 - DNA, 1110 bp, Mus musculus
agaagcaggcaagcgactccacaatgatactcattcctttattgtcaactgtgttcatctcaacagggctggggcctgcaggctgctggcagcaccaagttaaggtgcatttccactcaacagaaaggcctccatcctaaaccaagggggcagaggttaatgctttatatatatttatatatttatatattacatatgtcctagatatacatatgtcccatatgtatagagtgacaagaatgggccactttgtgtaactttaattaaaggccatagcaacagacatagaaatttgatcctaattaaggcccgtactttgtcaatcaaatgtgtgatacagtaaaagaaaaaggagagagacagagactgagatccagccacctccaggagtcctgtctccagggtatcttacattgagtgtagtgccccctgtacaggtgaacataaacacacacataaacacacacatataataccacaggcaggagcacctcttctgaccacaccttgggcccagcctttggctgcggtgctgaagtggggtgtattgtgctataagactgtgagggtagtggaccagacaatgtggagtcagtgtgtccaagtgatgaatggggtgactcatgcagcttcatctacaaatgacagagagctcagggggaggtccctcaatgcccagttcacatcaggagatttctacacacagctcctgttccagagaaagccattcctctgatttgaatcctgagtgtcaatcacagggttctgacagaaacctgggatccctttgaagggcaggcagccgcaaggctccgccattcagtccagtggagcagcagagagcacaacagtggagtcaaagcaaatgatgcgcagacaggaccctgaatggtgcaagaggggctcatttcccaaaaggtcgagaaggactgctgccctttgccacacagaacttctggcagatctgtcagcttcatgtcttacataagtaacagacctgctcctaagccagggaaggagacgcccaacattagggcactggaaatcctaactccctgttttctctccccgaatttacccactaccacccaccaaaatatgcatattgaa

SEQ ID NO: 20917 - DNA, 1241 bp, Mus musculus
aaacactaggttatgtcagcttttttcccctaattttcaccatttctctatttgtttggctttggaggatagactcggtttgtgtggacccccagaatggaatctcttcctcaggactcatacttgagtatgtgctgcccaaagcactattaacaagcctttcacactgtgtccattcaacagtcagcgaatgaatgactataatctttactgataaagtgaggaatgttataaattattccaactggattccattttctagttgataagacttttgtataggtgcctttgggcatggataggtcaggttttttgtttttgtttttcgagacaaggtttctctgtgtagccctgtctgtcctggagctcactttgtagaccaagttggcctcaaactagagatctctgcctgcctctgctgcaattaaaggtgtgtactgacatcacccagcttaaaagtcaattttaacttggctttgcttgctagtttcctgaggcccggattgggtcccttgagcgagcaccaactgagcatcttctgggtccaaggccaccttaatttcctctgagcattgttctttctcaatgatgcatttgctgtgtgactccctagattgtgtgtgtgtgtgtgtgtgtgtgtgtgtgtgtgtgtgtgtgtgtgcaggcatgggctggctcccatggagctagaagtgaatttaagggacctactctattcctctctatcttcatggcttgagattcagactcactgaagctcactgatgggctagactggccagaaggcccctggatggtcctgtctccaatcctagctctagggtcagtggtgcctggctttctctgtgggtgctgggactcaggctcaggttctcatgcttgcagcacaagcactttacctactgaaccatctcccagccctagagtgctctcagatctatttctttgggtaaaggggatattttgttggttagtttttcttttttattgattttttagtcatttatatgggtgtgtatctctctgttggtgagtgtaggtaccctgggaatctagaagtattggatccctgaagttgcaggcaattgtaagtcgcgtgctgtgggtgctggggaccaaacctggatcctatacaagaatagtctctctaggcccacactggtcctcttgagacaggacattactgtatataacctaggctcactcggagtttgccatggagatcaattttgccttgaact

SEQ ID NO: 20918 - DNA, 1198 bp, Mus musculus
atgaagttcttgtgactcaggatggcttgggcccagcatttcaacgccctgtcccaagaaatacaacaaaaccaaacacagaggcacatgattgtcatgtcaacactaggaaggtttctgctagaaaaacagaaaggaatgggctagagagatagctagacttaaaaggacttgttgttcttccaaaggacttgggttcctagtactctgtgatggtttgtatatgcttgggccaggaagtgacactattaggatgtgtggcatatttggagtaggtgtgtcactgtggatgtggactttaatactctagtcctaggtccctagaagtcagtcttctcacagcagccttcagataaagatgtagaactctcaactgcaccatgcctgtctaaatgctgtcatactctgctttgatgataatggacggaacctgtaagccaaccccaattaaatgttgtccttataagagttgccttggtcatggtgtctgttcacagcagtaaaaccctaagatatatccagatcaggtggttctcaattgcacaatttcaattccagctctagagcatctgatgttctcttctgaactccagaggaaactgtttgtgtgtgtataaccacaccaggacatgtaggttgcttttgtttttttttgttttgttttgttttaagatttatttatttatttattttcatgtatatgagtacacactgtagctgtacatatggttgtgagccttcatatagttgttgggaattgaatttaggacctctgctctctctaggcaaccctgctcgctcagtccctgctcgctcgacccaaagatttatttattatagataagtacactgtagatgcaccagaatagggcatcagatcacattatgggtggttgtgagccaccctgtggttgctggaatttgaactcaggatcttcggaagagcagtcaagtgctcttaccagctgagctatcttaccatcccccaacatgtggattttttatttgtttgacagggtctctgtatatagctctgactggcctgcaacttactatgtctggtctcaaactcacaaataatccacctgcttctgcctcttgggtttagaggtatgtaccatcatcataccaggttgaaataatttttaaaaaagagtgcttactggttatttgtgaaagactatgatttaaatgttaa

SEQ ID NO: 20919 - DNA, 1152 bp, Mus musculus
ttttttggaagattactttcttgttttttctagggtgtagtttccctccttgtgtttaccatctattaccctttgtaggactggatttatggagaaatattgtgtaaatttggttttgtcacggaatatcttggtttctccatctatggtaattgagagttttgctgggaatagtagcctgggctgacatttgtgttcttttagggtctgtatgacatttgcccaagatctttgttttgtgcatttgatgttttgactattatgtaatgggaggaatttcttttctggtccaatctatttggagttctataggcttcttgtatgttcttgggcatctctttctttaggttagggagattttcttctataattttgttgaagatatttactggccctttaagttgggaatcttcactctcttctatacctattttccttaggtttgtgtcctggatttcctgggttaggagctttttgcattttgctttttctttgactgttgtgttaatgttttctatggtatcttctgcccttgagattctctcttctatcttttatatatacacacacacacatacacacacactgtagctgtcttcagacactccagaagagggcatcagatttcattacagatggttgtgagccactatgtggttgctgggatttgaactcaggacttttggaagagcagtcagcgctcctaaccgctgagccatctcaccagcccccctcttctatcttttgtattctgtgggtgatgcttgagtctatgactcctgatctttcctaggttttctatctccctttgtgatttccattttagatcctggatggttttgttcaattccttcacctgtttggttgtgttttcctgtaattctttaagggatttttgtgtttcctctttaagggtttctacttttttacctgtgttctcctatatttctttaagggatttatttatgtccttctttaaagtcctctatcatcattatgagatatgattttaaatcagagtcttgcttttctagtgtgttttctagtgggtatccagggcttgctgtggtgggagaactaggttctgatgatgccaagtagccttgctttctgtttttgcacttgcctctcaccagatggttatctgtggtg

SEQ ID NO: 20920 - DNA, 1192 bp, Mus musculus
tattaaacctcttttaaggtgtttaaagtgatcttctgataggtgtaagtacaagaaaccatggcagtttgttttactgatcagatttagtttagtgcagcagtgtacaagagaataaatacttatttgaatctatgtgtgtgtgtgcaagcatgttctctcatgcatgtgtgcatgctttccactttcatgtctacttgtaaagtttcatgcataaataaagtaggtttgcaaaataagtttcatattgctatatgaaatttttgttttgcttctatttaagtgttaagttaaaattttccccctttatatattcaaagatgaattgtccattcatttttttttttgtggcaatctctttctgtactgatccggtttgtagttagtaaaaaattatataaaggaatattgatcaactaaaaattaggttagaattataaaaaatatttagatcatgattagataaactaatcactaagttcttcactttatttgcttttagtgggacttcccctcttgcatgcttgaatgcaatgctgcacacaaactcccgaggagaagaaggcatcttctataaagttccaggtagaatgggcgtgtatactttgaaggtaagttgctggggagacaagcaatagtaagggttggcagcatataactactgagttacatagacagaattctgttcttgaggaacttatttccagaaagaaataaaatttcaaccctaaagtaagtaaataaattttggggagttgaactcagagcctcatgaatactaaataaattttttgagcattatttgatcttaagtgtatggatgccttgcctgcatgtataatttatgtaccacattcttgtggtactcatggatgccagaagagggtattggatcctctggagctagagttccagttgattgttaccttctgtgtgggtgatggattgaacccatgtcctctggaggaacagcagttcatgttcctaactgctgagccccctctctagcccctacttcttattttaaagaggccaaaaatatttacatatttacaaattgggtattgctttagatggctttgctttactcatcttccccactaaaacctacagttatggttattattcctgtttttataagggagaaaactaagttcaaaagttgtgatttctttaccagtggtggctgtat

SEQ ID NO: 20921 - DNA, 1150 bp, Mus musculus
aaaaacaacagaacaaacaatagttcttttcttgctgctacttattagccaatgttgaggacctagttagatgaaaataatatgataatcttattctcctgacttgaattatgtaattgaattcagaatatatgagatgctaccctatacaaacacagctatgtctaagaaaattatgtgatttttaaaccttagcgtttcatcttttacctggatttatatataccagttatcatgtaatttaaatatatgttgtacctgcatataaatgttttgtgtaatttttatctttggatatagatcgaaaattaacttatttgatccccaaaaagggaagtataaggatttcggcaagtatttatggttttactatattaatactaaaaattaatcagctaattatctgctgcattacgtattagacatttagtttcgatttgctaaaatggtgacagtcctaacaggatgcctacattttcagaaagatgtgccagatggagtgaaagagctgtcagaaggttcagaagaaagcagtgatggtcagtcagattctcagagctctgagaacagcagcagcagtgatggtggcagcaacaaagaagggagaaagagcaggtggaaaaggaaaggtaatctccgactgctgcagcagtgccttgtcactttcctcagaccatcagcttcctctttctctagtagtttagtgttctgcaatagtctcttgcaggggtccaagtgtttgtatttaacctttcaggcagcagccactagcatcatgaacctgtctgactgcgtaactgaggagcttttaaaaaataatatttttcttttagggactgagagattgctctgtggctaatatgctgtgtaagcctaaacatttgagtttggatccccagcacccatccatatataacaatgaagggggaaaggggccatgctccaggatcaatgagagaggggcgtgggggaagggggggggggagagagagaaacagcgacagaggcagacagacagagactgactggactttgaattatcagcaaaaccaaaacatgatgttgaaaggggtacattggggggatgatgatgggaatatataaagtttaagcataaggattacagtttaaattaccagaatgtaaaagt

SEQ ID NO: 20922 - DNA, 1130 bp, Mus musculus
tagtaaaaatgtatttacatagtgttacactttgtagaacatagataggaatgccgtgaattcagtatagtctgtcaggctatacagaacagataataatgaaatagaaggtggtggtttccagccaagaaatcttcaaaaatcccctttaccttggaaacatagatactactcataatcttaggaccttattctaagttctaacttgataacatgatttatacatgacttcctgctttttaaatcacttctaatatattaaacaatgagaagtaatatatactaatacacaccccttccccatcctatcatcctacactagaactttctgaggaaataaactgaaaagggagactgtttgcagtacaactccaaaaagaagatcctccctaaagtgtttggtcccagttcttaacaggtagcagcatatgatctggggaaggaatggtgcttgatatctactctgataatacaacttttccttgtcaatttttctctagtatcatctagactgtcacatccaccctctcccccgtcaggctgcccatcacccaccattccagcaagtaaagtcatttctccatcacagaagcacagcaaaaaggcattaaaacaggtaagaagtgagtctgcatttatcagaataatctctccaattaaaaataattatgagggggccggtgagatggctcagtggttaagtactgactgctcttccaaagatcccaaccacatggtggctcacaaccatccgtaacaagaactgacgccctcttcttgtgtgtctgaagacaactacagtgtacttacatataataaataagtaaatctttaaaaataattatgagagcctcatggtgtttgaggctttacttttgttgtataatggacagtcatgtactaagaccatgtttcaagaaaatcctgcatcaactcttctgttagtaaaatttcttgaaagattgtagatttctctctttacagagtaaatgtcagcagtctacaaatttaccgctgataatttgtgtacactgtgtgtaacacccattgtagggtttggtaattctttttaacatgattttgaagacccagaccttttcctactttgctaaattgtccatgaatgtgct

SEQ ID NO: 20923 - DNA, 1156 bp, Mus musculus
cctctagtatctgtgggcactgcacatacaggtgaggcaataagataagatacatgcaggcaaaacatttattcacatcaagtcaaaataaacgtaaaactaagacgtggaaaattgtgtaggctttctaaaatatacactttattttccatcagacatgtttcttgggctttgggtattattgttgcttgttttgttattagttgtattgccacacacagactttgttttgcattatataattgaatgaaaacattctatggactgccacaaaaatgaaacgtctgagtgttacagaacttttcgtttttgccagagcagatactcacaattggataaataatgtaagagaagatgaatgattgtacaaatcatttagaaggcctatgttttgtcaatcataactcctgtaattaccatggaataatagtttgattaaatttattgggccctgggagcaaatgtatgtggcagtctgaggcaaacttgtcagttctcttctaccatggagggcccacaggtgaactcaggttgttgggttggtagccacctgtcttgctcagcctcaatgggcttttgtgtatgcgcctctgtcaccagtcttcacctatttttccccctagccctatgggaaggaaagcaatctgatggacagtcaagcagtccccagaactcaaattccagcttttcttcctcagtgaaagtggaaagttctctgctaggcttggggaagaagtctttccagaggtctgacagactccacacaagtaagttagtttacaaggacttcttttttcagtgcaacagtgtgttcacagcatatttgaaatcattagccactggcttgagttattgtataattttaattttaattttaaaaagtcagacatgatttctttccttttttgttttgaaacaaggtctcactataaaaccctggctgtcctggaatttgttctatagatgaggctggccttgaactcatagagatcctcgggcctttacctcccaacgtgctgggactaaagttgtgtgctagacatactttctttgttttacattatctcgatgtttttaaaactgtttctgatacaatttctttggggtttcatttggttttgttggtttgtttcatatgagcaataactgccacagc

SEQ ID NO: 20924 - DNA, 1646 bp, Mus musculus
taaatcacagaaataaagtttcagttgtctcaagagacattaatcaggaatacagaatgcaggtcttcacatttacaggaagagcaccttgtatagtaggtctgagtcaaataggactgaattggtgacaaagtttgcacttacaaaatcatgtaaatatgtcacattttgttttaacatttttttcaaagtatttaggtaatgatgtattaacttcacattcagatttatgttccatttcttttgactgagaaaagttgaacggtatgcatggtgaaaggaagctgtctgcctctgacctttccccaggctatgaaaaggaaagtgagggagcgatcatagtgctgattatgtcttcacagactggctcaggttcttcacgaagaagatggcctttgtgggatttaattcggggtttgctcatccctttactttaggtggaactattttcagtgaaattttcaaaaggtattaacagcacagacagtgtttttgaccctgacagccctggcttagcttttggcttccatgaatcagtactgttgttaaaagcagagctctgctgttaagaggttctgtttctaagggactgctgagttagattagtatatacgtggcagtagttcagcaataatacatcacaacattgcatcaatcatgggctcccaccaataaacactttacgggtgggtgtgtgtgtgtgtgcgcgcgcgcgcatgtgcgcatactgtgtaatgttggaaaagggatgaaattgaagaaactgaaacttcacggaatttggaagagtggttttaacatgggacagaaaatagtcttttcctattctctcaatccatttttaggtagaaagggtcttaagtgatacttatgctttggcatccagagcataagagatgaatgcagctaccctgtgccatcctactataataaattttgcacccacacacaagtacacagtttgctgttttagaaagtgattctacaatctcggctgtcaggacagctgggatgcttactgtgaaagggtcttgtgagtgactaatggaatatatggctgtgagattttgctgtttttctttccttttgatttttttttaatcctcccagtactccagagacagagacagaccagtctctgagttcaaggccagcctgatcttcataatgagctccagacaaccagggctatctaagaagccttgtctcaaaacaaaaataatcacaaaaaccctaaataaataaaagaagtaaaaaaaaaccacacacacacaaggagctggagagatggctcagtggttacgagcactgactgctcttctagagatcctgagttcaattcccagcaaccgcatggtggctcacaaccatctgtaatgggatctgatgccctcttctagtgtgtctgaagacagtgacagtgtactcatatacataaagaaatctttttttaaaaaagagagaaaagaaaaactagttggtggacatggtgggtgacacgcctttaatctcagcacttgggaggaagaggcaggtgaatctctgggttaggaccagtatggtttgcatagcaagttccagagtacacagtgaaacacttgtcttttttaaaaaacaaaagctagctacgaatttttaaagaaata

SEQ ID NO: 20925 - DNA, 4617 bp, Mus musculus
cttttgtgtgttcttttataaggccccaccatcccctctgcacatggcagctccggtcctggaatgtgatgtttttggtcatctctaaagactgcagtttcatacttgggaggctgatgacacctttattataattattcttatggttctggctataattgttttaagattttctttcagaaaacaaaaacccaacacccttccctttaggtttcaaaccaaggtgcgggggggtggcaggtgcttttttaaggaccagtggctctggtgccctggctcccacccctcaggccaggtgagccactgggcaacaagctaggcagccagggagtttgaggcccaccctccgggccagtcactcttctcttcttcttcccttcctcgtgagtccggtgtgtcagggctggagggaggccggggcagcctccctccttgtgtgtgtggttggagtggcgtgtgtttcttttctagtgtttgctctgatggctgtgctctcacttgagtcagcttcacctgggccatgtgctcgcactttgttccgctccccagccagggcaggcagcctggcattggcagcgggaagggaaggtgtgcttggccccagggtgagggcttgcctggatggatggagtgtagatatgtggcatatagagatatatattttataatgggaggggggacggcacctcctgggaccagcagagactgggaggtgtgctgtcaagcacatggtcccaagaccgcatccctagaaagatggggcctatgataggccctatataaatacatagatagggtcatgtataagaaatatacacagagggggttggagggagtgggctctgtgttgagcctgggtccttcccgcagacagccccacaaacagtatatcagtctaacacatgcacaggaatctatttctgtctggatgcacaccagggagcccccagcacacttctctgcaggatcaggacgatggagtcggctacacagctctctctcgtacatctgttgccctgatgacaggtagactcgatcccagaagttgctaggtgctgaagtcaggaaaaggaggaggtttgatccaagcaggtgcttcctctagcaggtctgtgttgtattccctttgcctctggtgatgtcagcttctgttagcagcctgtggttactgacctgcaactctcggcaccagtcaagtcagccctcagcccctacctattctccccaaccaaagtcgaactgaaatctctcttggccatggggcttccattgggaaaataaaatgttaaaaaaaaaattaaaatgggacagtgaacctcacttttggagtaaagcaaatcagtaattagtgctaaaactagtcagaggctttggccccttgctcactgctcgggactaagcttggctggtggcttggtacactgcttgggctgtgtagtcctgcccacctctgctcattttctctggatagagttttaagatcgcagctagtttcccctgccatggcaggtatgactatggggctggagcatccaggagagggggatgcttgccctcttggagtccctgtactaaatgtaacgtcctcccttgctccagcagggctccattctgacctggagtccaccagcaccatgcaggaggactggaggggaggaaggctgctttaggcagtccaaggtgctccctccccctctagcaatggcaaggtcttcccagctcctgtcaggactgtcttcaaaggccatctctgcccaccgcatatgtgacgaagctagcctttcccaggagcctagtgccgcctcagctgggcctggtgctcccgtgcctggggttagtgtgagggctcaggaggaggagttcccaagggactgagtagaggcttccaggtggctgaccagtactgacctgacacggtccctgatggactcctcatggggcgggcatcgggtggccttctctagctttccttccagccccatctgtaggcttagtcttaccatagtgtgagggcaccaggcgagttagcccccaatatcttttggggaggggtgtctttgggactgtgccaatctggctattcatccgtctctaccccaagtgcggcttctagggtcacctctgaggagagctgctgggatgctggggtagctgaggggaggttgtggggagtttgcagtgcatctaggaactagctcactgcaggtggggctgaagctggattcagtcatgggaggttccctgtgggctttcctttccaaagactaggcttgttttccctagaaactaaggtgctggggactgggtgacagccacctctcagcaggtgccgtgtaagtgtgaagatttgtgaagatctgtggcccttgcccaggggaggtagctggtgctagcaccagggtcacagaactaaggcctcctgaggaggcacacataccagcggggtcccaagctggtgctaattcctctcataggacccagtaagcccgggagcctgcagtcggctgtttctctgctgtggaataccctgttagaaagctgaggtcccctaaagagcctcctggaccgagtcacttttgtggccgggctgagtatggcagcaggtagaaagatccgcaggcataaagatccctgtggcttttggcaaatgactgaagtgtggatgcaggagcaatgagtggaggccaacatcaacagcatctaccctccccaatagtgtctctgttctgggggtgctgtggtcctcacttgctggcttaggattggagttaggctgagccactttgaaggagtgtgtttacaggaagatacaaattgttggtttctctattctttactgtacagtgtgtccagagagtagaagaaaattcctgggcctgtctggttggtgcagagcttttatggcactacaaggtcttcaggaactgtcactgtaagagccctggctgtgagctggggctacgtgaccactgcagctgagtttccaagcaggcctgtgtttggatctgagtttgacgcttggcggctcccagggcttgggatgagtggcagtgctgacttgttcacttggcagagccaccctgtgaggaggtggacttagtggccctttccaattgatcctgtcccatccaggcagtatcagcactaggagcagtgctgggtcagaagtccgaaggaaaggactcggttgatcggggtcattgtgagcttgtgtatgtttgtgtagagaaagctgaactttgggaggaaaggccttgtccttgcaggcttccaagacaccgctaaggttagcctttggttggagacaagtctctagcccagacactggagtaggcgctgagaccaagaggcaggccaagatggagatctatggaaggccctttgctggtagggattcaaagcttctccaggggaccccagaactctattaactggctcccctaccgggacaagcttcgtttgtgggctcatagagtggccatagagtgggtttaacccagcaccaagcctgagggcatgagcagtggtctaaagtctcacatagtcccattttacagactaatttgattgcccggccgtagaattctacagaaacaacaatcactgaaattccttagaatacgcagagggaggaggtgactcaacacggtgctaaacacattttattaaaaatatatattgttaaattaagtctgctgtctggacaatgatgttctgttttgttttcttgtagtggagtttaaaagagactattattttactctgatatattattattaaaaaggcattttaactttgtacttgaaaactaagtgagcgatttcacgtgttttagctgagacatcgaagtagcgggtgcttacttgtgggaaatcatgtattcatactacaacataaactccgtagctgatttggtaataacttttactgttacagacgaattcgctttgaccccggtggcagagcgctttgactccacattccacgcagctaagtgcaggaccttccagaaccttccccggtcccccctggtcctctttcggttcctcttcctagctctctcttttcctaattcttttttttaagaattgtcgtttgtttttcctggtcccggcttccttctaccactgtattttttgttagggttgcttctctatttattgacagtaataatgtacatttcacagtctggttctgggacagccaggaggggtgtggggggctgcatacagcttgctgcactctccggtgtcctgttgtatctctgtgtacgtgatgcttgtgacatagctgttgaagaaatattaaaaggtcaatgcgtacagcaggtgtagagagtccgtcagttccgcttcatcactttttttttttttttttgtgcccagaagaatataataaagctcctttctaatgtacttgtgctggagaacacttgaataaatggactgtttttgtgcaaaaagaaaaacggaaaaaaaaaaaaaagcaccgtcataatgtccttttgtcctgcgactcctttcccctgatgtggccactcacagtcctccagtgggctgaagtgggtgcagtttacgttgggagggtctgggaaatggatttctaaagtatctctca

SEQ ID NO: 20926 - DNA, 1170 bp, Mus musculus
agcctgcactgagatttgtgggcagacaatgtggtaatcaacaggacctaagacctttctgcctggctggaagtgtgctgccttcaaggtggatgcaggacatctaggtcctgaagccaagcaggcattacattcttgaacctagtgacagattgtcttaggttatctttgtgaccatgctcaatcctacagaccaatctagatgttgcaatttcctttatttaccctaagagatagaatttccaattctcttgagttccagtcttctgatggcacccgcagcttttagtgtaacaagccaagccaatcagccaagcttcggcaatgctatggttaatggtaatgaggagggcttggacagtggtgctcactatagctggagccacagagtagggagatgcggccattgtctctatgcttagtggggatttaggagcccccagctcacagattattccatgaaccattttctctagctttgtaaggaagacttcagcctccccaggttttgggacaaagatttagtctagagagatgagacatttctaagaagactggggagaggtcaggtgggagcgtgtagactttaaattgtcagggaaaatctctggaagcctatctatgttaccacaggatgtggctcaggtcaacgaagagaatctgcctacctataaccgctgtgcgctctatgctctgggcgcagcctacctgaacctcatcagccagctcacaacagtgcctgctttctgccagcacatccacgaggttggtgtcattaggggaccaagagcctggtgagccctttgctttggagaaagtgtggaagagctaaagatcctctgtcctcagccacctgagcacaggggtctcatacctgctccccaccctctgtcctcatggaagcatgtggcacacactcctccaaccactcagaagaaagcaagagtttgggggaggagtgaggatgtgattccggtggtagagtacccagctagcatgcataaatccctgggttcgattcccagcaccacataaaactgggtatggtgacatatgcctctaatcctcagccctcaaaaaggctcaggggcaggaagacctcagcatagcaaggtttggccagcctgggctaataaacaaaggctggggaaactgagtgtggtgatatag

SEQ ID NO: 20927 - DNA, 1197 bp, Mus musculus
agtgactgaccctccttacttagcctcagggcttggccacgtcccaatagtgccaggctcagaaccaggccttcagtttatgggcctttggagaacattccagatctaaactagagcagatcccagcactgtgtgcccgtccgtgcacacatatgaacatatttaggggactcatgatatttacatatatattcatacgtatatgtgcattataatgttcaaatcaggcgaaacccatctagatgctccaacagttatcattcccctgtgatgaaaacattaaaaaatcctgtcatctagctaaagtatatatactgggggttggagagatggttcagaggttaagagcacttgctctgcttccagaggacctgagttcgaatcccagcactcatatcaggtggcacacatctgcctataactgtgattctcaacctggaggtcttggcccctttgggggttgaacaaccctttcataggggtaagcatatcagatatttacattaggattcataacagaagcaagataatagttatgaagtagcaatgaaaatgatgttattgtaggggtcaccacaacatgatggggaagcatgtgaatcaggaaggttgagaaccactggtctataacgccagcttccgaggaccccacaccttctctggcctccacaagtgtgcacattcatacacataagtgaaaataataaaaataaatctttttttaaagaattatttattttatgcatatgagtacactgtagctgtcttctgacacaccagaagagggcatcagatctcattacagatggttgtaagccatcatgtggttgctgggaattgaacttaggacccctggaagagcagtcagagctcttaactgctgagccatctctccagccccacatgtccatatttttaagcatttacatttcagtgaattgtaagaatataagtgctgtatttttttaaggtattagccatttgattctcatttgcttggttttgttttgaatggaaatagataaaaaaaaaaaaaatacccatcctagaagacacaaaaatatataaaagtctttttatcaagcttgtgacttaaagagccagggagatggctcagtaagtaagcatgcatgcctccaagactgaaaacataaattcaattcccaagacccagttggtggaaggagaggaccaacc

SEQ ID NO: 20928 - DNA, 1171 bp, Mus musculus
aggagtcagacctggagcctcaaggtaagcagtttcaggatgcttagttctggaagaggctctgttgccaaaacttgtacacaacctttcttcttctgattgcctaggaacttgaagacatgtagaaataagtctcataaggactctgccccactaacttaacgcagaggtaaatgaagcagaaggaacactgcctgctgagcaggctgtgtcctgtttttcgtgaacacttgaggaaatggcttgctccaccttcaactgtgttgagcaagaatctgacataacctaagaaaactttacaaaaaataatttttaaatcatagagttttagaagaagaaagatctttcaacttgttctcatttccctggggaactggggttcagtgaaatgggtggtcattggggacccaggagccagcagtgtgtcctggcccaggagccctgtctgcccagctgtcttctcatgaacctgcttgttctctgctgtgattggttgatgtgtatgtgtgattgggtgatacgtggttacctgttggattgaggaggagctgggcatagtggtgcacacctgtaagcccagtactgtagagtctgaagaagagtacaaacttgaggtcagtttaggttagtcagactctttctccaaaggaaaaatgaaaaagaggactgggggcatttagttcagtggtaaagaacttacacacacagctctgggatcagtctcccaacacacaaggagaaggaaaagaaagtattcttcactgtgcaaaaacaactcattactgagcatggtaacatgactgcacatgaagtgtggttggctacgagggtatgagggtttcattttctttatttttgatgttatttttggggggagagttgttttggatttttttaaagctctggctgggctagaactcactatgtagaccaggctgtctcttgctcacagaggtccccctcctctgcctcccaagtgtttagggtcttattttatcatactgtcctcccgtgctttaccctttggcaccaagactgccgcggtggaagcacctgaccttgaaactgcatgtcagcagcagctccccttttcttcttggccttgtggcacatcttcacacccaaggcaaagaggggagaactgggaaggctgatggggccacctggacct

SEQ ID NO: 20929 - DNA, 2629 bp, Mus musculus
ctgcgcagctgctctgagctttaaaatgttgttcttagtgaactcagatgtgtataaaaggataaagaggtctggcatacggctgtattagcatacggctgcgtggcttgaattagcttctgaggtgattgagctccacctcatggttctcatgggcctcagttctgcttgaggctccctcacgcctagcacatctgattatccagctgctcctggaacagaaagtgggagtcatgaggatgagaggtgtgtgtggtgctgtcagcctgagtgcggggcccaggctgcgcctcgttcaaccacatgggcaggagagcagttacagcagggggctttagtgttcccatttgggtccctcaggtcacttgctgattctcagatcttgagacgctgttcctgacatcttacttatatctagggtggctgcgtagcatcttatttatttatttatttatgtaagagtaataaaatgaagaggtgaagcctcagggtcccagaatgtgtctggtttctttagtctctcagcagagcattaggaaacaacagagcatagctcagaacgaaaagtattctgaaccctggcttcgtgatccggtacagacctctgcattcattgaaattcttagtgcagctgtgtgctttgtccttcgacattttgaaaactgcttgcacatttaagatcttaggacgtcagcaggagtctcaactcagtcatttcagaggctgaaacgtttttataaagaaccttgcccccccccaaaaaaaagaagggataaaatatttgaacaactgttatcttaaaaagctgtgtccttctccatctgagtcaccaactggtgtcacctcttcacttgttggaagtccctggaggcatttctgagttcgtcttccagccttcgtcagcactttagagcgtcctcccctcccctggtgtgtgctctcctctgtgtctccctggagctgctgggctccactctcagtgtctctctaaccccggagctactgggctctgctctcagtgtctctatcccgggagctgctgggctctgctctcagtgtctctctatcctgggagctactgggctctgctctcagtgtctctatcctgggagctgctggactccgctctcagtgtctctctacgcactgccgctttacttctccatgtcaatgtcgtctgtggctttgccagcatcttaactcacgagtccagatgctgagagtaaggctgctgtccttctgcacactgtacaccattctttaaggcttgtatttacctcaggaaacatattctagtatcttctcactgattgaaatctcaagtgataaatacttctttatacctgcaaaatggtacctatttctgtcttagttcggtgagcagctagatggtcaggtatctagatggtcaggtacctatttctgtcttagttcggtcaggcagctagatggtcaggtatctaaatggctgaaagctcgtcagagtaggacaaggggctcctgccagcactgaatcggggacaagtggtagaaagacagagggattgccatttgaagctaggaagcaaggagccagcatatcgcctctagcaatgacagtgatcccttccaggtcagctcagtaggttctctcatgctgcctcccatggagctaagtccccagcgtttttgtaaaccttttgaagatgaatttagttgcaaaatcaagctaagcaatttccacttcaggctttgcaagcaaagagctattgctccttctcatcctggtgctgagcacagttttagacctggttagtgcccttggacattgattgctccattaactgtccctgaggagggtggatgtgtttacttgtggtatgggcaggcagtgggtctgtgtcttaacacacagtgcggtgctgggcagtctggagaaggcccttggtgaaaggctgttactgaagagttggacagtttgggttagctccctgcactggtgctgaccgctccctgcacattctttccctccactgtgaatgctcgtacaaggtaatttacatatttgctttctgttgaaataactgaaagtgttaaatctaccagttgtttatgtcttgtatacagagtgtcatatgtatttaagttgtgtatttttatagagtaaagtcaaatagcaaacactggtctgctggctgcattgatttgttgagacctgatctttggtgtaaaactagaccacacaaaaatccaggtcctaatctgctgtgatcttcattccgcaagacatgtacctcaccatatgcccagcacttgggaggctgaggcacgaagatcaggagtctgaagccaacgtaggtcgcaaagagaccctgccttaaaaatcacaagctaggtgtagtggtgaatgtctgtctgtagtctaccttacctaggtgtagtggtgaatgtctgtagtctaccttacctaggtgtagtggtgaatgtctgtagtctaccttacctaggtgtagtggtgaatgtctgtagtctaccttacctaggtgtagtggtgaatgtctgtagtctaccttacctaggtgtagtggtgaatgtctgtagtctaccttacctaggtgtagaggtgaatgtctgtagtctaccttaccta

SEQ ID NO: 20930 - DNA, 1108 bp, Mus musculus
gttagtgtgcaagagtggaagccgaggccaggctaagagatgacagtgactgaaataagccaatggcgacttggaccaggcagagttagagaaggtgaggatggactcttgagttttattggctggattctgaagaccaagatggcaagagtcactggcaggtttgttttgggctatgaaagggcagagccaaggacatctccagagcctttttatttgagcaaagcacatcagccaaggtagagaatataggaagagctttagagcaggagaggtctagagtgagctgcctgtgaccattgcccaggaggtagctgagttacagtctggggctcagggagaggctggctggaggaacagatctgagtgccacccacacagagcacacttgggaacatgagactcactgaggtcatgaaggtgagtgagtgagtgagtgggaagagaagccctttaaggcctgggtgtgtgtcttaaaaccagagaccggaaggtcccctaagtgagaaggtataagaggtgaccctgagttggatactggattggcaacctaagtttctgggggctcttggcaagagtgttctttctctgtggaggagtgagaaggtcctagaacagacggatttatttctcagagcggaggggaagaaatggatgtggaaaaacctcagtcatgtccgtgtgctctgtgcggtcagaggtcacttcacgccctcggcacgtctgtgctctgcactgttctcaccctagctagagggctgatgctcattcctaaggacccgttcccaggctatttctggactattttcagggcctctatgaccctcctcacctccacaaaagtcccagtgggcagttagcagctcgagggtggcattcccaggccctttgttggcattcctctgtcagggcctgtcatcttgttctaagacaaaaacagcagtttcttggtgtcaaagagaagctgccagtcataaggttgtgctcagctgacccctgtaccacccagtcaccttctctctaccacaggctgatgacaaactatgtgacctttgtggttggggaggttctgctcctgatcctgaccatctgctcgatggctgccatc

SEQ ID NO: 20931 - DNA, 1687 bp, Mus musculus
ctgtcacgctcctcccaccgcagcctcccctcccccggccccaggcaacttgtgtgtacaatcagcttcttcaagcaaccctgtatctgtggcatcaagagaatattttgcgtctacatatgtaccccttctcctttttataatgatggatttaaaccaagatgcctccaggaaaaaggatgaaattagtatattcattcaccaaggaatccaaaaatgcagtttgggggaaaatgcaataatttttgatgagatgggtgaaggacaagaaccaagttctatcaattattgtagatatgattttctgattgagtctgcggggaaggcagcctgttctttctgcttttactttgttaacagcaaggtagctaaagttatttaaaataaaattaagtttatgatccgagtagctttttttccttaaatctcactgtaaatatatttttgatttcttgtagaaattgattttgttctgtttaattttatgcttttttttttcaacctcttggtttttctaaatttgtgtgtgaagtataatgttgattggattgccattatgtttggctggtaatttcattatcccaataactgtgaggccatgtatggatttactttgggtctcatcaaagtggcaccgctggaaaagagctattgtagctgagctaggggaggccaccccagagtggccaggctcagctgatcaaagtgcacaggccacttggatgaagggaaatcagtgctcaaagagaatctcctttttttttttttttttggtctcagaataactttgggaatttgaatttccatcagtgcaaatgtgtttctctgctctgctccgaggctaattggtaccatgttacccccttgccttgttactctgctgcatcccttctcatcctgcccccacccccacctccacctcaagaaaggagccagcgaactgactctagtgctagcagttgtgctactgaccgggcaggtgagcttgattaaggtgtggccagaggccaagggagtctcccttgctaaccttgcccagcatccctgggcctgtggacagcaacagtgaccttcgtcaccagctacctctgctcacgtggcagagaaaaggccataagaaccaatgcagacaaggagcacggactcaagacttcaaggaagaagccatttccccaggtccttccttctgcatctcgccacccctggtacaaacaactccattgaatggcatctactcagaaactacaggattttgaaaatggtggaagggctcatgtggtagcaactatgaaccagaaataggaccctcagttacagacattatcttttttagttttgcagaaaatgcatccctgatctcattcatttccagcttgaaagccccgccatgttactctagttcctaccaaaccgctctaggaggtcatttcaattttgtttgtgataataaacgtgcagacttcaggaagttcacctttaatttcagcattccagatgaagtttcctgacgcggcgctttggcataaggacctagaaaagaacagcagtaaggaaagttggagatgctaatgccctcccctatccccactgcaccttaaagtatgcatgtcaccttcaaggttttataattgcactgtttgttttatgtatgtacagattaaaattattgctacatttgaggaaaata

SEQ ID NO: 20932 - DNA, 1191 bp, Mus musculus
tcaagaagcccaggctgacttcagctaattgtggcatgaccttgagcttgtgctccttgtgcgcttctacctcccaagtgctgcattacaggcatgtgccaccatgctctgtttagcagtactaggaactgagcccagagactcatgcattgtagacaatcactggaccaactgagcttgtccagccttagcttaaccttgctatgatttcaatgcctgactagaactgaatctgacacagtaatgcatagcaatccaagactacagtctgtgtcttgtctctaatatgctctagtatatactatgggtaacaagtagaaacagccctttttactgttttgtctatcaaatatttagaaggagaatattcattacacatagctggtgattttgaagtgtggatgatttataatcaagactctaacataaatgtaaatgttctttctctgtgcaggcaaaatcatctctattgacactagctccctgagggctgctggcaggactggctgggaagacctagtaaggaagtgcatctatgctttcttccaacctcagggcagagagccatcttacgcccggcagctgtttcaagaaggtaacacttttgttgtgtctgtctgtctgtctgtctgtctgtctgtctctctctctctctctctctctctcatattaacctgtgtgttgctgttaagtaactcttcttggagttcatagcttggtaagtattttctccaaattacagctctgtaataagttttaggaaaggaagaaatgggtaagcaaagtcactcatgagtggatcctgaaacccaggatgcacatcctaaagactaggatgtcatgtggcagtcactcactcactcattcattcatccattcattcagcagatgtgtcgagttccttacatgcatagaacactatgtatatataaggtgccagggatacagtgatggctaggaagcagggtttgctcagaatgtattagggaacataggacagctctaaaatcagtgtgactctggtgataatagaagtataactgttaaaaggcaatttcaagtttgatgataatttgagagagcaagagatctttttttctccaggaaaacaagtgtgtcagagagccccagtactgttcactgttcattttaacttgatgactgttgaaacatgtatcttctgatgtagat

SEQ ID NO: 20933 - DNA, 1151 bp, Mus musculus
agtgaaaccctctctctttacctcataaaatgtgtcattaaataaccctgttattaatgcttattgggtccctgctatgagtagttctctgttcttagatcattgtcagtatgcaggaaggtacctgaggagcacatgctgttagctgagcgcttacccacgataggccgtggcttcagagtcacctcacgtaatgaggtagatggtagcatgctccttgtgtttgctcaaacaccttttctgctttggagtttttcaagacctgatctttcagtacagaactaatctttgtatccatttcctttgagaatctttacaaggtattatttggaaataaaaaggattgtctctgtattatataccttctgtatctctttagttacatcattttgaccagacaggaaatgacatgagtatttgccaaatgtgacctgacttgatatttttgtacttcagattcagggatcagtttacttcataaaaagtcatcagaaaaggaagaattatgccaaagacttaaagaacaattagatgctcttgaaaaagaaactgcatctaagctctcagaaatggattcatttaacaatcagctgaaggtatttctctccttttatcttcatgctttatagctgctgcttgctaaaaaaaaaaaagctactgttaacataatgttacatgttacattttcattattgcttataccatgccaactactagaatcatagtactatttttgatgttctctgaagtttagtaactattttgtcatgagccgagatattttccctagcatttccagggtttgatgactatatgaatctttttattggcatctgtgcatctcaaaagcagcttcattgccagcccttcagaagtaatgtcagcaacaccctaaggtacaaacagactggcatggtggtgcacactgtaaatcctagaagttgggaggctgacacaaaaggatcagaattcaaggccattcctcagcaacctacagagtttaagaccggcctgggccacttgagagctatctcagagtgggaaggagggatgagcatggaaatttccagactgtctgatggtggtcttctaacactaagttcttcttgctggtttgtctctgtgatctaatataattaataagaaataat

SEQ ID NO: 20934 - DNA, 1208 bp, Mus musculus
agtgactcagaactataattgtcacaggtggattgtcacaagttaaagaccaaccaagaccttgtgagtgctattaaactatgtatacatggagtagagaactaatttttcggttataaactgtatatatatgctacttttgttataacttattttcatatattaactttttgttattttttgtttctttgtttctttgttttgagacagtgactcactatgtaactctgagtgtcctgtaactgactgttacaggctggcctcagactcaccaagatctatctgcctctgcctcctgagtgctgggattaaaggcgcacagcaccatgcctggccacaaatattaactttgataagatgtaaaaaaagaatctctccatgatgagaaataataaactaataatttgtgagaaatgcctttttatttccactgtgattaattctgaacctgagagtgctgcgcagtagtctatactcttgtaaatgtatacatttctaagccctggactttttttcttcttccataggttgatgaaaaaactgtaggagagcctggttggctttatggtagttttcagggaaagtttggctggttcccgtgcaactatgtagaaaaagtgctgtcaagtgaaaaagctctgtctcctaagaaggccttacttcctcctacagtgtctctctctgctacctcaacttcttcccagtgagtcgggggctaacagtgtgtgcatgtaactcgtgtgtaaatacaaatgcatgttgggccaacctgattcttgatcatagttttatgtgggctggcacttccaacatttcaatacttaaatctagtgagtgaacttacactgcaccagtgtcttatctaccaatcatagtcaagcgtgggtaagctggtagcacttcattagtttctgggtaacggagtgtgctcacattacagttttgcacttgcaggccaccagcatcagtgactgattatcacaatgtatccttctcaaaccttactgttaatacaacatggcagcagaagtcagcttttacccgcactgtgtcccctggatctgtgtcccccattcacggacaggtatgttacctctactttacagaggcatccatctttcccccgttaagcagagcctgtagcactcagtttctgttgttgtttataagtgatgtgcaactgaaacctgatttctaagggtttgctc

SEQ ID NO: 20935 - DNA, 1113 bp, Mus musculus
gcgacgacatcagaaagcaagttgatgctctctgaacaaccggaatgtagaagaaagtggtgaaggaaggtgtgggagacgtgctggggcagcaggaggctgcaggagggctcagggtccctgctggaagagtgagtgaacagctgacctgtgcagggaggagtcctgagtgttgttaggaggaaccagcaagggagatgctgagtgtggtcatccttactgcagtaaccaacagcgggtagaaaccattgggagctggaggggaggaactcatttcagtaactcttctttgcattttatttgatggattcatgaatacttccctgaggatacatttaatcagtgctgtgatgaagtggccttaagtggtgggatgcccaggaaggcgactcacatggctgtgtgtcattttaagttcataggtttctctgtcacgtactagaaattagaaatcatgatctgcgtggtctggtcttaagttttggtgactttgtattctaggggcaggctgtagaaaacctgaaagcccaggccctttgttcctggacggcaaagaaggagaaccacctgaacttctcaaagcacgacgtcatcactgtcctggagcagcaggaaaactggtggtttggggaggtgcacggaggaagaggatggttccccaagtcttatgtcaagctcattcctgggaatgaagtacagcgaggagagtaagcaccccgtgttcttatgtgagctgacgctggtgtccttaccacatgagcactctgcagaggatgactcctgctgtgaaaacgcttacttcacctttgtctctgttttggctctttcagtctacttttcaaaacactcaggtttagatctttgttttctttttaccataggaccaatgagagtcctcactattcatttcacttgaagcatttctccattgttcactgaaatctttcaatatttaatgcattctttacttagatcttaccctttcaaattggagcaaacattcccatgcctgggcctccggggctctttaaatataatctccctattgttcagagcacttcttttagttactgacttttttgacccatattccctattaagtcacaagcccca

SEQ ID NO: 20936 - DNA, 1099 bp, Mus musculus
aagcgattattgatgttactgtctacatgttactggttaatagtcgtctcccacattggctattttggcatagaattttacttcttcctttgagtggaaagcaccctaaacataatagacattattataaattaatatgtgtgatagcacttagctgatatgagttttaatacagtattaaaccatatttgaaaatcaatgaacagtttatgcagtttaaaatgtttacaaattgccgtgcaatctactgtttgtgaaatgtcagataggtgtatatacaattagagtcctactcctcacagcattctttgagaaagtaaaccatgcttttatacctctcgctttaatttaaaggcatattttgtgcaatatttatgttaatgtgcctatatataatgaatgaattattacaatcgtgcattgcctaaatcatgacttgaggggaaaaaaacaacagtttagttacagttttacaaaacccaaatatctgtactggaaacattcacattcttgaggttattagatgtctgtgtgctccctgggtgggggttctgtagagtccttagaccacctccattttagcacttgccatcatgacagtattttacataacattcataggaaagcaataatttcaatttacagatgggtaagagaattgcctgcagtcactaaatgacaatgcaaagactgatttcaaactgacttttccacgttatatagatcacctgatttttctttttgtctcatcaacattctgcctttacctccttaaatgccacgtgtggccagctgctctctatgctgagctcagaaagccagccccactaactaactgcattgtttcataaagtaccttttttctttataatttttatttggggcttctctactatacttataaatttatccaaaagtatttttataggtcaaatcccttgacttcgccatcatgaaaagtagattatagccaagtgtggtggtgcacgcctttaatcccagtactcgagtggcagagacaggcagatctctgtgagtccgaggccagcctggtgtaccatgtgagtccaggatagccagggctctgttacacagagaa

SEQ ID NO: 20937 - DNA, 1113 bp, Mus musculus
caggccttccccacaggacgctccccgttctcaaggcccaagtagagctgtcttagggtttcactgcccccagacttcacttctccatcctctgaagtcaccactgactcctggggagcaggggatctgtgtcacgctgtgtcctctgttcataggacaggtcgtccgccagctcagtgccctaaaggatccttggaaagcatccttggcccccttggcaatgccagccccaccttcccagtgcaagccggcctcccctcccaacctcctccctcctagtgctcccagttcaggctggcctcccctcccgacctcctccctttcagtgctcccacttaggctccactgctgaagccgaagctctttgtgtgtttttattcaggttgcccttattttgttctgtgctcctgaaggtatgtgaaaattaccttttcctaattgaatactattttaaaagcttgctactgaaaaatcaatgattggatcatttcataaaacatataatcatctcctaatttatcaaaagtgcaaatcaaggttttcctgagtttctcgctgtgtgtgttctgcattctccatgggtacaatccttcagacacagttctgtgctgtgtgccaggccctgtggtgtgcatatcggggcctaccgagttagtaaggccaggctctgccttcagggaacaagggcattctccatcgtggagatatgagacactggggagtggaccactgcttgtagaccaggctaccccactgacgctgaggcaagaggcctcaaggttgtggccagccatcctgagaaacctaacaataccttgtctcaaaaaaattttattaaaaaaatctttaaaaagaaaaaagttgagaagactgcacatccccagaccacaggactcactcggtctccattagagcatctcaagagtctttctcaatagattaaacaggaaatcaacctgctcaccaagacaaaaggcttacatagaagtgaaatgttgatgagtggctcacactttgttatctgatgttgacattttaaccttgcagtttaaaaactctggcctaggtgtgatggcacacacctttagtcgccacgctggaggcagaggcagg

SEQ ID NO: 20938 - DNA, 1322 bp, Mus musculus
ctaaatgctactgcactctctcctgcctgggagtgtttagatcttaatgggaacaaagatatctgatgctcacatgatgtttattccccagacttcttgggtcgtactgaagttccagtggcaaaaatccgaacagaacaggaaagcaaaggccccaccacccgccgactactactgcacgaagtccccactggagaagtctgggtccgctttgacctgcaactttttgaacaaaaaactctcctttgagggcctggggaagccagaaccaggggagctgcccacaaggctgggtctaaagacagattttgctctcccaggacagaggagcatcacatggcttcatccatcaaacagccacactcgctgggcctgtattttattgcacactaaattgctagcaatctatgcaaacatgatcttttaaacaaacgccacagcacagtgccttgtactagtgttaacctgttcagctgtgttagatgccagggtttccattttcagggctataaaagtattatgtggaaatgaggcatcagaccaccggacgttaccacttggcaaatctgtccactgtggagttggtgatgttggaaccattccacactatgtgacctctgctgggtcacacactcaggaggtgaagggctgagatgaaatgctgcagccttggggcttgtgcagcctgatactgaaatagcatccacttgtgcactgaataaatagaaacttgatcgttttattctgactagatattatcattctctgctaagacaatatagtttgaaatattatagtttgaatataaggaggaaagcttgatgtactttaaatatactgtgaactctaataatgtggggatatttttcaactttaattttcttaagtataaattatttatgtaaattctttgttttgcatatttcatagaacatgcatctttaagctttatcattgccaacaatgtacagaaagagaataaaagtataagtttatgaatgtaatcctttcaaagcttgactctctatgtggaaggctttttaacagttactttcagaagttgcttataatgaaaccagaaggatggggtgaggtggggccaagagatctgcctgacccttctactcgcttgcccagggctttgtaggcatctctgtcaggtttctggggcttgatttcactggtggcttttgtgggtgggtgaagtgcataggagctatgcttggcctgtctgaaccaaaggggtgacccacaggaaggatgaagggcaaaggtcgggactctctgcacatctgttgctctgcacctccagggtctcgatc

SEQ ID NO: 20939 - DNA, 1170 bp, Mus musculus
cctagggctgcacagtgaacaccgagagccttcatcggcattactggctagcaggccatcagtcctaggtactgtccctgcgtcaagcctgaggagtttctctgagcagtgtgtgctggtctcacacggctttgattgggctcatgtgtatgcagctttgcccttagtctaagatattccacttcaaagcacattagcttaaaaatgacacgctcctttagcttatctagtcatagtgtttgttccctctgctattttttcaggttgatttcaaattacttacacttatttctgttgtctccaatcagttcttacagggctgagagtagagcccagcagtagagagagcacttggaacagaaggcttggatatgtcctttgtagttttaaaaattcagtgccaaaataaacaagacccagttacaggttcaaaaagactggaaattgttgatgcttaggtatctgtcttctcactgttgtgcagagggaatacacctgaaaccagaggaacagcctatgtggtctatgaggacatctttgatgctaagaatgcctgcgaccacctatcaggattcaacgtttgtaacagataccttgtggttttgtattacaatgctaaccgggtgagtgtagcccactctacagagaggctggtgctggggtggggttcctctaggctagtgctgctggtgggctgtgtagctcagtcccgttaactgtggggcttgtcatacttgtaggcatttcagaagatggacaccaagaagaaggaggagcagctgaaacttctcaaggaaaagtatggcatcaacacagatcctcccaagtgaatgacagccacgcgtggtcctggttacctgttctcttctcttcctttttaattagtactgaatattgtgatttcttatttgagaactagaatgacttatgtgaaagttttctagcattagaaaatataatgttaataaacttgtagcttttttctataatgtgtcttctgttaaacttctcacttctttttcctaatatcagtagaaaacaaatgaggagaaacacatgtaggttatagatgagctaaggactgaggtgcttgtgctggggacgctcggcctggggagcctggctgttagcagtgtaacctcagtggagtgctgtgttgctgtgagcaag

SEQ ID NO: 20940 - DNA, 3442 bp, Mus musculus
ctgccgagccttttagaaaactttgatagtttttatttttgagagactgagaaaaatgatggttgcaagtagacatgcagagtgggagacagaagtcaatgtgactaaacttgcggtttgagggcttctcaatcccttatgagggggttcagtcgtcacaagctaggagagtgacatggctctaagccagggtcagtgcatttttctcaacaggctattcagaaaaaaatacctatttttcaaatattagttagccaatatgacattaaatagctgtgtcattaatcttaatgtggtctaaattagcagagtattcaattagctaaatcagcatcagcattcaaatattatctccaaacagcagatatttatataaatgttagctatctcagtttttaaatagcaatacatcaaaatattatccatgccatattaaaagcatcaatgtagttattgcccgtgcttcatcctcggagcttttcagtttctacttgtgatggcaaaagatactcaaatactcatttggcaacagtatccaagatgtagactcttctcggaataaaattgtgtagcttagtataatatcaatactaatctatatacacagttttctataccttctacatgtaattttatggactgggaatgtagttcagtggtagggattatttgccatacatacatgagactagtttaaatccatcccagcactacaaaaaaatcctttcaatttgtaatgtaaaagcacacacaaaaaaaattcttcaaagctgggtggtggtagtggcaaagcaggcctttagtttaatcctagcactttggaggcagaggcaggaggatctctgagttcaaggacagcctgtcctacagagctaactaacttccagggttacacagagaaaccctgtctagaaaaaactatagaaaagttttcaaatctttactcatttaaaaggaactttgaaactgcccacaggtgtatgccctagctctagctcacaccaagctgagaggagaggagcccaggagtttggtcagcataagagacatagcaaaaccctgtctcttgatagtaacaaccttcccacccggagacatagatggctcagctgttaagaacactggctgcgccaggcggtggtggcgcacgcctttaatcccagcactcgggaggcagaggcaggtggatttgtgaggccagtctacaaagtgagttccaggacagccagggctacacagagaaaccctctctcgaaaaacaaacaaaaagcaaaacaaacaaacaaacaaacaaaaaaacactggctgccctggctgtagatccaggttcaatttccagcatacacatggcagtgcacagccatatgaaacttctgctacaagatatccaactccctcttctggcctctgtggtcactgcactcaagttatacgtagacatacacgcagacaaaatatcatgcatattaaactaataattttcaacgagtggaaagatttatagagaaaggtggtgttgtatttccttttctccaaaaatgtaatgtctaacaatgaagataaagattctcacctggctgggtgtggttgtacatgcctttaatcccagcgctctggaggcagaggcaggcggatttctgagttcaaggacagcctggtctacagagtgagttccaggacagccagggctatacagagaaaccctgtctcgaaaaaaaaaaacaaaacaaaaaacccacaaaagattcttacctgtttcacattcactgtgatgcagtgtcacctagcttatagtctctagaagacaacactccatttgtgggaatgaaaaagaaacatttaactatatgattagaaaagacagtttgacaaggggtcatttgggagtcctggccaaacatgggaattcacactgatcacaagcccttgagaggctgaggcaggaggattactgtgaagtcagggccagcttgggctacagaatgagagtctgtttcctgcccctgtcacaagcattgtgcgtcactgtctgagatgggtgacagctgcacttggaaccttgagtgactcgtaggtatttggtgtaaatgcaggaattctaccctcgcccgagtcggccccatatgcttcaccaaggacagagaatggctccacccaagtggtttccgcggttgagctttatccccttgcccagtttcctcaggctctgccttgcctcccatccgcccaggaggatggaaagtgtgaatgaggctttaaggaagactcaggaagaacaagagggagcctgtgtgcgtgtataactagatgtcctttctttcagcccttccttgtgcaatcctgttttaaagatgctttcttcccaggcttccatgccagacttctgtattttgggtgggctttgtgtaatagagaatgaaagagagcattttattttgccctttacctatgaaatcagcatgtatataatagaaaaattaaatatttgtcaataacatttacacaacactatcagagtcccttttagcaatataaacaattcattaacaagaaaggggatagtaaaatcaatggttttatttttcagatataggcaaaaacttttgattgttaatatgttcaggaatctctatggaaatgtttcatataggcctatcctgaaacctttctatttacatagttataattgacaaatggttctccatatttttatgaggaacctctcacaagaatgtttcttgtgtatctacaaataaggcctccagtctctaaccagaaggtaaagtgggggttcttgtgtgtccatgtagagtacttgccagggaaatgttccactaggaaggtaaagtgggggttcttgtgtgtccgtgtagagtacttgccagggaaatgttccactaggaaggtaaagtgggggttcttgtgtgtccgtgtagagtacttgccagggaaatgttccactaggaagaacaatcatcagcaataagttgcattttttaaaactgtgaaaatgttaatgtaaataatgtttgcaaagatttccttaaagataatcacctgataaatctttttacttgaaaattcaaaagttataaagttgctagcatatagactccttattacaggttgattttgaaaggataaattgccaagggaagcaaaatttaaagtaagtgaacatctcaggagtagaatacaggttgacccaagtcattgctccagaattgtcatagtccgttgtcttgttttgcagatgagatagacattgaaatacatatctgattgcacacatcataatttacgagttagattactatcactatcacagctaaaatagccgtacttcatcacgactcattcagcaaacctcatgatgtttccattcattgacaatgtagtagtatgtatttattttagtgccttaatatatttttgatgtatt

SEQ ID NO: 20941 - DNA, 1177 bp, Mus musculus
aaaaaagcaatacacaaatgaatagacaaacaccaaaccaacaataaaaaaggccccttttaggacaggcagcggtggttgtgtgcctttaatcccagcacatgggaggcagaggcagacagatctctgtgagttcaaggccaggctggtctacataggaagttccaggacagccaagactacacagaagaaaccctgtctccaaggggtgaggggtcgggtagggagggggaggtttctttttaggtcttctttctctttcagaagagatcttgctatgttgactaggttggccttgaacttctgccatagccctttcaataactaactatagaccatgtacctagtacctttagactgtaggaaaattggctgtaggcatcatgagggcaggcactttattttcctattaattcctccattcaggacctactccaacatgtgacataaacaagatgctcactgtatctgctaatggttgaatgaatagtaatttgacgagctggcctattttgtgaaatgaaaatccagtgctttaagaatagaggacatgcctgacacatatacagcagaggactgcctgttctggcctcagtgagagaagattcacctaaccctggagagacttgaggccccagggagtggagaggcctggtggggtgggggtgggagagaagaagtggaatgaggtactgtctgtggtagggcagcctggaaggcggtaatgactaactgtaaaaaaaagattaaagagaattacaaaacaaaacaaaacaaaaaaagaaaaaaaaatgaggacaagtgaaatgtagcccctacattaagaactatgaatgtatatgtgataggcgtatgagaaaacagagtgagttgcttctgacatagataagttcaattatagttctggattctaccttctgaatgttttgatggaattctttcatgttctctgttgttgagatgtagtttcaaaggagatccagtcttctgtgttgcttaggctgttcttgaatttgtactctatctcagcttcccagggagctgggatgctaagcgtacattaccttgactgatgtattctgcaagttgaggtcccattcacaatatagtctgcgtgagttgcccctcctggaattgtacagtgtcgttcttggatgttatgactattgaagtctcc

SEQ ID NO: 20942 - DNA, 1163 bp, Mus musculus
tacctaataaaaaaaataattaaaaaaaatcatttaaaagttattagtatagagcaggacctagtggctcatacctttaatcccagcacttgggaggcaaaggcaggtggatctctaacttcgaggtcatcctgtttacatcgcaagtttcaggccagtcagggctgtatagtgagaccttgggttcaattttctttgttataaaaagataacatatgtctgacaatagtactttttgggctgtgggacagcttgcagctgactctcctcatgatgtttctttttactgtgatgtctttgtttctgttgtttggtgtttgattctagatccttgtacccattagaaaacggacccagatcttgtacgcactcaactatattcctcagccctactgtgtgcttttaaatacttgctgcatgttgtactgtttgcttttatgttcattattaagaaaatactaagttaaattcaaaaatgaaaagtaatattaattttctctttataggcatatttgatgaggccttctataatattttttgatgaaatagatggcttagctcctgttcgttctagtagacaagatcagatccacaggtaatttttcctaaactgactgtattgattttcctttctccacttatcaacgtagtatttggcatttgcctttggttaaacacttgaagtcttataagaatttttaaatgtgtctatttcctgagttactttcattcaacacaggattaatttaaagtctgtagcaatttggctgcctttggtttgggccactgtaatagtcctgctgtgaatatttgtatttgtgattctgtgtgtatatttcactttttttctgggtagatcttaaaaatttttttaaaatatgttttaaattgccccccctcactctgtgtgtgtatgtgtgtgcgtgcgcgcacgcacgtgctcaggctgtcgtgcttggtagcaagctatcttctgcttagttatcttgccaaacttttaaaattttattcttttgaaacagagttctactgcgtagccatagcttgggattcaccaaaccgggttgtcctaaaaattgtaaaaacaacattcattcattcattcattcattctgagtgctcaagcagcagagcacattttcccatgatgtgtgcggcgatgt

SEQ ID NO: 20943 - DNA, 1151 bp, Mus musculus
aatgttgatcctgccaatccatgaacatgggagatccttccatcttctgagatcttctttaatttctttcttcagagacttgaagtttttatcatacagatctttcacttccttagttagagtcatgccgagatattttatattatttgtgactattgagaagggtgttgtttccctaatttctttctcagcctgtttattctttgtatagagaaaggacattgacttgtttgagtttattttatatccagctacttcaccgaagctgtttatcaggtttaggagttctctggtagaatttttggggtcacttatatatactatcatatcatctgcaaaaagtgatattttgacttcctcttttccaatttgtatccccttgatcttattttgttgtcggattgctctggctaatacttcaagtactatgttgaaaaggtagggagaaagtgggcagccttgtctagtccctgattttagtgggattgcttccagcttctctccatttactttgatgttggctactggtttgctttagattgcttttatcatgtttaggtatgggccttgaattcctgatcttccagaacttttatcatgaatgggtgttggatcttgtcaaatgctttttctgcatctaactagatgatcatgtggtttttgtctttgagtttgtttatataatggattacattgatggattttcgtatattaaaccatccctgcatccctggaataaaacctacttggtcagggtggatgattgctttaatgtgttcttggattcggttagtgagaattttattgaggatttttgcatcgatattcataagagaaattggtctgaagttctctatctttgttggatctttctgtggtttaggtatcagagtaatagtggcgtcataaaatgagttgggtagagtaccttctacttctatcttgtgaaaaagtttgtgcagaactggaattagatcttctttgaaggtctgatagaactctgcactaaacccgtctggtcctgggcttttttttggctgggagactatttataagtgcttctatttctttaggggatatgggactgtttagaacgtcaacttgaccctgattcaactttggtacctggtatctgtcaaaatttgtccatt

SEQ ID NO: 20944 - DNA, 1196 bp, Mus musculus
ttcaaaactctctcgctattgttggccagtgtatctcttagcagcaaatctattcaacgggcaacggtccatttctactgcttggtgttgagcttgcaggtctcgtccagcacctgtgaggcaaactcaggactggtttctttcctgtgcatccctttcaatggtaagagggctttggcagccacacacttcctgagacccgtttctgtgtttggtatgaaggtgtgagaggcacattttgctcatcaggtgaactcccttccagaggggaactctgctttcagagggaatggaaagagaggctctgtagtcccgaatgtctcatccctttcaatggctacataaataaactgcctaaggaaatcagaagagacttaagccaaacccaggccccgtaggtacagtgctacagacctccagaagaaggccagctattttgcttttgctagttgttttgctattatttgaatggtggtggctggagatgtggccaggcaggaggtgggcatggagttgtcttcttgtagccaggtactgctccatatgaccagcactggcatctaacacccccagttccactgtctagagatgggatgacatgccatgctctgcatctagggccctcagactctcggctgtcagtatctagaattatgtctggctgtttggcatgtgcaaatgtggaccaaacaagagttgtggtaaaggtgctgtagaagtcctgctgagttagaagctaatgtgaactgagccctctaaagcacacaatctcaactcccttgggggggggcacatatggccccatgcctgaaaaatacttgctctcagcaattgcatataacctgtctctacttagacagtcagaacttccagaccctcctgatagcctcagacaacccacgagggcggcagaaagcccttgcctggcttctcagtggatcaagtctgcaaggcagtgataggggtgggtgagtggctttccctgagacaggagtgaggtctgtgattcctcccaggggtgggggctgcggtggtggtgcagcagccatctgctttgaggattgtggacgccttgaggaatgagcctcacttttggagccagcctgtccatacagagtccactaatctgcacctctgtttagaaacgatgatccagttcagtgagaaggctgagcatgcaacgctgggattcctgg

SEQ ID NO: 20945 - DNA, 1190 bp, Mus musculus
gtccttttcgggagagggaagggcatctgtgtttatgttgcagtaattggcactaaatccaagtagaaatgggttagcattggattctccttttagttggaggcggtgtggctggattcctgacgttggatatggagtgcactgcagggctgggatacccagattctctggagtgggcattgggaaccttcaaaagtaaggagccactggggcttgggagggagcacccggttcctaaacaagtctgatgtggtactggctcagttttgaaaacgaagctttatccaaaagaatgtgttgtgttgcaaaatgccaacacacacagacttaaaaattcattccaattaggaatgatctggaaagtagaaagaatagttttctcccgagggtgagtgtgaaatggaggagtcaggtgaggaacaggatagggtctgccaggtttaggagtgtctagaaggtgccaagaggatttcctaaggggctgtcagggattcagtgtcctggggccaccagcatcagcccagaattcaaacccatttgccaggtcggcacagccccctccaaaaggcaaagagtgtttatgctttgctgtcaaatctgtggtagcctgtgtgtgtctttcactgtgttccttgctattttttttggcagcaagggggagtgaagccacaccaacacctttgtcagacctaaacacacagcctggacctgcagggctggaggaagcagggttccactcctacactgtggaatgagaaggtggcaagcctgtctcccatctccagaatttttgttctgcagagccctttgatttcttggtgccagttcatcctttggggccccctgtcagtggccagggaaacagaaacaagctgggctgcacctgttgagagtcagaggaccactttgacagcaccctaggttttccacttcgggctttaggggaggagttaactctgcactcgtcctgaatgccaaggcccatgacctttacaggtcgtttagttcttagtggatactcctgagagaaggaaggatggacatttagattcagctaatttatttaagtctcatctgagtccttttcattttgtaaagtttcctcccaaggggaaaataatccatgtataatttattcttaaaatgaagacttctctccttttagaatgtgaacttatatgactggggat

SEQ ID NO: 20946 - DNA, 1931 bp, Mus musculus
ggagggcatttgtgagcatgtcttgagatcagaggacagtgcccccaccaagggaaaggacatcttcttcatacttgtacccactggctctgccagctcagcatgggaagtggggcttatcctgagcctaggctgggctaaaggagaacatgggacaggccactctgaactctctacttagcatggctgctcgggcccccaaggtgtgttctgaggagaaagaccagctctccaggctgccctgacccaagtcccttctcaggctcttctggcttccaatgctaagaagaaaacgtagtcccagccttgcctttctagtgcacggagggcttccaggaccccaagccttctactccctttcccacgagagggcctggccagcccatggtccttggatgtggctttcaacaaagtaggtcttagcatctcccagagtttagcccatggggtttgaggctctgaggcctcgtctgccctcaggatctgaacttgctcgtcagcctttctccagtggagccaccagccaagctgtgcccagagcaaccctgtgccttccagtagatggtgttttgtggagcatagaatgttagaatgtattctgtgtgtcagggacttttttttttttaatgaaacacatttttttttaaaacaaaatgcagccactttgttccttgggtcagttgtgcttcacagaggcattagaagggcccagttgggtccaagagtcactttcaggagcccctgagtggcacagttcaattgtttgttgccttcagtatcttgggtccccagctcctactctgtagtaagacctacaggatcagactaggagtatcaagtctgacagcctttcatctcactgtgtcccctgtcacctgcctagttctgagcaggtgtccaagctgttctgtgtaaggaccggatactctgctctcctaggttaaggtccccagagctgaggactgactctagacagcctccacccaactctgcttccctttcaccagcaggccttcaccccctccatctcttggtgcctagaactcagcccagtgcccagaagccccttcctctctgactgcggaggaaggttcacgtggcccaatcttttgtagagccaccctactgtggtccctgggcatctttgaaccctagtccctttatatccattcctgtgtgccttggctaccagctctctacctctttcatacacaccttgcacctactttgggtgacagatgacataggagccaatgggtgtgtaggagcttggatgaccatggactgatccccacgtggggtccctaacagtatctgacctgacctaccactctctagtgtggctttgcccactagtggggacttgtctgctgtggagcttttgggacaccctggcatggttgtttgccccacagatagcatttttccaatcatgacttcttttgatcactggtctgtgacctacagccagtctgtctcccagttatccagtaaagtctgtgtgtgataaagccagaatttcagtgttgttcttttccatgcctgggctgagaggagaagtggtggtggtggtggtggtggtggtggtggtggtggtgttgtgtgtgtgtgtgtgtgtgtgtgtgtgtgtgttgaggggattgtcctttgtagccagggaaggtactcttatgtctctgactctgtgtgtttctctctctctctctctctctctctctctctctctctctctctctctgtgtgtgtgtgtgtgtctgtctgtctgtctgtctgtctgtctgtttccatgtctctgtctatttctatccccacctctctatctctgtctttctgtctgtctcttcctttctctctttgtgatggaggctgggatagtcccttgtaaccagggaaggtactctatgcctctgactctctgtgtttctgtctct

SEQ ID NO: 20947 - DNA, 1219 bp, Mus musculus
aatcactgtgcagagtccaggctagctgagtcaagcctgagtctcctgtcgtggcattacagatatgggccactgcttctagtttagccataggactgaaagaaactttaaagtatttacaatttgctttctttatttagttcataaaattatagaataatcacaggtacttacgtttttatgaccgtgttaacaaaaaccaagtcattttaaaactttctttgcaaaggtaatattgcttagtcctgatagtacttaatctgtacctaagtcaaattatgtaacaataaactactttaatttgtggtgttactgcttttcctgtaccgctatagttaaggttgacttagcccttctgttataaatccctaggttttttggcctttgctaaattagttcacttaacaagattaaattgttgttttattattacatacactacagggtagttttagactaccttttggtgcctttttttttctgttctattaagtattgagaatcaaacagattctttttcctcagggtactagagatgctgaaacagatggacctgagaaaggagatcaaaaaggcaaggcttctccatttgaggaggaccaaaacagagatcttaaacaagatgatgaggactctaaaataaatggcagaggtttgccaaatggaatggatgccgattgcaaagattttaagtaagatttttaactttttcaagaagaaaaatatttcttttaggagatattccagttagttgatgtgattgatttagatggtttttccaatttagggttacttgatttcctttgtgccttgtgttaatctggatggatttttaaaaaatagttaatcatcatgagtcattgaaaagtcttcacaatcatatctaaaacagtgtgttatgttagaagattaatgttagaagctgctatttttgtcttatgaactaaattagaactttttttttgttgctaattagtgacttacaggtttaacatgatttttcctctccccttgagttgtgcttgcatatcttgtagtggaatttttctttgtattgctatattaactactttttcatcccctgccatttggcttttttcatcttagatatatgaagcaaaattagtttagtaatcagtggttttcttatactatatgaattgtgctaaaacataattgcttcttcaaatatgaaatagctttttaagcttgaatttct

SEQ ID NO: 20948 - DNA, 1111 bp, Mus musculus
atcccagcacttgagaggcagaggcaggggagtttctgagtttgaggctagcctgctctacagagtgagttccaggacagagaaaccctgtctcaaaaaacaaaacaacaacaacaacaaaaagaatactgcaaagacagaattttcaatagtttttggcttttacctaatctgtgtgggcttatattaagctcagaaatcatagaagctttaaaagtaactctctttaaactctttcttgtttctctgttgttttgaggacaaaatccaaactacttaggatgaccaaaagtttaataaaacagctgatgttctaaatggggttattcagtaaaaatttaaacctttattgtatggggtcccaccccagattcagaattacaatggttgtgaagaaatgctttacattttcgtttattatttctcacccttttaaatatagctggtgtattctcagcaggccttgctccagctgcatttgtgccaaatccatatattattagtgctgctcctccagggactgacccgtatactgcagcaggattggctgcagcagcaacattagcaggtaacttgtttattctttgttgcttgttatgaacttggttttaatcttgatataaggttttttttggggggaggggtaatctatgagtaatttgaagttcttctgagaaactaatatattttccataataaactgaaatttgaagagagttcatttttcaattacacttacagggcagcaacaataactcttgtgtagttggtttatatttctagtttgtagtttagaaatcctacagtgtggaacctacaccttcattttaaataactgatcctaataatcaaaacaaagcgacattattttttcagaaataatttggaggtcgatgaaattcttggagagaatgtatatctaaaacatttcttaagtattacaagcaagctgggtgcaaacagtatggaaggaattttattgacaggtgctcttcaagccaaatgtgtattaattgcttatttaagttaagggaaacttgcgtgctagtcaggtgcagtcttactgacagactattttgatggtcttgtgtaaagtcattaggggtatttg

SEQ ID NO: 20949 - DNA, 1120 bp, Mus musculus
cttctgttttaagaaaataattcttttcataatctgtaagtaaaagacatgactgataaacacatttttaaaatacctcagatgtggtttttccatctgtattcagaggtttagtagtaataatgtgaaatcattgactaaacacgaatataagggaaagtattcatgttttatgttgtaaagtgttttcattaataaatactcattttaatgttatctaggctatcaagtactagctccaactgcctattatgatcagactggtgccttagtggttggccccggagcaagaactggccttggagctccagtacgattaatggctccaacacctgtcttaataagttcaacagcagcacaagctggtaagcatgactgacatttttagagattttaggtacttttctgagtagtttcaagaagtttctgaaattattttacagcagcagcagcagcagcagctggaggaactgcaaatagtcttacaggcagcacaaatggtctgtttcggccaattggcactcagccaccacagcagcagcagcagcagcagcaaccaagcactaacctgcagtctaattcattttatgggagcagctctttgactaacagctcccagagcagctctttattctctcatggacctggccaacctggaagtgcgtctcttggctttggaagtggtagctctttaggagctgctataggctcagctctcagtggatttggctcatcaggtaagtttgtttaaaaactttgctaagcatacttgaggtatttgaatttttaatataaagacaagcagtaataacatagtgtaggagggataggaataaagtatgaggcgttagtttaattttacagaattcctgtaaatctttcagtcatttataaatgtttagctcattctagcaagcccatactccccttcccccagcatttaaaaatttggtactctatattttgctaatcactatttcttccttattccccataatgttggaggagtttaatacatggccatcctaaaatttggataacttaaaaagaacaatagtcattattggatggtacagtcgtactaggtttgggtagctaattatggttttctgtatttggc

SEQ ID NO: 20950 - DNA, 2804 bp, Mus musculus
gtaggtctacaaccccatagcacaacaggtttatagagatgtatatagaattatagttcttatttttttcctttgtgtgaagccttttataacagattaacaatcaactgcataaatattattaatattttaaaaagaaagttaagttgtattttggtaattcacaaactatcatgcaaagaaaaactcagaaagacagaaaagaataaaatgatttgagataacattatttacagtggatgtggttttaataaaattactgccctataatgtccctgacaatgtacagaattgtatatacttataattgtaatgagttagaaacaaaatcatggtggcacttccatccagttaaaactgcactgaatgaaaagttaaatctcacactaacttttcaatttggtttgcaacaagaatggatggagatttatattttcttctaattatagaattactaggctgttgaggaagtgttggtttgttctgcgttttcatagtagatacataaagtaggaccccgatagaggtgagagaggccactgagaagtgaagtgatagctcagcatttacgcatgattgcatattcagagagcttttttcccttcctataaataaacgcattgtgtgtgtaggggtagatgtaagtgtagaatttgaaagcaaatcttgtttcagtgtttgttatggaagccttgctaatttcatagtgacgttccttggttgtacaggtgtacatttgtaaaccttcatgctgtaaatggaatctgttttctctcttcgggaaacatttgcatcttagtgtacatttccatccctgccccttaacctggcaatatagtgttgtataatgtaaatttatttctccaaatcgagagtgatttttacaaattttttatctttatatggtttcagaagtatgaaccagctttcttgttattattgtgggagacattttgttttataacatagttgttgactctgttaataacggacgtgctaggatctggatcactttcaattgaagtcagggtattgtgcataatgaacagaaagtattggactgagattgattaccacagaggccaatgctttttccatctttaaatgtgatgtgactttttttctttgtacagaagagtactgtatttttgaatagcctactcccaagtaagagcaaatctgtatgataacatttttttcctctggacataagtcattataacagtaacatgatgtacatttacaagcggccttatgtacatttcccaacaatctttttaaggcaaaattgtgaccatatgtgtataattaaaatcgtttttaatcctttgcctatgaaaatattttggaaaaaattgctttgtatattcagtttctgaaagataaagaaagtgctttgtattttgttgaagtcagtattttatataaactttatgttgacccacttatgttcagtgctaaaaactgaaaggaacatgctatttctggcagatgaatagtagaagggatttttttattcgaggtctgcagaagaaaaacaatcagagcacaatattgagtataaagattctatccttgtgttactcatatcatgaaccttaaaatttggcatgaagtttggggtgccaggagtctttaacattgatgctgagttactctagctttcaaacacaacattccttggtgaggccactaagtctggccatgtttcaccattctcagtcacactgcttcatcagcaggtccctgtcacagtagcagtattctcgctcatgtagaataattctcttctccccttttctactttgttttgccagtctcagagtatcttggccctgggttgaatttaacttcctctcatcagcccatagtttcggatcaaagttgttggtgttagagattagtaacagctcttcctgcagaaatgcagcccattctggtttgtcctcacccttccctttggatgccccggcagctgtcactcggctcagaaaagtggcaagtcctagagaaagttatttggaactgaatcctcctctagcagtcctgattcatacttcccagtgctgacaacccagtcctcctgatacttttaggcatattctagaaaaaacctgttcgtgtagaaaatttatgatctgccagttttggtgcccaccctgattccaccttctagtatgttggcatggaactttagaaaaatctgacaatacagaataaagacatctgattgggcagaatccacttaggctttaattcttgagtagtctctttttgatgtagattgtttctggaccagtttgtctaagtcctggctcttattggctcaaatgaaatgttatcttcactttgtatattatgtataaattagaaaatgaaacgtgtgaataacattgtatgaaataaacctggtcttgtgtttttctctagataaaatatccctctatatctctgtcaagagtgcctgattacatcacttcacacacacacacacacacacacgcacacacgcacgcacgcacgcacgcacgcacacacacacacacgtgtggcttgctttctgcataaacttgggactgttctaggaaaatgtatattgggttcaaacctgagtttaagacttaccttactatttccagactttggctgtcaacagcctgggtgccctagtgaactaaagatttacttaggtgttttatgtatatgagtgttccgtctgcacgtagatctgcatggcagaagagggcatcagatcacattacagattgttgtgagcccccatgtggttgctgggagttgaattc

SEQ ID NO: 20951 - DNA, 1730 bp, Mus musculus
gtcaattctactccaggccacctcctaggctgtccgtctagtctgggagagactaccactgaccccgtggagctactgatctgagcctgcctctgttcactccctaggtgtcattgccggaggcctagtgggcctcatctttgctgtgtgcctggtggctttcatgctgtaccggatgaagaagaaggacgaaggcagctactccttggaggagcccaaacaagccaatggcggtgcctaccagaaacccaccaagcaggaggagttctacgcctgatggggaaatagttctttctccccccacagcccctgccactcactaggctcccacttgcctcttctgtgaaaaacttcaagccctggcctccccaccactgggtcatgtcctctgcacccaggcccttccagctgttcctgcccgagcggtcccagggtgtgctgggaactgattcccctcctttgacttctgcctagaagcttgggtgcaaagggtttcttgcatctgatctttctaccacaaccacacctgtcgtccactcttctgacttggtttctccaaatgggaggagacccagctctggacagaaaggggacccgactgctttggacctagatggcctattgcggctggaggatcctgaggacaggagaggggcttcggctgaccagccatagcacttacccatagagaccgctagggttggccgtgctgtggtgggggatggaggcctgagctccttggaatccacttttcattgtggggaggtctactttagacaacttggttttgcacatattttctctaatttctctgttcagagccccagcagaccttattactggggtaaggcaagtctgttgactggtgtccctcacctcgcttccctaatctacattcaggagaccgaatcgggggttaataagactttttttgttttttgtttttgtttttaacctagaagaaccaaatctggacgccaaaacgtaggcttagtttgtgtgttgtctctgagtttgtcgctcatgcgtacaacagggtatggactatctgtatggtgccccatttttggcggcccgtaagtaggctggctagtccaggatactgtggaatagccacctcttgaccagtcatgcctgtgtgcatggactcagggccacggccttggcctgggccaccgtgacattggaagagcctgtgtgagaacttactcgaagttcacagtctaggagtggaggggaggagactgtagagttttgggggaggggtggcaagggtgcccaagcgtctcccacctttggtaccatctctagtcatccttcctcccggaagttgacaagacacatcttgagtatggctggcactggttcctccatcaagaaccaagttcaccttcagctcctgtggccccgcccccaggctggagtcagaaatgtttcccaaagagtgagtcttttgcttttggcaaaacgctacttaatccaatgggttctgtacagtagattttgcagatgtaataaactttaatataaaggagtcctatgaactctactgcttctgcttcttcttctctggactggtggtatagatatagccaccctttgcccaaaccctggtagctcggggaagcttggcttaaggctgcacgcctccaatcccccaaagggtaggatcctggctgggtccagggttcctctgatttatttggttttgttgtgttgtgttgtgtttt

SEQ ID NO: 20952 - DNA, 1594 bp, Mus musculus
tccattcccatccatccatcctatccatccactccatctacccgtccattcgtccatctcatttacccatccttccctgcatttcgttcgtccatctgtctatcttgtcttggccactgatctactgctgtgaagagacaccatgaacaaggcaacttttatttataaaaaaaagcattaatcgaggacttgcttacagttcagaggcttagtctattatcaaggcagggagcgtggcaggagtgcacagcagcactgaccgtgctagagagatagctgagagctacatcctgatcataggcaggcaggcagactgacagacagacactgactctgacatcaactttctcgggttttgtgcttctacttatgacataaagtctgaaagctgattatttttggaaagaatttaaagtgacattgtctgacgtgattcttttctctcttcagtatgttttgccaacctatgaaatggctgtgaagattcctgagaaagagccaccacctccttacctgcctgcctgaggacattctgccttgtcaataaagcctataccagcttctcgtcttgtttattttacagaaagctgcagtgcgggcctctcagacttgtttgatagaaagtacactgtcttgtctgagcatttattttcaaacactaaggagcttttggacatttattaaaaactttttgttaagtatcacattttagagactttttgaagacaatctagattaagcaagagccaagtgccattgttagcctttagctgagggtatgggggggaggggtctccatgttttcttttttaactttgcactttctttgtataataatagtttatgttttggatgtttggtgccctgagtagtttccggggcgtgactacagtgttgaggatgaataggttgggtataacacctgcagtttccagctctatgaaacaggagagagagagaaatagcagtttgacttgactgtggaagatgatggttgcatgcttctcatttgtacgtttccatctttgtgataaaccgctttaataaagctcataaattttaccattgtccttaaatgtgcctcatgtttatgctataacttagagcgatcctgtccttgtgacaggaatatgttaggagaagtgttgctgggtagtttctcatcttaaaatttttatttattttgttgtttcttatgtgatgaaagaaactggtgtactggtttctggatagagggatgatggaggagtaagaggagaggagtcggggggagtgaggctggagccctttaggcagaggaaggcggagtgatcccaccatataggagcaggagtacagcctagcatttcaagaagccaggacaggacatttaaagatggccagtcaaagtcccttagagtccctcagtaggctctcgagggtttgtacacactggcttgtggggtgcttcattgtgtcctcccaaccctaatttagcttccaaggattgacttgagggtgattaagccaggattcgatttcagacacttggatggctggtacactggaagtgcataatttcagggttgttttggaatcctgaaataatgccact

SEQ ID NO: 20953 - DNA, 1180 bp, Mus musculus
taattccagtttgcctcaaattcatcaagtgtgtaaggggtggagatggtcctatattctagtgacatttcccaaacactgatgtcattcattttaacctcatgaaatccctaaaagttttgcttacatttatttgctgttgggttcttagtcttctaactgttagcaacaacatctcagacagtttttttttaaaaaaaaaaaaactttgctaagttaaaaaaaattattgcagactagaaactaatgacttcagtcgggtgtggagaaaacagttggtattttccagtctccacctgtaaccagctttaggctgtgagctactggtaagctgaaaagcagcagacatcacttgcctcccacagcatgttttcctctctcccttcttatctacagaatcccacttatttccacagtgaggagtaatgcacagagatagaatgtcttactctcaagcatgttgtagcttgaagtagacaaggtgctatgagtgtgtcaaacttacaaagagatctgccacgtaggcaagggttgcctttgctgatttagaaggtttagctgggttgtgccttttatctgtcttcttctcccccccccccaacctggaacacagtgctcacatctcaaggtaaaagctactttggaaaataaataaataaataaataaataaataaaacctctaactataaagccatttccttgaactgcactgtttccaaactgcccatctccacgtctcttattctatgggggaaaatgatcacatacagggctgaagagaggactcagcagttaggaacactgtctgcttttccagaggacctggcttcaattctcagcacccatacggcagcaaacactgtaactccagctccagggaacaggatgccctcttctggcttcagcaggcgtcaggcacatacactgtgcacagacaggcaaaacaccgaaacacatagaaaataaggtaaaataaaaataaaacctaccatactgcacacgcacagaccccaaacaactccctgtcacacatctgggaacgagggagactctcctccccatgtccctctcagttcatcctgtcacctgcactgttgtacagaattgccaaactcagcctccttggaatcctgaaggccacctccaagggaaaaatttctgccgtcatgaagagtgccc

SEQ ID NO: 20954 - DNA, 1196 bp, Mus musculus
cttctcatcaagaacaccaactcttctcgggcataggcctatgattgtgtgcatcacctctggcagattttctcccccagaccactgaggttccaaactttgacctttctcctcttggctctttttttaaatctaaaacatatgcacagcctagtctcttcaatgaatatcttctacctgccttctaaagttgttgctaataatagtgtgacatcatgagggggggcagggttttgaaacccatataagcttctgaaaggcccattttgaacctctaccagtgcctatctcttggaaagatctggaatgtctaatacaaactacaggtcagagagccctcctttcaccacctcttgaaatgccagccagcccagaggatacactttctctgatagaagactcaaagaagagacacattctctctgatgcacaagctgcaggataggatgcagctacccagaatggaaagagatgatgaaggtatgagagatgtgaacaagcagggaagaatggggaccagattgtatcatcagcccttattgaaaaggagggctggcagcacccagagacggctggttcctttcttcccaagcagtcagtggaaaggcgaaaagaacctggtagggaggggccttccaagacatgagtctgccaacccctcccattgcagcccaacattctcagcccacatgtaaccttcagcccctgcccagaacactcagtgtgacaataataatagcagtcacaagaaaatgtaacctcgatcatactaacagcttttgaaaagtaaaatgctgtggatatgatttcaattaaaactcacattgtctgacttgtctctatgcacagccagagttcaccttctcctgccctcttacctcctctattcaaaacgtagccaacaggagagactgcttcaatgcatgctccaatcttgaggagacagggtctgtgtgctacacatcacttcccattccccagtctgctgtgctcccacagccctgggaatggcctttctgttaacctttcctcaaatcaatcataacatagaggaggaattgtgggtagagtttgagtttctcctcccccctcctctctctctctctctctccctctctctctccccttctgtatctgcctctttctctctccccctacccctcatatttttcttaatttatgaaagaacaattata

SEQ ID NO: 20955 - DNA, 1220 bp, Mus musculus
ggtgataggggaagagtacttcaaaacaggagaagtctcttctggggacaggttgtcactatggggccatgcctattcctggcagaaggtatggcgggtcacccacctgatgacacctgtgctttcagcaccagaaactggccttcttgatgttaggaggcttccagggaacaagaattcacctgcccttaagataccttacagttcagtctcggtgctggtgtttccagacttctgggccctatgtggccagcaacacggcttcctcaggggtggcctgaaaagtttaactacccatttgtccaagaaagcagctgatggttcagcatttgtgttcataaagcaagaatgaagatgatcataactcgtataacatccagtttcaactttatgactaatacatctgtcgctgaagattgagaaggaaaaagatacctgccacagaaaccattcaagtgagtacttcagtctgagccttaatctggattccacgaaaagagctgacctccccttcaggagcacctcaagcagatattccagaggaccttctcaatggtgccacattgcaagtggacatccaagggactatagatgcgagttgccccacccccacaagccctggtggaaggaacaggagggccagagctggatcaggtggggagcatccttagtccagaaggaagctccctggcccctggttccctgcttacctggtaggtgaggatgggatttatctctggcctccacttttgctacagcacatccaatcccacacccccggtggtatgaaagctgctttcctggagaggtggagtgggctgggcttgtataagtcccttttccctgctgccccatccccgggaccaggccatctcaatacggagaagtcagagccacggcacatgggcagtgtgatggcaccacagcccattacacatgcagggttactgaggaggagggtgaatgatgtattgacccagagtggcttgaactgagattgccatattatctgtccacttgttcacaaagcagccttcacgcgtgtcagtgagagttcagttcgatggacacacacgccagcgagcaggggcttcagtccaatgcactcttctcacgttttgttgaaataaacctccacatttgtaaaaaaaaaaaaaaaaaaaaaaaaaaagaaaatcagattctgtgcaaactgtgaacttgagcaatgatttgcagtt

SEQ ID NO: 20956 - DNA, 1259 bp, Mus musculus
agaccatggaggagtgctgattattggattgttccctagtgactcgctcagcctgctttgttatagaatacaggaccatcagtccaggagtgacaccaccgctactgtgctgggatgacctgtataagttattaattagaaaaaatgccttacagagttataggtcagtctgataggacattttctcagttggggtttttctctttccagataactctagtttgtgattagttgccagaagaaaacaaacaaacaaacaaacaaacaaaccagtcatcatagtttttatatgagtgccttatatctttctgattggatttgaagtttgaataaagaattcaggcagaacggtcacgtgggggctagccatgaaaatggcggcttcgggagagagtggtgcctcgggtggcggaggcagcacagaggaggcatttgtgaccttctacactgaggtgaaacaaatagagaagagagattcagttctaacatccaaaaatcaaatcgaaagattgactcgtcctggttcctcttactttaatctgaacccatttgaggttcttcagatagatcctgaagtgacagatgaagaaataaaaaagaggtttcgtcagttgtccatcttggtgcatcctgacaaaaaccaggacgatgctgacagagcaaagaaggcttttgaagctgtggacaaagcttacaagttgctactggattaggaacaaaagaagagggtcctggatgtaattcaggcaagaaaagaatacgtggaacacactgttaaagagtgaaacaacaacaacaacaacaacaacaacaacaactgaagaaggaaggaaaacctacagatgtggaggaagatgatcccgaactgttcaaacaggcagtctacaaacagaccatgaagctgtttgctgagctagagattaaaaggaaagagagagaagccaaagaaatgcatgagaggaagcgacagagagaagaggagatcgaagtccagaaaaaaagccaagcgagaaagagagtggcagaaaaactttgaggaaagtcgggattgtcgagtggacagttggcgaaatttccaggcaaatacaaaggggatgaaggagaagaagaattggaccttcctgcggccaccgaaagtcaagatggagcagcgggagtaagcagcaggaccacggccgggccaccctggccgagcctccccactgcctcctcctgcttcacggactcattcattctttctccacctccaccccaacata

SEQ ID NO: 20957 - DNA, 1161 bp, Mus musculus
tgggagagacgagtcttatgtatctagtcttgaactcttaatcccaatcctcctgtctcagtctcctgagtgcctcaattacaggcatgtgttacactcttggctcacatatttaaacataatgagaaaattgttttaaataccttcctttccttttgctcttttaaaatctaaagcaagaaaaagaacttgggaaaagaattgtagtcgattaaccaggcggcctgtagacgtgaagccattgtgaagagataacaaaagcagcaccgctcttgactcacgtacactataaaatggcttccctctcacttgctacttcatttagaccatgtgatctccagcacagcctttttcagtttgaaagtccccacctatttatttttatttgtttctatttagggttttagaaactttttagtcaagttcttctagggagtgatctctctgtaggacgatattacttaaatatttacttatcctgtgatctttttgtgggggatcacttttaggtgcttgcattcatctacgggaccctgaacttgctttggccattgaatcttgcttaaaaggacttctgcaagcctattgttgccataatcatgctgatgagagagtacttcagtctttgatgaaaaaattttatccaccagggacctctcggccacagataattgtgtctgagtttcgggatgaggtatatgatgtgagactcaggtaatcagataaatactggttttgcttaattatgtgcgcagttgaaaagatgtttcataggatgcttgcagaactgttttcttctaaaggggatgatagccaaaactcttttattatctctagctgaccactccattttatatagagaggtatgtgagcttggcacagtagtgtgcacctatagttccaattactcatgagataattttgaacgtaggacctagaaacctactgcaaagttgaaataaaataaatatatgagtccaaggttgcattttgaaattttctttccatctttacttttgtcaaaataatactatttctgattattttgtaattaccttattcatcttcaagtaaatttgtgtagaaacaattacctttggttctttttttttaaagattttatttattgttatatgtaagtacactgtagctgtcttcaga

SEQ ID NO: 20958 - DNA, 1287 bp, Mus musculus
gatggggggatgcagtgagcgagaacattaggccgacatactgatgtttacgtattagagatctgctaagattggtgatactggcaagatctctgcttgccattgttttttaaccctgtggtacaactgtagatttggatacagtttctaatcactacacttcatcagttataagatcttctccactagacacttttatgcagccttgaagcactgccaactgtgacaagtgctttctcctttgtcctttaactatcctccttcaagaaggagcttagcatggctgtgacagtttccactttggcctgtggcatggtggccaaattgtaaaagccctcagcttttggtgggtgcaaccactggggtggcagatgcaagaagatcacaagttcaaggccagcctggatagcttggcctccggcttaaaatgaaagtgaaattgaggcctgaaaatacagcttagttgtcgagcagggctggagaaagcgggaaggcgagtgcctgtggtcaggtagaggagctagtggctattgagtcaaaatatacatctcatgtgagatgatataagctacaccctgaacttagagacattaaaatgtccacaatgatcagtttcctgtaaaaaaaaaaaatggtatttgtgaatttaattttttttttaaaagaaaacagtgtatttgtgcctatgttctgtttcatactagggttaggactagcctttaaactttgaatagcctcaagaagcattccttttattaccagcaataaattagaatacatatttatgaacttaaaaaggaagtattttaagaaaagtactatttttaaaagctagtataattctatagttattgatgaaaactgagttttgttttggtggggaagagaatgtattcttagaatacaatagttgccaaaaatccaaaagcatttctactctaagaatatagaaggagaaaactgttgttttaaactttcctcaccaaccataagcagtataactcctttgtatcagaactattttaacataacatacattttttcaaataaataaaaatgaagtgagaccagtgcattaattttaattagtgaagaagtttgagtattttgagtttttgtggtagttttaaatgtgcttctacagaatgagaaatgcagccctcagatcctgagcatctcctgccgaagacaatgcattatgggaaatgaaaccctcagatccgagcatctcctgctgaagacagtattattgctttggcctcagaaagctttggtttcaatcataag

SEQ ID NO: 20959 - DNA, 1232 bp, Mus musculus
atttgcttggtctttttgaggaagtgttccttgtatcagaggttaaactcctattcttcatgcctctacctccaaagtcctgggtacatactgcttttaatatgagtgtcatttttccttattattctatcatacaatacatccagactgcagcttcccctcctttaactcatcctgtttctcccatcagctcccttctccagatacacttccctccctagtttccttccatagaagagcaggtctccaggaacactaatcaaacacatggcacaacaacttacagtaagaccaggcacaaaccctcacagcaagactggacctttaaaaagagggaaacatggcctgagagatgactcagtgttaagaacactttttgttcttgcaggacccactacccaaataatagctcatagtgatccacaactccagtttgaggaggactaacaccaccttctgacttctgtgggcacaacaaggctcacatatggtacataaacattcatagaagcaagacacttaagctttcttttccgagtaaccgccaagattgctgaagtggagcagaagaagaagcggacctaccatggcgtagacctcgaccaactgctcgacatgtcctatgagcagctgatgcagctgtacagcgcccgccagaggtggcgcctgaaccgtggtcttcggtggaagcagcactcactgctcaagcgcttgagaaaggccaagaaggaagcgccacccatggagaagcccgaggtggtgaagacgcacctgagggacatgatcatcctgcccgagatggtgggtagcatggtgggcatgtacaacggcaagaccttaaactaggtggagatcaaaccagagatgattggccactacctgggcgagttctccatcacctacaaacccgtgaagcaaggccggcctgggattggtgccatccactcctcccgattcatccccctcaagtagccgaggccaataaagactggttttggtcccgggggtcggggggaagaagcaagacacttacatacaaaaaattaaataaataaatctaaaagaatttaaaaggaaacaagaggaagccacagagaagatgggatgaaaagataagcatagagagagtcatttatacaccaaggagttagacctagaacaaagcctttcttcttgggaacaagcaaaatggcctataccaacactctggttttaaagagctggtctagaac

SEQ ID NO: 20960 - DNA, 1139 bp, Mus musculus
tttacataatttaatacagattgatgttaatacttgtgtatttacataaccatttccttcttgtcactgaaatatatggacctgaatttgtatcctgactgattcaacccagccgagcataaattgacttgagcgccttacctttgatgtctgaagcgaaactcctttcaccaagggccagattcggaaacttcaaccttggctgctggagtcctgtagtgatacctgtaacaatcagaaattcttaatcgcttgtggtatggttttaattctagatgttttatctctctgggagtatagtttatagaaacacaaagtacttgatttcctgtgtcggctcagatacaagaaacacacacaactgttaccctgacagagaacagagagagaagatccaagataagaaaactgcatgtggagagcggcgcacaagagttctgagttcagcacgtcccccaccctcttcctgccgcctgcaaacctcacgtgcagcttttctatatgcacgtgttttattaatctgaatattctccttctgtctcggtttgtgtccctttcattcccttttagtatttgcaagaggaaaattgtctgtgttttaatcagctaatgaggaggctatgggatggacagagggcttcttgcaggagaattgagaaaagtgactatcttaagaatattatttctttttttaaaaaagaatattagagagaaagagagagagagagagttggcataaggacagtcttatctgtgtcaaccctctgcctgcagggacagataaatggaactctggttgtgatatcataactaagatcagtcacctcccaggagtctgcagagttctaggtacaccacccgtcttaatatgggagctcccattctgtatcaaaatggactgttcatatcagagctgagaactaaagcacttcgttcattatcagaaaactggaggaatttagagagaggaaatctacgatttctaattacctggagtcagcccccactagtctgagtacttcggcaaattcactttttgtctcaccttcatcatatggctcagtggttaagagtacctgttgctgttgcagaggacctggattggattcccagcacccactcagtggcccacaactatc

SEQ ID NO: 20961 - DNA, 1431 bp, Mus musculus
acgccctacaggccaacgagcaccagctcctgctggaaaaggagaaactgcaggcgaggcagcagcagttgctaaagaagatcgaacacgctcggacttgctaaacgtttcccacacggacagtcactgccactttgcacattttgatttttttttttttttaaacaaacattgtgttgacattaagaatgttggtttactttcaaattggtcccctgtcgagtctggatctgggtagggggcaggacacggggttctgccatgaccttggaaaaaaaactgacttatgggatgctgggtggcttgttttcctcctccatatcacctggtgacagccgtggaagttcgggacactaaggagcttcaggaggctgtgaagtcaccttgttccggtccaagattccaaacagagtcattccttctttttacaatggtgcttaagttccagcaaatgccacagaagggggggttgccatttgatgcccctgggaacacttgtgtaaataccattgatacacccgccttttgtatacgtcctgggtaatgagaggtggctcttgcggccagtattagactggaagttcacacctaagtactgtaagaatacctcaatgtttgaggggcatgttttgtatacaaatatattgttaatctgttatgtactgtactaattcctacacggcctgtatactttagtatgacgctgatacataactaaatttgatacttatattttcgtatgaaaatgagttgtggaagttttgagtagatattactttatcactttttgaactaagaaacttttgtaaagaaattttactatatatatatattcctttttttcctagcctgtttcttccttgtttactgtatttgttcatgtttggtgcatagaactgggtaaaatggcaaagttctgtgtttaatttcttcaaaatgtatatatttagtgctgcaccttagagcactttgaaatacctcatgtttatgaaaataaatagcaattaaatgatgcaaggcgatgttttccttcctagcttggctgcagtctctgcacacagtccattccttacccggacttttaacattgtggaatcctggttagggagggtacttgtagagggataaatgggtttgtgaattccacagattagaaccaactactttcaataggcaatcaatgggtgttaaagctctttcaaatattttgttttgggtgtgagtgtgcccacaatgtcacatcccctgcaactggagttcaagtctaggaacaaggcagaggccctgcgcaacagtaacaagtgactcacccctgagccatctgtcaccccttcatttttgaggcctctttgggtctctagctgggattataggtgtgtgccccccatatctagttaccaaaacactttcacatactcgaactctcaaagc

SEQ ID NO: 20962 - DNA, 1089 bp, Mus musculus
tctctttccccagaatgtttccgaattcttttgattcagggtatactaaaggagtgggagatgtgggcatcgaggcaactagtagtgaggcttgattactgatttatattgaaattcttgatttaaaaacttaaagctcaaggttctgaagataacttgtctgttggcaagtttttactgctggaaacaatatttgaagtgataaaattgggagcagggcttcctgacaagtgcttcaagcatgccacttacattgctcctggtttgtatgttcgtgcaggtggaaactacaaaggccatgtggatgtcctggcacctaccgttcaagagttggctgcccttgaaaaggaagcacagacctctttcctacaccttggctaccttcccaaccagctgttccgaaccttctgacgtcatgtagacagaggagcattggagtcataaagtctgtagtcttaactctaaccctctggtgctgctctctgagcagcagtatttacaataaccgagctatcacggctaactctcgcatgtcaggaaacacagaccttagcgattctccataaaatggcagcccaatgaaaataaacttgacaactatattttcatgaaggcttgtgtcttcttttaaagttatacttgttttttttttttttttttcttttaagaacactgtgggcttgtgaaatatagtttatggatgtacaaatgtgaccctggacccatatcaaacccagactgaatatcttttgagtgaaattttccacaggagtgatgctacgctgaagtgattttcagatatttcaggctgtctaggtacattatgaagctggaggagagctgtaaaacaaaagccaaggacctcaaggtggtttggaaactaggagggtgcttggaaattcagtatggattgatgactaatgctggtgacagggtgtctctgaatttttttcaagaacctttctttgcagttgattcacagaaggacaaaatgactttgctgtgtctctgtgttcgaaaatcagttaatttctgtcctttgattaaaataacctcaaggagaaatttcgagacataattgaattgctc

SEQ ID NO: 20963 - DNA, 1225 bp, Mus musculus
ttagttgttacagataaccgtcagatagtctcagtggctctttctgtagagccctgggtgcttagagtctagtgggtgctgctgcttgtgcaaaggggaagtagcatcggctgttgactgtcaggcacctttgtagggttgtttctgaaaacgttgcccttgttttatccataggaaacatttgagagggagagacttttgagagaagggagtgaataacaatttgtggcctttgatttaaaacaaaaaacaaaaaaacaaaccttcctagagggagagatggcatggtttgtgtgagagagtcaggactgacagcctgccaaggtcacactgttagttactacatggaggcagggattagatgtgttctgggttccctgactactattctgtgttctcttatcatccattgttagtgtgaatctcaaaacaaaataaatattttttaaaaactagtgtgatagaaagctgactgttataaaagttggtctgaatgttcgttttcctgtctctaggtgattgtttgctctgctactctgcattcttttgatgtaaagaagctatcggagaagataatgcattttcccacatgggtcgatttgaaaggagaagattctgttccagatactgtgcatcatgtcgttgtccctgtgaaccccaaaactgacaagctttgggaaaggctggggaagaaccacattcgagtaagcgctgcgaggtgtggacactggtgagctagtctcctcaggccgagtcattccttagcatcctcatgccttctttatctctgcctctcaacagactgatgatgtacacgcaaaggataacacaagacctggtgctaacagtccaggtaagatgaaagagtgagtagaaagtgttacatagcttggaaatgattggtttgtttctgtgcctagtgttctcttgaaagatgggagatatgacctacaaagttagaatggggaaaatagaagtaataagaataatcacgagatggggcaagctcgtaccacttagcttagaggagtagtgttaaccactgaacgtaggtgttagttgtgtggcctcaggatcataagccttctggattgttgatgtagatgatggaaaactagcaaatctgtctagaaacaaatttatattgaccctgaaattccagaaaaataaagatgaaggatgctgggggttgggggtgtctttatgaaatggtgaaagacaaata

SEQ ID NO: 20964 - DNA, 1192 bp, Mus musculus
aaatcttcattttaatttctctggttttgtttgtttatttgttttaaaggaaaagatcttggtctggcatttgaaataccagcacatataaaaaaccaagccctcttccctgcctgtgttttgaaggtaattagaagttttactgctgctatgaggcccccaacatagatagcatacacagcagaggactgccgggtctgggtttactcagagaagatctacccatccctcaaaagcctggaggccccagggagtttagaggtctgctggggtaaaggggaagggtggggaaatccttgtggagacgggtgtggggagggggtatgggatgtggaacagtcagaggttcgactattccaggagaggaataaaatctgaactttaaagaaagaaatgaagaaagaatgaacattaaaaaagaagaagaagttttgctgtaatctaaactgtttgatttttcattatttttgttttactgggcagtttgccattaggttaaacttttgttttcttttattcaatgctagaatgctgaattgaaatttaactttggtgaagaagaatttaagtttccaccaaaagatggttttgttgctctttccaaggccccagataattacatcgtcaaatctcagcacacaggtatttgttgcagcagagagggtgggggtttctggactaggactagtgcgtaggacttctcttagtgagtcccttttgcctcctgctctggtttaaccaacctcattggttaacagattaatgaacttcagtttgaaaacttaattgatgaactacttttgtgtctgttaaggctcttaagctacctcagtcttgatggcagtgatatgcttggttcctgtgcttgtgaaatgccatagcagaatgctaagtgctttccatggattgtttagtcttcacacagcaccctgagaaagaactcttcatattttacaggggcctgaagaacaaggtgtacctggtctttgctacttgtagggttttcttttttccactctctataccccacccctgtttctctcccttacattaaagaggagaaaaagaagggtacaggggagagatcactgaccctaagctcctcagcagccactcaccctgtctctggggcgctctcatttatgcatcttctgaaaagtgcccaaaactccagatgttacagaattacaga

SEQ ID NO: 20965 - DNA, 1144 bp, Mus musculus
tttctttccagtatagacaaaagctaaatctttatttacataagcacctgtctgactggtgtatgatgtaaaacttgatcgcttagagccctgatactagccaagcgcacactgggtatttgtttgcttctcgaagtcagggcagcaaagtgtggtgaataggccccatgccatcccttagtacccttgtttcacagcactggagtatggccttctagaccagtgtgtgggggccatgaggctattattccagcaaaaccctctagggtctgtgctcatctttcctggatttgttggtgtgtattcttgtcctaacagtgacagtgtagaccctggtcaccagcatagccaaagagatggtagggataaagaagaagaactgctgtcatcttggagtcaacaagaacattctaacaagtaacaagattattagaatgaatggcttttgttttataaaggatggtttgtaaaacctgtactgactcccatttctgtacgcttgttctccaatgcagcaattggatcagatggtctgtgttgtcagagcagagaagtgaaggagtggcatggatgcagaggaactagaggactgctgaaaggtacttggccagtgctcatgtccgtctacgtgttgaaactgtcactatggatttcccgcaggagctttaaagcaaagacctgaacagtcttaatgacacagaaagatccacaggtcttctgtcacatacaaatgtaacacagtggaagttggtatatgagtcatgcatatgcaatttgtgtaaatttcatggaacttgacctttacagggaagcactactatgaggtgtcctgtcatgaccaagggctatgcagagttgggtggtctaccatgcaggcttccttagacctaggtaagtgtttctaaaaaacctgaactgctttatatttataggatgttagcatattaattgagagacaaactaataggctttactgtaatttaattttatggacaaaaaaaccctttatctgtacctcacctggttcaggaaagacttgaaatgagatactgcgtgctccctgttagcacctgcgccccatgttctgacaatgtgaaatcggggtgtttgggtttttttgctatgaagacacaccatgacccca

SEQ ID NO: 20966 - DNA, 1186 bp, Mus musculus
cctgaggtggccatccttgtgctccatgactagagtgtgcttgctggttgtgccactgcattgtggttctccaactgagtgggacagcagtgcagtgcagggaatgcttacatggaatgcagatgggaaacggtaggctctacagtttgtgatactacttcaggaattttatagatgtttgtaattgaaacgcagaattcagatgtttgggttagagatgttatttttaatgtcactgcctttataattcactgtgttatttgttacttgcatctgctttgtctggaatgggccataaattgaagagtccgattttagtagatgaagcttgtgggttacaaatgatcctttttagctgattctgtaattaaagtgtgatttcatcatttcatagaattattaaatacctcaaaagtctgcaagctacagaaaaatcaagatttgtttctttggctgattaatggcactgtttaatattctattgaaagtggtactgggatatggagaaactgacttttagtccaacatgctttcttttccctagctccagcaaaaaattattcctgatgaggaccagctgatggccatagcgctcgaatgcatctataactgtgaacgaagtgaccagctctccctctgctatgacatcctagaatgcctcccacaaagggggtgtgggtaaggagccctggaagccaggctcacccaggcttcttagtctagtagtaaaagaaaggcactgcttttctaagtgttcatcagcagagaactttgagactataagaaagacaaaagtctgggagatagcttaatggtggggtgagtgctctatattcacgtggccttgagtccaccccagcccttcaaaatataaaggggagccatatagagataaaattaaaattgttatcttggtgtctggagatagattccactgtaattataatttctgatatcattccgtcagtgtgatcctcacatactgagtagtaagaaccccagcactgcaaggagaatctctgatcgtctacagcactgacctcttggttcttaaattgggctttagttttctttttctttcttatctttgcttgtatttattctgtgaattcttccttcttagtctgtgtttagtagttctttccttggacaacaggtagctgtcattctctctccctttgcagtc

SEQ ID NO: 20967 - DNA, 1147 bp, Mus musculus
agtgcattcagtcctgcaccatgagtctccatagtctttttaaaaaaaaacaattctttttattagatattttcatttatatttcaaatgctattctgaaagttccctatacccttcccctctcgccctgctctccaacccacccactcctgcttcctgacccaggcatttcccagaattggggcatataatcttggaaagaccaagggtctctcctcccagtgatggctgactaggccatcttctgctacatatgcagctagagtcacgagctctgggggtactggttagttcatattgttgttccgcctatagggttgcagaccccttcagctccttgggtacttcctctagctcctccattgggggccctgtgtttgatccaatagatgactgtgagcatccacttctgtatttgccaggcactggcataacctcacaagagacagatatatcagggtcctttcagcaaaatcttgctggcatatgcaatagtgtctgcatttggaggctgattatgggatggatccccaggtggggcagtccctggatggtctttccatctgtcccagctccaaacttagtctctgtaactttctccatggatgttttgttccccattctaaggaggaatgaagtatccacactttgatcttccttcttgattcatgtgttttgcaaattgtatcttgggtattctaaatttctgtgagtacatatcatgtgagttcttttgtgattgggttacctcactcagtacttacagtattcaaagtgctaagttccaagtgcctctgtaatgctcaaggtacttcttagctctaggatccatgaaaataaaagcaacatgcacacttgctcttttcagtggcactcaggtaaatatgcctgttccagatgagaacgggagacaaggaaggggagaccattgtattcagactgataatagaggtgtcacagtcatggtgaacccaagttacagccacatgctcacttctgtgtcacttgtgactaacccagtacaacaacttaggatagaagggtgaccttcgctcacagttttgcatccacagttgatatgtgtcgggtataaaacaaccaaaatgtcaaggcagttatgagtgtgtggcagaggctgagctcctca

SEQ ID NO: 20968 - DNA, 1328 bp, Mus musculus
aataactgcatacctacagaacagcttatatatttcatgcaatctcacttgtcaatttgtgggattatcatctgcattaggaaggaggtccttgccaatacctatatgatggtctgctttcctgtgctttcctccatttcagagtttaaggtcattggtcgattctgaattaattcttggggtaccctgtgacttccaggcagcacacgaggtccactggccccagctcgggcgaccacctgtctgggacgtgttgactcatctcccatgaccctgcggtgcctggagccctccgggaatggagcggacaggacgcggagccagtgggggaccgcggggttgccggaggaacagtcccccgaggcggcacgtctggcgaaagccctgcgcgagctcagtcaaacaggatggtactggggaagtatgactgttaatgaagccaaagagaaattaaaagaggctccagaaggaactttcttgattagagatagttcgcattcagactacctactaactatattcgttaagacgtcagctggaccgactaacctgcggattgagtaccaagatgggaaattcagattggattctatcatatgcgtcaagtccaagcttaaacagtttgacagtgtggttcatctgattgactactatgtccagatgtgcaaggataaacggacaggcccagaagccccacggaatgggactgttcacctgtacctgaccaaacctctgtatacatcagcacccactctgcagcatttctgtcgactcgccattaacaaatgtaccggtacgatctggggactgcctttaccaacaagactaaaagattacttggaagaatataaattccaggtataagtatttctctctctttttcgtttttttaaaaaaaaaaaaaaaacacatgcctcatatagactatctccgaatgcagctatgtgaaagagaacccagaggccccccccttactgcttttagtattctatctttatttagtgcgtttgatgttctgattattatgtgtcgggaggaatttcttttctggtccagtctatttggagttctgtaggcttcttgtatgttcatgggcatctctttctttagatttgggaagttttcttcaataattttgttgaagatgtttgctggtcctttaagttgaaaatcatcattctcatccactcctattatccgtaggtttggtcttctcattgtgtcttgcatttcctggatattttgagttaggatctttttgcattttctattttctttgattgttgtgccgatgttctctatggaatcttctgcacctgagattctct

SEQ ID NO: 20969 - DNA, 1100 bp, Mus musculus
gttatgaactcattaatttatttttgagacgtgttctctcactacccaggatctcaccaggttaacttgtttgcttggacagcaagccgtggagattggcttgattctgtctcttgagtactgagattaaaatatattgcaattggttgtttcccagtagttctagagatcaaatccatctcagagagactgactagttctcttttaatttatctccggttttctgtaaacaatcagcattttctttatttaaggtatttttctagaatttacatatatgtctttgtaaagattacattttatcttcttaacttccatctcaatgctcattcagggtatttctaatttttttcctaattaaacataagtaaactaaaaatggattaaccaaagtcaattagactgttgggggcaattggactcatgtaaatttctcacccatcatttttagaatattttctcacgaggagtgactgtgaactgttgtctgggaattacaatggtggactctgttctgttgcttctctagttgtcaggtcatttattggttgacagaaatagattgtggccatagaagttggaatctgctaaggagtgtgtaacaacttatttgctgaatatattttcatgtggggaagggtcatatgagatggctcagaagtaaatgtggttgggagaatagcaacaaaacaattttaaaaataattcggaatctattgccctcaacttgtgagaaatcctttcttcccatgaaagatgaaaaatcacaaaaggatatggaccattctagaggctaagcaattacaacatacatgctgcatcaccagtacagaatcctctcactcaagaataaaggagccttctccatcaaactgggcaaaaccatttttgtttataatatttctgactgaagctgattttttaacaacttgaaagataatgttagtcattcccaaaacttatttgcctctcatctctgctcatcaccctcatcatctatttcatctattaaaaatatcctggttcagcatacatatgctatatatcccagtcctagctcaaacaacatctctagttatttttttcctttcataaatact

SEQ ID NO: 20970 - DNA, 1171 bp, Mus musculus
tatctctaatgatccatatttacctcacaatgcaaaacccactgtctttaaacttttcatcttaaaagtctaaaatttcttaactgttagcttctataatataaaatatcttttaaaaaatattttcaacctatatagacagataataaacatttccagttcaaaatgattagaaggattataaagtcaaggttcgccatgaaagaacttctaatggttctaaaactgactctgaggaggaggaggaagagggaggaggaggaagaggaggaggaggaggagaaggaggaggaggaggaggaggaggaggaggaggaggaggaggaggaggaggaggaggaggaggaggaggaggagaagcagcagaaggagcagaggagcctggctgctcatcctgggttcaagcggcaccaccactcagaagactgtggtggaggtcctcggtccctgtccagggggctcccttgtaaaaaaaaaaaaaaaagcagcctcggagggcagcagtgaaaagacagtttcagacacaaagccttctgtacctaccacttcagaaggtgggcctgagctggagttacaaatccctgaactgcctcttgacaacaacgaattttgggtccatgacggttgtattctctgggccaatggaatctacctggtttgtggcaggctctatggcctgcagggagcgctggaaatcaccagagagatgaaatgctcccactaccaggaggctggaactactttgggctgctacaacacaggctgctccttctgacaccattacccatgtgccattgatgcagattgtttgctgcatgaggagaatttctcggtgaggtgccccaagcacaaggttggaatgacagagaacttacttgacataggcctgaggcctagctacctcctctgagccatgtttcacgcaacgaaacacagtctctgcaagtgtcacctcctgaagaacatgagctgcttcatcttgaagatggattttaaggtgagactgtagagatgagaaggtggaggacacatgtaacagaatcctcctgctgtgcaaccacaccccactctgccctgtcctgcacccccgctgcgctgtgcgcactgcccatgccaacacttccttcctatgttctcacatcacactcaaactggtgataccacaggaaaa

SEQ ID NO: 20971 - DNA, 1154 bp, Mus musculus
tttactgtcactgggctgctgttgtgagcatcctagccagatccttaggcttatagccgtcatgaatgcattaaaagttaagtgtgatagacagtccaaagagcctcattctgtggatgtcacactctgatcttctagaatctccgaatcactcatttttcttagttttttttccccccacagtctaagggaaagaaaaaaaagtaataatttgagcaatgttctttaagctgatagaaggttgctgtgaactgtctcagaacaatgtgaaaaatgaaaagtattttgctaaaagagttgctttactttgaaagtattatttttcttaaagggtgttttactccaaagacagatctttctatttaaatttcattgttagggtcagaggagacaggaacaaaaaaaaaaaaaaaaaaaggaaaagatagaaagaagagttaaaaaagaaaaaaagcagtagaatggactgttactctttctgtgaaagaaaacctagagtcactgcccttgtagtcactgggctctgttaaggtctcatgtggtccacatagttcacaggaatgtaatgaaagccactgtcatctgctgtgggcgcccactgatggagaaactcggccctgagtgtgtggctccctctgggagtcaggaaagccattaagctcctggcttgttctctcgtgacctttggaggccatggtaacccttctgccaccacggtggttttgtgtgtattttgattgctgtggactgtatacgagctcactggcctgcagaggttcacggccgtctccctcatgcccaggggaagctctggcatctcttttcaaatgccctctgcagcccgctgtccaggtggctccctgatgccatgttaggacttgagccagagtctctatagccaaggctggtctacaatgcaccatcttagacatacagcagtccttccacctggcttgggaacctagttttgatataccttaaacttccctgtcactctaccctgaaacagagcacacctcccacaaaaccacactctatgatctctgtgaaaatcttcaggagccctgtccaggcagtgatgtggacgtctactgttaggctccctgtgagatccaaatgagagctgcaccccggttctctcaagttgcttattt

SEQ ID NO: 20972 - DNA, 1120 bp, Mus musculus
caaggcaggattgatgtcagatctgcactgtgataagaacaagaccctgtacctgttcactgtgactgtagttgtcctgctccttcagagctgtgacttgtcttcggttcctcccccgtggcctgcacatggcctctgtggcaggcagatgcccctgactgtgctgtccgtcccttgtacctctgcgcaggctgtctgttcttcacgatgccaggcttggcataccctgtctcccctgctcacttccagggaattcctaaggctagaatggctctggttaggcagagatagtgtacccttccccagcctgaagtgcagcccagagtctggcattgcccttcatgtatcaggtacgactccgtgggcagtgacctcactgttcctttaccttccaggtacgtgcggctctgcgaagtggtcgatcacgtcttcccattgctaaagagaagccattcctgtgacttcccctgttcagacactttcagtaacttcaccttttggagagagccactgccaccttttgaaaaccaggacatgcattcagcctcagcttgacgcgaccgagcattaaaggataggttgtggggaccctggagctgctgggaaggctgatatgtggccacctgcctaagagagaagcatttctccctcggctcgctcgctcgctcgctcgctcgccccagggtgacacttctaagcatggagggcggagagaggctgcatctcatcccataggctgcaagaggattgggtgcactaggagtgtgcagagcagccctctgtttgggtttagcacacctcatgctgcaccctccagtcccgtctgctccagcaattagttaatgtgcaatacgggtgatgaccccttatcagcgggcaggccacctgagagcctgtctcagtatcactgtgcccctaccccctggaactctgatgtgcatagggatcagtagcatcagggacacatttccacgacagagacatccatgccaccttctgcacacaggctgtgtcccgagtctaagtgaagggaacatgggcctcgctgggtctcagccctagccttggctttgactttttagacgttcccttgcagtattgccgactgtctcactttagg

SEQ ID NO: 20973 - DNA, 1188 bp, Mus musculus
caccgaggactggcaaagggatgctgccctccgtttaatccacactgctggattcaggcgctcctgcttccctggaatgcctttccccttgtcccggagctccatgtgaacctgagaacggaactgcagctcctctgggcacaagtgaccttcccgaagttctgccaagaacctagggagggcaaagaccctgttttcttgtgggacaggctcacccctgctagggagaaaactggttgcttcttgggtggcagacagatcctgggcatgataatggtttgtggcctctaaaggaccatagttttaagtgtcatggtgggtggaggataggttgttaacttgccaagctgtttggggatgtggatatagtcaagccagctaagcaacatggtggctatggtgtccttgggctagcctaccggatgctgtatgtttacttgtagtttagaatggaagtgagtgtaccctgggactgtggcatgcgctgccatccttgtcagacacctgtcttggttccagtttgctcagggtcatcttgagaataaggcagccgcaagtcataagctagggctgagctatcatgcttgatcctagctgggactgactggaaatgctcatctaccagaggatagggtctacttgcttagagatcagaccttccattaggtaccaaatacttagccatatatatgtatatgtgtgtgtgtgtgtgtatatgtgtgtgtgtgtgtgtatgtgtgtatatatatatatatataatgcttatgtttatgtatatatgtgtatataagtacatatatgtatataagtatatatttataagcatataagtatatgtaagtatatatatatgcatgtgtgaatgtatgtatatatataaatatgtatatgtatgtagttttatattagacatgttgttttaatttcttttcctattgttgtaataaaatgccctgacaaaagcaacatgcatgcacacatgcacacaaacacaagtacaaaaaaacctttgcaaaaaaatcaaattaacttaaaagattttattcgacccacatttcacagagtaatccatttaaaaacattaatgagatattttaaatattgttttcataataaaccttttaggtcagtgatccattctttggacccagcagacaactatctacacctctctaagatgcctggaac

SEQ ID NO: 20974 - DNA, 1234 bp, Mus musculus
ctgtagagatggcgcagctcttaagagctctaactgttcttccagaggtcctgagttcaattcccagcaaccacatggtggctcacaaccatctgtaaagggatctgatgccctcttctggtgtgtctgaagagagtgacagtgtagttacatacattaaataaataaataaataaataaataaatctttttaaaaaatagatcctattcttacttaagcacaataggaattgatcaagtaactatattgttagttgtgtgtgtgtgtgttttttttcttttctatcttttaaacagatacttaggaacaaaggagaatgaattaattaaatcaggttatctcttacaaactaacctagtagattattaatgttcatagagtgagcgacatgcaccccacacatacaacacatataacactgatgtttcagacaaaaagagatgttttcccccgtagtaaacatttcttgaaaattgcctgctaaatatagtatcttattgttttaaagcatggttagcttaaagagtctgagggaaaatggtcattaccaaggcttttagaatgcagtttctcatttgctgtggacatgaccataaagaaaaattcccatgagggttttcatatgctacttgactagcagttaacctgttgggaacatgtgggggggggggagaatctgaggggatttatttagctgaaatgtgatagttgcttatttgactttaattaaaaggtatatttcctgaaatttgggcccttacatatgttctccctggtaagtgtcatacttctgctctggaggctcacctggaaacagggtattacatgcatctacttggctaagggtcagtttgttttgcagctagttgttaacagcattgcagcaccatcattctccttatgcaattaaagtattcatttttgtttgtttttttataaatcctcaggttcgtcataaggcatcacagaaggtttatgcaatgaagcttcttagtaaatttgaaatgataaaaagatcagattctgcttttttctgggaagaaagagatattatggcctttgccaacagtccctgggtagttcaggtaagcataataactttttgtgttaaggtgcctattcagaagactgttttgtgtgctttgttcacatagtaaaaagtgtaattattttttactagacctgattcagtatgcttgtttagtgtttcttggtggaatagctatatagaca

SEQ ID NO: 20975 - DNA, 1185 bp, Mus musculus
ttcatgtatgtatatacatatgagttgagcctcatatagatatgtacacacatacacataaaacacattgtactgtaatactgcaaggttttttttaacttaccattttattttttatacacattaatcagctatcattatttcagttgcaactatgcacttgtataaagccataatgttggagtttatatccttcattcatgtacctaataaggagttgcatgtttgtgtaaaaaaaaaaataactgtaacaagaagtttgaagttaattattccagtttcctaatgcttaaggtaggcagctttacccattttgaatgccttaatttaattttctctccccccaaatctcagcccttttctatatttaactaaagaaagaacaagtgtttaccagctcttaggatgcagcttgctttgtggggaaagtagtgcacaattttatgtgtagtagttatatcagtgttggcctatttgatgtatattggtttttaatgtacttggtcatagaaacaataatggattctattgaaactaatgtgtgtgatgtacctctgttactgttttcatccctttttgcagactttagcaggtctgtgactatagaatatttcctttgctttgaactttctggttaccttagatgtgtttttatttatggtaaagataatttttcatgttttcattcaatattcaaaaattgtctcaaatataaggaaaactaacatgtactgtgtagatatattttaaatatttaaatgtgatcctaaaaaaaaatctgtgtgtggcaatatttcagctttgatatctgggaagaggcagcttcaaaagtgcttaatttgattttcactgttaaatgctgctgagggtagagaacaggtaggacctatcctgccatgctactggcccaggtaagtgtgcttaaccccacagcagagtgcagcagtgagcagcatcaggctctgtacatatgcaaagttcaatatgacattgaaatgtttgcctgatattttagtgaaaccagtagacatttttgattgcttccttctagggtcagtgtagagatgttgtaaaaactttgatcctcgctatagttactattgtggaaatagtggctgttggcccactgatatactaaatccagttctgtgaccttcagatggcccagtttgcatctttcatgct

SEQ ID NO: 20976 - DNA, 1211 bp, Mus musculus
atagcccaagctatcctccaacctgtgatcctccagcagccttttgagcactgggagtgctggacaagagtggaccactcttgactttgacaactcaaatgatggaacctgcccaagaggccatcttcacccttaaagtcatgattatattccccgaagagccagctacagctacactgtggctttcagaatattaagtagtcttcccacagtgagtggggtctgctcagtaacaagtggaactgttcacacctgggcagtttaactcttccataaacataatgcagtataacatcctctcaagctaagcagggctagcaaagtatgcagagatggaactgggttcatataccaagcagtcgtccaacacagtgtgccttactaaacagagccccatctgtttagacgaggaaatctcaactgtctctctatttaagcacaatcccaccattttttaaagggctatatctcacaattaccactgttggaactttgtataagttttagttactggaaggtatacatacagtaaaaagtattgctaagtcctagccaattcttaggtattttattcatactaaagtaagaatatcctaagcatatcctaaacactgttgtctgcagaacttcctctgatgttttataaatccagcctttaaaagctcagtttcttcttctaagtgaatgtcattactctggtatactgcaagaaagtaaatgaagtttactgaaaaatgtttagttttctatatttaataaactttaatttgttgaacgcccccgaattcttaagctgtcatgaattttcagttaggtaggtataactcactagcaagccagctaatcttgtttaggtcaattgccttggacccggaggagagaaatactacatctaaacataaatcattctatggttatttcaaccagttcatctttcctcacatatactgacaatcagaccgttaacttgttaattaatttaatataacctgtagtctttactacaagtgttttccatatattcaatcaggacttttatcactacttaaagcaattcctttaaataaaaacaaaaaaaatcaaccaaaccaaaaaactaaccaaccaacccccaaaactttcccctttagttacccaagctggcttcagactcatctttctgccttcatctcttcaatgtattttaccagcatgcatccccatcactggcc

SEQ ID NO: 20977 - DNA, 1198 bp, Mus musculus
caatcaatttaacaaaataaagtttggaatgatactatatacagaataagtttggcaaatggttttcactgaatgctgagtccgcgaacaaaagaataaataaggtcccaaacacactgaagtcttaggactattctcccgacataaagggacagttcaaggaatgagagctggaaggggccacgagagaggcaaagaggaaaaagaatgaaagccaggaagaaatgaggaccccttagtcctgggttttttgttttgtttcagttaactcagaaaaaaattaggggaacaaggggtaccccgcaggaacagggccggaggtcccctgaccccgccccttcattccccgcccatcctcgccctgccccgccccgctccgctactccgctcgcccccacccccgaggaaaaaaaaacaaaccggtaacctctacccggccgctttcaattggccacgcacatgagcgaagtccacagagaccaatgaaaggcggccacggcgtggcgagcccttccggcccgcctccgcgcgccggcgcaccgcccgctagaagccgagggcgggacgtgggcgcggcagagccgaggcagcggcggcacggacagaatgcgggtgatcggcatggctcgcctggtgctcggtaagcgcgggcctgtggtgggaagccggtcggaggcagcctgaagggccggggccgcgaagcagggccgagtggagggacgagttgccgggcctgcctggggacttcgcggcgagctgggtgggagaggccaggtcgggcccactacgggaggccccggggagtcggagacttgcagcctctgctccccacgagtgcggtccgcctccggtccagctcagccttcacttttataggcagatagcagaggcctgtcccgaaggtgtcttagaagtgggcagtgcccactgaccaaggcctcacaactcctgagcacttaaaatgcctttggtcgtccacccaggtgtccgggaatgatgtttagcgactcgtgggcgaatctgaggggccctcatctcccggctgtccttgtaaatgggcctatagtttttgacattagttaactcagctgatcctggctagaaagtaggagagggaggtggatccctacaccacttctccctccatttactagttgagacccggagcatattttctcactgctctgccagctttttt

SEQ ID NO: 20978 - DNA, 1149 bp, Mus musculus
aaggctaaagtctgagggggtccttacaactgcactcagcctttacctgcgcacttgagtgttgaggttgtagtagtaggaagagaggtaacccttctgcatttcctcaggatgttgttaaagtcggggccgtcaatgcagacaaacatcagtccctgggaggtcagtatggtgtccagggatttcctaccatcaagatatttggagctaacaaaaacaagccagaagattatcagggtaaggattcttccctactccattcccctgtgcgcattcccttctcaaacagttagctggctcctgcagtattttaacgttttctgtaatggcatagagcacttaatatctcctccacgtttcgagcattagctcgtaggtaaaggtgtatgtgcttgaattatttagggtagtggagacccacacctttttacctccctgcctttttcattatagcttaattataatttaattatatttaaattattatatttatatttaattataattaaattaatatttgataaagatctgtttgcctcccttgactgtaagactagggtctggcgaaacatgcatggcttggctcataatctttatgccttgtgtacatatgcagttgactatgaaactgttgttagtgtcataaactattggcaataggtactccaaattctcccagttctagagatgcaaaacttgtgaaagtctgttaggagtcaccgaggcagctagaggagagttctggccctgaactctagggaattaatgctgctctcacactgcatggcaggctgtgatggctgagtggtgagcttattatgctcagcgcgtgcagggtcctccatcagtcgttagccacatacacacaaacagtatctaatgagaattgttgaattgcgacagattatggtcctaattaaagtgttgaatataatctttacagcaaatctggctgatggttgcttaggtgaacagaagtgcctgtgggctgagtaggagaatcacagttaaacacaggatggggagggccaagattacgaagtctgaagtaagctcaaggcagcagactcccatgactgccctccgtctcatgcttacgcctcacacagcacttaactgctctgccttgcttcttttctctgtaaacag

SEQ ID NO: 20979 - DNA, 3030 bp, Mus musculus
atagcagagtgtttgcctgtcacgtacacagcctgggaaaggagatgaaacaatcgtttaagctatctcgaatgatctggatttcagatatgaaaatgagcaacagttgtgtttacacagaatgctctgtcagagtctgcattcatccctgctgtggagtacttgagcgctccataaaatatagcaggtatagatcatatgttgtttaaatgtagcaggaattggttaagactgtttccaatcttccagtgcaatcctggtgaacgatgattttcatttgtttgctgatgaacaagtaaaaaacttgattgccttgtgaaatgattgttttgtcggtacttgtagtagaagtggcgttcatatttgtcatgttgctgtgacagggcagaggtgatagttcaagtaagaaagacgtggtagagctgacggatgacacctttgataagaatgtccttgacagtgaagacgtttggatggttgagttttatgctccgtggtgtggacactgcaaaaagtaagtgccttcagccgagcgtgtaactcggtcacaacacttccagtgtactcatagagctcgttcagtaagagctgtacatcatccctttggtgaagctaccacagtgtatttgaattgtgacataagacagggattaggctgtgcagctcagtctaaggacctgtgctgtgaggtcactgtttctacagcctggagccagaatgggctgctgcggctacagaagtaaaggagcaaacaaagggaaaagtgaaactggcagctgtggatgccaccatgaatcaggttctggccagccgatacggggtgagtgtgtctacagtcatttactttgaggaatactcaagattttcagcagccacttggctcctagcctccctttaaagtaggtagggagatgtttgttttgtaggtgaagaggtgatgtccctcactgtcaagtctagaacccaggacttgtgggttcgttcaccagcactcacctggcttttgaaagttgatcttcttgctctgcagtatgcacattgtgttattaagtacccagagcctgaacagggtttgcctgaatgccacaattcatgtgcgcttccagccgggaattttcccccgtcttggtgatttaagccaggactgacatatgctaggcaagtgatctaccactgagctgtggtccctactcttacatacttgcttttgaggaagtgtttcattgcccagagttgcctccaacttgtgggccttgcttcagcctcccaaataactggagttacagatgttaccatgcttggctggagcatgcttttacttttgtgatagtgaaatgtctatgaagtggttttagaaaccataaagattttggggcttgggtttttttttggggggggttctttatccaagttttcatttaaatattctggttgttatactttgatagattaaaggattccctacaatcaagatatttcagaaaggcgagtctcctgtggactatgatggtggtcggacgagatctgacatagtgtcaagggccctcgatttgttctctgataatgcccctcctccagagctgcttgaggtaaagtacttaccccagtagtgaggaagcttccggtcagctgatggcactaccccttgttcacatgaagtcttcgctttttacacagtttgactatgtagcccaggcgagccttgacttcacagcagtcttcctgcttctgccccacaaagcctgagattacagcatgcatccccagaaattgactctgtcctcctttttttaattgactgcttttcataactttctggcattaaaatacttacactgtgatctaaagctcactaagctgcttaaaagttaagagtggattcagtcacttgggctgttggatcacctggcatggccacggctctgccctggtgtttatgcaggcactttcagttcttacagccccaccaaaggggaacatcattctcgtctttgtagacttctggagaagcagacagccaagagccttacactgtaaatggccatgcacagatgtgtgttcagccgtggcaagccaggctaggtcagggcactgtaattacagactgctaggtggcttgggaatgagcggtggcactttgttccagctgattctagatggcgtgtctgtagtaggcggcattgtatggaaggagtctcttgagtgttcatgttgctcagcttttcaactgcactgtcttccgtgcagataatcaacgaagacatagccaagaagacatgcgaggagcaccagctctgtgtcgtggccgtactgcctcacatcctggacactggtgagcacaggctgtttctcattactgtcactgctggctgcttaaagcacttcctaagtgaactgatatttgataaaatatcaaaatactttattgtaaaccaggagctgcaggcagaaactcttacttggaagttcttctgaaactggctgacaagtacaagaagaagatgtgggggtgagttccgaagccccgctcacctctgagagaacgggtcaggcctggtgactgctgtgagtgctgtctgtagcgcgtgcccgtgtttgtctgctccttgcttaccagctctgagactcagggcgtgcaagtgtgacacgggaaggaaaacgcagtggacactctggtggaatctgagcacacctcgtgcaacgctcctttctgaaggtttaaatgtattttagtctagtacacaaagcatccttaccctaagaccagtctgctttcccaggtggctgtggacagaagctggagcccagtatgaactggagaacgcactagggattggagggttcgggtaccctgccatggcagccatcaatgcacgcaagatgaaatttgctcttctcaaggggtctttcagtgaacaaggcatcaatgagtttctcaggtaattgttttcttagttgtttgttttatctgttgggttttgctttcattgttctatgtaagccaggaaggatgtttgtaaaattgaactt

SEQ ID NO: 20980 - DNA, 1429 bp, Mus musculus
tgttctactaaaatcacaatttagaactggagaggtgcctcagcagttaagaactctggctactgtttcaataggaccagagttcaattcccagcaccatcataatggcttaaaactatgtgtaacttgagacctgatagggcacacagccatacatgcttgcaaaacattcatacacatacattttttaagaaatcacagtttaaagtgatttggttggtttcatgtctgtaattgaacatatgccacttgaaaggctgaggcagaaggatggccatgagtttgagaccagactaaactgggctaaagaatgaagtcctattttaaacagaaagcctaggtgaggtgcagtcagctgtgggagtcaggtggttggacctctgaatttctgtggggttataattggtgcaagagccaggctgggatgtggaatccggctggaatttgcttttctattgagacctcttgtattctgaggctctaactgccgctctgtgccccagctccctgtggaggacgacattgacctcagtgacgtggagctggatgacctggagaaggatgagttgtgagccacggcccagccttccttgggctttccttgggagcgagcagttttccagcagtgaaagttcttccgggcagctgtctgccgctggcctttctgagcagcacatgcggccactggaaactgccaacagtgaacctcagcgtctcaagaaaacactgacgaattctatgaattgtagcagtgaattggattgtattctctggcatactttgaagaaaactgggctattgaaacatttttccctcctgactgctgcttgaatgttcctggaggctgtttcttatgtatagggtttttaaaatgtgattcctttgtttgaatattaatggctttttccattaaagaataaaatgatattttggacaatgctgataaatgtatgaaattagtagcacattataaaaccagagtctgaggtttagcctaaaatctaccagcactgtgacctgctggctcacatctccaccttcctgtagaaatggctgtaagcggaaacgcagaccttttggtaaggatgtggttctgtgtagaaaacgtggtaccaagtgagaacagcatttcatgtcctggagtctgtctgcggcttcactattaggctcagggtttcagggtgtttcattaatctcccattaaaaaccccagtgggttgccaagttaacttcacataaaactcttgagagaaagtttggaattaacattagaacacaagaaaagactcaggactgagcactttattgtaacttaaaaaaataaatacactctaactaacgtctgtgattatcttctgagtcagaatcctgcaggactcggttgtctggcaaggtctgaggctgcagtgaaacaggctggccacctagt

SEQ ID NO: 20981 - DNA, 1150 bp, Mus musculus
tctatagaaggagagaaatggggatgtgttctcttagtcagtaaggcagccttcatgtagagctggcacgagtgacgggtgttaccagtagggagacttgagagcagtgtgggctctcactgctgccagcctcccatcatggaagtcttggttggagtagttgggttatctgtggattggttttcaccagcatccacctgctgctgagtttctgttgtcttaggaggctgatgctgcagtgctctgtagtgtttgctctgagtgatagtaaaatgaaggctgttcaaacaggaagctgctgttctcctctattgtcaaatgctcctcttcccagcctcacgcatgccgttttacccatcttcccacgtttttgtggctttataggtatttgtttgttgcatcagctgtgtgccaggcactgtgctagatgctgcagcacacaatacatagtatattagcattgcttcatcctcaggattaaaacgggaagaaaggtggtttcaggtctgcaccatgagctgtaggaggaggactctttgagagtgcctgggaggagagacccttcctccagagtgggctaggtgcctgtgagaaactcagtaaactacccagagtgactttggggagagactggagcttgagtctgtagactaggtggaaggatggggtgagccacagaatgggagtagcatcgcagccgcaggagagtgcctgtggagagcgcagggagagggtctcatggagcagagcaagtgccaattgggaagggtctggaagtgtgtgctagggaggcgtgagagcctggcccatcatgagcagcagagtgaggaagccagggctgccctttggaaaggttgtttgtctctacaaagagaatggcatgggatctaagctggaaacagctagaacaggctgtggcagtctccacgagggaaggcagtgctaggctatacttttcagcatcaggacttcggtaggtcctataaataaagaaacaaatctgactcagagttaatgtccacctgtgaagatgcaggtggactataagaaaatgttcctcttgctcgcacctccctgtcaagggtagtctcttccttctccccagggcgtacttactgtacttttgagcagctagtgccacatcgagagg

SEQ ID NO: 20982 - DNA, 1166 bp, Mus musculus
tttgtggggctgcaggggtggcttggcaattaaaaaccacactgttcttccagagggcctgagtttgatttccagcacccatgcagcgcagtcatgaccacctgtaacgcaacgctaggggctctgattctttcttcttgcctcgaaatgaatatgtcatctatatttttaaatgtaaaacaaacagatacgtttcatttttacttcatgagttgggtttaaactctctctcactcactctcgctctgtgtgtgtgtgtgtctgtctgtctgtctgtctctgtctctctctctctctttctcttctcattttgttttttgagacaggggtctatttagtaggcagtcttctcaggtgtggggtgtggccttgacagtactcgggtctttctgacctctgtggctcagctttgcaggaatggcttcggcaagttggctcccagaaccaacttgttacctccaactcaatttaataccaaaatttggaaacaaatgaaaagatataaacattgataaaaatataagttccatgaagctgagcacctaatgcagaaattgtttccgtgataatcttggcacatgctccctaagactcctgccagaaatgttaactggatctcatgaagaactgtctgtatgatctcattatgaggagcatacttcaggacgggaacctggacaattcagctggccccagccccagagaatgtccccatctgaaagtcaggaatggtagagttgagtcttctagataagtgcatcatgtgatccttaattcaatgtttaaaaaacaactttgtcagaaactctgtcctttaaaggatataatctagtggcttctcatgtacccagaatcatgttgtcaccaccgtctcactctcaggtccttcacaccaaaaggaagctccctgcctgccgcctctctcctcatcccaccagccactgtagcgcttggggctgcttctgagcattgcatgtaagtggaatgctctgatagctgcttcggggtttccctgtgctcagggtccggctctgctccctttccctttgtacggagtggtaggtttagttcactctgtgtgtacagcacccctcccccattgtcagctgctgagcatctttatgactgcatgcaggtagctgtgcctaaggcaggttctgtccatc

SEQ ID NO: 20983 - DNA, 1109 bp, Mus musculus
ccccttaaatcttgtcttctcccctgctgatgatcaggcatcatttcagatattggaaaggcctccatgaagtgaaaagttcaccctctactggaaacaggacattatcatgctgtaagaatggcttgggttagcccagccgtggtggcgcacgcctttgatcccagcacttgggaggcagaggcaggcggatttctgagttcgaggccagcctggtctacagagtgagttccaggacagccagagctacacagagaaaacctgtctggaaccccccccccccaaaaaaaagaatggtttggggttttttgttttgttttgttttgtttttttgtcatttgtttatttgagacttgagtcagggtttctccgtgtagctctgggtgtcctggaattcaatctgtggccttgaactcatagagatccacttgcctctgcctcctgagtgctgaagttaaagggatgcaccaccaggcccagccagagtgtctgtccccactgtcttctgcccctcaggactgagtcacatgatgactgctgagtggccctgtttatgtgcatgagtatgttggcaggctgactggcttgcttatattcctttgtatagtttttaagctatttttatatcaagggtataaattaataaataataagtgaacgctactggctatttgtttagcttatcacaaaattacgtagttattttctgatgaagtactatttgatacaggcagcgcctataaaaggagatgcttttctttggacattttctctgaggaagactcctgcctgtggaaatttaaaattcactttagcttccatactttggagtttctcatgtaaacaaatagaatgggagctcgttaggctgtacctatggtgagtccacaaggcaggacacattagttagcagtcagtgttgttggacccttgtctctttagcctgtgatgtgtactcaagaactttctgactgttggtacatgaatctgcacatgcgcatgcacgcacccacgtacccacgcgcacacacactcctacctctttattaactattaagcagatccctcctggggctgtgagcccctggtgccctctcttccctttctca

SEQ ID NO: 20984 - DNA, 1076 bp, Mus musculus
gggcgctcctcggggtttggcggcggcgcctccatgggtcaggccagccgggccaccgtgctgtgaggtgagcgggacgcgggagggatgtgcggccacgtgtcgcgaggcccggactgcggccgccggcaggggacacgtggcccgggaccggtgaccttgcgagccgccgccctgaaggcagctgctcctggacctcggctgcaagccctcggatccccccatgggagccctcttcgcgtcagccggactcagcgctccacttgcccgggtgatgatggagggcaagcccgcggcaggtgcaggggagcgcggccgcgagcagcggtcctgcagttagtttcctgctgctttctttagtttcactacgtgtacagagcagaggcgatgacccggagtggaagttggtagaccaaatttagtctgggagtcactgctaatgaatacccaccagctgtgacttggaattagaactccttgaatgacttagtggtttaggggaaaacgggttcccggctgtcccggaaaccctactcagaatcctcaataactggaaaaagtgtggggggcagagcctgtcaggaatgtctgggagaggacaaagaatgtagtggtttgttttattcaaacctaagatcgggcagactttgactgattggaattcttttctgttttaattggcttatatcttccagagttaccttcttgtgctaattgtctgacacgatttagctacttcccataccaaaatgtgttagtaacatttttctttcagatcttatctattatattatttaggcaaagctacagaaaggcaaaacagtatctcaaagcttttcgtgtttaaaccggaaggttgcctggaaaatacttaagacctaaaattacaaagttactgccaaagcccattcatcagttgtaaatgatatacaacgagttggctggctctcttctctagtcttaacttaggagaggtttaggcagctaacggaagttgacattgccaaaagtctcgttaaattaaggcttaacatgtttaaccatgcatggatttggatttatggcaggctcttccc

SEQ ID NO: 20985 - DNA, 1164 bp, Mus musculus
gtcctgttccttacacactgcataacatggctgctcccttctctccctcttagatcaccagtgtaatcaacccagctctggacaagtacttcccatcagactctggagtgagaatcatagctgagccaggcagatactatgtcgcatcagctttcacgcttgcagtcaacatcattgccaaaaaaaccgtgtggaaggagcagcccggctctgacggtatgtggtggcagggtgagtcatgtagggtaactggaagttgatatgctgggtggtaattagggtgatctgtttttctagatgaagatgagtcaaatgaacaaaccttcatgtattatgtgaatgatggagtatatggatcatttaactgcattctttatgatcatgcccatgtgaaggccctgctgcagaaggtaagttctgagcatgctctttagcagtgagaatggtggacaggattcggggctattaaagaacaatgtcttcttcattcagagacccaagccagacgagaagtattactcatccagcatctggggaccaacatgtgatggccttgatcggatcgtggagcgctgtaacctgcctgaaatgcatgtgggtgattggatgctgtttgagaacatgggtgcatacactgttgctgctgcttctactttcaatgggttccagaggccaaacatctactatgtaatgtcacggccaatgtggtgagtgagattggttttgcttgtttggtggtggaatatttgccaaccaggagccagaagctatccctggttctatccctggtgcatacatacacacatactatggggaaaacaatatgtgctgaaggggagggatcacttgagtgagggccttgatagaataataacttgcttgcctgtctcaagaaaaggactgaacttgtactttggtttttgtctttttgatataagaaattatttttgtaccttgatctaaatacagataaatggaagggagttctccaataatactgtttgcttacagattcttatactaggaaaggtcttagaactaaaagcaattagatcctttgcaactaaaatgttaattaatgcaactaaagtattcagctggcatttgtgacctgtggtgcattgggttgtttcctggtgatgtagtgacaagggtgaggtctca

SEQ ID NO: 20986 - DNA, 1176 bp, Mus musculus
ctgcaagtttagcttgtgttaaggcatttggggggaccatttaacttactgctagtttgggatgtctttgtgagagtagggttggcaccaatgcagtatggaaggctaggagatggggggtcacacttactgtgttcctatggaaactttgaatatttgtattacatggatttttattcacttttcagacatgatactaacgtgtgcccctcagctgctgagcaagcgtttgtagcttgtacattggcagaatgggccagaagcttatgttgtgacccattgtgaaaataaagtatcttgaaataactgggcatcagggaatgtttgcaagtatccttaaagaaggcaccaacatctgcacaggctgctgtgtcatggagagacccactgcctgtggatctgaaggttgggctagccccgcatagcacagaggagaggtggatggcacaaggctgtgccctctctgtacagcatcagtctgcttagcccatcccaagtgtgcagttggctgagaactttgttgcccagagtctgttggtgaggaatgtcacctgcctagtgaccggttggcatggccacttcctagggaggtcatctgaagtccttgcctgcagaaaccctgactgttccctcaacccttgactcccaattgcatcaccacctagtaacagttgggagtatcatacaacatcggcagtcaacttcctgtaataaattcaacaacagcaactactgtgttgtaaatctttaccctgaccttttagattatagtttacacacacacctattgcctccccaaagtatgccagactcttaaactagttagcattgaaaacctgtaggtcaggaggaagggcagtcatatcctgtgatcccagcactgggagacaccagtgtgggctacatataggctctatttcaagcagaagtggctgagtaaaactgctgacctgtcatggagagactcactgcctgtggatctgaaggttgaactacctgcacctcaacagctgcttcctctccagggtttcctttcccaggcacggggctttatttgctaagaactttcttgggagccacaaatagtggctggagttggaagatctgaagtgaagctgctgtgtcctatgctgtgccagtaggctcaggtggaaatgttatagggttgaaggctcc

SEQ ID NO: 20987 - DNA, 1154 bp, Mus musculus
gctgcctccttttgcatctctatgtctgcaatccttgtgtattcctcacccttaataataaaatacagaggataatggggcatcactgacaccagggtctaaggctggagctgctatgctgggtctttacttttttttttttatttcatttccttgcaacccttgggtggaacccaggctgggcaaggcctctctgttgaggtctagcaccagctcctctcattctctctgggatgacttgccctgaagaaagtcagacgacatgtggaagacaactcatgaagaagcagtgcctgtggaaagcctgagcctgccaggaagcttggaggcacatgtctgtccctcagaggataaccctgtggctggcgttagagcaaggctctgacctcgcctccttctccatctggcctaaagaggctatgatttcagggtctcccaaaaggaccaagtgcaggcaggtcctcacgaaggccctggctgtgtcctcatggcaccttggggtctgccctctgaggaccagtggcttgcagctgagcggcttaatctatattaaggtattgctgaccatcattgggctctgggaacagatttactatttttagcaaaagtcagggagtgtgataaatcctgttagtccacacaactgaggagaggggttgtttattttgaagagtggctttttaaaaacattagtcatggctgtcctataggaccctaatgtgtcaccccacttatctgagatgtcctgagtagacaaaagtagacccattggaatggtttctgtctaaatgctgacccaatgagttaattcatgttccctgccaggaccctgtggaacttcaagtctctggtttcagggccagcagagaaactgaggcaggaataatatagcctgcactttcctatgtaggctcatctttgtgattctcatctttaatgaaccattcttcctacttgccttacatggctgctatggcaaactttagggacatcatagcaacacagcataggttctaaatgctctatgtgtcacctccagggtggctagaacccaaaccagacaatgacaagtgtcagtggagatatggaggtatttgtgccttgctggtaggaatgggaaacagtgcagccgcattgagaagtagtttgatggt

SEQ ID NO: 20988 - DNA, 1190 bp, Mus musculus
taatggagaacaggggtaaattaacagtgatacagactgtccttggtaggctcctggacagctgtgtgcttgggatgtgggtggaggcatcagggtcctctggattcatatcctgcaggacttgtgggtgggtgggtgggtggtgtccaacaggcagccagttcttccgtagagacagagaaagtgtctttaggtgcctggctcatgggctatctcctcctgctttctccttatctatctatctatctatctatctatctatctatctatctatctatctatctatctatctatggacagtctttatgaccagcagtagagggtaccgggcacctccaggatgccaggctttgcctctcattggtagaatctccattgcagcagctgccagatgtgggtcctgctaccacggagcctgccagcctgtcagcttggtgtcctccacacgggaccggaaggatgactgggggatgggggggggtgggactacctcaggacatggcacactgacacaatatggtggctcagggctttccataggtcgttaagggtagccagctcatagggagaccttggttagtgactgtataggggctggtcaggagatggtgggtctaacatagaaaccaagtggctatcactcggagtctaccacctagttagaagccactgaggagtgggacccactctctcctcctttcttcccccaccttttgtttttgtttttggtttcttgacagggtctcctgtggcccaggctggctttgaattctctatgtagctaaggatggccttgaacttttgatccacctccctctacctctcaagtactaggagtataagcacgtatcagcacacctgctttatgtggatgtggtgggcgggtggttgagccacgagcgcgctacccactgaggtacactcctgaccttttcccagaatttcaatctgtgatcctaatgaccttcaaatagtgggaagggaggattcccagagaagagtctggaatagtccatcatctaactgcagttgacttaccagtcttgcagctttcgtttgctgggaaggtgatgtgatgggggagcctgctctgcattctgccctgaacttctgccactccacagcctgagcaaaaccaccagccccccacccccacccccgcccccacacttgtcagcaggggttagcag

SEQ ID NO: 20989 - DNA, 1185 bp, Mus musculus
agcgacccatccattgtccggttgctgcagtgtgatcccagcagtgctagccagttctgaggggaatgggcttttggacatttgtgagaaacacaggcttggcctgccatgttcagctttgcttgtaaaagtggattcctccgtgatctctcctgctctcccaggacctgggtccaggcagcaatcgcaccctcctgacctggccaactgtggcttcctcctcctccagttcaggctggctccttccaatggttcaagtgttctcggctgtagggctccttcctgcccacagagggcctggcggcccttaaggacaccagacaggacttttcagtatcttaccaagaccagctaatttattctatgatcccagatgactttgtgaggatgaaaaagatggagagtagacaggcaagcccttcctgtgcatggctccacctcccttgttcattttctctgaccaaagccgcttgcatgtatataccgtggtatccttacttttaatatatgagttatatgtacggtgagatggactataatgttcagcccctgtatttaatgcctctgactgcctttgaagcatggtcccctgtggcctgtgattccccccacccccaagtctggctgtgctgtgatatttatgcattcatgatttgcctgattccacaggagatacatgcatgcccagggctgtggacatctgcctccgtcctgtaaatgcaggtgtttctgtgtgctctgtccttcctgtcgattggtctggcatattaaaatgatcaaataaaccaaggtctgtgagtttcctgtgttgcagcattcaccctgttcatggtgaatcctgagcagaagtgggtccctcttctaactgccactatgtctaaatacattctatgcctgttctacaatatctgcctaatgccaagaaagccttgtgaaaatataggatgactgttcttggcaggtctgactgtgacacgctgcctccctccccactccttctgtggtttaatcagcaaggtagcaggaaagccaacttcaagagaaaggagtagggtcagcagcagcagcagtgagggggaagacctgggctctcattatcctcttctgtgatcatgcctatgtctggtccctaaaagtgcttccatcatgaagatgtttacctcttgtacccagaagtcatcagga

SEQ ID NO: 20990 - DNA, 1157 bp, Mus musculus
atgggtcctatccttcctgagggagctggttacaatattcaggcaaggcaacctctgaagaacaaacatgtcatgcttatgcagcaaggagagacctggccctgatagagccaaagaggatgtttggagtcggagagggacagagaagataataaagagacatgtagatgggtatgaacagcaacaccagcagcagatacatctgtaaggaactgaaatatcttccagcagttaatacatcttccagcagcagatacatcttccagcagttaatacatcttccagcagccagagatttcagaaagaggtgagggcaaagaacaagaacccgtgcctatggttcgtgagttacaggcatccttgtggcttttgaggctgcaggtgactctcggaaaccttgtgtcaccaacctgggtggagatggaagttgttgggtagaaatttagaagtcctcatttgcaatagaagtgtctgcctaggctcgagagccggatactgttgtcctgcggccgtgccgcttccagtctccagaccatgtctcacttagtcgagccgccgccgcccttgcacaacaacaacaacaactgtgaggaaggggagcagcccctgccgccgcccgctggcctcaacagttcctgggtggagctacccatgaacagcagcaatggcaatgagaatggaaatgggaagaatggggggctggagcacgttccttcctcatcttccatccgcaatggagacatggagaagatcctcctggatgcacagcatgagtcgggacagagcagctcaagaggcagttcacactgtgacagcccttcaccacaagaagatgggcagatcatgtttgatgttgagatgcataccagcagggaccacagctctcagtcagaagaagaagttgtagaaggagaaaaggaagttgaggctttgaagaaaagtgcagactgggtatcagactggtccagtagacccgaaaacatcccacccaaagagttccatttcagacaccctaaacgtgctgcgtctctaagcatgaggaagagtggagccatgaagaaagggggcattttctctgcagagttcctaaaagttttcatcccatctctcttcctttctcatgtgctggccttggggctcggcatctatattggaaa

SEQ ID NO: 20991 - DNA, 1146 bp, Mus musculus
aatagtgggacatttcaaaatgtctcttggttagtgatggagctctgttattacaattgagaacaaggaagactgagctgaatagtgtccagtgatgtgaaaattcacagtaccttgaattttgccttatttccaatactgcatcattcattattctggtattgtcttttaggctacacttgggaaaaccatcatattgaaagacattgtcaaagttcaagaagaaatgaaaggtaattttctcttgaaagcttatgcaattatgcctctaaggaaattttactatgatatggacgctctaaatcaaagcaggagtgtaaaatgtcaatacttgaagtgtaactattgttacaatatttttttaatatttattaatttattgtatataagtacacagtagctgtccgcagatactccagaaaagggcatcaaattttgttacagatggttatgagccactatgtggttgccagaatttgatctcaggaccttcggatgagcagtctgtgctctttaccactgagccatcacggcagccctaattatactattcttaaaaaaatgtactgcctagatatacttatctgatttatctatcaaagcattcctttaaaaaaaaaaagactaggaaacattgccttaagggatacctttattcaatttgtacctctactagagctatactgatctgacaatgtatatagacttacaagacttagatattgcacatcgaatagtaataaatatatatgcaaaaccttccgataagcaaataatccatgggaaagttggtgatactcatatctttatagtgaaattgatcatttgtttagggtacagtttatgagagtcaagagcgttgtcataggagaaaccttaattcatatattacaggtctatgaggaacaaaaagtcaaactgtgaatgcagtgtggaaacctttcatcttttactcttctattaatatatgtatcatgtgtcacaattgataaaagccatgttagcatagggatattgaaagaagcaatgtaccgctttctatcccagaactgtgagaaaattgtcagattctatctttggtagacattctgagtatgataaaagtttgcaatgaattggttttctaattttactgggaacttctcc

SEQ ID NO: 20992 - DNA, 1149 bp, Mus musculus
taatcctttctcagctaaagctttttgtaaatctctataacacaaaagcaaatcctgggggtcttttcccaccatcaaaacatcatctgtgaaatgaatgatgtaaatcataggccattgttgtctcacaggctgaatggcttgtgccacaaacttttgacataagggaggactattagccatgccctctgggagaactgtccattgatatctctttataggtaccttaaaatttatagaaggaccactaaaagcaaatctttaacaatcctttggatgcaaaggaatagtaaagaaacaatccttcagatctaccacaattttataatatcctttaggaaaggatactagggatggaagcccaggttgtaaaggtcccatagataccatggtctcattaacctttcttaaatcttgtaacaatctccatgtaccagatatttttcttgataattaaaattggtgtattccaaggggacagagattctactaaatgtcctgcctctagttgctcctgcacttgcgaagaagtggcttctattttttctttaggtaaagaccactgatccacccacactggaatatcattaagccattgaaatttatctgcctgggatacaggcaagatagtggccattgccgaaaatactccaaaccttttgtgtcagagtgaggtttaggatcttcaaaattcttaattccttgtcccttcttttttactccatgaccaggcaaaagtccctttctgagcgtctacttaatcactatctcattaggacggtacattataacgcttatctgtgacaagagatctcttccccatagagttacaggcaaatttgacataacatacggctgaatttgtcctgatttaccttccccatctctccaggttagcaatttggagcttcgttttgggttactagcataaccaattccttgaaggtgagtaagtgtataagtcaaaggccaagttgagggccaatcctgtcctctaataattgtttcatcagctccagtatctctatcaatccttcaaagctttttccattaaatgtcaatttaaggttaggtctctgattagtaatagattgaccccaattcacaccagaggagtcaaaaccaccttgtcctctctcattcttaaca

SEQ ID NO: 20993 - DNA, 1279 bp, Mus musculus
ccagcaccatgtctgtgagacttgttctgatgagagaagggagtgagcaggtggagtgggaggaggggattgggagacggggtggaggtggggagaggggagtagatgaccctgtgaaactgttgatggcacagaggtgtttgggatacactctctgcctatgcaggcctgcccttttccagcccacttgattcagctctgattgagggagggagactagaattcagggtcaggtacacctagcctgcatcctgcacccttcctagggctctataaccatgggcatgtcagtagaccctctgagctgtaggcttcatccctgttgtctgagttagggtttccattgctctgatgacacaccatggccacaagcaacttggggaagaaagggtttattcactcacagtttccacataacagttcatcatcaaaagcaatgagggcaggactcaaacagggcagcaacctgaaggcaggagctgatacagagaccatgaaagggttgctacttactggcttgctccccatggcttgctcagccttctttcttatagaactcagaatcactagcccagggttggaccacctacactgggctgggctctgctccatcaatcactagttaagaaaatacactctggtcaggcatggtggcacatgtctttaatcggagctcataggagacagcagactctctgtgagttcaaggctaacctggtctaaaaagtgagttctagaacagccaggctgttacatagaggaaccctgtttcaataaacaaaacaaaagggaggaaaggagggagagagggagggatgtagaaagacagggagagagagagacaaagagagagagagagagagagagagagagagagagagagagagagagagagagagagagaagaggagactggacattgtccattttccagagggttccagactttaaccagagcactggctaatcctaagtctcccacttccattcctcaggcaaaatgtccctggaagaattcaacaaaggtgccaagagcgaccatttattgtccggttgctgcagtgtgatcccagcagtgctagccagttctaagggaaatgggctttacacagttgtgagaaacacaggcttgacctgccatcttcagctttgcttgcaaaagtggttttctctgtgatttctcctgctctctagggacctgggtccagacagcacatcaaactcacctggtctggctggatgcagctccctcctctgtctgatccaatagatgtccctc

SEQ ID NO: 20994 - DNA, 1200 bp, Mus musculus
atctattcttctatttatctatttatcatctatatatcttcaatctatacatatatatatcacctacaaatctatatatctacatatctatacatatatatttatatatctatatatttatacacctatacatctatatatctgtccatatatcaataaatctagatagatagatacatctatctatatatattatctataaatctatatatctatatatatataattatatatataattctatccatctgtctatctataagtctatatgtttagcttgatgtagccttgtctaaaaggactgttatattctaggttttagacgttcaggctgagaggaaacagtatgagtaacatttgatctaataccagatcctcgactctggacccatattttatgataatttggggattatgattacatcattcctacctcctgtgatcaattagtaaacacatctaatgcctgcagctggcaagaagaaaggttgatggcatttcagttctcggcctcggtgtctttggaagagaccatgactgagagggaagaagaagcaggaataaggtcctatgggtggatgaattgggagagcatggccaggagggtgagcctgagagtatgagcagcctgggcagaatatgtcaagtgagccgggcgtggtggcactcgccttcaatcccagcacttgggaggcagaggcaggcggatttctgagttctaggccagcttggtctacaaagttgagttccaggacagccagggctatacagagaaaccctgtctcaaaaaaaaaaaaaaaaaaaagaatatgtcgagtgatatctcacagttctttgtaaagaagtagagaaattagcataggggaatggtatctgccccatgctggtgctttaatgcttataataattattattatttcttattttattttttcacattatcatttactacattattatatcatattatttaatattacttctttttattatttcatattatttattattttattatttgatagcattgtttcttattcttattatttcttattagtttattatcatttctttttctcttcttcgtattattattattatttcatacctctataatttatgtggtggtaagaaatccacaagtaatatttaccacaacaagttggatgcaaatcagcttgtgaccaatgactttttgaa

SEQ ID NO: 20995 - DNA, 1138 bp, Mus musculus
aagaccctcctgcatatcacatatttacattatgattcataaccatagcaaaattagagttatgaagtagcaatgaaaatgactttatagctggaggttcaccataacatgaggaactgtattaaggggttgcagctttaagaaggctgagaaccactgctgtaatggatggcactggacatacagaggatattgcttagccagcatggtggtagggtgtgataggaagccagacttggggtttcaggtatccacagctcaccttgtgtcttggccttgcaggtttagtctccactgccagctgccatgggcaagcagaacagcaaactgggtcctgaggtgctgcaggacctgcggaaaacagggagttcacccaccatgagcttcaggagtggtacaagggcttcctcaatgactgtcccactggccacctgactgtggacaatttcaagatctaggccaacttcttcccctacagagattcctccaagtttgctgaacatgtcttccacacctttgacaccaacagcgacagcaccatcgactttcaagagttcatcattgctctgatcatgacctctcggggcaagctggaacagaagctcaagtgggccttcagaatgtctgaactagacagcaatagctacttcagctgcagtgaaatgctggagatagtgcaggtacctgcacttgacagggcctggagcatggggagtgcagggacccaggacccctatccccgaccccatacaccaggtcattcctctgcccacttgctacctgctgtattaaaggactggaggtctttgcagcgaggaatgataaaagccaagcatctatcgattgcttgctggacatcaggccccagctgagctcatccatcaggtttattcacacacttctataaaacgggtcttttttttttttaaacaaaacaaaacaaaacaaaacaaaacaaaacaaaacaaaacaaaacaaaacaaaacaaaacaaaacaacctctaatgagatctgaggctcagataggtgattaagaattgtcaaagcaagaactgggaaaatggctcagtggggaagaacacttgatacctagcatgaggacctgagttctgatcccaacacacacggaaaagtcagg

SEQ ID NO: 20996 - DNA, 1156 bp, Mus musculus
agtcagtagtggtgcttgcctttaatctccgtcctcgggagccagagcaggtggatcttgtgagtttgaggacagccaaggctcagaagagaatttctgtctcaaggacacaaaaacaaaacaaaatataaaattcttggtgctgaggcgatggcttaattggggctaggttcaggtggggatgttggacagagatgggaaggcgcttgcactctctgactctctctggactttctcagctagactaaaaccagccagatgccttcccactccttaactcatataatccttataccaaccccatgagttgagtcaggttcacaccggatatctagatcatataatgcaggccctgatagtgtacagagctgaaatctctctgtggagggtcagagcactctctcggttaccctggagggtgttctgctaataaatcctcgttcaggcagttgcacagccaactcaaaacagctcttctcctcatcttctattttctgtaaaagcaggaaggggactcaagcagggcaggaccaaggtgttgtgtctagaacattgcttataccgtggctttgccatttgcagcacttgaaaaaaaaaataaaaatcactgagtccagttgctgtgagactctgagcagagtggaagtctcagagggtaaggcatggtaagcctccactgtgtggcaagctggacctgaaagatcctctacgtcctttgcttctggtggctgcagtgcagaagagtttgtcctaccagttgctgaacatggggtgcataagctaagtgattcctggggccttagctggtgagggacggagctgggaattagcatgaggccttacagtccaaactcatggtgccttctactgttgacacccaaggaggcttcttggtggcatttggagggacagaacctgagagaaaaaataatgtagggtaaagtagtcagagatggtgagggctggtttccctgctgggacaacagcctgccttacatgaccagcacagaggagaattgaagttgaagggcttgcaaagtgctgcccagctcataggtgatctattggagttgttaggacttgtgaacttatgcaacatggccctggtagctttgaaacttaaagcaaggtggaatggggactgttcgtctttctt

SEQ ID NO: 20997 - DNA, 1195 bp, Mus musculus
catcaacctcagggaaacaaggagcatggaacagagaggaacgggaacctctacaagaagagcgatgggtaggtgactagccagctcggtgctggttggagcgtggctgattatgtcctgtgttctatctcctgagttcttatctaaactctcccgctctcccctcttctccttaaggatccggaaagtgtggcagaagaggaagtgttccgttaaaaatggcttcctcaccatctcccacggcactgtgagtatcttttaatcagcactctcggctgggggtggtggctgacgtctgttatgtgtgctctagtgaggacacattctcaaaatgtttccccttaagaaacttgtgtccttgcctgtgtggggagcacctgcaccctgggcatgctcctttggtcactgttcatggcatcaccaaatccaggacaaaccagtcactcaggccacttttcttttgtagcctttgacttccagaaaccgtcaaacctgctgccccagctaactttatgcagacatcctccttacttacagagacttctgctgcctctagaaagaaaggaataatctctctactcatcaggattttgggaaccaaatctagagagaaagggaatccatctttcttacagaaatctcatgtgccttaagttttcctacctttcttcctgttcgtaaaggctcatgcactataatagagccttgtaaggtgcttgtgtgagaatcaagtcactttccagtttagtttccagagatcaggaacactgccacaggcctttactctccccacctggtggggctggtgggctgatactggttgggattgtcaaagccaagttggccaccccttcattgaatgcagatgtgtaatgtgtactatattacacacacacatatatataatacagtctcataccacatatgtctcccttggtcatgagcgtgggcaataacctgagcctttctctcagacttttctcccatcctatagtccccttaagaggcataactgggcagaagcacagatgggtttcttggacacagtagaaaggttttaacttaagatgggtttttttttccatttttttattaggtatttagctcatttacatttccaatgctataccaaaagtcccccatacccacccacccccactcccctacccacccactccccctttttggccctggc

SEQ ID NO: 20998 - DNA, 1152 bp, Mus musculus
gcactgactcgggagagtttaggtcatccatcttcccgtaacccaactgctcctcactcctgagccttcggttaggatcttgatgtactgttctctccacacagcaggtgcacaggaatgagggggccttactgctcagactaagggaagtgtaaccgtgtgtgcatcctttagatgcagaacgtcaggccaggaggacggctggatttccctgacaagtctcatgctctctgatgtggttcatttccacagtgtccattagtttgttttagctgagacacacatcaggtcgatgcagaagtcactgtagaggaagttagaactcccatgttacaaggcatagctgctttcttggggtccctaaggggccctccacttaaatcaacaacagggctgtgatcccttgggcatgcctggtgattccgtgctggcattctaagtggcttcaagtgagttccagagttccagctggctctccaaaggcataataaaaattctttaaattttgatgggttgccccagttctggggcagacagtagttataattatctccaccaggatgctgatgctcttcttagacagtgggtatgtatttttaaaagctgtgttctttgagttgaaccctctcaagaatcctcctcttgcaggggcaggggggagtatcctctggctttagcagccacttcctcctctagctgtaggtgggtcccagagcagcctccacctaactaccccagaggagcctggataacaactcctggatcctgaagggccctccatgttcctgtgccatgcaaatgcttgcatattgcagatgtggatgacccaggctgagatcgaggactgggcgagcattatttgcgggtatgggtttttaatctggctcctatgtagcttgctcattttgccagtcgttcctgactctgcttcattaccagcaggaaagggggacaggtttccaaaggtgggtctgaggaagtaggaatctaagagcagctgctggcacacagctggaatagggtctgtgggaagtgtaagctcgtagggcgtgcttgcactatgggaaagactttcccttctggaagcaggcagccactgggaagtgaaattgctgcactctttactcccacagaggagtacaggtaccctct

SEQ ID NO: 20999 - DNA, 1669 bp, Mus musculus
tgtttgtagtcaagaacatatcagaaatctgtagaccttggggagcccagtgcccccaaacatcccagttacactatgtaagcccatcgcatcactcctaaacttacactatgtggggtgggggaggggaactaggttgtatatgataaaaatcaaaactcattagtttcatgaacttgactgtcatacctctacttaataacattaagcacaggtaagagccgtggttaggatatgggaaatgaaagaggcaagcataaggcctgaacgaaagctggagtttgagcaaaaggaatggattgagggttaagcttgacagtgaggcgatgttgctgccggaagtggcacacttgatcgaagcagccccttctttatgctctttgtgcaaggctcttacaagctcagagctctctctttgtttctttcaaggaaaacaggacaaactggaatgtcttaggatgctatatagtgattgcttcctgtctttcagattctgggtgaaaatgtgttagatctgtaattgatctctctctctctctctctctctctctctctctctctctctctctctctctctctctctctctctctctgctcccccaacactacatctgtttttcactacttgttaatttctgtccctttagcccttctcatcacttttctcgtagacttaagagcgtgaacagatgcgttttgcacattgcacttcccaataccttttacagtgcctcccccacccccacccccacccccacacgcatctgtatcatcggtcttaggtacctggtgccagctctctgaggaatctagttgatttatgtcaacattttaactccagtcccaagctaatctatcaggttcactggtacataaatacctaggaaatatttttccgctctctaatttggtggcactattgtgcagtaatgggtagtcctttttaccagaagagaagttctattgacttccctccttaattgtccttcctgttactcgctctttgcaaactgagaagagaaagcaactgaaaggaaagcattgtagatatctatttatatttaaagtttacatttcacaagcgtcagctgcggaatcggactttttttccgctgctttccatcaggtctgacttgggggacgatgactgagaaatagtgcgcagactaatgtgatctgctgaggtggagaatgacctgcagccaagaatgctattttgagatgtatgatattcaattcattcacttgattactttggtctagttgcagcgcaactgtatatactgtataacctaaacggattattttcattgtcttaatgcagtgatttataattagagcatgtttaataaattgacttcctgttaaccagtcatttgactggaaaaaaaataaagtacttttaaatggacatggttcatctgtaaagtattagctactggcgcccagcaaccagcaggcgtcctccaagattcttctaactctgtgataaactaagtgtactgggtattgtctagacagtacctctctggtagggtgctttttgtcccaagctgacatcatcactctaaggtcacatgcaattgaggttccccagtccaaacctctgcatgtctcagttccaagcaagtgatcccaagtccctgggaagctacagggtgcaggtcat

SEQ ID NO: 21000 - DNA, 1100 bp, Mus musculus
agtaacactatagtccaggctgggctggaactgtgctctgtagctgggctgtaccacatgagctgctctaagctcggtgggtaatgtaatgcatgtctgtaagccactgctcagggagctgaggcagacgatccccagctccagcctagcctgggctacaacaagagtggagtaccgtgtgtacagtgagactaacagtttaaatcagcagccgcaaggcagtggctgttggatggttaaagtcaaattcacacccagcggtgaacaattcaccaagttcattgctggctcagtaattcgtattacacgggctcagttgcatggccatcaagaaatgaacagagatgggggctttctttggtccaaagctctaggcatcccccacccccaccccaccccacccttggctctccagtcactgtgttgacagagatactgcaggtgacaggagggtgagtctgtggctcatatcctggcaatctgcctccagggcttagagtgctcattttcatgcaggggataattctaggctgaagttggcgcttttattttcaggctgtagaatgtgaagaaggaagtgaagatgatgaatccctccgagaaatggtggaactggccgcccagagactgtacgaggctctgacgccggtgcactgacagccttgcctcccagactcccagacttttttacactcagccaagagttaacttctgttcttcaaataaaataaccttagtttctccgggggtgcctgtttacttttgcatcagatggcttgactactgcaggaccaccaactgatgtgtcctttattctccaactaatcctcaagggagccacttctgcctgagcaccacactgagtctgcctccaggcactttccgcagtgtatgctgaaatcttcagctctccgtctgtcttcctctggtctgtactggcaaatctgagttttgagttgaatgcaaatgttgtgccacagctttgaaacccctgttctccacacccttacccaattccttggcttatgattctaaaaccaccacttttaggactcatctgttatgggatctacatgttcaattcagagatggggttttat

SEQ ID NO: 21001 - DNA, 1099 bp, Mus musculus
cacacttgactggaaaggtgtactgtggactttgtccaagctgcttgaaactggaggacaggcttgactgggacacactaatggcttttcagcacaggtccgctgtcaaaactggggaagagttttcttttcctcacacagctggtcagcctggctcctgccataccccagatcccttccctagcctctcaggaagatgtgtgattctcccccagccgggcttcccccaccaactggatattctgctgggaggtaggcaggcatgcaatgaatctgtccattttgtcctggaatctgcattaatggacaggcatggctgtcacatagactaggaaagcctcagaatggctgagcatgttcacaggcacagccgagtagtagtgcctagtgactacagtggctgttggctgcatgttgacactggaggtctcagtagcagtgtgtctctctctctcatgatcttgacatttctttctagccatgcccttccttgccctttacctacctcactggggtctatgctctagctgcttagcctcagtaccctgaccaggcctggtgccttaggagcctctggctgctccttggctgttcctccccacggtgcactcctgccattgttgcattgttgtgccattgttgcagcccctatgctggcatcagtggcatcagacgctgtccagtccatgtggccttcaaaaggaccagcactaagtttgccagtgacctctggagttttcgccaacaggttgcaaattaaaccgcctgaactcagttgttggtgaatatgcaaatgcgtgtttacaagtagcccgagactgtgggactgatgtccttgacctgtggaccctgatgcagaaggacagccaggtaccaaggttttctcggccctctcagggttattgggagcacacgggtaaacaagatgtgtgcagctttcctagaagagctctctagacgggcatggtgatgcacatctgtaatcccagtgaggtgagggtagaaggatcaggagttcaaggctagccctagctgcacagcatgtttgcatccagtctgccatataaaactgtgtctcaaaagacgtgaatgtcagtca

SEQ ID NO: 21002 - DNA, 1841 bp, Mus musculus
gacagagtgctagtggggaaccttggcctgctctaggacatatacctgcagatgttccatagagctgacctgaatcaaaacatagattataatgatctgagaaacggggaagcaacttagcagatgctggtcatgtgctatgaccttcacatgacatcctatgtatgtaggccctttgaagaggtgaggtaaatctggcttatgtaaggctttcaggttttgggtttttcttttataatctaaaatctcctttgacctgtggtgcagaagcagaaagtaaggctggaccccgttcctggtgacagtgctgttaagtcttcagtctgtttttctgtaccctctgactacagtgaagcacttaacagtgaggataactggaacacagacatacttgtttgtttgttttgtttttgtttttgtttttttttttttgaccctcaactaaaagaggagcaagagaaacctgcttgtatgttgtctccaaatgcggcctgtcttggcactgaattctttgtagatggagagacctgcctacacttagggccatctacattaagagcagtcctttccaagaggaacagtttatagaaacagccacatgaacttcgagatggcctattaactgttcagccccagattcactgggcagtttttccattttacaaatgtgtcgtctttaaactgtttgccttaaaaaaaaaaatcaatattgggctggagagttggccccacagttaagagcagttggtctcattctcagcacccacatggtggctctcaactctgtaactccaatcccagaggagatgacatcttctgaactctaggacacgaggcatacattggtgcaggcaaaacaaagccaagtgctgtaaaatgtggcaataaccacaaaacctatagtgcctcacagtatggactgagtggtgaatagacactcttcccagaaccacttctggacaggccgggatgtgctggctggctaggaagagggggtgggagtgggagagtggtgctgccatcggggcccagccctagaagaactgaccttcagtctcggcaagtagacacccacgtgacctctggctctggtgcttcaagatgttctgtacttactgtgtgaggaataaatgccattagcctgaattctgatttctataaattctagttataaatgctcttttcttctaagaattgcagtgtgctcacaagccaacacattttaaccaagataatttgtaaactctgaggacagttaaccaagcctgtgccttgtctctcctgaggacgcctgttacactaatacttgaatatataccttgtggtatttgctctttttactagtcatgatagtcttgtattttaattacactttgatgatttgctatagggagagtggggtgtgtgggtatatgtatgaatgaaacagttggcagaatataagaaaaccatttttataaaattgtgactttttaaaccaaaattgtcttaattgtattactttttttttctttggcatgtacagaattaataagatgctcagggcatattctatagctgtggcattgatgatacctgcctcagtcaataaatactgaatatcaaagcagtggattgcgtatataacatttccctgaaaaataagttagtaggttttttgatcaataatcatgaacagaagttaagcttggaaaagacatttaatcaatctcttgatgtctgtgaattactaataaagctacgcacatgttcacagaatgtttgtggctaccaacatgaatgatacgagccattaatttttgggaacatctcccaagctaatagtctccatctcccagcag

SEQ ID NO: 21003 - DNA, 1343 bp, Mus musculus
atttcatagaaacacgagtaacttccagacacttgtgtagaggagtgacagcacacttggtatttaagtaatctgaaccagttctacaagtgactgtgttttgtattactgcgaagatatggaaaatgtagtgcattacaatttaaagtaattgtaataataacgtcttgatttctacattccttttctgaaccttcttggaggtttcctttcagaagcaacttttccatgctcttactacaaattcctttttagtaggaatccagaagtgttagattgaatgggaaagcgcttaatgcatccgggcttggggtcacagatcgaaatgtctcctgtgtcacatattctggaggttacatctttctgtgacaacagggagtttccttatgcattcttcatttgctgctgtttaagttgacaacttccttcccaataaaaattcacttacacctcctgccttcgtagctctggtattcactttaccttgtgatagaagtagcatgttgctgccagaatacaagcattgcttcgggcaaattaaaatgcatgtcctttcttaatacactaggaaggagaaataaagtccacaagtccaagcctgcacttcaatacttttccatgcagagttgtgcacatgggagagggtatccggtttgtccagtgattgttctttagagagttggaccactatattgtgtgtttgctaatcattgactgtagtcccaaaaaagcctcgtggaaatgttatgccctatgtaacagcagagtaacataaaaataaaactacattttataaaaccatttattatggctttgtaacaattgcatacccatattttaaggaacagaatttactactttttgaaggcttttgctgtttctctttatgtaacatgtagtggtgatacccatatttctgcattgtggtacacttgtctaaggtgcctggcactgtaaagttggactatatttctccagatagcctcatgggtcatcttcctcagatgtaatgataatctggttagacatcatatgaaataaagtgatgtgatgatgagtgccttggctggtattagaattgggctttagttatgtgagcatcaggagtatctagttttcagataacccacttaggattctgtctacactcaaaatgatgtttttaatgccagtgatttttaaatactaagtatttgagaagtgatcttcaaggcaacatgattagaaaaaaaaatagcactgggcgtggttgcgcacgcctttaatcccagcactcgggaggcagaggcaggcggatttcgaggccagcctgtagacgaggtagacgaaagtgagttccagga

SEQ ID NO: 21004 - DNA, 1228 bp, Mus musculus
ttggcgcatgcctggggagcagcacttgggaggcagaggcaggtggatttctgagttcgaggccagcctggtctacagagtgagtgccaggactgcacagagaaaccctgtctcgaaaaaccaaaaaagaaaaagattatttactttatgtatatgaatacgatgtaactgtcttcagacacaccagaagaaggcatcagacctcactatagatagttgtgagccaccatgtggttgctgagaattgaactcaggacatctgagagagtagtcaatgctcttaactactgaaccatctcatcatccagcgcccccccccctttttttttttaagaagcagagcaagtatagctttagtgaggaaaggtgaggccagaactctcccgaattggggcatgggggcaggggagtgggacttgaagtgaggaacactcacaaaatcttaaactggggctccaagggagtacttccatagtgttaccctgtagcgtaatgtggttgtacacacggttgtatttgcagactggctagcttctgttcctgaactaaatgtataatactacaaatgttaactttaccaggcttttgatgaggccatcgcagagcttgatacactgaacgaagactcctacaaagacagcaccctcatcatgcagttgcttagagacaacttaacagtgagttgttcactattaacatgtctgttttcagaaacaacagtaatttcgttttgggggggtacagttatagaaaagttatagcctctttttttattgtcatttttgagacagggtttctctgagtagcctccttggctgtcctggaaatcactctgtggaccattctggcttcatacacacagatatccacttgccctgcctcccaagtgctgggattaaagatgtgcactactactgtaggactagagctatggtctcttacaaaatttggagaaatgtcttcatgatgacaaagtattttatcagacctttctatgaaagtagaatatagtattatcattacttttagacttagtggaatgtgttggtaacaacagttaatgtagagagcttgtctagttctagtatttcctttctttgggtaaattagatataacaaattagagattctatatgtgttgcaaactccttattttactaaaagtttccttggagggctagagagatgattcagtggttaggaacattggttgctatctcagagggcc

SEQ ID NO: 21005 - DNA, 1171 bp, Mus musculus
agagcatctatggtgatgatgtagagaacaggaggactggaccacttacatgtgatcagggcatctgtgatgatgatgtagagaacaggaagactggactgcttacatgtgatcagagcatctatggtgatgatgtagagaacaggaagactggaccacttacatgtgatcagagcatctatggtgatgatatagagaacaggaagactggactgcttacatgtgatccgggatgtggatgaaagggccttgaatggaagtctggtgtaagaggctccagggtggtttaatccagtcttctatatctgtgtccctaccttagggaaatttttatccactcttgggctggtgatcaactaggcctttggtggaattttcctatccatccaggctgcagaaggctgcttaggccaagaatttacagaggcctttcatggtgggggactgcgcttttggattttggtcagcattgtagcccaagaatgaagtcagctctttgttaacattacttggtctcagatgcttggtggccacattggttggtggccactctgttgcatgatgtagattcaggactttgttctacttgcagaaagtcctgtttatgagcataggcccttgcaactgcaaaatgcttcacctgaaagcaccagtcagtgtggtgtgcaacttgcagagcctcaggttccatggtagagctgtggaaatagagtctgcattttaatagcactctcaggagcagtgtgtgcaccagggtttgaaagtactgttgtaggctgccctgagtcctggctgtgttcagagttgcctggtgggggagggggtgtctgtggactggaagaacctggttctgctctcctgaattctgatttcataagatttggttgaggcctggagcttttatatttgtaaaaggctcctccctagttgataatcactgatagacaagtgattatgtcaagttgtgtgccaggtagtgataagtcaaggttattcataacttggggaaaggatgtggttttagaagggaggaaactgaagtcaagacaggcatctctgcagaggtgacctttgagcagtctggaatgtagaggctgcctgcttgcaaagacctaggcatagaggagtcctggaaaagggctgagacgttagtatcagggcagacagaagg

SEQ ID NO: 21006 - DNA, 1099 bp, Mus musculus
ttaaaagcccctaggctccgagtctgggggtcgactcccctgcctcctgcgcgaggtacgtgtcgacccagagctctgccaaataaacctcatgcgtcttgcaacgagaggattcttgtgttcgtgggtgttccctgttcctggattagagcggggtccctaaatttggggtcctacaggaccacattgatcagctggcaaccctgctgtcaaatcccttggtcttggccttgctgggctcccatctccagctaattactcagagggacccagagagcctgcctaaccagacatttctacaggtctggcccatatagtgaccttctttgccacactcagggattctacccaggggagggttcagggcatggccctggggaggctgggagcccctaggaaactttgaccaggacaggagctacctgcttctgcgtttacttcttggcactagtaagtgggactcaccaaaatgcaatgcagagtcagccagtgagatcagcattggctgtgaagcccaagctgagtgggagaggtcaggagagagagagaggagaactggaacaaacagaaccagaatgtaaccctgttttttaagcactaacaggaaagggaaagtttgggggcaaagtgcctggctccccactgctgtctgggggggattatgcccaaccctcaggctgctagagttagttttccaagcaagtcaaaaagactcaggaaaacaatctgtaagctttttgcaaagaaagccccccacagggcatcagacactatgaattccactgcactgagaaaacagtctgtagggactaggtcgcctctgtgatttgggcattgcttccacttacaggtagctcagaatcctacaagcaaatccctctgcctcaaacacataccaggagagcaaaggcatgatccaagcatggatattagacactttcagctccactgggaacgcttttggtcttaaaagtatttctcattatctttgtgtgagcatgcactaatgtggaaatcagagggcactctgcaggacttggttctctcttctaccacgttggttctgagatctgaacttaggtcactaggctttgtggca

SEQ ID NO: 21007 - DNA, 1155 bp, Mus musculus
ccttgtttcaataaacaaaacaaaagggaggaaatgagggagggagggagggagggagggagggaggtagaaagacagggagagagagagagagagagagagagaagagactggacattgtccattttccagagggttccagactttaaccagagcactggctaatcctaagtctccctcttccattcctcaggcaaaatgtccctggatgaattcaacaaaggtgccaagagggaccacccattgtccggttgctgcagtgtgataccagcagtgctagccagttctgaggggaatgggcttttacacagttgtgagaaacacaggcttgacctgccatcttcagctttgcttgatacagtggttttctccgtgatttctcctgctctctcgggacctgggcccaggcagcacatcacactcacctggtctggctggatgcagctccctcctctgtctgatccaatagatgtccctccccatccagtccaggctggttccttccaaggtttcaagtgttctgggctgtagggctccttccctgcccacagagggcctggagacccttaaggacaccagacaggacatttcagtatcttacggagaccagctgatttattttatgatcccaggtgagtttgtaaggatgaagaagatggagagtagataggcaagcccttcctgtgcatgactccacctcccttgttcattttctccgaccaaagctgcttgcatgtatatactgcagtatccttacttttaatatataagttttgtataaagtgagaaggttcagcccctgtatttaaagcctctgactgcctttaaagcatggtcccctgtggcctgtgattccccccacccccaagtctggctgtgctgtggtatttaagtatttatttgcctaatcacacaggagatacatgcatgcccaaggctgtggacatctgccctccgtcctgcaaatacaggtgttcctgtgtgctctgtccttcctttccattgacctggcatattaaaatgatcaaataaaccaaggtctgtgagtttcctgtgttatcacaagcaccctgttcatggttcactctctagtgagtgtggggatgaagcaggtaagtggtagacatcgggaaagtccttgaatgtaaggaacag

SEQ ID NO: 21008 - DNA, 1180 bp, Mus musculus
tagcacccctctgtaggttgggatcctgggctgaataaaatggagaaagcaggctgagcaccaggatccatctctctctgctcatgactacagacatttttaggcttggcaattgtggtcaagattcagcccgtggtcgacccatccttgtctcttctcagcacacaacccttccccatatttgtcctgcaggctagcagcacaagagacagactccttttctggctactgtcagggtcccagcactttccctatgtcagcttgaaattcctggtgaaaattccagttctttgggggtccgttgtcacagtcctcagaaagctgaagggagggcacaagtgtgtctttagaacaaccttggtcttgccatgacagtcacagtttcttcctgctttccaatgtaatagcttcaacagagtttgcatctccaacctgccctatctacacaatgaactctgtgcttttctagtggggtgcaatgtgggctccctcttctcagaacaatgctcctgtcgtctagtatcctatgctctacactcccatcctcacaaatcaatggctcttgaataaaccactaggctatccagcttcagttttctcattgaaaaatgaaggtttttatgttgggagacttcagtctctcttcattaggagagccctgcctaatgaagggttgctccaggcttgcattgaaggctaagaccagggctctcaagcttcagctcccaaaggaattgctgcaggagaggtgtaggaatccaggtgccacactccagtactgtgatgctgtggcctggagtcaggcccaaggagctgcattccaggagacccaacctcaggcacattgctgcctctctgactactgaagactgacaagcctacaggccaggggatggcttgaagaacacccagaaccctccctagacctgagcatgctcttcagactggctggtcccatgaaggacaagtgttttgttttgctttgtttttttgctgcttcctctgacttcacagccaacgggctctctgttccaaggaagcagcatcctttttggctaatggaagtagtatgggagtttatttgtgagatctgggtgactcccagatctccagagggtcccagactaggtgaggcactatgcaaccagaaccacgtgtcaactgtgtacagtggcatttg

SEQ ID NO: 21009 - DNA, 1149 bp, Mus musculus
gtcagagggtgatcagtagaaagatccctctgaagatgggacctcctccattcccacccacctgcctgtggttgaaatcatgtacaagtctggggcacagccttgctgccagctgtgtaccttggtaggcagaatggctgtgctcagcatgtattaagaatatactctatccccagtgagctagagggctctggcttctaatggcaaagaaaagcaaattaaagcctgggcattgaattcattataatattgggaaaagtaaagctggaaagaggttaggcttagaaggttgtgtgtagaggcttcacttttcaaccaagtattccagcaaggctaagagatgtgagcacggagagagcctgaagaaggtgtgggagcaaaggcccagtggcagccatagggatggagacagaagcagtggagatattcgtggccaaagaggatgggaagatgggtcaggctgaagggggtgcaatgaatcacagctgcagttcagagctcaacttgtactgagtaacagctctgtggttgtagataatgacctgttccctccctcccaaatttccccacatgttcctgctctctctgtgtcatagtgactcacctctgagcacactgaggcttgctctgagcatccatctttcccgtccaccagtcagcatcttctccatctgtccaaagttagggtcattcgctcagcacatcttcaggccaagtccatgcatacttggtaaaggtggctggatgaatgaatgagcaaaggactcatattcctgtgtgtaagaatagtgagttcccaatgggatatcttctggagtcctgtgtggtgctctgaggattccttcttctgaccgcttttcctcctgggctatcactggagccaggagggatgggagcctctgagtagtcagtgaggtaacacatctctgtgttgggggaggtttgttggtgtgtgtgtgtgtgtctgtaaacttggcgacatgtatggcatgaagtgtgagccactgcctgagggtccctaatcctcacaatcctattcccaagcagtaggcattgacttcccaggatacctgctgtcatgagagaaggggccttcctcctgaaaccccacccctgtgtctagcaagcccttggtgcttgggcccctgt

SEQ ID NO: 21010 - DNA, 1107 bp, Mus musculus
ctgtcttacccttgtgggaagagcagcactgtagaaggaacgggaaacactgaactaaaaacaactgagaaggttctttttggtggttgtgtctggtaaagtaaaggatgtggccccggtcctgggcccagatcaagaactactgtattgatcaccctccacctgactctctgccctgaaggctctttggcaggccatctcccaaatttctatgttgcagctccttcttcctgggaaacacacttttgccaggtgcagagccaaggtttccctgtcaagtcctggagactctggtagggctgttgtatctgaccactggagggcgcctggaaccttccaggtcagagagctttctcaacagcctgtcagattgaatacatctgcaggccagggtctccacctgttacagattttcacaattttttaaatgagtttttttaaaagatgtatttacttatttttatgtatatgagtacactgtagctgtacagatggttgtgagccttcatgtggttgcgggaattgaatttaggacctctgctcatcctggtcggccctgttctctccggtcaaccccacttgctccggcccaaagatgtatttattattattaataagtacactgtagctgcttcagacacaccaaaagagggagtcagatctcattacggatggttgtgagccaccatgtggttgctgggacttgaactcaggaccttcggaagagcagtcagtgctcttaaccactgagctatctcccagcccaaattttcacaaattcagtggtttaaagctcagagtcactgggccaacattgaagttgtgtgcagcattcctttcaagactgtcttctctgcatctttagaccgcctctgattgttccacctcctggtcccttgtaatcacctccagccttccctcccccttgccatgtaacctgccccttctccagccccaggatcaggtgtggggattactggaacccaggtgcttcctgtggcccgcacttggaaaccgtgagtcacaacttgtgggcaccggtacctctgacctaggccagtctcttcccatctgaccacattcctctggagcccaagaaaccctgac

SEQ ID NO: 21011 - DNA, 1390 bp, Mus musculus
tcgtgtctctgtctctctctctcttttgtaaggaaatggaagaaaatttgctctaaatcaccagcattcaaacaaatatttctgcaataaagtttacaaagtctggatttttttttatacctttctattcatgttttgtagaaatgtgacagggtactaatttttatactttttataaaaatatttatattgtgctcaaatcaccagtttgtggatagaaaattttacagccttcttttccatgttttataacaaagttttgtaataaccctgcttaagagtaagcctggtagttagtcagaaagaagcaaaaataacaagtttgttaccagccttttatagtcaatattttagatcagaactggttgaataaagaactcttaaaggggaaaaataaactttgtagttagcttctttgtatcagtttcaggggaaattctagcaatcgatcctatagcccacagaactaagattgtggttaggtaaaactaatcatgtgagtctcgtgtccctgtggaaggtgtgcccagtctgcctgggctgctggccagctgagcaggggcaaatatggaatgtggactcctgggccatctgtctgctaagagcaaatgaccccatgtcctgtctgtgttaagcaccaacactaagaatgtagacgcagaaactctgtatgttacctgttggcttctgttgtggttttgtactgcgtgctagattgaatgaccacagggaaaaggaaatgtctgtactggttggttaaactctccgccagagtgcagcttccacaaagcaaggcctttgtgcacattcggctctggggttcggatgcctctctgactatggacaaaacactgagaaacatatcattaaatggcagtggctgtcacccaactgctttttcaatcattgtgtgtgaaggaaattagtttgctcaaacaagaagacttggaatgggtatattgtagctttcctgaaaacagatttcaggcactgcttttacgcctcgtgagcgggtgttctgcatccaggtgatcacaaaaacagaatggttttagataaattctgggaagctcaggcagtacagcaagtgtgataacaggtatattgtgctgtttgggcagcctgagactatttttgtgtggtatgtattaggttttgtatttgccttttaatcattggtatttaactttattaaatgatggcaaggttgaaataattaaacgtaaaatgaggcttttgtgttcaggtcttttgagccttatataaccgttatgtggtcataccttgtatgttacttgacccctgttaagctgctgtggtagccgagttctgtatgtacatgtgtttaggaactgcccagacagcagtcttgctaatgtctttcaacata

SEQ ID NO: 21012 - DNA, 1126 bp, Mus musculus
ctaattgggacagaggggacaggggtctgacaggaggggcagggtagaaaaggaacccaaggctgcatccgtaccccttcatgagtttgaagacagctttttagggaaccctagtttgaggacccccttaatcccacaaggccggtgcgattgctcgggaccccgaatctctttaagaaaccagggtcccccgcacccctctacttgggacatgaagacagtcaaggcgacgtgtcccagaggccagcagcgtcactccacccttggcaccaacctcagcggcaacgcccgcccggcgaccccctgcgcgctcaatccccaaggctctcgcaatcctaaccggttccggccccgcgagcgcccgcgcacccggccggcgcaggctccttaaaggtctttgtgcggaaggcctgcggcgcaactcaaatctcccgcgctgggcggcgagcggggtcagcggcgtccaatgggaggcgaggccacgccccctcggagcgcgcggttgggtggctctttaaagggcgcgggcgctggcagtcggcggtgcaccggattccagctgttttcgcctgctcctcgccgtctccgccgctgccctcgttcgccatgctctccgtccgcaccccgctcgccaccatcgctgaccagcagcagctgcagttgtcgccgctgaagcgactcaccctggctgacaaggagaacacggtgagggcggcccaggtgccggctgggttggatgtgcactggcaggtcgtgggttcccggacccgggagggtggagggtgcctaccgccattcaccacgcgtgtccccctacagcccccgactctcagcagcacccgcgtcctggccagcaaagctgcgaggagaatcttccaggactccgccgagctggtgagtggcccgtgtggggctgaggtgggtcgcttaggctcccagtagagggcgcccgctcgttggcgctaaatctgcattgtcccagctgaattatttgactcttctttcccgccaaagtgtctcctcagaatgtcctactcgggtcggcctatggtaatagtagagtgcagcgtgacagctaagcacacgagattaccaatcgttgaaagtactcgatctgatgagacac

SEQ ID NO: 21013 - DNA, 1271 bp, Mus musculus
agcaaaaacaaccaactggctacaccatgaattgtcattaaatttgctaaacaggtgtctaaaaagctgtgtagctacctcagtcctgtttgccaggctggtcactagaagaaagtatacttcaaacaatgggtacttggatccttagggagatcctgtccttggcttttacaagtagtgtggtcacctttgacctcatcaaagtactaacagcactgggccaggttttaggagcagtgaccatcaagcaagcaggtttaaacatttagatgctgtttagggctgtttaaagatgtcggactgcttcctgcaggcatgcagggtctacttaacaagtttgtaaataaaattggcactttgcacacacacacacatagtgctgtcaggcgattaaactatacattttatgaggtagtacctctatgctttttttttttttttttaatgctcagtattatcttgaagtttgcaaatgctatgatggtacagtaaattctgacatttgccctaatagtgtcactttttttttttcttcgagacagagtttctctgtatagccctggctgtacggaattcacaagtgagtttgagcccagtggtgggtacacccgtgggactcttacaaaccaaaacaggaaaagcaagtgttccctgaggtagtttactgtgatctagcttcctcatgaactgacataaccctgatcagtttccttgattattgtatagatgtttttgtaatatgaaaagcctttgtaccttttaaattattgttacttaaaattaataaactcttgaattaacagtcttgaactttcatggcatacaagtattaaatgatttaactaaaaccttaatgtcagtcctttgggtaaaatgtacatctctttatttacatcccaaatgctcccctgcttggtctgccccacccccacggcccacacaagagaatccttccccacccccaagtttactttttgctttttgttacttctggggactttttcctcttttcttacatagagcagtgagatagatatgctctgggcctctgtatggagtggagccatgtctagcccaggctagctttaaccttttgtgtgtgtagcactttaggtttcatttgggagtgagggcagggggcagtggtcacacagaagccaggatgaccttgaattcctggttctgcctctagcttccaaatgttaaggtttttttgttatttttagtctggtagccttggttataagcccctttcacaattcaaagtatcc

SEQ ID NO: 21014 - DNA, 1146 bp, Mus musculus
gaagcaggattaaattggagtaaaaagtgttttgctgcctccttattgcttcagagttctttgtgacttgataatgtcccttctgactgccctgcctctctaagtgcatacaaccctagcctctctctgtttattaggtcagggtgtggctgacttgaagtactcaaaataactcacacacagccttcacctgcagtccagtttaacaggtgggattctgccaggatcaaatcttgtagtgtttctttcaaaacaaggcacatctgtgagcctcagaagagagatcatttagtgctgttgaggagtgaagccctcccttagtcgccatttaaaagctgatgtgcggagagttagtctttagagttgaggttcagcgattagaattgttaattcacaggtgtgaccaaggacacgcccctctcaccaccgcttcccatcccttgggggggggggggacacctacattcaggcctcttgctgctctcatctatgactcattccttattggaaccttgggagcattatagatctggcagacttctgagacgttcgttctgcccgctgctgcttgtatccattgggttctggtaggagacagattgaacaggcaaaccagagagatttaggcgcttagaaagatgtggtgggcgtgggcagagagagcagcagggaatgagatggttcccagatcagttgcactgtgagttcaggggcaagaggaagggagaggcagcaccccaggaggagggtggtcaaggaacaggggtgcttggcacggagttgaggcctctagcggaagggctcaacctagagtgagtctgaggggtggcagagacacctctccctttcctcccatctttgggtctctgcagagggtgggtgaagccctggggacatggggcagagctgaaagtggagctggagggatgtgtgggtaccacccagcactactgctgagctgcttctcctgactgaaggacagaggaggaggagccccgcctaggtggcttcacacccttctcttagtcccctccccctacacttggagagagtatttgactcttttcttgtcttcctagggcctgctcaatctttagaacctttgtcctaggccctgtctttgacactaaaagacaaatcccctgg

SEQ ID NO: 21015 - DNA, 1182 bp, Mus musculus
tgcagctggttggttatgaatgattacattttagtgggctaggtgtcaggcagtgccttgggctttctcacgagcggacatttatgtctctggtggggtagggtcaacgtctgaaagcctagtgtttgagcactctttgctcatttgaaaatgaattcatcagtttgccttgctgtttactaaaaggcaccaaaaagaccaaagttgttggtttagcactgggcacgttctcaaaactaattctgaggagatgggccccaagcatctttcctgtagacttagcgggctcatatctgagctagctcacgtgagctaagaggtgtaagaagagtggactatgggaaaagcttgtataagtctgttaaaagagggactcaaccctgcaggggtccagtcttcacctggtgttaggatggtgttaaagccacacccaggcagatcaccggagaccctctcattattcctgcaaacagttgtttgtctttctcagatccatacaatgtaagattcatagaatgtcagaggagttctgactgttgacttccggactgttgacttccgggttaatgagaactgtggatgttagggtgccccccccccccatgcctcccctttcttcacattgcttacatggtttttgttactcatgtgtttgaggtttttttttttttttcttttgagagattgttctggcagagctaccattttgcttttaacccacaagataagaagaattcaccaacagctttttcacgaaggaccgtttttatgacaactgaaaccaacaatcagaggcagttctcgaagttcatttaatgctagcacatgaaatggtttcacaaacgggaatattagggacagtaattttacaggaaaataagcgtgtcttaaaggatctaaggtccttgctgaggtggtttgtgtgagtcctctctcgatagtcatttgttttccattcatagccctgtcttcattagctaccatggaattttactcttgtagagacaagtggacttgtaggttaactggtagctggtgaatgtatcagacacagaggtgatttgcatgctgaattgcatacataatgattatatgtatttgaagctaatatttgttaacaataaatatgcacgatatgcatagtttatataactattttctgatcagaaatgatggcagctt

SEQ ID NO: 21016 - DNA, 1101 bp, Mus musculus
tgaccctttcacttggggaatgcatcagatcctttggagttggactcctagactgttgtgagccacctgaagtgggtgctgggaactgaacttgctactccagaagagcagtgtatgttcttaaccaccgctctccaccacactcaaccctctgggtacaattcttaaagatcacaacttgaaatgtatagaactaacaagacagttgagaaaaaaaatgattttaatacgttgtatacttttcatcctggagataaatgctttcaggtcaaaatgggaaagttccaccatttttccttgagttaatgttcttttggtaatcacagtggaagtgattgaacgtgaacctaagttttctgcccttaactatttctcctaggaagctttagaggatatgattcatgttgaaatttgaatgatgaatgagtccagcttgacacccatcccatgggcaagcaccaacccctaacattattagtgatattcttgcagataggtgcttgttctctgagagtctccacccagcagctggctcagacagacgcaaacacccacagccaaacagtggatggaggttaggactcttgtggaggaataggaggaaggattgtgggtcccaaaggggattgaaactccatggaaggaccagcagagtcagctatcttggacccttgggactggcagttggaatcaccaaccagagatcatacacaggctggacctaggcttccctgctcatgtatagtagatgtgcagcttggccttcatgtgggtcctgagcaactgcaatgggggctatttcctgtatgtgggatatgttctaccagctaggctgccttgtctggcctcttggagacttgagatgccaggttggagggggtgggagattgaagggggggtggtgactgctcagaggagaaggggaggaaggagggattgtgggaggggggtgaccaggacaggggcagtgaatgggatgtgaagtgaataactaaaagtaaaaataaaataaaataaaataaatggaaaaaaagtctgaatgatgatatgactgtgtttgctcattctagtgatagaagttgcgggttgagggaggtgggt

SEQ ID NO: 21017 - DNA, 1150 bp, Mus musculus
gctcccacttccacagacagtcctgtgtccccatctcatcaacttctggaaactcaggggagcagaaccctgccctgagcattgtgggaaacttggagcttttctatcagttgtgaagacctgactgagctgaatagttttctctgtcccttcaccatagagtgcccgtgctttccaccccagtgtcctcaccgttggcacttgccttccaggtggcctgccacacatgacctcaccttggcatgcctgtctcctaccagatgcagtgcaggaagtggatactgacccatccccaaacttaaagctcctccccaggaaaccacaccatttattggattgattttttttgttgttgttttgttttgtaaaccaaaagaactcagttttatattaactgtgattttttttttttgtccttagaatttaaatgtaacattgaagttccagtctattgctaacacggaattttaatttttctttacaggtcaactttgtagtgtgccagctctttgccttgttagcagccgtttggtttcgaacttatctacactcaagcaaaactagctcttttatcagacacgtagttgctacccttttgggcctttatcttgcatttttttgctttggatggtaagtaattattttgatcatgtttaaatgaatgctgttaggtatgtttgagagttgagtatgtagagaaatacattatataggggtttgttcggaaatgtactgacaaagttttctttccaggctatctttcaagatcttctagtcgagaaacgatggattgggagttgggtctcttgattcttgtcttagagaagaattactttttataatttatgaacaggggcatgagaaggatttataaagacagtcgattgttaagtggttcttttcactcatcttgcaaatattttatgctaggacaaccaataaattactatgttgtttgttcctttgggttttctctgtgccgttggctctgacaagtctgggaaagctcgtttgactaactccttcctgtaccattctctctctctgtctctgtctctctctctctctctctctgtctctctctctctgtctctgtctctgtctctctctctctctctctctctctctgtctctgtctctgtctctgtct

SEQ ID NO: 21018 - DNA, 1113 bp, Mus musculus
gagaatagatctgggtgtttttagcaacttgttttgtgaatggtacttaagaaggtcagcacaaatcagagatgctgctgttggggaagttgggaaataggagttctgccagaacttttctgaaagctgtgtttattactccttttaaagttactgttccttaacttatgaagaaggtggcagtccttgatccaaatggccccacactgctttcctgcggttaggttctgtggagtgctgaggcattgagctgggctcctggggctcagttttatttatctagctcctttggcctgaggtggggggcaccttgtccaggatgtttgaagagtgtcatttgggctttgggtttaaggtttttgttttctgttttttttgtttgcttgtttgtttgggaaatgttgtaggttacacatgtactttcccatctgtagcgtttgaacttgatgtttgtggctgcttctaacacattcttattttttataggtatgccttacactttcttgtacaaagtgggatttcctactgcatcatgatcatagcaggagtggagagcatgcagcagtgagtattgactgcattcatatagaaaaatacctttcacctgaatagagcctgaccaaaagtagtaacagagtcacatttattacacaacagtactccggaagggtgatgatttctcaaggaagcaacacagtataaaatctcctgtctatgaaagtcagcgctgacatttaaggatgggctgttctttgacatgaaggacttgcagtgtgggatgttcagcagtacccctggctcctaacccattagatactaggagaactctgagctgggacaaaaagcagatatgctcttgagggtgggattcttcctgtttagcacaattggcatagtgtacagatgattagcagtagagaacagaactaaagtagtagatggagatttagaaggtaaatttaggactgagtaactagagggaactctgggaaggaggcaaggaaataatgtccatgttcctggcttgaacactgaagtagtagaagcagttgcccaaagtatagggattctgaaagtagagaccatattgaggggtaaccagacccccaaaac

SEQ ID NO: 21019 - DNA, 2235 bp, Mus musculus
ctgggacagaacagtttttccacgatgaataacgtttgcaatcagaaccgagacactggctccagacactcgtcactaacacagtgactgcgagagcgtgtgatggctgtttcccggctgtgaacagaagccagtcttgaggcctttgcagagcctcttgtttaaggaagagagactaactgggtggaaagggatggtctcggatagggggtttcctatacactagattggaaatggaaagagataacccctcccatgccatgttcctgtgggtcacgccttatacaaaatcttcccttgtttcaatagggcactctgacctcagcatctgccctcaaggtcatctgtgtaccctgttgctgaatgtacactgcgtatcccaaggcactgaagaggtggaaaataatcatgtcgtctggatgattaaccttttccaaatgaatgtcttgccttaaatcttcctaaaatgttgttcccggatggtatttccaagtgtaaaatcgtgaggagacgatttcagtattcgatatggtgtgctacagagaggattgagggaagtctaaaaccagatacttaagatcgtgggtactttaaaaatgcaataaacatctcagtattcgaagggttttcttaaggtatcttagaggactgtgtgcatggtgggactgtaaacagtcagggcttaattacaggtgtcagtcaggggccccttctaggaggactttcttaaacataattaaaggttggtaatgtgatattttaggcttattttcttaagaacaaaaaaaaaaaacaaaacaataagagggaagctaagataaggaggcccgaacaaggaaagcacctcggagcctggagccggtggcagagggcttcccacttctgtgtccgagattagtgtaactgtatgggacacaacagcttactgatgagaacactgtggactttctgaagaaatccctcgagcataaattacatagagttacagggggttataagaataacagtgatagatgatttgaaggttttgaaagaaatctctagtaattaaggttcttgtatggttcatcggtttcttgttcctgtccctttcattgctatttgggaaagatgtagggaaaagaaaacttagttgatgagtctaagtgactttttttttttaattaaattagtttctatactctttaacttcatgcattaaaattcttccattaaactcttgttaaaatgggtgttagattctatctaaacaaatacgtgctttcctcttagggggccactcttgccttgagtgactgggtttgtctttaatcacatagcagtgtggtgtgggctgcagcagctgtaagtatggggtgggtttgaggccatggaaaatgagcctgagactatagaggggaaggtggggcctttgggcctcactgccatttgaccaatcttttttggtatgaattttgttttggttttgccttacattttcaaatgaaatgcaagctgtcagtctacggtgagtttggttttgttggcttttgtcactaatacgttgtaagtagggtgaaggaagaagcagcaacaggggtgggaacctaaagatgtcaggaagaagaaaggtgcagatgccgtacctgggagccatacgtggcatggttgcttttctgaagataggttgcatctgatgaggaaagtgttctcctggcctctagagtcctccccattactcctccccgggaatggctagtaaataccttttcttagttttctttcccatgtgttgagatcaagctaactgtagaattggaggagaaagaaaagcatatttctggagagtgcccgccccaaatgtttctacgatttcatgagcttgttaaagacagccctgggcggttcctaagtgaagccagagcagctttgggagctgctgcaggcttgatccatcgatctagccactcacagatgaccccatttatatctgctaccccaacagacttcgtttctatacattgagtcgctgtcgcctgtcccctcgtaatgaatttataatcatagttctatcatccaaagagcaagacagctgatcactgttcctcctggcccataacacagcactccaacttgactgatgtcctttctcattcttcttcagcgttctagttacgttcatgggattattttgggatggctgtcttctaatttggagacataatcagaacacaatctaaaatcaaataaattctc

SEQ ID NO: 21020 - DNA, 1211 bp, Mus musculus
agatggcatgtgtatgctagaaacgctgcattcagtagctgagtaacatcggcttggtcttcccccaaggtttctgtttacagattacaatagactctccagtgttgggggagagacttccttggctgaaatgatcgcgaccctctcagatgcttgtgagagagaattcggctttctggctacccggctgtttcgagtatttaagactgaagattctcagggtaggattacttccctccccctcttccttccttcttgaagtgtttctaggtgtgggggagggaataaatgttcatttattttcatgagaccatgaattgaaccttagagtcatcatatgctcttgaccaaaaagatttcagtattctgagtacgtgatacgataattgttaatacgatttattctattacaggtaaaaagaaatggaaaaaaacatgctgtctcccgtcttttataatctttctttttattgttggctgcattattgctggaattactcttttggctatattccgagttgacccaaaacatctgacagtgaatgctatcctcatatccattgcatctatcgtggggttggcctttgtgctgaactgtcgaacatggtggcaagtgctggactctctcctgaattctcagagaaaacgcctccatagtgctgcctccaaattacataagctgaaaagtgaaggattcatgaaagtaagaacttgtcactagataaactagtgggaatatgctgctgtccccatgctgacttgagcatgctctcgaaatgttaaaagttacgttcaagggttttgttgttgttctgtttttatttgctcagtagtagggacttgtgcataccaggcaagtaccctaagactccaagtctattgcatttaatttagtttaattagtttgttaggcttatagcaaactccatatataccccatgtatctttttttttttttttttagtttttaaaataaattcatttattatatgtaagtacactggagctgtcttcagacacacaagaagagggcatcagatctcattacagatggttgtaagctaccatgtgattgctggggtccaaactcaggacctctggaagagcagtcagtgctcttaactactgagccatctctccagctaccccatgtatcttgtgcacagcctctgttatcaatacctgtcaaaggagtgctatatttgttcagt

SEQ ID NO: 21021 - DNA, 1184 bp, Mus musculus
ccaccactcccagccagaggtgataaatcttatttcccacatgaagagtatgttgaaggctgaacagggcgatttcttggatagttttaaaaccttagactaccaaggtagtgtgtagaatagttaagatatttgatatagacacttgaagaaagttagtcttagacatgtctttgtgctctgtaagtgtaattttcttcttttctattcccttaagttctctccctcttactgagggcagtgcccttatttcttaaagttaagtggaattatttgaggacttgacataggcctgggccacaggatggccatcttgtaaaagtgctttgggtcaggctgtctctactgtaataaatgctactcgttacatgtcagatagctgaatctgtttattaagatcttttttttcttaaattctatatgcattggctgtgatttctttatttcagcagtataactagatgaatttttctgtcacatgacctcaaacacttcatattaatgttactcatatttcccttgacttatctaggcatccgtccctgccacaggcacctctctgttactgagttcaatgactgtggatatcgtgtgtgagaaactgagacagatagaagggctggaccagggcatgctgcctcagtattgcacaaccatcaaaaaggtgatgtgtgtttgcatctatgtagatatctctaagtgaaatggtgctttcttttttagaactactcttttttataattttatgagtagattaaagaaagagtagctgaattacagcgctacttaaccagtgtctaatataattaaaaataaaatagcatggtggaaaatacaagagctcattcaccgtggagcagagagcattgagcggctgcttggtacatccattaccttcagctgcacacagtattattcatctccaatctggaacctctggaataggaaactcttttgagcgtggaggtcagtataagtcagatatcagagcctttgattgttggactttgtgctgggtgctcagtgagtaaaacttgaatgaatatcccttcctcagtgggaagcactgcacttggaagcagttttggtcccaagcatttgggaaggatacctggcctgtatgtgtttgtgtgacttcgtagtaattagagagtgagcatcatttcctacaagttgtcattttg

SEQ ID NO: 21022 - DNA, 1209 bp, Mus musculus
ctctttccaacccagccctggcttccgacaccacccacctgtgccctcaaaaccatcttagtctgttctgcagctactaagtaatgctcatggctaaagaaaagttagtggtactggtgatgaaacgcaggacctcacagatctaagtcctctagtgactagctacgtccccagccccaagtgctaggcctttccttcctccagagatttgggaagacattaaaggagttagtgacggtggtactagacaaatgacagtatttagtttgctaacattaaatcactgcctctgtactgcaattatttaacgtatctgttcctaaatcagcattttagttctggggaggggggtggattataaaaatggaggcatggttttaaaaaggaatttgaaagcatacaacaaagcaagaatagaggcggagctggtgtgaccttgacacttttattattcttagcagagctaggagaatgaccacatacatttaggctagaggtgtgcctgtcttcatcctgcattgaaactgtttgtcatttgatcatagtgtgtttacgtagatcagctctagtggtgtgtcctgagccatgggtagaattgtagatggtaaggttgcaggcttagtgctcagtgagatgtccatcactgactggacctgtgtggttcacttgacactgtgctcatagctgctccgtgtcccactgccttgctgtttgagtgtaattgagcattttcatgaagtgcatatgttgcatgatctttaacaggtatttttaaacattaaaaacagcacgatgttactgacattatgcaatatcatgtgatgggtacttgagaggcagtttggtttctttccaggtgagtagttatagctcacggtcatgggagccctttattcacactgtctgtgaagttaatgctggagtgccaagtgcacacggggactaggaacaataaagagttgcatgccattctgactcacggagttttattcactatagcaatgacaattcccattctgattaaaaattaaaacatgatctgtgtgtctgttttgtcctatgactggagtatgtaaagacttacatgtaggtcatgaaattttcagaatttccaggcagcccttattgtctttctgagagaggttggctccgaagccactgtgcctgctttcttgaagcacagcatcccagagcacgtgggcaccacag

SEQ ID NO: 21023 - DNA, 1159 bp, Mus musculus
gcgagtctcggtgcccggctccctgggctcaggggcattgacctagagaaattatctcatcattttattttcggaggcagggtctgtcattcatttgaagcttcatgttccagctaggatggttggccagcaagctcctgaggtttgtctgtttctatcccctaacactggagctacagacataccatggccagcttttcctgggtattgattggggagttgaactcagcaggtgttcataccaagtgctcttgtgcaccgagtcgactctccagtcttcttgtggttctttacattacacaattgcagagactttgtgagacatacctgcagatagccataggttagtgatggtatatttggacaggttcattagaagctgtgagcttttatcccaggagcaacctgaagaacaggagaagacccagaaggagaagctggggcatgtgccagacaaagactgatgtgtccttcctctgattttaaaacgctcaaggccaacagtggagtttcatagacacactttcacatttacagaagtcccatgcagccgcctcccacatttgctgcctaagtaactccccactctagttcgtttgactcttggtgaattaaatataaatgagaaagccattagtgtcttggccttgtcggatgctttagagtggatagcataattcagtcatcgcaaactcacttcaatcctgacttcattggttacagtaatcattgtgtgagttgtgccttacctcgtatttctcagtgttttagaacctgtgtctcctgcatacatgttaaaacacatagagtatataacaaagatgaaacatttgtgttcaaatcgtaggcggggccgcttctgatagagcacaggtataattgacaggtttgaacataatctcttcccatttctattgtttcggcaatgaccaaaacagccaacaagacctcactatcatacggttaaagaattcttgtaataaaattacaatcatatactgatttccccccaacttttttctatatatatgggcctaaaatagtatgtgtttaagagacaagtcatagataaaaatgagttatttatataattctcatgtagtcttttgctgtggtctagctttctttctgttgctatgacaaaacactctgaccaaaa

SEQ ID NO: 21024 - DNA, 1229 bp, Mus musculus
gaggaagatgtcctcaaattccttgctgccggaacccacttaggtggcaccaaccttgactttcagatggagcagtacatctacaaaaggaaaagtgacagtatctacatcataaacctgaagaggacttgggagaaactgttgctcacagactgagctattgttgccattgagaactctgctgacctcagcgtcatctcctccaggaacactggccagcgagctgtgctgaagtttgctgctgccatgggagccactccaatcgctggccgcttcacacctgggaccttcactaaaccagatctaagcagccttcagggagccacagcttctagtggtgaccaatcccagggctgaccaccagccactcacagaggtctcttatgtcaacctgcccaccattgctctgtgtaacacagagtctcccctgcgctatgtggacattgccatcccatgcaacaacaagggagctcactcagtgggtctgatgtggtggatgctggccagagaagtactccgcatgcgaggtactatctcccgtgagcacccatgggaggttatgccttatctttacttctacagagacccagaggggattgagaaggaggagcgggctgctgctgagaaggctgtgaccaaggaggaattcagagtgaatggaccgcaccagctcctgagttcactgctgctcagcctgaggtggccgactggtctgagggtatgcaggtaccctctgtgcccatccagcagttccccacggaagactggagtgtgcagctagctactgaggattgatcagcagctcccatggcacaggccaccaagtgggttggagccaccactgagtggtcctgagcaaaggggaaaaggtgggaggaaaataaagttcctaaaagctgcagatgcctgagcaaaggggaaaaggtgggaggaaaataaagttcctaaaagctgaagaaaaaaaaaaaagagtaaaaatggaagaatctacctgacagctgctctaataggcttgtttggcctgggaaggatcaaaggtgttctacatagatgcactgtagcaagactagagagtggacaggataaatggaggttagagagggtcatctaggtgtcccatgtaaagatatgaaagaagagagttgtagtcataaaagtgagacactatgggaaggctttcttcatcccttttgcagttggcttgaatgcattaataataaactccaagt

SEQ ID NO: 21025 - DNA, 1188 bp, Mus musculus
tttgaaacgtcccatcttcgtggggaaggaagctgctttctttctttttcctagggccgtccggccgccaccactctgcccaggtctccaactaggggagcggagaattttcaccaacggagccgaacgctgacgactaccgggaacaagcgaaaccggcacgctcatcctcccgcattagttcccagtagggaactattttccggtacactctaggcggtccaactcttttcagaagagcttccggtttccacccacctacttccgctgtccccacctcttttcttccgccacccggatatgagccgttctcgcgagagccgtccctctttctaagccggcgatccgtcaggtaggttcgcgggccgcaatgtggccgcggtttttcgcagagtttgggggaacagactcttggggggcgtccggggcggcagagcctgctccccggggtgggatgcagcggattatccgccttgcgcccgtagatggccccggctttggcggcccgcgccccaggtgaccggtggcaccttcctcccctcagggtgaagccatgttcagctcgagcgccaagatcgtgaagcccaatggcgagaagccggacgagttcgagtctggcatctctcaggtgagcttgtcgcccgggtgccccccgcgatcgcgcttgacctcagggtcccctgacccccggcatggcgcccacgttctctgtctccccaggcgctgctcgagctggagatgaactccgatctcaaggcgcagctgcgggaactcaacatcaccgcagccaaggtgagcggggaccccggagtgcgctcgctcgctgcccacgggtggttgacagcctctattcccggggcaagagacgggagggcagcagacagggacttccagtgcaggccagtctcacgcttaagtccgtgctgccttctgcacttgattgctggacttttttttttttttttttctttccccactgacattaaccttaactttttggaagtgtttagacccagtaccactcggttgaggatcagtgggtgtttctgagtttggcgtttgacaggtgtttcgtttttgtaagttagtattttgcttctgttaatgtacatgcaccttgcgtgttcctgaaacttgaattacaaatgcttgtgagtgctgggaactgaacctgggtcctgtgccctg

SEQ ID NO: 21026 - DNA, 1133 bp, Mus musculus
tcatgtgtacctacagtattttacttggttcattaaaacctcccatttagattccttatgtgatttttatatgtacatagttaatttctatatcagggtgaaagatcctgacagaatgtaaaaggtcacagaagccctgaaattggcaaaatagatttcattgttaacagaactagcttcactgatttagaaaaatagaggtgcataatgctctggccgctccttgaacccgtgtgtctgccaatgttttgaccgttccttgacccatgtgtgtgcccactgctaaagtccactgccaggtgtttgtgatattggttgctggggaagagtcagaaaatctccccagcaaccacagccgggtcaatccggagttgctacacctgcaccagactctttccttgtacccctcccaaacccatttcttgagaaatcattttagaatagatattgtttagattgggaaatcccctactccttccttctcctttcccccctgagggcctataaaaactgggacccctttctcctcggggtcaactcctctacccctgcgtgggatatgagtcattcccagagctctggctttccccaataaagcctcgtgtggtttgcatcaaacttggtctctcgagagttcttgggggtccgctattatcccgagatatgagtgagggtctccctttgggggtctttcaagggtagatattatcagtgtggttttgggtccttttacaatcaagattcaaaggaagatataagatttttcttggtgagtatttggccaggcggtggtggcgcatgcctttaatcccagcacttgggaggcagaggcaggcagatttctgagttcgaggccagcctggtctacaaagtgagttccaggacagccaggactacacagagaaaccctgtctcgaaaaaccaaaaaaaaaaaaaatttttttttctttttctactccagcaccttgggttacatagtgtagatgtagaaaaagaacaagaatcctgaaatatgtctatgtgtagtatgttagttacagagaaccccaatgatctatgctggagaagatggctgtaggcattctctgagtggccactcaatgtaaatgaccgtgatctccgtgacagtttag

SEQ ID NO: 21027 - DNA, 1165 bp, Mus musculus
gggcttagttgtgtctctgtgcaggactgggtggttacgtgaagtgcacaccgctcgctgtatgtcactgcccacttacaccatcaccacagtcttgactcaagcttgcagcatcttatctttaaatggacatctaagagcctgcttctgaggctggatcgaaggtcctggcagtgggttgggcagtgctctggtgctcaggaccacggtttaggagtaaagctctgccaaccataatgccaagttaactgttctctttagggctcagatctttggaacttgagggagcagcgcaggataagagcgccgccctgatggacgtccattcccgctgcttttgctccgggcccggccttccaacccaggatctcctgtagctgctgggtctcatgaaaggccaaatgagcatgcgcagaataaaggcccagctgccattggccaccggggaggagcgtattgatgacgcgacgaagaaaacaggaagtgagccgtcagggagccggtctgggtctcgtagtccatttttcaggcggggaatgaatgggttctgagcgatccctggtgaggggggactcgagctctgaggcgtgagtagctgggtaggcagagtatcatggaagacgacgccccggtgatttacgggctggaattccaggtgagcatggcggagtcggtgaggtgccgcctgtgcctggccctcaccagagagcgcccacactcagtctggttccaaggattctgggcttcaaggcccggatttggggagagggtacgcgcagggagtgtggccaagtgagggccagggctggcatagacagcagagggtgagcactcggcctcgcaggtgacttgattacactcgcacttctggggtcttgagtagcaattattgaccattgagttgtgtgttggatactgctcagtacaagagcattaaagagggacttcgtggggaggggagttgctggctggctggtctgttatgaagcattttgctcactcaggttggaaatatacttgcctttttccttatgaactttttatttcaatagctactaaactcgttacagattcgagtcaatagtgggatgagggtttccatctcccagggagttcttcagacctggaccatgatttgctaagagctcactggagacttctgcca

SEQ ID NO: 21028 - DNA, 1200 bp, Mus musculus
cttcgggctcacttgctagtggctttgctgttacactctactagacatagtgtcctggtgcctggacagggccctcagaatactccagacagatgatcaccccaggaacccacagtcccagagccggttgtaccctgtccccatagctgtcatgagggctcttgagcgtcagcatgctggccacacataggctgcatatggtccttgccgtgttttcctctgtgaccctcatatctcctgtggctcactcgggtctctatgtcttgggctataggagcaaggaacccctgcaggacaacgttattgccacctatgaggagcatgaggacagcgtgtatgcagtggactgggcctcagctgacccatggctgtttgcttccctaagttacgacgggagactggttatcaacagagttcccagggcactgaagtaccacatactgctctagtggcccatggcactgctgcttggtacttggcaaattctcagaaatctgcagctacgaggtaattcctttcacagacagattccctccttgggagaaccagcattgcttctacaggagctctgagggacatggcgcttctgccagcagctcatctgatgctgtcagcacactgctcagcatgggcgggagctttactggacacagctgtccatgtgtgaattgatggctgcccagtctctgtttggtttctggtttctgtttaaagggtgttggaagtttaacttttccccagtgtgtttccaccttcctgttgtcatgagattgcaaactgaaataaagtcagtgggatgcgcacagcctcctcctttcaggctccctgccccactgaggaagtcattaggctctttgtttgttttttctatcacatctgaaaaaaacacagtgccatccctcacctgtgggacaggtatgccctccccacagtgccatccctcacctgtgggacagatatgtcctcctcacagtgccatccctcacctgtgagactggtgtgccctccccacagtgccatccctcacctgtggacaggtgtgccctctccacagtgccattcctcgcctgtggacaggtgtgccctccccacagtgccatccctcacctgtgggacaggtatgccctccccacagtgccatccctcacctgtggacaggagtgccctccccacagtgccatccctcacctgtgggacagg

SEQ ID NO: 21029 - DNA, 1121 bp, Mus musculus
atatttacagagctccacttgcttctgcttccagactgctgggattaagggtgtgttaccaccatgtctggcatttctcttttgttcttaatcaaggcgctaagtttgcccattgtccctgcaccttcagcagggcacagtagacaccagctggctgcccatggctctgcctcactctgtaaaggtagaggaaaggaactgtatgctttcagctcagtttgggaacctaatactgactcatgaaatgaaggaaaatcaccaaggcatgacatgtgctctgggccttgtttatagtgtgaccaagggtctgtggaagccatgatctggttgggctcgagttcagagagcagcacaactatatccttgttcttaggggattcaaacttaggtggtgagggagactcttgtaaatagacaatgcaatcctaaagggaactagaaagatgctttaaggctttggaagaaaggagagttgtcttgcaaaggagcaaatgatgatattagaagacacggtagtcgaggagggagggcatgctactaaggtgacccaggtctgtgcacagagtacaggtatttatttgagtttatgagattcagccagagagaagaactggcaggtagcagactgcaatcttctaccctggatggacagcttgacacatacctgtgataaccaaggaggaagggcatggatttctgtctgtgcgtattctatgcaaagaggttcttgtggctgctcattccatggcaggagagccccactgtgtgcacaatagtcaaggtgtcccacgtgtacaccatgcagaggagcctcacatgtggacgatggtccagggatgcaccatgactggaatgtctcatgtgtgtacaacatcgtgcagacatgagtctgaagaactctacctcagtaactacaaggtggccaggaaaagcaggcattgccagactaattagattaatgtaggaaaatgtaaggaaatgtctcttaccttaaagttcttatcttacctttatggggacctgagttcaatccccaggacccatgttttcaaaagctattgcgctaccataaggtgccaccattgtaccagtgtattttgtatgcacatccttactgtagc

SEQ ID NO: 21030 - DNA, 1151 bp, Mus musculus
tggacatgcccctcggtggtggggcatggcaccatctcacttcttcttcagtaggctttcctgcattagaagaagggcttcattccaagcacacattatttctgaagttcccaagctgggcttgtgcctgctttatgaaagccggtgacttgtagctgtcaaagctctgggctttcctaccctgctacctgaaaagaactcagcgctaactggctccccaccaccctggcctattaccttcccctggattttttggtacagtctcccgagtttctcaactgctgctcttgaagatttaagtcctagtccaacaatatctggtctccttggcttgctgctcggaacgttttttttagtgcctgtcaaacccaggaaaaaaaacgcctgaggtcttcactgcggtgtctgattccctgggaactcactgtcacctacagtggccttggctgtcttcatcctcctagcttcctcagtccctcccctgtctcttcatgtgggcaccccacagtgcatcttctgggagactcttcttccagacatatttggaaacttctgtcttccctctggtgcttctgtcccagggaggctcattcacctgccatgacctcgtagcccagtctgtctacatttccttacttactgcccccttttctatctgatacacctttgttagctgtctaactttaggtctagctccattcatttgaacggtagcggttgtgtaatgacagagagagtgatcagtgttttaaaatccattgcagcttagcacttgtaacaatagcaaatgagagggacttagtggatgctgggtaaggtacagcaggcagatgggaggacactgtagggacactagggcagtgtgtccaggacaagccctgatgcttacagccatatgacctcactgtttacttctaggaggctccttttgttcatgtggagaatgagaataaaacaaagagcatgtctgagtgcctgctccaagggaggtccctaagtggacgaagattgatgatgaatatgagcaagggtagtgaggtggaaggaacacgctgaggtcatccatggaaggaggtgctttcttagacctagtagcttcacatggagagtcctgcagaatccaagctggcatcctgtagaagctgagaccc

SEQ ID NO: 21031 - DNA, 1183 bp, Mus musculus
tagtgttcagcaggctctccattactagcattgccaggagtgtatgaactatgaacttcacagcaagttccctggctcctgaccgtgtcctagggacacccttggctctagtttcttagcatgtgctctcttcaggatggtcacaacaggagagctcatgaccctggtctcagagcccaaggatgctcagatgtgtgagcctgatgtttcattccactgctcacagctcaaccaaggcctgtgaatatgctgctcattttgggttctcggggtactggcctaagaggagaaccctcattgtccatccagggctcagttaggcctgtgtcatacgttgagaccatcggggtgctctttagggttgtattctgttgggatatattgcctgtgtgcatgatcttggatgtttgtaaggaagatgctcctgtgaggaagccatgttggtttagtccgtctatctctactctgccaaatttgttaacatccaagaaatggtgtaaagcgagtctgaatgcctgggaccctggcagctctgactggaagcttggtttgatcctaatgaagccaccttcctgtagttttctccccatggtccacttggcctccttttttgttagttgactccattggtggtaagtgggagctgtgggaagagccttcctggaacagcttgtttgagctcagtttgcttccactccatgtctccagtctgtgttccccaacatgtggaccagaaccagaggagggttggggtggaatagctgaagtttttggatgttgggcagactggagaagaggtgttctctacacagatctgagccccacggtcagcagataggcctgatgtgtatctacaaatgtgggagttggagagtcactatgaattgctggttcccattgacagaccatgttcttttcatgtcctgttggagaaattggccttttcctatgcacttggcaataaggggaaatgaaaacagattcaaatagataaaaggaagccaaggctgttctggggctcggaagtcaggactgtaggcctggagctagagatttcttaggagccaggaaattaaggaaatgaagaggcatctgcaggctgctggcctggcctgccactcagggagacctcttgaatttcacaatatccaggacaccgtcttggttttacagtgacagtttt

SEQ ID NO: 21032 - DNA, 1868 bp, Mus musculus
ttgagtgacccgaatagccccttgcatcggcaggatggtctgcagccaccacctgccttggttcctggccatggtgtagggagggtgatggtctgcagccaccacctgccttggttcctggccatggtgtagggagggtgattcactctccaggtcctttgaataggtgacagacaggcagagcctgaatgtcaggaaattccattgtatgaatgctttaaaggaaaacgttccctatacctcattattttttattgcatgatgttttataaaaatttgcccattttagatgttagaaaaattatttccactatgcaaatttctttttaattcagtgaaaagcaactgttatacctcatagtctcttgtttttaattgaccaaaatattccattctattctcacaaggttctgaggtctctgcctgaaaaagcaagtctcaccctatagacactgatgtgcccagcactacgtgccagccattgtgggaacacaagagggtcacctgcccaagggctagggaggaagacctcaagaacacagaggaggtggaaaaggacaaaataggtgccattttagggagaccatggtcagatagggggatgctcagttccttgcagcctcgggcgggcttatgttggcactaaggccattgtggagtgtacttatatgatccctatgctgataggattaccttcctagacatagctagacgcaaagccacatgtgtaaggctgctgagcaaagacagcatcccagcatgggtgtgttcacggtggattcaccacgttgcatatgtaaagtggtccccttggcttacccttcactttgctcatgagattcagaagctggtggtccagcaggggtgagcatttgtgaaatagtaagctgaacttagtggtgagatttcagaacagacttctgtgaagtaagagatgtaaccatgcatctaaaatcagatggccgtgtaactgctcgggcatagaaatggtgggagaacctgtcctgggtacctggcatttcacatgagcccagggatatgtcttgtgccaaggcacacaagtgtccatggacttggacaggtgccaagggtttttgtctctgttcctatgtgggaggctggctgtgatttacattaatttctgtatttcaaacgaagatgtctgcagatctccattttgatgttacagcctcattgcccaggcagtgggcagtgcccagacaccctttctgactagccactgcattgggcttctgtgattcaaagtagtgtatatatttatttacttctctgactgtggccaacagccaaatgccattttatgttccttgtattcagtccattaccaaagaggtgtttgcactttgtaatgatacctttcagttcaaataaaaggaccacatcgttaagtggagaatctgtcctttgtactttgacacaaacaataacttgttcactgagtgatgtggaagtaagaggaaggggtccagtcctccacagaaactcagagctatgctgtgagcctctgtgaagaagaacaaggaaagaaatgggggggggcgagtaagaggagcttttctttttgacatagagatgcctcagccagcctgatgctatgtgggttcagcccctggaacaaacctcatgaatttatttgtggaccagtatattccaccttcaggaaatgcatggtacttctggccctctgaggggacaggtagcccctgctcttccaaagcatgagtaaagatcgtgcagatctcatcacaccatcaatgtaggacgtcttccatgtgtttgtgcttacgtgtggccttcagcctgagcaaagtgacctgggacacaggatagggaaaggacgctgttct

SEQ ID NO: 21033 - DNA, 2115 bp, Mus musculus
cactgttctcctgttaccttccaggaccgaacgtcaatcattgtgttgtgttttgcttttcctacaacagattgttctcaaagtaccagtactttgactcccgggggatgttcatttctcttgtgttctcagcgccactgctcttcaacgccatgctcattgtggtatgtatgacacagacgcttatgtcctggctttcttcactcagagcctttgcagttttaatcatgactccaaatggtttttagattatgtgggtacggaagactttgactgtgatgaccgacctgaagaccttacaagaggaaagaaaggagaggaggaggaggaggaaggaagagtaatggtgaactgctgctgtgcgccatgtttgtcctctgacttgcttgtttccagctgggaactaactgcacatggcccagatgccaaatgtcagccgactcatggtttagaaaaaggtccttatagcttagcacaccacaactggttcttatagtttactctgtttggagccctcttaaagctggttcttaaaagaactgatggcatcaccgaaacacgttggatggggacccctcctttacatggggagagcttcctggttcagccactttattcacagcttctcacacgttgctggtagacctcattatgtaactagagttcacgaggttctaagtgtggacactgggaaataaagagccccgatcctgctgggatcactacctgctccctcttctgtttctagcctgtagcggtggctatcagctaagggtggctttgttccccaggaactttgctgatgcttgtcaccgcaggtggacatggtacttgtgtccataggacagagccgagtcctgcagggcacaggacagccccaccgtggagtattgctgtgtacataatgtcagcagtgcccaggctgagggagcggtgggtcaggtctggggaagaatgtggtgtgtttcagttcccatgaagctaggcctctaaataattgagttggggctatgccactgggaatgttttgtttaaaaatattaagctagaatgaaagctgtaaagtcaagactccgtggaaaatagtatgtcaaatgaaccgtttggtcttgttttttctggatacagaattataaatacctgcatgctctgtgaatggcttatctgtttctacccagactgtgacaagtgcagacagttcttcccaagtgtcacatttgtgcggttgggggctggcgaacacagcagggtgtattgtcacctgtgcctctgttttgtcagacacccttggtttccatggaatccggagcaataaacctttagagatttgaggtgacagagacccagacttagagacagtaagaaatacactcttggctttagtttaaagaaataatttgtgaagtattttctttatttaataggattttttcctttctaaacattcttcaaagttctaagctaaaataaaatctagttaaaaatatttaaaaggttaaaagtagatcgtttgatagactaccgttatgttctgaaacccagttatatagtttctaatgtttatccagcttccggatttaacagaaacctactcactgtcttgtgacaatctgatcatcctgtggtgtgagtttgcggctcctgctgcagcacttaacctgcattgtgcacagtctcttgatttgttccacttcacattgaacaaaaaagtgccaaggaaaataacacagtgttaagttcagattttgaatttaaatcacactgttaagtcgtggacattgtgtctaaagggatacttaattgtatgtttctgaagttttctggttcaggatatttgatcattttatggttacaaaggtgcttactataacattgattagtttcatagaaaataagaacaaattagtccgttagataaatctgaaacaactgagtgtcagataggcctggactcaccaactagatgtgttcccttcaggcctttgtgtctgaggccagtggggcagaatggggcagagagcggctgcgatgtccgcgttctggcatatgccggtattaatacctcagcttgtgtaaccatgaccctgaccggctttcttgccttgtttctgcacg

SEQ ID NO: 21034 - DNA, 1391 bp, Mus musculus
tgccgtttgcttgccgtgtactctcttctctaggctctcgttgtgacaatagctccattcacggcagccttccagttaacactggcagtttaagctcagacacactgagggtgttgagggatttgagagaggagacgctggatgtgctgatgggcctgggactccagcaggccgtcctgggctggacagtgacaccctgtctaaaaggggaacaaaaataacaacggatgggagcagcagatggataaagttaccatcttcagtcttacttggtttttgtctactttcctgagctttgttcttgtttgagccactttgctttaaaaaaaaagtaagtgtgcttaaatactggtatgtgtttgtaagtgttctctcatgggcaatttacaaagttataggcaagcaagagtaatttttgtgtattttcagaaaagagacctcaaatttatatgaatgtatgtcagaaaggaacatgaattcaactgggaagttatcaaatacaactgagatacaaatccagtgtctgcctgcttcttactgacaagtgaacaagatacctaaatgttgcctccatgtgcctttttatttgcttgagtgtgaagtttgggctctcagcctctgtgttagaaagtaaagtgatgagatggatacacacaatgctgtgttggatggcgatgggtgtctaattgagagactccaggcactatccttatccttgggccttcttcatgtagctggtgctccctacccgcttcccagctgaaaaggtggtaactgtctgtcttagcctgtcttagctcaggtcactactggtgagctccagtcacgcagaacttgtagttagaagagccatcctgacgtctgaaaggaaggaagcccaggggcctaggaatatgcagtctcttcttggccagggctcctctctcgaaggaggaaagcttacacctgactcttccagaagaaagcagctatcccagcaccctctcacagaaaggccatgatgtcccagcaaaggcagacacttcagctgcctttttgggctcctgtggggttttggtcagagtcttcacaaaattaaaaccgaggaagggagaggacaggtagtcagccacaaggaggaaatggattaagtcaaagctctccaccctacttcagtgcttgcttcagaatctcagatttctctttcaggtcataagatcctattgttttcttgaaattttacctgtgtatcttacacgcagatccttggaatgtcaggttctgctttgttctacggctgtctcaaacagcacagtgtgtttataagggctcatgaacagagaaattaactttttacattcaatcaaattacatttgtttaaaatacagccattaaattttaaaactgttct

SEQ ID NO: 21035 - DNA, 1174 bp, Mus musculus
tcaggtgtgcgcccgctgggcgggtcccgtcagggaggcggaccaaggagaacgctttcctcttcctggactggagtgaggagctcgggtaccgagaggagcggcaggcaccagtgagtaagggtctgagcggctggggcgtgtcggcaccgcggcaactcttcctcttgcgatgggcgttgtgaaagaggagagaaaacagtcaagtccctgggtttgtctgggcgcatccaccaagatcatactgcacggatccttttgtaaatcctcagaactcaagattagttttctacactcctggctaaaggttttggttgattgttaaccacagtcgttccgcttcattgcagaaaaaaaattttttttcctccagcatttccagttttgaagacagactttcattttgttatttttcccctaatatctgatgttttaccatcttctggtttcaaattgttttgagaattggcatcctgtgtacttgacacagatgaaggaggtgcagattgggggttgtgtagggcctttgtgggaatgtgatctctgggaaaggatagtccctaggggaggggctcacatgcgtttgggacttccagaggtagaggtgtcaggactttgacacagtgtctttggttctgcgatactttacaaaggggtggtgtggagggtaatttgattgctgcatctctagtatatagtgcctgtatggttttttttgtttggtttggttattgttttgttttgtttgttttgttttcttttagtgctctgaacaataggaataggtaacaataggaagcaggtttctcccctggcaaaatgtgccggcttcttttcaacagatgttactactgccctgccaaggcagaccagggaagaaagacttgaagtaaccacctccatggaggaatgccctggcctggggcagaagccttgccctgttctgtgtttaccaagtgaacaggttctgtattcctgctggcccaggtattttccttgagatatgaggaaatgtttcgattactaatgagttagttcacttgtacacaaagtttagagaataacacggctgggttgaaggtgctgttttattctgctctgtggcctgttattgaaataccatagtagcatctggttgtttgtaaattgctatgttggaggttaaaatagacta

SEQ ID NO: 21036 - DNA, 1162 bp, Mus musculus
agtggccaggtaccgccctcgggctcccatcattgctgtgacgtgcaatccccagactgctcgccaggcccatctgtaccgtggcatcttccctgtgctgtgtaaggatgccgtactgaatgcctgggctgaggatgttgaccttcgtgtaaacttggccatggatgttggcaaggcccgaggcttcttcaagaagggatatgtggtcattgtgctgaccgggtggcgccctggctctggattcaccaacaccatgcgtgtagtgcctgtaccttgatggccctctggagcccctcttctagcccctgtcccttcccctcccctatcctttccattaggccagcaacgctaggccaaagtgtggcgctggtgggctgggacaccagggaaaattaatgcctcgaaaacatgcaatagagaccagctgtttttcatggccctacttgagccaggggtgaaggaggaatacagaattggaaaccctctgactttatcaaagatgggcagcagcatctctgtactttgctcctatagaaagttgtccagagatttcccagccctagcctggagtcgggagacagcaagagtaggggctgagggcgtggggcccagggtcccagtatagatgacgtttgcccctggccctgacctgctttcccaacagctttggcctccccactccttgtgcactccactgctgtcactgcagacactctactctccaccttgtattctgcagtctccaggccttttgctatagtgcccacctgaacgtcagtaaacagcagctgatgcaaaaaaacaacaacaacaacaacaacaacaacttttcctccacaactttttcttggtcattgtgttttaacactgtaattctaagacagacatgaaatagagttatttatatcaaataatttgtgtcaagtacacgatatccctcaatgcagtaagcactcaatgatacaattatggtcatgagataattgaaacagaagactgtggcaaatgactacagcaccattcccagactctaaaagcccagaattgtacatgaagtgtgagtgattaaagcacttatgggacaatattgctccttgtccttgcttgccagtgcaggtgctgcctttgagtcaacaaagtcctcattccttacatggatcag

SEQ ID NO: 21037 - DNA, 1132 bp, Mus musculus
gagagagagagagagagagagagagagagagagagagagagagagagagagagagagaaagaaagagaacatccacagtggtagttgtactggctagttttgtgtcaacttgacacaagctggagttatcacagagaaaggagcttcagttgggaaatgcctccatgagatccaacagtaaggcattttctcaattagtgatcaagggggaaaggccccttgtgggtgggaccatctctgggctggtagtcttggttttataagagagcaggctgagcaagccaggggaggcaagccagtaaagaacatccctccatggcctctgcatcagcttctgctttctgacctgcttgagttccagtcctgacttcctttggtgatgaacagcagtggaaatgtaagctgaataaaccctttcctccccaacttgcttcttggtcatgatgttttgtgcaggaatagaaaccctaagacagtagtgcttcactagaccttcatctacaagaacgtgtgctgtgttggatctgacctgtgggctgacctgtttacagagcccctgtgcagagacaactgatgaatgagaaataaatttgattctagatgatagaaaggatattgtgttctgaaggaacggccatcattggtatagctcaacaaattatgtgtagcttctaaataaaggaagaatccgggaagatttcgcaaattttccttgaatgtatcattgaaaatataccagttgtattcgaaagtattctacgtctagtttgctgtgtcataggtttccatgtcttcagagtgtaatggctgtgaatatcagtgtcatggctttcagccctgctgggtttggtcttctcaggaaactttctatttttaattttttatttaatctttagagtactgaggcttaagacatggccttgtgcatgcctgggagcacagtactactgctatactgccagtccctaccattctccttttaatggctgtgcttttataaaatttaatatgatctggaaaaaaaacccatcagatctaatcttaactgggcaagaagaaacaacaaacacaattaaaagcccacttttgggcccatggtgctggctcaggagaaaaagtgcttgccacttac

SEQ ID NO: 21038 - DNA, 1193 bp, Mus musculus
gattccatctaagctttgagggctttggtaagtctacatacccattgcgtttcacttacaagaagatggcaagacccagtccagagtaattttcttttatttttgtttttcaaaaaaaaagattgaatgggggctggagagatggctcagtggttaagaccactgatagctagctcttccggaggttctgagttcaattcccagcaaccacacggtggcccacaaccatctgtaatgggttctgatgccctcttctggtgtgtgtctgaagatagtgacagtgtactcacaaatgtaaaataaataagtcttaaaaaaataaataaccagccacccgccactgcacctgaccagtattgttggctggtgcaatccagtggtgagctgacagtaagccccagcttttaggaaacagggctgtcctacatgtggatggctctgtgccgaaagcatgggaacaacctagcgataggtaaaatggaaccatgatctcagaagacaggggaagctgtaaaaggccctgtgctttctttctgcagttaaacacagtgggaacattacttttgatgagattgccaacattgcccggcagatgagacaccggtctttggctagagaactttctgaaactatcaaggagatcctgggtactgcacagtctgtgggctgcaatgtggatggccgccaccctcatgacatcatagatgacatcaacagtggtgcagtggagtgcccagctagttaagaagcaacaagaaaatatttcaataaaagactatctgataaaaaaaataaataaataaataaataaataaaaagaaagtccagtgatagtcccaaagtgggatccagctcaaggggaggtcccaaggcctaacactattactgaggctatgaagcactcacaaaaagggacctatcatgactgccctctgaaatatccaacaagcagctgagtcagatgaagatatttgcacccaaccaatggacagaagcagctgaccctgttgttgaattagggaaggctgaaagaagttgaggagagggcaatcctgtaggagggccaaaagtcttaattaatctggaacccccaagatctctcaaacactagaccaccaaacaggcagcaaacatcagctgatatgaggcccccaacacacacacagtagaggatttcctgttcattcagagat

SEQ ID NO: 21039 - DNA, 1135 bp, Mus musculus
gttctttaccagctaataggcactttggctgttgccattcttgggctagtgtgagtaatgctgcttgttttctcacatttcctgtgatggtactgtggtgcttgacatattattgtacaatgactatgatttttatgtgtgtgtgctccttattaaactgtgtgtagcatatggatgttatataagccacaggctatatcatctatggaatgattaaatgaagaagtgagaaagcaagcattcaaaattagttctctcctgggcatggtggttaatatacccaagtgtgtttgctacaagggcctgtttataatcagcttcaagaaggaacagtttactggtctaccaggtggttgctacaagtgcggcctttcaagaacagtctccacagaaataccaagcacacagtcagcttaggcacacaggagggacaaaaggacagagtagcaagcagaaccatggaatgagactttcctcctgcttttagacattccgcccagccgccatgctgatcgagcggtcttctgactttgggaaggcttggggcgtgtacagatacttcgcctacgactgtgagagctcgttcccaggcatttcaactggacccatgaagaaagtggatgacatcatctgtgactctcgatattctgacattgagccctcgacagaaggagaggtttgtatgcctctgattgagttctctacttgctagtctgccttttgatcattgcaaaaataccaaccctctgatctatttttaggtaatatttcgtgctttagatcctgctttcaaaattgaagacccttatagtccaaggatacagagtgagtttgttttgaaatacatgctttggtgggaaacagtacttacggagggtctcatcctacccagtgctgtgtggcccgatatcttgatactcagtcctacatacacctagatcttcttcctttctttgtggtcttccaaaaaaaaaaacccacttcaaattaccagtaatcaggcttcactgataagaaacacattttgactatgtcagcagaactccaaaaatcagactgaccatgccaccttctgtttttgatgctcagtatataaattagagtacagattaaactgctgtaatcaaacaccccc

SEQ ID NO: 21040 - DNA, 1271 bp, Mus musculus
tttttttaaatcatagcatggagttacttttgccttaaaaacaatttttcatttcaagggtgctggagaaatggtgaacgaggcggccctggcattggaatatggtgcttcctgtgaagatatagctcgagtctgccatgcgcatccggtaattattaccaatacacacaggcttaatggctacccccgttttcttttgatctgtaactactcatgtttaattgtgaattgttttcccttgcagaccttatcagaggcttttagagaagcaaacttggctgcagcttttggaaaaccaatcaacttttaattagaagattgtttttcttaaaatctggaagcttttgtcaacattacatttttgaacaggataatcttccagttccaagaatttgcaggatgaaattatgaaacttctgggagatctttagtaggtttgaacagaatggaataaccatgtacctatatttcacgtatcttgttccagtgcattaatgcaaacagaaaactacatatagaagaatcctggaaagttttgacctgttttcatactgtctacgagattcaacttcactgaattagcactaatagattttacctctaatttagtggaggtgaatctgttgacaggaaggagctggaaaatatgtgtgaacaacttgaagaagactggcaaacttactttaaatttggttttcatattggaaacgagtcaatgactagaacaagattcaaatatgtacaaacaacttatgtaaataaaaatgattttctctcatttatttaacttccaaattgctggcagtttaagaggtagaaatacatgttacctaagtgaagatttttgtctacagaagtattaaatggagactcatgattataccagggaatgaagacaccaaaataaacatgtcttaaatattaatttactggttattctgagtgcatactaagattgtcctaattctcactacctccgattaccttttattttgaattgtcgcatctgcagcactgagtgttcacactgtccaacagtactaagttgttggtgtggtcactgccctttcatttcctttacagtaactactaacctgtgctttagcctgtgctgaaggggtaagcgaagctcttgtgtgctgtagtttccatgtggatctccttggcttagtaatgtttttaatcttagtaaatggccattttttaagagtgctacaatttatatttattgatgttattgaacgtctaaatgttaaaatgactgagtatct

SEQ ID NO: 21041 - DNA, 1119 bp, Mus musculus
attgaaaaaaaattcactgttccactttgagaaatactgactttattaaacccaatgtttagttttcttgtgatgcattttgttaacctgtgtaaaagaattaaatttcaaaatggttgtaaaaatgctatttttatgtgaatttaagtgcagccatatcattttttaacccatattttaccactaattttccaaggttaaaatcctaaaagtaaaaatctactaaatcgttaccaggcagactgttaaatgtagggaattattcacactttaggcactgaaagttcaaagtgtagttctgtaatacggttcactcggatgccttttcacagcagctgcagatcatcagcgtttctgtaactgtgcttggctggcatgtctccaggtagtgtgtaattgggaaaccgacctgctctacaggctctaagctgccagtgagtgctgttctcattgacgctttttctgagtggctacaatcacataacttgtcacacttaaaggtcttaagttacattattttataggactgtttaaagttgttattggatgaaatgtgctctctgttcactgtcttaacctacatgtttggggctgactaggctttatttaaatctcctttttctcagtttgattctgtgttttagtgcatagtgtgttcttatttatggaattacacactgcagtttgaatgatgtggaggaatctgactaatgtattagcagacggtgttccttgtagtcacaagctagcatgtactcgggtttttgtggctgtggtgagtttttcctctaagttgaaattttaaaactatcatttcttttattggtaaaacagtcaaaaattggaacaatttactgtcgaatcaatagtaaggacaaccagataattttgaattggacagaagaaaagtcatggttagattgtgaatttcagtgccatgtaaggtgcctttagagtcagtgtttgcattataggggcttgttacagtccattggagatgaccactcagtttatacatatttctaagtcagcatccttaggatattatcgtatatcctttggattgactaaactcttgtgaagcttttcttcccctttaaaatggtgcataatataaac

SEQ ID NO: 21042 - DNA, 1470 bp, Mus musculus
tgatttgggaaggactaaatgaaaaggaggtgggaggacggacagaaagaaggatgagggggagggggagctggccatggcagttaacaggctttggttttattttttgttctataatgtttaaagtttcaaactttctcaatccgtattttcacattttaattctctaatgactagcagaataccatttatatacaagtgtttgtatctatgaacgtacttcttaatctgctattttttcttacagaaccgtttagagaaagagaagaagaaaggcctgtgaactaactttataaaagaagactgtaatacaccttgtcaaagttcagttgaaaacaaagaaagctgtgctagcgcctgcagacccgcacaggctatacagtagtgacatttccaaaatatttgataatgtttcagatttcagatataaagtatggatttcagctcttttggaaaatataagcatgttaaataccatatttacatattgctaatagcattgatatatggtggctctttacccataaaaggaaattttcatttgctagcatttacttcccaaattagatctgaagttgcatgaaaccattattagctttgaaagctttgatgtgtttttagtaataatcagatgatggtagtggtaaaaatgatgtgtttgaaaagagaactcagtatcagaaaatgttttcacagggaaacaaggatgagtaaccacaattagccactgcgcttatcgagaagagtcagagaacagcgaaaactacggccttagggctcttcaagcctcatgattgtacaacctactcgaaatatgacagcactgttgatagtgtgtgttgctactgtgcttctgtgcctataagactattgataatttgtttagtcatatatggtcagtagtctgtcttttcaaggtcatctgctaatagaatgtatgcccatttgcaaaactgtcataccactgaactgagcttatgttgcactgtggatttctccactgacaaagcttatttacgacatcctaaaagcagcgttttttctatttgtgaaagttactgattgtactggtattacctcagtattcatgcactggtatcatacagatctctctactatgtttctatattctcaaagttaaatacaggttttcatgcaaatattcatgtagaagtagtgagtgtaataatatgatttaggttatttcagtgtttaactgtgaaaagccacttgtcttaaaatgcttaaatataaaagaaaatgcaaaataataattggagtttttattctctagtttttatctataattttaatgccaatcctatgtatatttaattgttctcattgcaaagtgggtaaaatgagtaatacctaattgtatttcagataaaagttaggatttagtgctagaaaacagacatgaggaagacactctccggggtaaaatacaggagttacaccttgtgggct

SEQ ID NO: 21043 - DNA, 1184 bp, Mus musculus
actatgaccaaggcaacccttataaaggaaaacatttacctggggctggcttacagtttcagaggtttagtccgttatcatcatggtgggaagcatggcagcatccaggcagacttggtgctggagaaggagctgagagtgctacatcttgatctgaagtagcttgaacatgggaaacctcaaagcccatctccacagtgacacacttcctccagaaaggccacacctcctccaacaaggccgcacttcctaatagtgtcactccctaagggccaagcattcaaacatgagtttctggataccatacctattcaagcaccacatggcctatgcccatttccatagacaactccagagtttaatattgcagctggtaagcccggcaaacatccattgcctgtccctttccctaaaagattagttgtctatcccttggattaaaaaaaacataagttcctaatagtttttacataggaatatatctgagaagatgcatactaagatatttaggggaaaatatcaaagagactttggactgaaaaacaaagcaaatatgacaaattcttcaaaatttgaattcctatgataggattataggtgtgtgcaggacagattgagcatccccaactaaaaattccaaatttaaaaatttgaatctaaagaattgaaaacatttttgcacaagcatgctggcacaggtagaaaatcttatccctcattttgtatgatagattagagtccaaatccaagaacagtaaagacattgtctgaaattaacttcaggcttacagctgtaaagcatgtgtaaaatttaagtgtatttcatgtttacatgagtaatatttaaaacatgaaatttcaaagttcttaacaacagcagcaaaaacagcctaaatccaagcatgtctggtagtaggcattttacagaaaatatgcagcctaaatgagtttttcaacaggtcagaaatgttcctggcaatggtacttcatacattaaaagtagagctttaaggtttccaaagcagaaattccacaagccttcataatctccatgttcttttagaaacgactgagaccagcaagattaagtgacttgtctaagattgcctacccacttcttacaaatgtcactccttgctactttagcttttaatatgtattgcaaactgttttccctaggaact

SEQ ID NO: 21044 - DNA, 1959 bp, Mus musculus
agccaccagatgaactgtagtgtagagatttgttctgtgttttttggtgtatatgtgtgtgagtcgaggtttcataagtagcccaggctggcctcaaacttgcttttgtctccaaggatgaccttcaccttctgatgcttccgcctccaacccttgcggtcctttcagggattacagctatgcaatacaagctcaggttctgtgtatgtgtacattcaagtcacagaacaaactcaagtgttggtcttgccgccttttatttagtgcaggggtttgaacccaaggttctgtgcttaaaggcaaagtatatctatggaaccacacagccattccctacaaattctctaatgtctggaacttcatttgggacattagcacttttctgtgcatgctggtctcacatttgtttaaattttccagatacttaagctatgagccattaggaaactgagaaccaattattttgtttccacagggctctcaacagcattaaacctgatgcttgtgtttgtaagtctgcatctgcataagtactgactctggatggaaaagcttggaagaccttggtctcaccatttgtctacatttgtgtgaccataaaatgctgggagcattgagttttgtaatgatttaatgggtgaggattgctttctccattagagcattaagctataactatcaacattgtaaaccaaattgccttattttccttccaaacttcatatatctatcaggtaatataggcttgaaaattgatatcctgtggtgctaaagtacagtagaaagatgtgtatacgttttattttaaattgtacgaaggggaatttaaaaatacgtaactgctgtttatacatcagctccttactgcttattaatctgtattgtacccacgatatcaggagtgaagcagacgctggcctttccatgaatagccaccacatggcccagcatctctgccaaacacagttgcttctagtctggccagtgccaagagacaacataacatggcaggtggatggtgtcggtgtcattgtctcagctcaaagagccacctgcttcagataccatgggcatgtgctgagtggatgcaccagggggcagcacagctccatgattcccagtggggcccaagccaggccaaggtgcagtcagttaatagcattgggacagtcattgtaatggtgctgttaccagtcgacaccattgtgtttgaccgcgttcctgtctcctcagccacataccctcatctgtgctgtcagtgtgtctctggtggggcagactttgcacttactgcagtgcaccacttgcactttactccctccggcttctgagacagagcaagtacttcagcagtcctgctgctcttgctctgagctacaatcatggcttctcatgttacttaccaagtgagagttttggttagtaatcacagctgtaaaattgatttacacttgttaaacatattgcccctcaattttgcacactatattcttgtatattatttcaaataaaaggaaaaaaaaggtctgtctttgatttctggttgactgaattcatgatacctatcagtataatctgattggcagatggaaaacaaattcttgataaaactgagttctggtgttataagtaggtttctggtggggttttaaaaattaaagaatgttaacaatggagtaaagactaaaaaataaggccctgagtgcctgtttctagtaaaatgactgtaaagaaaccctgacttcatttaaagctgtagttagatccagtaaagagcatttagcagtgtgtctgcctcagccttgggctccgccatagttactgggcttgactacatgcccacatcactttggggtagagtggctctgtcaggtgtatactcctcaactccctgccgatgtgacttctttcactggttcgttatgtgcttaacactaaagaaagtggcaggctgggagg

SEQ ID NO: 21045 - DNA, 2816 bp, Mus musculus
tccattgttaacattctttaatttttaaaaccccaccagaaacctacttataacaccagaactcagttttatcaagaatttgttttccatctgccaatcagattatactgataggtatcatgaattcagtcaaccagaaatcaaagacagaccttttttttccttttatttgaaataatatacaagaatatagtgtgcaaaattgaggggcaatatgtttaacaagtgtaaatcaattttacagctgtgattactaaccaaaactctcacttggtaagtaacatgagaagccatgattgtagctcagagcaagagcagcaggactgctgaagtacttgctctgtctcagaagccggagggagtaaagtgcaagtggtgcactgcagtaagtgcaaagtctgccccaccagagacacactgacagcacagatgagggtatgtggctgaggagacaggaacgcggtcaaacacaatggtgtcgactggtaacagcaccattacaatgactgtcccaatgctattaactgactgcaccttggcctggcttgggccccactgggaatcatggagctgtgctgccccctggtgcatccactcagcacatgcccatggtatctgaagcaggtggctctttgagctgagacaatgacaccgacaccatccacctgccatgttatgttgtctcttggcactggccagactagaagcaactgtgtttggcagagatgctgggccatgtggtggctattcatggaaaggccagcgtctgcttcactcctgatatcgtgggtacaatacagattaataagcagtaaggagctgatgtataaacagcagttacgtatttttaaattccccttcgtacaatttaaaataaaacgtatacacatctttctactgtactttagcaccacaggatatcaattttcaagcctatattacctgatagatatatgaagtttggaaggaaaataaggcaatttggtttacaatgttgatagttatagcttaatgctctaatggagaaagcaatcctcacccattaaatcattacaaaactcaatgctcccagcattttatggtcacacaaatgtagacaaatggtgagaccaaggtcttccaagcttttccatccagagtcagtacttatgcagatgcagacttacaaacacaagcatcaggtttaatgctgttgagagccctgtggaaacaaaataattggttctcagtttcctaatggctcatagcttaagtatctggaaaatttaaacaaatgtgagaccagcatgcacagaaaagtgctaatgtcccaaatgaagttccagacattagagaatttgtagggaatggctgtgtggttccatagatatactttgcctttaagcacagaaccttgggttcaaacccctgcactaaataaaaggcggcaagaccaacacttgagtttgttctgtgacttgaatgtacacatacacagaacctgagcttgtattgcatagctgtaatccctgaaaggaccgcaagggttggaggcggaagcatcagaaggtgaaggtcatccttggagacaaaagcaagtttgaggccagcctgggctacttatgaaacctcgactcacacacatatacaccaaaaaacacagaacaaatctctacactacagttcatctggtggctgaccctactttaaaataaatccctgagccatttaacctacaaattatataggattggctaaacacccttaataagccttctttctgattaccgttccaataatcttcattttaaaaaaataatacataagtttattctagtctatcctatgtattttgtgctaaataatctaaaatgtaaacataaaggatgctattcaagtaaagaacagttataagaatggcgtctaccagccaaagacagcattgtgaaacttctttctcatccttcctgtgtctcctagtttctgcctatagcagaagcctgcaaggatgttaccaaaaactaaagatcttctactgtaatgagttaatgatgtccatcttttaaccagactactagtagtatactctaaaacttcctcagcacttggggcattcttcagctagcttgagaaaatctgcttgctgtactactcaagtggttcttgatagaaaaggcagactccagtattaggtttgaagtataataatggtgagggatctttaagactctgcctgccatcatggcacaagaacacacagagcatcagatcaggacttctgttactactaacacttactgagttggttcttttccttttccaacagtcaggatttaaacgcttttgttcttcagccaaagcctttgcttctaatgtgtacatcctcctttcttcgttcttcatttttttccacctgtcaccaaggatcacacttatggctctgcaaagtaaatatttacataatgtaaagtttcataaaatgtgtagcagctgctactactttggggagaaatgtaaaaaaaaaaaaaaaaaaaaaaaacagaaggggaaagatcaagactaccatggtcatttcaacgaaatcctggcatatgcatccatttatcagttggtggaataatgatagtatttacaattgttctaaaacatccaaaattgccagaaaactggcaattttccaaaggaaagttcagtgtcagcagcgtggggcattcaacttgtattaaaacttattttgtgtgcaaagctattgtggttatgataataaaagctttactccccccatgcagtgcaagccaagtaagaaagactatctttgctttagagtttatgtctag

SEQ ID NO: 21046 - DNA, 1106 bp, Mus musculus
gagattaatctctttccattgctggaacaacatgcctgagataagcatctgtattagtcagggttctcttagagaaacagattgaggattcatttcagggcagggagttatattatcttcttagtgttagtagtttacgagaatttattccctgttttacatagctaagttggcagttaagcaagcaagggtcctttggtgaggctatgaatcaaaggattaatggccaagccatgtccataagtagagtagttaacaagggaacaagcagaacaaagatttataccagttattagatttttttgatctttttttttttcttcctgaaatttattagatggtttacaggctgtggatcaggtagtctaaaaatggctgtctaccatcagaaggttcaagaatccagtagtagttcatccacgaggttggatgtttcagctggtctttagtatatgcaagaatcctcattgtctattactgcacaaacatcatgaccaagaaacaagttggggaggaaagggtttattcagcttacacttccatactgctgttcatcaccaaggaagtcaagactggaattcaagcaggtcaggaaacaggagctgatgcagaggccatggagggatgttttttactggcttgattctcctggcttgctcagcctgctctcttatagaatcgaagactagcagcccagagatggtcccacccacaaggggcctctcccccttgatcactatttgagaaaatgccttacagttgtatctcatggaggcactttcccaactgaggctcctttctctgtgataactctagcatgtgtcaagttgacacacaaaaccagccagtacactcatgaaataggctcttatgccagagaaagaattacttttccagtgagagcaggcaggcaaagagagcaagcttcccttttccatgtcctttatggacgttcacagtaaaaggtgtggcccagattaaagctggatcatcccacctcaaaaagatctagacaaaaggtgggtctcgccacttcaaatgatttaattaagaaaaatctttcataggtatacctaaccgcttagattttacttaattccagatat

SEQ ID NO: 21047 - DNA, 3528 bp, Mus musculus
ggctttgcagttacagtctatgtaactcggtcatataaatgagacagaaatacctgcttttctgtttctgtcttgggttgggtttttggattgtatccgtttttaaggccaaaatttaaggacaacaagtttattaaacttgtagattggcaggtctaggcaatattaaggcacttggccagatcctgagtaataattaccaggactacgtgtagttctcccaagcaaacattttcttcagcagtagaaaagatgaggcatctgatggtttgcctctccctttaagaaaaccagtctacgaatgtttatcataacctcactcgtattgacccttgacagctttgtggatttgacctctttaagtaaattggtcaaagcatgatctgaatatttggtagacggtctttttaataacaaattttacattcggcaggatcttctccatacggttttcaagaatgggaaggtgacaaaaagctactcatttgatgaagtcagaaaaaatgcacagctgaacatcgagcaggacgtggcacctcattaggcttcatgtggccgggttgttatgtgtgcagtgtgtgtatacatacatgcacgtatgtgtgcgcctgtgcgtatgtactaacatgttcattgtacagatgtgtgggttcgtgtttatgatacactgcagccagattatttgttggtttatggacatactgccctttttatttttctcccagtgtttagatgatctcagattagaaaacacttacaaccatgtacaagattaatgctgaagcaagcttttcagggtcctttgctaatagatagtaatccaatctggtgttgatcttttcacaaataacaaaccaagaaacttttatatataactacagatcacataaaacagatttgcataaaattaccatgcctgctttatgtttatatttaacttgtatttttgtacaaacgagattgtgtaagatatatttaaagtttcagtgatttaccagtctgtttccaacttttcatgatttttatgagcacagactttcaagaaaatacttgaaataaattacattgccttttgtccattaatcagcaaataaaacatggccttaaccaagttgtttgtggtgttgtacatttgcaaattatgtcaggacagacagacacccaacagagttccgaacatcactgcccttgtagagtatgcagcagtcattctccgtggaagagaagaatggttcttacgcgaatgtttaggcattgtacagttctgtgccctggtcagtgtatgtaccagtgatgccaaatcccaaaggcctgttctgcaattttatatgttggatattgcctgtggctctaatatgcacctcaagattttaagaagataatgtttttagagagaatttctgcttccactatagaatatatacataaatgtaaaatattgaaagtggaagtagtgtattttaaagtaattacacttctgaatttatttttcatattctatagttggtatgtcttaaatgaattgctggagtgggtagtgagtgtacttattttaaatgttttgattctgttatattttcattaagttttttaaaaattaaattggatattaaactgtatggacatcatttattaattttaagttaaaccctcagtaactaatatttaagtaagttcttgatgttatccccagtggaaagcctgattcttaatagaagaatcttaatacagagatttagctaaatttaagatactcatcctcaaaatgtttatagcgatttactgctaggtcctgagtcagccattgcactcaacaagacaccagtctctttgaggtgactcctaggtcacctgtaggtgacactacacagttctaagccaaggttggccagccaacttcatactgcttcttcatttttagttacacactgtctaaggatgtttcccacttcggtggcagaaatagagtagttacaatagagaccagatagtcctcaaagcctggaatgttcactaaacacaatcacagagagctcgctagcctgtgttctaagaaaaggagcatgcgtttgcattttaagagagatgttggtttttctgggaagggaggaagttgaattttacagagtacctcttgttctttctcatttaagaatctgataatagaaaactgatttagaaaagttttcacaacttgccattaagatagaatattaaaagccatacatcatgtaaaacaatttcatgaggaaccatatgaggtgaattagaggggttagcaggtgatcctaagacttggaacagtaagcattactcatttttagtaatctttattttgtaatacatgaaaaaaatcttaaactgactttaaaaagtggaacttgagtagtgtggtcatggtgtatacactacaatgcctgtaatcccagaaatgaggtagacacagggatcggaaaccaacatcattcttgactacataacaaattttaggctagcccgcactacctggctcaagaaaaaatgtacctgagattagtagtactgcagagacatgtcctgcatgggtataggcatagccagtacctgagactttatacacaggaggtttgttaagttcaaaaccagtctgagcttaaatagacccttgagtctcctcctcttcacaaaggcttgtagagtactacacaaaacccattggtgtcatactacaagcagtgtttttgtgttgtgtgaattccaccggctgcacatgccagttttgtttagaagcatgtagtataaactagtagcttccatttgtgcacagaatgggtctagagatggaaggagtcatgtctcttggctccagtccccttggaacgggttcattttggatttctgtcacttagcagtatttggccatcccccttctgagtaccaaatggttaacatgaatgtcaaattgagttgatttgcgtgtcacccttagattggactagctcttaagacactagatttgcagttgacattagtcccctcaattcataactttgaagtaggcagtagaatttgtgttatttgtaccctctacttaaagtaaaaggtttttatgagtagccttcctttcttgaaatgaaaagaaaaaaaagcttttttagtgaaatccatcatggaaaattagagaaaaatagcaagatgtttgttgttgtatttaccataccttagaactcacacttaaactagtattttgtagttttacattcctttttaactcattcagtggagaatatcagactttctcccaagttgtatgttaagtcaattctaataatgtactcagcatcaaagacaaacatgtaataaacatggaaataaagtttagttctgttagtgaaatgttaaatttgattgtgtgtatcagatgccatttccagacctacctcttctaggtatctctccagagaatcaggctgagaggagggcgtggtgaagatggttcccgttctccgccttcagcagctctggatagcagtaccatttactaagaat

SEQ ID NO: 21048 - DNA, 1200 bp, Mus musculus
ccaacaccttgaaaagcattattgtttctaataaaaagtaatggctttttcagtaaattggtgggtttaaaaatttgctgcttttctacataaaatgtgccttttctagaaatttaagatgtaaatgtatttttacatgaaagtttgaaaattcgggagcctgttatgagatgatgttacttttaactgaacaataatttaactaagttgcttctaaagtgtttacaccttaaactttaacataaaccttcattcagaaaacagttatgtcgtatcataatataggaagaatgtgtttggaaaatacactactgttagtttgtatacattagatctttcaggcttggcttgtttaaagaaaaccttgattgcataaatcatatttagaaaaaaattagtgcaattttatatttgaatattgttcatgttaaaatttttttgaattgcaaagactgggtatatattttgtttctgttttttctaaatgatctgctgtacttattaggtgtactaaaattgtcttagaagcgagggtttgaaaattgtacaaatgtgtagaggtaactttgcacttgtgctgcatgggtatatccattatttctggtggtttcttaggcttgcaaagagcacggttcccaagacgggtttatacacgtaggcgttctccatcaggcttgtttactatcttttgttcataccaagagaaaaaaatctactttttttttccagaccctgtttagagggttactaaaaattaaggttgccttttacgtttgaaatgtttaacatttagtcaatgatgtttcttctcctgagtttaacattgatattgtgaaaataaatgcagttcagatttatttcttaagattcattcttcacaaaagggtgattaaggaattatgctcataaaggaacctaagcaagctgtattgtgtgtgtgctgtgtgtacacacatttgtgtgtgctcagaatacatgctttctgctcctgactttttgttgtacaggattcagattcctagtcctacaagatgatgtttgtgtgtaaggcacaccttttttgttgctttattcatgacaaagtgtcagtttgagaatgtatgtttaataagcaaacaataaagaagtgaaaataaagaatgccccgttgttatattacaatgaactcttcatcctaaaggtataagcattgcaaaatgg

SEQ ID NO: 21049 - DNA, 1084 bp, Mus musculus
gctaggggacacaggctgagaagcggaaaaagctttaagcatctaagtttttcctttggtagtgtttacaatttggtttcccttaatcaatcctaagtgtttgggtgtatttgtttttctgttggtgcagatattggcaaggctaatgaaattaaaaaaaaaaaaagtagtccattgaaatgagagtaaactcagaaagggctcctgctagcctcccctccccgctgttttttagggaacattgtagaggcaatttctaggacagaagtgataagctttaacttcccagaagacaagctgcagagagacagctaacagactcgttactaattgtttttaaaaaacattcacctagataaagatctttaaatgtgtaaaaggtaggggtagaattacatggtattttgtgtttgggcataattataatttttatgtaatatttccagaaacaggtgcctgtaaaatcataccgaagaactttatatgtaccagatttttaaaagaaataaaatattgctagaagaacttgttcctcatggagatagaattggtacagatagctcagaatgaatattctcctcagtacttgatgctgccgggccactcgtcactgctctgagtttgaagcgtcatgtttgttttaaagcctgtttgtggttgctgttgaggctgacctccctttagtttagttacagctcctctgcttctcctgccttcccttctcaaacccttagctgagttttcttctgtgagactttctctgtggatgtacacagttccctacatcaccttggtagtaaccccttggcgtttccatggctgcagtgttcgccccatctgtggcttgtattttcactggattttgtcatataaatttgtaatttcttcatttcaatggtatgtaactaccttcctggtgggtttagtttctgcaatggttttggctgtggtgaagtcacatattcctgtatacattttagaatcctcttatcaagctcctaaagaccctttgtgaggtttcagttgtgaagaattgcattgaatttgtacatcagttaatttgtgaagaattgtcaaatttata

SEQ ID NO: 21050 - DNA, 1136 bp, Mus musculus
aacaaaacaaaaacagaaaaccaaaagaattaaaacaaaacaaaacaaaacaaaacaaaagctcaaaccattaattcactaggccttgacccagtattgaaagaaactgggagcttaaaaaacaaaacaaaacaaaacaagctattttgggcctctgcctttttatacttaggtgcccagatcaataaattcaataaattcaagcttcgctccataactgagcatactttgaagtgatgaacatctgcctatagatatcagagaaccgcctctggatatcacacatgctctataggtacacggcctcagaggtttatctggactcgggaaagagcagcagccctctgctggtcaaacctctataatgcagctttagaagattaaaaatccccaggccgcggtcggtcgccttttgatgatgtcagccatcatcaacactcagaggtgaggcgggaggaatgcttgcgtcatccgtgcgcgccccgaagcacccagccaagcctcatggctgcgggatctgtggagtctcagcggtcccaggcggcctccgagaggcccgtggcgggtcaggccggggtcctgccttgcctggagttgccgagctacgcggcggcgtgcgcgctggtgggcagccgctattcgtgcttggtggctgccccgcaccgcaggcacatcgccctgtcgccccgctacctgagcaggaagcgcacgggcatccgcgagcagctggacgccgagctcctgcgctactccgagaggtaagatgtcgccgcgtcctcccgggagccccgtctctgctggccaacgggccctcagctccgtaaccccacggcgccgcggaagtaaagtcgcacgagcttcgtgaaccttagccccggcgtctaccgtcgccttcggcgccgctggcctggatgcagtggcccggttcctggggatgaaactggctggtgtggtgtgagtggcggctgctgcagtgctaaaagcactccccgtgtggagactagaggtgcccggtgtctagaaacccaccaggctgagctttgggtattaaacgtttcgtttaatcacttccgggtgtgttctcacctaataatgaaaatttgctgtcagtattattctcctaatgtggaagccgg

SEQ ID NO: 21051 - DNA, 1709 bp, Mus musculus
cagtggctaccagagtgaccataacaagaaaaaaaagaaaagaaagcacagtgaagaggctaactttgagtcacctaagaagagacagtaatcgtcttttctattgttaacatattcagatacacgaggaatagattttttgagtggtaggaaatgcttatgggacattcacaaataaatacttgattggtagggttttgtactaaaatcatacattgataaatacattttggaaaatgccagtattaaagtattattttattacagttcagtggaaaatgttaacaattgcatttactcttgactcatattgttaaagctctacataaagttttagattctcagcatttgccaaagaactttataatattttcattttttttctgataataaattttgtttttagccagaacatcttttctaaaagcttaatacatttaccaggtttagattttccttaaacagtatttctatttacttaacatgtatagctaaagaagattatctagagctcttatataccctgtggctatctgttgaatgtatgatgggcagaaaactcattgttccctcccacagggggtatgtgcatgtgttcttgaattctgagactgttaatttttactttgtgtttcagtagtcttcatgtcattatatatggatcatgagcaagatgaagaaagggtaaatatggttcttgctagttgaaaatctctagttaaccttttaatgattagaggtagtctactagacttgctttgaggaggagctccacagtcattgcttttattgataaaaatgtgtgatgtgttatgcctaaccagaaggtggtaatgaggataagctgtttgaggctcataatcagcccatagccatgcatttacaggtacttaatatctgtaatatattttattgaggccaaagcctataaagtcaatcaagatagtatagttccttcctccatgaggcaacatgggagaaacacttgtgtgcacacagcctaagtgaggaaataaaacagtatttgtagtaaatactgtgaagaaaacattgactactctttagttagtatctggaaatgtacagggttagggttggccttcccgtgtcagtcactgctgttgtcactgactagcagacatagtgtggtcgtcagcttaatgtttcataaggagtaaattctggcaaccatgtttcttgacttcatctacggtatatagagcataaggaatgacagcaatttaatatgtacaggtagataaataaccagcatctttaactcaggatacttgacattttttggtggctttcaggtctcttcttaaactgtgactattctaaattgacatgtgttgtctgtcagtacaaaatatgagattttaaattaaagacgttaaaaaaataaaaagaataccccaatacagttgtctttccctcctcttaccttatccctcttgttcccatacctacccactcccccacccactttcctccctccatgcacccttgatgtctattaaaaaactgggtatggacctgaacaaaattcttggcaggaatctctaatggtggagaagcacttaaaggaatgtttaacatccttagacatcaaggaattgtacatcaaaacaactctgaaattccatattatacccaccagaatgactaagataaaaaactcaagcaacagctcgtgctgacgaagatat

SEQ ID NO: 21052 - DNA, 1214 bp, Mus musculus
ataattgtgagcataccgaacacaaccattctacattctacattcttaaccaaacattttcacaagatcagtgttttcccttgtgggtgatagttttatatgtaactttttagatgctaaatttggatctacaaattcaacatattatatattgcatttctcttataacaactttttgactctttgtttctctttatttacaaggctattaaatataaaattagaggagctggaaagtaactgggcgtcattctcatgacacctcaccgccacatgcaactccagttccaggggatccagtgcctccttctggtaccaagtctgtacctaatgcacacgcatacacgagcaggcaaacattcatctacttaaaatattactgcctgagtattaaaaagtaaaaccatataagcccataacgataaattaatacctataatatgctttctaaatcaaaatttcttgcaacagaaacatcagataaatcttaggtagaagcaataatctggttatatgtaataaatgtagtcaaacaactatatcaactaaagtctggagatacaattaaatagcagaggacttgtctaagcatgtatgtgcaaggcccagggttcagtccctagtgttgtgagtaagcgaatgtacgaagcacgtacctatgagcagttaaaggtatgtcaggaaatacagaggcagcctgtgtagtctgtttactcaaatatcttaatcttactatatttagttctttctatatctcccaatgtctaaggttgggcatatgtcactcttttactctagaccccctctctgtctgtctgtttgaggctcattaaatttcctaatcttcagctttaacaaagaattactgattttttattctttttgtaaaaaaaaaaaacctatttgaattcaatttggattttgtttttttgctctgaagaatcatttcttctctgccaaagaaaagttataacttgagcatccctgtaataggaatcggttgttcaccagggccagatcacattgcacattaaaacttctctctagtgacactgtagagatgttataggtaacaagtgtgaagcagattttgggaaatgaagccaaagtgtctaaatgaccgttaggatcaggatattggtcagtttgtgagggaaactctccaacaaacaaacaacaaagcttctatcccctcatagtgaatagttacctga

SEQ ID NO: 21053 - DNA, 1333 bp, Mus musculus
tcattcaaggtcaaagcaaatgcagaaatataaacaaaaacttcaaagtactcaagcgccttctttacaaaaaaggtgacactccaacgtgtgaagctggtgttcattttgtctaggactaatggtgtggacagatctcctggggtgtaactcccgtactgttgtgtctataccagtctttccatgtctgaaaacagaatcctagtacatcgtaagactggttctccttttcaactgtaatccaccaataccaagagagtcctgtgtcttacatggtttgctgcgttatttgcaacatcgagaggatcctgccccgtctcgttcaagaatggagtcggtctcttctgttccagactaatcagcattctctcccagtgccagagtgccagagtgtgtgtgtgggagctgagggaagcacaaagcaatgggtcacaggtaacttagctaactagtgtggtggctgcagagcgcagctcagagttggagagatttgtctccctcaaggatcttgtggggcatcagcattttgctatcatgtgggttagcaggtgagtgatcttcagaacaattgtccagttgtttccaggtagcctgggcaaagtgagggaaagaatgcccttagtgcaggaaatcacccttcccaaattaccgtcctgtgtaaagcattttaatataaagccaatcaaaactagcatttgattggatttattattcaccgatggaaatgttggttgattctctttggtgatgtgctgtatgggctcggccttgctcttagggccctcacctctccacctctcctttggcattctgtgcagaagaagcatgtggtagctctcttaggagttcacattttttaatcttttaacagattactgattatatagaagggaaattatttattgtaagaactgccaaatacattgtccttctaaaaattggaaattaaagcagtactctattgaaagttaccatatgataactttaaattgtatgatctagacatgccttaggtaactaccaatatagcaaatcaaaggattaatgagcttctagtcctatgtaaacatacaaatgcctaattctactatgtgtacatatataaaaataaataatgaaaacagaactgtactatttttaaaaatatgcttttatttatatttcgcataatgtaaaattctaaataaagctagtacacaaaaccctttggtgtatacatttaactccctaatattttatatcagtgaaacaaataccttttccagttgtgaagcctttgcatttcctagtgttctctccattttgtccattaggaagtcttcatatcccatac

SEQ ID NO: 21054 - DNA, 1109 bp, Mus musculus
aacagttgtgccattgaccagtggatgcactttgttagccttaatttaaacaacaacaacaacaaaatttcttgaatatatcagtttgatcactacaagtttgctgcaggtgtttggggaaaaaagagttaagtgcaatgaaagtgtacctttttttttagaaaaaaattaagaacataattttcacaatctacagttttaattttgtgcaatattttcatttaatgcatgtttgagtaattgtataataactacatttttaatgttttgagatctaatttaactgtcttattaacccaacaacttcattccgttgttgctgcaccttaattaaggacttgttttaaaagtctttttgtcactccttgtaaaattcttttcttagtagaaaattttgcttatgggagcatggctcctgtattataagggaaaactaaagagcacattttagggttttaattgttaaaaactaccttgtgcatatctctgtatataagcgtcgatcgtgcctaccgctctatcaatgctctcctctaaccaaggggaaagaatcagaatgtcagttacttttattaacgacagaaattaaaatttttatttggtttgtgttatgttctgtctgttagaaaatactaataaagtattaacaaacagttctgatgtgtttacttggcagtatgtattttttaaaatgcttgttcaatggtcttgtttttatagtctctgagcacttttgtttcaattcagaatttgagcagtcaagtttcaagattatagatgaactacagaataattaaaactagctgcatttaatttctttcatgggataaaccattggctaccaaaatcttaaaagaaactttctattttattgtcacataaaattaggtagtgattttctgaaagacaaagatctagaacttagcaaattttatttgatgtcatttgcaattcacattttgactggtattttagacatgttctgttttaaaagacagttgctttgacattcagtaatatgcttggttggtcaaaatatgtatagctttcttggtctacatccagaaactgctcaggcattaaatcaatacctgttaccttactaagaa

SEQ ID NO: 21055 - DNA, 1536 bp, Mus musculus
taaactaatttgttcatacgacaaaggaagcagtatctgaaaaccacattatgtcaacgatggaattaaaaattttactcttaagtttctccagacattttttttttctttccattgctaaaaaagcaatcgaagttccccatattccctggccctcagtggtccctgtaatctactgttgttggtgtctggcactgtccaccgtggcctttcttagcatttttacctgctgtaaactgtgtatggcacccctgggtagatgatatttgaccccagatcttcatctcactgtctaattacccagagcactggggctcccacccaagacagttgatgttttatgaatccagaaaggaagagactctgttgtgttcagttcattaggagaaatctatgttcctgatactttttgccttttggaaaagctacattgtagtgaaaagtgttagcacagaagtgataatttagttctagtagtctgtcaggattgcatccctgtgttctagaaatagctgtgtctttaggaaaatgaaatttagtttttgacctttttagtcaagggcaaaggaagataccatttgggaaatgctttggtgtgtaacatcttcagctctcaaaatgggatgaatttgaggaagatagagcatatatctacataatctgatgtaaaaaaaaaaaatacgaagttcaaaacactgtatatgtaaacaacttgccgtcaatacattggcccaggcccatgtaacaaatagatatttggttatctttaaaaagtaactttttttttcaagacagggtttctttgtgtagccttggttgtcctagaactagctctgtggaccaggctggccttgaactcacagggatccgcctgcctctgcctcccaattgctgggattaaaggcacgtgccaccatcgcctgtcaaaaaataactttttaatgacatttcttggtattgtgacagcaagttgtcaaatctaaatatatttgaatgtactacctcccataagttgagagagaaatggtgtttgtggctctgtatattacattaaaaaaataaaagctgaaaaccttcctttgtatatgggtgtttaaatcaaagaaggtactagaaacattgacaaggcaagtaggcatctttccttctgcttttccatagccttttattataccttaagatggtgtttaaccaagccttagaaatacacccccagtaatgatgtcttttggaagttattcccaaatcctttcttttttttttttttttaaagatttattttattattatatgtaactacactgtagctgtcttcagacacaccagaagagggagtcagatcttgttacggatggttgtgagccaccatgtggttgctgggatttgaactctggaccttcggaagaacagtcgggtgctcttacccactgagccatctcaccagcccaaatcctttcttaaattaagaaacaatttgtgtgtgtgtgtgtgtgtgtaagtcagaagacaatttgtaagaattggttctccccacaa

SEQ ID NO: 21056 - DNA, 1285 bp, Mus musculus
ctttgatgacccagctgatcaaaggccatatatactgtttaatgatgtacaaggccttactgcattgttagaaagctggagttcactgggaagcaaaaggtagggagggttttcgatctgttctcatgtgtaactgttttgcctaactaatacatgataaaagtatcccatagcattgggctgttacccataacatatcccatagcattgggctgttacccataacatatcccatagcattgggctgctcattagaagtccacccataatctgacaatgcctcatttgtctttcttttctcttagaatctgaatcagaaggcgaagaaagctaaatgtctccagcacactgcctaaaaaagaaaaaaaaaattaaaacgccacacttttcggttgggaatgctgaagcgtttggggagggaaacttggcttctgtttgcaccaaggaaataaatgataggcgaggcctcccccgctccccggggaaggcatttttttcatttctgttttgtttcaatggagccctgaggcgtcggctactacacttgggactctacctctcactgtacgctaactaaagccattcaacaagggggtcaggtaggaacctgaagctcaaaactcagtacacccctttttttagctgtattttcaggtactgtgtgaacgccccactggtgtctatgttacagggccacttcaatagttgtgtttcttctgctcgtgtatgtgatttgacaaaccagtttttttaaaataaacggctttttaaaaatccttgtgtatatggtcagagcgtgttttatttattagcatagtgtgttgtggggtctgggagaacaggcctgggcatggcggtcagagggttcccattctcttctccagtacttttacctgctaagccatctcatgggcccccagaggttggttggtttgtttaacattacttcttataaaggtgtcatcatttttttccctatccaaacattaaacggttacatttttttggtacaaatttcaaatctgtcccaaaatatactcacattaaataaaatacgcatttcagtaagatctactacagtaagtgactgcattctgggaagtgtcacatttaggttcggtcagcgttcctggaagaagctaagagagtgtgcatcccatcactgtttatagcgggtttcttattgccaatccgccagtcacatggaacaagtcattacatcacctgtgcaggacaccgattgttgggggaaaggaagcaagcgctatctcctcaggggtgagtt

SEQ ID NO: 21057 - DNA, 1180 bp, Mus musculus
tggagaatagatagcaaagtccaccatggctcctttactgtatccttggctgcagcatttacttgtgatgagtggaggtccctggggaggagcggtttggtttttttgtttttgtttttgtttttgtttttttttctagtgtttccaatcatttcagctttacagaaagagccttgttaactcaacgaaggaagcagtgcaaacggtttcagtttccttcctctcactttaaaaacaatttaaatactgttcagagtttttatcatattcatgtggtcaggtgaatttagtcctgtgccattgttgattaaagcaaagaaaaagagatgggtgggtacggtgaacaaagcaagtttgtctatgttgctcaatactttattttaaaagatgctcacctccgtgactgtataggaacacttcagtcctcctcagctgaatgagcgatgtcacaagtggctttagtatgagaatcccatcctaatttgaatagcctgtagcttacaaacctccttttctccttcaggaactcttcccagtgaacagacagagtgtggatcatttcgctaagtacttcactgacgcggggctgaaggagctgtcggactttctccgagtccagcagtcgctgggcaccaggaaagaactgcagaaggagctgcaagagcgactgtctcaggaatgccccatcaaggaggtaggaggccgtagtgaactcctgcacaacacacacagataaagggtaagggtggcgcccctcagcgagctaggagaccagagtgaactccaggacaacatacatggttgatgggtgtgggtgtgtccagtggtagagtgcttgaagaagtatttacgaggtcacggcttacatccccaacactgcagaaagctatgcatgctgaggtgtgtgtgtctgtgtgtgtgtgtgtgtgtgtgtgtgtgtgtgtgtgtgtagaattacacgggtcatataacataagctttccctccctcatatgtgttaccattcactgttcccttactcctagcactgaagttggctcaaggtactcactcaaaatcctattttattatattttgggctattctagaaattgatgttattttggctcacattgcttcctcataaccaggctgctatgattatcacactgttttatcaacatatagacttggctgtctg

SEQ ID NO: 21058 - DNA, 1182 bp, Mus musculus
ctgctctgtgtatgcatcacacatctagtttctcatatgcagggttctttgctcatggtccagggtagtttgtcttatacaagagatatctccatctatctctgtcttgttcgttttcttcttctacagtctggtgattctctgtttcatttctttacctttgacaaagcaataatttaagttttagtcgtcataattttttcccatgattagacttaatagattacaaacattattagcctagcctacaaatgatgacataaatgaataattgttacagttaatatgtgtgagatacttaaaatgctaggtggccttgttgtacagagctattcaatttgtttgaataaatgtgtaaacaagtgttttagatcatagaaatttacatggccagtttctttccagactatatggataaacacatatgctcacgaaatcattttatttattatttcagatgaaaaagagaaattcgaacccacagttttcagggatacacttgtccaggggcttaatgaagctggtgatgaccttgaagctgtagccaaatttttggattctactggctcacgattagattaccgtcgctatgcagacacactctttgatatcctggtggctggcagtatgcttggtaagccatatggtttggcattttcttatagtgtgcatgaatttcaattctattgtcatatttcctcttaagatagaatctttggaagcttatattaattatatttggtaaaaaaaaatctgtaatttttacctagattacaatttagaatggttttaatgtagtataggcttacatttttcataaacctactttaataaggataaaggctttaaccttcccttcaagtccaccactcaccacaggtagtagaaagaaaaggttaatagcacaaaggagcatatggacctgttttttggggggcgattctaatctgtgttgtaggataccagcagtcagttcacatgaatcaacagcagtagctcgatccactcacaaacactactcacgaatcagcaatggctgttggatccagaaactgcaaggctctaccaactggcccaaatccacagaagcagcaaaaagctgcttgtcacaagctggaataccacaagaagttctttggtgtgtttctttctacaaattcacaacatgatcagccaggaagg

SEQ ID NO: 21059 - DNA, 1556 bp, Mus musculus
agaagctgaagagggcatcactcaagaaaattccattcctagcgattctgtggaaggggagaaagaagctgctaatgacactggactggccagtgcacaagacgctcctacagggccacagttgtccgaggaataaaggctgtcgacagtggccggcatgggtggtcttcatcctggccgatagctgcagaactgatgtgaatgtaccttcatttgctctgacactgcatggcacagtggcaggattgcacatccctagagtagaggctttcaagcaaagctgcctcccccgtcttgatttcctgttgatttctattctataattgaacaggcatttctgtggaatttctttcttttctttctttcttttttttttttttcaaaatacacaaaaacaggtccattcctttgctggcttctcagtgattgtacacaaaggagaagaaatcaccttaaagaagaaatctgggtcctagggaacaaagagaagaatagggaagatgtagaaagagaggtgatatttaggaaagaaggaatcgtgggcacagagatgggcattcagagaaacaaaacttacttgtgaatgttgtcctcaagttggacatacaaagccgtaatgaggaacaatctttggtcttaaagctttgccatagttgagcctcctgtggtataaccaggaattgttgagagcactttgaaccctctgttccttgcagcgatacgctacttgatttgaacaatcagaaaggttggatccaaccctggtagtcactgtgtttatttcccgtagaaccacccatgcaccatcctccccacccagaaggccaacacttaccttcccatcagcctttcctgaccctcctcctatccagaaactgtgatttcttgctgtcatttcgagaatgtcccattctgcattttcagtgtcggggcatgtaagcaaagctggagtgtcctgtctcaagaaggtgctgtctttctgttccctctgttggctttaaaataaatctacctacatgcacagttcatcttgtttcataattcgtgttgagaggctaaatatcaaagaagataacatgtaacaaggctgacacacatgggggaatgaagttaagattatataatctgcccagtacctcagattctttcttccatcagtcctggctcattctaatcctctttatggccattttttccccagccccagcacacatatctcctccacatcctagactcgttcagtgatgacctcgtgtgagtacagtgttaaaaagtttatacttgtcagttgtaaaatgtttctcttgaggactcaaggaatccatcgatgtgccacagttatgcagtgataaacacttacttttaggttgtgagtgagcctttcagccccctctgaatgttaccactctcctctctctccgttttaacaatttttaatgtatacttatagcattttccttacccctgtctcactaagctcttgcccacactctgacagcctgcctacaaatcctggagtccacgcactgacatgtggtaagttctctgggcctttt

SEQ ID NO: 21060 - DNA, 1880 bp, Mus musculus
ctaaacaaagaattctcacctgaggaataccgaatagctgagaagcacctgaaaaaatgttcagcatccttaatcatcagggaaatgcaaatcaaaacaaccctgagattccatcttacaccagtcagaatggctaagatcaaaaattcaggtgactgttagttcatagcaaggttgtcttctgaagagttgtgaaagtgtatcatccaagtgacgggtgcctatgtcacgggacacaagatgggctgaaggggaagaaaggtcggagaccagaatgtcctcaccagaagacacttggagatctaactagttacatgtgtgtggtttcagtactactatgtatataggggacaaattcatgtcctcatctgaaacatctagtccttctaggtgtttagaagtgcacaaagtatgttaaaagtagacatagtaaataatacgtgttgtagattctgtttaaactcatggtgaagtgttgtcttttggaactagaaagagaaaccgcttctgagcaatgcagccttgtttgcgcaggtctaggagggaggaagaaagaaaatgaatgaagagcctaatgctgatgcaagtttggtaatacaaggttatccattgttgcttatatctgtgcatcttactttgcaatgtatagaaaacataggtccaaatttgcagcacccagtcttcctagactgtaaaggtgccagtgtgtgacaaagtagaattagtgaaaaaacatatttatagattatgttaaaatttgtagaaaaaaaccttaaaaccacttaggaagtgaaattgttaatattccacaaaaacatgacagatgcatacacatggcccctggggggagagagaactggaagaggggctggaccagaaccttgctgtttagaaggcagtctgaccacagcctttgttaggtgtgcagtgtattcactgtggtgtacacatgctggggaagccaaagtgcttactgggaacatctggtctccagccttttaggtgcatgatagacctgatgtggtaatgcatgcctttaattctaggctgaggcaggtggatctctgttctgggtcaaccagggctatagactttgtctcaaaacagtgagaaagtgtacataacggattggtagggtggctcagcatgtaaaggtgcttgctactaagctggtgatctgagtttgatttccgggatccacttgataaaagcgattcacagcttgtcttttagcctccacacaagtgcagtggcacatgtgcacacatgcatacagtattgcatacatgtaaaaatagagggctgacaccactttgttaaggatgattttgttacaggaatggtcacactgggggaatggaggttaagcttggcctttgagcagatgctgttaccaagtgatggaggtgggctagggcaaagcttagtgctcagaaagaggcactgtagctgttggttggttcgagttgtctagccattggttgggtgtgcatttcacttaatgttgccaggtagtagaggtaagtcccagtgcctaaaggatgttagaagtagcaagagtcactaaaggccaggttcatctttggggagggctgttttcttggtgtggcctttgttaatcctctcactagcatcatctgcacttaggagttgtgcagtgaagaggatggctgagggaaaggctgctagtgcctctgtccaggggacagctctacccaggggtcctatgtgcatcgtggtaaaatcttgtgttcattacgcacagttgtcatctgaatgttacatcctaaaggaaagcacatggttaagagtagagctaatggctatggtggaattgacaaaagggttcctcttgaacatggaactgctaagccatgtct

SEQ ID NO: 21061 - DNA, 1195 bp, Mus musculus
tcagagagattatgagccccatgaagatagatgtcttagtcagggtttctactgctgtgataaaaacaccatggcaaaagaaaaggaaaacaaaacaaacaaacaaaaccaaacaaaaataaaaaactggagcagacaaagtttatttcactttacaggctgtagtgcattatccaggaaagtcaggataggaactcatgtcaggtacctggaggcagaaacagatgtagaagctatggtggagtgttgattactggctggttcagcttgatttattcatccaggaccatccacccaggggtagcactacttcctgtgggatgggcccacctacattgatcatcagtcaagaaaatgtaccacaggtttgtccactggccaatctggtgggacattttctcaactgtggtttcctctgtgaaaatgactatagcctgtgtcaagttgacataaaagtagtcattaaactgatatggtatcttttttattcttagcggcctgtctaatattttatgaatatcacatatatatctgttttaaagaatagctgtgaaagggtgtctgagcatgagaatacaaagtgtatgtatgtgagtgtgtgtgtgtgtgtgtgtgtgtgtgtgtgttctatgcatgctccttagatacttctcactatggtttacgtctttgtgcaaatgtcactccctcctttactccaaatgtggcaatctctgtcatacacctctttgttttctctattagatctcaccttcccctaacatctaccactttgtgatttttttcccttctattatgatagaattttaattccatgagtgtaagaagtttgtcttatccaccttatctctagcatctggaagacttcaaggttcacatttggttcttaataaatattgttgagttgaattttgtatagagatacatgtgtatgtgctaccagtggaaggaattgtgtttattggcaatctctgtctctctgtctctgcctctatctctgtctctgtttatatccttcctatcactctgtctctttctctttctctctgtgtctctctatctaccatttgtctgcatctatctatctatctatctatctatctatctatctatcatctatcatctatctatctctgtgcttggatgtgcatgtataaggggaactggagctatagccccgtggtaggacatgtag

SEQ ID NO: 21062 - DNA, 1195 bp, Mus musculus
tgatttgtactaaataccaacactgataattaaagtacatttggaaacaggagaaagaaaacttggagtgttacttttggacttttgaagttgtgagacacagcagtatgtggtagtatatacctgtaatcccagtactggtgagacagagaggaagatcgatccttaaggctcagtggtccatcagcccaggtgaatcagtgggctcaggttatccaagggaccctatatcaaaatgtcaggtcgaaagcagctggttgtgacacccagtgtctggcttatacatgactgtacatttatatgtcctcttgccacacatatgcacacaagttgttaaatgcaatgcggttagcagaagcctattaaaattatttatttgcaagcttgccttttccaactatataagttagggttatccagggaaagtaatacaatacagagaggtatagatatacctctctatagtgatatagatataagattcgtcttagcaatggtaggaagatgagccagagttcaatgaaagtccctgctgttaccccaagaattcctttccaagtttttcactaaggtgaagttgagattcttgactctgcaaaaaaaaaaaaaaaaaaaaaaattagaatctgtcagtatgaatcacactttgagtttaataagtgttttattcagtaacaggttagaaaaaaattactcagggaaagagtacacagtcactcgtgggtgtgggcttctcatgcatttgatgttaatgggttctgaagttccatcttcccagggttgctatggaatctaaatgagatcactgggtggttcctgagatgtgcagacaaaaggattgaggacaaatttcatttggtaccataaaacccaagatcacaagagctgcatgggaagttaagatgtttcctctgtcaacaaaaagttaatggtcttgcttgtgagattcccagataatatctgggagaggaataaggtaatattcaggggtgtatatatttgtgcctgaagcatgtttcattgctgttttaatattcttaagtatctgtatataaatgaatattatctccacattagcaaccttcacagtacatgtcatttactatgctggaatgcttgagttccgcctgctcgagtcttcatgcagagtcctgagtgagggactcatctcccttttcacgtctttcctgttttt

SEQ ID NO: 21063 - DNA, 1205 bp, Mus musculus
agggctacttttcctgatccttacatgccagtgggcctttaagttccatctttgtgcttccccattatggtgaatctctgcctcttcctcctcttcctcctcctcctccttctcctcccccttccccctcctcctcctcctcctcctcctcctcctcctcctcctcctccttctgtttctcagtcctttgcccactgcaatctaaatgtccctccccatctccttgccaagctattggttgtacagcaattctttatttaccagtcaaagccagctgggtgcagagacgctgaggtctgtaagtgaggctctgggagccaaattgagacaaagcattagaactacttcccaacaacatggctcttaaatctttccacatctctcttccaccatgtttcctgtgccattagatgtggggttgtattgtattgtagctgtactaatttccctgagaacatttaccagttgtggatctctctagtaacccctatctattgtaagaagacattccataacaggatgtggcactttatgtgacttttgaataaatgtttagaattcagttagaaattacattgatttaagaagtggtaatgggcttagatcgatgtggtgctcctgagttctcttcaggccagggcctaagctgcgccaggcgagggacagacattcatggcgaatggaggccgctcttctcgttctgccctcgggcccctcgtctctccaccccatccttataccggtggtgtatggaaggcaggggtgcggctctctggcccaagctcttacccgagcgcgcacttttctcagtggttcgcgtggtccttgtggacgagtcaggcgcctggttgcccttacgtgtttcacttcggtcgtgtctcgcttgaccatgttctccgagccggggaatgtggctggtggtgttgcatattcttcctgtctggtgtgtgtgtgcacgcgctgtttcttgcaatcctcgaggtgctccttgggggtgggggtgggggaaagaagtagtaatggcagcttttcctttagtgtctataattactacaactctagtagatggccagatttaaagtgccaggtatgaatttcctcccattgatcaggtctgaagttcaatcagagaactcttgattacataaaagatgtaagtgtcactgctgctccattgggcacatcttgtcaagctggtccttgtt

SEQ ID NO: 21064 - DNA, 1162 bp, Mus musculus
tgcaggtcaggctagttcgaaattgaagctgttttgagaccttctcttcctgctttgagtgcacatgcagagtgtgtcaagcattaaaggactctctgtctagggaagtcccccttccctttctgcttaaatatgtttatatttctgcactaattaatgcttttactttgcaaccattttaatgtgaaaaccggatgtggtctataaaaccaggcttagtggactcatgattattttgttccatggactgaagcctcattttaggattagaaggggtaccaccgcgcaaatgtcgattttcttctttatttacttaaaataaatcgcaaattccttcaggtaaattcgttcctaaactttgatccgaacgctatgaacctccacagtgatctcttacattcttatggctcaaaatctgaatgataggcaaggaggaaaggccatttatttatttgattactcgtatttattttcctccagggaatcagggcttcccacatgctcatcaagggctctgtactttagtggccctttcttctcccccctttctttcccctcccccctgcttgctcttctttctcccttctttctgttcacctttccttatttttcttgcactttcctaagttttgtacatccatgtttttggaacagggtgcccataaactatgatggatttaatatgtgtgtatccatctctttccttctctccctcccatattcctctctttatgtatacgcgtgtgtcatttatatgaacgtgcttctcagtggatctgtttgagaaagagcagtaaacttggcgtgtttaccctgcaagttcggcctccttgcttcagttctctggaagggtgtgacatgaaaagattgcggttgggccacatggttcatgctggactgtgtttttgtgaatggaggcagaaatccagttctgcctgcttgtcttgaggaaatgctgaggagatcagctgtctcattcacgggcagaaagtatgagtcatacatcttccgccttgtttggctccaggtcattgttacagtggatagaactggttttaattaaatattaacccctttaatacttgacatttgtttcatttgtaattttcccactcctcccccgcttggctttaaaagaaaattcaacagacagctagctagc

SEQ ID NO: 21065 - DNA, 1472 bp, Mus musculus
tcttcatttaagtgttaaagctgggatcacaatgaagcaaaaaatagaaaaagaaaaaaaaattacctgtctcctttcactatcttcagtacataaatacattatttaatcagtaagaattaactgtactaaatcacatatgatgctgttctagttacagcaagcactctttaagaaaaatatccactacactaaataggtactatagtaatttttagacatggtacccattgatatgcatttaaatgtttcactgctgtgttctgttgataacatatataaatattagataatgctaatgcttccgctgctgtcctttctgtaatattctctcatgctgaatttattatgaccatttataagcaatgcagttaactacagatagcatttcaggacaaaatagatgactcaaaccatttatggcttaaaaaaatagcttaccaccttgctatgctataagcagcttctatgcacattgacaaacgaagagtgagcctcagcttgctaaaggaaactggggaaacttttgtaacttttggtgaaatggaacattgtttatgaactgttaaagaatatgaggaagttcctgtgtgacatagtgctggcactgatgttgtccttcatctcctttggacacacctgtaaatgtgatcagattgtacgaaagacgattcaaagatctgaaatctcaaagtttctgccttgttttcattttgtttgctgttcgtttggtttattgtccatccgaaaatgacagcattgagcgtgtgccttgctgtttcattcactctgaaaaccataaggaaatggtgtctaaataccccctgagtagctgcttaccagatccaagcaaagaaaatgaattgtgttcacttcgttactactctggaagaacagcttcataaagagcctataggaaaacactatttcttagaaaaccattaaagaccaaataaacccagggaagcagttcaccagcacaagaaagaacttgtgaagacgagccctcagtatccttcccccaccccccaaccctctgcagatcacagttgtttccgtaacataactgtcccttcacttactctccccatgcacaaatgggcactatccacatcctccagaaatattctgatccctgcagatgtctataaatgattccctcgactgtgctgcatgtgtttcttctggcccttcatgggctgataagtatgccttaaaaatcaggacagccaccatgaccatgtggctttttacagcacttggactttctaagtaaccagcgaagtatttattggatagacacccaagattgagctcttggtaaaatagaaaaattctaagtgtggattgacatgtaaatcatattcaggagccttttctctgtctatagttcttcccctatccttttaatattcttgtcctagtcaatcagagaggaaaatttggactctgacttactctaacggatcaaa

SEQ ID NO: 21066 - DNA, 1158 bp, Mus musculus
attttatgttctgatttcttccttttctttctccttccttccttccttccttccttccttccttccttccttccttccttccttccttccttcctccctccctccctccctccctccctccctccctccctccctccctccctccctccctctctctctctctttctttctttctttctttctttctttctttctttctttctttctttctttttttagattgattaaaaaaatcaagttcctgatgtttgcaagagtcttgcattttgtatttcaacagcattggctacaaagcataggaattagtaaagtagtcatttttttcaacttgataaaagaaatggaaagctacatctactagtgtttgatgtctctagttgaacatctgcatatatccaatcatttctttaaacaaaggatgttaccttccaaatatgtcatgagaaattattttcttaaggggtacttcaaaagcaaaatccacaaaactgagtatgtagtatttcttaaaaccacagaagacttgcttcctgtagatgctataacaaatttctcagacttgagtaacaatacaaatgtcctgtcttacaatcctggaggtcaaaatttcaaagtcagccttagagggctaaaactaagatgctaggaacagcaactcattttgaaggctccagagaagccttgttttttccattttctgaggctatataacaacatttcaattttgcctccctgtttatgcccctttctctgcactcacagatctttctagcttcctgcaagaacacataggatgatatttagggtttacatagaaaacccaggttgatcttccccttctcagcctcctcacttatgctgtttgtaccttttaacagataaacaattcataggttcttgggttataatgtagctatggggaagatctgggaaaggctatttattcagtcttattcagtttcccacatagccaaagaccccagagagcaaaatgctaattgatttattcatggaaaaaagttctaagattagtacatactaagggatattgtcatgtaccattcaaatttccccttactttgcataaatacttttaaaaaagtacctcagtataaaaattctcctattctagtaaaccatctggattatcacatcaaa

SEQ ID NO: 21067 - DNA, 1166 bp, Mus musculus
atcaacccatctcaaaaaaatagtttttaatttcagtatttgctcaaaccttctactgtgcgtgtctttgaaaaatgatctaaatttatctttatgtagaaagatcttttactttaatcatttattttgttaaaatagtcagaagagggactctgcatatgtccttaggtaagtcatgcttagggttactgtagcagccctgttagtgtgagttccttaaggaattagaaggcagagcttgacggggaccacttgcctttgcagtcaataaaataattcctcaagaaggatactacactctgtctacagatgagcaaatctgtttggaacactggagaaattaagctatgtgtgtttatctgtaatttgactgaggtttatctgtttttagcatttgagcatttaaagcctggaatacagtatgggtttcagaaataaagatgcttccttataaactactaccttggaaactcactcacttgatactgaaaataaaatctgccatgcttgcttctctgctgcttttccaggaaagagtgacgagcagcgtgcggctgcagctgtcgcatctgttctttgtattcagctgggccctggatttgagagtgaagagattttaaagactcttggaccaatcctaaaaaaaataatttgtgatggagcagctagtatccaggctaggcagactgtaagtatgagattaaaatttacaggtcggttcagactcaacacccaagctataagtagtaggatcttactagtaccttactctcctgtcttaaaacagtgaacagtttaagacaagttctcttttgtgctccaaagtcttccatttgaatacatcgtttgcttttgggattaaagaccatacacaggtactagataatgggtcgtcaggatagtttgggaatatgtgagattggagcttaaatgacactggtgtttgttgggttaagtcctcatgaaaagctacatatggatacatgtaggacttttgaggtagcctgtgaagtgttgttaatctgtcttaggctttgagcatgctttcagatctctgactgtgtgatacttgagggagtttgagaatcacttgaactttactagatttctgctttgtgcttcatggaagctgatctgtgcaatattccttctagtttcagcaaagg

SEQ ID NO: 21068 - DNA, 1129 bp, Mus musculus
ggcagctaagagtacagcccaatacaaaaaccataaacttccttaaaacgttatgagatttagaatgcagcccaatacaaaatcataacattccttaaaacattatgaggtgtgtgtgtgtgtgtgtgtgtgttgatatttttgttgttgctattgttgtagtttttggtgtatgtatgcacaaacatgcagacacctgaaattaatgttgaacaccctcctccatcactttccactttatttattgaaactgtttctccctgaacccaggattcactaattacagctagtcttgctagccagctggccccaggaaccccctatgtgggcttcccaagtgctgggattacaggtgactcccatgcctcctggcatttatgcaggctctggggattcaaagtctggttttcacacttatgcagcaagtactttatccacggaggcatttcctctgcatcgagtggtggcagccagcggtggcagtggtggcagctgtggtggttgttaatgtttggagggaggggattgtaacttgatttgtgaggatctcaagtgtgaactcagcagatgagagcatcgtggttgtgcctgccgccaggcagtatttcagagtcttttccaggagttcttcttcaaaaggaaaagaaggtgcatatccttaagtaactctaagatatatatatcaagggtcgataaacagtgatttgattttaagaaagtacggtggtgggtgggaagaaaaacatgattaaaaggctactgctgtttctatagaaacaaatatttttactattttaatttttagcattttaggatttattcacctcaatcacagcaataaatttgtaaacatatcttactcgcactgctgcgaagcccgaggggctgggtttgccttggtgggggtggtacttaggtttggtgcctgttttctcactctttgcacctctcctctttactctgtctgaactctgcattctttctacaaaggaactcgggaagtcatgggaagaggtgcagtcagaagacgaccgcgagctgctggaccttcaggaagagtaaggcaccaaccgctctgctgccggttaattagagtgtcggacggacggagagcaggcagatgagtctt

SEQ ID NO: 21069 - DNA, 1147 bp, Mus musculus
gtgtaactggctgagcccagttagtgttgcttttacttgtgtaaccccttaggattggggtttcatcactaaaacaaacaaacaaacaaaaacaaacaaacaattttacaacaactggttcttattctctcagtaggcattgactgccgtagctctccatctacggctgtgatcttgtgaaatttcccccctacactggcatgtagactggtaaggtgtgtagatcttgtgcaagcagccatattgttaagagctcacggagtatctcatgagagtccagaagacattgtcatatggcactttcccaatcctctggctcctccaagccttttgattctttcccttgatagtcattaagctttaggtataggggttgtgttatagatatttcacttgagactgaagagcccacagcctctctctgtatttggaccagtcctaaatctctggcgggaggtgagagcgtgcttatccttggatataaggatgcatgtttataatgcaggtgggaactctattgctttagtaatatggtggtgctagatttttcctatacggcctatgatctctttagccacaggtttatagtaatcagactgagttccttccacttgaccagcattaggtccaattagataactcctggttgctgcggagatacagatgccgccatggcaccactgaggatgtctttccagtactgtcctgtggttcccaggcttaacagctttctttgcagctcgcctagcaccttcgaacaccatgagaactggctttcagggagaggcttctaggtcagactaccttgatttcccgcccctacaccccccagccctgtgaataaagtatgtggtgtctttagcaataggctcttgctttcacgcagtggtaggcagccaaggtccacgacgatagcctgttttatgttgagggtcctttgtgtgcctttctgcaggctatctcaatgagatcactgtgggactcttcacatcattcctttgcctttgttctccactccctgcatagagacactactaaggtagactgcaggtgagaggtgtgctgtccagttggtcaagttgacacaaactagagtcacctgggaatagggaacctcagttaagcaaatgcctctttctattccatg

SEQ ID NO: 21070 - DNA, 1113 bp, Mus musculus
ggataacaatgtctcacatatcactgaagcaaaatagcagacgttgtacctcacacataagacaggaaagaactttatggcttcttgaaagtattagaataaaaaaaagtctttcaaacagattttgattatattagaaataggcttccaagtaaaagagagaggccctcagtgcaggccgagttgttccgaaggattttacagaacaagtcaaaatgtgacgactttcaagatgtgaaccttggagcatcaaaatgtcaggatgcagggcatgcgaaccttggagcatcaagaggtaagaaaccctgtctcgagaaaaccaaaaaccacacatcaaaacccaaaccaagaaaaaaaaaaaaaaggaatgcaggggatgcaaacctcagagcactaagaggatgcaggggaaggaagagttacctgttgtgctgcgtgtacactcgtgcatatggggcaatctatgagtgtgtggttggactctcaggggccataccatcagaaggtttacagtttttttttttttctgtcttgtagttactactatttttctggtcaccttgagatgcatttcccaccagcaaacatactgtccacttgttcttacaagagtggcgccccagtacgtactctgtttcatagtttacaccttgcaaatgcagaggaaatcttgacgctaaccttatacatagatttatgtgatgcaaggccaggaggtaccctcccatttcttttagtaaaaggcactgtatgtttgccgagtgcaagtgatgattgctagaaaatgtgcctgtggctgataagaaagagagagagttcagagcaagagacaccaaagtttattggagctttggagctcaggagaaaatatctctttccaaaagggaaggaatatacctttaagaaatgtttatttccattaatgagaagcttcagtgacccgtattatggactgttctctttcgcataatgtagtgacagatttactcacatttagaggttgcattaatatttacggaaggcacagctgtaggtttcactttattaaaacacatatggatgttaaaattgctgatggagttgctggctcagtttgctttggctatggatgtg

SEQ ID NO: 21071 - DNA, 1121 bp, Mus musculus
catccagaacagataatagggacagaaagtagggaagaagctgtcagggggtttcagatgcgtggaagtggaacatggtcaggtggctcctagttccttgctgggtatagaatacttacaagcattgattctgatgcttccgtgataagcagttcagagcccattaccttcagggcacccagatttcatacactgttaccacccttagtttctagtattcctgagctttcttccgagatggtactgggctcttcctctgagctgtcagatgtgggtatgcacatgtcgagatctgataacccttgtgaaggagagagagagagaggggaggggggagagggggaggggggagagggaggaggggagaggggaggaggggagaggggagaaaacccaaaatcactcagagttgtgagctgcaatagaaagagacagggaaagcagaagggaggggattagtggcccagtgtaggtaagggttagggcaaggtgttaggatcctgctttggggacacattgccagctgaggtgggcatattgagatatggtatgggaattttgtggtttgaattagtcagcgcctggtctaggaccatgagggtcattccaccatctgctgccagtttgattggatgttgtatctgttctcttcctttgccaagtgatacactcctaagtctggagttcctctaggagcagggagtacttctgactggggtttgttgtcttagtgtctggcacctagtagagaaattagtgttcattgaattcagtatgcatctctgaaggctggtatatttacatttcagatgactaggaagatggggcagggagctgtcctttctattttaggggtgtcggggcaggaggggaaggggggctgtcattcaacagccaacagctttattgaccagagtttcctggaaggagaatgacttctctgaagttccttgctttgacctcagtgttcctgcttggcttccagctttattaagtgaagagagactttgccttccattagcatgtcttgtaacagcagacaagctctgtgtgactaaaacagtcatatgcaaaggagactgtttaccttaaattagattcccaagggaacacttgtagct

SEQ ID NO: 21072 - DNA, 1176 bp, Mus musculus
ttcagctaataaacagattgcattctactgtctcattagcctttcagtaaatggatttcaaaatagtctcattaactttctgataaatatcattttaattaaatatccataagtctggaaagatctattgtaacaatgattaggatataatttatattattgtggaattatatacctatttctcatgcaaaataactacaaatgagagtgttcactgacttgtatttgtagagatcagagtctctcagttgttgccttgaatacatttgcattaacttttaccatagttcagaaagagttgatattatactgtctcatgtggcaaaaactaataagcacaggcttcatagtttttgtgctaatgaacaaaaccactgatttgttgcttacagaatttttgtaaatatcaatttgttaatatgattgaatattacttagtttaattcttcagtaaatcatgaaaatagttatgaaatatagaaacattatttagtagagatgacgtgaaacagggaggcctgacttatgagctccgatttgttgattacaactaccacagtgccttagacgaccatgagagaaatacctcacagaatagctctgaaagtaagtgtaataattaagactaaacattaagtattatcctcgctacaaatgactccctgtctcaaagcattgctgttgctatttctgggtgtatctttaaaaaataggttcatcatgtcaatggaaaaactacagctgtcatcctaaagggaatgagtgataatttattctggaaccatatggaatgaccatggcttaggacacagatttaggtgaccccaagttccatattccaacatgggagcagttttagaaaattctaattattttacaaaacaaagaaagccataaatcaaggacagtttaaaatactttggttggccaccagccttttggttcttagcttttggattggtgaaaactagtagtctgctaagtaatagtttccaaagattttaatgtgtcactcaccagaggttgcttctggcatgttttcagccctcattggtggcatgaacagaggagagcagggaataaaagtgaggcaggctgaagtcccacacaatagcaactttattcagagcatggtgcaatttacactctgagggttaagaagcgtcacctgagtca

SEQ ID NO: 21073 - DNA, 1196 bp, Mus musculus
gaagatataacttcccttaaacaagatactccatagcagtcacacggggcctgccctgtgtatgtaggtatgaaaagggcatattggattcaaaattttgaaaatgcttttgaaattgaattgctcttgtagataagataaactacagaagattcattgtaagaaagaatatttcaattgaaatgtagtactgagaagtccttaatatcaagggcatttcaaaactaagaaatacagctcagcctgaaaaatggatcatatgttattctaaaaccgtctaaagcatttcaaaacatgccattttcttactttagaaataagacgaaattatacaattatatatgattccatttatgacgttaaaattctaacaagaattgtacatttatttaaaaagtacaatggttttggtttccttgaaagcaatgacaaatcttactttataatcatttggtgtatgtcattttagatgctaactttctatgtctctatccagtatctgtcatctgtgtactacctacagtcatcatctattatcaattttcgacctatgtatatatgtatgtatctatttctaacctctgcctctaaatagaaatatataatttctgatattttggagggatcaaattgttcttacttttatgtatgcctttaaataatgaacaagaaaggtcaccaatcccaggatatatttaaagactcttcttgctgtttatatagctctccattcttttaattcttatctaatctcttaaagcattttcttggtgagggaaatttaacttctttccactattactgacataaacagcatttcagtaaacattcttgaaggttttcttcatactcatgtatgagtaagctctagatatagaagtgcaactagaattgtatggaaattttaataggtattaggagagttgctttttgataaattattcttttatgttctgaccaatgttagatgagaatagcactgggtatcaggaagctatttaaatgttgtgggctggggatatatagctcagtagtagagcttttgcctagcatgtgagtaataggttttgtcatcagttaacacacaaacacacacacacacacacacacacacacacacacacacacatacagagagcgggggagagaaagaaagaataaatgaatagattttgtaaattcatttataaaatata

SEQ ID NO: 21074 - DNA, 1182 bp, Mus musculus
agttcctggggaccgccgggttttacagactctggattcccggatttgccacactggcagctcccttgtatccactaaccaaagagaaaggggaattcacctggaccagagaacatcagctagcctttgaaactctcaaaaaggcactgctgcaggctccggcattggccctgccagatttaaacaaacctttcaccctatacattgatgaaagaaatggagtggcaaggggagtccttacccaggttttgggaccatggaagcgcccggtagcctacttatcaaagaaactggacgctgtggccagtggatggccctcctgcctgcgagcgatagcagccacggctgtgctagtaaaagatgctgacaaactgactatgggccagaatgttactatagtggccccacactctcttgagagcatcatcaggcaaccaccggaccgctggatgaccaacgcccgaatgacgcactaccagagcctattgctgacagagcgagtaagttttgcacccccagccattctcaaccccgcctccttactacctgaggctgacgaggcccctgcacataagtgtgaaaaaatactggcagaagagactggaatccggccagacctcacagaccaaccttggccaggggcgatgacttggttcacggacggaagcagctttgtggtagaaggtaagcggaaggctggggtggcagtagtggatggaaaggctgtcatatgggccagcagtctgccggagggtacatcagctcaaaaagcggaactaatcgcattaattcaagccttaaggctggcagaaggaagggctcttaatgtctataccgacagccggtatgcttttgccacggctcatgttcacagagcaatataccgacaccgtggactgctgacgtctgccggcaaagatatcaaaaataaagaagaaattctcagcttattagaagctgttcatttgccccgtagggtggcaattatccattgcccaggacaccagaagggaactgggcccattgaaaagggaaatcaaatggcagaccaagaagctaaaaaagcagcccaagggccaatgactctggtggtgagaacccaacagcccgctgctgaggaaataaataaaagaaccctcacagaagaagaggggcgagattacttagctaacatacaccatc

SEQ ID NO: 21075 - DNA, 1141 bp, Mus musculus
gtactgggtttatgtagcccagagaagtgaagtctgaatagggacttaattacagttttcaaaatcactgaactcagagagacagaggctatgtgtagtgcccaagaggacatcttttgacagcattgagaatgtggctggtttccttttttttttttcaatgttatgagtgatgatgggcaactgttctttcttcatggcatgggagtagcaagcaagggcttgcacggccacaggagagtttttcaaataacattagaagctggtagctcagtagagcttatgcctttatcgattttttacttttcgttgacagtcatagccctgttatttgtgggattcaatctgatgatttgatatatatctgcagggtaactaacaaatccattacacttgcatacatttgtggggtgtgtgtgtggtatttaaaattcagtcttttagttgttttgccatacatggtatatctttattatgttagccattgcaaacaatagtttgttccggcttcttcctcccatctctgtgtttttaccctttgcttagttcctcttttccctgaccttccctgcctatcttctagcctctgatacctattttgtttgatatagggacttgcaaggttcagactacatgctgaatagactttagactgaatacaaggcaagcaatttttagaacacttttctgattaaaagtaaatgctttctagatacctccattctaagctgttaaaggtagggctagattgtaaaagacaaaggatctgggagtttcctgtgaagctgtgtctctactggcgtcaaaagctacatttataagtctcaccaaccaccttagcataaactgaatatggaaaaccaccaaataaacatgccaaagtagatgggggagaccatgggacctcaacgctatacaaagagctacaggcaatgaagaaatactgagagtgagagaaataatctcccccagtatgagcacagcaattagttgtccaaaaccaaatgattagccctgaaaatatacatacaaataacttacgtcaattgggtagtccatattcaggaatgcatgtgtgggtgtgtgtgtatacatgcaataacaattgataaaaggaggccatgaatttgaaaaaaagcaa

SEQ ID NO: 21076 - DNA, 1126 bp, Mus musculus
agtggatactccttctttaaagtgacactggcattcttttgtcaaaaaaaggaagacgttcaaaagcacattccagtttgtttaacaggatgcagtgctggtaggtctatgcttcatccaggcagattgctggtgagctgactcccatctcttcacatggtttagagagtcaggtgtggtaagactcttcattttgggcttgctgcctctcagcatttatggttacaatggcacaattggatgaagatatggtcgacatttcagcaatacacataaatattcatacacataaacataaatgccatgtgttctcatagagaggtatgagtgttactgttttaaaataaagatttatttctaagaattatgaatcacagtttacatttacagctatcttgtcttttccctttaacactcagaaatgtgattttatctgatattgagttgtgatttttttttttttttagttaactattaacttgccttgagtcaaagatatctgatttttttttcatccttcaagcctgcatcctctgggaagcctgcctttcatataacttctccctcttgcttctcagcattttgtgcttccagtcacactccttgggaacatgagatttacttgtcttttgatctgcagttcccgaccttggtaactggaatgtagcacagactcaagaagtgttgagagtataccagcgaatgaatgtgaggaaatggacatttccataatttcacatgcaataaaagcaatccaatttgttcatttttaaagcatcaataaatttaactgctcatattcatatttatcttactacttacacaaactctatagtgactatatttttacataagattgaaatattatttctgaggataaaacaaaggattgttagattctaaaagtcaatctcctgccatccctaatgtcctgacccttcaatacagttcctcatgttacagtgactcataaccataaaattattttgttgccccctcatgaatgtaatttttctacggttacagttaatagcataaatatgcgatatgcaggttctctgatatgcaaaggtgtcaggacccacacgttgagaacctttgatttactgtatttgtggttcattcg

SEQ ID NO: 21077 - DNA, 1099 bp, Mus musculus
ggaagtagatatgatcaaaatacattgtactcatgtatgaatttttaaagaatacatttaaaatatattttttttaaaaattaaaatggaaaataaattggagaatgtttgaaggtgatgcccagtgttgctctctgcccccccccccatgtttgcatacacacacacacacacacacacacacacacacacacacacgggatagggatgggaatggagtgtctaaagaagcagtccagggttatcaaatatgtactatttgaatgtttattatattccccattcctaaaaaagtaaactgttgaagaacaatgaccttacttcaggcattctattggaatttcatagatattagaatttgtgatcttgttccctccagcttccaccatccctacccatatgggatagagtaatcagtcgtcctcacattagtacaaggagagggaatttacttggaaatcattttcagttcacctcacttctatatatttataaatacaaaccgtttgcccactgtgctcgagcaagcatgttgtttcagacccatccttccttatgggagaggcacttccgtcagtacagtctctctaagggtctaactttccagctctgcttcagtccctttatgttctcagattatgctctgaattacaggagtgcttcttgatgacttccacataagtcctacaaaagcagtctaacctgtagctttttcctttctttttaaaattttatttatttgtttgtttgttttttattttagaagttcttgacgaatggtttgttgttgttcacagacttggggtgtaagtgtcacttttatttcctcggatgaagtgatggcatgcgagccatacctaagctgtgcacatactgagcttgggctgaacccagagcatttccttctttgtttccactccccctaggccttgggctggaagcttctagcctctgtgtaatctaattaatctttctagtttactgattcaatctcgcttctctgggcttctgactgaattgctctgcctggcctcatgttctttagcaatatgttctaatctggctccttattctctagctctttctaccttcacctgtg

SEQ ID NO: 21078 - DNA, 1192 bp, Mus musculus
atgacttatttaaagactttaatttttttggtcagaaccaaaacactcggtctaagaagcattttgaaaaccacttccacacacgccaggatggttctagtagacaaaggcatcacttccaggagttttcttttggaggcggattgtttgatgatatgtttgaagacatggagaaaatgttttcttttagtggctttgataccaccaatcgacacacagtacagactgaaaatagatttcatggatctagcaagcactgcaggactgtcactcaacgaagaggaaatatggttactacatacactgattgttcaggacaatagttgaatcttttcctgtttccactaagcccacctagtttattcttccttactatgtctgatgaaaaaagttttctgtgaactattttggtaaatgcatgatttcacttatgttaagctgtttgttataggtattccatatattgaactttttgttttttaaaacaaattaaaatacattcagctagtagacaactgtaattttcctgattaggagaagttcttttgaaagatcatttgcaagatttttttacgttacctgtcctttggctcattttcacaccccccccacccccccggccatattcccaaacaaaactcagcccgacacatacttaacaattaagttttaaaagttaccatagatttacattgtgtgaacttgaataataattgcagtgaaacctctgcaaattcaaaactgcacgccctgtggccctgacttgggttactaaatgtctgaagctgtaattttgagtcatttagtgaagaagaccattgcttttggctgtttgcccctgaaagctttagaaagtgaaggtttgattatcacacaaagatgccttttctaccgtagaattggtgtaatggggaagattgtattgcacgtcattaagctgaaaagtttaaaacttatgacatattgccaagaaattgtgttttagtactgggtgaatgattttgtttgatcaaaatcatagctttgtaaacatctttggaatatttttctatttgttgactttctaggtcttcgtatgaatttatttttggtgtgtgtttgtgtgtagtcactcttttgcacttatctttatctagagattgactaatacctcattctttttgtaaaagcagccagtaatttctgtgtaacc

SEQ ID NO: 21079 - DNA, 1200 bp, Mus musculus
caaaagtgagcattcatatgtcccgtattaaaagtactttgaattcagtttcaaaggctatttttggcagtcaaaatgaaatggttacacggttagctcaatttaagccaagttctcgaatattaagaaaagtatcagataagggatggttaaaacaaaaaaatgttaagcaagccgtcgagtctctgaaaaactatagtgataaatcagcaggaaagaattctttagcagaacagaaaagttactttgcagataaagaagaagattcaggtaaacacagccttttccattacacatacggtataaccaccagatttggagagtcattctccgttttagcaaatcatattaattcctatttcaaaagcaagggaaaaatgtctcaaacaaaggaagataaacagcttcaggacaagccagaccttgaagaaaggaaatccagttctccaggccctgacaccgtggcagacaggccagactcggaatctcccctagaagttaaagacaaactttccagcccgacccagatgcctgaggctcacccagtgtctgcaaaacaaagtattgctaacttcctttctcgtcccactgaaggcgtacaagccttagtcggtggttacattggtggacttgtacccaaattaaagtctgatcccaagagtccgcccgaagaacaggaagtgtctgctaaaacagagcaggctgttaacaaagacaagaaggcagaggagaaaaagcgtgtgctacttcagcaagaaaaggcaagttgtctttcagtgtgggcttaagaaatgttaaccatttgtagagtaactccatcttctaatcatgtttcatatccccttacagattattgcaagagtgagtattgataacagaactcgagccttagttcaggccttaagaagaacagccgacccaaagctctgtattactagggttgaagaactgacttttcatcttctagaatttcctgaaggaaaaggagtggctatcaaggtaatttctaacttatttaatatttgtcttgaaaaaaaatttaaataagcctattaaagtggggaatgcaaagccttttttatttaaaattttttgttcttttaaatcatacaatatatattcaggaattgtcttattttatcatacacattaggctaatgagttccttttgtgctgtgacataaattctgctatgagcat

SEQ ID NO: 21080 - DNA, 1193 bp, Mus musculus
atgattggataaaattaaaaagtgacatgtatgaaggccttccatttttttcaaaattgtgagtagggtacacatgtgttctcataaatgaaggccatcaaaagatccaccagtttagagaggaacggtgtgattcaacatgacacttagtgagttatcctgaatcagataatgctttgaacagctccatcctcatggaagatatgattggtaacacaagttatgtgggaattaggtattaagatgttcataacctttaggcattttattactgtgctagtggttttagtatctattgatcttaagttgtttactgtttgaatgttttaatatatgtgccaaacaagaaatgggggatgttacacttcagcctttgcttttactcgtttcaatcatgtggaatttgtgtgacttgattttctttcatgtctttccatttacactacttagcatttcactaggtgcgcccacaatccatgtgttacttttcactgtaataatcactgaaagagatataggaaatgggattttctttattaaagtacatttatgtttgaaatatgaaaaaactggacagttttctattcaaaaagattgaagaatttccagtgaactaactttttcttgaaatttcaagataatgttcacttttgtagatcaaatgctcttatcatttcctgttacagaattgattattcaattttactgagaaaatattcttatcattaacaaaaataaattattgaagtgaccaattgttcaaggctaatgccattttaacgtttgtattttaattgctcataatggttgcctggtttcttgtagcatttatgaagaaatattagtctagttagatttacaaaagttgaacatggtgccataagtattcactgtattgttcactgtattatttctcttgtaaatctttatattgaattgaaaatttttatgaaaagttaatcaaggtgtatatcctttgcttactacacataactaacagtgctgcttccgttgtcattgtgcttgtgagagctgggagtggttgagaatgtgggaggtagtcggctgaatagtcagcccctgtgcatgaccttgaagacagtggacagcttgtaagattcagctctgattcataaaaggaggaaagctagttgtcaaatttcatttcttctcctttattttttaagaactag

SEQ ID NO: 21081 - DNA, 1159 bp, Mus musculus
gtctgttagaagtcacactgattgctttgttcactataactttcattcaactgatatgaagagtttcagattcatcacaccccacaaatatgcatgaatagtttggttaattggtttgttaaaaatatattattggaccaatgcgatggctcagtgataggcacctgccattaagcctaataatctaatgaattctaaaaccccacaaagaagagaactagctcctacaaattgaccacactggatgcatgcacatgcatacaaatgtgttcatgcatgcacacacagtttaaataataaaccaggtgtgatggtgcagacctgtattcacaacaattagaagcagaggcaggataatcattacctctcaaggctagtctgggctacatagtgagtttaaagccaatctgaactattcgaggctctacctcaggaaaaaaaaagtaaagcaactattgactgtaatgttgatttttcttcattataaaaagctgtacttttacctcattctttacttttagacagtacatactatggtatatgacagttaatattgtcaatagagtctatagttacctaggaggtaattctgtgagcatgcctgtgacggatcatctagattaggttatttgagaaaaagtccatgactgtggtagcaccattctacgacctggtatcctggactcaagtacagaagctgatccctagcagtcacaatcactctgcttcctagcagcagattcactgtgactagctgcttcatgcatctctcttagtgccatcctgtaccatgataaaaatgcattcaaattatgagctaaaataaactcttctttaagttgcctttttctgatagtttgttgcagcaggcaagtcagtaatatagatacattctagagattacaatctgattcaatatgaacaggttaggtggtcaaaaatggttgatagtctaataactgacatttaaaacagtctttacaagaaccttccaaagtttaagtatcaccactatgcttgatctgtggagtatcactgagatgaaaggaatacaaagtagtttttgactgttttctcaatgccattgagaagttaaaaaccctagtatgaatgtatctgtagtagtctttcaaaaattcaatactggccaagcagtggt

SEQ ID NO: 21082 - DNA, 1197 bp, Mus musculus
agggctaaaaaagtagatatttctatattaataaagattggtttttattttgatagacaggcttagtcccttagctgacctctggcttttcacccttgctgttactgcaaggtgtccttaggctgtggaaaaaacagggatgaggagaaacgacttccagctcctattttagccacaaatcgtggtgttactaacgacataattcttgcttaggctttgctaattctgatattgataattctcctttaggagctgcacagcactcagaactgtacatactggtttgtgattgtacaaattcagtatgggcatcgcttggtgcagaggtactgcaagggaaggtccagcttgaccatttctaagtttcctgtgagataaacccggtttgaaagaggttggtaccaaattttggctaaaaatgaaaaatatttttcggctctgccttgcctccccaaaaggtaccgagagccacatgtgtgggttttatcaatacccacgggaggaatcgggtccatgtccacccaagccagggttaaaagcccactcatctacggatgagaaaatcatttgatcacctcagttaagcgttgccttatttaacttaatcaataggggggagagagattggagacgtactattgaaaggacaagcccttcactgcctcccacccaaataaaaaagccaattggccttgtactacaagagccggtcgaactccttctccctgtttcccacctatcatccaaaaaagcggagaaatatcaacttagtgttattatagtgtatttcacatttgttcagtcaaacttagccagagttccaacgccctacttaaaattcaactagaaagttacctaccaagtactaattagcattataaagtcagagcctacagctccaggcttttcagttagttgttcactaagataagaaaggacagtcttagccttatacagtttaccataagaaaagttaaggaatccgatgaaagcaagttttttctttagccctagattccaggcagaactattgagcatagataatttttcccccctcaggccagctttttctttttttaaattttgttaataaaagggaggagatgtagtctcccctcccctagcctgaaacctgcttgctcaggggtggagcttcctgctcattcgttctgccacgcccactgctggaacctgcgg

SEQ ID NO: 21083 - DNA, 1183 bp, Mus musculus
agtcaatgccatatctctgagctcacaattgcttaaattgttcatccctcagatactattaattctcaaatttacaattgcttatgcatatttctagttaataaataaattatgctcatgtaactcttaataactttacaagccttctagttacaactgctccttaagaaaattgattaaaagtgcaattagtcactgcccctttacagccatgtatttaaaatattttgtcaactagttattaattcaaaagtttaggtattgtaaaattttaaaactttaacttcttaaaagacaaaaaagagagaaattgtatccccgtgcatactatttagtgcattcccatgcacactattaaagtcttacctttattttcaaaatctaatattttaatgtcaaagagtttaataaatgctttatagtatcttaaagggatctacttattggcttatagattaatcctaaaacaactaccttattagaaaagggaaaaacaggttttctccacagaacgctgcagaagcatattagtaaattcgtgtgacgagctggtaggtaagttgactcatgtcctgattgaatcgactaaaaaactaaattaaattcatgttttagatccatccttacttgtcatttttccagtttagactagcttctagccttttaactttatggcaatagtacatcagagactgtatattcagacttagtaaaattagtcatttaatagagtcataatgatttttctcctttcttcagtgtgaccagccattctaactcaatcttagactggtcctaatattcagtccaatgttagagattcctatattctaaattacctagcaagttaattcagagcacatcccccacttcccctagatccctaacctcagaaagattgctggccttacagctagtagaaaaagctattaaagagcaattggtcacttaatacattggtaaaatagaaggaccccctgactaacaaatggaagggtccagatccagttctaatttggggtagggactcagtttgtgttttttcacgggatgaagatagagcgcagtggctgccagataaattaatttgttagataaacacagattctaaatcttctaaagtatcaccttgaggactaaaattcctcttttgcttaaaagtcggcttgaggactcaggctcc

SEQ ID NO: 21084 - DNA, 1219 bp, Mus musculus
tggtggtggtggtgtgtgtgtgtgtgtgtgtgtgtgtgtgtgtgtgtgtgtttagctaaaatgtattaactacaaaaagcgggtatagaattctgcttctttcttggtgtgggaaatgtcacatttaggactgtttgctgctgatcgtgttgttaaggaatgttgtcaaggccagtatgtctaaaattagagcatagagccaggaggtcagagagggacagacaatgcaactttcactcataatcaaagaactcggctccctgtggatttccccagccaggttcccaattgagaagggagatctttgtaatgttttcagtgtttattctcaaggcctgttgacctttgaatgatctgagattttttttttccttgtgtattctgttttaatggtttgtattttgtttggttttaagcatgtttaacttttaaaaaagaagaactactatatacgtgttgagaatttttaagtatataaaagaataaatatcaggagataaacataggaaggcaatggagtcatcatgcacataggtgctgatgctcacacttctccgtccctcagggcatttgtaaaaggtgcatttccagtgtgctgacttcacaggactatgttcttgataaaaaaaaaaaaatccaccattttaagaaacgtttgtatcctttaacttctcaaccacaccacaacacacactttgatgcccattttgccaggaacgttctgacttcagcaatgcgggatacttgactagaatgtgaaaacatgaaaaagatttttttggttgtcaagccgagagagaacattagggtttgttgttgttgttgtttttgtcttggtttggtttggttttcgtgctgatttctatttctatccattcgcaattctacagggcatttcaaacacactgtctagacatgactcggtatggaagacatgtagacaagtccaaaggaaagactgttctttgttctgtcctattagaaccgagctgtgtcccagacctcctagactcagagcggggttatgtccactgtacacttactgtgttttgagacatgatacactgtagttaaatgatattaagagcccagatttcacatgtagctatgcttatattactaaatgtaaacaaagaaaaccagataccactagctttccttgtcagtttgtttatttgttttatcgcttgttgttgttgttgttgttgttgttgtttcc

SEQ ID NO: 21085 - DNA, 1134 bp, Mus musculus
tcatctgttacagaatctttctgagttgtggtttgggaataaaactttaattttaaaacctgtttttagcttttcaacaaaattaaggattagtcagaattaatttcaagctatcagtgacttcatcggagagatttgaatttacaggactctcataggttggaatgaaatgagagcatagtacttcggtaggtgtgccttagtaatagttagaagtgaactttatatgccccagtacaggggaacgccagggccaaaaagggggagtgggtaggtaggggagtggggggggtgggtataggggacttttgggatagcattggaaatgtaaatgaggaaaatacctaataaaaaattgaaaaaaaaaaaagaagtgaacttttattagagggtgagggagtcaacctggaaaactattctttgcttcctaaatatggattaggttgaccaattttgggtatgcttagaagacgcttgtgtctctttagctaagcactgaccaaagaagaactaaatcaaaaaccagtgactacatttctctctctctctctctctctctctctctctctctttctccttctctctctctctctctttctctcgatacttgctctttttattttatgtttgtgggagttttcctacatgtatgtctatatgacatgtatgtgtaatggtggtgctgaggagggtgaagcagacctgttggaacttgtgttattgacatctctgagccaccaagtgtgtactggaggcgaatacaggccttgtaaaagaatagacagcgcccttaatcacagacccaagttcttcagctcaaagaagcctttctcggtactagcccaggattttgttgataaaatccatgtcttaattttcatgttttaaaatttggaccccagatgtttttgttttgttttgttgccaacaatgtacaaagtatgtgccaataatcttgttttgtgttttcctgagcacaggcatatgatatgctaatcttttttaaagcttgattcacttcactgctctgagatttcctacagaaacataactgaatgaaaagtgtgtggttcagaaagcagttgaattttgcctggtctctacctgtaagcgaaggacaacaatttttttttg

SEQ ID NO: 21086 - DNA, 1856 bp, Mus musculus
gagaagtaggaaacaatattttgaaaaataagttttcaatttaaaatgatcaaaaagcaatatagttgcataaaagcactgtaaaatatttaaaaggttaaaactgtggaaaattacattggtaagtttacagatcaataaaagcacctgttctccatctgaactagacaatggaaataatgctgcatgctggccagggcccattcttcatcatttgtaagttcaacaaaagttctcacatggagtcccacctcttccgaggtttgtacatttgtttttaagcactgaattcactactgatcccatcgcctggccagtagaacagtcattactccatgaacatcctcactgtttagacacataactgtggtacagtgtattggaaattttataaacaaaagtgaaagtgccaacacattattgatagctgataatgtttcattatctgcaactgctggataagtatgttgcattttaagagcttataattgtgtataatttgttaacactagcaacctattagtattgtgaatgtagagtttactgtgaagctatctgtgacttagctgtctgctccatgacggagttcttgcagcatggcgctagcagccagtgcagtttctaatactcggtaatttgcatgttttgtggagcatttttatgtcaccaaccagacagtatttcctgcatgcttatttagaagaggcagtttatcttgagaggtagtgtgatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatccatccccagcacctcctcatgctgtgcatgcagtcttaaattcaatggacaaaactaaaatgctggctacctctggatcatctggctgagcaactgaattacaaaagagaattacttccatctcaacttcagcccattggttacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtaggactcatttttttttttttttagtttttaacattggactgttatttcatttagagttctctatctctaaatatttatttagagaatgattttcaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgcttagttcatcatgtagcatcacttgtctcccgtctcattttttccttgcatgtcacaagtctcagatcatttataatacattaacagtaaataatatctatgtaaatttctttcaccatgctgtctcagagtcagcagtgaagaaaggcaaagattggggccccactcattggaagaagggaaaggaagcgaactaggatgtgtcttagaagcatttcaaatgtcgggtcttgaaaatgttttgttcagta

SEQ ID NO: 21087 - DNA, 1149 bp, Mus musculus
agtggaaagagaggcccattggtcgtgcaaactttatatgcctcagtatagggggaacaccagggccaagaagtgggagtgcggggggggggggggctgtgggggacttttgggatagcattggaaatgtaaatcaaataaatactttaaaaaaaaaaagaatatgcatgtctccatcatgaagatctggggtttacacatgatactcccttacattcatggtcttttctagttttgctatgattagtatgcgccagtaataccaaagaagttcaatgccatgggacagtgaatactgccacattattacagtgttgccaggatttgcagtggatctagaggtaatgtatagggatgattgcagcacatgtaatttatgctgcaactgtacagctgtaggtttggggcaacatcagctgacagtgcagcatttgtgcctctactaattatttttttcttggtattaaaactgaatttcaaaccaatctttatattacttgtggtattttcttacttttaacatgcaacattgacatagacttttttaaattaaaatttatttgtgtgtatttgtgtgtatttgtgtgtgtgtgtgtgtgtgtgtgtgtgtgtgtgtgtgtgtgtatttactcactgggtaatctctaatatttgcttactctaaatctttccttagagaagtcattgcatcctttttagaagctttttttggccctttgcctctaaattgcctctaacatagattctctaatattttccttctgtactgtttaaccaaggaaaaaaattaatgtacttacaaaaattttgttctagttgtcttcaggggcaaagggttctgcttcaaattgttattgaatggctgtacaatgtttgtacatccatttgtacaaacattgaatggatgattgtacaaagtactttatttgagattctaaaattgaaaatattaaaaagctttcaattttaagatgaaattacttccatttggtagttttcatttatattgcattatatacttgaaatattatataattaaatctttggttttagagcacaaactcagttttacaaactgctttttgtcggtacagagctttgtgcctgtgtgtgattccagttccagaggatcaaggcagcaggctcaga

SEQ ID NO: 21088 - DNA, 1199 bp, Mus musculus
accagcactctcccagcagtatttgggtattgagcactgtcagggtattttcttcattatcaatatagaaaaaactttcctgtaaatatttaagaaagggcaatctttaaattaagaagaaatataattttatctctataccataacattcacctattatgggttaatacctcatccatctaaggagaaataatcataaacagggtcattttctccattagataacttcttatttatattaaaccaaaagataaacacataaagcatttggagatggcaggactgttgcattttcctataataaaagcctaatatgattttcttaccgttagaatataaattagaacagtagatttaagaaaatcttaaaatactttgcaaattgtttcaaataagttgtatgctgaaagaggatactatatctttcgagtcttggctccaagatgaccaaaaatagaagaaacaacggtcgtgccaaaaagggccgcggccatgtgcagcccattcgctgcacgaactgcgcccggtgcgtgcccaaggataaggccatcaagaagtttgtcattcggaacattgtagaagccgctgctgtcagggacatatctgaagcaagcgtcttcgacgcctacgtgcttcccaagctctatgtcaagctgcattattatgtgagctgtgccatccatagcaaggtcgttaggaatcgatcctgagaggcccgtaaggaccgaacacccccaccatgattcagacctgctggcgctgcacctcgacctccaccaaagcccatgtaaagaggccgttttgtaaggacagaaggaaaactaccctggaaaaataaaatggaagttgtactttaaaaaaaaaaaaaaaaaaaaaaaaaacagaaaatgtggtacatctacacaatggagtactactcagctattaaaaagaatgaatttatgaggatactatatcaatgagcaaatagtgaagtaaagttgagcaaagttttaaatattccttacaatagtaaagtgtctttttaacagtaagtttttctagggtatattaagcagattcacacttgaacatcgcttggaattctcctgtcttagtgtgctaagactgatgtgataaaataacatgacaacagaataggataagataggtagttcataattgaaggtatagtccattgtattgggtaattcatgtta

SEQ ID NO: 21089 - DNA, 1121 bp, Mus musculus
ggaaatgtcgctggcgaattctatcagtcagagcagaattaacaatgtgtttttacagaggcttacaaggaacacaagaagaaggaatgtttttattattcattatcttattgtactcttgttatgctgatcaaaatccaggcaaagttatcaagaggaaaaagctttgtaaatattacaagaaaacattctttgtaaatattagaatatgtgcaaatactcttcaaatacaagtgaactaaatctcaccaagtataaagagttatgtatcacagccatgttgaacttatttcagcaatgcaaggttttgttggatctgaaataacatagttaatgcatcatagtaaaatttaaaaacatatttataacaatttcaaaatattcatagaagactgtaatatccagcattattgtaagcttcttgcaccacatgagtagtgaggcctctctctggaggacagccaactgctagtttccacccacaaaatattttaactgccctaactgcctgtcccagcccctgccctatagagtaaaaaacccaaactcaggacttgaaatctcaccaaccttcatactagaaatccccaccctggaaatctccactctggaaagcctccccaccccaaggtaccatatacagatctgtcttcgaataagttctttgctgtttctcatctgagtagaggtagcaccctcctgggttgtttcttcctaataaagctctttattgtgtgaggtttgttacatggtgtgactttgtggtattccttggttcccaactgccggcattcatttcccttcagagttgtaacacttacaattataccatgttgttaaaaataatcaagtttattaactagaaatgtaagatattctcctccacgtagtagaagccagcagtataaaatctacagttaatatcaagcataattgcagaaagctaaactttttacttctgtaccagcatatgctaaagaaatctgctgttctcacttctttttaattttgtacagaaaataatgggtaaggaaattagagaagagaacaaaaggcatctggattttgaataacaataagtgacctttatttgcataggtcttaccttgtatggtgaatct

SEQ ID NO: 21090 - DNA, 1148 bp, Mus musculus
ggcatgcgccaccatgcccggccctctttatttcttccttgaccaagttatcattgactggagcattgttcagtttccatgtgtgctttctgtttttgttgctatttaagaccaacccccaggttctcttacatcgaccgcctaagagtcgcgctgtaagaagcaacagttcttccttgcctctgccatccgcccagcagcagcgaagcagcaaccatgcgtgagtgcatctccatccacgttggccagactggtgtccagatcagcaatgcctgctgggagctctactgcctggaacatggcatccagcctgatggccagatgagaagtgacaagaccattgggggaggagatgactccttcaacaccttcttcaatgagacaggagctggcaagcatgtgccctggtgttcgtagacctggaatccacagtcatcgatgaagttcgcacctaccgccagctcttccaccctgagcagctcatcacaggcaaggaggatgctgccaataactatgtccgtggccactacaccactggcaaggagatcattgatcttgtcctggacaggattcacaagctggctgaccagtgcatgggtctccagggctttttggttttccacagctttggtgggggaactggctctggcttcacctccctgctgatggagcagctctctgtggattacggaaagaagtccaagctagaattctctattgacccagccccccaggtgtccactgctgtggttgagccctacaattccatcctcatcacccacaccaccctggagcactctgattgtgccttcatggtagacaatgaggccatttatgatatctgtcgtagaaacctagacagtgagcgcctaacctacactaacctaaacaggttaataggtcaaattgtgtcttccatcacttcttccctcagatttgatggggccctgaatgttgatctgacagaattccagaccaacctggtaccctaccctcgtatcaacttccctctggccagttatgcccctgtcatctctgctgagaaagcctaccatgagcagctttctgtagcagagatcaccaatgtctgctttgagccagccaaccagatggtgaaatgtgacccctgccatggtaaatacatgtct

SEQ ID NO: 21091 - DNA, 1289 bp, Mus musculus
aacttttgatttatatttctgtgaaacattttatcactcagttcagaaattaaattgccttataaactttgttgagttaaaaaaaaaaatcaaacttactatggcgtaccccctgagtacagcttcaaacaagaagattttgtgaattttggcatttggtaccctgagtatttcttgagttttttgtatttctatttatataatggttaagcaaaatgggatataaaggagccttagagaatacaaaggaaagaagaagattaggaacagtttgtcacttgcatgtgacgtgtcacatgatagatgttaagttcttttaagttaggtgatactgaatacagtagtgtgtgctccctgggtacgagggtaaatagactattagtaattagtccagtagtgtgtgctctgctggagtacaagggtaaaggtcctctgttactaacaaaatactgatactagtcttgagggagtcttacctcccagagtttgtttcaaagcatttggctttccttgagtacaggatgctagactatagggcccacatatgtgaaacagaagagattataaactgagttgtgtttttctcttccttatatattctttacaaatttctacttttaggtcattttgctggaaacatcgacccgttcaagcaattacatctaataaatatagtagttctttaccatgtactatctgtttggaatttgtcgagcctattcctacttataacatactacaaagtccctgttgtaagaatgcttggtttcatagagactgtttacaggtaagatagctttttaatctttgactccataatataaaatctattgcttatcaatttgaattttaatctggtgtcatgaaatatatcataaaataccagtattcctctcttggagcctattacactcttgggagctctcgtctcacttcttaatctgtgtttactctgctcaaacgaagaaacagtatcctaaaaatcagaggtcggctcctcatcgagtgtgtgtgagtccccttggattaatactcactgaaaacagtccggtggactgcattctcaacttgattgaatggctttatttagaacattcttatggtatagaaagtgttgttagtcaaaaccaggccaaataaagatttacttaactttttaacttgctttgtaaagcttagatcttggtttgcttagtaaaataaaatggtttgttattaactgttcagagttatcagatattaagttgccttctatttcaaaaaagactcaatggagcttatctgatttc

SEQ ID NO: 21092 - DNA, 2128 bp, Mus musculus
tttaagatggaaacatttttcctattcaaaggaaactaaaactttaaatatgggtggtcataatagcatagagcagtcctaaagctaatctctgttccatctagttcagcttaaagccaccgaattagtctatatcaactctactcatgataacaagagtatttgttaataaacattacctatattcattttataaaagaaagtttttactttcaagttttcctataaatttttggtttttatcatttagatttttctgcatttattaagctatcatattagtgactacataaaagaagttaacaataaatgggtagaccttgatttttcttttgaatcctacattgatttgcatattggatgtactctttagcacactctgtgtcttagtttgtcctagacgaatgtcagaatctgttacttcagaattctcagtctagttagaaatagtctttgctgatactgtatgtttcatggatttaattatctttcctgtttaattgctaacttttcagatggtaaatctgcaacaacgatggaagatattcttatttttgcaactggctgtagttctgtcccaccaactggatttaaaccctctctgtcagttgaatgtctacatgtggattttcctgttgcagacaaatatagaaaccatttagttctaccagccaccaacacgtatgaagagttccaagaaaatatggatttcaccataagagacactctaagattagaaaaggaagaaaggtctcacatactacctcggacattaaatgtttcttctaatgaagaaatgcttatttaaaggctgctattgatacctatttttattaatcatcacttttgaacattctggccagcttcttggcacaacaaaatttataactttctcataaagggatggtttggcttccgaaccactgaaggtttggttaaggccttctagtcatgtttggtgatagctttctattactgtgttgccttcgtaacaccaatatgaatattttctattactgtgctttcttgataacttcatatatttttagaatggttgtacaaaccgttcaactgtacaggtgctcggctatattagcatgacctatgaaaaactgttttctcgattttttttttttaaattagaaatatttttttaggatgacactctctagttttgtgcagctatcagatttgttttgttttgtttgttctcctttactgtttgtggttttttttgtttgtttgttttttgtttttttgtttgtttttctctacatagtcctgattgtcttggaacctgtctatgtagaacaagctgtcaaattaaagcaataaatagaaaagttggctaagtcatctcataaatcagagatattttttaatgttttgcaattaagtgaccaatatatcaattaaatgactgattgtaaatagtctattaaaagcaaggctttacaaatatctctagaacctatgtgtcctccttaagcttaaaatcatggctgtggggttttcaggtgtgcttgaaaatcccttagaaagcacagactatttatgttctttagtagtcagaatgtctcatgcttgaaaccatctaggtgtctgaagagtctctggaccatcatggtttcgcgccataactgctatttattattactaagattgttgtatgattggtaagatctcaccatagcattctatagttaccttcttttgctttcaaaagatatacattgtataatcaatgaatgaattataatttaaaactacaagttaaaagaaatactctaattttgccacatagagataaataatgtattttgtatattctttataaactatttatttttcaatttttattgtgttatgacagggtctttctatagagctcaactgttctaaatttgcaatcttcctgccttatagtcatttaggtgctgggattatgacgtatatcaatgtgcctagcaatgtttattttttgatatgaatgctgtaaaagagtaacaagaaaccacgtaataaaatcaagatatgtacagtctcatctcaaggcacgacatcactctcttgtaatccgtgccccgagagactaaggcaagaggatcaggagtgataacgcaagttt

SEQ ID NO: 21093 - DNA, 2604 bp, Mus musculus
taaaagggacttagatcccttaaacaacaggattgacttggtattgacaatgcccttcttaatgccaaaggaaaactcagttgtcatcatagtgccattttcttggttgcatcagaaccttccaagttgtacttaagaaaactaatagtttctctttatcttgagcatttctttatcttgtgttacattttgctggatgtttcgaaagtaatgaagtgggccatcataatttaaatcttaaactcaatagacaccttttatttcaagtgtgttgataagttggatctttatgttttaacctgtttaattccagctggggagatggctcagtggttaacagcactgtctgcccttctaaaggtcaggagttcagtcctgagctatgtgcaaaatgtttaattcctacagagttttaaaggctgttaaatccatacaactcctaaatgctattttttcagcttttagtttgaggggtttttgtttgtttgttttttgttttcccctaagataaagcgaacacagccttcataaaacatagggtgggattatggagcctgggactggctggctacaagtgattttattccacttactctaggtaagacaatggccttgttggtgagatggtctaaatattaacaggatacttacttcaagtgaaacatcagatttcaagatgtcttctggttcaaacctgttttgcatggtttctagatcagtctctatacacttgaggcttatcagagaaactgcagtgttactgcgtcatgcttgtaatgttcccattctgttttatagtatagttctcacattaacatacttagcttcaaaattatgaaggaacagttttatgtttggttaagtaaaaacccagaactagcgtggtctctgttgtctgcatttatgcttccccctaattatattggaagcttttggaacttgcacattcagtgtttataaaggggtgtataatgagtttttcctatgactttgctttagtgtttagtcataagaaagtggtaagaactagactctgttgataaaacatggttactattgcatatttgttatgcttcaggtaatgcagtgtaaatcattaaacacatttaatgatgaattatttgaatttatattatctgtaacttgggaaattttgtagtccttaaaagagacccagttttcaagttctatttttgaccaccttcaaatatactccactacccactgtatattagaatctgtgtagaagtagtttataagtcggcctgtttaaaatatatcaaaacaaatactgctggggatttggcctggtagtagaatggtttgcctagctagtatgtggaaggccttgggtttaattttaaagtatgaccaaaacattaaaaaaaaaaaaaagcatgaacatttaacaataacatttctaagtaaatgtttttatgccactaaaatgtgaagttgtgaagtgttcatataaactaaataaatgtgttgggaatcttgagacagaaaggcagaatagcactgttcctcaaggagggaagtcaaggcaggagtctgctggtgggggttgatacaaagtgattgctgcctactgccttgctttccatggcttgctcatttgctttcttacagaagccaaggccactagtccagggtggcactgcacacgggctgggcccttcccattcgccactaattaagaaaatgcctttcagggttgcttacttcctggtttcatggagccattttctcagttgaagtgttctctgcttgcatgtctctagctgtgtcaggcatctaataaggatggggtggtcttttagtgcagatgtgtttcttttcctttttattagtatgtaattgtttaaaacaggctgtcacgacacatgcatacatgtgtgtaatgagctttggtcatactccccttcttgcctcatactgaaccccttccctatttccaggattgtcttaaacaagtagtccatttacgaggctgatgttattaaagtgggtaagatccaaaatctttactcttcttgtctgagagctccttgaactcaagaaacaaactgtttttagcaaattttctaagataaaactatcccttgatgttcaattatttaaaccaaaaaatctggagttaaacagctacaataaatctaactctgaagtcatgatttttattcttataatcaacattaatatcattcttggtcgtagctttgcaggactgttctatatagttactcttctaatgaatatatatatctttatgtttactccccacattacaccattggacagaaacatgcacactgtataaatgtcttagtattttatgataatgtgccttatagtcttggaaggagttagtatggaacttaaatggtcaaatgacaaatttgtacttaaaagtggggattctcaggtgagtaagattaaactcactggaaggtgggaaagccattctgctcaagagtccatggacaccagaattgagatacttcccctagggcacaaactggtagttatagataacctgttgtaactttataaaaataggtatctacatctgtcaaatgtgtttttattgtaaaaaaaatg

SEQ ID NO: 21094 - DNA, 2171 bp, Mus musculus
cattaatcttctgctatgttttataggtaaaatgatccattctatggtagctcatttggatgctgttacaagtttagcagtagatcccaatggaatctatttgatgtctggaagtaagtttgaacttcagtacaccctacaaactttataaaagaattgctccttagtaacaagcttccccccccccccttcttttacaggccatgactgttccattagactatggaatttggacagtaagacatgtgtacaagaaataacagctcataggaagaaattggatgagtcaatttatgatgttgctttccatccatcaaaggcatatatcgccagtgcaggagctgatgctcttgccaaagtatttgtgtgaaccaacatagactcgcatcttagaaaaaaaagatttacttggtcagaaagggggtctgcatcactgccatcatgaaggttcctgacatgacactacatgtgatctgcctggtgattggggcaggcagaaattgggaatcacatcctaatgtcaggtttattagtttaagtgtaattaactgtattttgtgggacagaaagaaaaaggactccagtatctgtgccctatactggatatgaactgagcggtttttgtttttgttttttaaggtgtttaagccaatgtggagtctgctcttagggggaaggactttttgttggactctgtgtgctgccttagggttaggaatgtggtgctctggtggggaagcaagctccaagagtagctttgttcatctcttagtgatcttatgttcatcagtgaatgccacagattcccttttaaagttattttgctttaaaaaaaaaaaaagaaaaaagaaaaaagaaagaaaagaaaatttaacttaaaatattttagcattagttgcacaaaatgtttggataaaattctagtttttataagtctttttatatatttagcctgtcacaacagtgctcaagatcatattgatgttttttctgcattatacaaccctaaaacacagagatctcactaacctgccacctataaccactttctttcctccttttacctaatacagctcagctaagtccttcataaagatgataaaccaatcacctttgtctacatgtcttcatgaaccaaggactattaagtgtattaaaacaaagctgtggagtttagtactccaaaggaactctttaaaaactaatcttgacatcctatcactatgtgatattttgtacatcttactgtatttacaagtttatttatcaaggattatccatcttgctaatagcctattatttattttactttttgttggtctttatatccttttattaatgtgctaaaggaacctgtatatctattttggaactctttgaaaagtctaaaatagactaaaaatggaatattttatagttaagttacaaaccaagatgtttctccccaagattcttgatttaccatgattccaaaacaaatgaactagttagaaaattggagaatattttattaccattacaaataagatattaaaaaaaagttgaatcaggacacagaagtctgctggatttggactcacagtctccctgttttactttttagatgtgcttacttttatggtgtaactgaagattttctttgtgtaatgcatgattaagacaataaagtattttttctagtcttccaaaagccttttctgatcagtttgcgagttttgatgagttttgtaaggtttttgttttacagactatgaatcagcagatttttaagattgtaccccagagcaaacatagagctgttgaaaaataatgtatataaaatacatataataaatattaaattgtgtacctgtatgttgctcttggccacattatttcgtgttgaataataaagtgcaatactctccacaattaaactaggaaatgaaggtgctttcttagtggagtccttcatttttatgctattctttttggtttttcaagacagggtttctctgtatagccctggctgtcctggaactcactctgtagaccaggctagccttgaactcggaaatccgcctgcctctgcctcccaagtgctgggtatgctattcttttcatacgttgttgtacttaatgagattctagtaaggttacagcagaaacactattaagaatacttttcagag

SEQ ID NO: 21095 - DNA, 1209 bp, Mus musculus
tttttactgtttcaaaagtcccttaactttctgccttgaaattttttatgtgctggccaattttgtaaatggaaactattgtgtttactgtacccttgcatatttggtaattttgatattcctattatgctttcttataaattattatggcagtggcaattttctgttctcacgtaacatttgataggagctttggatttagcttgctaattagaagaaaacattaaggaacttttcagttgatctaggtatttgaaagtttaacaaaattacttttctgaattcttacataaagaaatagacttgctctgaagtttttaaggtacatttaaaagcccctggatattttagtgaaacagttctaaatatgtgtttttaaacacacaaaaagaaaacagaaaaagtccacatgcctttgagcttattacttttacctggaaatagtgcaatttttcgttttagttgcctgccaataaagatgcctttcgaaagacttggaaccccaaatacacactacgtagtcattttgatggtgtgagagcattagcttttcatcctgtagagcctgtgctcgttactgcctctgaggaccacaccctgaaactttggaacctgcaaaagacagttcctgccaaaaagcaagtattttcatactaactttttttcttgtacttttgaacactcttttttactatggtttatctttagtacatctgtaatagcaactagtgatttatggtgatttaatatgttcttttttccccattccttttctctcttaggagtgcctctttagatgtagaacctatctacacatttagggcccacatgtaagttttcttgaattagtatttactgagcaacagttgttgtttatagttagcagttttcaaacctaattttcttaacatttgatgttagagaagatacgttagttgaataatgcctcattcgattaattatatttgagtataatctaatagtacttttcagttgtacatttttacctaaaattgcttttagatttacattagtgaatggattgagggggaagggggctttgagtttcttcttagaatttataactaattatcctctttttctgtaatagtggccctgtcctgtcattagctattagttctaatggagaacagtgttttagtggtggcattgatgcaaccattcagtggtggaatatgcctagtccta

SEQ ID NO: 21096 - DNA, 1184 bp, Mus musculus
atgtaatactattttcctaaaactctgaaatacttttgtatataagctttttgtattttatgtgttttaacaaaatataaattttgttattgtttgcatttctgtctctctgtctatctagacatgaagttgggattttacaaaaggtattttaaccataggtttaatttaagcatgaggattaagagaaagggaggtacttagaagtacattaggacatacccaagagtatgtgttgtaggcatctcttaagagagtctatttgtttgaaggcaggacctcaatctagcctaagctaccattgaacttgtattccttgtctctctttctcaatctagtgctaagataatagatgcgttcttctgcatccatccagagtaaaccctctggcttctgaccatgttgagtaggagccttaagttctacacacgcagatgattttctcctggcttacatccttagccttaaccttaggttctcaaatctaaacttccgtgctcttagaatacttctgtgcatttaacttggtctttgttaaactttaaaattgtttctgatttttaaatatttatgcagatatcagctatgtgtatctgtgtaggggaggacttaagaattagttctcgggctggtgagatggctcagtgggtaagagcacctgactgctcttccgaaggtccagagttcaaatcccagcaaccacgtggtggctcacaaccatccgtaatgagatctgacacatctggagtgtctgaagacagctacaatgtacttccatataataaataaataaatcttaaaaaaaaaaaaaaaaagaattaggtctctagctgggcggtggtggcgcacgcctttaatcccagcactcgggtggcagaggcaggcagatttctgagtttgaggccagcctagtccacagagtgagttccaggacagccagggctacacagaataaccctgtctcgaaaaaccaaaaacaaaccaaaacaaaacaaaaaagaattaggtttctaaagaaatgattagaaattatttactttccacatttccttcatgaaattatttataaattaaaaattggtgaattcagagttcagtatgaaaattttaactaaattgttgtgtagatttaatttagggaaaaatggtagtatcctagctaaataaaggatgcttcaagacca

SEQ ID NO: 21097 - DNA, 1176 bp, Mus musculus
cttcccctcctccctcttcctttctcttctcttctcttctctcccctccccttcccctcctccctcttcccttctcttctcttctcttctcttctcttctcttctcttctcttctcttctcttctcttctcttctctcccctccccttcccctccccctccccctccccctccctctcctctcttcaagacaggattctctggctatcctggaacgcctatagattaggctgcctctgcatcctgagtactgggatcaaaggtgtgcaccaccacacctgccttaattcattttttaaaaaagattgttttatgtatatgagttttgtctggatgtatacatgtgcaccacatatatgctgattgcctacataagtcagaggggagggtataggatgtcctggaacttaaagttgacatcattctcttagacctggaattaggctataacgaagctattgagacaaagaaaaagttaatttgtgtgattgtggctttttttctttaatttttaatatgatttgaaggtggcagatgttaacaatatgttgaattttagcatttaattttctcttgataggtatcttcaggaagtaggatacacagatacaatattagatgtacgatctcaacgggtaaggtcattacttggactgtctaattcagagccaaatggatctgtagaagcaaagaatttagaacagatcttgaatggtggtgaatctcctaagcaaaaaggacaagaaatcaaaaggtatgatttgtatttgttgattaacatcatttaacttatggaagtcaaaatcagtgatacaacagtggcttttcattggtagtctcattttctttccttttttttttttttaagatgagccaggtttttttttttttttttaagatttatttatttatttattatatgtaagtacattgtagccgtcctcagacactccagaagagagggtcagatcttgttacggatggttgtgagccaccatgtggttgctgggacttgaactctggaccttcggaagagcagtcgggtgctctaacccactgagccatctcaccagccctatattttctatagttgcatttattgttagatattaaatgaatctatcaaagccacttttttatatatagtagtaaaatagattattgttattagctgtta

SEQ ID NO: 21098 - DNA, 1221 bp, Mus musculus
tcttgagttcctgccctgacttctctgaatgagtgactgtaagctgtaaactgaaataaacctttttctcccaagttgcttttggtcatggtgctttgtcatagcaacagaaatgtaactgagatactgagtaaaacctgtgtttgagccttcttggagaacaaggaacatgcacttattttgctttcttccctatgttttatgatatttaatttgtgttacatcttttgttgcatacttagtaattttatgattcatttgtattgctggagactgaactcagggctttatgcacgatcttcaagcactatatatgcttagttctacatttttttgattcaattaaaataatattttaataacagcaactctgaaagtcagattcacctcctttcttgattgttttctacattttgtatttttgttgtgtgtgtgtggtcactggcttctttgtacagtgcagggaaagtggtaaaaggatagagaaactgagttagtaaaagtttcaaatcttgcatgcctggaatatgtgttctttaccaattcttttttcaaattaattaatcaactaattaattaataattaatgtatgtacattgtgtgtggaggtagagggggagcagagacggacagacaaaagacaatctgtgggagttggttctctcctattgtcatataggttccagggaccaaacttaggtagcaggcttggagctactccctaggccatctttctagccctatagttagtagtatatcctaaaaagatatccaattcagccttcacattcaagaattgaagaagctaagaacaaggctactgggcatttataaagctagttagagggattcaaatatatatctgtttagatgcccaggctagtctagtgtgcttggatcaatatcttatttcttcacctgattttctataatttctaagaaaagattattggagttctaaaactaagtaggtcttttttttttttttttaaatggtgtttggaatcatcttgttcctaggagcaatgttgaacagtatgcagatatttagtaacaagtggtttctggagtgatagcatttggacagatggatctgatgtatttttaactttccaggaagatgatttcacagttaactttggaaacgtctcctaatgactgtgagttaccaggtaatggaaactcttcatttgttggcagaatcagtataaatgagaagt

SEQ ID NO: 21099 - DNA, 1099 bp, Mus musculus
caccagaagagggtgtcagatcccattacagatggttgtgagccaccatgtgtttgctgggagttaaactcaggacctttggaagagcagtcagtgctcttagccatctctccagcccacaactacttctgtttttatatgtagttctgaatgttctacgtttatcaacactttttaaaaaaagatttatttattattatatgtaaatacactgtaccctgtcttcagacccaccagaagagggcgtcacatctcattacagatggttgtcagccaccatatggttgctgggatttgaactcagcacctttggaagagcagtcagtgctctgacacactgagccatctctgcaacccaacacttttttttttttttttgagactatactaggctagaccttaactcctgggtataagtgattctctgcctcagcctcctaggtagcagggactaagatgcaaacacacactttttggctgtgttggaaagtgaactctgagcttatgcatgctatttagtgtctgtggtttgtgatctcccacagcacacagatggaggtcagaagacaacttgtgggagtcagttttcacttttcactatcagagccctgaggatcctactcaggttggcaagcttctttacccctcaaccatttcactatctttacaaaaaattttttttaattctttaattctttcttccctgctatcctcagtttgagtcttgtcccttatgaacattgcataacacaattcccacccttcccccatcatgattgaccttcaaatttccacatcctgtagctttatacactgtattgggtttaaactacattttctgttgtcaactatttcttcccccaaatcttttcctaaagatttagggcttcgatcctagaagtgggaaggcaaaaagcaggtggacttctcttgagttccaggctaactagaggtatatagtgagactgtctcaagcaatggactctttatttggcttccattctattcattccttctttcattttctctgtttcatctccttttgttttttgagacaaggtcttaactatgtattcctggttggtgtggtgctcaactg

SEQ ID NO: 21100 - DNA, 1179 bp, Mus musculus
tttttgattggctttaattttgtatgtctccaaaaggtcttgtctcgcagctagtgtttatagatattatttgtttattgaatcctttgtcagtttcttagagatttggacattctagctttgttttcaatggtgtatatgtgatggaacagttctgggcacacaatatatgctcagcaggtatctggagataaaataaatgacttcaaattgtacttcttgtaatactcagagaatgcaggtgggattgttttgttttgttttaaatatcatcttcatggttgccctttcatagattttgttgactgaaacatactttgagatcatccattttcttctgccatggttgttgttgttacgtgtgttgttagggtaaagaggtggcattattaactgtcacttatgcgggagccttttgaatttacctatggtttgtataaccccagatgcaaagatgaccttgctgtgccgtttgctaattgtattcacaatgcggttgttggctttgttcgtcctagatttcctcgacagctgccgtgccagtactctcttagctgaactagatgatgacgaggatttgcctgagcctgacgaggaagacgatgagaatgaagatgacaatcaggaggaccaagaatacgaggaggttatggtagagagactcttccattcccttcactaatgtagggtagtaaaagccaggcatggtggtatctctggtgatcccagcaattgggaagtagagacagggagattaaaaattcaaggccatcctcagtgcctggggagtctgggctgcataaaacggcgtcttaaataaaatagagccagccaggcgtggtggcgcgcacctgtaatcccagtccttgggtggcagaggcaggcagatttctgagttcaaggccagcctggtctacagagtgagtcccaggacagccatggctacacagagaaaccctgtctcaacaaaacaaaacaaaacaaaacaaaagccaaaagattttagttagtgaaatgaagagctttaaaaaacgctttgtagtatgtatcatttaatggtgtacgcctggggcccataagagtgatgggtgggtaaaaacaattgccactatgcctgctgacttgagttcaataataactgggactcgcatagtgaaaagagagactggatcgatgcag

SEQ ID NO: 21101 - DNA, 1190 bp, Mus musculus
cagtgctcttaactgctgagccatctctccagccccctctttatttatttttattctttggggggtggagtagggtctcagtatggctgtcgtggaacctagtgtgcaggtgtgcttatgcctcccaaccgctaggattaaaggagtgtcccaccactcctggctcatctgagaaagtactttgtaattttacttaaagcatgtatatttaaagtttgaaaattctaacaagttaacttgtttccttataattgatgtctgtcattgaacttttttacaagccacgtagaaacatgtattgttttaattccttatctttgaggccaggttttgcaggtcacccaggctgccctcaaacttgtggcaattctcctgcctcattctcccaactgttgatattgcagatatgccaccacattggttttatcctggtttattgtggctatacattataacaaatctcaattgtttgtgtttatgtttgtgagtaatttttacaatgctaacaaaacaaggtcttctctgaagaatgttgatggtttttgtgtagatacttacaagaagattacgctttcggttggaacgtgcacctggtgaaacttcattaatagaccggacaggcaggatgctgaagatggagcccttagctacagttgaatctctggaacagtatctgctgaaaatggtgagctccgtgtggcagggctttgtgagatacaccttctccattactttgaccctttgtaggaaagtcacataaatgtgtatccagagttatggtaatgctacttttagaaatctgttttagaaaacatgtggtggcacatgcctttaatcccagcacttgggaggcagaggcaggtagatttctgagttcgaggccagcctggtctacagagtgagttccaggacagccagggctacacagaaaaactctgtctcggaaaaaaaaaaaaaaaaaaaaaaaaaaacccaaaaaacaaaacaaaagaaaaaagaaaaaaaaaaaaaaagagaacttgccttaacagcaccctcaacataaagatttttattaatgtcatttaatattgaaatagtagacaaaaatcttagtaccattcaataaaggtatcgctacttacaggtgtaggcaatctttttcaatcaagaaaatattaacattacattgtttggagaccgtgtgttat

SEQ ID NO: 21102 - DNA, 1235 bp, Mus musculus
aaataataagctagatcttaccaaagtaaaataacctagtatttatataacattatttgtaagcttttgtgaattaccatgttagaaaataaaactagaattttcatgcctcttttagtgtagatctacctcacctcacattcatagatgatattggcaagttgcacataatagttactctttccgcgtttctactgctcacgtcctttacatgtcctgcctctcagcagacacagtgattcataggtagcatttccaaactgtttaataaatgagcctttgacaggaagcaaccctctcagattatggagttagcagtgtatggtgctgacattcaagccccatggggcacgttctttatcactttgctctggctgcctttcattggtgtgtgcattgagatgacttgatgctaatcttgggagggaagttttatttacattgttgtacaccgttaggtttccgatggagctctgcggtgttttgcatcactagctgaccggtttactcgtcgtggggtagacccagctccattggccaagcatggattaactgaggagctgttgtctcgaatggcagcggctggtggtactgtatcaggaccatcttcagcatgcaaaccaggtcgcagtaccacaggagccccctctgctgctgcagattccaaattgagtaaccaggtgtcgacaattgtaagtctcctctcaacgctttgcagaggctctccactagtaacacacgtaaggatgcttcttggatcttttgggttttgaccttttggaagaagtgtttttgtatagtggcaaatatattaggtgttttctcccattctctttctaggatcttctgaggtcagagcttccagattcaatcgaaagtgcattacagggtgatgaaagatgtgtgcttgataccatgcgtctggttgacctcctcttggtgctgttatttgaaggacgaaaggctttgcctaagtctagtgctggatctacaggcagaatcccaggactgcggagattggatagttctggggagcgctcccatcggcagcttatagactgtattcgaagtaaagatactgatgctctcatagatgcgattgacacaggaggtcagaactttttctgttaaatataacattcatagccaggttgtacacaccttttgtcccagaggcaggcagatctctgtgagttcaagggcagtctgctctacagaccaagttctaggacagc

SEQ ID NO: 21103 - DNA, 1193 bp, Mus musculus
ttttttgtgactgataggtactctttgacttaagatggggttgtagctcagtaaatctcttcttagttgaaaataacatcagatataaatacatttaacacatctaaacttactggaaataatagttcagcaaagagattgttgggaatgtgaattttttgatgttgaacaaataaacaggtgaacagattgaaagtcactcagcaaggcaatctatttgcaaaaagggtatgctaaacccataccagctagcaagtatgtgtggccaaaaagtttttattcctaacttaggtgacaattgtctcattctattggtggcagcttactttgcattatgatgtaattggtaaattgtcccaaaagcagatcccaggttgggctaactacctttgctagaaaggatcccctgtatggtgtgggttgtttactctcatgatcttgtggctgcctgggagctaatgtggcaggctgcctctgcagatcatgagaggatatttgtagcccaggaaaaggtcagcattcaaacttgcattaggctttcttctgaatatgtattgctttcataccattgtggtcacagtgttttgtttcttgagacagtacagtgtgggccaagattgtctcaaactctgattcttctgcctctacttcctgagtgctgggattacaggtgtgtgtctccattcgaggtttaagtttaaaacttgaatatttagtttctgttcatttctctattaaaaaccttcatgcaaatggaggcccaatgttgatgttgccaatcttcctcagtggctcttctcccccattctttaaggcaggatctcccaatcaaaaccaaagtccgcctattaggctagtctttagagctagctagcttcagggatccagtctccatccatggctgggatcacaggctagccttcatagtcgccagtatttatgtgggttttgatgatccaaactccaacatgtcaagcttaactgccgaaccacctcctcagctctccacagtccactttaaatagtcttttgagacagggtctcttactagccacaacctcacatgaaaccttcttgttctagccattcgaatgctgcattttaggtatgagcctctggagacccagtttagctcccactatctttagtatatttatatgatcagttctcatgcgtggttgccctcttcctct

SEQ ID NO: 21104 - DNA, 1405 bp, Mus musculus
tattcagtggtcgtatcaaactgtgttgcatttctcaagcaacatcaacaattagagcaggggagggtggcactcacctgaggagactgagacaggatgatcatcaaagttccaaccagcctggtctactgagtgagttccagaccagctgtgaccacacgataggacttctctcaaaaaataaattaacaaactaactaacaataataatgccaacaataaataagtgattgcaacactctttaataactagacctaagccaggctcatgcctctaatcccatcactcaggagacaggcaagtggatctctgtgagttcaaggccagcctggtctacagagtgagttccaggacagccagggctacacagagaaacctgtctcaaacaaagaaccaaatctagaattacccaacttataacaggagagacagcttcagccccactgtgtggcttgaggctgtggtctcatgattctgtcttttaagtgagtctatgctgagatcacgcaggatgcttttatgtagaatatagaacgatcaccctcctaccattctcagatggattttctgttacctctgttccttttgttttggttttttatttgtggaaatcattcatattgaaagcttaatatagagtcatgtctatatcgatttggggttatatgaatgtcagatttagtacaacaaatttagaacttcagtgaatacgaatacttttttaacacagaatgtattttaatataaaaatataatgataaagtcatactggtagaaaatattttttggctgtttacgatcattttccctccacttcagtattgttctgtgtgaattgaccactgtgtcagaatgatgcagcttcctgttaaaatttacaaaatgcagggacagaggtgtagccagaattgagaaaaactgattagaccaagagcacgtggtggactctgttttattatgtttgtatgtaaatactcttgtaaagcattcagagtggaaaacatttgacaaactctaacactaaaatcaacttttctacattacataaataaagctaattttctttaatgtttttgtattttgaagtgttcatccaggaaagatgaccagtttttctctcccttcaccttggctttggttctcaggagtgttccccacaggagcgttccccgaaggagcgttccccgcagtggtttggggttgtctacctagagggcttgaatgtatctttgctgctgttctcatctaaaatgcccttctcccgggttctttctgtgaactctgtctcctttcaggccagggctaagtcttgctaacaacacgttatacccttgacctaccaaattctactactgccttactcatctgtgttgctgtagtcactgccacagtgtgatgcctact

SEQ ID NO: 21105 - DNA, 1194 bp, Mus musculus
ttagtgacctcagcgatctccgcagagttcatcagctacttgtctcttccctgacgaagattcaggctggaaaagaagctctcagccagctgtacaatgagagtgcctccaccatggagatcttagctgtgctgagagcctgggcagaggttagtgctccttcatggacagtggggattatgaaaactagtacacaccacaaacactgaaggacatgcaatagaatcataccgtaaatctttttggcggggggagggggtttgtaagcctatatatgtgtttgcctgagtttgaacccagatccttgttacgtaaggcctataacactgaggcacaccctaaccgactttttgttttgttttggggggctttggggggttttgaggcaaggtcctcccatgtagctgagggtggcagtgaaattgtgattctcctcttccacctctcaaatgctgagagcaccagctctgtcaccgcattaaatagcctgtgaatttcaaatgagatttatttaaatattagtttataacttctaacaggtctatataattgctgtacaaagacataaaaatcacaagcaagccttgaagactactgttaattctgaagacagtatgagaaacgggtcctcttcagctgctggtcttcttgacttagtctgcactgacctggccacgctaagcaaactctggcttgctgcacttcaggattttgctctcttaactttgcctgcagaatttgcttcccagcttcctactgaaggtaaggaggtaaaataaattaattcctagagtgacagtaacttctattccaagatttctcctgtagtacatgatgctcagctgaaacatattactcctaaatgacttttattcctgggataggcatctaagagctgcatttttgtagacaaccagattttgtaattccccgtcctcacagtcatctgtcctcacagataggatattaccaaacatgtccccagagcagcttcagtagcctgtgtgcctaccaacatggctgtctcgtctcacccttccaactgaatttagtccttaatttttaccaatctagagggtaaaaaatagtatttttaaatttttatttagagtctttgcttgtgtttataaccatttaaattgcttcttctgtgaatccctgccccttcttggatttctaatttatgtttgtcct

SEQ ID NO: 21106 - DNA, 1174 bp, Mus musculus
ctactgatccatgtccctagctctcactggatttttttttttttatggtatatagttgaaattgtttttatagcagtttcttttgtgaatgagacagtgttaatccaaacctataagattttattttataaaaacaattctattttgttttataatagtagaaacgttgtataatctcaaagttttataaaccagcacagataaaaggaaggaaaatgtcttagggatgaaataggtccaggggcaaatacaacaataaattaatcatgatgagtcactttcgcttcagacaaaagcagtttcccccagcagagtcttttcatgaatggagccatgtttgattctcatggaaagaggtactgaagaccatgctatgttggtgagtttgacagccttcattgattgaactctgtcgggccacattttctcagccagctcatttcctggtctcaattctttccagtatgcatctgtttctactattcccaatgtaatgacagctcagtcattcatttatacctcaacctactctgtcgtagatactgtggaaactgtagaaatggacaagtcactctttgccattggggagctcacacactagcacaccatggtgtgacatccttcctgcttgtgctccagttctttctgtgtatcctgccagttcactcataactgttggaatcacatagctgtcctgctcagatttacactccaaaacctttgctgctattcacgcaaagcattctattatataacctacatttgtacaggaatgtcctgtgcagttttctgcagagttctgtgttttctttccaggctaccaatatgtctatcctggttatattctgtataagggtgtgaatgttggcaggaggcagaattgagtgcttacgaaaatccagctactgtcgtaacgtgcgtcttctggttgcttacagtgcttacaaaaatagtttaccagttagcatttctctgaagtagttcaataaagtgttgtctgacttcccttcaagtaagggtctttccccagtgttgtgaaattcaatggtactgattgtattttattattattgcattcatgttgtcattctagtatttttatagctaacacttacgatgtggagagccgtgagcaattgccatcacgagcctccgctgtgcttaactggtaaac

SEQ ID NO: 21107 - DNA, 2104 bp, Mus musculus
gcagaactcacatttggttactagaggctttaggaattcattttaatgcttgtgagccattagatttataacagttactgttagatttaccttaaaacttgaggccatgtgcatttataaaagtaaattataagttgtttatatgatttctttacatatatgcaacattattagaattattagtttacgtaaactttgttattgacatttttactttgtgtatttccacatgtgtaactcatgtaagttttttgttttttttcccctttctaggaagatgatccatatgatctcgaagaagacctttctttggcaatgagggaactacaaagaaccaaatataattctgaaattcaggatctgtattttgagatggttttattttcagaatgaaaagtatatatggttatctttatgaatgtaaagacatgagaaaagagttatgatggcaaaaaacaaagagcctcgacccccatcttatactgtcagtgtagttggactctctgggactgaaaaagacaaaggaaactgtggagttggaaaatcttgtttgtgcaatagatttgtacgttcaaaagcagatgaatattatccagagcatacttctgtgcttagcaccattgactttggaggccgagtagtaaacaatgatcactttttatactggggtgacataacacaaaatggtgaagatggtgtagaatgcaaaattcatgtcattgaacaaacagagttcattgatgaccagactttcttgcctcatcgaagtacaaatttgcaaccatatataaaacgtgcagctgcctcaaaattgcagtcagcagaaaaactaatgtacatttgtaccgatcagctaggcttggagcaagactttgaacagaagcaaatgcctgaagggaaactcaatgtagatggatttttattgtgtattgatgtgagtcaaggatgtaataggaagtttgatgatcaacttaaatttgtgaataacctttttgtccagctatcaaaatccaaaaagcctgtgataatagcagcaactaaatgtgatgaatgtgtggatcattaccttagagaagttcaagcctttgcctcaaacaaaaagaatcttctagtagtggaaacatcagcacgatttaatgtcaacattgagacatgtttcactgctttggtacaaatgttggataaaactcgtggcaaacctaaaattattccctatctggatgcttataaaacacagagacaacttgttgtcacagcaacagacaagtttgaaaaacttgtacagactgtgagagattatcatgcaacttggaaaactgttagtaataaattaaaaaatcatcctgattatgaagaatatatcaacttagagggaacaagaaaggccagaaatacattctcaaagcatatagagcaactcaaacaggaacatataagaaaaaggagagaagaatatataagtaccttaccaagggcttttaatactctcttgccagatctagaagagattgaacatttgaattggttggaagctttgaagttaatggaaaagagagcagatttccagttatgttttgtggtgctagaaaaaacaccttgggatgaaactgaccatatagacaaaattaatgatagacggatcccattcgaccttctgagcactttagaagcagaaaaagtctatcaaaaccatgtacaacatctgatatcagagaaaagaagaatagaaatgaaggagaaattcaagaagactttagaaaaaattcagttcatttcacctgggcagccatgggaggaagttatgtgttttgtcatggaggatgaagcattcaaatacatcactgaggctgatagcaaagaagtatatggtaggcatcagcgagagatagtagaaaaagccaaagaagagtttcaggaaatgctttttgagcattctgaacttttttatgatttagatcttaatgcaacaccaagttctgataaaatgagtgaaattcataccgttctaagtgaagaacctagatataaagctttacagaaacttgcacctgatagagaatctcttctacttaagcatataggatttgtttatcatcccactaaa

SEQ ID NO: 21108 - DNA, 2395 bp, Mus musculus
tcttttcattttagggaaagatggccttgcccaggaactagcaaatgagataaggactcaatccactgatgatgagtatgccttagatggaaaaatttatgaacttgatcttcggcctgttgatgccaaatcgccttacattttgagtcagctatggactgcagcctttaaaccacatgggtgcttctgtgtattcaattccatcgagtcactgagttttattggagaatttattggaaaaataagaaccgaagcatctcagatcagaaaagataaatatatgactaatcttccatttacattaattcttgctaatcagagggattccattagtaaaaatctaccaattctcaggcaccagggtcagcagttggccaacaaattgcagtgtccttttgtagacgtacctactggtacatatcctcgtaaatttaatgaatcacaaataaagcaagctctaagaggagtattggaatcagttaaacacaatttagatgtggtgagcccagttcctatcaataaggatgtgtcagaagctgacttgagaattgtcatgtgtgccatgtgtggcgatccatttagtgtggatctcattctttcacctttccttgactctcattcttgcagtgctgctcaagctggacagaataattctttaatgcttgacaaaattattggtgaaaaaaggaggcgaatacagatcacaatattgtcataccactcctcaattggagtaagaaaagatgaactggttcatgggtatatattagtttattctgcaaaaaggaaagcatcaatgggaatgcttcgtgcatttctatcagaagttcaagatactattcctgtacaactggtggcagttactgacagtcaagctgatttctttgaaaatgaggctatcaaggagttaatgactgaaggagaacacattgcaactgagataaccgctaaatttacagcattatattctttatctcagtatcataggcaaactgaggttttcactttgtttttcagtgatgttctagagaaaaaaaatatgatagaaaattcctatttgtctgataatacaagggaatccactcatcagagtgaagatgtttttctaccgtctccaagagactgttttccctataacaactaccctgattcagatgatgacacagaagcaccacctccatatagtccaattggagatgatgtacagttgcttccaacacctagtgaccgttccagatacaggttagatttggaaggaaatgagtatcctgttcatagcactccaaattgtcacgatcatgaacgtaaccataaagtgcctccacctattaaacctaaaccagttgtacctaaaacaaatgtgaaaaaactggatccaaaccttttaaaaacaattgaagctggtattggtaaaaatccaagaaaacagacttcccgggtgcctttggcacatcctgaagatatggattcttcagataactatgtggaaccccttgacacaattttcaagcagaagggctattctgatgagatttatgttgtcccagatgatagtcagaatcgaattattaaaattcgaaactcatttgtaaataacactcaaggagatgaagaaaatgggttttctgatagaacctcaaaaggtcatggagagcgtaggccttcaaaatataaatataaatctaaaactttgtttagtaaagccaagtcatactacagaagaacacactcagatgcaagcgatgatgaggctttcactacttccaaaacaaaaagaaaaggaagacatcgtggaagtgaagaagatccactactgtctcctgttgaaacttggaaaggtggtattgataatcctgcaatcacatctgaccaggaggtagatgataagaagataaagaagaaaacccacaaagtaaaggaagataaaaaggtaagtttatatttacatttataaaagttctcacttttgccttaaaaggaaaaaaatatatttaaaataatgagttttgatattaataacaaaaaatcactaagtaaatttggtatctctttaatttttaaaattctaaaatatttggtagggatagatttgtttttgttgttttagtgcattttatttcttgatgctttacttggaatagaaggctgaatttatattcttcagcatgaaaattatgaatggaggtttattttgtcctttacattttcaataactttatctaatggtatcagatttgtattaaagttgtattaatgctttctacatcttttttcacagtagtatttaggaacttatattactgtttgacttgattacacataagccttcatcaaggattttatggttattcagataatattcagtatatatttattccagtgtattgaatgttac

SEQ ID NO: 21109 - DNA, 3566 bp, Mus musculus
gagctaactttcttgaaagttaaaaatattcttggctggatagattatcctaggttttccaaagttggtttaaaagagatggcataccctgatttatttcttaatttcccacagtaggttagaaacttatatgcacataatgtttgtcacttggccttcttaacctagaggaaaaggtttgtttgttttgttttgtttttccttcaaattgaaaagacctctatttgtaaagctttaacacttggcatgcaagtaaatgttacttgaaatatgtattgattgctctcttgttttagaatatagttgaatatagaatgctaagaaaaaaattaaattggaagataaaattagcatgaatggaaaactagctttgagaatctgtaattgcaatgatttctgatttctttttttttttttctcccgttttataatttcagggttagtcagcaaaataaaatcaacctaatgacagcagacaacttatccatctgtttttggccaactttgatgagacctgattttgaaaatcgagagtttctgtctaccactaaaatccatcaatctgtcgttgaaacatttattcaacagtgccagtttttcttttacaatggagaaattgtagaaactgcgaacactgtggctcctccacctacttcaaatccaggacaattggtagaatcaatggtaccacttcagttgccaccaccattgcaacctcagctaattcaaccacaattgcagacagatcctcttggtattatataaatagaatgtgattgcagatggcctgaaattggacaaaaacaaatctagacatgcatgtttcaggggttagtagtatatttcatgtttcatacagataatccacatcaaaataatgagacattttctctttgaactatatggtattccctattcagttacattatgaatctaaaaacatgtggtaagcatgactggagaggtttaatttttataaacaaaaaaaaatagttataaaaatgcaaagctgctgctgcatgcaaccttattgcaatcagtatatcattcccgtggcaatttctgtcacagtatattgtgaatacagtttttctatagaaattaaatgatttaaaaactcatatatgaaatgtttaatgctttcagcctgctttatggctggttttgttatttgattgctaatttggggacctaattccagcagtctgtatagataactaaagcccagttaagtattttttaatttccagttactatgccatgcttgggatgtttgaaagaaagaaaggaaaatacatgtaacatatttcacatttctgcaccttcatcttctaagtaaatttgtggatgatttgatgaggagagagtgaacctgtttcttttactcacgtaccaaggacacacttgtggttaaagtgagttgataatgtgatgtaaagaatagttgtcaccaactcatttctttattatctataatgaaagatacattttgtatacacagttaattctgtaaacagatgcatgttcaaaagatctatgatggtcttgtaatcttaatctaatatattttagatattttaatttttccctcttggggaatacacttagtatagtgtagaaaaatacttcatgacattttcatataaggttatataacttttcatacataaacatgaagtttgttgtagaaagttctttaaaccaaacatttaatctaggatttcaatttaatctgttccttgaatctatttttatgtggcccttgagaatatatcccaaaaaattccattgctaatacagcaataaaaatactttgggtactgacagactccttggagtatgtatatataaaataacaaacttgtattcatattctttcagtgatgtgttgttctacaatccagaatggcttttgcaccattttttaaaccagttttcccccctttgccgttggtaccagagttgctataaatgactgctgctttaagggttaaatattttgttagtgaagatacaaccagaacactaaattatgataaaactttctgactgagtgataggtaaatttagttgggctatattcaaaattattttattatcaaacccataccatttgttttactggaaaaggaaaagtggtttgctttttactgctggatcatattttgtgtagtaaagaaattctttggtcaatgttgtaatctttatatttcaattttaaggtttccttatctgtattatagtaaattcatgattttgagattcaaggctcctaagagtttgatttgctccattttgtcttaaaatattctttctcaattgttatatcttaggtattgtacttccaatttcaacaaagatgtcaacatgaaccaggctactgtttaagtacatgtatattataaattatcttgtgttattatcttttctaagagaacaaagtccctattattcctattgcaaagcacacaggaatttaagaaagtacagtaatttttaaaaaaaaaaatatccggtaaatgtagtattcttacttgttctatattacttatacctattgtctatatagctttaatttatagctgtcagtttaacattggcatgtctggcaaagaaaattaaactttaagagttttataaactgtttctaggttgctaaagaatttatttttctacgataaatggtatagacaaagcatcaactatgtacaggataaaagcctgactatttctattgaaagtaggcttacaagagaattttcagaactgttcatatctttggttcattctgtcctaactttacaattgtaatatgtgagtcccagtttatttaagctattatcttttataatgtgttaatttaacattcatttacatttaaaactatttttgttattaaaattagcatttataagtttccacattaaccaccttacacctcttccaaaactgatattacttttctatgcattctatcattgatttgacacactacatagtgaatcacttaaatattctacatctggttcattttactactaggttacagatattgaaaattaaagtatggtttaaagctcagtctgttacactgacttgtgtttgtttttggccaagggtataggtatgtttttaaacattagaacagtaaatctaagaagtgaataacataattaaatcatttgttgcttgtaagttattgcactgtttagggacacacacgtacacacatgtgtatatagatttaatgggtttaaagaatagtagatagtcttaaaataatgggtcaacatttgacattcacaatatttaaaaagtccatctatacacattgccgttgtttcacttacaattcagtgctttttattccaaaatcagtctcgacagtgtttagataatataaagaagaatagaggggtctctgtttcaggcttttagtagatatttttaggagtcaaattctatttgttatgtacttgccaaggaatacatatatcttaacaaaattccaggtgcaatttatgtgtttaaagtgatatttttagtagtacttccctcccctcccc

SEQ ID NO: 21110 - DNA, 1230 bp, Mus musculus
aagtgtgggatgtggatatttcaagcaggatgttgccacaacaatggctgagttctaaagaagagatggggtctaaagctgtggtgtggaggactgtctctgtgcatcactgagagttagcacatcttgctgagtgccatctgccctgggaccatcttcctgtcttcgtcctatggatgatgccatgctgtagaatccaagggaagtcatttcgttttttcatggcttcaccaccagcaaaacaaagatgacaggcttgccctttttagccactcacatttgaagatgcaatcggaccacgtttgtgagaattccacaatctatataaactgcatcattcaaagaatttcttcaatttttaacaccatgaattttctaataagttttttttttggtcttggcctattatatatttgcacacaagactgcaaatccccctcccctttctatctgagaaataatatattataattcttctctggcctcattagacaataaaataagacacatcaaagaagaatcattgagtctatggccataccaccctgaatgcacctaatcttgtctgatcttggaagctaagtagggtcgggcctggttagtacttggatgggagaccacttgggaataccaggtgctgtaggcttaaaaaaaaaaatcattgaaaaagtaaatattgcatacacattcaattcctttcttgcagaatctacaaggtaaggtataagtattttctctcctcttaggaagggaagaggggacatggtgatattatccagtgctaggaacttcacagaccctaaaaacaaatagtcagcttagcacttctttgggtcttcattctctgcccaagaataatgttaatactccataaagctgctatgactttggatgaactaacgtgtaagatctaaggcctgctatgtaataagcactatccaagtgtttgtgcaaacttgatccaaatgttgcgtgccagcttgcgtgcctgtgcgctcctgttctcacctatttatatgttcctagtgacagtttatatacttgtatacatgacttctcttccaaaagtagaacactgcattatcagtagaaagacaaaagacattgcctgttaataacgtccattgaacgcactggataaacctattgtgaggcattgtgggctctctactcctctctagggtgatttcctggtttgggtgaagttgtagaatcatgtcaagagaatgt

SEQ ID NO: 21111 - DNA, 1201 bp, Mus musculus
tattgatataaaccacaattttaggaaataagccgtggagacctgctctccattccaggattacattttacttgtctgcctcggaatggaagtggacagaagaaatccaaccagtagttactacacttaggacagacaccacaagttgggagaagccagcttgcagcacatggggtctctggtagttaaggatggttttctgtgcaggtatgtactttaaaggattattagcagatttgttagattgaagcatgagtataaatatacaaacaagtgagcctgatgtaggagaatcaaatgtattccagtggctctctagagctgtgttttccccttcccatctgatgatcaactggaaatggtttaacaataaccttgttgctgtaatgtccacattaaaatgaatcaagtattcattttagaccttaaagtttttattcttttctgtgtatgggcattttgccttgtatgtacatctgtgaaccatgtggatgcggtgcctgtgaaggtcagcagaggattttagatcccctggaattagacagttgtgagccatagcgagtactgggaattgaacccgtgtcccctggatgggcagcctgtgctcttcactgctgagccatctcctcagccctcactctgaacttttaagaggacttgctttctgccacagctatccacgtggtcctcagaatgtggttttccttgcagccaggggcttattctgtggaaacatgctatgttggctctgtcctgaacagaatttagaagcgtgggaataatcccctttgcaagtgggcatttaaatggcacaacacggtaatagagttcctaagagatatgaaaatattaaagaggagcttcttgcctgggagggattattcagatcttaccctttatgtgactgtgttttggagtcagaccacaagagcagtctacagtggtgtctaactgcacctcaggtgggggtttcacaatatgaatggcttctctcttccctatgaatggaaactacggatctcattccagtttgaatattaggtctagttcacactggagagacagaggggaaagtccagcccttatatgtgatttactaggccagatggctcccagtgctagtgctgttggggtaacggatgaggggtcatcaccacagtgcagatagaggtgtgtgcctgctcccagtactgtttataaa

SEQ ID NO: 21112 - DNA, 1217 bp, Mus musculus
attttgacgttgagctcagtagcaggtgtcattgaaaataattctctttatatttatttatttattcaggttgtcaggcttgttcgcaagctacttgacacactgaaccagcttgctagtcctattttcttcttcctgagtccccttcctgtctctctctgtctctgcctttctctctctcagtgactttctgaggcaaggtctctctgtatagctctggctgtcctggaactcaccctgtgtagaccatactgatctcaaactctgcctcccgagtgctggattaaaggcgtgcaccaccattgctcggcaagtataatatttctaaataatattttgcgataatcattttagaaatgatctttatctacaagagggatattagaatggaagacacggttttctgcttctgaggtctaatagctgctgattttggtacaaggctccctcggattctaatactaggtaggtaaatgggatggagagggggaaaggaaataaaggtgagcatgtactaaaataacttctggaagacataactcgctcttttaatacacgttctgagatggcttcatattaaatgggattttgtaacaagatgaatggataaaccccaagaactcaagaacctgccgatgcagagtgaatttaccgtgggaggctccatacatatcatcaaatctttaaagagttctacaatgtccaaaggaaataaaaccactgtggaagatcatatgatctcatttatgtcatgggatagctattactaggaactctcagaaactcttagaacaagagagatttgtactttaagagacacttacgtgtgtgtttagggaaggcaaggctttctttagctaaatttcacaccccaatttgctgcttttgctactatacattttaagactagaagtttgtaaaatggaagttatcagcaggcgccataaaccagagagtggttctcaacctgggggtcaggaccacttttggggttgacccactctttcacagttgcatatcagtaatcctgcatgtcagatgtttacattatggttcataacagtagcaaaattatagttacgaagtaacaatgagataattctataattttctagaaaagtctctgtgctaaagggtcccagcatcaggaaggttgagagccactgcagtaagccagtgaattactctcgttcggagtctttataccttaaggagcc

SEQ ID NO: 21113 - DNA, 1444 bp, Mus musculus
tgaactcatttgctaactccagaaatacctgcagacgacatcctagctggccagcggtttaaagatagatttgggaattcggctgttgagcccaggactgcttcttattcgcactttatgtatgcgtcctgatttgaagggaggaggttcgcaaagaaataaagttggtgacagatgccacgaaggggtaccctccaaaccctcacagcaagaaagagaaatatctgaacgatttccagatgttgttaaccagagtctagacagtgacgacgacctaatgacattatcacctctagaaagggctgctgcttagcaatcgatttatagatatcccacggtggatgctccattttcctggtttacgacccgtactttctgaaggtcattgctaagtcaatggctctcttgtggaagatgatcccagcatttattatgcactatgtttacttcttacttggggaacctaattatccagagaataaaattcgccaggtagtttgggttgtttttctggtattgaaatttgaagttaaatcagaggatagaaagcttcctggtaattcagcactggattctgctaactctatgggaagagcaaagcccaacttacatgattcgtccgagcatccccatcccgagcagttcagttcggggagggagatggggttggaagtgcagacagggtcctttcatccgtgtgtgttccctttaacggttcatcgtccataacaaagaacagtgtgctgtactcttaaaagagatggaaataaaaagacctcagagctattggagttcttccacatcatctgctctgccagcctcacttgagtcgtcttgatccttgactgcaactggctggtaggacggccagagttgtgggatttcccagaaccgtgggagggtctcctgctgcagggggcaggtgtcgcttcctcccgaactctgtacgaaacacctattttacgaaagttagccaccctcgtttctgctgctacttccccaactttcaaacctctttaatttcctagctagaatcccacaagcagcatagacctgaaagtgttttatttcgtcatgttcagacagatagacagacagactttccaagacagaagttgatacttttcctctaattgttttggaaagtgtccaggaagaactgtcatcccacccccacccccaacaccccacccccgcccccaacacccccacccgtgccccgtcccgtggctcagttttgttttatttagtatttcccaccttctaacttgcaatgtcatgtccttatttattttgtttattgtctctttagcctgtgatgcctagagtgttaagtacaacgaagacagggattttgtacatttttgacccatgcaatattcccagcgcctaacctaatgcctggcatatagcaagaaagggcttagtaaatacatgctcaata

SEQ ID NO: 21114 - DNA, 1587 bp, Mus musculus
caaatagactaggaaaaataagtttccttaaccatcacgcagattcgatgctggtttccgtggtggggatggccctgtacactggctacgtcttcatgccccagcacatcatggctattctgcattactttgaaattgtacagtgacgaagatgtgaccaggatccagaggttcctggggaagatctgccttgtgaagttggaatgagacctcatcagatgtaagatgtgctacggatgtccacgtgaccaaccttataaatacaaagactttaaaaaaaacttcatgagtagaacaggaaaaatcatcctggctcatgtgttgtgttctttctttttgattttaacagaggctcttatatagtagcttttatctattttaacattgtagtcatttgtactttgatatcagtattttcttaacctttgtgactgtttcaatattatccagtgaaagcttttcttaatgtaactttgagtacatctcaattgccttctatttttaaaacctaaggtcattagttgggctttactgttcttgctatcatatggcatatacatctgcctggatatatttctactcttgaccaaagttttgtaagaaacaatacagaatttggggacgggagggaggatactttgagaactacttacaaaagatttatctgcttgcttgaactcaggagtacggttttagctccctagactcttaacagcttttgctctaaaactattaaagtgtttcttagtaatgaaaaagtaaagatcttgctaacattaatacaaggaacatttcaccttttagatattaaattcttatgtggacttatttccaaccaactttgatgattcctgtgattggtgattggtggccggcttgtatgacatatgctgagatacactgtggagcttttcatagaaggcttatcagatcctctgaggcagtattgaccctgtatacgctcaagagttaatttgatgttgtaacaggcgttgtgaaatgcatttgcacgttgtgataaagacacaatgagatgaattgtgcagaaccataaccaaaagaaatgtaaacttgcttaaaaatcctttcactctttgtattttttttaaaacggtttttattccttagatgtaaaatgactacttttttttttgatgtaaactcattaaattcaaagaaaaatgtagcagtctcttttatggttaaatattgatcaagtagttattttgtggttggttcctggggcttgggtatacagtaatcattttagcatgtttctgaacataaaaattatagtaattagaaaaggtactgtagattttaagatgtcttctagcataagttcttttttgtttgtttgtttttgttttcattttattgaatgtataagagctctgctgcacatacatctgtgggccagaagagggcgccagatccccttacagatggttgtgagccaccatgtggctgctgggaattgaactccggacctctagaagagcagccagtgctcttaacctctgagccagctctccagctccttctggcataagttttgcttttttttttttttttttcttctggttt

SEQ ID NO: 21115 - DNA, 1587 bp, Mus musculus; identical to SEQ ID NO: 21114

SEQ ID NO: 21116 - DNA, 1172 bp, Mus musculus
cggcggagtgctaagaagatgaggtctaatcctgaagatcccgcagagagagaagcggaggaaatctatcaccctgtcatgtgcacagagtgttcaactgaagtggcagtctatgacaaggatgaagtctttcactttttcaatgttttagcgagccattcttgatcaatgtgacaggtaactgcccagctctgtgtataaggcaaacatagactcttgttttcctctttcctattcatatcattcagtgatgttgttattaaaacagtatttcatctttatgaaaaggagtggttatcaacctctatctcttctccctttttgccttttaattttcccatgaggacagattattcattccacttctagtgcatatttgtagacattggagcttcttatttattaagttagctttctagactaaaacagttttggaataagtatttgtttcctagtgtttggtccattttctgttgctgtaacaaattactacagcctgcagtgttttataaagaaatgaggcttagctgttggcaagatgactctgcacttggcatgcaagcctgataacctgagttcaatccctggaatctgcagtggaaggagagaatcaactcttgaaagttttcctatttcttaacataggtgcacgcagacagacagacagacagacagacagacagacacacacacacacacacacacacacacactcactccaaagtttccctgaaggggcctctagtatgccctgaggggaactatttctctctctgattaccttctgggccttctccaagctacaagtcaggagagctgggccagtgagagtttgaatggagttgagacaacaggaaatgaatggttccttttgtcttctgtggatggggaggagcagtgatggagtgcgtgcttgacatgtgcaggttcctggactggatagccaacactacaccagcacacaagtgagcttctaagacattctcagtgcttagggcatggtggcctataattcaagcacttgggaaagacaagaagggaaggaacgggggaaagaagttggtgtcagtgtgttggtggctagcatatttgataatttttataatatggtggtatctatatggaggcaatatgtacttgacatttttagtttcaaattagcacatgggagt

SEQ ID NO: 21117 - DNA, 1277 bp, Mus musculus
tctcatggtttttattaggtttattggctgtgtgcaagtaaataatgtataatagacctactcagaaaaacaccacggaaaaacgatttttcttttactagttaaacttaacaagggtggatctcttagaatcctgtcctccgctagcagaaactgaattgagctaaaaaaaactttttctttgcccagagcctgggcagaagcttaggttttgaattccagattcgattgcccactaccaacaaaccccgcccccgcctcacagccttagtgggcggagtcgcgttgaggggcctacagacgagttcccgcggcgtcaccacaaaggcgtggaatatgtagatgagaatttcacgcaaaggctaccggttctccctaaatagacatttttttccgttattgataatatttacataatataagcgtatatttatggatcaaggttagaaaagagaatataatgtagagaagacgcattgaggaagagaccgtagttataaagtaagtatacaatgatggagagcctgcacacggcactcgcaactcatacttacctggcaggggagataccatgatcacgaaggtggttttcccagggcgaggctcatccattgcactccggatgtgctgacccctgcgatttccccaaatgcgggaaactcgactgcataatttgtggtagtgggggactgcgttcgcgctctcccctggcatttttgttgaaaaaatagaaaacatttactttagcattgcgaaagacttgctttctacctggtgttttagttttttttttttttttttttttaaagatttatttatttattatatataagtacactgtagctgtcttcagacactccagaagagggcatcagatctcattacgggtggttgtgagcctggttgctgggatttgaacttcggaccttcggaagagcagtcgggtgctcttacccactgagccatctcaccagccctaggtttatttttgaatgatgtgtaaggtaattgtcagttgaaataagttttactatctcagttagcaccaacaacttgttttcttttttttctggtgttttcaagacagggtttctctgtcctcgaactcactttgtaaaaaggtcagatactaactgtttaggtgaagcaaacccaaaaggtgttgtatttgctaagctttatgtaaacatgacactaacttcatgaaaactttgagaagattcatattgggaagttggacatcttaatctgtacaggatggaaaggctcattgtggg

SEQ ID NO: 21118 - DNA, 1229 bp, Mus musculus
tcagtagtgatgatgggaaggcccagcccagcgtggggcagtgctacccctgggctggtaagaaaccttggcatgcacaaatccccaagtgtgtggtccccagtatggacgatggcatctacgcaggatcagaaagttaagggtcatctcaggttgcatagtgcgatcaaaagtttagggtcatctcaggctccaggctacacagtgcgctcgaagtcaccttgcccgggtctcgatatcttgcctgctttaaaaaaaaaaaaaaaaaaaaaaaaaaagcaagagagcgagcgcgaaatctagagcgagagctagagcaagagcaagagcaagcggcgcgtgggcggggcgtatgcagatgagaggcgcgcaggggctgccggtcgtgcggagcccgaagggccgtgtctcaggtggagtgtgttgcgtgacacacgtgtgattttcgtgagagaggagcatcgtgacagaggtgtggagggcttgagggcgtgagggcgtggcggtgacgcggaggaggcgaccgtgcgtttgaaaggagtgcgtgttgagggagggcctgttgcgggtgtcaggaactcatacttacctggcaggggagataccgtgatcacgaaggtggttttcccagggcgaggcttatccattgcactccggatgtgctgacccctgcgatttccccaaatgcgggaaactcgactgcataatttgtggtagtgggggactgcgttcgcgctctcccctgtctttgttggtgcaaaagcagagcataccagtttttctcctcaagactcttcttcctcatggttgcagtaccctctgagctactgcaggtcttcttatgggaagtaagatctctgctagtggagagtttctgctgcccattcttgcactcacggactgtcgcgtggaagcgtaaaccagttaaaactttcctccccaagttgtttctattgtctgtggtgtttacaacggagatcctaaattaatatactgtattggggaccaccgccagtactacagaaagcgaggccgacgggggccagaaaaagacgataggttcgtggatgccccaggaattggagctatagaccgctacagccaccgtgtaggtgttgggaatcaaaccccggtttctgcaaagagcagccagtgcttttaacaactgagtcgcttcttcagtacccctcctctaccttcatgtcttactcgtttggtctgcatgggtt

SEQ ID NO: 21119 - DNA, 1194 bp, Mus musculus
ccagggcaaccttcagctccttcagaactgccttgcggttttaaatggagacacataggcttcactctgccttctgtcaaaaagggctgccttcaaatccagtttgttttcctgacgacctccctccggcatctaagctcactgggaacaacagagacagcgggcacagtgcatcagctcttcttctgagagacagtggagcagcagggctcaccggctgcagggcagcggcctgccacctcgcactccaccttccaagaagcccaaagttctaccctctcttttctttgagaagcctgtcttactgtgtttatttcctatgtggcggttctgtggctgcaggccttatttacctaagaatcgcttgtcctgttttaacattctcaaagtactctctgttcacacaagataaaggttgcctttctgaatattttttaagcatcctgttcccttagttctttcatgtatctgtgtaaagcgtcttaacgagacttactttgaattaatgaacgtagaagtttcgggtcagactttatgtaagctttataagtatgatctctgaagaaaagcagatgcgttagtatgtttgccttaaacttgtggactaaaccaatattgtaaacgcccagagacagcagtggcgttttgactccatgctccttgtatggctctggaattcagggtagcgataataaatctactccggcattatgctttacagtgaaggtcttttctttatcttttttttttctttctttcctccctcccccaccccccggccccctttgtttgaaatggccaaaccaggttcactgaatgctttacctcacgtagagtgaccttctgggtgcactgattcaaaatgcaggagtatcatggttccctagatccccgtctacaattccctggattccctgcctatctcagcagataaccgggagacattcgtcagccgagccatttggtggctaccatggctgtctagtgagtggtgtagaggaaaagctatctgctaggaggagggagggggtggtccccaggacgaaaggtggggtgcagacagatgaagagtccctgggtctgtgtcacccacgcctggtctttctgactggcccagactgcttcctgtgcccccagtgtaaactggacttggatgatggacttctcatatatttcttactcctctcctatttg

SEQ ID NO: 21120 - DNA, 1199 bp, Mus musculus
attaagctctgcactggtatttggaattttttttcctttaatctttggtttaaaaacatcttaaaatcacttatatacaatcattaaaagagtggtaattttataaatgcttatttatgttataaaatggagatcagaaaaaaattctttttgcactttggcctatccagtatcttatttattctctagataagctaggatattaatccagagttacattactgagaattgagtagtataagtaggatgtttttattacttggtcataatgaaaataatttgtaaaatgtcattcgaaggttaatgatgattgtgatgtttaggaatgtttgtctcagccacagttccttcatagcttttccaaaatgaattgggaaaaaaaaatcgtatagcagtcttaaagcttagtaatggaacttggctgtggcccagagctttctccttatagagaatttgatctgctccgtgtgcgctctctgctattagccggagctatttatggcaaacacatgcttttgtatcttgtcatagtcatccacagatggcaaaactggacttgattctactggcatgtaagacaggcgtgctagtgagcagtcgtgtgtggctctggactctgaccccagagctctgaagaatgctcttatcagaagataggaaatgaaaatatccttttttaaaatatgtggaagtaatttgggtataattagtttttttctaccttttggaaagttgtttttttgttgtttttttttttttcccagatgagaacattaacatagtggttaaatgtctaggcttccatttaaaactacacaaatgacttgggatctttttagcactaaggaatttgatttcagccttccagctgttgctgtgagttgttccagacctttctgtggctttttggtaaggctgcttagaagcatgagaagcatgagaatggtaatgtgtgctaaacctatgtttaaccaatctttgcaccaaaggactttttcaccaatttattttgttattcttccaaatattaagtgatttctaaaaggtaaagggtgaccttttgtttttatatctaatttctcaatttctttatatgcatttttagaataatttgagagattaaatgctgcttgaaactattatactttgagttttagattggccaaatacattaatgtagttaaattcatctttaaagt

SEQ ID NO: 21121 - DNA, 2300 bp, Mus musculus
cacaagtgaagcaaaagctggaactcggcttcaagcattttttcatattcaagctcaaaagcttggactccacgtctcacccagtactgtggaccaggttagcacgccactagctgcaaagaagtcacggatctaattttgtccttctaaaggcaatacgtgaagaaaaagataaatcgttcatgaaatggaacattaaatcatgctctaaagcagatacgtgtataaagcaataacagctggttgaccacatgcaagtgtggcctgcactatattctcaatttactattaagcactcaggagaatgtaggaaagatttcctttgctacagtttttgttcagtatctactaagttttatagctgtattgggtacagtcctggtttacagaggcttttgtgcattttgaggtcattcatgtgttcaggtatcctgaaaaatatttttcaactatgatttattttgtcattgagctttaggagtttcagtcataaggaggctttgtctccacagtagctcttgtagatcacagcttagagaatgtgtctaaagactgtttcatgagcacatggtttcaacactacacatgaatgaatccaattctctagctctgacgtgctgtagccagtgcctgccgactgaatttattaactagatatttatttagcattcaaagtcatttgtgaatttgttttgtatttataaaatttatacttggaagaatgttctttaattttttaaacattttactatgtttctgttttatttcttgaccagtcttaatgatttaaaaataaaaatgccaccctctctaacagttctgttttacaaacgataagtttctgtgtacaacttttctaagtgtgcaaataaaatgatacattttttcaagttttctgaattctgaagtttttgcaaattaaaatcatgcttttgtctgtttatacatacagatcataaaagccatacagtgtttcattgtctgggtagaagatgcctccagttggtggcagtgatattcttgcacagattcacactaggagagaagcatgttgaatcctgagattgcagacatatatcactgtgcctgattccaaatacatggttgatttcaatggtctttgtggtacaggcctgtaatcttagcattcaataagcctgaggcaagaggatcacaagttcagggccagcctgcctgggctacacagtgagaagctgccgatggtagtttgaatgtaaatggtgcccatgggctctggattggaacactaggaccaagtggcttctgtatggaaaggcttaagaaatgtgacctcagctggacgatggtggcgcacgcctttaatcccagcattccagaggcagaggcaggcagatagatatctgggtttgaggcaagcatcgtctacagtcaattctggacattgagggatacacagagaaaccctttctcaaaaaaaaaaaaaaaaaaaaggaggaggaggaagaaaggaaagaaaatgtggccttggtagaagaagtgaatgaatggaaacagttggaggaatggatgtcttgggacaattttgcagattatgtgttgcttaaaatgtaatgtaactgacacagagcccagaaagctattgtgtttttggaaaagtctctgctgaactgaacttgctaacatgcttcctgttgtggtctggccagtggtaaatgtactgcagtgatgttaaagggctctgtagaactttatacctctctggatgtttatacgcatgcagtttagttttcagatgtggtatgaactgagtgcttctgacagcaaaaggcagaggtactagtgtccaatttttaaaaaaacgttttttttttctttttttatgtgtaagaattttatacttaaagtatctgtagcttttggggtgaaaaaaaacttttctttgccttactcccagtttgctccccctgcttcaaatgctctcagtttcctatgcctgctaccaaagtcatgattgatcccaaataacttcttatataaattgctttggtcatggtgttaaatcacagcaagcattgactttttcattgactactattgcaacaaatgccggatggaaagaagtcaaagtcgatagtctttgtacctaataactgtgaaatgccttttgtattaaataaaccagttctgcaagatttcttggttcatctctccatttttcagaagaggttaaaactcacatcattttttttttaattcagtcaggtaggtaccttcaggaagatgtgaatacagttttatttttgtggagagcataaaag

SEQ ID NO: 21122 - DNA, 1133 bp, Mus musculus
gctggatatgatggcagaggcctttcagagctaaaggcaggtgcatctctgtgtgctccagggcatccgagtctactactactactactataatgggaccctgtctcaaacaatagcaacaaaaacaaagaaataaaataaataaaagagcaataacaatacattttatttcaacgtagggaaagtgggacaaactgcagttaagcaatgtataaagcaagaagagatgaactactgtataaagcaggagcctctgagtgccgacgcagaggaagctttgaggcaggagcagcagcagaaagagaaagaactcctagacaagattcagagtgccatcgcctgtactaacatcttccctctggggcgcgaccgcctgtacaggcgctactggatctttccttccattcctggtctgttcatagaagaggattattcaggtcttactgaagacatgttgctgcctaggccttcatcatttcacaataacgcacagcctcgcgatcctcaggtatctattaaaactgaagagtccttcctgtctgaatctacctccagcctcgaccaaggtccgttcgatgactctgtgctgctgccaaaaccggtgcataagccaaatcggtggtgcttttacagttcttgtgcacagctggaccagctcattgacgctctcaactccagaggacaccgagaaagcgccttgaaagagaccttgctacaggagaagagcagaatatgcgcacagcttgcccacttctctgaagagaaattccatttttcaggtaaatggttttttttttttttttttgagccactgtctgtccctggctgtcctggaattgactgtagaacaggctgatcttgaactcacagagatctgtctgcctctgcctcctaagtgtggggattaaagagatgtgccacaattcctggattaaacctatttcaagctgaacacatatgttaaaatagttagctttcatcctgacctgttcttagtttgcaaattagacagtcatcatatatttctttatacagacgagggtctcaaaatgcctttgtgttgtttgtgtgagcggtcttctcattccttcacaatggactactacttgtgttattcagctttgcattattgt

SEQ ID NO: 21123 - DNA, 1109 bp, Mus musculus
ccaagagcaggttctcactgagcacgcgcagccagacacgcgcgctgcgaccccgccctcctcagatcgtccaatcccgagagccgaaacgccaaaccccgcccctccgggaccccgcctcccgcggcttcagaagccctaggccgcgcgcccttgcggagttctgcactctttcacgtagtcgctttcccctaagtcctgacttttcctcgaggtcgcacccgaggaggtcctgtctcgctgctagcttgccgcggcagtgacgtacagggagaacactaaggtcaaaggtcagctccagcaaagaaacaccccttctatcctttcgggggagccgtagacgcggggctttgtgccccggaagcggaagtgtgttttcacgaagggctgaactccgccgagtgatgacgtctcctcattgggcggaaggttcggtggcagtcgtcggtgttccagctggtgggagttggcttcactgtgttgggcgctgggcccctagtttctggagctgggaagttgggcgacgggctccgtccctgtccttcagcttccagcgttcctgggtttccttcggcggcgtggggcctcgctaagggctcgccggccctgtggggccacggctttagtggcgccttttgcggtgagtgtggggggttttcctcgctccgccctgggaacccctagttagagcgccgcttctgcggaagtcttcccgggtggccacgggcagtgatcgccgaggctgaggtgcactgacacttttattttactcttgccctccactgcaagctttaccaaacgctgcgctgctacccttttaatttgtcttcagatttacccgagccaaataagtaagcattggtaggcttggctcatggaaggcattcccgaacaagaatttagataaagctatttccccaaagccttttgacatatactagggtttattttcctatcttttagtgtttactaacatgttggttagcatattgttcagaacttttagttccgcgacagtgataagatgtgctaaggactttaataagtcgaagctagtgacaatgtattttttgttgttgaaactttcttaatcagcttttcggttacca

SEQ ID NO: 21124 - DNA, 1161 bp, Mus musculus
cagatacagcttaacggggacaatacctagcatatataaaacaataaatatagctgggcgtggtggcgcatgcctttaatcccagcactcgggaggcagaggcaggtggatttctgagttcgaggccagcctggtcttcaaagtgagttccaggacagccaggactacacagagaaaccctgtctcgaaaaacctaaataaataaataaataaataaataaataaataaatacttgctgaatgagcatgttaatcctttggagcacataaattaagactaaatccgccttttgtgactggcggtgaacgagcacgcagtgccatgaaggcttcgggcacacttcgggagtacaaggtggtggggcgctgcttgccaaccccaaaatgccatacaccaccactgtaccgtatgcgaatctttgcgcccaaccatgtggtggccaagtcccgcttcttgtactttgtgtcacagctgaagaagatgaagaagtcatcaggggagattgtgtactgcggacaggtgtttgagaagtcacccctgcgcgtgaagaactttggcatctggctgcgctatgactcccgcagtggcacacacaacatgtaccgggagtaccgggacctgaccactgctggtgcagtcacacagtgctaccgagacatgggtgcccgacaccgtgcccgtgcccactccatccagatcatgaaggtggaagagattgcagctggcaagtagcgcccgccagctgtcaagcagttccactactccaagatcaaattcccactgcctcaccgcgtgttgctgcgccagcacaagccacgcttcaccaccaagaggcccaacaccttcttctagacacagagacccactgaataaaaacttgagactgtcaaaaaaaaaaaaaaaaaaagaaagaaagaaagaaagaaagaaagaaagaaaagaataaatcccttggatctagtgctcagtggctaagagcacttgctcaggctggagagatggctccgcggttaagagcactgactgctcttccgaaggtcctgagttcacatcccagaaaccacatggtggctcacaaccatctgtaatgtgatctgatgccctcttctggtgtgtctgaagacagctacagtgtgttcacatataataaataaataaat

SEQ ID NO: 21125 - DNA, 1167 bp, Mus musculus
ggtttttacaatttatttaattttctcacccctcagtttattcaaatttaagttatgttaacgtttttaaagcattgacactcaaactaaattgaacatattttatgtaacttagcttcatattaattcagttgaaatgctttcaaccttagctacaattaaattctgggtctggtatcaaaaaacactttgatatacatgaaattgactgggagttcctacagtataatcttcagtaagagtcctggatatatagactttcaaaagattggttataaattggtaatggctggagttagttgatccatacttgagagtttgttgtactatcttttgtatgtgaattttttcataaaaaaatttaaagtaggcatttgtggtttttaccctttgccttttaggattcttactgaagcagagattgacgctcaccttgttgctctagcagagagagactgaacactcttatcagcttaccagatccttgatgcctgtgcctatgtgtttggtaacaacaaactgacatcatagaggccctggattgaagatggagactctcccactcctcctgccactgactggttaggactctgtataaataaaacagtgcttttggaaatggcggtgcatcctgtctttcttgagtattaaaccctggtgcagagggcagaaagtgctcgtttacatttgtgtcacagtcgtggtttacacagatgcttcgttgcctttggaacacagatcccagctcagacttaacttagcacaatgagtaaactcagacttggaacctggctttgaaactctgaatgaattgtcatgtgagacaggcttttatttatacctcttattcgagagagaccttcctgtgctcagttctctggagactttctgctaaagatggcgctggctggctgaactcgtgtttactgttgttcctctggattgtgctctgctgagctgcacctccagctagctgtctttgtagtagtttaacaagtatctatttttattttgcataggattttgtttttagtggtttagggttttttgttctcttttgttgtttggcttgttttgttttttgaggctggatctctgaatgccctgaaattcattgtatagatcagcttggcctcaaacagaacttcccttcctctgcctcccgag

SEQ ID NO: 21126 - DNA, 2277 bp, Mus musculus
aattgctgaggcacttctgaaagctggctgtgatcctgagctccgagactttcgaggaaatacccctctacatcttgcctgtgagcagggctgcctggccagtgtagcagtcttgacgcagacctgcacaccccagcatctccactccgtcctgcaggccaccaactacaatggtaggtctgccagtccatccaaggatgcagaggagggagagagatggggccacttgagtcttaaactccgaacgtatacaaagttcagacactgtgatctttttaaaaagttttctcctcgatgcctatatgatattcactcagaacccagattctgagttcttcaaaactgatgatgtttgtggttgtcctcaagacaatagacatgagttgtgtgaggattgaaacacgtagttacagtttttgtcttcctcctccaggccacacgtgtctgcacctagcctctatccacggctacctggccatcgtggagcacttggtgactttgggtgctgatgtcaacgctcaggtgagtacatctcccttccacctaatctctgttgggctggctctgatggtgagcaggtttccagatgcagccgtaaactaacgcctgattgcttttggtttcaggagccctgcaatggccggacagccctccaccttgcggtggacctgcagaatcctgacctggtttcgctcttgttgaaatgtggggctgatgtcaacagggtaacctaccaaggctactccccctaccagcttacctggggccgcccaagtacccggatacagcagcagctgggccagctgaccctggaaaatctccagatgctacccgagagcgaggatgaggagagctatgacacggagtcagaattcacagaggatgaggtgagtgttcctcccctcagcacgctgacggctgttctagggctgctttggatcagagggatttcagttgtttaacttctcagactcggcttgcaaagccaggatcccaagaatttgtctctggtttgttttaagagcttacccttttgggttgaggaatgagggaattctagaaattgaacccaggccttagcacatggtgataagcacacgttcaaccattaagctccaccccctcaatagcttagactttttttttttttaaggaaagaataggtaagggaaactcctacagcctggtgcccttgttctatttgggttaaggagaaaaagagcccaagaataggagttatttcagcagcagctctccccttatcccaatgtcttggtgaagttctaggaatttaatatgtctttttcccctctcttgttttagctgccctatgatgactgtgtgtttggaggccagcgtctgacattataagtggaaagtggcaaaaagaatgtggacttgtatatttgtacaaatagagttttatttttctaaaaaaaaaaaaaaaaagaaaaagaaaaaaaatgagaaagggtatacttagcaccacaccacacagcgcctagacccaggcattttactggggtgattcggctgttgtctttgtgaaatccggggaaacagatcactgaaattcaaagaaaatgtctcttaaggttcatgtttgtgggattttttttgggggggggggaggtgattttccagaacctaatgaaaggaccacgttttatttattgtgcttttgattgaaccaccatagacctagtaagtgagcccagtgtgtcctcccatgtaagagccaggtgttcagtggcatgtgcttaaaagtcgcccccaactaaggtctgtgtcgccttcttgtaaatgttgtatatgttgtattttgttggtaattattttggtacttctaagatgtatatttattaaacagatttttacagacagcattgtcccgctcgtttgctattctgagtggcttgttcctgaagatcgggggctggagggggtggcgtgaatgttttcagccagctaaggaagttcacagagtagcttctcacgtgagagccgagcttcacagcagcctccagcccctgtgtgggagggagcctgttgcaaggtgacaggaaatgccagcctttagctggggtaccaccagcaagccacctggcctgtcactgaaggctctggtaccattttctccttgatttaagctgttccggaacccagtctctgtagaacttagttggaacaagaggaatttgctgagttagcttgatgtagctgggaaaatcctcaagagaggacatgggcttggaaatggtactgtcctgacatacc

SEQ ID NO: 21127 - DNA, 1107 bp, Mus musculus
aggaagtttagtttcacccaggaggattcatgaactatccagtctcatctgccttgacaacatccctttcccacagaggagcttcagtccatagccagtccgggaccattgtggggccatcttgtcatctcttgaggccagcctacactaagttgctacaaggtacaagatattatttttgccttctgctttaaaaggaaaaacaaaagactgaggtgtagtttcgtggtaaactatgtgtttatcatctttgcaagaggccctgaggtcatccccagccctgagctcacaaacaccaagacagggctaggcacagtgtcggacgattgcaatcctagcactcaggaggtcaaggctggctgtgacccaatggtgagaccttgtctccaaaacagtgatgtaaagctttgacagtttaaaagtgttaagcttagataaatgtttgacaatgaggagaaaactgaagcatggaaggatccacaagttcacttgccgcctccaagaagccagaccctttcattgttggacatcttccttcttgtctgtccacacacaatcctgctgagctgtggtgttgttgacttaagctatatggagccgtgcatggaaagaaagcctgttggctcactttagtaagtcaacagtgttcctgagctgcaggtaaacagaaggtaactcctagggaattcccagggagggccaagtcagccggcctcagcaccgcccagattttttcaaagggttctgtgacagcccagaaatgcttgagcctgactcctgccactaggtgtcacactaaacaataccgaagttgatgccaaggcctgaagctgtcgggacagcccaaggaggcataaatatacatactccttcattttatacctgcagccccaagtcaccttctgcagtatcctttatagatggggctttgagtccatactgtggcttttttttttacaaactttaacttcatatatatatattcattacaatagggtacattgcttaaattttatattacttaattttttatgtatatgaatgtttcgcctgcatgtatgtatgtgttccaccctcatgcttggtgcctggcggtgctgaatctcc

SEQ ID NO: 21128 - DNA, 1149 bp, Mus musculus
agtggtgttaccttcaagttcatgatgaatgttgagacaaaatataattggacagatagtcttgtggttatttattgtgcctcattacaactttatgattcaataactacatagtttttactaatttttttggcggtgctgggaatagaagccagtatcccaagcatgctaggcaagcacactgtccttcacagcccagtgctacacatttaaattaatggaagcatttagagagctagagcaaagctgcacatctgtttgtcacataggctgtacacagagtatttgtgttacagagagaaacactcctaatggcagtgcagcagctcagattccaactgaaattacttacatgtggtaacattttcttcccaagttggtatctcatttctgggcagtgcaggtgatagcggcacatactcagtacccaggaagcccaccactgacctttgatttccgtttagcttccagacaactttgttctgcctttttaggtggcatcactgctaaatgctatttctgttttgaggctgtggtcttttattattgaccagtttatcccggtgtgtctgtgtactttcttaagtaccaaaaaaggtgatggagaaaagggggaaaagcttgtttttgctcaaattatgtgtattgttaaaaagcaatggaacatgacccacaagtctaagttaaatataatattttagtactaaacttggctgcaggtgcaggttggtatgcaccccacctccagaagtatttcctgtagtaaataagcagtctccttttgtttaacatgggcatctcctaaggaaatgtagcatgattgataccaactgcatgtgtaaatatatcatcctgacaaaccacagaatataaattatgtatcattcatgtagtgtctacagatttgtaatgggacaaaaagatgacatggtatttaataaaaacaaaataaaaatattcttcacacttcctgtccatgatcgtattctattgtgtgtattttcagacactgggagctgaactatacccctgtggtatcttagctaatcatgaaaagtcaaggagtgagtccattctcagcagcaggaccgtggttctcagcccctcccgcccccggccatgcaagcactcactaaggaccaaaatcaa

SEQ ID NO: 21129 - DNA, 1146 bp, Mus musculus
actgaaagtaacccagtcccaccactggaagaaagccttgcctggctacaaaagatggccagttcttaatccatatccttcatttccaggagtcttcactagatttaccctcaaaagtttgcactgcactaggtttgcacactgcctcccatatcccctgactctagctgtctctccttccacccacccagtcctccaccaccaccaccaccaccaccaccaccaccaccaccaccaccaccaccaccaccaccgctgccgctgcctgatcccttcttgccccagtccacctgcaaaatctattttaaatctccttctcagggaggtgcgtgcattctccctacattaaagggctcattccttaatgtgcagttatataactctaagtttctgctttgtgaattattgggacctttaagatttttttgtattcagtttttcctctatttggaggaaaattttaaatgacaaagcagttaacaggactagtttttttaaaaatccacatgtaagttttatcaggctgttaccactttactggtttttatctttgtgcttataaaattgatatttatgtccaacttgcatttttctgtcacaggctagcaagatggcccagctgataaaagtacttgtagcacaagccccagcacctgcattcaatcccaggacgcacacacacatacacatgaactgattaattagtttctggttttgacagcttcacagtaagtggtagctgaataatattttttttcagtaaatcttaataaaaaccctatgaataagaaatcattatcaacatagaaaattatgaattggtaagttattggatattatcaaaaaacctacatttacatttcttatatctatctctcttgtagatattaaagatgattcacttacattggctcttttaggtactgacactattttgttattttttttccatagaaatcagtgaatttccatctgaatgttgtagcgtgatggcaggaggtactctcactgggtggcatgctgatgttgctactgttatgtggcgcagaatgctgggcattttgggagatgtcaatgctattatggatcctgaaatacatgctcaagtttttgattacctctgtgaactttggcagaatctagcca

SEQ ID NO: 21130 - DNA, 1188 bp, Mus musculus
ctatgtcaaaattcttgttttgttataaatcagtcacaaagattatctttttaaaagacctttttttttaaagatgtatttatttattatatgtaagtacactgtagctatcttcagacaccccagaggagggcatcagatctcattacagttggttgtgagctaccatgtggttgctgggatttgaactcagaaccttcagaacggcagtcagtgctcttaaccgctgagccatctctccaggcctaaaagacctttttaatatttatagatagtatttaaaagatttctcaagtgctatggtttttgccttcattttcctcatttgagataaaatgacttctataacatttaaatattttgataatattgtcatactagaacatattagaacaaacactatatatcttactatcagaattatgtttatttatatttattgttttggggcgtggtcttagtctgtagctcattctgtcctcaaactcatgactattgctttagcatcctgagtattaggattacagacatgagctccttgtgtccaatgtcattttagacagtgtgaattacctcagtgcatttaaaaaacgcacataattctctaaaaccaatttgttcgtaagataactttgccaccaatttttatgcaaatgcacatacacaatgtcaaagcataactaaagttactttcaattagaaattatttttcttgtagaactcatacaagaggcaagcaaatcctcatttccctgaaaactgacttaatatgaagtccccatttgcaagtccccagtcaaagcttagaatactttctaagaaataaaaagaaaataattaaagactcataataattgctgacctactgaaggactgtagaagtctcttaacaaataaaaacttcataatccaatacttttcatgtttatttcagcataaacactttgtctaactttttgacagtttaatttataatagaattaaggtccatagagcacacatttagaagacattgaattaatctttaaataaaaacataacactgtgaaatgagatgattttatcagtttatatttgtaggaatttgagttattgtttgatttttgcatctgcaactcatggaagcagattgaaggcatggaggtatgtggaggagaaagaagagatagttatatgatagagttatga

SEQ ID NO: 21131 - DNA, 1773 bp, Mus musculus
tgctgcctgtgtttcttctgagcttttagaggggcaggtatcctgcctggtgtttatgatgcgcagtgccagagtgacaagtggctggcagtattgtcgtgctttctgcacatctgaacttttgaagattttactaagcattatctagaggcaaaactagatccttattctaattttattgctagagtggaatacatatagatacttcccttaactctaccatcccccaaattagcttttttttttaagtgtttttaacactttaaggccatttggtgcaatttagaaaatgttggcctcccttcccttagccatattcagaatgaacttggaagcctctggaactgtgcaggaaaccggagccctcagcccggaggcacagtgggctacagtgtgtacgcagggtacagccaaatgaagtgctctgctggtctcatgcactttaatttctgttacagtgtatttaagaggatgaggaagactcactcaacactcctcaaaggagtctctgcatgattccgttagttccttatgacttcacctctgcagacattccctgcaggtatactccacagttgccaaattgtaaccatctgactttcgaagttcagtatcagcaacattgtgctgctctgttctgtttctgatcacccttagcggctgtgcagactgtcccaatccagtagcatttggcagtgcttataaatatatatatatatatgatgtttgataagcatttttaatgagatttgtatttttaaatttagtatgtaataaaaagaagtgtttgagcgtcatttgtagtgttgtgtgttacttattcatactcaagttcagttgtttatacccagtcctcttgcttgtgctgacgtcagcaggccctctgtgctggggaagggcttctgctcggcttcccatacgtgcacctctatgaagcatatgtaggtgttcaagaagctaagttatatttaactaaaaacacacatgcagttgtgttatactttaataagtgtactctattttgaaattttaaccagaaaaaaatttaaagatttatttctcacacttaccatgaaaactttaatatctgtatatgtgccaggagccttggaccagcccatgtgtgctcctggttggtgggagctccctggagtctgggttagttgagactgctggttttcctgtgtggtcactttttgcttccgcttctgcttctttaattcttcccctaattcaaccattggaggaacttcaattcaaatggttggctgtaagtgtctgcatctgtctcagtcagttgcagatagtgcctctcagaggacagccatgccaggctcctgtctgtaagcacatcatagcatcagtaatagtgtcaggccttggtgccctccacccaccccctgcccatgagatggagatcaagttgggatggtcattggaccacttttccttcagtctcttctccatttttgtctctgcagttcttttagactggaacaattctgagacaggaattttgactgtgggttagtaacccagtccctctacttgaggccctgtctatctattggaggtgggacttgttgagtgccctctccccaatgttaggcattttgcctaagaccccagaagatggaaagatctcccatgctcatggataggattaacatagtgaaactgtctgccttaccaaaagcaatctacaggttcaatgcaatctccatcaaagttccaacacaactcttcaggcatggaaagagcaattctcaactt

SEQ ID NO: 21132 - DNA, 3138 bp, Mus musculus
tgtcggcggcggaggcaagcggtggcagtgacagcagtgaccactgagcagtaattgcccaagatgtcgaatatcaaaatcttcagcgggagctcgcaccaggacttatcccagaaaatagctgaccgcctgggcttggagctaggcaaggtggtgactaagaaattcagcaaccaggagacctgtgtggaaattggagaaagcgttcgtggagaggatgtctacattgttcagagtggatgtggtgagataaatgacaatctaatggagcttttgatcatgattaatgcttgcaagattgcttcagccagcagggttactgcagtcatcccatgcttcccttatgcccgccaagataagaaggataagagccgggctccaatctcagctaagcttgttgcaaatatgctatctgtagcaggtgcggatcatattatcaccatggatctacatgcatctcaaattcagggtttctttgatatcccggtggacaatttatatgcagagccagctgtcctaaagtggatacgggagaatatatctgagtggagaaactgtactattgtctcacctgatgctggtggagccaagagagtgacctccattgcagaccggttgaatgtggattttgctttgattcacaaggaacggaagaaggccaatgaagtagaccgcatggtactagtaggagatgtgaaggatcgtgtggctatacttgtggatgacatggctgacacttgcggtacaatttgtcatgctgctgacaaacttctctcagctggagctaccagagtttatgctatcttgacgcatggaatcttctctggccctgccatttctcgcatcaacaatgcatgctttgaagcagtagtagttaccaataccatacctcaggaagacaagatgaaacactgctccaaaatacaggtgattgacatctctatgatccttgcagaagccatcaggagaacccacaatggagaatctgtctcctacctgttcagccatgttcctttgtaatataacttctgaagcattttgaaaataaaaccaaacccaccccttgtttttcttggtattggtgagtttagcagaaaacccgacttgcttcagtatagctttttacatctcacattaactatatttgaatttattttaaattggagaaagacagattgttgttaactgctaggatgccctacctgcattgttggatcctggctttcttgtttattttgtgagccttgcagctttaagttgagctcagctcttgaaaggtgttaagagagtaatccacatggtccttaagacatgattgacaaagctcatgctccattgcatgtgaatgctttttttcattcagaataactagcaacaaagctagcccatgagtagtacgttttcagaggtctacagtaagaaccctgagcgtccttacacatagttcagtggttgagcatcctgtaaggcaggggtaggtaactcaatgcagtaattaatttttggaaggaaaaaaaaaagcctaatccattactgtctttttgactgtatagcttagattctctacacctattcctttccagttggctttatttacctttagctatcttgatactttcttggccaaatatcctggactcagtgatcattgtgacacaatgtggtgtaagacaaagtggcttcttgctatgtaactgctagcattcacactaggtaacctcccttagcctcctaccactgaggtggtgggtttagatggtgtcgtagtgcctttgattaacttaagtatttagctttcatcttccttagatctctttgtcctcccaattgaacacatttctgctaaacaatttggtcttatcttgtgtagaaaaaagttaataaaatgtctgtcatgtgtgaaaaaaaagattctgtaaagtttgtttgcttgttttgtcattgttagaataatacccaagaaaaacaaagatttattttgacttcagtgttttgggctccattcttggatggagataaaaccttgtgggagagcatgatagttccagtacagctgctaagttggggacagcaggaacccttcaaagactggcctgagtggcccattcctcagttcaagcccttcctctaagagtcctcaagattcattcacctttagaatggattatgtggcaactgagccttcaggggggacattttaaattcaaatcctggcagtattctaaagccaagtgggcagtaaagttcctagcaatttttattcagaagccattgcagtcgggggaaaaagcaaatgtagagtcaggctttttttccaaataaatcaaggacaaggaaagttagaggtcaggagtaggatcagagtcactggatgaaaacatcatccatgtagagggaatttgtgcttaaatctactgacaatcatggaggcaaaccagggtttatgagatttttcaagatgtgagaacctcaaaactctgtaagcaagattcttgttaaagctgagctaggcagagacaaacacagggctgaaggttgaaacctaatagagtagatgattctaagattaagtttggtttttatcattcatagtattagcttttctataacttgactcatctgggtcttactcttcagtttactaagagatgtggtgaagcgtccagctacagttatgtccttgtttgtcctctaagttgtacatttacaaatactcctgattgtgtgtttatgcacacactcctgtgttaggtgtcctttattgctctctatttttttgtagcagggttcttccctgactctaggcctcctgttggttcaggtaggtgcaggtcaacaaaactaaactgtcatcttgtctccatccaagagacaagaaggcttggattacaggcatgcacctggatgctccactttacgtggatgctggaatccaaactctggattcacgattgtttggcaggtgccctttccagcttcttttcaccagaagtgtttgatgtttataagttacagcttttcatattaggatcgtttatgtctggggagtgggtttgatgcttttatatacttttttagatttagattttatttttcattttactttatcttgtttacatccttttttcctactctgtc

SEQ ID NO: 21133 - DNA, 1129 bp, Mus musculus
gataggaatttttggtgtgaactggaactaatttgttgtggatgttttcttctcttattaaagtaaacaagcaaactttcttattttgagtagctgaaaggcataccacttaacttaggtacaaaataaaataagaagataaataatgatgtgcctcttattcacattctctcatcttagatcagacagtgttgtggtagttggatatgcttccgcagcaaactctcacttgttatcttgatcctaaagttcacagcattaatcttagattacttaaagttctatcacacagagatgttaaagcctattctcttggataattatcttattgaattttattttacctttgtaaaagaaaagtggcctaattaaaacttataccatgcagacatgcctttttattgccttaaatttcataagaaatacagatgtggcctttttgtatttcttttaaaatatgatcttaattaagatataattagattactttcccatttctgttttattccaccaactcctttcatgtattcccactcacactctctcaaacttatggcctctttttctttatagttgtcacacatccccacacaccacacacacacacacacatgtatatatgtgtgtgaagatatgaaatacatgatgaaggtgcttataagcatcttcaagttttgttaagcaggtgaagtgaaccttgatgaaaagaatggcctgagtctgtatccctagaagcagcaaagtttagggcttttatttatatctgtgcattatagagccaggcagctggctggaaaacagtttgaggaaaactgtgcctgcaatgaaaaggtacagaatatctttcaagttattctctgaagaaaggtgactatttgtatagcattatgcattacaatcagccttaaaggactgggaaggtgtggctgtaggttatgtgcactctatgccactttgtttaagaaacttgagtaccttacctacaggctttggtatcgatgggacgtcatagaaccaatatcctctttcatattaaagaagttgtaagtctcttacatatagtaatttggaatagcattatatattcccaagtatttcttacactgatttgagttgttctttcacagaa

SEQ ID NO: 21134 - DNA, 1103 bp, Mus musculus
ttgtgttcttactgggagagcctgaaaagccctgagctgaggtgagagcagtgctcacctgcttacccttgtgtcacgagctatttcagttggcaatatttctacgcagactgttcagtaattgatgttgaaagctataaaagaaattctaccctagtgcttgccgtggactgaattgcagattgcataatttcaatttttttcttttttttttcctggcaagactattttagttcagcaggtgttcaggtgatgaagtgtacactagatgcaatgcagaaacatacaggatcctgaacaaataaacagaactctactggctaactgaagagaaaggtactgcatgtagagaaatgtttgtgactgaaatgtagacgagaatatgttgtcatctggggaactgtttgtttcttgagtttaagtaagactttacttttctctgtgtgttcatattcttaggtggcaccacagagcttagtggaaggaatgtttcctgacatgagagaagacaataggctttgttgggaacctacatactaagaattcattctaccactaagctacactcccagcctaggaaccaatgctctggctgatacttcacacacacacacacacacacacacacacacacacacactattcttttcttgaggaaattaatctcaaggataggtgctatggttagaaagaagttcattaatagacactcactgataatcattgtcagaacacagtacccccacagctcatgtctccagctgcatatatagcagaggttggcctagtcagtcatcaatgggaggagaggcccttggtcttgcaaatatcatatgccccagtagaggggagtgccagggccaggaagcaggagtgggtgggttggggagcagggggagggggaagggtataggggattttcagcgaggaaactaggaaaggggatagcatttgaaatgtaaaggaagaaaatattctaataataatttaaaaaggaaaaatatggagtcctgggaggagttttctcaatgcttgtgagaaaactcgaaagaaagaaagaaagaaagaaagaaagaaagaaagaaagaaagaaagaaagaaag

SEQ ID NO: 21135 - DNA, 1444 bp, Mus musculus
aagtcttgtatgatttaattatgtttaatgagttagaatggtttgctttgtattacagataccacttatttgtatactgcagacagctctagagtggcactgggcatcctccctgacctgttaggggttatttaataagagccaggaacaaatcaatagtgatgatatatggctagtttgctttttttgtgaagtaattttctggttttctttttagcatacattgtatatgccattctgtattttgttaaattggatttattttatggcttaagaattatttgactttatagtagcaattttttgttaaggtaatttaatatttttggttatttaaaaaaattatttagagctaaaaaatttgagtgaggtaataaacccacagcagacattaaatgtgaaattcccacagagagcccaactcacattactaactagagtaattttttaaagaaggacgttctcactactaaccatatctttttttttgttttatcatttattgtttcccttcttagataatttcccattgtgttcttcagtattttaacactattctaggagttttcacttcactctttgtttctgtttccttgtgaatttatgaatttgtggttcttactgagacagtattaatataatgtttaattatgtcatgtggagatggttctgtttgatttattgattagtatcattcacttttaccttttaaagtttacttgtagcaagtgtttacattgctgagcagataagtctgacaatgaaatgtatgtatcaagtgctgcacatgtaagggtgctctggtgggcgcagcagtggggactgactgcacccgcatgaacacaatcagacgacggcgaagcagaaacgtaaattgttattatactcaactatctaaataaattactttgttctgttttatttgaattgaactgtgctaggccaaaatgccaataaaatatacctttctctgttttcttagttattttaaaatctagtaaaagcctgggaaacatcatgtaaaataagagtgctttttttgttttttttgtttttgccagggcttcattacgttactctggctgtcctggagctcattagtagaccagggtgacctcatgctcacagagatctgcatccctccctggtggtgggattaaaggcatgcatcaccacactgggcctacattttttgattggcacacagctgtacaaatgtattagtacaatgtgataattcaatacctgttcatagaaatggtcagattaccttaattagtgttttcatttcttctaaacaacattgctttgtgttggaaactttcagacctttctctcttaattcttataaaaatatgcaataaattgttgtaaactgccatcagtcagctatgctgaagaacactggaactttgttcagttaatctttggtgcctgctatata

SEQ ID NO: 21136 - DNA, 1228 bp, Mus musculus
gatgcagctgtgttctactgtggctggcactagacgttatatatttttatactcaatttatattatgttaggttttttgtttattcgtttgcattgtttttttgagacagggtttctctgtgtagctctggctgtcctggaacttcagatttgccttaaatttagatattcatctgtctctgtctcccaattgtctgggattaaaggtgtgcttccctatgcacagcatagttagatttttgtttgtttgagacagagtttctcagtgtagccctgactgtcctgaaactcactctgtagaccaagttgggcttgaactcacagagatccgcctgcctctgcctcttgagtgctgggatcagaggtgtgcacattcccctcctgctatgttttctataatggtggatattatctaatttgagaggaaattattattttgctttattagattagtgttgggtgtacaagtgcatcataaatttcaaattttgacttaaaacacttggaaggcctattgttaattacatgtatattacaaaaccattggttttgaattttcattaaacatatcttattggcatttcattgatggcttactatgtagtcggcatgatggtaggaaattgtaaagatgtgattgggtctctaaggtggaggtcttgttatagggaaacttaattttgagagattaaattgaaagactccgagaggagcccctctctcaggcctcgggacaatagcggacacccaagaactcaggagagaccaagcttgatgtaaaccacacgaggctttatttggggaaagccagagctctggggacgactcatatcccacgcaggggtagaggagtcgaccacgaggggaaagaggtcccagtttttatagtccctcaggggggaaaggagaagggggagagtaggggatttccagatctaaacaatgtctattctcaagaaatgggtatgggaggggtacaaggaaagagtctggtgcaggtgtagcaactccggattagcccgactgtggttgctggggagattttccgactctttcccagcaaccaatatcacaaacacctggcaatgggcttcatcagtgggcacacacatgggttcaaggaacggtcaaaacattggcagacacacgggttcaaggagtggccagagcattgtgcacctctatttttctaaatcagtaaagctagttctgctaacactgacatcta

SEQ ID NO: 21137 - DNA, 1275 bp, Mus musculus
ttcccagtggtctaccaaagacttctgtgatggatgctaaaaaaaaggcaaggctctgattggtccaaattagtactaaagacacaagatagcaaatgaggccaacacagcttccatggctgtgattgattgctctaaacacacctttctctgactgtataagctgattacataggctcactaagtaaatcaagaggaagactcctgtgatgcctgtaacattgtgtgctgtactgcaagtcagaccaagaaaatgtttctccctaggcggggcgtgcgtagccacgcccctcgaaagagggcgagacatgcaaattaaactggatattagcatgtgggaacgccgggagagctggggtcctggaaattgtagctgaagctgtgggtgctggagagggagtggagtgtggaggacgcagacacggatgggaacaggaaggaaccgcggggaagacaggaaatgagggttgcgtgaggtcaccacaatgtcaatgtgtcgcctggacacaggtcatggctgtgtgggcgagggtggggtatcgcttctcggccttttggctaagatcaagtgtagtatctgttcttatcagtttaatatctgatatgtcctctatctgaggacaatatattaaatggatttttgggaataggagttggaataggagcttgctccgtccactccacgtatcaacctggtattgcagtacttccaggaatggtacaccccctcgggggaaaagtacttgtcaaataaaagacttcgaacttgaaagggagagaagggatacttagtgtgttcttaccaggaaactctccatgactttatcaaatctcaagtgggcttgtaagaccgtgtcaaaaaagagccaaaagtctcagcgaacctgggctgagagtgctagtttatcttacaggctaaggaatctcaagttctaggcctacagaaaagcctgttacttagccctgcctttagtaagcttgtgatgtcagctgcagccaaaaagtgaaaaatcctctatttcaacaaatcagtagcagaaaacaacctggttgaaaacgcctacaaccgcatagatgttcctccaaaggaggaatacaaatgaccaaatgaatatgaaaacatgctcaacactgcacaggaaaatgcaaacaaaagcatagaatatacttcatagcacctaggatggccagtatatgacagatcgacatgtgtgtatatgtatgtgtgtgcacaatatctcaaatagagtcaacgtccccgagacctgcatgggg

SEQ ID NO: 21138 - DNA, 1149 bp, Mus musculus
caatgatgtagaagtagaggaggcaggagaggaagaggagaaggaagcaggtatagttcatagtgatgcagagaaagaacaggaggaggaggaacaaaagcaggaaatggaggttaagactgaggaggaggctgaggtaagagaaggtgagaagcagcaggatagtcagccagaagaagtgatggatgtgctagagatggtggaaagtgtcaaacacgtaattgctgagcaggaagtaatggaaactaaccaagttgaaagtatagagccttcagaaaatgaaactagcaaagaattggagccagagatggaatttgatgttgagccagataaagaatgtaaatctctttctcctggaaaagagaatattaattctcaggaagtggaaaaggagtctgaggagaaagaggaaaaagaagagaaagaacctgagccccaacctgagcctgtggctcagcctcagcccccacctcagcccctgccccagagccagccccattctcagccccactcccagccccagcctgtactccagtcccagcctctctgtcagcctgagactttgccattagctgttttgcagcctccacctcaggttattcaggagcaagggaatctactacctgagcggaaggattttcctctagagtctataaaactccctgaggtgtctgtagagccagtcttgacagtacattcagaaaacaaaagcaagaataagactaggagcaggagcagggggcgagcaaggaataaaacaagcaagagtagaagtcggagcagcagcagcagtagttccagtagcagctctactagtagcagcagcgggagcagctccagcagtggcagcagcagtagtcgaagcagctccagcagcagctccagcacgagtgggagcagcagcagagacagcagcagcagcactagcagtagcagtgagagtaggagtcgcagtaggggccgaggacataaccgagataggaagcacagaaggagcgtggaccggaagcgaagggatacttcaggactagaaagaagtcacaagtcttcaaaaggtggtagtagtagagatacaaaaggatcaaaggataagagttcccgccctgacagaaaaaggtctatatcagagagtagtcgatcaggcaaaag

SEQ ID NO: 21139 - DNA, 1515 bp, Mus musculus
tgcatgttgtaaaaattctttttggagaatacagactgtttgtttaccagacattcttgtactttttgcataattttgtaagagttatttatcaaaattatgtgaggttccaaaatatgtaaaaatgataataataaaaaaagattaacatcctttgtcatcttttttaactaccctattactgttcagtcagaatccgtatattttaataggtaaatctttaaattgttccttatgttctgtatcatacattgcttttgtagaaataaatatgcatctttcattatttttgggatgtccttgttgacacttgtataataaatatctttatatcattttcagtttttgtcacaagatactgaacatgattaggatgtttttgaaggtttcatcactttgatttgcctgaaaacagttgccaggtttttacagctttgacagggaatagttcttttaaaacatttatttcctatcttacagtttttaatctaagcatttttctgtttttcattaaaaccattcagttggtagataacttcaaccgtacgatttggttgtcatttcacgattatagaacaacattctcttgtcctctcagctccttgtgtgataacaacttagagtgtaatctgttatagttatcacctcccgggtggtgggggtcgggtaaaaatctcttctaaacttggtttttgaatctgtggtcttgtcttttctgttggctataactgaaacatgccaatctgtgttttcaagaatttttgtttaaggaagtattgtatggaagtttacacaatgaaggaagttcatctagacttgaatatgtaaacaagataacacacaagtgtaccaagtgattattaactttgttgtttataaatttgtatggacctggagtatctgttgcccattactatatatgtgcaaataaatgtgacttagacttgtgactgtttaaaattagtacttgtattaaagttttgatgcatatgagagcatttaaatgacagtggctattttaacattgtagttttagcctgatattaaatattcagtatattgtctataagtaaatggtttcagtgaaaaatgaacaaatatcttcatttagttttgtgtctgaaccactcatgtgttaaagcaaatgtgaaaaagaattatttttaaaaatccttttcttggattaagtgaaccacttacatccaaaagcatgctgatgccaagacgggcttaaccaacggcttgtacttggcaaaatgctttggccttgtgctatgcaatgagacagattggtaaaggactgactagattagaaatgacaggagccctcccctagcacatagtgggagggggactccaagaaaggagtactcaataacatgttttacttaaatgttttgtctgtgggcgtgtgcaggcaggcaccaaggcagccagaagacattatatccctcagagtgagagtgaggcattgttcattgtggaggctgaggaacaaacaggtcctcctaagat

SEQ ID NO: 21140 - DNA, 1628 bp, Mus musculus
tgcaacacatgggttcttctcttctgattttcacaacagtgtcctgctgctgtgtagttcaggttggcctggaatctgctctcctgcctcacactccagcctgagttgaatagctgccggcctgtgccccatgttcagactgtttgcttgctttgcttgtttatttttaataagaaggcttgtatggcgctggagagatggttcagggttaagagcaggcactgtttttgaacctgtgtcaggcagcttcgtgcctcacaaccacctttaactccagcttcggcaggatccagtttctctggcctctgtaggcacacgtactggagtgcttatacacttccccagccctgttctacacacatgtacacataatcacaaataataagagtgaatcttgcttcttcttcttcgggaaaacaccaaatggcggatgacgccggtgcagcgggagggcccggaggacccgggggcccaggattaggaggccgcggcggcttccgtggaggattcggcagcggtcttaggggccgtggtcgtggccgaggccgtggccgtggtcgaggccgcggggctcgtggaggtaaagctgaagacaaggagtggatccctgtcaccaagctgggccgtctggttaaggacatgaagatcaagtccttggaggagatctacctgttctccctgcccattaaggagtctgagatcattgatttcttcctgggtgcgtccctaaaggatgaggttctgaaaatcatgccagtgcagaagcagactcgggctggccagcggaccaggttcaaggctttagtcgctattggggactacaatggtcacgttggtcttggtgttaagtgctccaaggaggttgccactgccatccgaggggctatcatcttggccaagctttccatcgtccctgtgcggagaggctactgggggaacaagattggcaagccccacactgttccatgcaaggtgacaggccgctgtggctctgtgctggtgcgtctcatccccgcccccagaggcactggcattgtctctgctcctgtgcccaagaagctcctgatgatggccagtatagatgactgctacacttcagccagaggctgcactgccaccctgggcaactttgctaaggccacctcttatgccatctccaagacttacagctacctgacccccgacctctggaaagagactgtcttcaccaagtctccttatcaggaattcacggatcatcttgtgaaaacccacaccagagtctctgttcagaggacccaggctccagctgtggctaccacataagggtttttatatgagaaaaataaaagaattaagtctgctgataaaaaaaaaaaaaagagtgaatctttaaaaaacaaacaccaaaaaaccccagctaggtttgtatgtaataacatagttgactagtgttatcttgtagatagtggtttgcttcagtacttaaataagggcaccctctacttgatccaattaattcccagtaccttctattctcaaagactatgtatgctgagaagccagcaagcacatcttggagccccgcttcagccctcactggagcctatgtgtcctccgttgtttttcttttcttctcttttcttctc

SEQ ID NO: 21141 - DNA, 1232 bp, Mus musculus
tttttttttttttcctttatttcattttgtggttctcttgttgggtaaaatatgacctttatcttaagaatgagctagcttttgcggtcatcctttttcttagtaacagtttttgtcttaaagttttttgttttttttttttaaatcagatatcacagttgtcacgccacttgtttttgaccagttagaatctggggccactgagggaggaagttttttgagctcacccaggaagaggcgaactatgtaatcagctgcaagccttgagctgcatggtgtgcaagagtgtttcaggagcagtgtgaagcggtctccgttatacagtcggttacagtcctagtccgtggggagggatgatggcaatacttgccttctcttgagtatctgtcctcgggatcctagaggcagatgctgttaccattgcttgggggtatgagaccacatttttctgcagtgctgtctgaagtaaagaagagagacagagtaggataaagacttttcaccctttcctgtgcccttttaaggttgacactgtactttaagaggctaacacagaagggtaaaggaactctccatcaaacccagagaagaggctccacacctcctctctggatcctgtctggagtcacagctgaaaaaaagaaggataaagatacagggattaaaaaaagacataatattacatgctttttgtaacattatgttaataaactagatagcaacttggaggaagtctgtgtagacacaatagctaaaaatagattttaaaaagagtaactattagaggggttgtgtgtgtgtgtgtgtgtgtgtgtttgtcaggctcccagaggaagatggctgtggagggtctacctggtctgtgctgacggctgaagagaatcaagcctgatcatttcttgagttctttctcaaagagccttaagtggtatggcgtagaagagcctttcagaaggaatgtagtgaggcctatactgtaaggggctttaagggggtgggggaaagagatggtgggaacagctgtttctactgattatctggccttgtgatcaaacctgcattattttaactcaaggagagataggagggaaggattcaaatctcacagtcaaagctccatccgttgttttatgactactctccctgttcccacccagcaaactgcagagctgtgtgtctccctgtagagaaattttttgtcaaacccaatgtattgcaggatttttttgttt

SEQ ID NO: 21142 - DNA, 1144 bp, Mus musculus
ttctaggcctagatatgattgtacagaggctagaagcttccaggactaggcctatgttagcagacggagggagtaagactcggagatgacagttatatcaggcaaatgaaagccacttttccctccatgcgtatagataaaataggagtttggagtcaagaaacacccgccactcccctcctccggtcactgactgataatcttttcttggcattctccgtatccttgtaccttcctgagttaagctctgagcaacctcttcataattccttgtttcaccacactgttgctcttcacccagtgagagcaattgtaagttgccagaagaaagtggtcagaggcagaaatacctcgtattagatggtagcctgcttcatattcatagagctgacctcagccgcctgtacctgtctttgtaatagtaatagtactgtggaagatacttggttatgggcttatctccctttgtcttgaaggttgtggcagcattgcctgaagatatgagagcagactttaatcccagtggtttttcgttggaattggcagtatgtgtgctttccgttggactgcttgccgtggtcttgtttctgtggcgaggcttccgatcagtaagtaaccactgcatgctaggagagttttcactctgggtgttttcaagctttttttttttaaggtttattttatgtgtatgaatgttttgcctgcatatgtgtatctgtatcacatgtgtgcctggtacacacggaggtgacaagaggccattggatcccctgagactacagttacagatggctgtgactactgtgggtgttgggagttgaaccctggacctctacaagagtaacatgtgctcttaagcaccgaaccatgtctccagccctcattttgtctttagactaaatagcgcattgagaaacttaattgttatttcagagaaataagttagaccatagtgttctgggtaatatgtggttattagaaactgaatatagattcagagaaatgtttttatttgtaaggactcttaaaggattctttgtaggggtagtacacactagtaccaaaaccccacccttcttccttctccttcctcttcctcctcctccccctccccctgctcctccccttcatcaggcagatgtat

SEQ ID NO: 21143 - DNA, 1120 bp, Mus musculus
ctttagaatatttgaaatcaatgaagagcgactcaagggagcaataaaagatgccttgaatgaaaattctcagcttcaggaaagccagaaacaggtgtgtagccttttagatgctgactatagattttgaatgttctgggcaaactcacaactgatcaatggagttacattcacgaggggcattcgctgaagagctcaaggacaggacagggcagtttcccatgcatactttgtatctctggtaaagggttgaaaagtatttctttctgtctttgtcttcccccatgaaagaaataagccaaggcagtgagcattctgataaccgcaggaaacagcagttaacaccaaccctcagtagagaatactagtaagagttaatgtattaccagtttggggcctaaaggaaggaggagttctggggcacataaggtgaaaatttaactttcattcttaccgcccccgccctcaggcactcctacagctatccctctgttctgttctcccaaaaccatttttggcatggaaattttgtcttgtcttgtctgtctgtctccctcacctatctttctctcgctctctgtctccctccctccctccctcccttcctttcttcttatttatttatttatttttattttatgtgcactggtgttttgcctgcatgtatgtctgtgcaagggtccaaaccaatcacttggagctggattacagacagctgttagctgccatgtggttgctgggatttgaactcaggacctctggaagagcagccagtgctcttaactgctgagcatctctcccccagccccctcccttcctttctgtctcttgtttactctttcccttccttcctttctattgatatgcatatggtgtgtatgtgtgtgtgttttgtgagattgtgttatgccttggtgttggtccttgccttcgccttgtttgagacagagtctctgtcctttttcttttgtgtatgtcttggtagctagtctgcaagcttgtagggattcacctgtctgccttccatctctccgtaggaacacgaggattataggtattgagctatccctctggactttatgtgagttctggggaattgaactcaggtctcgatgcttga

SEQ ID NO: 21144 - DNA, 1175 bp, Mus musculus
attctaccagaagttttttttttttttttttttttttaattgatgagaaaagttttcactatcctgggttttttgtcatccccgatgaatttgcaaattgccctttctaactctatgaagaattgagtgggaaaagttttccttttctaaaagatttttgtttgtgtagtatgtgtttgtgtgtggctgcatgtgcacacatgcccatggagtccaagagcaagcatcaggtatcagattgtctggatcaggagttagatcacagctgtgtctgcctgatgtgagtgctaggaaccaggtttaggtcttctggaagagcataaagcactcttaaccactaaaccacatgaacagccctgcaaactacttctttcttcataattctaagggctagagaaagtggtcacaacaaagaattatagtgatgtaatatcatctctcctgttattccttttgaaaacaaagtaggttgagaaatataagtgccaaggctagagtcacatcctgacatggtacttgtcctggtgtgctagagttctcgaggagaatctgctggtcttgatttattggtaggggccttcagtgtcccttctagtgcccagatcagaaacatggcaagaaaattgagaaatataagtttcttgtaaggagatgtgacctcagtgaccttgctattttgttttactgcccaattcatgactgtacatatcaagactgacagcatttgcagggcattcattacttaaaattttcttagcaagaataaaaatttacctagatagtaaatttctccttcttttactgaaaaataatttgttctacaataagagtatatttttaaaattgagtaaggccataaattgcatacaagctttgatcaaagattatatttctctgagttgatgagctaaatggtcatttatagagctagcattattaagctatttaacgtatcaatattatctaaatgaacatgataaaattgctcacgtgctcaaaaccctttagttcacttttttataacattggtaacatttcaatatgtcaagcttatgtcacttataaatgtcagccacgaggtgtttgaataatgctttgaaaatattttgaacagctatgctagagcaaaaccattatatgtatattttatatgaagaataaaaatggcatatgta

SEQ ID NO: 21145 - DNA, 1099 bp, Mus musculus
tatatatatatatatatatatatatatatatatatatatatatttcaaaaagtgagggggaaaaagaataaatatacaatcactaccaagtcctcctttttatttaacattttcttgagaaaaatttcaaaatttggggtcaggaatgtccaataatttctatcatattctcatcactcattcaatattgtgctatctagatgttattcaatattagaaacacgaatgcatacttcaacaaagtgggaaatacgtccacagggctgaatataaaactaataggctttaacttattaaaaagagaagagtagaggggctcatgtctaggtggcagtggatatgccccaactcaactgagtgggctatcactattgctgactttctgcaatccatcattgactgtgtcaaacagatctgtggtggtcatgatggagacccccaaccccgaaagaatgtgaacattcagtactggccaaagccctctagttctccagtaatctttgcaggtggtcaggacaggttcacagaacaagcagtgatagtgagagctttcccaacaccacctctagaggtggtcccttcaggtcagggaccttgaatccagctctccagagttgaaaggctattaggcagatttggatgcatttgctcaaactacttctcataaactcgtcattccaaatgatttgattggctgcataatcaggctttagggagccaaaatcaatgagatctgtcaaatttctagggcacagatcaaaatcgcaaactcaaaggaaggatctactgatcatcaggttaccatcactagatctgctgctagtattagcctggctcagtatgtaatcaatgtcaggctttcctcagacacaggtggcatgaggagcagctagaacagtccggatttatccacagttcctttctgatgctcaccaccaccccatgacccatctgtgtagtttctgaagagtcagcaagtcccagttttaaatagtttgtaaattttcactttctacacactatatcatccaatcatgatttttttaatttaagtgttttaattcctttctatgttcagcagttatgctgatatattcat

SEQ ID NO: 21146 - DNA, 1109 bp, Mus musculus
ggacctgggttcctttcctaactctacccatacccacacaaaatctacttgatgtctgatttattaagaaactaaagctaaaacatctgagtttggaagaaagttgctagctcgatgttaatattttatgtttcttttctttacaaaacagcaatatggcgggctgctgccccaccccctggaagctccacaccttgcctccaaccttgagtcacctttcagagtttcccaggaagaattgaggtgggctgcaagccccgaggctctgcctctcctgggttctgcccattgcccggtcttgtccagaggcaaagaaaatagagaatgccttccagtctcacgatgccccataattccgtgagaagagaggatgaccacctacccggatatggaggcctaggaatcatggttatggaagctgctatagatgatgatgctttgggacaggagttcagtgtccctggaaaaaaaagaagaagtagtacaagctgggtggacataacccaggattttgaagatgcctgtcaagaactgaagttgggagaactgcttcatgacaagctgttttgtctttttgaatccatgtctgctattgaaatgatgaatcccaggatgtttgccgggatgatcagaaaccaagcgaatagaaaggttctcaattttgaacaagctatcaagggtggcgccattaaaattaaagacttcagcttgactgaactgctaggaataatggatacctgtttttgctgtttgatcacatggctcaaaggccattctttgacacagacaatgtttacatgcctttacattcataatctggacttcatagaagaaagatcctgccatgaaagcttttgctctgggaatcttgaagatctccgacattgcaagggaaaaactaaataaagctgctgttttgaagaggaagattttcagtcaatgacatggattaaaaatggtcaagagtgtgacagatcttacagatctgacagagttacaggaatgctaaaagatgtggaagatatatcatcttcagtacttgaagtcaacaaggagaagagagatccagaggttgaactagaaaccttacaattatgatgggctttgat

SEQ ID NO: 21147 - DNA, 1818 bp, Mus musculus
ccttccagattgacggacattggatgcactatgatggcctcagaaatgtgaatttaattttgttaaataaacccccagagtttctcctcttgtcatcattggtttatattcgagcaacagagaaataaatatagactgatgctgaattaaattgttctcccgcctgcccatgctcccagatgaagggcttttgttctgtatatacttggtatccaaggaaacagttgaactatactagtttcagagatgtatttttcattgttttgccccaggtaaatgttttatatggatgatctatgcaaaaaatgtatttttaaagtattttctgggttatttttatacaagcatatgttatgttcaataaaatgtatctcgtggcctttgtactttttatttatataaatacctcaacagttttttacacttctatccttaaatccaagaaaatactttgttatttgaattctagatttccctttttagatacctgagtaacacctagcataaagtcagtattctggttacctgactgtatttctttgccttaccttcaagtgcactgcattggatttagtaggatttgaatggatggcttatggatggcttagtttaccaattgcttagttcgttttaccccttgctaatttccttaaggcaatttttaaaactatatatatattatatatataatatatatatattgtagattaaaccatttttttgtagtagcaagttactatagctgtttgccaaagtgtaaacccaccagcacatttcaggcattagctaagcttcaactttagttaaggtaagcattacaaataaattatgtaaatatctcatcattaaattaatgaaaattctccagtaaattattttgcaaacaaggcaactatcaaaaatattaggccactggatgtttattagtgttggactaacattaaaaaatgtattatatatttaagagggaaatagggtacctagtaatacttccagatcagtgttttagtggggcagagaaaaagatatatttttaaaaatgaataatatctggttcccttgaaacagcttactaatgtcaggaggcttgcgtttgagccacgggtgcaaagtcaaaccatttaaccgaatttcatgttttgttataaataacctaatgtcactcatctttttgcaatttaaagggaaaatatttttagggagaatacttggtgaactctcattagtgttagtgtttacagcgaaataccattgcttatgtttggcgttgagactgggtgcaggatatctgaagactacatgaccacagacttcactgccgaataccaaattgctatggtttcattctaaatcttccaatgctgtggtgcctggagacaacttgctcaaaggatgggcagctgagggtgaaaccttgctaacatctcactttcagtcaatattaggaaaaatatttttatcagaagataagaatggtagtatttttgtaaatcacccagggtttatttaaatagttccccaaatatggttattggaatttgatttatagcaggcttttctagtaacatgtattgcatgaatcaaactatacagaacacaaatattagtgtatccatacaaaatggtatggttatattatagactaagttattcttaatacagattcttcagggagttgcactttatttaggatattagtttattgtaatgacttacctacctcacagggttgttgtgagggttaagatgttaaatttttgactaccttgaacatgctaataaaacatatttctacctcttgtgtatagatagtctccc

SEQ ID NO: 21148 - DNA, 1202 bp, Mus musculus
ctttctttgtaacgtaaagtgacatgaagactcagttttgttgggtactttgaactgactaatagcttgctcttgattatatagtgaattaataattaaacaagggaaaaaaaaaaaggaaagacctaagcaattaaatcgtgcacttttcttcactgagactgggaaagtttttatgttcctacatgtagaaaaaccttgctgcattttagttttattttcaatcattttagctcttctttcttgatctgtatttgatttactgggatgagagaagttcagactctggagtgtatcgtatgactggacaaaatgtggattgtgattgttggatgtaaatttgtatgcttcacatggtgtgtgtgtttgatttttaaaaagggctgcttttacttcgggtacttttaaggattgtaaataacaagtcaatcatcacagtgctctttctgctgaatgattttagggctaatagtatggtaaggttgcaaaacagtggttttcgtatcatatttggggccctgctttaagatattacatatttattgtttatgctttttctgtataagctggttgaactttgttactcatctatgctttggtaagcagggatagaaaactaatcatgtctgactcagttctttagtgctacacagcaggcttctgatagtggatgtaaatatatttgaaagatgtttagtctcaccctcgatgcagtgttttctttgataggttcttaattttagttttttttaaggtcttcattttgttttcagtgttcaaatataaaaatggtgctaactgtaggatgtataacgaagctataaccgatgttatttgggtgtccaatgtgagatgcatgatacactttgattagcgttttcattgttacttgtgcttgtgttaatgattacattagtgttaacatcagaactatctgaatggcttgagttatacttcccatggcttttgaatggtgacttagagatgatgctttttccccttcttgttttagagattacatgtccttcagcacagaaatatatgcaccaaacccagcgtgctaggcaggtgtgcatcactttcttcatctcttaggtaaccgaatacttttaacttattgaggaagactggaacttgatgtttacttgaataaatggttctaaatttggttctgctttgtttaaagaaacaatctttcaaaa

SEQ ID NO: 21149 - DNA, 1848 bp, Mus musculus
ctcttcctctgcagctcggggcttggagaggaactggaaggctgggcttcatccagccctcccaagacggcaatggttccctccagctctcgctacctgacgaccctccatggcggccgcgccttccgagctgctcccgctgccgcctcctgcgacccctggttcctatcgcctcctgagccgctgtcgtccttacgccccagggactgatggtcgtcgatccgggggcaccatgagaggcgagaaaaactattactgccgtggggctgccggggatcatggctcctgccccgcgacgccgtcgcctctggcctcgaccctcctgttaccggcggaggctgtttcaactagctggtccgggcctggaagtgggctctcgggcggagatgaggaggagactcggcttcttcaactcctgcgcaccgcaccggatccttccgaggcgttccaggctttgcaggctgccttgccgcggcgaggcggccggcttggctttccccgccgcaaggaagccttatatcgggcgctgggccgagtgcttgtggaaggcggcagtgaggagaagaggctctgcttgcagcttctctcggacgttcttcggggtcagggcgaggcgggtcagctggaagaggccttcagtttagcgcttttgcctcagctcgttgtctcgttacgagaagataaccctgccctacggaaagatgcgctgcagatcctgcatatttgtcttaggcgtagttctgggcaggtcctgcgaactctcatccaaggcctggaaagtccagatgcccggcttagagcttccactgcgctgttgctccctatcttgttcactcctgaggatttgttgcagggtttggatctcactgaagtaataatatctctggcccgaaagcttggcgatcaggagatggaagaagaatccgagacagccttctcttcacttcaacaaattggagaacgacttggtcaagagaggtttcactcctacatctcgcgtttgccttctgcactgaggaggcactacaatcgccgcctggagtcccagtatggaagtcaggttccttattatttggagctagaagcctccgggttttctgaagatgctgccccgtgtgtagtgaatctttccagtagcaatcttaaatttgagattattccccaggaactccatgcaagactgttggatcaggaagattataaaaacaggactcaggctgttgaagaactaaagcagttgctgggaaaatttaacccaagttcgacccctcatgctagtctcgttggtttcattagcttattgtataacttgctagacgattccaatttcaaagtggtccatggcacacttcaagttctccatttgctggtcattcgcctgggagagcaggtgcaacagttcttgggaccagttatagcggcttctgtgaaagtgctggcagacaacaagttggtgatcaagcaggagtacatgaaaatcttcctaaagctaatgaaagaagtgggtcctcagcgggtgctttctttgctcctggaaaaccttaaacataagcattccagagtacgggaggaagtagtgaacatttgcatctgttccctcctgacctaccccagtgaggattttgacttacccaaactgtcctttgatcttgctccagctcttgtggatagcaaacgcagggtacgccaggcagctttagaggcctttgctgttttggcatcatcaatgggctcaggtaaaaccaatgttctttttaaagctgtagatactgttgaattgcaggataatggcgatggggtgatgaatgccgtgcaggcccgattggccagaaaaactcttccacggct

SEQ ID NO: 21150 - DNA, 1168 bp, Mus musculus
ctgcaattgtggataacaacctgaattccaagaatccaggcatctatgctgcagccacaaatgttgttcacgcactgagtcaacatgtaggtaaggaatcctaaattggtactcacatttttttgatgtcactttcatgctttctgaacccatgtatttttatatgttgaaataagtaatatttttcatttaatagcatttaatagtgtatctgaaactttttcataaattatttaagtgatgaaatatttaaattgattatctttttcattggatgttcgtttttttaacctcatattcatgagattaaaatggattatagatttaaatataaaatattacatgcttttggggcataacatggaaattatgtcatggcattataatgtaataaagctttagaatcattttgaaagaatgatctatgcattcagtaaactggatttctgtaacttaattgttgcatgaacctctttttttttttttccttaagacagggttttttggctgtcctggaatttactctgtagacaatgctggccctgaactcccgactgcctctgcctcctgagtgcaccatactacctgacttgatattttcctataattatatgagatgtaacctttcattgcgaaaggcttgtcagtcctacctttataacttcttgtgaatcttttgaaatgtgagtttggaaggagaaaagtgaagagagaaatgatgtagttataataaaaaaaaatacttttctaaaaatatcattaaatgtaaaaacttctccataaaaacaattttcttgttttattataaagccaccatcatttgaaactaagctgttcagatgccctgcagtagcttcttcagtgtcttatggatacttttgtttcatctttacctgttacagaaaactctaagtagggattaagtatgtgggcttcttaagttattacatctgcagtgttgagattgtttttcctattattgctgttattcagaattattgagatctcgttcttagacatgattcttgttcttttttttttttttattttagacaattacttgcttctacagccattttgcacaaaagctcagtttctaaatggaaaagcaaaacaagatatgacagaaaagcttgctggtaaaatatttttaagtaaactctatttt

SEQ ID NO: 21151 - DNA, 1171 bp, Mus musculus
ttggcaattctataaaagctttattgtttccttgccatatcctaagagcagctgtagacagtacaaaataagtaagcatgggtgtttacaccccatcccacactagatctagactgcaggctaatgtttttcattgcttgatataaagtctatttcaaaaatttaaacaaaagtataaatatgtaattactattttagggaatattaatgaagccaggattatcttgagaacgtttgaagaatgtgttctaggattggcaatggttcgattgcgaagagtaagtttagaacgacggcatggaaatatggaagaagccgaacatttgcttcaggatgctataaagaatgccaaatcaaataatgagtcatcattttatgctatcaaactagcccgacatcttttcaaaatacagaaaaatcttccaaaatcaagaaaggtacttttggaagcaatcgaaaaagataaggtatgtacattttttaacaacatttttcataaaaagctagtactttttccctttggcaactgtgatgaaagatttggtctatacagtaatatatttattactacatgaggacaacagtccctctaaactgatgttgccacttttaatattttttctttctttgtgtttaaagtgtgcgaaagttatggttacttaaagttgtaaatattgtgatctttgtaattaactttcagaaattgtagaaacttgatggttgttaaggatcagtggcctgggagcagcatttgtgaacaaagcataacagtagcaaagcagtatagtgacactcatcttgcaagccgttccttttatgaaacagggaataaaaactagtggaagtgtcttatttttaggattatgttgtttgatttttgttgttttttttttttaaagatttatttattacatgtaagtacactgtagctgtcttcagacacaccagaagagggcgtcagatctcgttacagatggttgtgagccaccatgtggttgactgggatttgaactctggaccttcggaagagcagtcgggtgctcttacccactgagccatctcaccagccctgttgttgttttttaagacagggtttctcaatgtaaccagcgctgcctgtcatgggcttgttttgtagaccaggctgtcctcaaacgcacagggatccact

SEQ ID NO: 21152 - DNA, 1155 bp, Mus musculus
tcagcatagatggagaaaaatattatttatctctacttttgcttcaatcatgttacggttacaaacgatgactgaatgcttgtcctggggtcacgaagttatgtatcttaaccccgtatgtagtatgtcgttagcagtgacagctcatttaaagcacagcaaaaactacattctatttacttatgttaattttgacctggaaactctggacgtcaaggatgacctagacctgattctccagactcctcctcaggccagagccaccgctccaggtttgagattgccttcaagcccgctcgagggatgggaagggtaacaaaacgaaaacaaacaaaacacagcaaaacttgcaaagatgctaaatccagacacccgcccccagcccgtcacacacttcgcgcaatacgcatgcgcttcttctgatttccggaatggcaaccaatcatcttcccgccgcaaaatcggcggcgggttctttaacccgccagtcccgcccccgggacccactgtgtcgctggcgggagactaatgggcgtccgagtcgcggcggttgcgctgccatccaggcgggttcctcagcggagctccgctgctgctgggcaccatgagcggacggcagagaacgctcttccagacgtggggcccgagcctcgtgcggggctccggagactcgggatgcggccagccgcgctcgcccgcgatggcggaggcgctgccggaggaggacgacgaggtgctgctggtggcggcgtacgaggctgagcggcagctggatcccggggatggcggcttctgcgcggctgcgggagccctgtggatctaccccaccaattgccccgtgcgcgactaccagctggacatctcccggagcgcgctgttctgcaacaccctggtgtgcctgcccaccgggctggggaagaccttcattgccgccgtggtcatgtataatttctaccgctggttcccttctggcaaggtggttttcatggcacccacgaagcccctggtaacacagcagatggaagcctgcttccacgtgatgggtattccacagtctcacatggctgaaatgacaggtatcttgagaaaaactgggctccccgggaaaggctggctcttgtggacatagctatgccagcagaattactcaatgca

SEQ ID NO: 21153 - DNA, 1165 bp, Mus musculus
tttaagtagagtaccagagcatgaatgtattaaaaaagtaggccagactatttatttatagtctatagatgacggtctgaagtttctgagtgttctctgtccctgtgtgtgtttcttctgttttgtgttcctgtatggcttggctggcctggaactccccagatagagcgagctagccgtgaacttacagttgtcctacctcaagctccagagtcctggggttacagggaacttttgctacaccctgcttcactgttactttgggggggggggggggaggtgttcgagacagggtttctctgtatagccccggctggcctggaactcactttgtagaccaggctggcctcgaactcagaaatccacctgcctctgcctccctattgctgggattaaaggcgtgcgccaccacgcccggcttcactgttaattttgtttacaggttcaactcaagctgttaacaggaaggagatatggtccagcaggagggttcttttcctgacaccgcaggtcatggtaaatgaccttactagaggggctgttcctgccacccacgtaaagtgtcttgtggtggatgaagctcataaggcacttgggaactatgcttactgccaggtaagctcttttttcaaatgctagtttgtagaggatgcataaattcttaacgggcttgggggaataagtctcagtgatgggaactattgctagtgtgattataaacgcctttcattcactctgtcagaacagagggtgctgggaaatctctcttgtccatttagatctgtatttgctgctttttttcccccttttcttttctcttttcctctttctttctcttttttcttttatgagacagcatctctctatgtagcgttgctggcctggaattcactacgtagaccaggctggtcttgaactctcagagctctgcaggcctctgataggcatatgctaccacactcaactctctgatatcttcttaactttagcaagagtattagtcagggttctctagagtcacagaacttatgggtagtctctatgtagtaagggaatttgttgatgacttacagtctacagtccaactcccaaacaatggcagctgcagctgtgactggaagtccaaggatctagcagttgcttaggtccacaaggcaagcaggca

SEQ ID NO: 21154 - DNA, 2051 bp, Mus musculus
cagcatccctccctccatggcctctgcatcagctcctgcctctaagtgcaagccctgcttgagttcctgtcctcgcttcctccaaagaagagactatagtctggaaatataagccaagtaagccctttcctccacagcttgacttttggttatggtgttgcatcgcagcaatagaaacctaagacaatacagtgctggggacttcagaaaatggaggctatcaggagtttgcaaacgctgtatcaggatggcaaagttggtgagctccatgttcatcggaaaactgtctggccaccacacaaataatgcttgcctgtgtgttcacatcttcattcatacacagaaaagatgagtcatctttgatgacatactcctggaataccaaaacattgtaggccaaggcagtaggcacatgctataaggctagccttggccttaacaagatcctgtctcaaaagagcatagaagcaagatgtattttagaatttttccaagaattaagtactatgatttattattggcaaaaactttataataatttgtgctgtatgtgaattatgtaacattttaagtatactaagtctaggacctgaagagatggcgcagaggttaaaagcacacactgctcttgtatgtccagcagcaaccccatcaggtagcttcagtggatctaaagtctctgccttcttaggcagtgcactgacattgtacagacgtgtgtgtactcaatcatgcatagtgagtaaagtagatgtgaaacacatgatctaataaagtcaaatgtttactaagtatatcattaccaccaaataaaccttccatccaactgtagtccaatatttaacatgaacttttgttttgtctcatgccatatgtattttaagatatgcctctgtttataatgtgcaataaataggagactttccccgtcttcatactttctccagtcccagcagacatacttcatcctacatctgacagaaacttcagaattcatctatttcaatttgtgttgctatcatcataaaaatgaggccttgaaactagcttgttcatatttacactacccagatatattttttactcaattctgaattttatcagctggtgggcagttagcaattacttctcagatccaaaatcacatattctatatctatgcattaaaaaaaaaattgctagctgtaaaggaaatttaatggctttcttctaaaacattacctatcaccctgaacacagcatcatgttatatattgacaactcaaactacattctgtttagggtgactctaaaacctttcttttgttctacagctagcaataactactggttacctgggagagaggtattgctggggattgaacctggtactttctgcatggcagacaagtgttctaacagctgtctccagcctcctccctccacttgttaagaacttttttttttgtattttaaaacatttattcatgttttctttgtgattgtgtgtgtgtgtgtcctctataagagcagcaagtactccttaatgttgtttttgagacagggtcttagttgcccaggttgccctcaaacttgaacctcctcctgcctcagtttcctgagtagctggtattacatggctaaaacacctagcctaggaactggcttaattaaaaaccttgttctacatagcgagccccaaggcagcccagctacacagtaagaccctgactagagagagacacagagtgtcaaataggaatgaatgagttacttttgactatatgttacagtgtgttgttaggaagtagtaacaaaatgcattattttcaaaaaacaacaaacccagaaacaaatatttcacaaatgtacatttttatttgcgcagtctaactagatttaaagggtggatgaatactactatagcagaggacaaataacttaggggaaatgttaaaacaacggcagaaggcaagttaccttttgaagcggtaagaaagggaaaccctgctcattatggcattgtaagtccttgtaagggtggatctatcagatagatatagcagggctga

SEQ ID NO: 21155 - DNA, 1229 bp, Mus musculus
tgtataactgtctctgccctccaggaacttacaaactaatctaatcctaatatgaagctagtagtgaagaaagtgtatatagcactgtaggattatagacgacagctcctagactggaggaactgaaccaagatatacatgggtgaaaattctcctttgaaatctgactggaaaataccagtccagaagggacattttaagcaatatatgaaaacactgtacctactcaacaactgattccagactgatttatggcttttatagctttgaatcagtttcagactctttatttatctatgtatatgagaacactgtagctgtactcatggttgtgcgccatcatgtggttgctgggaatgaaggttgctcgctctggtcagccctgctcactccagtctacagatttgcactgtagctgacttcagatgcaccagaagagggagtcagatctcatcacggatggttgtgagccaccatgtgattgctgggatttgaactcaggaccttcgaaagagcagtcagtgctcttaatcactgagccatctctccagcccttcagattctcttagatttagtgagtatttaaaatccaaacataggggccgggcggtggtggcacacgcctttaatcccagcactcaggaggcatggcaggcggatttctgagttctaggccagcctggtctacaaagtgagttccaggacaaccagggttacacagagaaaccctgtctcgaaaaaccaaaaaaaaatccaaacataggaaaactttaattgaaggttgttttaataatgaatagagcctggacaaaagacacatctgtttggattggtgagaacatgacttagtagtagagcatttctctggtatgcacatagactctgagtctaatccccagtactatctcaaaaacaaatactttagagctgggactccactggaacagactagtaattccaacacttagagggtcaggagatgaagtccaattagagctacaggagtctgcagtgtcaaaagacaagtttttatgaaaattcttttattttctgagattataattacattattcccccttctcgttcttccctccaaaccttctctacccacttgccccttttcaaattcatggtttatttattttcttagctcttagtcctttgaattatcttttaaatttttagttttctactttcaactttaggtactcttaaagaataatttatgt

SEQ ID NO: 21156 - DNA, 1201 bp, Mus musculus
ccaatcaaaagttactgcatctgacttgtccctcttaagttactcctgtgttttcacactaaattaccattttaagcaatgccaatacactcctaggtaactctcgacaagtaacaacgtgagttcattccaaaggctcttcaccataagtatttacctgattcacttgatcctctgagaactctaggaagttaggtcatgtgcagttaggtaaagtttaaccagatattttgactccaatgtgcattcctttttaaattttgacacaatgtctaaaaccccaaattgtttaaaaatacaaaaaaaaaaaaacataatgaagctcttgtttagctatatattagtatatccataaaaattttctgtcactgctgttcacccttctttttagtttcaaaactcaaatatggaagatttgaaaagaatcaaggctctgtctggattggatccctaacacaaaagaaatctaaaatactagtagatagaaaaaacaaatataagatgttacatgttaaatactggtgggtagcaaatggctggaactagaaaatctagagtaaggtgacacagattccaaaggacatgcatggttatgtactcactggtaagtggatattagcaaaaaagtgcagaatacctaggatacaattttaatcccacttagaagggggaacaaaataaatcacaggaggtagaggaaaggagggaactgggtgggagaggagaggggaaggggatcaggtatgggcaaaggggatgggaaaagcccagaaggccaggagaatgaatgaaaatatgcaacctttaggggtgggagttggtagggcactctagaaagtaccagagaccttggagttatgagactcaggactcaatgggggtgaccttagccaaaatgcccaacagtggggagagggaactgaaagactacatctccagtaggggagtggggggagggtatgggggactttggggatagcattggaaatgtaaatgaggaaaatacctaattaaaaaaatatatacatataaaaattttgtgctgcttacaaactgtttatggagccatgctgttacttttaaaaaatgttttggttttttttttttttttagattttatgtgtgtgggagtttgagctgcatgtatgtatgtgtaccacatatgtgcctgttaccatgtaacccatggaggttagaagac

SEQ ID NO: 21157 - DNA, 1878 bp, Mus musculus
tttcccccactttggctttttgagacagggtttctctgtgcagccctggttgtcctggaactcaccctgtagaccaggttggcctcgaactcagaaattcgcctgcctctgcctcccaagggctgggattaaaggtgtgcgccaccaccgcccagctgtaaacttttgtttttaagcctactacaaagcttaaggtcaaagttccaaattcggtgggcagtggtgggctttcttcggcctgaaagaaacctttcagtatttaccactgaggcctgcgcaggcgtagagtgacccggagattgagtggaaaggtctatcttcaagtcttcctcagtctctatgattcccgcaaggcttgatgggtaacagaaatttggcctccattttgcggctggcggtgggcacgcacggctgaggttcctgctgtcgccatgggtcgtcgtccggctcgctgttaccggtactgtaagaacaagccgtacccaaagtcccgtttctgccgaggcgtccccgatgcgaagatccgcatctttgacctgggtcggaagaaggcgaaggtggatgagtttccactctgcggccacatggtgtcggacgagtatgagcagctctcctcggaagccctggaggccgcacgcatctgcgccaacaagtacatggtgaagagctgtggcaaggacggcttccacatccgcgtgcggctgcaccccttccatgtcatccgcatcaacaagatgctgtcgtgcgcaggtgccgacaggctccagaccggcatgcgaggcgccttcgggaaaccacaaggtacggtggcgagagtccacatcggccaggtcatcatgtccatccgcaccaagctgcagaacaaggagcacgtgatcgaggccctacgccgagccaaattcaagttccccggccgccagaagatccacatctccaagaagtggggctttaccaagttcaacgcagatgaatttgaagacaaggtggcggccaagcgcctcatccctgatggctgtggagtcaaatacatccctgaacgaggtcctctggacaagtggcgagccctgcattcctgaggactttgctggcagaaaagaagtacagatgaggttatagtttgaaaaacgttaattccgtttattgactttagaatgttactttgcatagtatagaccattacaatggaaagtacctgccttaagaaacaagaaaactgcagtttatagagaaagaattttcaattttgacccatgtacttaaaatttttggtgtatactgcagtgtagcaaatgttttgtggtgacggtataaatggtactgtttgttatcttggattaagagtggctagagaagttggaagacgtgtgagaagttctttatagagaattaaacatgaaaattacatctcaactgtagctttggttgttttgctttaaacttgtcaatactatttttaaaattacccatagcctcaggttatcaatcttagaacagttgggtgtactgaaaaaggattttctagacaaaccttacattgtcctacactcaggagacagtgatccaatctttttttcatcacagaaaggttataggtgacaaccgagtttatattgcttgtatttggatcccagtggaatcaacaaagaagagaaaatgacactaaatcagccatctgttctgcgggggccttggagagtgtaatctgttgcttttgccctgtacaattacattgatgaagcaggtactttctatcttattttagaaatgatataacctaaaactgctgggttgtactgtttagttttgttgttaccttacctgctttttaacttaaacttctgaatcttagtcctggaatcagagcctttggattacctc

SEQ ID NO: 21158 - DNA, 1099 bp, Mus musculus
caaagctcaagtctaagtggattaagtacctccacataaaaccagatacaacgagtctaatagaagagaaattgggaaagaacctcgaactcattggcacgggggggggggggtgggggagggggaattcataaacagaactccaatggctcatgttctaagatcaagaattgacaaatgggacttcatgaaactgaaaagcttctgcaaggcaaaggacgtagtcaataggacaaacttggaaacctaagggttgggacaaacatcttcattcaccctacttttgatagagggctatccaaaatatacaaagaagacaagaagctaaccttcgaaaaaccaaacaaccaataaaaaaattgtgatatagagttaaacagaattcatgacaggtgaatgtcaaatggtcagaaaccacttcaagaaatgttataagtccttagtcactagggaaaaacaaatcaaaatgactctgaaattccaccttacaccaatcagaatggctaagatcagaaacccaggtgatagcataagttggaaaggatgtggagaaagaggaacatgactctattgctgatgtgattgtaaattggtaaaaccacactgtgtggagagagagagagagagagagagagagagagagagagagagagagggagagagagagagagagagagaacaagaatacaaaatatctatttcaggtggatgttctttcacaatccaaaagaaaattcaaacaacctcaggctaagtcactcaatgtatgataggaagtgttattctagaacgccacatctaaaatcctttgctctcaatgtacttttagaaatcgggtattctcaataattttcaataatgggtaacactattggagtaatatacttcttgattatgtaagtattaatgattccacaatgaaacctatgactactcaaaagatgcttgcaaagtctgttatatgcattattattcatgcatcatattttgctaatttagtaaattttaggtaaaaaattttaatttaagatttcttatctttaaaactcattttgcatatccaattaactttataaatatccaatatatatcaattaca

SEQ ID NO: 21159 - DNA, 1232 bp, Mus musculus
gctggcaaggatttggagaaagaggaacactcatccattgctggtgaattacaagttggtacaactactctggcaatcattttggcagttcctcagaaaattggacatagtactacctgagaacccaactataccactcctgggcatatacccagaagatgctccaacatgtagtaagaaaacttgctccactatgttcatagcagccttatttataatagccagaagctggaaaggacccagatgccctcaacagaggaatggatacataaattgtggtacatttacacaatagagtactactcagatattaaaaacaaggcaaatggatggacctagaaaatatcattctgagtgagataacccaatcacaaaagaacacacatggcatgttctcattgataagtggatattagcccagaagctgggaatacccaagatacaatttgcagaccacgtgaagctcaagaagaaggaagaccacagtgtggatacttcggtccttcttagaaaggggatcaagtatacagccttactaccctgaacgaaccccatctcgtctgacctccgaagctaagcaagttcgggcctggttagtacttgcatgggagaccacctgggaataccaggtgctgtaggtttaaaaaacaaacaaacaaacaaacaaaaaagaaagggtatcaaaatacccatgggagggaggagatacagagacaaagtttggagcataaactgaagaaaggccatctagagactatcccacctgggaattgatcccatatatagttctcaaacccagacactactgtggtgccaacaagtgcttgctgacaggagcctgatacagatgtctcctgagaggctctgccagtgcctgataaatacagaagtggatactcacagccatcctttggactgagcacagggtctccaatggaggagctagagaaaggactcaaggagctgaaagggtttgcagccccataggaggaaaacagtctgaaccaactattacccccagagctcccaaggattaaatcaccaaccaaagtgtacacaaggagggactcaaggcttcagtggtatatattacagaggatggccttgtggaatattaacaagaggagaggccctcggtgttatgaaggctcaatgccccagtgtagtggaatgctaggacagggaagtgggtgggttagtgagcagaagggtagggggtgagatagggaggt

SEQ ID NO: 21160 - DNA, 1194 bp, Mus musculus
tagggttacgtggggaagagaatgccccgctgaaaaagggagtcctccattttacactaaactcagggagctttcaggcatggtgggtcccccaacacagaaaaagccacatgggaaccatctttcagtttaagttagactgaccaggaaagctaagcaccccacccccacagagaatcaggtttagctcgttacttgttgaacctcaccagagctgcttttatgaagcattccagatgcttttaatgcatagccagggttgaagttcactgtaagaacagtttgttatggtttaaatataatatggaagaagggagatttggatgaggctggagtctagccttgagatgctgtaggaagagaaccattattttctagtctggtgttatgaagtagattgcggagagagagagtacttttgggcaggcccaggccaaggtgtacctgtgagtgattacaccatgcaactgacttaaagtaagagaagttttttgagggtctgggggaagggatagaggcaggcaagtggacttgtagagatagaaagacagatgggtacagagccatgagggcagagaaaagggggtcatagagggtgagagaggagttgcatgccaagaacgagagggacgatgccaaggacacagagagagcactggagtggctgatgggtcctttttattctcagcagacacctatcacacctgacagtgacagcaggtcatgagtcaagcaattattagcttcctgaggacaggccagtgaaattgccagcacacaaacactctgtccatatgtagtaaattagtcttctgaaccttagccagcctcatttagctgtaccagacagactacatgtaccagactacagcaaaaacaacccatcctttccagggctggctggctggtgcttttcttgatccacacccccacaaaaaaattccctgatgaggaaaaggacagagtacacattaacatgcccagagtctgcttttatttgtgccttatgttttctgaggctatagtgctaattttttattaggtattcatttcatttacatttcaaatgctattccaaaagtcccacacacactctcccacccactcccccacccacccacttccactttttggccctggcattcccctgtactgaggcatataaagtttgctcgaccaatgggcctctctttc

SEQ ID NO: 21161 - DNA, 1384 bp, Mus musculus
gagatggccttaatggagccgccacagtaaggtacagcactcctcagcttccccaccacccgcagcagggcccgcccggcccggcctagctaagcccgtaatggcgacggcagcaccgaacgccctgcgcgccgcccgcgggccttgaatttccgacacccagtcaccaacaatggcccttccctctaaccgcggtctccacaacccgctcctcaccaagagcgggaaccctggccgaacttccgtgggtgactccagtagagctgctggtgacccatcttgccttcagacgcccaacgaggagaaaggaacgagtcggctcgcgcaggcgctcttcaaagttttttggagctacacgctacccagaatacaacgctaagacgtgacgcgtacgccgtgcgacaacattggtccgcgtgctctgagtgacatttctaaggctggctgggcgggcacagtgagtgacgtcacggcccgccgcagctctagtatctccccgtcgctctcagcgctcgccgggcgcggtggcgcacgcctgtagtcccagctactcgggaggctgagacaggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctctttttggacacttaataatattaacattattctcactttctttttaattcacccttttctcatataatacatttcaaccttaattttttacattgtcttaacacaaacgttcgcttacaaacgtgattttttttttcctttactcactactgacacctactggcgtgaaattatatgacaacttaaatcaagtgtaatgagtaagagtcaacgataggggcctcttattaaatcttttgacctcatatactccaaaaagaaatccacatcattccatggatggaaaatagggtcttacgtatatgtgagtataccacccttgatacctaaatataatcgcctacatttacttttcatttgtttttgtgtagacaagactggcccaagactctcattttgcccataatagactcacactccctatcctaatgtctcagcctctaataatgggcttgcttgtgccaccaaacgcaggctaagtggatgaatatgaagaaaagtaatataaaataaaagttgttttcatcagataatttaatagcaaaacaagtaacgacaaacttcaaaagaca

SEQ ID NO: 21162 - DNA, 1231 bp, Mus musculus
tgacgtggctggggggaaggaacgagcccggttgttgcagaaacgactatatttcgttgtaagccattcgtagctagaaaacggagggaattgctgtggggtagtccgagcaaaacttctctacccggacgccactgcgttgtccttgcagtgagacctaagaaattggacgctggtttggggagaactgtaatggccactccaagtgtcagttcctttggacgctaaggcagacctcaactagcaatcctctgcctcagcctcccaggacacactccatcaggtctgagtttttaactgttaatgcctcgttttagtttaaaaaaacaaaaaacagtttttctataggcttgaagtggtaaggattgaaccccggtgtttaagccagtgctcatccactcagctgcgtgttggccttttattcacgtgggaaatgagtacttggtgggttcacaaattttcgaacattactgttttttttttatatgttcctacaaattatacctgtttaaaactttcgagtttgaagatctttaatgtctgaaactttcttacagttctcatcgcagacacttctactgcaaacatggtcaacgtaccaaaaacccgaaggactttctgtaagaaatgtggcaagcatcagcctcacaaagtgacccagtataagaagggcaaggattccctgtatgcccaaggaaagcggcgctacgatcgcaagcagagtggctacggtgggcagacaaagccaatctttcgaaagaaggccaaaaccacaaagaagattgtgctcaggcttgagtgtgttgagcccaactgcagatccaagaggatgctggccattaagagatgcaagcattttgaactgggaggcgacaagaagaggaagggccaagtgatccagttctaaaacttgtgttctctgagaggaaaatactgaagcagtagagaaatgacctgctagagaataaagttactgttaatgataccaagccttgtgttttgattctcagtaggattgcatatttagggggttttgttttcaaacataatttgagtctgggtctacctctgcctcctaaatactagaagtacagaattgcaccatatcctatttctaaggtgctgtgttgggttgaacccagtgctttctgcatgctaggcaaagtgtgtactaagtgccctacaagaagtcatacagataagcagtagctacagaataatgggcacagaa

SEQ ID NO: 21163 - DNA, 1153 bp, Mus musculus
tagtgtgcagattattagagaccacacgactcattgtgcattcagttttcagaatcccttgctatatgatttagactgatgtatatgattttgaaatttaaaaattgagtaaaaaaaattgggacctaagacaggttgtttgtgtttttaaattgatgtaaaaccaaacatttacagttaattttggtgaggaagctggcagcaatcccaatgcctagctagcactgggaacctgatggtcagtcagtttaggtcaggctcagctacaaaattaggggccagcctaggctacgtgagaccatgcctttttaaaaacaaaaacccctggagatacttttcttgaatagtttccttaataagagaaaatatttatgatttttttcaaagtattctttttttgtttttggttttttttgagacagggtttttctgtgtagccttggctgtcctgaacctcactttgtagaccaggctggtctcgaactcagaaatctgcctgcctctgcctccccagtgctgagattaaaggccaaagtatcttaaaaaacatttatttggggtcaaggagatgtggagatgtgggtcatcacatgcatatggaaggcagaagactgtgtctctgggattaagcccaggtcatcggccttggtgggaagccatctgtctggtcccgtagtttgtgagacctgggttggttctgtattccctatgtagcctggcctaccctcaaagtcttcctgcctgagtttctgaggctgggactaaggcatgcatcagcatgctgggttaaagatacttagttggactacaagtagatcctgggtttgtgttcaatttgatttttatattaaagtttcaaaataaaaattcattgagttaacgtttgttacctacattctcaagaatgcagttaactggaatatgatggaggaatacaatcctaaaatttgttcacatttttaagaagggaaagaactctcctaacagataatgatctaaaccagtagaaatgaaacttagctacttttgcaccagttttcataaaagtctgtcacatatataatttaagataatttggggtgtagttggatagctcagcaaatagagggtacctgctggcaggcctgacgacctgagttcaatccctgtactt

SEQ ID NO: 21164 - DNA, 1178 bp, Mus musculus
tagtgtcagtgagtctcgggtaagtgagtgagtagtctgaggttgccagtaaataagcagaaaagtgtggactaggaattactcatatctgcaggtccacttctctctaatgtatcctgttgtcagactaggtagtatgttaataatttataatagtattcattttttaatacaaatgtgagcatatttcatttaattctgttttaggggaagtttttcctggaagatcctactggaacagtacaactggaccttagtaaagctatatcctttaaaaaaaaaaaattcgccaggcgtggtggcgcacgcctttaatcccagcactcgggaggcagagggaggcagatttctgagttcgaggccagcctggtctacagagtgagttccaggacagccagagctacacagagaaaccttgtctcgaaaaaacaaacaaagaaacaaacaaagaaacaaacaaacaaacaaacaaaattctgtccaggcatgggggtgcacactttgaatcccagcactcgggaggcagaggcagggagatctcttaagtttaaggtcagtcttgtctgcatagcaagactctgtctccaacaaaaggggtgagatggggctggagaggtggctcaacagttaagagcattggctgctgtaggatctgggttaaattcccagcacccacatggcagctcacagcactgcggtttattattaaatctccttttaaggccaggcgtggtggtgcatacttgtaatcctagcacgtgggaagcagaggcaggagttttaggagttttaaggccagccttggctacatgtctcaacttttccctacagtaaataagacttcctcctaataccaccacaacccactacgaggaatttaaaacaacccgaaagctaaaagtcccttggggttcagactgtctactgacctattagtgttccgagcatatccttgagttcttcctcagctgctctgtaccagttccacagtggcttatacaccgaggcctgcttcgtcctggcagaaggtaagcgtgcgcgcccttttcatgtccttgcttgacagtaaaactgttcccacttggggaagacaccttacgatgtcgttccagagggtattcaccgtgaggatgtcaccttgtgagacggtgatgcttaagaaacagcctattagaaaa

SEQ ID NO: 21165 - DNA, 1133 bp, Mus musculus
agccaactcgtggagctgccttccaaaacacttacttcacagcgttaatcagaggtttggtagtaacaacacttctggatcataaagctttgtagataatacttcttctggtccacttgcatggagaacagccccgtacttgtcacacagtgtcatcctttgtataattatatgcatcgttgtagtttgcagcttcctgggttttatgtgcatgtgaatggcctagagaacctatttttgtgtctaaagtttacaataaatgtatttaacaccagtacctgtctattgttaaagttaaaaaaaattactgtgttggctttttttttttttaacgatttatttatgtatactgaatggtgttttcctgcatgcctgagggtgttggattccctggaacaggagttacaagctgcaatgtgggtgctggcaactgtacgtgggccctgtggaagaacagccagtgctcttaacccctgagccatctctccaacccctgcattgactttttatcccacgtctgggtataacaattttaacatttatcttttgataatgtggatgtaatgtaactgtagaaatgtgaagatgctccatctgtatgtagcctttaaccttatgtagctaaggctggtcttgaatcagtaaccctctatcttccgccccctcaagcactgcaactcaaagtgtgctgccaccctgggtgtgtatgctggggcggcagtgagccttagacagcccaagctgcaattaatgcactgctccaaccttcaagtgttggtgtagtcctgggacatgtgatggtcatggctactacccagttaactaaaaagtggcagcttatacctcatgaacagagaaatcatgtatggcttcattctctattctgataggagccagaagaatactggtccaggaatctttagtgataagcctaaaagccaaaaagcatctttgacctttcccagactccagacagtttctctctgtagctttggctgtcctgagctcaaactcacagagatctacctgcctctgcctccccaatgctgccagcaccacccagcaagaaaatgcacttctgttattacaggtcaagatacttgagcccagtggtggtgatgcacgcctttaat

SEQ ID NO: 21166 - DNA, 1334 bp, Mus musculus
ctaaaagcaagacaacacaactgtaaggaacccccgcccacccctacctacccacggactagctttcctccacaataggagaccaacaccaggaacagacagatattctaagtttcgttccttccagctagcttcaacaccttttcggacccctaacctctgccacgaggggtcatgctatacactgtatggtatacagtatttagaacagatggttcgctcatatttttccaatgcagagatatagcggagactgcaggcctagaaagcaacgcgatgcagaggaaccgtttgaggccctctcctttccccttcgcgaccagtttttgagagaatacgaacgatttgtaataaaacacaaggctccaggctccagcggaagaaggcggacccaggtgacatcacagtctctggaccgcccgagctgggcgtgtcagggcgtgtcagcgaaggctttgccctgcctccggtgacgtcacggcccgccgaagctctagtatctccccgcagctctcagcgatcgccgggcgcggtggcgcacgcctgtagtcccagctactcgggaggctgagacaggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctcttttggctctctatccctcactctttaaattactaccattattatagtgttttttcctcttaaacattaaaaaaggtaaagtatatttttagggtttaaaagatttagtcatacaataaaaatatacctatctaattatcttaatctccgtatttttatttaaatctttttcattccctctttctctctcacacacaccccaaacccccccccccccccagttttatctttccttcgttgttaaaacaacaaatttgttcaagatattcatggactggtggccgcctcactactgactcctatcggagtatagtcagaatgtgtttataaaaagatgttattgtcaaaagaaccagcaggggctgctagttcatttaaaagtggttggtaaagaacagccgcctgacaaaaaagcattttctctaacagagtactaacagtgtacgcttagtggtaaattataaatttacctatgtctatgttcctgagttatggaaatttttctttaatgtct

SEQ ID NO: 21167 - DNA, 1917 bp, Mus musculus
cttataaagaacgagtttaaactttcaaaggcagggcttaggggcagacccaactcgagtacaaaaagtgcgggctactttggcggattctatggaacactggcctcccacgtgtcttccaggaaactgaaggaaggctggggagagcgggaggggcttcgcgcagggggtccgggagcgagcctgggaagcgtggctggggcgccggtcctaagggccgacgaagcccgccctcggtggatccgtgccccgccttcgagtggcggagaaggagacccgcggagaccccgggtagagcgacaggtgggcacacggccagccccacgccagcaggttccgcgaggcgccggcgttgagccccgggagccgccgtagccccgccccccggcgcgtggcgctcgtgacgtcgagagcgcgggccactctcctttcagaggtcgcgctcttccgaacggtcgggccgaggcgcgcgtgcgcagttgggaggggaagtgaggcggtttcctcggcgccttttccggcagcggcggcggcggcagcagagctaggaggaggaggtggaggccggagggaacccgcgctcggggcggcggctggaggtaacctcaagggccgagcccgaaaggcgggccgcgtcggtctgggcgccccctcggaggcccggcggtaactcccttctccctctctgtgtccctgcaggcgagcacccgcgagttcccgcgaggatccatgacctgaccgggcgccgagccgcgctcgtcgtcggggtggtgaccggggtcggtgccgagtccggtgctcgcaggccggcaggccggccgcagttggagccggcgcgtgccgaggcggcggaggagctgtcggcggcgcttgctcgctcgctcgttcgcgcggcgcctgcgggggggaagggcagttccgggccggccgcgcctcgcctcgcctcgcttgagcagggcggcggctctcccggcgcagacgcagggccccggcggcgggcgatgcccgagtgagcgcaggccgggcccctgctcccctagccggcagcttcgcgcaggccgcagggcgtcctcgcagcggggcggcgacgtttcgggctcgcggcggcgttgtaggcttgaggggacccgggacacctgaatgcccccggccccggctcttccgacgcgatggggaaggtgctatccaagatcttcgggaacaaggaaatgcggatcctcatgctgggcctggacgcagccggcaagacaacgatcctgtacaagttgaagctgggccaatcggtgaccaccatccccacggtgggcttcaacgtggagacggtgacttacaaaaacgtcaagttcaacgtgtgggatgtgggcggccaggacaagatccggccgctctggcggcattactacaccgggacccagggtctgatcttcgtggtagactgcgccgaccgcgaccgcatcgacgaggcccgccaggagctgcaccgcattatcaatgaccgggagatgagggacgccatcatcctcatcttcgccaacaagcaggacctgcccgatgccatgaaaccccatgagatccaggagaaactgggcctgacccggattcgggacaggaactggtatgtgcagccctcctgtgccacctccggggacggactctatgaggggctcacatggttaacctctaactacaaatcctaatgagcgtcctccacccagcccccggaaggagagaaatccaaaacccattcctaggattatcgccacctccatcacctctttgaattgccactctctttttgaatctgaactctggagttactgttctacagtttagtggggttgggggttttctttgtttccttttttttttttttttccctcttggctttgcgttaggatgctctgatctgacatttga

SEQ ID NO: 21168 - DNA, 2664 bp, Mus musculus
tgccgtttgtcttttatatttaaggcctccccccccttcctccttagcgctaactttagcagtttcaaatgtgaccttttatagccaagaccagtatggtgaactaagcccacagtggcaagataatgagtaatagcagtgtaatgttccagttgcacatgagtgtgtcagacaggtaatgtcaggagcccctggcagtgtcagccattaacgtgcatgaggaggagtacagctcgagctcccttcaccctagctaactgccgcctagaacaagcagcgcagcctgtaaagcctacaggtctcttccactgcaaagttagcaacttcgctgtttccctcttcttacctttaaaaatactctttccagaaaatggagcaataatggtgtatgcctcacacagatgaaatatttgtagatattttaaagtgacttttggacaaaactggaatgttaccttgtttcaaatgtcttaagaccagtagttttaaaattactaaacatttgctcactaataaaacatttaaaaagtcaaattatatgcccctttaacgtagctggaaagaaaatacacattcctgttttcacgttacagcagctgactagaccgaagataatgacattttttaaatagatgagtgatctacatctccattaagacactggaaaagatgttttattttaaaaaggtatttagttttgcttgattgtagggtttactcctgcagatatcctgttggttcggtagtatatctatctcctgtaaggaaggaaatgtgctgaatgaatggcttagatgtggatgacaaaggggaagtaggctggacgggaagaacctacagatgacaatgaatgtaaattaactttaagggtaagcattgtgctggttgtatccggatcttaagatgatctggctaggacctgtaactagatggagaccactatagtaactttttgaaccaaatgttaatgtcattccgaattgtgaagcagcttctggtttctctgtagccttaaggattaatttagcgatcctcaaggaattaaacttagggaatttgggaaatgtagactgcacaggcagtgtactggaaaaggtggaatttttttttttttttaatgagggtgtctgaaaattaaaatcaagccggatatcatggtaaagttggacagtattggtccttcatgttttggccatattgtataatggagcttttaccaaagatgtaggagaagcaggaggctatacaaaaatgagctgtaagtaaaacatttaacctaaagcagatgagaaaaggtgctatgttgtaggctcctattggtgcagagggatttttgattcaagacgcaactaaagcctaacggcctcagtttcacattaatagaagcatctctaggaatgaggcggactcacttaagaacattttagttgcttttacagttcccaaagctccaccgtaaatgtaattcttagtgttttaaatgattacattctaaggtacataaatatggttatacaaatatcaatgctatagtaacatcctgaaacaaaataagcacaaaggtataaatgcctaaactggaggaaacttgaaaccctcatgttgattcttaaatgtagtgttctacttgtgacagacagattggtagacagccatttttttgtgtcttaaaataattgggggcatagttaaaattttatacaagtgattgctgttactgaatgttgcaggtgagatgggttatttttagcttatttgagatatctgaagaggtgggagggggggagacatatttgaaatttgaaaaccctaaaccttttggaaagaaattgtaattttcacttacatttctttaagactttaagagatttataattgatgtagttaagtcaaaccataaccattggtgattatgaagcaaaaattagagcctgcagaaaaagttataatggaaggattaaaaaaaatctaaagattttgttttaattgcatcaatttctgtatttgtgtgaatttataaacatgcagtaagttttgaatgaggtaaatcttgtctaatataagtaaatgagtctgtagactgtgatcccctcccccagctaaaaaaagtgcagtacttggaaattgttctttatggttgtagtgttgctgaagcactaacatgcagaaaataaaggaattacacagtgcagtttcttggttatgttacttggagtagataagtgggatgtattggtatcttgggccatgttattctccagggatatatggtataaaagtgaatttcagtctggctcttacgataaaagataaaaagatttttttctcccctaaatagtgactgtttaaggtgttccctgttttagtttcaccgggcttttgacaactgagggtacagtagcagttgaagatatttaggtcccccgccctccatcacacagtgaatccctgaccccttttgctttgctttttgagatagggacttgataagttgttccagtgcactttgcacttgtgctccttgcttgcttcatcctgcaagcctgtgctaccaactccacctcaggcctcaggaatctttttttgttgttgccctcccccaacccccacccaaattacagttttagcattttgaaagtacagaagtgagtttagaaggaattg

SEQ ID NO: 21169 - DNA, 1594 bp, Mus musculus
gttttctaagctgagaaatgaaagtccctaaaaggactgatttttataagtgcagtttaaaatcctgaccctgggtgcgtcactgtgtaattttatgtgtctcacacctcagtcccttggtcacactaaggtacccaagatgttggccaggattactagagattcctatctatttgggttttcagaattcctataagctttgtgaggacatttctccatttttggttaatatctaacttggaggcattcacttttgtaaaccgcgaaagtgccttatatccttcctatttacttcattaacgtggtaagtcagtgccaagtgccatactgtgtgtgcacgtgcgcatgtgtgggtagtaccacattgttactgtgtatactatatgtgtgtgtgcatgtgtgtatgtgtgtgtgtgaagtaccatattatattactgtgtatgtgtatgtatgtgtgtgcgtgcgtgtgtgtgctcgcgtgtgtgtgctcgcgtgtgtgtcttagctagtgaagtgtgtcttacaactcagaaagttagaaaatagaaatataagtggagaactggcagcctggccatggaaacaggcagcacttcgggagaccctttgtctgtcctcccgagcgttctctcaggttgatcttggttttcctcgtcaacactgtgatggatgtatgagagggggtgcatgttgatagggaacccttttcctgccacttgtttctcttcacttcagcccttactggtacatttattaagctatctaatccattaatttaaaaggatacatattgtgggcttcagttggagaggcagcatatcccaggtaaatagatgaggcagttactcaacccttgggctgggcatattgaaacactcagaaatcatttacagaaaaaccaagccctcgtggtcctccatagcagctgattccagaagaagcactgcagagcacgtctctgttctaagacgtcagtgacacaagcgtcatagtaaggttgtgttactttatgaataagatgagagtcttctccttttagctgtggtgagagaagtgtgcatgttctgtttcatcagctgtgagacctgtgcacatacactaagctgtgaaaaaataaagttacaaaataactatcatgatagaagcaatccttactccatttgggtctgtattgtatatcccagaataatagtgaaaatttgttgaaatatgtcagttaatctgtttgtaaaatatttgatatttatgtcaataggaattttttgttaaatactgatatataagaatttttgtgtctttctgagaaaataaaaatgtatattagtattaaaatattttaatgtttcttggtgttatgatcatattttattcccattaaaacctcgacagaggagctggagaaatgacttagtggctgagagcactgactgctctttcaaaggacccaaaatcaattcacagcacccacatggcagctcactgttgcaggatatttgatcacactgaaccctgagattgtgttgttcactggaaaaacacaattttgttatggcttagccttagcatacacctttaatctcaaacaatgaacata

SEQ ID NO: 21170 - DNA, 1269 bp, Mus musculus
gtgtgcttgtatgtggaggccagggtcagtatggagtgtcttctccagtcactttctgttgtgtagtattcaccagaaaagactactccgacatgggtttaggccaatagaaagtctttattagccagccggtgattacactgggtgtttgggatcccagtgttaccctgagcctttctcagagtgaaattttcagcacaaaacccatgttctgagttgatgtgcttcgggtaaaaggagagttagccagcagcagaactacagaagccagaaaacaaggttagcacatttagagactttcccagaactaaggactttgatggattaggtctttgtttttcttttggcaggtgatactgtttacatgttgaattttatggcctgaatggtacttccatcaaggagtcagttttgctaaggggccctgttacatttccaccttatttttcgagggtctcacactgatcctggagctcaccaattagggtagactggctggccagcaagggctccttcagtctctactcccccactactgctgttacaggtgcatgctgccaagtaggctttttacatgaaagccagggatctgaactcaggtcttcttgtttgttggcaaacactttacccactgacccatcctcttgatactggcttctgataatgacatcaccatttcaccagtgggccaggaccaaagcttagtcatcttcaagtcctctacttcttgtctctgtatgtcccctactgagtcatatggagtcttaactctaatgtcattccatccttctgtaactaagtcctatccttgtagccttttctttgtagcccttgctgactatttctgggccattctgtatttacttatttgcctattttgaaacagactgtagctatattgttttcaggctagcctcaaattcctgtgctcaattgattctcctgcctcagcctctgaaatagctaggatcacaggaccatgtcaccatacctgacttgacctttggttttgatgttgctgtctgggtaaatttcctggagcacacagctttaaccatgccagtactcttattctgatatcccagtgactccctgctgtttgcagaatatagtccagatatccggctgcaaggccttctgtgacctggcattaagtgtctgactctccttgtcatgaccaccatgtacaaaccaaaccgatgtatagcatgccttaatttcctgccttggcttaaaaacctagcctaactgcctgggttttctgttgaa

SEQ ID NO: 21171 - DNA, 1535 bp, Mus musculus
aaacagaagccgcagtactgaatcatccttctctttgccctagctgaggcttcaagacttgctctatcagaaactggaataccttccagaactcaccctcgccctgggggtgctgtttgtttgtttgtttgcattatttctagtattttacatataaagagatctgttttgtatgtgtatggaaataaaacaaaactaaaaaaaaaatcaatgaaataaggaaaaattataatattaaagtctcacacgagtttcatttaatgtgaccctcaagactgttgctctgagaagccattgtaaatatcttctgcatgttattttttctaaaatcatgtaaattgaattcatgtttaaagccataaaagggcacagtgaagtgattgtttcttctctatttgcaggaacctcaagtatttgttcttaagtgatcttcctggagtaaaagataaagaataccttgcccaagtctttaagacagcactgccttctctggaactaaaattaaacctgaagtaaaataagtgtctggtgtcactattaaggatcatttgaaattgctgatactagacagctacaaatattacatagtcaccaatagaactgtgaaaatgattcagaaatggagaatggatgtcaggaagagaataactcatcaaaagtgactcactaaagttacttagttaaaagtgagaaattatgtacattgaatcattttttttaaaatacaacatagcattttaattctaatgtatttctcattgagatatatatatatatatatatatatgttgatgtagagttctttaaactgcaatgcaaatattcttccttacaataatttacaccacattgaagcatgttactgtaactctacagttctgaaacctgaaagcacaggtactgactcactgctggaatccactgtaccgagctgtcgtggcattgagagctgcgggctgtatggcttcccgggatttgcatacttgctcaagctcctgcattgctgcattcctagtcatacatacttttaaaaataccctttctcagaaacagagctgctggctactctgtcctactttaaagcctgggctacttcctgctggttaaaacagaacgcaatacttatctacacccaactagttttgctggtaaaacaaacagaggaaacaggctaccctactccccatctgcttcaaacaagaatgtgtgtttgttagattctaattttgctatctctcaaatacctttggattctaccttctatgaactcaaggcatataaaaatataaatacaaaaatgaattttatatctagaaaacactaataaagaatgccataagtaagtgaaggctagtctttactttcttgaaatagctgcaattccatcattgttagttgtgtgctgtgtgctgtgtaggtttctggatgtatatgtgggtgccaggttgctgaatctaaatctaactagggctggccttggacagtgcagcattcaggcagaaaaatgaatgttagctgtattcagaactatgctt

SEQ ID NO: 21172 - DNA, 1704 bp, Mus musculus
ggaaacagctagtcaatctcttgccactgtgtggtggttatatcaagtttgcttaataaaagctatgagacaaatagtcctctagttccaagaaacacagtcctttttaaaaaacaatgtttgtaacaaggtgccatggtgtttttaaataactcatgattctctggagagggagtttactgagcattatatcattttataccatgtcttactccttcttagtgaacataatttgataagacgttatcgaacaagcctttcactttgacattggccgttctgtatgtttttgtaagatagaatatttaatccttatttattaatctcttgctggagtggtgtaatgtttctaacttttagcaaaggaaggttgcagagcagctgaaattttttataatgtgtgaaaatgttgtttaccttctcagagtagtgctttgggggttcctggcggcgtgttggaggtctagcacatacagcttcccttaacagaatattttacgacagtttcatacagggttgccttaacgggaattggtttccaactccagatggttgtaagggctcgtgcagaaatactgatggtggacacaaagcctcagcagggacgtgtagtgtccaggtgtgactaccggagttttgacaagcagtataatatacctgtgattttgttttttacattagggataatgcataagaaattaatctttatatatatcatgacccctaatgtttgggaaaaaagtatttaactgcccatattatgtattttacttatgttatgccaagggagaaagtaattacacgtgtaatcttggggttttcacatacatagatattcattgtgagtaggcttaaggaaaaaaaaaactttaagtgaaattggaatttctgatgggatagtatagataaatgatgttgttttatattttttaaaaaaccagtatactaaaattaaaaaaggatagggttgtcttttagtttgtttttattttacaattcttagtattcagaattgatgtgttttattggtaccagctgtcttaatgcatttattaagaacagttagcattgaggtaatgaacacaggggctaagagtagcaaacgatagacgtagtctgaccggatacttgaggaaaacaatgtacctatctcatctttacagttttataaagtccatgttatcatctccaccttccaaatgaggaggtaagagtttaaccaagttaaacaacttacacgttacatactggttagttctttgagccagaccaagagtcctccgactctgctcttttcactatgcaatatacaagtaataaaatgttacgcaaatgaactataaagtatttgttctttaaagtgcacatattggggttgggcagcaagatgctcactggatagaggttcttgccatgcaaacctgactttggtccccagaagccacccatgtgaaggtggagggagaaagaattgactccacagtgttgtcacctgaccccaatgagtgtgtgcctgcacacacacccccaatagtcaaatagaatgcacattggctgtttacatgggatgtgttaaatgggctcctcaggaggagtgccacacacaacagacaagcctctaactcgggaaagtgaaaagacctaagaaagggcctggccaaggcctcctgctcacaagctgcatggctagaaaacattacagta

SEQ ID NO: 21173 - DNA, 1940 bp, Mus musculus
gccccagctcaagaaaaatatatctaagtagcaagttttactaacgcaaatactttaacatgaagctgagttttatgtataataaaaatatctataaaaaatagaccagtttattgttgtaaatgcacatttctgtcttatcttattaacatgttttcctacagatatgaccacattctgaagtgggagctcttccagctggctgacctggacacgtaccagggaatgctgaagttgctcttcatgaaggaactggagcagattgtgaagttgtacgaggcctacagacaggctcttctcactgagttggaaaaccgcaagcagaggcagcagtggtatgcccagcagcatggcaagacgttcttaagttaacttatcacaagccaagtttataagagctttaaaatattttcagataaatgactgcaaacaagttctttggttaataaaggtaacttactatttggaagtataaaattctagttttacatatattttgttatcaattttttttcttttattgaaccaagaaagttttatcatttaaaaagccaatatggcatatgctaccaaatgctgtattaggaaactgctggagactctggacaaaaagtagtacaggaagagattatcagcataaacaggcattaaataggaaaccgtcactctctgactttttatggacacacccttcttgtttaggaaacagaagaggatgagagtacatctgtgatcagttgctacgtgtggtgtcaagtgttttctggaatgagatggtttgactattaccataggtatagttcaaaatacaaaacaggacttggaacctttattgtaacaagcttgtacgtgtgtggtcatctcccccccgccccctcagtcccccgacccccaatgtaaggaacacctttgaaggagaaagatgaagtctttgaggaatacattcagaaatacaggactataataaatacatgcctcttagtgcgcaactgttgctaatacggcttccttcctttgaggcagagcacataagtacagttagcatggctctgagacacagcacaggcttcctgaccacatagaatactgccttccatcagggtgggctaagttgccaaaaacgacaatcagggatccaataagcaatcttggtcacttaagtaaattttatattgccttttttatctttgagaagtatttgtcataaaggtgtagaaacaggctgtcattccttcctatttttcttgctttgggtttaatagttgttcataattagtgctgaacacttgattacagataaacttatggaacttccagctgtaaatctagaattcttgagcttcatagctcttcagttgtgcttacaaatgttgtgaatatgtatatatattagttcttttcctaagtataagcactccatgttagaagtgactttgaattattgataaaatttcgcatttgattttatataacaagttattaaatatatttttgtggaaactgtctggtccttgaatgcatgttttggtatatttagtctaatgtttgatgctttatacttgttatgctttatcattctgttcagaaggcccacaagcctataatgaaaagagaagctgaagctaaaatatggctactgggacattatcaggggaagagaattagtgcgcatacggccagctgtctgtaaagaagtgtaaacttctgttcagcttgtaagcttacacacattcttctgtctctcttactttctgttcaccatttctgagacagttaaaaatgtctgcttgggctcccgggtagatgaggcattaccattcttccattactagtctctcctctgatttattttcctctaaagggtttagtttcgttaacaaaattccactaaagatttcagttattagaaatatattatagccaggtggtggtggtagtac

SEQ ID NO: 21174 - DNA, 1153 bp, Mus musculus
tggaggtttaataaagaaaaccgtaacactgcaaagcatgcttgagacgagaccctgtgcacctccaaacccaacattacttcatgaacttgtcctgctggtcagccagaatcttggcagaggacttggtgtcatagaagagctcgatggtctcttccacatgctccttctcagtgcttgtccctccagttgatctttgccaacaggttggctggggtcagcagctgcactgaatatgtcggagtggtcttggtgccaatctccccaaggtggctcagtgcctcctcactgatgttgatgccttctgtctgggcttggatctcagtgatctgcttcatctcctgtggtgtatacagcatggtcctgatgatcatcacccggtccagctaagctgtatggtcatcataattactggcctaggtaaagggcttctgttttttaataaatgtcaattctttgttctcagtgtacctcggtatgatcagcctccacccatcacgtatcagccacaacaaactgaaagaaatcagtctctcctggtccctgcaaatccctaccatactgcagaaattcctgactggcttcaggtttatgcccgagcccctgtgaagtaagtgagcacacggcacgagtatctttggggtctctaaccagcttaagtaccatgcatagtcagtatggattaggtggtggcagcacatctttaatcccagctctggcagggtggaggggatgggggtggggataggacccagatggggatgacaacatacaccagaggcaggcagccctgtgagctagaggccagccagggctacagagagaaccccaccccaccccccaccccccactccccacccccaaaaagtattgtggttttcttacactattgggcttctatgtgacatttaagaaaggatatcagaggttataaattttgattctttgattagaagtaaaaattcttcaaagatgtttgaatcctaattactttgtgtacaaacctctggtaatggatacataagaataccaaatatgacatttaatttttgttttcttttttatatgacattaacatgtaacatgatatagtacttacaaccaaggtacccagttaagagcttggtactgtggtgacacacagcagaacact

SEQ ID NO: 21175 - DNA, 1451 bp, Mus musculus
aatctttctactcagtacttgtattagctttagcagaaaactgtgtcgaggcctagactcaggtcagaggtaaactgtgtcgtatgaagtagtcctgtggaagcttcaggttctgaaggttaatttcactggaactaaacagcaagcacatttctccaacagctgcctgccatggggccttctgtgtgtgcttcttaattttattttatattataaaaagtataggttggtgtttcttataaatttgtattcatgtgtacataaagagttgtacaatgactgtaaatatgattttttgaaaagttttagagttcatttagaattgtttcacccaaaatcaaaatgctactttagtaaaatgttaatttcttgctttaccccacttactaaatagggaggagggaagatcaatatgagaaatgtctatagatatcttaaacttatacattcatgcagcagtttatattttagaaatcttttagcaagggagtttaactgccatgtagaatatagcttaaagctttaaaaacatcaaatgtaaaatcatacaatcatgtgttgatttaactctcagactttcttcccagtggcgctctccaaaatcacaagttatgtgttttatggccatagctactttttctttttcttttcctttttctttttcaagcactgggtttagactctaagacattgctgggaagcgctccattgccctgtctgctgtcttctcatttttaaaagccttactctgttgtttcccctaaggggagaaaggatttattttatccaaaggccttttctcttaaagtgagtttgtgaggggagagaagtctgtgtgctttaggatgaagaacagtattttcatttgttttcaaaagctctaatttcagctaagccgttttaaatgtgaatccctccttgaaactgcaatgtgctatttgtatatttgactatcagcatgttttatataaacagattatgaaagacatcttacaggtctagagtttcagtaataaatcaatattcagggcaggtattgagaaactttaaaaaaaaaaaagaaataactaaggcttcttggcaaactttttttaacatgtggaaaataaatgtgtgattccccccttttacttcgctgagtaaagaaaaagagagcactgctattgtcagcatctcttaaaggcattccctgtcacaaaagtctgagtccagtgttagtcgagtcctgttctgaatgggttgcctgcaatgctatagcattccagtgagtcattagccaagccaaaagctgggtcgaagcctgaggagcaaagcactcgctggaaaggcagtcaggagagcgtggctgcccctacttgaacatcttagcactgtgaagatggagtttcaggcagctggacagctatttaatagcaaattaaagttgtgccttttcattttgtttttttgga

SEQ ID NO: 21176 - DNA, 2372 bp, Mus musculus
agttttagtatacttatagaccgaaaattaacttcaagttgtaacaagatgggtctgtttaatgcagtatattttatctcagcttctacgttcactgcattgatattgattcattaatgttgggttaggtgatttgaatgtgataaatgaatctttgtataatacctgctttattctctttgaaaatctaaacataactgtcagggctttcgagtccttctgtcgtaattttactctaaagcaaattcagtacattaactaaagtgcatttctgatctttaagaaaaaacatcaccagaattttctcaacctctgaaaaaagtggaggaagagcaggaggctgatgaagaagatgtttcagaagaggaggcagaagatagagagggagcaagcaaagccacttctcagagcagcataagacaacgctgtgtgggcctcccatctgccacggacacatcctaagttttacatatatcttaatactatgactttggcaaaactgaagctgggtgatcatttctattgcgagctgaactatgacttgctgtgtatacagtgtaggtcctttaggttggacagtttccattcaggaaataaaaacagacataagagtttgaaaatatgacttaagaatattatgatggtttaaagttatttaatttcagaagatcctggtgccaagcagtaagatttgtgtttatatttaataatctattttgtgtgagattcgaaactgcctttcccaagatttgcattactggagtatttaagaaaattaccttagagagaaggatttctcatttcacatcatttttctcagtttcactgtgtgaaaaaggatcatatttcccataagtgggaacattgcccattatttcaagacatatacttcattgatagtactgcacttaggtagagtccaaaatttcctcatagattttggattatgcagctaacaaaactaccttactttatagctttcatttctacacattacatttaggctatgttgctgacttaagaagtttttataagtctatatggcattggattaattcttaaggctgacgcctattttggtgtcttgttcactgtatgatttttgttatttgccatgtgttacatttctaagttggaaaaaattaccagtatcactgttgtgtttgctatgggtaaacagaacttttctatccttttaggatgaagtttactgagagaaccatcaaatcgaactgtttacttgaaaatgtacaaatttggctatacattccagattttaaattattattctgaagttttctcttttttaatgtgaagatgaaattttctgatttttaaaatttgatgtggaaaagctttggtattttatattttggaaattcagaatttaattgatgtagaatgaagtctgcattctactcaagaaacatctactactatgtgtttttagtgtaattctgtcctccacggggtcttgatgaattttataatcaggatattgctttgtgtttgaatattgtaacactattgtgttttaaagacaaattatatattgtattgttgttgactgctagtactgtgtatctcacaaatggaaacaagatcggcaaaaggactacatggatttcatcttacaaagtgggaagggtatcatgggggcagggactgtcttgatgtctggagggggaaagcagactgaattcttgatgagtcagtcaccagcctttatggaatagatggtgtctgtgacactccctccccttatgttctctgtgtgacttccttagacttgcagtactgtgatgggcaacagcttcttttaggcctctcctttatagtttaaatgttctgctgtcagagtttggatatgtagtttgtggtggcttagaaaaacattctaagcacaaaataaatgtttctaagcacttcagtgatgttgaagagaagtttgatttctgttagtttcttttcagagtctcgtgtatcccaggctgacctccactactgtctcgccaagcgtgacggaagcaatgggagcacgccatcaccaggggccctcctgcatgcccagcaagccgagctcagtctccggcccaggagtgatcgctgggttcctgttgaaattgtgcttaatcatttgccactcggtggtgctcgggggcgtgaatggatgtgtcactgcatgtgtgcttcctgtagacccagacactagtcttctcgatcatgtcaggagaataatgctctgtaggcaacattttttttagtgtttccgttgtatctctaacattgtcgggtctttcattagaaaatgctttattacagaaaattaaaagtatcctgaattaaggtgttggtgttctcataagcacatt

SEQ ID NO: 21177 - DNA, 1118 bp, Mus musculus
atttatgtttatcacgtgaaagatgttataggcttatctgtttgcttatgggtttttcagccacttcctcatgaggcacggtttgagggggaggacaaaggggagttctctcttcttttctggagagccattcttagtacatagccattgttgcctcacagaggttggtccgaaatgaacactgaagttggtgggagtcttatgttctagccaaagatgtgtatgtgatggaagatggaagccccactcagagtccagaaggcgtgtgccgggacactgggctccttcacaaatggacagtgctctgtccgctgttttgttcttccatgaccttcccaggaagctctgggattggcctgtgcttgtgacatggtacattttgcagtttacaaagctggtgtatgttaacaaccattgggaatgtctcagaagacatttgtttggttgtatttcctttgttggtttttaatggtggccaacagatggtgatgctagtttctgctttaacaagatacccttactgtatgtatatgttatacgtatctagatacgtgggactctgtgtgtttatgtgtttgaagcttagtgactcttcatttggacttcagtatatgtcttgcacacatagaatttcttgtttaatgtcaaggatgcttagacacagacaatcagttgataaatgtagagttaagagtgacttttccatgtgtgcctttggccaagattctcaaccctgattgcataatagacttgtccagagagcttttaaaacatgcccgggtcccaccaggccagtttaaaccagtctcctgtggctgggagattgatttaaagtgtaccaggttgagacagtaatgcacagtaggattggagatccaagagtgtctttctattcattttgaagtaaaagtatacagaaaatattagtgatagagaatgggccacttttaagacagggcctgctactgttacagtgtataatgaagccaggagaatgagtttggtcaacttgatatccattgaagacgttgctcgcccttcaggagagaacttcatagcacaatgtctttctaggagatgtttttaatgatttagtattttacaacatttgtttacca

SEQ ID NO: 21178 - DNA, 1113 bp, Mus musculus
ctcatatttttgtacaaacttatgtttccaagtaaggaagaaatagatgtagggtcaggcagaacatagcagtgtttccccctggctaggtcagtgtcccagagcccgtggtggccacagacatgcccggtcaccatgctgccctcctgtgctggcacggcctcagcagggtcacatccagtaactctcacctgacactaaagaaggaaaaagaagttctgtgctcatgactttattttgcttttgttgaatgcttttagaagaaccaaagtttcagatgccagaatgtataagtgtctcagtgtccacagataggcaaagggcaaaggggtccgtcacctgatggcttcttttgcttccgagtcattgcatagtctcatcattgctcacagatgcttaggggccacaccctggtgaagtacgcgatctccagagcacagatggccgtgtattcccacagccctcggcatctcttgcagatgcagagatggaaaggttgcttgcttggctgtgtgctttataccttttttctctctgctccagaatccagtcttcagggttctgcccaggctgtcgatcgccatttgccctcttccaggcagacttggaaatagtcttaaagggttttcaaagacaagatcagccaggaaacagtttctcatttctgacccacgggagaatcatagacatatatgtatgtggagctccactttgaagaattgacattcttgtattgggcagtcgttttccaaagtaaaaggaggaaagtataaagccgtcactcacgctgcacttgctagcgtgtccatggctggcagacgcaccagtgcatctgtcacctccctgcgtcacctgcatctgtatttgcaacggtgagctttgtatctaagtaagctgtaaacagtcctttctgtgaaaggatcatcgtgtcgggatgatactgaaagtatgtttaaaaaaaaaaaaaaaagctacggcgttattttgtaattatttcttagaggtgtttcatggtatgcgcgaccatcaataaagttaacttttttgcctttaaggtgtctcttgttattatacgtctcaaacaggaaccagaaagaattcattgtatgcttt

SEQ ID NO: 21179 - DNA, 1180 bp, Mus musculus
ctcttccaggggacataggttcaattcccagcacctacaatggcagctcacacctgtctgtaactccagttccaggcttctgacacctacaaactgaggtacatgcaggcaaaacaccaatgaatataaaataaaaataaatgatatctacttacacatataataaatgcaaaaatacaaatatgtatatatacagacacacatgtgtatatacatttaaattcttggtgctattctcgtgtggtagtacatgcctttaatcctagtactcagaggcaggtggacctcttgagttcaaggctagtattcaaaaaaaaaaaaaaaaaaaaaaaaagcagtgcccagagttaaggccgaaagattgagcccacaagttaatttatccattttgttttaactagaattaaaataataatttttagatttatttttgtgggtttttttttttttttttttgcatgtttatattacaatgtccatgcctggtatccacgaaggtcagaagagctttaatctagaactaaagttatggatggctgtgaatcatgggtgctcggaactgaacccaggtcttgtgcaagagcaacatgtcctcttaaccactgagccgtctctccagccttctttaactagaatgatcatattattctgtggttcttgtaataatgttgtgtttaatgtagggacattctgtaaccactactgagaacagcgagctttttgtggaaaatgtgacagcatttatttttcagattgcatagatatcttatgactggaaattatcacctgtcttagtcagggtttctattcctgcacaatcatcatgaccaagaagcaagctggggaggaaagggtttattcagcttacactttccattctgctgttcatcaccaaaggaagtcaggactggaactcaaacaggtcagaaagcaggaactgatgcagaggccatggagggatgttctttactggctcgcttcccctggcttgctcagcttactttcttacagaacccaggactactagtccaggggtggcaccgcccacaagggaccctccccacttgatcactaattgagaaaatgctttacagttgggtctcaatggaggcccttccctaactaagctcctcctctgtgataactccagctgtgtcaagttaatacacaaaccatccag

SEQ ID NO: 21180 - DNA, 1139 bp, Mus musculus
tggcttttcctagactagtgcattagcacataactgctggcctgcccctccccctcccccaggctggtctctgcactagatctgaagctagttttttcaaaccagaaactacatgtgatccctttgggaataaataattttaggacacaaaagaggtgttttttttttttaactttttacttaaaatatttctaaagcatgttatgtaatatctctttttcaaagcagtgtacttggcattacttaatgtcacattattccagatttatttattcaggaaattcactgctgtcaggacctttggaccttacacaaatactgcctacttaatttttaaaacttatttctcttttgctttatagttagttatttatgtacattttatttgggtagaggaggctcaccagccatgctagtcaggggcttgaactctggctgtgaggcttggtagcaacccgccaccattatccactgagccatctccccacccctgtgtatttaaggcaggagctctagaagcctaagcagaagatgaccttgaattccccctacctttacctcccaagctctgggatggcaactgtatcctatttcctgctctactatctggttttgtatttgaaactttgtacatagttgggtttttgtttgttttttgttttgttttgtttttactttgtagattgttcattagcgtctatgttaagttctccctccctcgccctccctcaccttttctgggatgtagtgttgctctgctgcccaggctgaccttgaattcctgcgctcttgaattctcttggctctgcctcctgagtagctgcgactacaggtgcaggtcattgtaccaagccttttctttttcatttttttagatttatttcattttatatgtatgagtgtgttgcctgaatgtatgtttgtgcactgtgtgcatgcttggcgtctagggaagtccgaataaggcatcagatctgctggaacaggacttagggacacctgggagacactgtgtggactctgagagtcaaatacttctgcaggagcagcaagagttcttaactgttgaactgtctctccagccacttaaaaagtattcttagggctaaagagatggctcagtggttaagagcactgac

SEQ ID NO: 21181 - DNA, 1235 bp, Mus musculus
cacccggacacgaatggaagagcaccagagcactcccgttccggtcgggggggggggggttggatctttgcgcgcatgcgtgctgacgctcaagggcgggttttcggggaagacggtattgacccgcgaacaaccgaagctgttattctatcaaaatcaagacggcgtgtgtgccggactctgtggagactctgaagactaagttgaggtgtccgaaattgcgtcctgactcgtagaaagaaatctactaagctcttatgagggtggtgttttaaaaaacacgattttaacgttgcctgctcgtctgggtctccttaacaaatcctaaccccgcctccacgtctgttggggttttcagctgcagctctgggtttggaggagtgcgtttttattacggttcccgtggcttctcttttgctcttggcataattcctttgaaatttatttcttcgatgcattaacagactcagtgggatcaagactttttgttttgttttgttttttgtttttgtcgtatttagccctggattaaatgtcaaaatcgaaatttacagctttatggatattttgcctatagactttctaagttaatgactgcttcataattatttttggaactcaggtgtttttcaaattcacttccaccattacttcttttcctggtactcaaggagaaactgcgtccttaagttttgagaagctagaattccctctgttaagaacggcgggacttgatttgtgactaaccagatgaaaaacgttgagtttagcctggaaagggggcaaaggcttaaaatgccagcgaggaaactgcgagagattgtttctccaaaccaagggaataaattggctgtggtggaagatgagctgccccgtgttcctccagccctggctgcaaataaacgtcttgctgttgaaacgaggactagttctaatggaacgttatgtggtatgtgattccaaatgtttcagtttcccacccagtttacgttttctctctctctctctctctctctctctctctctctccctctctctctctctctctcttccgagacagggtttctctgtgcagctctggctgtcctggaactcactctgtagactaggctgtcctcgaactcagaaatccacctgcctctgcctcccaagtgctgggattaaaggcgtgcgccaccactgcccagccagtttcctttttttataagtcattagtctttatcactattttgagt

SEQ ID NO: 21182 - DNA, 1140 bp, Mus musculus
ctcgggaggcagaggcaggtggatttctgtgagtcagtccagcctggtctacagcgtgagtcccaagacagccagagctacattgaaagaccctgtctggggtgggggaaaaaaaagtgttgatttacttcatataaattgcttttaggttttgcattccttagtcttataaacccagcagccgagagtggaaaatatgaattttcagtattttaaagcaaaagtttggtattttgaatgttttaaaagtatcttaagttatgtgtctggaagtgtcagatctagcgtctgactccggcatctccaccgtaagtgcatgccaggcttaatgacatactgcaacccctgggatcaaggagtcatcttgtgttcagaccccaaaccagctgttgaaacaatgacatcatagtgtaatgacacaactggaaattctaaagttgaactttaaagcatcaagctacatttaatataggcagaaaaatatatattgctctaatggtgatttattaagatgtcctgttctttatgttttttttttcttttgctctgacagctgtaactgggtgtgaaggtattagcctttttgtctgttaacagtaatcaagtggtactttttaaaataacccgtctaaaattttttcttttaaagttctaaagctgtggttatttaaaaaatattttcatgaacttaaaaaaaaatcttcctagagtatatattagcaaatagcattttataagatggtaccttttattggtataatttttatttaaaatcatggtacaactatttggaggccttccagagtacaaggtcatatgtagcccaggctgagggtctcattagcccaggcagagggtctcacatagcctgggctaaggatgtcattagccctggctaactctaaccccactacggaccctcctgagtgctgctgtgtggtagcgcatgtggcttatgctggaggtgtctgtgttaaacaggcactacaaactaagccacgcccatccccatccctcctttgttctcttgctagtttccatgcagtctcattctcagtgccatttgtagccctcccccagggccgatacctgttgggatggctcctgttcagtacctaggagtaagagctaacttacttg

SEQ ID NO: 21183 - DNA, 1097 bp, Mus musculus
ggtagagcacctgcccagcatgcacaaagctctgggttctaatcctatctatctatctatctatctatctatctatctatctatctatctatctactgggcatggtgacacaagtctataattctggtattcaggaggtgcaggcagaaggatcagacattcaaggtcatcttgaatgcagtgagtttgaggtcagcctaggttatgtgaggttctgtcttaaaataagcagtttgataagcagtgacatttttatcatatcaattttgagttttacctagaaatttatcacacatataatgcagtggtttgaatgagaataactcccatatatgtgagtgcttggtccacagttagtggaactgtttgggaaggactaggaggtgtggtcttgttgaaggaggtgtgttactgtggggtgggctttgaggtttaaaaagcccagggctgtggggcaagtggaccatgccaccaaacagaagaacttgtaagatcgagtaagctcagaccctgagagtctcagagagttgagattggcagaagtccagccgcttcctacccatttctgtacctgctctggaacaggaaaccatgacaccccactgagggggccatgacaatcagtaaggaaaacacccggagtccttcccccatacaagcagagtatcactaacatctgcaactgagccaataggaagtacccaccccactcctcaatgtttataaagttcctgtccacatggaataaagtgcacattacttcactgaggatcttctgagagcggctgttttttactgagctgtaacacttgaggaagagttctctctcccgaggaattcatcactgaactttgaatcagcctggctgaccaggttcacactgctaccacagccaccgtcaccgtcaccaccactgtggctgacaaagcctgggaccccggcttcctgccccatgcaggctgcccagacctccttgtttctcttccaaggcctgtaacacttcggcatttccggctggaccagagccccgtggaacctatttgttcaggtccctcctttccccttgggtggttagtagatgacacaggtcattccca

SEQ ID NO: 21184 - DNA, 1143 bp, Mus musculus
agagctagggagcctaagacagtatcagcattatttatgggtaggagaaagcagctgagatgtcttcagccccattggttttccatgtaccccacgtggccccaataagtggaattaagctacttcaaaggaaagcttaaagtatggcctttcccacccctgcggtgctggctcttagtctctctgttgtgggtgtcctgctgcacaacattttgccttcctgtttactgctgtttagttaacacagagttgtatgaggagatcataggtgttcagctaaaacgaagtgggcaggaatcgtggctcgggactcggggagtgtctgtctagctttggaaatgacaagtaggtgcatgcaacagctggaggtaaataattggctggctaagaaccctccgttgtatttgagctcccggccttctctggagaattcggtttgactatgaactctattctcttggaacactgactttttttttttaaactttttcaccagttcactaaagcagtgaagcactttggggaagaggctggcaagatccagccagatgagttcttcgggatctttgatcagtttcttcaggccgtggccgaagcgaaacaggaaaatgagaacatgagaaaaaggaaggaggaggaggaacggcgggctcgcctggaagctcaggtgagaggggctccctcagcgggccctcctggcagcctgtggccacagccctcgcgtttcagtgggttggcctttcccctttgtggtgccacatgacgacagatactccagcacccagctatgaccagacccaggccctgtgttcccaaagcactgtcaaggagggaagagcatgtgttctagagtgctgcaggtagctgagagctgtgccaccgttcccttgagcagtttggctgcctcttcccaaaggctgaaaaggtggagtcacatcctgcgagtttatctccttagaaactgccttcaagaagtgaccataaatttgcaaaaggactttagcatcccttaaaatagctgtaaattatctacttactgcctcaaatggtttttttttttttttttttttaagaaaagactatggcggaacttacctagccactgggaagcgttggttttcactgtccgttgcttttgcagtg

SEQ ID NO: 21185 - DNA, 1883 bp, Mus musculus
agcacaatactttctcctaaaacagatgacagacattccttcaaagggggtgggggggtggagaaaagaggaaattttaaaaaaaaaaggcttgtcttgtgaagtattttatggttcccaaggttggtgtagtgagacgattttcactggtagaaatggagttggaaaacagacgggtgagctcaacggttgtgggccaggcaccgccacccgcatcagtgactgacatagcggaacagctccaaggttccgatgctgctgttggggtacacgcttgtctagggtacaaacgtctgttgagaacatcttgcacacattcatatcatgtagaatgtcaatcacacttcgtttatatatttaaaacttgaacaccgtttcccccctaatttcatcaatttttctgccaagtgctcttgatgacttctttcattggttttttggtttttttgttttttgaaatcacactttcccagtgatgcctcctggatcctggttaagaaccagaattgccagagcttcctcattgacctaacaatacagatctatagacctgacaaataagatttcccatccaagacttagtggaagaactccctgaagattcttcttaaaggcataggggtgcttctggggcgtcttcagttttcctcacaggccgtgctgcatgtcccaggataaaggacactcagatggacacgaaacgtcaacagtatctacagggatgctcaaatctatttatctcaaagaatatttgaagtgatcgctgttacgtgttgtcattttaaattgtgtgtcagtgacgctacctgtacaatttcagtccaaaaaataaagctctcagggagataaaacacaatgagcagtagagaataaaaatggacgcttaccactgacctgccagctcctagtatccttaaattatatggtatgtaaagaggactgttactattgttttcttttgctttatttatttgtactagggtgtggggagggactagcattttctcttgttttccatctttccttttgtggttgggtttcctgtggagagagtagtttttcctattgcactacaatattatttactcgctaaattgagttttcttttcagtcaagtatcacatatttattaagcacttactatgtaccaggcatagtagagctgtagtggtaagcaagacagagtccctgcccaccaaggagttcacattctccacggtgttttcagggacggtagaataccaatgtgcatagtagacaggaaccgtactatttaaaaactaatctgtatgaactataatgtttagtgcagatggcgaggaatctgtgctgtgtaaaagctgtgaagcagcgctctaagaattgtcaagagctgtgctttttactttttttttgtctttcttcatcacaaacttagcgaccttctacccattatgtggaagcaaatggctcttcactaaggcagtcacagggacaaagcagagctgactctcccagccccgcgctaaccacaggctgcaagcatcctggctgcggtgctgatggagacgtggcgaggaggagtggggtggggtgatggatttcattgttctgatctaaagtgcctctttgtatattcttttctattgatagcaggaaaagtttggtccagctcagttttggaactgtggagagagactcacaacagagagcaagtctgtgtcgcatgtccccttgcccctcttagaatcatcctcacatccatgtaggcctcccagtaggccacctttgccatccccagcttctgggtttattttcctaaagactgtgtgcaggaaacttcatgtgccattgttacaaacaaacaaaaatcgactttttagactggtgctggtgtaagtagc

SEQ ID NO: 21186 - DNA, 1325 bp, Mus musculus
cctgtggacggtgtgatggctagacctggggctctcaagtccgttttagctcaagctttcagagtcccagccatgagtgtataaggagcagtggtttagctgggtttgctaatctgtttctcttttcctttccaatgatcccatagaactgctatgatctcctggtcaggaagaaaagacttatcgttctcttcagccactggctactgcacgcctatggcatagtctccatctccagagtggacaggctggaacacgacctaccgcttttggctttggtacctacaccagctctgttttacttgtttactgcaaaatttaccgaaccatcacggatactctcagaaggggccaatggacattgaatataaaatgccaaaaaaaaaaaaaaaaaaaaaaaaaaatcccgaaaagtattcttcattaaaaaaaagtaaagaagaattaaaatgtattaatagcattctttcatacatgggaagaagattgtccagatattataatgcttgtgctttatctttggatttattggaccttgtggttacacttggagactacagggcctcctgttactgtgctctgcctatcttagctatcacaccggaagcccaaacaggcaggggtaattgctctttggagcacggccatgtttttgtacacctgtgctgatggtgtctccctgctttttgtgaagaacctttaacaagtgtattctgaactcaattgctgtggcatcattatgccttctgttgtctatacattaccttcgaggaattacaaaggcagatgtgcttgtggagtgtgatggcaaaaacagaaacaaaggatgtctttgtcaatggctatttattttcaccaatacagtgtttagtaatatttcaaaaataaagcataatttatataacgaactttctgtttagagacagtttggttgaagacatgttcagattattgttcctgtaaagaagaaaacaataaagaatttaattgtaaaataactccatgttctgataattcttttttgctacagtgattatggaagtaattaaaaatgttaagcattacgactcatatttcttctgtctactgaataaatatgctcactcccattctctcatattcaatttcttaaaacaagatatataggccacactgtattgatcctgagacttttttccagtcatgacatttctgagtcaggatcttataactggaagtctctgagatagagtgaaatatgacatacatagaaggtccccgtggctggttttggatgggtaagtggccatgttcgtatctgaaggctttgagagactcatgttcta

SEQ ID NO: 21187 - DNA, 1247 bp, Mus musculus
ctcgttactgcaaattgattgtttccctttcctggtaccataatcttagaggcaaactttgagacaggtgttttgaggctcttcctgtactcttaggatatatgagccgccccctccccacccccgtgtcaagcactaaagtatagagtgtgttagatgtggtttttgatttcgtgttgctaaaaaaaaaaaaagaaaagaaaagaaaaaaagtgcatgatggtgagagcccacgttctccctcctccctcgatgtcctcccctctgcaacgcttctgtagcttctactgtccctgtggctaggcctttcttgccaagtgcgctgacacatagtggatcgcttatcatgtccttgggttgctggatggattcatctctaataacactatatagaattgtaggccaatgttttagcatttccccacacacagagaacataaaaattaatataaaacagttgaccgtacatatggtgatccattttgtataacttagaatgatcgaattaaagaataaatccaaaatgaacgcacagtacttttctcctatgggatgcctgggctgatttacatgtatggtaactaaaggtgccagcatgttgactttattacaatttgtattacttcctctgtagttcctaatggactcaatcacagactctggatatttgcacttatgtacttgatactgaatgcatcaataaatgtgactaaatgtagacatttctctctgtctttaatgatcttactggaaaatgaaaaaaacagaaaagtcttaaagaggaagtcacttgaggaggagccacaaggactgaggtcaagtgttcaacgtgctcccatctccagaaccgcagggtccagccccagcctgggttacagcttcattgtgttaatactagaaatcaccacagaaaggctatttcatattgtactctgatggatcagcgtggatattttgcagtttctaaaagtggtatgagtccttatgtaaacatttatcatcttataaaatactggcataaaaccattgcaggcatcacgaactcttcccgttgacaagtaccctttgagatcctgctgtgtacagaacagaataaatagggcactgggtcaaagtccacagagttcctgtacccaccatgctaaatttccctgtgatagacctcttgtaaaaaaattatttgcacttttgagggagtgggggtagggttccatgtagtccaggctatcatcactctattatgtagc

SEQ ID NO: 21188 - DNA, 1189 bp, Mus musculus
ccttgtaactccagtttcaagggatccaataaactcttttaaactccacaggcaatgctttcctgtgcataaacccatgcgtgtgcacacgcacgtgtgtgcgcgcgcacactcacacacaaataaaacattgaaaattcatttatttatatataatgtatatgtaatgataagaatttttccaactttattgactcataggaatctttagtattcaggagattacaaagacctcaagaatctgtgagagaagaactgtctgtccttctgttccatagatttatatttagtacctgttagatctcaggtgaaagaaacagaaaatgtctcagccggtacctgagttcaattcctggaacctacataataagagagtacatgcacacagagacacatacagagagacacacagacacacagagtcacacacactcactcacagagacacaaacacacacacagagagagagagagagagagagagagagagagagagagagagagagaccagacacacacacagcagaggcattgctaaattattgtgttcttttctagtgtctttatagctttgtttatgtttctttttccattctatagcccagtgatgtgcagttcagtatgtaaacttgggctaaatcatgtaaggatcctgcctctggctcttaagcgctgggattataagtgtcattacagagcattaggattaataaacgttacattggaaatttgttaaggtcatatttattaaaattatcttttttcatatttaggcaccatcctcattgcgaaggtttttcttggccagagtattcaggctcgtgaccaggagcccatcaataaagccaactatcccatggttaactcggtgtttgttcctcagagacatgtgctaagtatgtctgccaaagagaaagacgggcgacttcatcactctcagtacaaaccattcctacctaatacaacagtctataacttatagcatggtctaatctgaacctaacaaggcctataaacttttctctgaaaacctacttctggatattaataattttctgttattcatattaataatatgtgttgaaatttatttcaataatttatgtgtgataggtatgtgtgtatgtgtgtgtatactcacctatacattaaaatctcagtatctgttctagagtacatacaatacaca

SEQ ID NO: 21189 - DNA, 1088 bp, Mus musculus
acctacccacccccattcccctacccacccactccccctttttggccctggcgttcccctgtactggggcatataaagtttgcctgtccgatgggcctctctttccagtgatggccgactaggccatcttttgatttattcatttctttctcctgtttgtattttcctacatttctttaagggattcatttgtttcctctttaaaggctcctgcctgtttgcctgtgttttcctctatttctttaagggaattatttatatcctccttaaaggcctctattgtcttcatgagctgggattcaagatcatagtcttgctcttcaggtattttaggataccaggggcatgcggtagtaggagagctgggttctgattgtgccatattgtgttggcttctgttgattaaatcttgctcttgcctttcgccatctggttttctctggtgttggttggcctgggtatctgggttggagcagacttcccaggaggcagttggagccatgtgtctttggtttgagcaggcctcctgggaggcagttggatctgtgggctggggtacagtgtgctgatcggccacttctgctgatgtaggtgtggaccaggaagaagatggagcttcccaagtcttctaggcttgctagggtcccagcaggtgaagggggaatctggggcagggggatgtgtctcacttgtatgtgtgtcaggctagagctggcctcctgggaggaaggcacagctgtgggatgtgttgagatgctctgatctatgactgttagtgtggactagaagttaaatcaagattattaaaaaaaaaaatatgatataggctgggtaaaaccttgggaaagaagtagaactttctagcgaggtaatttttaatcaggtataattcaatatgtatacacttactattatataaaaggcaaatttaatgaatagaaaagtcataattttgtaatactaaaaatgtagacagaatgatggtttttaaattagttgtagaagaaaaatggaaaatcttctaaacaggcattttgcaaaactacttgtttgtctttttaatatctagtttctgtttctctttgtat

SEQ ID NO: 21190 - DNA, 1219 bp, Mus musculus
gtgcgcctcgtggggtcgaaggggcaggctgagtcccctgtgccgggcgctaaccgagactgcacctggagaccggcgtccgtaggcaggtgtaagagtcgggtgcggacgacgacgacagccgggtttggagaggccctctgcgccctagcgcgaaggccgcgcgcctggctcgcacccaggacgtccacgctccctagggatcggcccgcggcagcgacctgaggagcagcgcagggcagtgacgtcaccgccgcccctcccccgcccaagccgcagttccggccctcccacatccgggtctctccagcccatgggccgcgccgcagctgcagggccgggggtgggggaaacggcggcgcggggcggggcggggccgggcgaggggcagcggtgtcgagagcgcgcgtgcgcggggccgcgctagaggcggcggcggtggcggcgctaggggcgggagcgcgcgcaggagctagaacgccgtggtctccgcgccggccgggtccgcagctcgggatcgggtggctggggcggggggaggggggcccaggcaggtggggcggaaagcgatgagtcctcggcgcctcctccgcctcccgcgggccccgctctctgcctcccgctccgacgcccggatgatctgagccgcgagggctccgagagccgggggcccggacccagcccggctcctcccctcctccgcccgggcccggccgccgtcgcgggaccccgtgcccggccgccgtcgccaccgccgccccggccgaccgagggacccgcccgcccgcggctgctccgggtaagcgcggcgcgagggcgaggaagagggcgagggcgggcgggcggagggcctgtgcggcggcggccaggcctggggcctgtaaacaagccgggcgtctgcccgggcgatcccgggaggagacgcgacaactccaccccctgggcggcctcctccccgagcccgcgccgggtggcgaggggttaacacgcggcgggggcggaggcggggtgtgtgcggcggctgggagggggcgcgaccctcggccgggcggggcggacactggcggccgcggaactttcggggagcctgcagcggggtctccccttgaagcagatcagcccgtgagttcactggatttggagactcacccgctgggttgaaagtgaggcccccaactcagtagtgatgcctccatttcattcattattccggcttgga

SEQ ID NO: 21191 - DNA, 2860 bp, Mus musculus
cgcatgtgggtaggtagcacaagtggccaccaaagaatacctccacattggatgtaacctggaacggattcctctggggtgctggtgatagttaaatggaggcacctgacctcccacatacctgcctattctccttacaaataaacaaagtagttatgattggcaagttataaaaataatcaaggttttaaaaaaatagaaggaaaatcaaatactttcttgaccttttctttccagggaagtcgagacaacatgagtgtgattttgatctgttttccaagtgcacccaaagtctcggcagaggcggtgaagaaggaggcggagctggacaagtacctggagagcagagtagaaggtggatcattaacaaaaataaataagtagctttctttcaaaacaaaaccttccacacaaagtctaaccttttagaaaggttttagtccattacatgcctttagcatgtagtactagtgtggaaaggacgttctgtagtaaccatttgtttagctgtgttccctgggccctgtgcactatggttaggaaacttccaagtgactgaagcatggctctaagattcttgctaaacccactggcatgtgtaatgtcatgccaggcaagcctgagtatcctcctctgaaaagacgtactgcaagtctctggaatatttttaattacctgtgtttggttggttggattttgggtggttttgttttgttggttttggttttgagaacgtgaaggtcaaatgtttagcaacaactgtcgggtcccacagctttgaaactctgctttcagctggttcacggctttcctcctgagccatgagcagtttgagcttacaacacagacctggcaggaattcccagatgaatcaagaaagtagcttgcaaccccaggagtgtgaatctgatgtctctgcagatcactttagagtagaacaaatggaaagtgtttgtacctcaaaaaaaaaaaaaaaaaaaaagcaatgcatttaagtatttggagaaattaatcttttgttggtggggtttggttacttggttgtggaacttgggaccaaatctaaggttttttgcacagaagggaagtatttccctctgtggcacacctcggcccttacgtgatctttgataatgctgttcaccacgcataaaataagcattgtctcccctgtgcgtacacacaatgcatatggatcatgtaggccctataagcagaaacacttccatgtaaaaagtgtgtttgactcttctgataccataattggcatgcaagcttcaatctgccatgtccttgcatctcattgtgtcttcattattaaaattagtgtgcatcttaattttattttctccatttcagttgcttgatttcatttgtaatctgcctattagcatcatgtttggttttggttgtcagtgtttctagagaccggagacggtcttgttcttcttaccccctccctccttgtatggtaatgtctgtgtttgtactgtttagtatttcattcattgagtgtactagtcagtgcattttttctcactattttaaggttcttgtaactttttatatcttaagtaatttcaatatgttatttgtagataaaacagtaaagttaaaaatacttagaatgttacagggtgagtggtctaaattgctgatcggtagaaaaatatgcagccaaaaaatatgtatagggttaagttcctattgatgtcttggcactttaacctgggcatatgttttattggtataaagaattaataaataccttagtatttttactgtgaagtgatatccagtttttggaatgaattgctatttttctctttaagcgtgctttattttaaagtaaatttttggtggaattatcaaacattcactacatacatataactttataagttttatatttcatactatcaagtgagagttgccatctgggcagagtttacattagtagtcaatatttttgctatattcaagtgttttaacatgcagttggaggtaatgtcataaattaagatgcaactagagagaaaatgatgttcggtaaagctgctgctatttaaaggcatagaatgtgactttgcactgtaaatgatgtatgtcttaaatgaagatacacagcttctaaagcaggcaccaaatacctttttaaatacatgccttgactaagttgttgtggccctactaagcctcattgatttgctgtcgaccgttttggcctgtgtgactccaccattgggaaggataatgcttccctcctgctgctgtgtccgccttcactgaaggctgcttgtccttatgaaggcggagtgctgctgtgctgcggtccttgggccctttaaggtcatgcttacctgcgtgaccttcccaccactgctactcacctggctccctgaaaagttgctaatgtgagggagcactttattaaggaaggtgtggggggggattatgtttgtgtctgtgttcatgaaacataagagaatttcgtggcatacatattctttatgaaggtatcaagtcttttacagtctgttaaattgtatagtccaagaacaattaaaagaatttccttctcattcaatattttctagaagccaaaggaagagggagggatagtgtaattgttcagtttaaatgattgtcccacatcaaataagagattctaattgtttctaaagcttttattattcataaaatatttttcctgtattcttcacaattaaaatatcctaacattttcgtgaagatgtaagctacatcagatacagtggggtttttacttaggactgaaaccatcattggttaaatttatcatcagtgttcatttctcttgtatctagagctctaatcaaat

SEQ ID NO: 21192 - DNA, 1595 bp, Mus musculus
taattctcttggtttaatgatatatttatccatcctcacagtgtttttctaaatcaacgggtttatttgtttgcttatggaaaatgttggtgggtggggccaggccaaaacaagttttaatttttttttagtcaaacagattaaatattagtatttcatatatgtataaacataaactttaaaaaccaagtaagttctggagatgagtgttatagagcttgtctttctgcattagtgtctttctgaagtgtacattttagcatctggaagatttcctttaatgccttgttttgtttgttttcctatgtgaaggattctgcgtcaaccgatgatatgtggtaaagccgctcacccagccgtggactcaccttcgcctgcaaaggggaagccagctcatccttgccgagcctttaccatccatcaccgacttcacaggagggtctgacacgggtgaggactgcagcttcagcgatggaacagctagcccagaatggattttctttttttattgtaaatttgagacttatgtaagcgtgatttcaaaccgtaattcatgttgtaaatcagactccagcaatttttgttgtatgattttggtttttgtaaagtgtaattgtccttgtacaaagtgctcatatttaattatgaactgctttaaaatcactatcagtgaatgataaaggaaatttggcttgttgtgtgacacaacagacatagtcatgctgtgtctggactcggttgggatagggaaagcggcagccacatagctgcatgctacgtgcacacgattaggaagaattccaaaagcttacacagctgtcacccaggctcatggaaactgtctctgttccggcgaggactggctcactgatacagccatcgctctcacctgtctctaggatgtcctctcctcgtagccaagatattgcagctgatcctgtatattcatgagagtatctatcaattttgggctaacatgccttgattctcttgcacctctttatgagttcttacatttaattactaattggtaagcagcagcttcctacacagtaggagactgccacatttttttcctatcatgactggctgggcctgctgctgttcctagtaagatattccgaattccattttatcaataaagcttggtttaacaaacaagacatgtaatcatgtatgcgtgattcctcggtcaccccggcttcagaccccactcggggagagaaagatgtcatgtttccttaaactggatgatggtgttagcatccaggtgcaggtggatcggaagattgacgtctgctgtctcctaatctgttttaattgcgtttcttccaggctgcttacttctcattaagatgtgtgtcagcttgactttacctactgttaattaaagtaattgtcaaagtttgacaaccctaaccctgtgatagatgtgtgtgtgttgaatgtgtgtttgcctgtaacttttaattgacccacgtctttagaatctaagaggttaagatacatttgtgatttgaaataaaagcatgttgataatatttagctgttggcctttaaaaatacatttcacagcttgaggaattgtagatata

SEQ ID NO: 21193 - DNA, 1126 bp, Mus musculus
tggaaattcatagcagccagaatacagaaccaatcccaaacttacaataaatgcttgatgtctaaacctgtgatagagttgggagtatggtaatattctaagctgtggctttgcagagctgtaaacgtgcattgtatgaaaccctgtgcttctggtacagactggccgcttggctgacagccgaagctgagatcctaacaggccttcgttctactgggaaaccttcagtttttgagattgaagctttcatgatggaaagctgtgtatcacactatagcagcttggttagagccttgatatcagagagtctcaacaacaacaacaaaaaggaagttagaatattcctctggtgtcattgacaccaaaggttggagtaaggaccatgtgacctgatgtgactagatctttccacaagagttggcgtcatagaactacaggaaggaggtgtgcatcataaaagcaggtatgctggaaagatgccatcctctttcctgataattaccatctcaggacacaaatgcctcaaatgttttggaagtttggcttttttgggggctttgctttttttttttttttttgggagggaaaaagaagttcttgtgtggtggtaatgtaatattcagagtatactttaatgttagtgagaaattcagttctgcatagcaggcttttgctaacttacctcttgaaagttttgtgtctctgggcagtggtggcgaacgcctttaatcccagcatccgcaggcagaggcaggcggatctgttgagttggatgccagccagggctccagagacactgtttgatctcttcacttcagagcacttctcagacatcattacttactgtgcattcacttgaccctaggccgttatgtggctgtccctgctgaacttcttaggccatgtagtagtagaagtaggggtggggcagccaggtgtgggggtgtgcctgtggtcctagcacccgagaggctgcagcaggaggatcatgggcttaagaataaactgggccacaaagtgacaccctgtttggaaggatttttttttaaaagaaattgacaatgagttatgttgatacaaattgtttgaattagctacttacaatgtaagtttgagcaggtaaacc

SEQ ID NO: 21194 - DNA, 1934 bp, Mus musculus
gttatttaccttaaacacagttacctgaaataacttatgaagaaagatttattacagttcatagtctgagggttcttggttggttccattgctttgggccaattgtagcacacatcataaaagaagttcataatggagtcaaacacctctgtaggcttagatttttcaaggtccactttagggttctttaatgctctaacctcccttctagcccactgaccaaatgtagggaaaaaaatggttactaggacaaggggttgtggacctatttagaagtagttatttggggagactccaccattcattatcaggatactagcagtccagttcaatagcaaacaccaaacatgaatcagtagtggttgcacaatccagcagaaacagtgaggctttgccttagcacaagtcagcagaaatggcaagaaacagctgaaataccataagaagttctttggtgcatttctctttacgaagtcatgacaagcaaagatcagcgaagaccagcaaatcatttcaaggcataccaatgcaagagcatcctctcatgcctatcgggttccatttacattctctccaaacatcaggagccctctcactagtctgcctcagcaaaacatcctttcatgtgtctgcttcaacaaaatatcctctcacaagacagcttccagaaaaacatcacatgacacaactgagtttccaaggaaacgagaaatttctacttcatagcttatctatgaccaggaatttttttttcaaagaagagatcctacagtccctttcagagcatgctacctaccatgatttaaaggactcttataccctatctcctaaaattttactacctcctagtaacgacaagctggggattaaacctgtgacacagatccagattatagcataaagcgatattaaacaaattgcttaatttcctttttaagaagttaacagagtatactgtgaaatttttaaaagaaaaaccactcctcaatattttccttcaatttcagcatttttggttatcatttaatttttttttcatgtagtgttaagcaaaatggagctgggaataagagaagaattcagttacaaaataactacttttctattcctttgaggatatgtatatatctcactttatcagttctagtttcacttctctgtgaagtgataacagaataatatggtgcattctaccttatgcagtatatgtgtgtgcttttaagtaacagtcactgttaacatttttctgttactttccatttacaggccctatacattgaacactttggaaagtccatagaaaataatagtgttgaagaggaaagagatgagaattttcctcaaactcctgaaactccttcatttctaagaactcctgaagcgctgaagacacctgaatctatggagaaaatgcagttccctaaaagccccttctttgaaatgtatgatttttattaataattctaatttatttatatattgagcaatatacgtaatttatagtaataattactaaagattctactccctgttttttgtttgtttgcttgtttgtttgtctttctgatggttggggtttgttattaaagtgaagatgataaagagcctgagtttccagtgagacaatatggaggcttaagattttttttcctccatttcttatttattcgttgaaccaatggccagtaagtacctcctgtatactaggtattatgctccatctatctaaccttctattttgccctttttttattagatattttctttatttacatttcaaatgttatcccctttcctagtttcccctcccccctccccctgctccccaacccacccactcccatcctggtcctggcattcccctatactggggcataagaggcttaagattttacaaaggataaaagatgtggaaaaattaaagtcaagctcaa

SEQ ID NO: 21195 - DNA, 1172 bp, Mus musculus
gaggaggcagcgggtctgaggagaaggcggcgggtctgaggagaaggcggcgggtctgaggaggaggcagcgggtctgaggagagggcggcgggtctgaggagagggcggcgggtctgaggaggaggcagcgggtctgaggaggaggcagcgggtctgaggagagggcagcgggtctgaggagaaggcagcaggtctgaagaggccgccgcgctccacagagccacgtgccagggcctggcgccagggaccagggcctccgctgaggggagcatctgcggaaggggccatgcccttgggcggattcctggcatgaatgcaggagtggggatgcgaaaccagcctggggcgggcggggctaggactgagagctgtggaaaaccttaaaaagcaaaagaaaacaaaacacatggcggtcactcgtcaacttacaccatttctctagagccccttccacgaagggcgctaagagttcccctacagttgacgcataagttttggaatagatcataagaaatctagatgtctgggttctagtcgttcaaaaactcaacagcagtcacgaaggaaaacttctagaactttccgtcttgcggagccctttgggtatccactcagttgtttatctgggctctggaagcgctggctgggaattcagcagctaattggaagagactcccttctcaccatgtcttaatccacttacattttccttttaagaatgctatactagaaaggttcttactttatgtatgctcttttatatatggcttctgaaagttttattatttattttacacagtgtccaagatgaatgataatctgtttgtcagtttggacaggcttttgttggaatttggtaggtataaaatgaaaataaagaagaaatagtaatttgtattaacatttgacatttaaccatgaagaaaaatctcaaatgtttatttttagttttccagtatgagcaagacataagtattaaagaagatacgattcaaagaattaatagtaagtagttttgcatgaaataaatattttagtcttttggttttatcttatatagcatagtgcataattaaactgcttagggcaacttgtatgtatgagaggggggtctttcttttgagtaatgatgagctatttattttaggagtgaataattgaaacagtatt

SEQ ID NO: 21196 - DNA, 1543 bp, Mus musculus
ctagtctattctttcagtaaaataagggccagttgatatgcagcccatgtatgtgtgaatggaatatggtaaaccccgtgatctccttgcacagaattgcaaatgacttttttccccaacaccaagggcccagcctcggagcccttggagttcacgtggcagaatatccttcttacataaaccaatgcttgaagatgctgcaaaggatcctctagtgattcctgatgaggaatcagaatagaggtaaataaccccctttaaatcccacccctgctgctggctgtggggttttctggtgccagcctatctatgcactctatagccagaattggcactcagctcttagttacgtctagtagagagaatggtctctagcattcaaaggaggttcattccctccccccccaaaacaaacaaaggcccctgtgttgtactgtataaatatctcatgtagatttatagtgaagacttaatacatgtctggtgcctttcttgtgttgtgaaaggcaagtagatgttgtagccataggtctgttttttaaatccatagttgaattgcacactgaccttaactctctgtatgtacccttgttattctgcatgttaaagctggaattcttgggcgtgtatggcagactaccctgctacatcctcaatatgtgaacattagtgcataaactcgagtcctcttttctcaagtgtttttgacagatcatctcataaaaataattcaggaagtctggggaaaagtcactatgttttacaagagcagtttcaaagtcttcctaaaacttggatgatagaccctaatggttattttgtgtctaatcgagacatttcgatttaattagatattaccaccatatgttttattaatccaaattatatcgcatgtgactctttgggttttcagggtttctcaaaaaaaaaaaaaagtgtatcattttgttgcatgtactgtatgttcagaggcaatcagttgtatactcaatatggttttactgtgccttacctgaagagaaactctacacagaatgtatgacacggggtggggaacagagcctctctactgcactgttaggtgatagcacacggcatggcccagagcatttctgtgcttaattacccaaccaaagagatctaaagtctgtatgttgtactgtaatgggggttatgcctggacaatttaagtgttttatttgttttctgaaatgatgtgaacttatttttctaaacactatgctaaataaactttatatttatacatactttgtgttgaagaaagattatttggggaaatgctactttttaaaatgagagtaacccatttcattagacaagaaacaggagttttatgtttgcctagaagagaaaagagtaagaagctgggcggtggtggcgcacgcctttaagcactcgggaggcagaggcaggtggatttctgagttcgaggccagcctggtctacaaagtgagttccaggacagccagggctacagagaaaccctgtcttgaaaaaccaaaaaaaaaaaaaaaaaaaaaga

SEQ ID NO: 21197 - DNA, 1432 bp, Mus musculus
accttgtggcctttttattactagtcaggtacagaagtgtcaacagcagtgttgatggttcttttgtaccgtcaaacagggttaagtttaccacagaacccctgcataaggcaggacttccgtttcactaaatatcatgtggaaggtttgccatgcacatggatagacagatatagtcgatgcttttcattataatgaaagtagaaaagtatagaaagaccatgaaacagcagttctgcaggctatgactatgaaaacaacctttttttttttaattctgttttggttttagttttcttgagacagggtttctctgttaaacagagaaactgttactgaccatcctggaactcactctgtagaccaggctggccttgaactcacagagattcacctgcctctgccttccaagtaccgggattcaaggcatgggccaccactacccagcttgacaacaaccacttaaaataaaaaatatatatgtaaattgtactaaaaatctgttcaactgaagctcatttccagtgttttgaattggtcggtatacatgactgttgcctgtcgtatttaatgaagtaaatccttccggtttctgtgggaaattttgtttaaaagttttagtaggactctgcatctatgatataacaatgcaatgcctttatgctgttagtccagggcatctctgatttcagaaagaaggcgactttttctaaggtgacttctcagttgctaagcacaaagatagtaccactccttggttttgttaaggtggtggaagggtttctaactaacacactcatcagctgagcctgcagagtaacggtcactggggacttaacatttgttgttacacaagggaactttcagtcaagattaagagccctatgaagaattctgtgcccatcattttgatcaagaacctaaatcccatttttgtgaaattggtgaatgtccctcaattgctgaaatatgcaatttgggccagaggttgttgtttgtttgttttggatgttcttgttttattttcatgaagccagttgcttcagtgtggttttccactctgacactacttacacagcttggctgcccccgtctcccagttatttactgatcatattaatgtgattagcatcctggtcttgtagtatagtttacatttttaaaaaatgttattttttactagattgctgcagatatcaagaggacattattttaaaatacctgtctggtaagggaagtgggaaagtcaaaacgttctataaggcgggtgtgtgtgggtgtctgcgtgcgtgtgatggaaaactcccatatatctgacaaaagtatcttttttattccgagttcttcctccttttctccttatgagaaagaaaagatagcacaaaactaagtacttacctaggaaatgtcttcatattccaacatgatgagc

SEQ ID NO: 21198 - DNA, 1445 bp, Mus musculus
gtggggcagtggtggtgcacacctttaatcccagcacttgggaggcagagacaggtggatttctgagttccaggccagcctggtctacagagtgagttccaggacagccagggctacacagagaaaccttgtctggaaaaaccgaaacaaaacaaaacaaaacaacaacaaaaaaagctttcgtagaaatgttagtagcataatagtgtgcgtgctggaaaggacagtattcgctggatgtctaaatagcttccaaaaaaacgaatcagtactggaaatggtgaaagagtggatattttaacatttcatccaaatgtacaggttataaggactattcttagaattcattgtcctttgtaacttagtagtagttgggcaatccatatatatgtgtgtgtgaacctgaacatttcaatcttggaattcctttccaaatgtagaatcagttttacacttgctttgcagaatgtcactggcttacggtcttcaaatcaatggtgtactttttgttttctttcaggtatttaaaccacgtccgggctgcatctccacaggatcttgctggcggctatacttcttctcttgcttgtcacagagcgctacaggatgcgttcagtgggctcttctggcagcccagataacctgtattttctcatgtataagatctggattgtggagccaaaccaaggggtttgaaagtatagaggtttgtaaagttccagccccgcagctgcacagcacaccaccactgctgctgtgctcaggtgtttattgcagtctggaccaagctgagaaatgtgttgcatatagattcatggaagaggtttattttttacttctgttctttagacagggatgaagaacattaaacctcatctgacagaaaagaaataaatgatttgcctatgtttggagttgacttacacattttataaaaaataaagcctgactttatggtacatttttgtgggatttttttttcttcctcctcctccttgtgtttttctggaacatatttccaaatgcctttttgattataacattcagtgctattatccaagtctatattttccctataaaaacttctttttccccttaatgtcgtattgatagtggtacagacaagtggagatgtttcatcttagcagcaggccgtgtcaagaaagcacaactgtgatgtggctcttcctcagcagtaagagtctgggggactgttttgagccatgcaaagtgaggcaaacctaatgtggttcccagctgtgagccacagaaatgataaaccagagcaggccattaacctgctttaatggcagattcaaagatgtgagctaataaaacttaatacatcaatggcacctttcactgctaatgtgagctcattttatgatgagatgttgagactggaaaaggtaccatgtaagtgaaatttctctgcataaattata

SEQ ID NO: 21199 - DNA, 1119 bp, Mus musculus
ttattcataaaacgagggacttgatatgtctaatttatagacatgaaatgggcaagattttagtaattgtctcaaaacattgagtatctcaaattctaatgatgcttcaattatgtctcccttttgcaacctgaatgctgtggagagccacttgcttgatgtgtggaagggttctgtttttcctgttgtttgctttctctacatggtgacataaagccagttagttggcctttctgcaaaattccttatgtgaattggaatcagttttaagaccctttagaatgtgaacaactgttttactttggagagctgacttttctcatgaaaaagggttgaatacaagatacatactggtcccagaaatggtataaagaccaggattctaatcaaaatgtttttaagtgaagttatttgctcctatgatacatgtatgctctcatgcgtacataacctatccagtttcagtggacagactttaaatctagtacgattaactaaaaacatgaaaccctttttaggttcgagaaaacaactacacgtatgagtttgatttctctaaagtctactggaatcctcgtctctctactgaacatggccggatcactgaacttctcaaccctggagatgtcttgtttgatgtttttgctggggttgggccctttgccattccagcagcaaggaaaaactgcacagtgtttgccaatgatctcaatcctgagtcccataaatggctgttgcacaattgtaaactgaataaagttgaccagaaagtgaaagtctttaacatggatggaaaagacttcatccaagggccagtcagagaagagttaatgcttcggctaggattgtcagctgaagctaaaccctctgtccacattgtcatgaacttgccagctaaggccatagagtttctcagtgttttcagatcacttttggatgggcagccttgcagcacggagctcctccccacagtgcactgttactgcttctccaaagatagcgatcctgctaaggatgttcgtcagcaggcggaagctgtgctgggcgtttccttggagaccagtagttcagttcatctcgtaaggaatgtggcccctaacaaggagatgctgtgcatca

SEQ ID NO: 21200 - DNA, 1195 bp, Mus musculus
atgctttaacttctaaggatgttttcaataacttgagactgtaattggaaggatgatgttgtgttggaccacatgtggttgtacacacctttaatcctagcacttaggaggcagatataggcagatctcttgatttccaggccagcctggtttatgtaactagtttcaagccaggtaaggctacagagtgagaccctgtctcaaaaagagaagtaagagaagggctgaagagatggctcagtggttagggccactgactgttcttcgggaggggggaccccacttcaaattcacatcctcatggcagctcacaatggtctgttactccaagatctgacacactcccatagacatgcaagcaaaattctgcacataaaataaaagtaaatttttttaaaaagttgcaagagagttctgtgaagtacttgttgaattacagagacttaacagttaatttttttaaaatagtaatttataaacagagtatactggtctctctttcttaattccctctgtcaggacctagtctctgttctttgaaagcagtcttattaagtcttgactactttgcattgtattgctattgaccctactgtattatgtattacatgcttaatagcattgcatctaattattgatctctgcatcactctaagtatacacactcggttctaaataatggatattttgtgtttgtttgttttttccctaatacttccattttatataccttaaaatgtatccatttgataaatgtccatgatttttttagatattcatagaaatggcctaaccaccatcatacctctaattttattttttaaaattgtcttgttttattgtatgtttgtttgttttgagacagggtttcactatgtaaccctggctggcttaggactccaagtagaccaagttgttcttgaactcatagagggctacctacctctgcctcccaaatgctgggattagaggcatgtaccattacactcagccattttagaaaatgtcattgcctcaaaaaagaagttctatatctatctaatccactttctctgagcatttcaaataagtaaaacatttgttttgaaccagactaagcaataaaaaaggaaatcaagatgttgtttcagagtcatctaaatgtaatctaattttttagttatgaggtttgacattaagattaaattagacgtga

SEQ ID NO: 21201 - DNA, 2125 bp, Mus musculus
gttgtttgttgggtttttgtttctgttggttatttttggacactggtggctcagcagtctatttatattttctatatctaattttagaagcctggctacaatactgcacaaactcagatagtttagttttcatcccctttctacttaattttcattaatgctctttttaatatgttcttttaatgccagatcacagcacattcacagctcctcagcatttcaccattgcattgctgtagtgtcatttaaaatgcacctttttatttatttatttttggtgagggagtttgtcccttattgaattatttttaatgaaatgccaatataattttttaagaaagcagtaaattctcatcatgatcataggcagttgaaaactttttactcatttttttcatgttttacatgaaaataatgctttgtcagcagtacatggtagccacaattgcacaatatattttctttaaaaaaccagcagttactcatgcaatatattctgcatttataaaactagtttttaagaaattttttttggcctatggaattgttaagcctggatcatgaagctgttgatcttataatgattcttaaactgtatggtttctttatatgggtaaagccatttacatgatataaagaaatatgcttatatctggaaggtatgtggcatttatttggataaaattctcaattcagagaagttatctggtgtttcttgactttaccaactcaaaacagtccctctgtagttgtggaagcttatgctaatattgtgtaattgattatgaaacataaatgttctgcccaccctgttggtataaagacattttgagcatactgtaaacaaacaaacaaaaaatcatgctttgttagtaaaattgcctagtatgttgatttgttgaaaatatgatgtttggttttatgcactttgtcgctattaacatccttttttcatatagatttcaataagtgagtaattttagaagcattattttaggaatatagagttgtcatagtaaacatcttgttttttctatgtatactgtataaatttttcgttcccttgctctttgtggttgggtctaacactaactgtactgttttgttatatcaaataaacatcttctgtggaccaggccccctgggtcagcgcttacgtttaaataacatttgtctcaacatttctagctcataaaacgatttctcaaaaatttaagttctttataaaaattagattgtacatttctacattcattttattgccattttctaatgtatgatgtgtccctaaatgtcatgttaaataatgacatcataatattgcattgtaaagagaatttttttttagaattttgccattataaatgtatgagtctattaaaatataaagtacaaaccttcagtatttgcagtatgaatggagtaagtgaaacagttcatgaaacatgatcatactgttttgagggctcaggctcctgcgtgcatgtctaatctgttcccattagcaggtgaaggaagctagggctgaaacaagagttttccgcgctctcagggagctatgtggcatgtcagaatcttaggtctcagaacataccttgtttggttttgatattggtttggtttgattctggtacatggcacattaatatgcagatacattatatagataatcatatattacctgatgtttctttactttgccagctttaaaaaagtatcttatgcaattgtgaattttagaaacttccaaataaacaccacaaaccttccagcttatatgcatatctttctagttcatgtatcactttgttttagtattttaaaaactttgtttttagatacttgattctttttctctgtttttctagtaatatatctgttctgctttcatagtctaagtttaaaaaaatcagtctagaaagatataaaggtaaaatgtggaatttgggtgtgcacttaggaagcagagctagggtaatcaggaattccagcccagctttggcgacaaagtgggtccaggccgctgggggctgcatgcgtgttttgtgtaaaagaagagatggagaaggaggttagtgtgtccctacacctagagataacagtcttttagaacccattggtgtga

SEQ ID NO: 21202 - DNA, 1177 bp, Mus musculus
tgttttaaatatatgcaggtaaaatgtgtattattatataaacctttcatttagatgtcagtattttaatccatggagttcttaaccttgtatccacagagttcactgcgcccaagaggaagagaaaatgctgaaccgggaggctggtggagttttaaattttgagctttccaacagaagaaaggtgtcatgtgttctaagcaggaagtagccagtgaagactggatctgagaacaagctcatttctgtgagatggaagagcatgccataggccaagagttgagtaaaggtttactctgaagattaattttaacatttttgttaatattgcaattttaacaaattacattgtagtttgttacagaatagattgtaaatgtgttaaacttgttagacttgttaggggtctgtatgagtggagatagagtttctattgccttcagaatgtaatagaaagaattacatatttgtgagttagtactctttcctgaaagtttttgtgctgtactaatgcatttatatataaatgattcatacctgtcacctagcaacggatttggctggggtttttgttgaatattttgtgtgttatggttaagtgcaataaaaattttgcccccttgttttatcttctagtgtgtgaaattttcatggccaataacttgactgataccttagtaagttacggctgccttcgtgcttacgatgtacccttacttcctcattgatttggacagggtctgcctgtgtatgctaggctggccttgaactctccatgcgagtactgccttgctcggcctccccactgctgggattatagataatgcaccgccgggcctcactccttaccctctgtagtatttgctttaaagttcccattggtctactgtatatgaatgcataggtacctgtgtgtgtgtccttgtctacacataagattaattaatacactgtttaatgcttatgtactgtctaataggcccataggagcagtcatgtagattctgaaacgtgtctttgacacagaacttttgtaaatcacagaaaagatgtctctagtcacgtgtgtgctgctgttttaatttcacacccctggagttttaagtggagatggctttagctgtgcttgaaagctgccaacacacggcctctgtgttgtgaggctaatgcagcctga

SEQ ID NO: 21203 - DNA, 1121 bp, Mus musculus
ttgttctcttgttttttaaaggtatgcgtaccaccaagtccaagatggttcagtggaataaataggactcttaaagagcgttaaggagggttccatctgaggacctggaaagtgtgagcagagctgcatgttcacatattgatgctaagaagcaaaccatagcacatctcccttagctgtcttagccgtttccatcttcattacacatatctttgatagtgtagaccttgcttgctgtggtccctctggggatgacatgtgctcatttgacatgaggaaggtcaggacctctttctgcaccgtgtcctgtcctcagagctaagggtcagtgttgtctgttggtcattcccaactgagaggaatgaagctaagctttagactatttaaagatgtgatgagagctgaatgtcagaactcacagggcaatctctgagaagaaacactcatttcccttttaaccaaaagtgacaatgtgacctctgtcatgttgtgtgtggtgaggagaagctagcccaggtgacttgattgttgcactatgtgacatatttaaggacatacttgctgcatttgcagcagcccccctgtctgacctccctgggcaatcctgctgtcactcaatgtgagttaactgtgacaaactcagctctgtgttatattttgtttgcttcatagtttccagaactatatataaatatattttttcaatagcaaatattgtagttagtgagtggtgaccacttcaaccttatccctaccatattggtttcagggatgggactaagaatgtccttggaataaaaaaattaaaatataaccctgtgatttagaatgatgccgaggttgcaggttgcagcctgcagcagctgtgtgagcgaagtgaccgtctcctctggatcaagcgtccactcctcattgtgcccaggccccagtgctccttcatcactgtttagttattgtccgctgtggttttgattatattttgctcttcctgacattgactgtttttttttaataaaagaaaataaaaagtaaatgaataacccctgaatgtgactggatgcagggataagcccctccctcctccttgggctctttccctaagtggcaggatcgcgctggct

SEQ ID NO: 21204 - DNA, 1508 bp, Mus musculus
agcgagaagaactgtggaaaaaattggaggatctggagttaaagagaggtcttagacgcgatgggataattccaacttaacaacagcctgacagcgacacactaacccgtgggtcacacgcttatgtagtagaaggatggagcaacagttttctgtattgtgcaactttacagtagatttcacatttgtctcattattacagcagcactgtatatacctgtctctaagtaaaggaaaacataaggacttcaaagtgtggacagtagatggactctcagaactttgcaaacataatcattgttctaaccctctttaaaaacaaacaaacaaacaaaaggtctacagagatctgtcggggaaattgctatgttaaaattccattatcaggagttccttatttatcactagcagagagtatgatacaattttcaaatgtgaacaatcttaaatttagcttgtctttctgctaagctgttaaatgtatttatagtaaaggaagaaaagattgtcatttctttataagtttgtatagcgccctcctctggacatgactgtaacgtgatatcctttccttttgcacatcttcatgagtcaagtgtccacatggaccggggctgtgagtcagaggtctctgaggaaaggttgtctgctggatgaacatcttcccagctgccaggtcctggtactcctttagttttcagattaggagtaaaaagaagaggtgataagcatggtagcgaagggaatgttggacttcatatcagatatggtgagtccaaatcagtgtcttgaatcctttgaaaacaggcagtgggacgcgcaggcttcagcacctgcagcattagctgcagacataagtgtgcatccagaccagagacaacttagaaatgtcagagaacatcctttcggatcctgtggagtaagagagagagcactaagcgatagaaccgtgaagccgagcaccaggaccgcgcatccacttgggaaccgagttgagcaaacagcatgaactgtttgcagttgatgccttacttcctaatgtgtacttacaaagtatttcagcagaagaggatgcagggtgcagcctctgggaggaacatcctccttctctagctcaccacagcgccagccctgtttttagccagaaaggattcaggatcaacattatgcgttctgaattggatgcatattcctaactactgtatttgttaccaaaagtggttctacaaatgctactgaaaaaaatctggaaattcctaatgtcctgagtattaataataaagtttaaaaaatgcttttatatcaaaggtgcatcgtgaccaaattgtttaagttaaaaacaaaacaaaaccaaaccaacccgagggctgtgctctagctgggcttactgtctctgtactgggtccccctgggtaggtaagttgctgatgtacaggtgtgcagtatgtattcacccgatgtgttgcatcgctgtgtattggcaagtgtgtgttgtggggtttgtttcc

SEQ ID NO: 21205 - DNA, 1161 bp, Mus musculus
attttcttaccacatagattgcaggctagtagtaggcaaactagacacaacccaagtgctttgtttatttggaagtatggatcacagagttcttgccttcaatgtaaaacacattgtcgatgcttctgactcagtgtcttaagtcacaagtaggcgtcttctgtaatgacttgctgtacaggtcacttgctggttctatctgggagcctcattgctattcgatgctcaccctctcagacccttttcatctcaccatgtctgcttggtcctaatattaattaaaagatcttcatcctttggagtactcttctagtgctgtgagtttaaccacaggccttgtataggcaaagcatatgtttcactgctaaactgtattcctagtttttaaacaaaatttaagcatatgtgaaatttaacagtaaaattttacagagcattgaatgaatgttagaatgcaatatattgctagattaaagtaaattatccatcataaatatattcatataatgtgagttcatttgtatgtttggtatagttctttgttttgttttccccctttgagacagtgttttctctgtgtagttttggttgtcctagaactcactctgtagaccagaatggcctctaactcaaagaggcctgcctcttacttcctgagtgctgggactaaaatcatacaccatgatgcccagctagtatatagttctaattaaaattctgattttttaaaaaaaaattagaatctttataattcatgggatacgttttttgaggaagatatttaatagggtactttacatagttaaatagttctcagtactgcaagaaaaaaaagaatatttaggtacattaaactgtggggttgggacaggagaagggatataacagaagtttgggtggaggggactcttctgagaaagtaaaaaaaggccatcagaagatctgtacctgtgagtgacagacaagtacacatggcatctgttccttaaagtggtcatttctgaagagaaaatctcatagtgttctgtcaaatgttgacccagcagtttcatgtaacacaaccaaatgtgcctacagagataccaaaggcttcagtgttgatgattacaggattagaaaaaacttaatacatcttcgtcagaagttgatggagaaactata

SEQ ID NO: 21206 - DNA, 1349 bp, Mus musculus
gaaatcgaagcgttctagtgagtctgagcagaagtttacttttttaggaataaagtataatattttcctaaaatgagaaaaatatatttgataattacttgtatctgtactttttttttaattaatcaggagctatatttatactatatttacatttggttagccagcacccaggtactttgctgatgaaaaaagaaattaccttactagattcattttgagacttaacataagacaggcaaaagaaaatacaacagcacggctatttttttcaaaatggcctttcaggggctggtgagatggctcagtgggtaagagcacccaactgctcttccgaaggtccagagttcaaatcccacaaccacatggtggctcacaaccatctgtaacaagatctgatgccctcttctggagtgtctgaagacagcgctacagtgtacttacatataataaataaatcttaaaaaaaaaaaaaaaagagcttttcgccgccggacgctgccgaggtcgcacgcgtgaggtctgtcccccgcagccgacatgcgctacgtcgcctcttacctgctggccgccctcgggggcaactcctctcctagcgccaaagacatcaagaaaatactaggcagcgtgggcatcgaagcggacgatgatcggctcaacaaggtcatcagtgagctgaatggaaagaacattgaggatgtcattgctcagggtgttggcaagctggccagtgtgcctgctggtggggctgtggctgtttctgctgcccctggctctgcagcacctgctgctggttctgcccccgctgcagcagaggagaagaaagatgagaagaaggaggagtccgaggagtcggatgacgacatgggatttggcttgtttgattaaattcctgctcccctgcaaataaagtctttttatgtatcttgaaaaaaaaaaaagaaatgtttgttcttttaaaaaaaaatggcctttcaaaaatattatatgattaaatattctttcttatctcccccatcattttacccttgaagccttgtttactgcctctgtgtgtgtgtgtgtgtgtgtgtgtgtgtgtgtgtgtgtgtgtgtgtgtgtgtgtctgttttctcttactcccctgtgggacccaggaatcacagtccagtccttagactgcacagcagcctctacctaccaagccacatttactgttaattttgtcatttttcttaaaaaactgttttgtaaagtgccttaataaaagaagttgatacttttaagtttgggtatcttgtcttatgtgtaaaggtaagaatatctttttatagataccagaaatacagtcatgaaaaagatgttttatt

SEQ ID NO: 21207 - DNA, 1349 bp, Mus musculus; identical to SEQ ID NO: 21206

SEQ ID NO: 21208 - DNA, 1149 bp, Mus musculus
acacgttctgatttttaaagcctttcctagaattgattgttaactttagtttattccaaagaagacagttttggggtgccatattctggtccccttggctctcacgtatataccacgataagacaacctcctctggaaaaggttacttttcctcgtttttctctgtgtaagggacacagcgacagacagtggatcccatgcagctcctgccagtgtttgtgtggaagtaagcaatgggctttgggatgcctccagtggtgccggccagaaggaaggcacacgacactgcctctgccgggtgtaagagagtgatatctaagtgcaaggctatgcttgcagctgtcattaaaacgggcaaatatttttctaacaagatagcgtatgtgaggaatgagttcctcattttaacatccaacatatttctggctgctgtttgatgtcaaacatttcggttttagaaatatttcttttaaatgtcttggagagactagtgtttggaattttgaagataataaatcctcaccagcagggaaaggagacacaacggaagtgtgtaaaaatgcttgtgtgtggggggtggggactcagctgtaaagtgcttgatgtgcaaaacctgaagatctgggttccaccccagcatccaccgagaaactggggatgcgtgtgcgagaagctgggaatgcgtgcgcctctaattccagggctgggaggcggagttagtcagccaggctaccaaatcagcatgatctccgtctgtctctcacacatacatacgaacacaagacacacacctttacccgagaaaaggttagtgagcatctaagaggggtaagaatggaatggggaagctataatcaaaataaattatgtacacatagacaattttccaagaatatattttttaaagtatgttggattgtaattgaggaagacacccgatattagccaagcccatgagtgtgcgctcaacacacacacacacacacacacaagtctgcagctatgttccttgtactggtgtagttgtgttacttggacatttggggaaaatattgttttaaccacagtgaagggctctacatctttctaagtatttccgtcatttctctagaactggaccagttgtgcatgcagccattttacattaaa

SEQ ID NO: 21209 - DNA, 1224 bp, Mus musculus
tagtgaccgctctgactgctctaggctgcggaaaagcaggaagtagaagacgaagagtcagccggacaattgaaagtgaacgaagaagttgaaggactcatcaagcaggtgacaatctgggagtcacaaaccaaatccatcttggatctcctccaacatggagaccatgccgatggctcctcagcagacaccttgcaggtatgaatgtgaccatgtttaagagggaacactcatgattggaaactcatgtgggcttgtgttttaagataaacaaaaaatgtcaaagagtaatgagcctgcatttaattttccgtattgggaaattttaagatggcaccaatctaatcactgattgctttccacgtaatatgcttggaatgccttatatgcataaggtcttgactcattttcctgcctataaggtggggattgtaacattctgcatgagaggcactaagatgaaatgcattaggtctctggtggctagttacaatgggaacatactgattatgtaatctgtgccttgaagattctcccatttaaccagttatgtccccaactcactgatggaggggtgactaggctgtttgaactccattctgcatccatcctccagaaattgcctcgagtaagaagcaacaaggtgcaagtgtatcccacttgggataactgaggatttttcccaagttccagcacagttgtgacatcaggggagcatgtcgcaactgggccaagataggaagtttacgcaataaagggccacccgtggacttttctacatctgtgttgctggaaaggcctatagctcaacctgcagtattttcattgtttatgatggtggtaacttagtagcttgaaaagtattcttacaaaatagcattaaaagcactttattcgctagttttttaaatttcctttttaaaaaaatatagatcatctgcagtttgtcttagtgaaataaatgaaatagggatacaatattaaacagatttttttaaagcataattttaaggtttttttttctttaattacatttatttacttcgtgtgggggcaccatgccacactgcacatgaagggtatcagagtaaccttcaggaatcgaatctcttcttaaaccatgtgggtcccagggattaaactcagatcaataggcctggtggcacacccttactaacagagccatcttgtggaccctagagtataattttcttgtttccattt

SEQ ID NO: 21210 - DNA, 1103 bp, Mus musculus
caagtgccaagtgggaggtgagcacctcggggccttgggcttggggttctggtcctgtgcctggtcatctttcagagcctcctctgtcaccctggtgatacatttgccttagaggtaggggtcccaggctcttagcctcagccagtgagaacaccttgtagatctgtgggctgctggaagaagcggaatatgcctacattgtttctttctccgcctctccacagtgtctcagcagcagctgccttctccagcattggagactcatgactctgtcttccctaggctttaggaaggcgtcaagcccaggggcggagacgtttttctcctgctgctttttgatagactgccttttccttcttagtttgactggtctgaactttcatgcctggagccttttaatatccccagaataaaaaattgagcgtgtttctaatttcctggatggatcctgattgagataatgagataatgagatctagactgaatgggctgtatccctgcagatttctctagtcaagcaggggaggcttttgttgaggtaaaactgtgaccctgggaaggttactaaacttcagaaacctcgatggtaaaacgagactaacacaatataattggcaggttattacaaagatttacgtaagtcatagaggatatgttcaataaatgataattatattatggatatctgtgtatgtgtctggtgagtatagtcagttctccatatctttgggctctgtgtccatgcagtcaaccaactgggggacgaaaacatttgaaaaaaagacttgtgtctactctgaaggtgtatggccttgccccgcccccatccatgatttattaaacaatatagtatagcagctaattgcatagcattacattatgttaagcattaaatataatctagagatgatttgcagtatattggagattgtatgtagataatatggcacttttcaaaaaggactagagtgtcctcagattttagtatctccagtggggaaggagttctggatcaagggagatctatgtaattagaataaaatctattaatggtttttctggacaaacttatttttgttttgttttttagacagggtctcatc

SEQ ID NO: 21211 - DNA, 1195 bp, Mus musculus
gaagaggggagcgaagggcaaacaggctgacgtggctgaccagcaaaccacagagctgcctgcagaaaatggagagacggaaaaccagagtccagcctctgaagaagagaaagaagctaagtccgactaagcatccttcacgtctgtcagtgggcccgcctcccttcttgtacaatccagaggaatatttttatcaactattttgtaaatgggagtttttttagtagctctagaaacatttttaaaaggtgaggggatcccacctcattccattttttaagtgtaaatggtttttttttaagaggttaaatcatttgctggttgtttattttttggtacaaccagaaaatagcaggatactgaatcaggagaggctgtgactgtctcgggggtcaccataacattccgtagatggggctagttttatatcctttaatacaaagcatactaaatggcaatctggcatcccagtagtgcatttgtgtctggaatattttcagttctatctggtctcgtgtttctagtagaaccattttgtaagaaagccagtccttggcctttgccctgtcagaactgtgatgtctgtggccatggcagtccatcttcctataataataatagtgataatgtgctgtgaaagatggaagtcctgagtctgttctgtgtgtggcgtaacattgtgaattggtgggctgaggattacaggcatttggttgttatgagaggtcttaggggaacttgcagagtcaatggaacaagttcaaagaaaaacaatacgtagctcttcatttgtgtacatgaacacaatgtgacttcagagtttgggtacgtgaacacagtatatggctctttttgggtacgtgtaataagaattggaatgtctgtactctgctccttgactgataaaatctgttgtgaaaaaaaaaaaaggatagacatttagaatgcagttaggactgtatagactactgctctaggaaagcggggcagtggtacagtctcctctaagatctataacctctctagcctcaggcggatgggtgggtcttctttccaatcttgaaggacctggaattctgcattcacccaagatcaatcttactgcacttacttcctttttgatttatgaatcatatctcttaccttaattatttttgttatttctgatcctgccctttggcggaagtatttagat

SEQ ID NO: 21212 - DNA, 1150 bp, Mus musculus
gtgtgccacagcatgcatgtagaagttgtcagtggacaacgtcgtggagtcgggttttctcctggtacttttacttgggctttggaatttgaactcaggtctctaagcttgcaaggcaatctcctttatccagtgagccatcttgctatcccatagaaaccttttctactgttcatatctttccttactttccttcttactgtagctgaggtgagggggtgtaactgaaataaaatagatgcctttggggctggagatgtaggtcagtggctgagaatttacttggcatgctaaaggccctggatttaattcccggcactgctgtggaaagggggtggtaatttttggagattttcctcccagaaggtcccccccccccccaaattccagctaaatcctagccctttggctcctgtggctccattatgaagccaggttggcatttgctcatgacgtcatggtctccacagggcacgccagtgtttgtccatgccgggcctttcgccaacattgcacacgggaattcctccatcattgcagaccggattgcactcaagctggtaggccctgagggcttcgtaggtgagttctcctgcatcctcagtgggcggccatgatgagtttatcttatatcacagagtggccctggtggtttacagttgctcctctcccttgcagtaacggaagctggattcggagcagacataggaatggaaaagttcttcaacatcaagtgccggtattctggtctccagccacacgtggtggttctggttgccactgtcagggcccttaagatgcacgggggtggccccacggtgaggaccagggactgggagagtggctattaggaaccttccaggtgcttgaaggaaatttcatgacatatctctgggtctgcctgctttccactgctcttatttatcctcatgctggatagggtgccaaaagccagggggtggccatacacaggctccgtcaccttcagggacagatcctcttgcagcattttgaggagacccaaactgtctttatgactgcctatctaaccccctccacaggcttgtgcttggccctattgatattaaaaaacaacaacaacaacaaaaccaacaaaaaaaaccagtgtcaaccagttatttataaatcc

SEQ ID NO: 21213 - DNA, 1163 bp, Mus musculus
tttttttaatatcaattagggccaagcacaagcctgtggaaggggttagataggcagtcataaaaaaagggggggcttttttttttaactcttgagtgtgaactgtataggagacaatattatgttgcaaagtcaaaaggttggacctgccagggagtctgagcccctaccctggcagtcctgaaaggaggctttgcctgtccagcgctgccctggagccagacgtgtgggaagttacgtggacggacactgcttcctgtttctcttccacgtggcccttcaagagtcacaaccccatagactggacatgcagacctcagtcttcctggagagtagaagacccagctagacgctttttaatcaccatgttgcctacagtgaccactaagtcaaccttgagccatttggtgtaccatacagtagggttgagccagctccctagatcaggacccaggcccttcctcctagcgacacaatgggctaactgctttagagtttatatacctctgagtctgctctacctcagaggaagaaagtctgccgttgtgcccccagccccttttcttgggctcaggctgccctctaactgctacgttgatgaggagcttgtagtgattcctgcttccatcttctgagtggtagggggtccaggcacacactggctcttgttttccccctcttcattattccgacatcacagcccacccaccaccccaccttctgccaaggcacgagcaaccacgctccttacaggcctgaccttagacatcagtagtgactttcagggttggtggctgtcttttttcccccccatgctcacccttacttccattccactggtgtgtgcttcattccctgggatcagtgttctgccacagcatatttctgtctaccttggcattcatccatctgtgccataccctacccccacccaatctcgcatcacaaagaaacacctgactgctcgaagctctacagtctcacattccaagcctgttgagcaggaaacagcttcacactgctgcccattactctttggggagtgcagccacttgcctgtcagtgtactgagcaccactttagtgccaacagtgagtaggaaacgtggctgactttctatcctatcttctaggtcaccgctggactgcctcttcccaaggctt

SEQ ID NO: 21214 - DNA, 2255 bp, Mus musculus
ctctctcaaaaacctgaggcatcagaacctggagaactcatgtgggtgctggaaccaaaccaggtcctctgcaggagcagcaagtacccttaagcaccgaatcagcctctcctgctcattctgcctttttgaggttatgtcttactatatggcccacaatggcctgggacttgaaacaaccctgcatccacctcctaagtgcctggggtagcatgcactataacgcctacagcctggggagttttggttttggtttttaagacataagtcttcatttgggggaaaaagtattcatattttaaaagattttccaggaacaacctttagtttttgtcacatctgcaatatggagctcccttgccctcccctctcctcccctcccctcccctcccctccccgtcctcccccaccccaccccccaagcagtgtggtttgtgtaatggttgcctagttgagcctggagtcaccatatgtactttgttgccagatgttgccctcttgtgttgaagtgagcagcctgccgggtaacatttggaggccttgcgaaacaagcttagttcttttttttgtgtgtttttgttttttgagacagggtttctctgtagctctggctgtcctggaactcactctgtagaccaggctggccttgaactcagagatccacctgcctctgcctcgggctaggcagatcctatatagagcttttctgtgtgggccagctttaagtcttcccttctttatagagcctgcatgtaggtgttttgcatttgttgttggtaggagcgctcagtgagtgcagtctgcctgacaagcagtgttgttgctctttaatgtatagaatgtttgaagtggttacttacctcttccaagtaaagcggaggtgtccacagcacctacctcgcagggctggtgtgaggctttgctctaaaatggttagtgtgctgatggaaaccaacagcaggaagcggttccacggctagcccggttcagtattccatctggtagattctagaacatgcttgcagccctacttaatagataattagttgagaaaattagtttttatgaaaatgcgccagaaatgggagtgctacttgagttcttactcttctgaactgtttgtatcgttcatcaaggaagataggatttagcattagtggaagtaaaatacacctatttcagcattaaggaaacttccctccaaatacattattttctttttttttttttttttttaaagatttatttatttatttattatatgtaagtacactgtagctgtcctcagacactccagaagagggcgtcagatctcgttacggatggttgtgagccaccatgtggttgctgggatttgaacttcggaccttcggaagagcagtcgggtgctcttacccactgagccatctcaccagccccattattttcatataagaaaaggaacaaagaaaataaatatcccattgcttcttggatgaagaccatctaagtaataaatagggacgggagatggaataaggattatccgtaggaactcactaatgttctttggaagtaaaactggaccgctttctctgaccactgaagggaataactgctatcatgggaggaaaacaagctgcgaagcggacagcgaataaagcctgtttgcaccggctaattcttgatactgaaccttggattcctgtgaatacttgacagggatctttgtggtatctgtgctaaaaatagttcatgtgggaaatttttacaatgtaacttgtgtcttttagtgtacttaaactaaatatgtctgtggcgtttcattaagaagttgttatgttccaaggagtgaactctgtaaacatttctatgctcaaccatgcttgtgtaaccgctctctctttaatctggtatgtcacagtcctgaatgtgatgtcttaaatgcaagtgtcccacactggctctccttctagattggatgaaaccctggtgtgtgtgtgtgtgtgtgtgtgtgtgtgtgtgtgttcccccaattccttaggttgtccttcagcacagctgccatcggctccttgcagtcactgcaacagagaaggtcagaggacagccctcggccagcattcaggaagctgatacagtacgattgagtttaaggccacgcttaactgagtcttaaaaaaataaaacaagagtctggaaagatggctcagtggttaagagcactggctgctcttctacaacctcagatttgttctcagcccctctgtcaggca

SEQ ID NO: 21215 - DNA, 1142 bp, Mus musculus
cagaccccaaaacctatgtaaaaaccaaacaccatagtacacacctgtcatcccagtgggaggtgcgggaagacagatacaggaggatgtccggggcctgctgggcagcgaatcagtgagagcctttcttccaaaataaggaagaaccctgtggctgagaggggtacattatgttgtgttatgaaatgtaataatgtaatgcattttaacatctaagcgtttgctgaggggcagtgttctcttttatggcttcttctccacctctccccttttttttctattttaagacagggtctctttattatgtacctctggctgacctagaactctctatgtagaccaggctggcctggaactcacaaagatgcctctgcccacagttgggattaaggcatgcactgtcacaacccactcctgttataggttcttggtcttgtaggaatttggggacagaattcataaggaccttggggacaatataatttgaaagaagggcaaagcagcagcctcaggaatcttcacccagctacacacaggaacggaggggtcttcagaggatgaacaaaaatgcccagtgtcgggacagatacatttgagatcttgatcagaatctgtggagatagaactgcttgcaccaacccttcccgggagtaactaaaagccgggaggctttgcagaactggttgtgatgcaccttagcctgacactggatgtgatcaagccctgtctcctccctgtgttctgtttataccccatctcgggcacagccatattttacctcaagctgaggtgctataaattaagagctgggacaaggacccagcctgtctggcaggaatggcggttttctaaagagaatgtgcccccttatctgtctttcagactgctgaaagaatgggtccctccaaattagtatttcctcgggaatctcttactgggaaaggaagtggcagaatcctgggggcttgcaaaggagctacaaagacttgcaggttgtcagctgaccttgcaggagacaccgacattgcctgagagacttcgagttgagacagtggtggccaggggatcacacttggtggcacagcttaagtatacacacctcctgctttcagcttaaaccctacccacaatggggtgtgttg

SEQ ID NO: 21216 - DNA, 1221 bp, Mus musculus
aaacttgaggggtagcctcgctctcccgggagcgggctggttcggcagcctgtaaccagagtgacatcataagatgccatctgtcacctgttctttttgctattgagactgtttatgtttctaggcccttgtcataaataagagtgttcattacttcctgggaatctgtaactgagctttttaaaatctcatgtcatgttatgcatttctacaagaactgactcaactttcaatctccctcatttctgaagtgtggtgggagccagttataaagaatccgtgctgtcctttgagtaactgagaatccatggctccagtcccacagctccttgaagggttagagacatagctcagtggtcgagcatttgcctaccacacacaaggtcgccaagaccatgaaaaatggaagtttgacattgtgtggtcctgatctgaaatttgcctataaataaatcccttctttgccttcctcctcctattcctccagggtatcaaccttgtgacccccaggtcatccaggaccgtgtcagccacctagagcagtgcttcagtgaactgagcaacatggcagctggacggaaggctcagctggagcagtctaagcgactctggaagttcttctgggagatggatgaggccgaaagctggatcaaggagaaggagcagatctactcctccctggactacggcaaggacctgaccagcgtgctcatcttacagcgcaagcacaaggcctttgaggatgagctccgtgggctggacgcccatctgaaacagatcttccaggaggctgacgacatggttgcacaaaagcagtttggacacccacagatcgagacccgtgtcaaagaagtgtcagctcagtgggaccacctgaaggagctggctgcctttcgtaagaaagacctgcaggatgcggaaaacttcttccagttccagggtgatgcagacgacctgaaggcttggctgcaagacgctcaccggctgctctctggtgaagatgtagggcaagatgaaggagccacgagggccctgggaaagaagcacaaggagttcctggaggagctggaggagagccgaggggtgatggagcacttggagcaccaagcccagggcttccccgaggagtttcgagattccccagatgtaacaaaccgactccaggcactcaggaagctctaccagcaggtactgacccaggcagaattgcgtggacacaag

SEQ ID NO: 21217 - DNA, 2208 bp, Mus musculus
atctcgtgggctctctgctttttctcttctttcttctctttctccactccctcccctcccttgtaattcgcatcccctatcatcccagtctctcctcccttgtctgtgtgtcctgccaagcgctgctactgcagttccttccttttttccttcctgattctgcctaagggaatggacccaggctctgccccagggaggactgttcaccctgctccggggtgggctgaaggctaagggtgcttcttcctccttgtgccgtgggctgcctccccagtggcctgggaaggtagagcactgaggtaggaaggaaacactactaggtggccctcaagcctggactggcctcttctgcctttgccttctgctgacgttctggccttgcctggctgcctctgtgcctctgtgaggaactgagtccagaggcaggcacagcagagaaggaaaacgaaagaaacgatggggtggcagggattaagtcacctctgttctctacctcccatgcctctctcctcacctggattcacaaatttaaagatggggatcgaggtctgaggacaccaaagggcaaggggagccctggggtcagatactgtatagtcagctgtgaactccagatagaggcaagagcggatgcgaagggcgggctcctagaaccagggttagagcaagagcagagggagcttcgcagaacagcgagtgctgtggcgactacagggcatcagaggtgacaagtaatcaaccactcctctttcactgaacccagccttagggagttagggtttccccagagtctggacaacaggccttaagacaagggaagagaagggtgggtatgatggaaatacttggtgctgttctgccttccaggactccctccccctggttcccttatttctaagtcggctttgccaactgctgtgtggctaccaagggagggaaagagacaccctcctccagagttctatgctcaggaagtttctttaaccctgtggttcaagagtagcttgaaggaggcccctgaaaaacaaacaaacaaacaaacaaacaaagccaaccctggtagggttcatccttacattcccaaggtgggaggagctcaggtaagagaagagtcccaagatgcacttcaagcctggggctggagccaaagcagaggaagaactaggcactgaccgagcattcaaggaccaaggtcctttcaaatccagggcacagctgtgatgacagagagccccacacctctttagtcctctaaaaagggagatgggggtgaaatcaatggggatttctccctgacttagcaaacaaggaagcaggcagaagagaacagctcaggatttactggtggagggaaaaggagccgggaacaatagtccattgttcgctaaagagaaacagtgttgtgaagactggaccatgactggctgaggtggcttccttggggactgactcctgggtagtagtaagccttcggtagcagacctgccttcagccagggacctgaggggagcttctacagggcacaggctgtcccaagtgtcactgtcttgtcccagcctcttaagaaaggacttgattttttttattaccttgaggattctgggagggaattcggggctgtgactctgtaccgtggtcaccctgaagtatagcaacagaaggaggctgggctatgaagaacacctgtgcttgctctgttctggagtttgcctcaccctaactgccagtctgggatgtggcttgggctgtgtcattggccttgactgttcagcaggctttcctggcctgtctgcccatgacctgagatcaactcaccctggtacaccacctgagtcccactatctccctgtgatgggtgacctttgtgtactgtgtcttgggtccattatatgaattgtgagcagggttcatctattttaaacacaaatgtttacaaaataaagaatatttcaaaccataggtgtgtgggtctgtatgaatctctgtgagggacaaagtattatcaggacattgatggtgacatgggagacagtgaaactgagagaagaggtcctagaatcctaaagcccagaatgacaagggacctggtgagctttatctgtcttccttagtgacatctgcagaagagcccaaagcaacccaccccccacccccactgcccacctgtgagctcacaggagcaaggggaggactaggagaaaggtgggc

SEQ ID NO: 21218 - DNA, 1189 bp, Mus musculus
ggtcttgaacttgttatgtagctgaagctggagtcaaatgcccagcctccctagtgccaccactgccagccacaaatagaagtttattcacatgtgtgaacatactggagtagcccagtggggtggttagagcctgaggtaaacagaggaagagcagtttgggcagacaggaggcaaggtgtggggagatagtactatggcactcaggtctacacatgtgttgcctcagtttccctgtattgcagagaaacaaggaaacaaattagtaaagggaaatggatttatttacaatttggccagaactggggcgagaaaagttctttaaattctttctgcctttgatgcagctttgtggaaaagatgaaaggagagttaaggtggctgaaccaaccagtctctcttcaggggcaaggcctcctcctcctcctcctcctcctcctcctcctcctcctcctcctcttcctccacccctccccctccctccccctccccctcctccccctcctgctcttattccttacccttcctctccccctccccctcctcctgtacttcctcctcccactctggccccaggcagcctgttctctcccagcaagggattcccacagaaactaattctttagagtccattgtctcagggttcctgtttcagggcaatccccccttctccttgttcattcttcaatcttgaggatttggggtgctctgttatctgttggtggcttggtgttacacattcttgaaatatgactttgcatgtgcctgaaagaaagatctacagcaggatgcagcagccagttagaagacccactaatgtgtcaggtcacattcataagaacccttctctgcaacctctggccttagtggctctcagaagggcaggcactggggactccattttgactgacagtacgcctcttgccttggaacagtttttctctgaagacattgctgctgaagtcttgtggtttgcctttaattctccctccttggtgtgatgaggcttttgccctttgatctgatctatgctggggctgggggtggggggaagtatggcaggcaggtagggagacagtgtcaaaggcctctgtttgggtcaagcataagcaactgtttggaaggaagggctcttaggccgagttttcctggagtctcctgaatttttgtgaatgttgggtccctcttc

SEQ ID NO: 21219 - DNA, 1755 bp, Mus musculus
ggtgacgaacctgcctctattctcttcacagcagcccacacaccctgtgtacaacattggacctgagaaggtgatccaggccaccacacactttctgcagaagccagtcccaggctttgaggaatgtgaagatgaggtgacctcagatcctgccaccgactagaggaccccgtggctctcccagctcccccgtcagacaaggtttctccatttgggtgtgtagcacgctctgtgctacttgagcctcgaccactgtggagttgtggtttctttgtcctttcctgtcaaacaaaacaaagccatcagctctgggttggaatacacggtggtgtgatttttaaaattattttcatacctgtcaagccaaaactctgggagccgatgtagcaagccaggttgggagcagtgtatgctgggaagcagcagcgcacccccttctcccccccccccccccaatgctgaaatggaagatatctgtgagtatctgcatcccagccactgctgtgactccacccacacacaccattcagtcaccagaccggcatcctctctggtataaatcttagctctgtgcaagggtggggctgtgggtccagccaatacgagctctggaagagagcactgggctccagtaggccatatttatgcttgtctctttcaccccagtcatctgcaaaggacaggggtcgggaatgaagaaggctcttagattgagccctccccataacctggggaaaaccgagtcacatcctctccgaggccacgtttggtatgagtgagacttattttgtccttggtatgatgactacacccaggtaatcaattatgagtggaaaaccaacctctaggtcaactctgtgccagaggaagcagcttccccatgcccagcccctgcctctccccatcatgtaccaggagaggccctcctccagctatgctgcggcccaggttccttctccccacccacccctccaagacagtgctgtcttttctcatccagagtgttaacactactaaggctttcaccttaattgatcactcaggatttgttcccgccctgtccactccaggcaggctggctgctgccgggacagcagcctcaggtagtagggctggcagtaatcctggaactgccctgcaccggcctggcacggtctgtagggtgctgagtttgctcgtccatccactgctacagtcacagcgagctcgcctcactgtcccagcctgtgagcaggcagacgggagcttggagatgcagcatgaggctcttcccctaaccactggccatttgctgcctctgattccctgttgctttggtgtactgggctatgtattacctccttgaaataataaaagagtaacattttctatgctgtcttttttttttccagaaaaaaatttaaatctctctctctctctttctctctttctctctttctttctctctttctttctctctttgtgtgtgtgtgtgtgtgtgtgtgtgtgtgtgtgtgtgtgtgtgtgtgtgtgtgtgtgtgtgtgtagatgtctgtggagaccaaaaaagggcatcaaatcccctggtctgaagttacaggtggttgttacttggctcagtatgggtgctgggaaccaaatttgtatccttctaagaacagcaagtgctctagccactgagccttccttccagcccactgtgctatctcctgtctaatcccagaaaattccttcaggatgcccctttgctctggggacttcctgtctcctgcatat

SEQ ID NO: 21220 - DNA, 1057 bp, Mus musculus
actgggttggctggtgggacatcttaggtacagggccctggctccaagatgggtatgggacaagggttgagtttaggcttctgtgaaatccatacactagttggatgtaaagaggtgcagtgtctagccgggctgtcttcaatctatactacctgatacgacaggtggtggaggactgaaggtgctgtgggcagtattgactgggcaggaagagacccgggcagagggtggtctgcagaaaaggacaagcaaaggaagcaaaaggcacagctcggtctcctttggcatgagtgtctaggacacgtggtgtggcccagtgatgcggatctttgtttctgttattacagcgggtcctgcccagagcccagcttacctgttggtttcctgtttgcttggtcactgcagcaggtaacttcccttagggacctgttgaaactcacagcttccttgcagcagcgagtttgggatgacaacttttgcaatcgccccaagcacggggtgtttaaaaatggcctggttcctcctctgtgcgtgcttttctgacatgccagtcccctcgaagagtgtcaaacatctgctaggctcacagagctgtcaggttttgtttggttttgttacatgctcttactatgtaggccatgctagcttggaactcactaggtagccaaaattgaatttgagattcctccagcctcagtctccctcttgctgggattttacgtgtgtgccaccacacccgagagctgtcagctgggacaggtttaagaaacaaaactgagtggggtggcaagagttaagagaactaggactcaagcagaattctgtttgcaaaaatgaggttttttaatgcctagactctggagtcagactgcctagatttcatagctttcatgaagtcatttcccttagcttcagcatcctcatctctagaatgaggttcataatggccatagctatataaggcggctgtgtgtatacgtgaggtaatgtgaccagtgacaggtgcaagatgggcagtgctagcaagtcccacacaagccccaaagtgagagttgtc

SEQ ID NO: 21221 - DNA, 2131 bp, Mus musculus
aggtatctgaacagagctttgaggtccttgctgtagaatgtgccatgtaagtaccagattctccaggagttcagggacagtgagccctccccattgtcaatagtagtccaatcagggcagcctatgggccaggcccctgctgttctccaatgctcacacccgccttttcctacaaccacaggggaaagcgagagctgatcaagttctttgttcctggggaattcacttctcttcctccctcatggaagatgcaagtaaaaggaaatgcaagtaaccgcctgggttagaacatctcacataaaataacatgaagggtgaccctccaggctcgagccgagctcaaccaagggatgggcagtgggcggcggcagcgggttggatgatgggccaagcagcctgcatgtaggggtgtctgttgaaaggcccaggtattttgtgtgtattggtgacttgcttccaagtgtccagcttgtcattccaagtggattttgttcatgagagccaaccaaaagttttctttgacccaatctattgtgtcatcctttcctgctatcattgggccttcacaccgtcatggagcctagctttgctaggctagcttcttctctgtcattgcattgctcagtccaacagggaactcttgctctggtctctatgctgggtccatggcaggacggtgtctcatcacaagccttctcttcagggtggtatggctgtggctggccatgtctgctgggcccccaagcccatctgggaaaggaaaagggggacggaagtgtgcaggtggagcagccaccggaagggaatgacttctgagccaccctgtgccttggggtccagcaagcaaacccttaggaagaacaggctggaccctgagtctgagacttggttgctccggatctccagaaggtggtaacatgctcccttggttgccttttagtccgtgcactggagaaggcaagatcaagtgcccaactgcagaccaactacccctcctcagacaacagcctctacaccaacgccaagggcggcaccatctctgccttcgatgggggttcagactccagctcagaatccgagcctgaagagccccagagcaggaagaaactccggatggaggccagctaagccatgcggggcaggccagcaataaaactgtcgactctctcgtcgcatcctccttctgttcatcattagaaccctcagaaccattgagaagactctttattttccttttctctttattaattgttatttttgcatagaagctcttggacaacagctctcatccccttccctgtgtccactatttttaaatgtattcccttcaggggttcctgtccccaccagaaattttaaaccaaaacaccccaacttggcagctctttctgtggaggacagacggccggccagacctctgagtacacggtgtcctgcccaccctaccagctcctccagccctcagagcacgtgcctggaggacgcctgctctaccaggctctcctcccagtcctccctcacctctgtttggtggactttgtgactctgaacttttctgctttggcaagaagacctgattggagtaatcagaactcactccctcctttgtaaggattatttttttggaaaagctgtctctcctgttgaaagacgggattcttgaagaagtttgtgtggtagaaaaggaaagtggggacagatttgcagcacccatggcacagtctgtaacttcggctgtttaagcctgaagacccagccttccagaaggccacgggacgctggtatgtatgtataggagacggcggcagtgaaacgaacggctctcaggagtgggggtggctatgtgggtggggctgggagggagtcttaggtggggtagaggttttgtattaagggccagtgatgatgttttgatatttatttcctgctactgaaatttgaatctgaatgaaatgccccctatttctgatgatgtcgatattgtaaagcgacagattcataaagtaatgatcaaatcttcatttctttctgtgtgtatttctaagaaatagagccaactattttgtatgtaaataccaagagcgacttacctggtactaaacccacagcccagtccagcctcccgccctgc

SEQ ID NO: 21222 - DNA, 1084 bp, Mus musculus
ggaagtcaccctgaacactggttactaaacttaataattgcagaatctcactagtactttttggggggtggagtgggggagtaagttgtattttaaaactaagtttctgaggcagttactttatgcaaggggttccttttgctttatttctgtttggataatttctctgggaaagagtgaaagtgtatgtgaaatgtaggattcctgagctggtcaagaaacccgaggcctttctctatgtactgtcctttgccgcgtctgctgaatccaacatgttgcacctgctctgctggctggaggtgtaaagtagggttgcactcttccacttctagttctttctggtttacagtatttttaactcctcagctttttgcttctttggagattgaagtgtatttgggaggaagggagtttgaccactctggaggttcaggaaacttgtgacagaagtgctgcaagggctgtagtgcttgtagtgcttctgctcagcgcttgctctgatgatgtaaaagccgcgttcctccctgcgcgtgttgtgagagagaagacggtgctaagtttttaagggttgtgtgttgctttgtcaaaaggctgacagaataaaagagttgatctaggaaccctatttgatctcttttggggacaagggagggttatgacagggttttgctatgtagcctggcctccccctctccctgcaggaattctcctgcctcagcctcctgtggggcttacaggtgttatgttatcaggcctgccttccgtgtcctaaccaagaattccttccgctaaacagctagtgtaatggcacgtgtgggttgtagtgttcccaggttcttttagactccaaaagatggtagaaacctcaaaagcaaatatattgacagaaatgtgtatcagctgtaggcttcaaacagaagagctaggaacctggagttaatatctgcctactaaagacactagtgagattatctcatctcaggtgcctgttgtttcatgttgcaatttttaggttacttttgagttgcttaggaattgttttatttaattcaccaaacagaagtaatacgtgtactgcgtgaga

SEQ ID NO: 21223 - DNA, 1192 bp, Mus musculus
agattcaagtcagcttgagaatttatcctaaaaacgacaatttgcgtgttgaatagtgaaatgacagcagagtattgagatgaagggatatgagggtttgtagcactggattcactcatactgagaacttggctttgttttagatgatgaacacattagtttgaaatacatagttgaattgattttggttgattattcagatctgtaatatttcaacctatataagagttattacagaacatctcaatgaagaagagttaatggtacttagaattccaggtttagggtggactaatttgctatcaggtagaatcctattgtgtggttgacttaatatacatttaaagctttcacaaaattgtctttcagctttgtaaccaatcaataccacaaggttttttggaactccatgaatatcaattttttgttgttttatatatctttaaaaactcaagtgcattttttcactctttccacagcatgtaggatccatgaagcacaggacattcaagcctcccgcccgcgtcaccaggaagatctctttgtaagaataaccacaggattgatttccagagagattagcctgtctgaagcattatgtgttgaagcaaaagaaacctattttcttgtgtggctaactagaaccagagtacaatgtttccagttctttgagctccaggaagatagaggacagagttgaaactctgaaaatgcgggcatggactggttcctggcgttggattatgctcattctttttgcctgggggaccttgttattttatataggtggtcatttggttcgagataatgaccaccctgatcactccagcagagaactctccaagattcttgcaaagcttgaacgcttaaaacagcaaaatgaagacttgaggcgaatggctgagtctctccggtaggtttgaaatactgaaggatttgatgaaatactgggcttggcttttaggtatacaaactcattccatagttgaaaaattcttaaaatttctacaaactgtctgcaaaaatctgttttagcagtcctttaaaaagtgtcatgatacatctatatagtcaatctagataaggtctacatagttgtaaatcatattttgcatatgaattaatatataaaagctgtggtatttatgcttatattttatttacaaattatgtttagactatattgaacaca

SEQ ID NO: 21224 - DNA, 1387 bp, Mus musculus
ggttaaagattgctgtgcagtggggtgtttacactgtgtaccaacatacttgttttctcctcttttccaaggtctgtcgggttgcttatgaaatcatgcaaaccctgcatcctgatgcctctgcgaacttccattctttggatgacatctactattttggaggccaaaatgcccacaatcagattgctgtttatcctcacaaacctcgaactgaagaggaaattccaatggaacctggagatatcattggtgtggctggaaaccattgggatggttattctaaaggtatcaacagaaaacttggaaaaacaggcttatatccctcctacaaagtccgagagaagatagaaacagtcaagtatcccacatatcctgaagctgaaaaatagagatgaagtagaagagattaacaacagaactcacttcagaccatctcggccaagcagaagacgcagactaacacgtggttcattgatagacacgctccacaccaagagcaagcgggaaccctcagatgctgcactggtggaacgcctctttatgaagggctgtggtgccctcaagcccatacacagtacaataatgtactcacacataacacgcaaagggattattttctactttgcccctttaaatattatgtccccattgaacaaacactgccacattgtgtaatttaagtgacacagacattttgtgtgagacttaaaacatggtgcctatatctgagagacctctgtgacttaccgagaagatgtgaacagctcccttctctggggaagctggtggtggtgtggccactgaattcactccagtcaacagattcaaaatgagaatggatgtttttcctttatatggttgtctggatttttttttaagtaatttcatcagttcagtttatccacctcatcattaataaatgaaggatgcatcaataaaataaaatgaaatattcactctccattaggaagttttgtaaaacaatgccatgaacaaattctttagtactcaatgtttctggacattctctttgataacaaaaaaataaatttcaaaaaggaattttgtgaagtttctggaattttgtatcactagattatatagttacaagctttacagtagaaatatggtaaaaatgggcttatagtttttaaaatttgttttctacttttattctacttttttcagcttctgatagagtaatcatattttaactaagagaagaatcggtccctctaatactagtaactggcttcagctggtgcatattttgaagttgctaagaacatgctttggtggtgtttattatcttactttgtatattgttgctttgttttaattgaatgaagtagttattttcttgcttccagagaaactagtgcttgct

SEQ ID NO: 21225 - DNA, 1202 bp, Mus musculus
ctaggcacccttagactgccacagtgctgtctctcacgattaattccactcaagcaaaacaaatgaaggtttttattatttataatatgtaaaaacaaaatggaacaaaacaaaccccattgtctgaccttcctttgcttcaatgccagcatctagaaaacttaattcatgtgaactttctaatgtatggctagaacttcccatgaatccattgaacttggcaggaactaagtcaaatgacccatatctcttgcatggcagctttgtgtaccattgacctgcccaggggcaagaatttcaagtcttttctcatccttaaacaaatttcaaagaaacaaagtcaataaatatatcaaacacgaacaagcatggagggtaatataacagccaccaagctcttactgcacggctttgaccagtcttaacatgttgctacccattcttcaactatatttcttcataaataaagcattataggaaaatttatgtagacatctccaacccattcttcttttctccttccccaaagaaaccgctgtgctgaattcagccattttattcccaaacatatttatatttattgtaggatacgtgcatacacaatttgcttagatgtggttttggacttatagaaatggtattgtatagtatgcatttttctctcctttttcccattctaccattttttttataatgccatgagaccacttttttttttattattttatttctttacattccaattgtagcttcccttttcttccccctaccccactgagcccttctccccttttgatcagaaaaagggaggcctcccatggatgccaaacagcctttgcatatcatgttgcaggaagattaggcctatcttctgttgaggctggatgaggcagcttagttaggggaaagggatccaaaggcaggcagtgtagtcaaagacagctcctgcctgtgctttaggagtcccacatgaagatccagctgcataactgtcacattgcgcagaggacctaggtctatcccatgatgctctctggctagcagctcggtcattttgcgtccccaggagcctaggttagttgattctgcaggttttcttgggacatcctgggacctttttggctccttgaatcctttattttcctcttccacaggattcttcaagcttcccttaatgtttggctgagggtttatgcatcagg

SEQ ID NO: 21226 - DNA, 1201 bp, Mus musculus
tgggactgagaggaagagacgtcggaaacctggccagaggcaagtggatgggctgctgggcaggtgctgctgccaaggagtaggagggactgtcccagcaaaattcagcatccacaccggcagtgctaaacctggtgacctgtgtggaatgttctcgctctgactgagttctatctcttaatatcaaacaaaaatcctttcatatgattgtaacttgattatgagttgatatcatctaatataccttaaaatatttcagtacgtgttaaaactgcatttggggcctttttaatttctcacagagattggatagagtaaaaagactaaggctaggttctgtagaaacagcggtacaacatatagaactatggattaatatagtctttcattgatgaccagttcagtaaataattgtattttgcctgtgttttattttcatgctattacttatatagccaggaattacagatttataatatttgtataaactttgggaatgaacctgatgacttcattttcattcttgtaaaatgtatttgttagtatttcatacatctgagttgtttatcttgggatggggggcaaattttgggaaagaaactataatggaagtccatagaaaataagggctaggtagtaaggtttgtatgacagaatacctgacaaaagcagcttgaagaagaaaggtttatttttgatgcaaagttgaaggctacagtagtgcaccatggccaggaagtcatggcctcaggattctgaggtggctgcttacactctatctgcagttgggaaggagagaaagataaatgaatactggtattcagcttctcccatgggatgttgctgctcatactctggattaatcttttcctctttagccaagtcttttggaatatctctctctctctctctctctctctctctctctcacacacacacacatacacacacacacacacaccctcacacacccacacacctgttttcatgatgattctaaatccagtcaagctaacaatgaaaattaatcatcccaacttgttgtttctaataattaaaaatatttaagaattatcttgctctttctagtagagaggggaaaggtggaaagattgtatatgcttgtctccatttttttcatcagtttgtcttaaactcaaaataattctgatatcaaagtagtacatattaagatggtgta

SEQ ID NO: 21227 - DNA, 1243 bp, Mus musculus
tatatatatatatatatatatatatatggactatactaatgaagttgaaaatataattaggcttctcacaaaaaaaaacttatgctccaaatattagaaaacaatatgggaagaatttagtcttaattacataaatttgggcttgttgtcgttgttgttttgttgacaccactagaacacatttaggaaagtgttttcaccaaacattcctacccaaacaagcccccaaataaacccagagtttagaagctatgctttccttgtaaatttaagtcttttagatttaaatctctcaaatggattgttattttggcatcattatatgtgctttcaaaattagatagctggtagatgagatttaacagcaactagtgactgagacatgacttcatatcatagactaacagtgatcctttgtcttttattacagattattgtttttccttgaaaaggagaccttgatttatttacaaataagtaaaaaaaaattactttacatatatatgcttttctgcaggatatgctggctcgtgcctataatcccagcactggggaggaagacacaggtagaacttgaattccagtgtaccctggtgtacatagacttctgggcaagccaggatgacttagtaagacgatgaggatgataaaataagactgagtctgaattaatgaatgaattaactaattcatgaataaatgaatgagtaaataaatagtgttcatcttttaaaacaatggctgtatggttccagcttctatgcaatcagggcccatctacatacaatgaggcttcagactagccccaatttatgttaccaggttagaattcaatatttcaggcttcaaactgacacctaaaattacagcccttggaaccagggtccaggctataggagacatggtatgcaaggctgcctagtagataccagcactagtcttggttcaacaagctcaggctctaggaactcccagatggatccaggtttcagactgacttcctcagacccaagatttaaaagcctatgcctgcagactaaagttttaagaccacttacagtggtctgaatgtgttctccaatttcaaaagttaaaaatataatccctgatacatcagtatcgtgaggtagtatcagatgagtttacctcttctctgacaactagctttcatggtcctaggtagcaccatgtagacttacaaaggaggaaagcagtcatcagttgaacccacctgttacacctg

SEQ ID NO: 21228 - DNA, 1353 bp, Mus musculus
ttagacaaatacttgtatttctctgtatatatctcttaaacgtgaaaaatggtgtttgcttatatattcatgagttttaccaattttggtggtaagtttgttcttttggtatttctagaacactgccttgtccccctgagtatacttgtcatctcactgtagcctcactgattaaatgatattttggtcccttggatcatgacattaaatatgaaggaaaagacaggattgctttctgggaagcaatcatctctaaatatatactgtgcttatgtgctgatattaagacgggttgctatggtgaattgaatttcttaaaactgtcagtcagcagagggtaaacagtggcttctgaagtagtgattccccatgaagctggacattctcacactgtattttcataaaggttaaaatctagttaccatgtttaatgaattatttaggaaatttcaaagtatctttaaagtgtttattatatgaaatagaagagttttgtttgctccagggacagtgccaggtggggagtttgactggggcggtacacctgtcaaaaggtaatgcaggtgtcctaaggcgagctcagggaggacagaaacctcccgtggagcagaagggcaaaagctcgcttgatcttgattttcagtacgaatacagaccgtgaaagcggggcctcacgatccttccgaccttttgggttttaagcaggaggtgtcagaaaagttaccacagggataactggcttgtggcggccaagtgttcatagcgacgtcgctttttgatccttcgatgtcggctcttcctatttttcactttgctacccacagttttgttaattctgaaaacttactacagctgtcttgctcttggtcattttttaaaattcttttataatttggtttgatttgcatgagtgtttgtttgcattgtacatgtatgtgccatatatatgtgtgctgttcatggaaaccagaagaggatgttggttcccttgttgctggagttgtagttggctatgggctattttgtgggatctggggctcaaacttgaattagcaaacaagtgctctacttttttaaaaatcaatataagtaggtaaactggtttatttatttttttatttgtataactagtcataaagccttgctcaaactttatttctgcccataactacgtttaaaaaagattatttgtttgtttttctcttataattacatatttttattggctattttatttatttacatttcaaatgttaccccctttcctggtttcccctctggaaaacccctacctgatcttcctcccctgcttctatgagagtgctcccctactcacccacccactcccacctc

SEQ ID NO: 21229 - DNA, 1291 bp, Mus musculus
taggttttcctagagggctagaaaagtaaatatttctatattaataaagattggtttttattttgatagacaggcttagtcccttagctgacctctggcttttcacccttgctgttactacaaggtgtccttagctgtaaaaaaaacagggatgaggaggaacgacttccagctcctattttagccacaagtcgtggtgttactaatgacataattcttgcctaggtcttgctaaatctgaggttgataattctcctttaggagctgcacagcactcagaactgtgcatactggtttgtgatcatacaaattcagtatgggcatcgcttggtgcagagaacactgcaaaaaaaggtccagcttgaccatttctgagtttcctgtgagataaacccggtttgaaagaggttggtatcatattttggctaaaaatcaaaaatatttttcggctctgcctcacctccccaaaaggtaccgagagccacaggtgtgggtcttaacagtacccacgagaggaatcgggtcaatgtccacccaagccaaggttaaaggcccactcatctacggatgagaaaatcatttgatcacctcagttaagcgttgccttatttaacttaattaataggggggagagagattggagacttaagcgttgccttatttaacttaattaataggggggagagagattggagacgtactattgaaagggcaagcccttcactgcctcccacccaaataaaagagctggtcgaacgccttctccctgtttccctcctatcatccaaaaatgcggaggaatatcaacttagtgttattcttattatagtgtatttcacatttgttcagtcaaacttagccagagttccaacgccctacttaaaattcaactagaaagttacctaccaagtactaattaacattataaagtcagagcctacagctccaggcttttcagttagttgtttactaagataagaaaggacagtcttagccttatacagtttaccataagaaaagttaaggaatcccacgaaagcaagttttttctttagccctagattccaggcagaactattgagcatagataatttttcccccctcaggccagctttttctttttttaaattttgttaataaaagggaggagatgtagtctcccctcccccagcctgaaacctgcttgctcaggggtggagcttcctgctcattcgttctgccacgcccactgctggaacctgaggagccacacacgtgcacctttctactggacccgagattattaggcggg

SEQ ID NO: 21230 - DNA, 1186 bp, Mus musculus
gtgcctgagaaagttttttccctgtgttcaagagaatttctttttaacagtgttgcagatctattcagatgtttaaaataatgcttaaattcaaagagttttgcttctagtgaactggtaatcactagaaaattttgcctctaggtatagataatgtaactttacattatgtaagaaaaatttttattgtttctgcttctatacaaaaagccaagagttttaatctttcagtgtatattgtttcctaagtaaaaaatattttattaactaatgcttcttgaagtttaccttaaatccttgctctcacccaaaagattcagagacaatatccttttattacttagggttttagtttactacaaaagtttctacaaaaaataaagaaagcttttataattgttattaattggtaattaaaaattggttgtgcccaaaacaattctttggccaaaaagaaaacattattataaagtcatttttctcatcctcccagccgattgttggcccacgtgggcccaactagcttctgtggggcggagtcttaagacacagttgcccctgttccagcacaaataatctggttgtgtgctgtagatggtgttttaaaatgctgaacaatcaaaccttaatttgtatattaatagtcaatgccatatctctgagctcgcaattacttaaattgttcatccctcagatactattaattctcaaatttacaattgcttatgcatatttctagttaacaaataaattatgcgcatgtgactcttaataactttgcaagccttctagttacaactgctccttaaaaaaattgattgaaagtgcaattagtcactgcccctttacagccaagtatttaaaacatttggtcaactagttattaattcaaaagtttaggtattgtaaaattttaaaactttaacttcttaaaagacaaaaaagagagaaattgtatccccgtgcatactatttagtgcattctcatgcacactattaaagtcttacctttattttcaaaatttaatattttaatgtataataaatgctttatagtatcttaaagggatctacttattggcttatagattgatcctaaaacagctaccttattaaaaaagagaaaaacaggttttctccacagaatgctgcaaaagcatattagtaaattcgtgtgacgagctgg

SEQ ID NO: 21231 - DNA, 1193 bp, Mus musculus
agagatcataaggaagtaagtcattgagcattttagaaaaggacatcaggagttttattaagcgtgtacagacaagtttttatcctaacagtcttccttgtgagtgaaatacagcagcttgctaaatcttaaatgttcatgctaacgggatttttgtactgtctctttagctatagctttaaaattgtctacaaatccacaaagaaagttaccttgtagtcgtctcaagcctttaaggagaatgttctgtgtgacaaccaacctcaaatgtgaatgtcttgattttatgtagctacagaatttcatgttcccaaaactaaacactggaatgacactgatgtgtcacttagcacaagcagttggtgttgatgtcttgtcagtgctgtttgtgtctgatttctcttctggataatcttattggaacaaatgtagagtgtttgtgatgtctttttatgttcagttttgcatggcttttgtagttggctggcaagtgtgtctattagaaatactttcaaaataattttccttaggaataagcacattcttgggttgagggaaggaatgctatgctatacggtctgaagtctgaacactcccagtttacagcaggaaaagttaacgccttgtcagcactgacggtcaggtcacttagcacgtaagggattaaatctgtccaggttttcactggttttcccctcaggaatgaaaggtagtctatggtcagtagagctttgtgatctgcgtgccgaccaaaaatactgcctggtgagacttggtgaatacctgtaaccctataggaagatctaaagtttaaggctggtctaagttacatcagactatctcaaaataaataaataaatatctttttttaatgagaaagaaaagcatggatgaaaggatgaatattggatttaagtaaagttttaagttagtgtcagtggggctatgtgctatcaagactctcacacagacctttacagcagagcctatacccaggcacttgccatgccaccatgtagtttttgactgagattctccaggtcagcgagatcctatactttacttgtaagtcatgataggatagtgtacatcctgagcttttgtaaatcctaatggttatgaatgtactaatgctcaacatagtcctaaacagtgaaaagttagcctctgctttaaaaaaaagccttgtttta

SEQ ID NO: 21232 - DNA, 1307 bp, Mus musculus
tatagggctactgcaatcagatattagtgtttattctcaaatattttgagaatgagttttaaattactgaaaatgaaagtcagaatctagttttccatgctcattgcctagttaaagaaactgaagacattgagtttctatgcactgaaacagcattcagaaagtccccttcttgcaggttaaagaaaatacaggagaagaaaaagattatcaaggaaaaatttgagaaggacttggagcggcggagagcagctggagaggtgatggagcctgccaacctgctggctgaagagaaggatgaagacctgctgttcgaatagctgccctcgtctgctcccttcagactgagcatcagctccatgttaactcagtgtgtaggttcggtatgtgtggatatttattttggcatatgaatttctctggctgtaagatttatcagaatgccttgtaagactttttcctgcatcataattcagcaacccgagatttgcaaaacctgcccagcaacctacagaatttcctctgtgaaaagtgtcatattattctatttacaattgtttgaccgatctgtttaaaactttaggaaatatgtactataaacattcatggtcgcaggcaaaggctgtgagcaaccttccttcctacccacttggaaaccttgccgctgttgtccgaggctgtacagccattgtgttcctatggctcaattcttcacctatttttctttgcacgatatgtgtttgtaatggaagcagttctgcccatttaaatgtgacctatgaacagagtaaaatgattttaaaaacatgttgtttctttttctttttgagaattagctaagaatagtgattgtgtccttatgctcagatcactgaccttcctgccaatctagtgtgctactagatttgagatagtttattgcatattgggctactaataagtgaccactagtactatgtaggcttcttaatacttccttcctaacctaagaacaatattcattcctattttggactaatcagatagcttttgcttaggagcaatagcattttgctgtttttttttttttatgaagataatatgccagtggacagaccaaatggtgtttgaggttcagtattgcttaatttggcctgattatctgtgagtactcagactttagtgtaaccagttctgtgtgttctgggcttgcctgggcaagacagttcttggttatgagagtgacaccagcattaacggagtctgaccaactgctaccacagtaaagatactaaatgattctgcaaacatttaggactatttgccag

SEQ ID NO: 21233 - DNA, 1255 bp, Mus musculus
gaagattaacgttttggcaaacagtccaatttaaggagtacgaagcagcccttcctggctgtcaaccctagacttgagagttttccagtattgaaaacttcaaagctgaatatttttatttccaagtatttaagtattcaacaagccagaatctaaatgccctccttcatgtcagctgtttccacatagtggctctaacacctcaagcatttttcaagggagtggcttgatttgaccagagacaaatcttaaacagcagtcctaatattgggcctacagtttccatttctcatgtctctggaatggcacccttatggttcagagatttaccagggactccaaacacaaacaatcccaatctttctatataaaatgtattcaagcaaacatcaaataaatttctgggatatttaattgtaggcttcttccttcttgtcacaagttaaagccaatctgaatgctcagatcctaattatcttcatatggtagaactcaatgggcaagtaactaaatgacttatgcaggaacagactctccaaaggaatgttagagaagaaattaggaatttgacccctggtagagaaaaaccttgaaatcaattaaagatttatgtgcctgttaacttacttgaaagcagtgataacttgtgtgagaagtcatcacactcagtccctttggtttattctaagctacttaccttgaattcataattcaaggggtattttaatgtgctgctgctttgatggagttattttgagcagcatcacccatctgaaggggacagtttcctctatctggtaggtgctacctaattcttgagttgtgtgtatgtgtgtgtgtgtgtgtatatatacatacatggttttatatatatataaaccacacatgatgtgatttaacaaaatttttaatcccatttttaccttctcaaactagctactttaaaggttaatgtgcaaaataattttttcaaataacacaaagttacagctacaatatcacatgtagaaagtcttcatttagtttggcatgcttatcttaggatatgtatactatttattatctgtaagcaaacttgaaactaagtcagtccaggactagacatcatgggaagagttctagagttgggtacagaagcacatgctgatggctccagtacttggaaagttgaggagggaaaattccttgagccaagagttgctgatcagcctggacaaccactgcaagactctgtatcaaaaggattggaaattag

SEQ ID NO: 21234 - DNA, 1168 bp, Mus musculus
gaaggagaagaagggggaagaggtggggcaagataaggttagaggaaggagagagaaggaagaatgggttggggggggagacctttctcatgtccgcttcagcagcttctccttcatgagctgacttctcaagtcctcagtacattcctgggccagcccagtgtccactttttgcaaccacacctttctaaacactcaccagttccctatgctgtcaagatttttcatcccctggacagctttcctctctagttggtcctggccttgggcattctcctccctcccgcctcacagggtcccagtgtcttttcctcagcatgctcctgctttcctatgccttcctctggctcctcctcaaggcctatcctctgccggcctcagatgtcaccctcctccccaggatgctcctccactgctgtgctccatcctgacgtgttcattaggtaatcactcagttacctgtttgtcccgtcaggtgtgtaaatgcaaagaccccagaatcagaggaatccaggccatgtccagccttgagctggctatcctatctgtacttcaaacacaaagaacatctgaaacaaagctactgtgggttcctagacctgcacctcttcctggatcctcttctctcagggaatgacaccaccatagccaggggcagaagtctgggtggcatcctcaacccttccttccagataatcactcaggagtcctgccctttgtcttccatgatgactctgcgttaacctgggtcagatttcctaatcgttttagctaattgtgttggttgctcattcctcattaggatttaggattgcaatacctaatttactattgggctggtttaagagttttgcaagtcttcagaatggatatcgggtctctttcttgaccctctcttatgctgggaataaatcctagccttcaaacatgctggacaattttctgccgctgagcctgccccaatcccactctttaaatacttttctctgatgtcctatgcatgtaggagtgtgcccaataaagtgtcaagatgcttggcctgggccagggtctcagattctgtggtctttgcatgtacacatctgatggagcaaataggtactgagtgattgtttaatgaacatgtcagtgaatgcatagataataagattgacataaaagatcctgt

SEQ ID NO: 21235 - DNA, 1355 bp, Mus musculus
cagtgaagaaggcagcattcaggataaggctagtttaatcctttgcttctctaacctccttagattacagaaactaccttaatgatggccagctacatgaaccactgttctgcaactgtgaacctatcagccaagctccctgcagcccgccagccccgagacctggatggacagttctttgcttctgtttcctgcactaaggggtcagctttgctgtgaacatttctcctccccatacccttgccaccactcgtgcctctgggatcagattgataccctggagcatacactactgtgatgggtctaatggcccctcctcaaactgttctgtgaattgtgaattccagggtctctgaaacctttgtgctctttaggtgccttacctttcaaggcccaatgttctaagattcagacccaacatcaaaaccactattttacaagaatactgactctggatgctacctgattctagatagagacagggatggcccacagttaccagggcaatggtactgtatttggggcttctgcactgatactcagggaagctcatctttttatattatacatggtctttacgtggggacttatacttgaagttttctgaacatccctgaataaaaataggactaaaattcctaatttacctaaactctggcaaatgcctacaaatctctaaaactggacttctttcccaaatgggaaaaaccctggccaagctggagaaggaaagaatgacgagccctcccctattggtgaggaggcatttgccatgcccttttgggctctaatcttttcaggactgtacagtattcctgttaagattaaagcttttcctctcacactggactagcacaggcagggacagagccagtctgcacccttcctgtgtcattttaaggcccaacaaggctcagtgaagcctgtgctcactactgaaggacgaggtggtcatcatctcctattctctccaagaccaagcacataaattttgcttgttgctgctctaagaggccaccagagaaacaagatatcaggaacactaaagacccttccattcttggaaggcctggattgctcactaagacttttggtagagggcttctcgaaattagttggaagcacagggcatgtacatatctgtggaagtagaaagtttctttcaactttgccttcctgagaatattatcatccctctcaacgcaaaccttttagttgattttgatgaagatgatctttctttccatctttccccacaaaataataataataaaaaaacaagtccatactttggttttccaacatataaaaaataagctttattgtgtagctttaaggcagttttattatttttc

SEQ ID NO: 21236 - DNA, 1259 bp, Mus musculus
gaaagcaacattcacagagtggactaagactctacaagggtcagccaggaagaaggtgaaaatctacaagaatttacgtatgcctttctggttctttataaacatgcaaacacttgccaaaaaaaaaaaaaaaaaaggtgaacatatgatatggcaaatcaactacctgaatgctggtcagcagccggagcagacctctttctactaagctttaggcatcaccactaaaatctccagaggcaccattaaaattctgagggatgtgcagctgataaaaactggagacaaggtaggagccagagagccacattgctgaacacgctgggcggatcatccagcaggtgtttgacaaaggcagcatttttaaccaggaagtgctgggcatcacagagcaggccctgcactctcgcgtcctcgaggatgtccgtggccagcgtctgtctgcagattgggtacctgactgttgcctcggtgccgcactccatcatcaatgggtacaagtgcatcctggctttgtctgtggagactgagtacaccttcccacttgctgaaaaggtcaaggccctcctggctgatccatctgcatttgtggaggccaccactgtggctgcggccaccattgttgctcctgctgctgctgctgcagcccctaggaatcagaagaggatatgggattcggtctctttgactaatcccgtgaaagcaaccaagccagcctgcttaatttgagaaagatggaaataaaggcttacttctcttaaaactctgtctgggtttattccgtgtgttcacttaagcagggttaaaaagcaaaaacatttagggagatactttgtgttggcatctttctaaaaataaagctcctagtggtttaaaaaaattgggggtcccttttaaatgaaatcagatgaatgagtctgtcatttagaatctcttgactaggaatgaatatgaaaaatatttaaaaataaataaaagtttaggaaagaagacaggaaatatgcaaaagtgtgaggagccgccctcacatttgccattataagatggcgctgacagctgtgttctaagtagtaaacataatctgcacacgtgcaggggcagttttcccgccatgtgttctgcctttctcgtgatgacaactgggccgatgggctgcagtcaatcagggagtaatacgtcctaggtggaggataattctccttaaaagggacggggttttgccattctttctctctctcttgttcttgctttttctctct

SEQ ID NO: 21237 - DNA, 1686 bp, Mus musculus
gggggacccgtgagctctagattgttttcctggcatattctttatattaggcaaagagaaaatgccattattgaccctgtgtttcaagtctctctgtttcccttccagtgattgccagttggcatgggtctcttaccaaggtcgcaatgagataatagccaggcggctgtgggatgtcagctgtgacctgctgggcctcccagtggattggtaagtggtggtttggactcaaaagaagattggaggagatgatgattatccttcaaagtggccaaaaccttgaacctgaagagcgaagaacttcaagcctttcctgcttggcatccagttaaatcctagtacactgccaggttcctcgaaaccccttgagtttgtattgacttattttgttcctgctcctgccagcgtttctagtggtatcactaagacagaggaccttcatgtgacctacacagctcctattttcctttggaaactccccctaaccaggagcatgaaagccctatgaagattggtacatgacaatgtggattagatggagctcctccgagccgaccatcctctccttgaagaactccattgtaacctcagctgaacctcaggagtcccggagcctggctcaagggcaggcagggctttgtggtcccaacatctggatacttaagaaaagtttttactaaatctggcagtctgaagctttggcttctgagacacttttctatgtccagaccactgaagagcttccttctctaagaaatttgtgggatttgaagggcagagataaaaataaagccaaactgtcattttctcccgctgtttctcagcctagtaaggaggtaatgaaaggaacggtatgagacgataggtcactggggtcagttactgaccccagacccacagaggcctcttttttgtgccttagtttctcttaggaaactagaaaaggaaaggccttctcattgtcattgtgtcgattttgtgtgtcttcttgtgcattcatgcagttgaatgtgtttccacaaaattcacaatagccacaaaggaaaagttcttaatcagactgtagtgtagacaaattaccagagatgggacaaatcactgtggagtctttgagtacagttgcaaagcaagggagacactatctgtgttgtaatcggtcactgagaagcacagatgccgcagggaagaagtttaaaagaaaaatcctaggaggggacacatgataatgaaggggtcagctgaggatctaaaaccataacggaaaggcagtaatagacagctacagaaaggcacactgtcttaatcaccagtcagtcagagtgataggaaaatgtccaaagcacaagagtgaaatatttctctattcagaaatgttatcctaaggattggtaattatagtcagttcataatcttttagagcattttcttacattagcttaacaagatgtccatttcaggaatgtgtatggagagatgggatggcttagtaatgcctgctgttccagaggaccctggttcaattactaggacccacttggcaaccacaaccatctataacctcagttatagatgatctagaggatcagacagcctcatctacctccacaggccctgcaggaatgtggtgcatagatatatatgcaggcacacatacaaataattttgtaaaaaaaaaagaaatcaatt

SEQ ID NO: 21238 - DNA, 2049 bp, Mus musculus
gcctgggaactatggcgacaggcacaataccacacaatgccctccctctccgtcttcctgtggagtgggactttatgcgcctgacccaggtcggagtgagcaagttggaccgttcttgcctgagtgggcaggaataggtcctttcacacaagtgccatgtaaaattgtagactctgtgtttgtctggagatagccacttctttctacctcagagtgactgtgcgtgcgcatgtgtgcacatccgtgtgcatgctcctgtgcacttgtgtttacgcccaagcattttctgaacaaatgagactcctccattgaagagaggcgctttacttcctgctttgtgctggtctgaagaccttcggtatgtttggttcttgtcctaggtcggcctgttcgtgcacagtttcccctctatgcagacatacatggtcctcctaacaggaggggtcaacagaattacagagcaatgccaaaaaggttgcttctgcccaaaattcagagagaatgttagaagcatggctgtggaagatggcagccttccccgtcacacctctcgcaagcacaaggttttcaagtgcagacatctgaaagctctggcagtggtataaagtcagatctgggaaggtgaggccaggccccttcacattcattcagaaggaaggaaaaggcagacctctctgagcacaaagctggctcttgccagtatccctgctgcaggattgatgtgtaaggacacatggctttttctttcagaggctggggagagaaatggtagccaggatcattgggactgagtgaatgctagtctctacctgtttgcattccattcccgtttgtacctcttgaattagttaagaaaccatttctccatctctcgtgctccctgtctggtctcctcagggacacagggtggatacctaaggtgagctggtgctgagagagagggtctgcattttagtgactgatttgcaaatgagagccctaaagaaaggcctgtggccccaagtctcccaccagccagagctcagcctattgtctcccctttgctgccaaggcaacaggaactggaaactgaagtcagtgtctctggtgcttagaaaccctcttcgtttcttctgaaccaagattttcttaattaacagctgttaatggacatctgtcagattccaggctttggtcctaatagagaagaaaggctgaagcagaaacctagctcacttaaggctgaggtctgacagtgcctttccttcctgacgcatagaacacaccacagctcacaggaacccccattgcctgaggtctgcttacactcaaggctgtgtatgtttgcactgaacataagcactttacacaactgggttggaagtcttgcagccctcgatttaggatgtcattaccagatttccctgactatcttctaacttgaattgtaaaataggtggaccattgaccaggttaacagagaaaagactgcagacctaagacattatactgtggtctcctgaaaagcaacaataatatcaaagcagttgtacatgttgaggggttgtttgtcctcctacaaccaagccacaataaactgcctatcccacctacgtcttagcttcatcagctttttaaattttattatttactgttatgtgcattggtgttttgcctgcatgtatgtctctgtgggtgtcaggtctcctggaactggaatacagacagttatgagctcccatgtggttgctggaagagcagacagtgctcttagcctccaagccatctctccagccccatggctttatttatataaacacacgttttaaattttttcatgagtacctgcgtgcgcgcactcgtgtgtgtgtgtgtgtgtgtgtgtgtgtgtgtgtgtgtgtgtgtgtgtgtgttgtgtgttgtgtgtgtgttgtgtgtatcacatgcatgcctggcacctgtggaggccagaagagggtatccaatcccctgggactgaagttacaagtagttgcgagcttcctaatagggtttctgggaactgaattcaagtcctgcctaagaacaaat

SEQ ID NO: 21239 - DNA, 1198 bp, Mus musculus
aagaattttttcctcaattaaaagtgaaaatatgaagcttaaaggttttcaagaagaaggaagtcaccatctgtcagaagccactgatcccattgggaatgacaaaccagtcttctagcatgtgagaggtgctttggttgtccccacagcaccaagaaccgattctgacagaattagcagtgtggagctccttgttagctagctgcagttcctgatagcatttggggggcagaagtaatgttagagggatctgaggtaaaaccctgggagaggaagaagagcccatgggtgtagagagccgtcaaggaagggccgagtggagcatctatcgagtgtgttctcagaggaacctgtgacacaaaggatgcgaggtagtgttcagggaagaccaaagctcaaagcaaatcctagagcctgccagaaccagctctcccactgctgacttcctaccgtatcctgctgtttccaggaaagtcctccagaagtcttcatagaaggcattttccagccgagctataaaagcgggaagctacacactttggagaacttgctggaatccatcgatccgaccttggagagctggggagcccacctgatcgccgcctgccaacatctgcagaagaacagctactaccacatcctgtacgagctgcagcagtttatgaaggtgatgacaccccagcctccctgcctctcctgtccctggtgctctgtcatgcaggagaagctgtgcaagatgagggaacagggcagtcatttgaccctaaagcaaatccactgggctctctaacattgttaaatatttagacttttatcctacatttagagccaaactttagtcttgtccataacattcttcagaattcaaaaaatggggggctggacagatggatcagcagtaaagagaactgcctgctcttccacagtatccaggttcaattctcagcacccacatggtggctcataaccatctgacctccgtgggcaccaggcacacatgtggtacacagacatacgtgcaggcagaatacacacataaaataaaataaaactcatttaaaaataaaattcaaggactataaaggtcaaaaaaaaaaaaaagatataaaatccataaggaatgatgttccagaaagctgggatctttaaaagaaaacatatacaagtagaaaggccaagtttcccctaactgtctgag

SEQ ID NO: 21240 - DNA, 1197 bp, Mus musculus
agtggcatctatgcctttaatcccagcacgtgggaggcagagagaggtggactgaggctaccctggtctagaaagtgagttccatgacaaccagggcttcacagaaaagccctgtctcaaaaagaaaaaaataaaatccaatgctctctagtcctgtaaaatagccatcttaggtccatagtctaatgaattggcccagcatcctatctctggatctcccagagtctgtggaccccaccactgccacactccttccctccccatgacaggtggtactcatgttcaacctgaagtcctcacctatcgccggggagctgatgttcgtagagcgataccaagaggtaatccaggagctggcccgcgtagaacataagattgaaaaccagaattcagatgggggtaacaacaccatccggcgcactggcagtgggcgctcaactctccaggccatcggcagtgccgcggcagcaggtttgtcttccttgctgacatcaaagttggagggctagctggggtggcagcttaagggaagaaaccacccaggtcttcatgagaagtcgacagaaacgggaagcagtttacctgtcctaaaccagctgacacattcccagtctcccgctgcacgcagcctcctgacacagtcccagtctcccgctgcacgcagcctccctgaggagacgtttcacacacctgcctcttacgccacccctgcttatcttcccagcttaagagaaagcgcaggagggctgccccagtgcatcttgtaatccctctcgggggctttagagggttgttaggagccgttctccttcctctagttgttctgcagtaaatggtatcacatgactgttcctaaagttggaggaaaaaaaacccgcttgttaacatttgcagcctgggggccacagcctggttcccagcagtggcagctgggtaccccaacagctaccttcccttctttctcaaagcggaagctcatcccgcattctcagctctcctgtctgtccccagactccatatatcaggttaccatcctgtggttggcctttacagacgcttccagaaacttttcagtgccttttttttttaaagatttatttattattatatgtaagtacactgtatctgtcttcagacacaccagaagagggagtcagctctcgttagggatggttgtgagccaccatgtggttggtg

SEQ ID NO: 21241 - DNA, 1196 bp, Mus musculus
attgatgggatccaaagtgatgttgtggtagttttaatggtaactgcttaagcctggcaagatttagccaatagtgttcccatgggctcagttcattagttttgatgattgtgctgtcatgtactgagtaagatagtaggaggagctgggagaagagaactctgcattctcttgcaactttatggtgaatctaaaattactgcaaaataaacagtttttaaaacggaggtaaagtgggtgattgcctttgccatagtcggtcgacagactcatgaagacgttgtactggttgtgtctggagaaggggacgtgcatttgagatactggctcgactccctttggccatctgcttctatagatcttatctactacctcattatttttaacactctttttcatctttcaacgaattctcctggttccatcttcgtaataatctcagcgtctggttacttccaccatctcagtcctgtctccctgggctatgggagcgcagcgctggctttggatttagatgttggcttgacagatagtccactcttgctaaaatttatcctggctctgaccttagttatcctgtccaaaaaatgggtataatctgactttcctggctgtagggagtaagtggggctgtctgtagtgttctttacacaatgtgtggtaaagcactctgtgaaaggcagcctttagttgttaattttagcagttacctcattcccaatgttttgtatattttctaccttaatatttttgcagtattagaaccacaagaacagatcatgctgtcctcttcattgtcccttcctcagtgttgttgatagatactaatgctgcctgaagcctcttttgccccataactcctatttttttgtatctgagactttcttcctctttccccttttatttaattcaatataaacttaaaatttttcccaactatactttaaataaataaaggcttttaaatgctttagcctcccttctagcctaccacccaccagaggtagtggaaaagaaaggttattgggatacggggaaagtggacttgtttagaaatggttctttggaatcccttctgcattgccagcagttcagttcacaggattctccagagatagctcgatccactcgaaaatacttcatgaatacaccagcagtccagttcagtactgttgggatagcagacacgaatcagc

SEQ ID NO: 21242 - DNA, 1180 bp, Mus musculus
acacagttcctcagttgaggctcttagatgactctaggttgtggaaagttgatggttaaaaacgagctggccccagtggcacaagcctttaatttctgctttggaggcagagatgagcagatctctgtgagttcaaggctgtccggtggtctacatagcaagttccaggatagctagggctacatagagagactctatctccaaaaagaaaagaaagaaaaaacacctagccatcacaatcctctaacaatctagaccgccttcctctgagggggtgctgcccttcccatgcatgccgtaaagaagcagggaggcactatttcttctgccatagaaacatcatttattgaatcattatataaacatacttttattgtactctgaattaccgttggctttaaatttgttaatcgttattttcggttgaaacataaaactagagtctttacaactgtggtcaaaaggactttaatgttgtttttggcaggtcaggctatgagcatagccccactggttacaagacagcttagagagtcacattttacctccctaaggattgctcctatccgtgtctcccagctctgctcctccttcaggtagacagggttctgaactgcacttctcttgtagaatcatgactctctagggaccaactctggtgactagaaaagctgctgacttgggcatctctgttacagactttcagccccctgctgtgtctttgtccactaacagcaggggcaaattaagtctacctgcagtctaggaatggtagctagcttttcttcttttctttactacgtaaatgccatagttcaaaagcaaactgtgtttaaaagttttcttgcttgtgtatccacttggagatcttgacagtgctaggtaggctgatgcaagtatcgagttcacagagtagactgttaggttgtaattaatagatggcaaaccgtgtctgtgttgttttgcagtgagaattcactcaagtgtaagctttaaaggcaatacttgtaaagaacgggagactctgccgattgatttttattcttgtaatttgctagttttcctgtgtgctagacttttccatggaggctgtgaaaatgaagctctcctgcccacgttagacgagataaaattgagactgggaagatgaagtaacacagaacaccctactcaggaacct

SEQ ID NO: 21243 - DNA, 1190 bp, Mus musculus
aaatattgaaacaaaagtgatcatttggaaaactcacactgaaaaacatttctgatgagactggtaataattgacctgtgaacattaggaagctctgcatggctaatctttcacatgattggtgtgtgaactgtaaaacatattggtaaagatctttttttttggaatacaaagtagaatagaagattttaaaatagtagaacaaaagaaattcatttctctgccgagtttgtatggtaacttctttttaaaatttagcgcttcttatgggttggtatattttcaagtgaacatttctccagttatatgaaaaaaaccactaaaacacattttccaattgtagacagtcatattatcttcagagacattagccaaagcaagaccacgtgacaggctgcagacataaacatggaagcatagttagttgttgtctgctatggtttgcagacatttctattaaaaatgtattttgtggcctgaagaaatggctcagtagttaagagtgtgggctgctcttctagcgaaactgagtttagttcctagcacctacatcacgtggcatataatcacctgtaactccggctgcagggatctgataccgtctgtcctccaaggcacctgcatgtccatgtttgtacacagacacagataaacacacatacacaacaataaaattcaagaaacaactttgcattagatgtatcattgtctagtgaggttttaagtagaatcataaaataaataatgaattataatataaataaaaaagaccccaggctgggcctagcacacaagcctatagttctctggggaggtggagacaggaggatctgaaattcaaggatgtttgaagctgtaaaggaagtgtgggaccaggctgggatatataagactatgtctttaaaaaagtatgtagatacttaatggaaatttgttttatttcaaatgtggtaaataccagtgtgtagttcatatgtctgaaagttccttgtgaaccttagcaattttgagaagtagaaagcggtctttgtggatgaagacagttttcactgcttatcagcgaaagctccaacttttcagttgcttttaagaccatcaataaagtggtcctaacatactttttccaagttgtcttttttagagatttttaaaaaaattttatgtgtgtgggtattttgtaggcatgtatg

SEQ ID NO: 21244 - DNA, 1106 bp, Mus musculus
tggacgtggtgaactttttcagctgtgtggttcactggtggcctgagtagattggtggactataaattacccgacaccctcccatgcagtccgtgtgctgctagacatgaagtctaaacgtctttggcaaatttggttctttaaggggagtgttttgacttgattttgtatggggcaagataggcaaactgagttctgctcacggctgccctgcctgctaatccactgcaccttatgagactttttagggtctctcattgatcttctgctcctccctcagttcatgcatccagaactacagtgaccccgagaccatctcaggctgtgtgtgagggttgagggcgatggaggtgatggtggtgtccgtcgtgtctgctgactttatcctttttatgatctcacacaggaggttgtcatttaaaacagggtaaatgtgatgtggttgctccagtgccaggttttgggtaggggtctgctagaatagggcaggtgagaagagcgtatagaatgttgctgctctgagtgagattgcatacggacagtggatagggttgcttctttgtccctcagcctggtttcctttagtatctgcatgaattctgtaatgcagatgcaagctgggaaggcagagtaaagcttcaaatggactggcccttgaatgaaagagggcaatgtgttgtccatcatttgggtggaaagctgtttggatctttactttctatataagggctgtttgcttttcccttctttcaatgtattaaagagaagaaaaatctaataaagtaattggacctactggttataattcatacagaattttcaagtgtgtttaatagtggtctctcatacaactttaaagaaatgaataattggagaggaagggtcacagttgtgttgtagtttgggacccagcagagtccgaggaggtttgagtgattgggtgaactgctcatctgggagctgtttcttttggctgccttttgtgcctctccttggggacagccctcctttactcttataatgtattttgcaactttcagtgagaaaatagccatcaaaaatgaaccgttagtaaataaacacattctggttctatgatgggaatc

SEQ ID NO: 21245 - DNA, 1153 bp, Mus musculus
ccttatgcttgtgtagccagtatgccaagtgtgccatcttcctagcctcctgcatacttactagttttatgatcataaagttataaaggagctaatcacatgagggaattaacattgtattaatttctccaggtcgcttctgtggcatacatgatgcacagtgcatatgttctgacagtattcagatatggagagagggctttgcctctaaacatctcataacctacaagattacagtggtgtataaactcattctgattgagtttataatataaagactccaaatagagccacagtgacattgtatgaagatcatggacattgaaatgagataatcttcattcaaatctgtgtcactggagttctctaacctctcttagtttccatcatgtatcgaaataataataatttgtggaccttaaatcaacaagattaagatgattgtttttgtaaaccttggcaggtagtagagattcactaactactggtttctttatccttaaagtacatttaagatatagaatcagttaattttattactgcaacaattttcagggtagaattgacatttaaattgtgccttggatgtcgggtaggatattgatatacaattgtaaacccctccacatgggtgctgggaactgaactcaggttctctgcaagaacagtgctgctgagccatctctccaaccgcattcactccacttcagtgaacttccattaacctcagtgaacaagtgttagaacatgtaactagtgggaagcctgcatatgtgcttatggagtcatagtctagaacttaagaaaagcaatttagtttagcaatatagtcgtggtttatgcctctattcccagtgctggtgagactgaggcaagagcattgtcaggagttccaaagtattttgggctacaaagtgagactatcttaatgggcaaacaaatgaatgaagaaataagaaaaagaaaacaaaatcaaagtggtgggtaaataaagatgaaaggcagtatcaacctaggccattcctgtttactgccattactaatacattggggaggcttgtgggagatgtgtgagctgatgtttcgtaagccactgttccaggctgctttacacaggtgagctgagctgatcaattcattgacttgcaactgc

SEQ ID NO: 21246 - DNA, 1163 bp, Mus musculus
ccttaagtaataagtcaatgtggggttgcataaatgtctttctagtcaaaatgataaaccacatggacttttgctcttattctattaatgtataaagtttattaatagatttttctagcattgaaccacttatattctcagataaaatggttcatcagtagatttctattgtcattagtttctaggaatgaacgacctgtagattttctctccagcagtgaacctttagagatcataggataagttggtagctgtgatgggtgatgccagttctcagcttggtaggatctggagtcacctgggagtagggtctcagtgagggtttaatgaggctgggttcgtctgtgggcacttgctttgagggctgtagttgatctgggaaggttcatcttgcatgtgagcaggattccaagctgtcgatggagggcaagcgggctgagcatagcatgcacttattctggtcttctgactggggacagaatgggaccagtcctgctaagctcctgcttctatgacctccttccctgccccgatggacaataacctggagccctgagctaaataagctctttctcctttgcgtttcttttgttcggggcattttatcacaccaaggggaaaagaaactgatacaggagcttttccttattttctcttctctgaaaaatcccagacaacagaatttatctcttcgtgaaacctttaagcacatgcctggtggagtacttaggtgagtgttgcttttcttcttagaagaagttttagttgactctgattcacatctaagaagcatatgcaagccatggctgtgcaggtctacacgttttcaggataaaccaaacaattctaggtaatcagaatcacatcaacaaagtgaaaattgctgggcgtggtctcacgcctttaatcccagcacttgggaggcagaggcaggcggatttctgagttcgaggccagcccggtctacagagtgagctccaggacagccagggctatacagcgaaatcctgtcttgaaaaacaaacaaacaaacaaacaaacaaacagacagacagacagaaagacaaacaaacaaaaaaccaaagtgaaaattatgcagaagcccctgtcatatgtgcctttagcccctcccgtccctcagagtgaccgctgtcccccagtgt

SEQ ID NO: 21247 - DNA, 1111 bp, Mus musculus
ccggaagagctatagtctcgtccttgagggagccacggcttcaaagagagaaagttctgtcagtctatacttgccagggcaggaaatgcccccactggctcctcttatgtgtaaagtcttgaaaaaaaatcagttatgcaaatagtgattattaaagaaagtcatttgcatggtgggaaacttgaaaagaataaggaaaaacaaagaacaactacctgttcccaaggtgagtgctgactcccatggcacttcattccctctgttctctctatttttgctacttgaatatgcacatgtaaatatgtaactacaatttacgaggtcaataagtgctcttttctttctaatttgtgttattgatcaaattttcagacttaggggctctgtgcatatatagaaaaataggaatttttactatgtttaaaaggtgattatgataaacacatactcaggaaaggggctcctgggacctaggaaagcatgaagaagtttaggctcacaacagcagagtgtggggtggtggcacggacagaggtgagcctgtgttgcccacatcctggaacccaaagtggtggcttttttgtcctctacactgtgctgtgaggctgtcaggatacagctctggttagagtttagctgttagttgccctagcactgctctacagagcaccagaaggactgtggtctgacttggtgcggcttccctaggaacaggctgatggttgatttggagcccactggaagccaacatttcaaaccaacaaacacctcactcaaaccctgatatggcactagggtggctatgctcatgtgaagatggcacagctgctactgctcatccacggggacataggacacatactcaactcccattggcctgatccacataggtcttggagtctattgataccacctctgactccactggttaaacctctacccgaatgtgtttacttacagtaaaaaccagggtctgtgccggactggctgtttcactgatgggctttcaccaaggtacctagatgggcaaggcctctctgcatccttggcgactctctcaggcagggacctggaagagccattcttctcttggtgtatttatttctaatgt

SEQ ID NO: 21248 - DNA, 1150 bp, Mus musculus
ttttgatgccagaaatgattaaaacacacatgtaatcccaacacttgggaggtagttgtcagaggatccagcgttcaaggtcagtctcagctatatagtgagtacaaggcctacctgaacaatatgtatcaaaacaacaatatgagttgggctttttttgagatttacttatttattttatttatatgagtacactgtaactgtcttcagaagagggcaccagatcctataacagatgaatgtgagccaccaccatgaggttgctgggaattgaactcaggacctttggagcaatagtcttcttaaccacttagtcagaagcaaactttccatagggctcctccttaggatttcagaggtagtatagaaatgaccatagcaaaacagaagagtcagtgacagaagcttcatattttatcttaaattgacaattagaaagtgaattaatttcagaattacaataatatgtacttcttctcccacacacccttcaaacatttagataacagatttgcttgtacaccactgaccacactaatgaaatgtgcttaagctactagaatgggaaggatcatgggctgtgttacagaagaagaaatgattaaaggaccagtgttggtgtcatagttcagagttcatgaccttcaaacagtaaatggctctgagatgtttggttttgttcatttcgttttgttattttgggttttctttgagaaaacaaatgggttttggagggacacattaaaagaggggcagaaaaaataaagtaatgctaattatctttttcttgttcttacatccccttgtaatgtcagctgaaccagtgtctgtaaaatccaaccttttatctctttataaatagtttcaaaagcagacacatttgtaagtagcagtgactagttgcaaagtataaacccagattttttgcagtttgcaagtgtgagtttgggtttgactaagtcctcagctcagagccatctaaacttgattagtaatgcaggaaggtttggattttactgtgcccacttatgtgactaattagcactctgtgttttagaagccagcgaagtaagaacaagatgcatgggagagtccttttcctgtcatgtgctgcttaaaagagggacatggagtgttgaagtgcagtgaa

SEQ ID NO: 21249 - DNA, 1109 bp, Mus musculus
caggcatttctcaaccactttcccttctccttttttttttttttaaatggaaaaataaattaggaaaagacagaagatcctacactaagacattgtcttggccttgctgaggatacactctggattcccagttgtccattttccatggtgtcattgcatctggagaacaacaaacccctgagcccagccattgttcccgtggttacggttcatgctttgctgcttcctggctgagaggaggcttaactgacaaagccgatttctatagctgtgctgatatcacccataattcagacccatgctgaaaaaaaagtgacaattaacctcagccacatttcttgttattgtttttattgaaaccacccaatcacggacaaagaaattcatgtttgccaagtaagaccaaggaatcctgctgtagaatgaagagaaagtttgtgaacctacggagagtaagtaagcttatttaaagtggcaaaggcaaatggctgtttccttttgtttctgcaccgcttgggtttgaatcactcactcactcactcactcactcactcactcactcactcacccactcagtgtcgcccttctcataccttcttctgctagctgtgttcccatccagatgttatcctgaactgatctgactcttgcaggactcgggtgattctcaagaacacagttggataaagtatcataaagacagcctttcttcaaggtccagtttcccacattctcagtcacttcctttgtcaacgtcgtgttggttggctcacaagacgccaccctgcctgcctctgctcaggttcctctcctatctatgtcttcccttagcttgagcaccaatcagaattccttagtctccagcttccatattacctctgctgaaaagcctttcaagtttgcatcagcctctctgctcatagaagatccagctctctgagcacctagtatgtacagcacgtactcaggatttttaagttgatgttcaagatcaggttcaaaacattgtccctaacacccatggaaggagttacagagacaaagtttggagctgtgacgaaaggatggaccatctagagactgccatatccggggatccatcccataat

SEQ ID NO: 21250 - DNA, 1148 bp, Mus musculus
gacaaacctcccttgaccacctatcaaatgcaccacggtgcctctaagatgtattcttcaggattacctacagtcctaaagctgggatgatttattccagacattttaaggctaatcagtactgtttgccttctagtcactcagggctttgagtcatatgataatggcgtttcttcttttttgatgtcgcccattgtcttgatgttataaattttaatattcttattttcggtatgataagctatagtttgagaaaatagaaagatgcccagagttctcatacctgttttctgtctggaattctatcttcaaggtgattaaaactttagctttgaaaagttctaaggaaactagtttctttttcttctcctttctttccataaagcactgtccatacttttcctggtatgagcttccttgtattatgtagactctgcgtaaaccagctttctgcattgttttgttgtctacgcttatctttttccttaggtcatctagtttgtaaaactcacggcccaacatcactattaaattgtcatggctcatgctttttgccgtggctttgtattttgtggggtctgaagcaaactgaattttttctttttgatctgggcccctttcttcctggggaagttgggtctctcgttattcccttatttattgctctgctgtgggtatggtttagaggcttggtttttattgctctatggcaatcaacacactatacacattccaggttcctggtccctttacatatggacacacactattccatgactcagacagactataatgaatcgcctttatccctgggtatctgaaatcctgggttgctgtgttggtctgttcttcctaaacacagagccaaccacaatgcctgttgtaaaccagcactgtttgatttcttctggcgtttcctcaccatgggtgcctctcagcctaattacatgttgatttgtaatcaacagaagctccctctcatttgatttcatgctgactctgtatcccacaggtccctccacacacaccatttggaaacctccaggattattgtctcaacttcagtttcactaaacaggtctcctttcatgatggcctgcttttaatctgttgcttttctgttcagttactctgtcaacccaaaggta

SEQ ID NO: 21251 - DNA, 1132 bp, Mus musculus
acaaaatgatatcagccttggagttgctatatgtttataagagtgtaatcaatagacacatctggtaaaatctccttcctgggtatttcacaaatattcaaaatgttactgaaaaaaatcagaaaattaagaggcaaataaaaaaaatattatttcctagtatcctgatcagaaagccaaaagtttttgagcttggtatagtaaagcgataacattttatccatgggaatatgattgttagaaatcaaagaagaacggtttgtggtaagacataacttacccacacagttaaacaagaagcaacttgacgcgtgctagtgatggctcagatcagaccctgtctcaattgcctgtcttaaaaaagaagaaccaagaatttctagaccacactagttagctaagggtccagagagcaagggattctgggtgtaatctgaagtcgacccatcagctgctcaccttgggcagtcttgggaatgacttcaatctgttcaggctcagtttctgcagacgcagtgaaaggaaataaaactgtaattcatgtaatgtatgttaaatagcccaaagagttgtttctgagccttgaaacctggggctgagaacatagcagaacagaccaggacatgcccgggcaagcccatcgcctccctatctcccacccctctgacctaagttaaatgttacaggctgctgatgtttaaatggaccaatcatgtgaaaccgcgccaattcctcccccagccccactccttttctataaaaacccctagcttccaagcctcgtggtcgaatccactgtctcctgttatgtgagatacgtttcgacccggagctccgccattaaaaaacctcttgttgttacatcaaggtgttgtgttctattcgtgattcttgggtgcacgccgaattgggagctgagtgggggtttccccactgagttctttcagcagtaccaagatggcatagcatgccctgcactcacctgtgcaggttccacagccacactatgctccatgagaaggtctgaaacactggacagaataccctaagatggatggacagctctttcttcctgagtagggctatcagagtgtgggcatctttccttaacacacagctggatcaggacctg

SEQ ID NO: 21252 - DNA, 1450 bp, Mus musculus
ccttggtatgttaccctccccccacataaggacaagtcaatttgttggtagcttctggcttgaaaccctctccctccatttcatagcccacttaaccacgcataacagagttccatcttttgtcagtagatgcctttttttacccccccccaccccccccggcttaagccttaagtgccaaatcacaaaagaaaaaaagcagtaaccgtttacagaagcaacttagtgccttgtaatctaactttgtcactgtgactacattacctcttcaacgccagggggcacccgtgggcctcccagagcctctgcccgtggggttgggggtgggggtggggtgacccgcaaccagcagctcccccagctggccacacaagtgcacctttctttcggtctcccgcacactcttcctcttccttatagttactcacctccctcagagagttgttgctggacttggggtttttttggggggaggggtctattttgactttcaaaaccttttacttcccagcccgaacccctgttgactaatcttgcctgggtttgtgtaggtctccagggacaaaggttgaacaagttggacgaaggttttgacataagtgggacttcgtgatttaatttctttctttcttttcttttttttttaagtggggaggaaggggaaactagatggactatgagagacttgattttggtgctaaagttccccaattcatatgtgacatcttaaaaatgacaacaaatgagagaaaagctaaaaacaacaaaaaaaaacatgtaaggggtgagcagttaatggtctgcattccacatacaatatctgtgtaaaacgatttcctgtagaagtagctttaatggattttgctctagaataccttaggtctaccttagagcccccacacaatgcttttttccctgggtttaaacttcatctaactttcagaaattggagagcaaaaatgttgcttatcactgcacatcaatataaaaaagcttatttaacttatcaaaacgtatttattgccaaactatgctttttttgttaattttgttcatatttatcgggatgacaaatccatagaatatattcttttatgttaaattatgatcttcatattaatcttaaaattttgtgacgtgtctttccttttttccacagttttaatatattattcttcaacaacatttttgtaactttacactttttttggttattttattttaaaaaaatgaaaaattaatttaaaaaaatgcaaaaaactgttggattatttattttagaaattctcccctttgtgttggactgcaaattgagtttctttctccttaggcctttcacaggtaggactgagaatgtatgtataagttctgtgacagtacagaaggaaaaccaccattttatgtatagcttctaaaagggaaaacaaaaaaagagaaaaaccctttgaat

SEQ ID NO: 21253 - DNA, 1242 bp, Mus musculus
aaatctaccagctcatacataggagacaagacaaaaaaaatcaactatatttctaaaagctagtaataaatggttggaaacaagtatttaattacaagagttcaaaaaatgggaaatattaggtacaaagcttaaaaacaacaacaacaacaacaaaagcatctatataccagaagccattgtcatagggtacaggcttacaatcctagaactcagaaagtgttagaggaacattgagttccagaccaggctggcctacagagaaagaaacacactatctcaagaaaactccaaccagccaatcataaaagcactgattaaacaaaacaagtgtgtgtgaggtgtagctcagcagtagcacacgtttggcttgctgggttcaatgcccagcagcctcttactctgtctcccaccaataaataaatacatttgccatactatgccaatatttatggctagcagaatcttagaaatgataatatttttaaatgggtgctattctgcgggttagccccaggaccctgtgtactgaaaatgctgtggtttgaatgggaaatgttcccccacggactcacatatatgagcacctgctctcaggttagtggtgctgtttgggaggttgtggggctcttaggctgtagtgctttgctagagaaagtatgcactgggggtgagctttgagagtctgtagcctcacccctttcaatttgctgtcccagcttcatgtgggaggaagggtgaccagccagtttcacgctccagctgcctgctaccatgcctccccacgtcatggactctccttctgtaaccataagccaaaataaacacttttccccctctgtaagttgctttttggttttgttttgtttttttaaaatcacagcaacagagtcacagtaactaagtcggaatacagacagacactccatccctgattcctcaggagggctattttgcagcgataaatctataaatctataatcttctgaaatctatataagaaggcaaaagaatgagaatagataaaatcattcaaaaagtacgaaaacgttgggaggaaaaatagcctttgattttaagacttccaattcagctactataattgccagtggttggaactgatgatacaagtgaatggtctgacttggggagagagatgaagacaattactaggaggaattggagtctttcaacagtgctaggattggacaatctcaggcaaaacaaaacaaaacaaaacat

SEQ ID NO: 21254 - DNA, 1589 bp, Mus musculus
tgctttagactacatgtccttctccacggcactgtatggcgagagcgacctctaacccgcccctgcctccctccaccacccccccacccccggccttctgcgcgtgcgccccaccctgctcctcctcctcctccgcccagtctggctggctgggttcattattttcagctcagccaccaagggggcagagctccgacccaggcggcatcaagcctccctgcccacaaagtgacagtttacaaaattattttctgcaaaaaaggataaaaaaaaagttacgttaaaaaaaaattttaaaaagaaaaaaaaaaacaaacaaaaaactacatattttattataaaaaaaaaagtatttttttctccaccagtcttaaatggaaaagaggaaaaattaactatttgcaccgaaatgtttttgttgtgacataggaaaataaccaagcacaaagttatattccattctttttactgaagttttttcctcctacctgttctgtctgctgtattcatttctctaatttcatgcccacttgggggtggggtaggtgggtactctcatcagaggcacattggtgcatgtgtgtttgctagctcacttgtccatgagaatattttatgatattaaagaaaaccttttgaaatggctgcttttcaaagaagataattcatggcttctcatttttcagtctcttcaaaagtgtggctggcctgttttatgactgcagagttgttatgttttttaattttgaatattgcctattaaagataggacaaacttggagattatgatgttgcttggcacagactgtattaaaacaacactcccgtgacattactttgcttgttcctttggctgacttccagaagtgggggtgggttgtgtcaagaatggtgtggggtacctgtcctcacccacctctagatttctgagcctggtttggtacattctcacttctttaagaggagaagatggcctcctctatgtacaggggaaagctaacaagcgcatgaaagagcccctgacgaaaacccccagctttcttggttctctgtggctgtctgtgacttctctgtgaccccgaccattttgtttttgctgcaggggacagcttggattgtgtcagggttgtagtcctctttcctactctaagtgttccatagagtactggggcttggtggcagggtgtacaaccagcctatgccaggccctgaattcaatcccttgagaccccaaaatgtgccacagatagtagctgttggtcattgcagggactcaatgacaatgcagattgccagcattccccccatatccaaacatatatgatgataagctccaatttatcatttgttgtctaagaatatatggtggtggtgggagcctgttgttagaatttccaagactacagagcagagcaagagcgatcatggttaaaataactttgcaagtagagatatgtcgagttggggagttctgcctgggggcggttttaaaatccctggctgtgcctcctgaaaatggtgggctggctctttgccaggttcccattcattaagtggtgctgttataaagtgatggtaaatgggtatgg

SEQ ID NO: 21255 - DNA, 1128 bp, Mus musculus
ttttaacaggactgagccgaatgaacaaaactgccttcaccaagaaccacttaaatgagtgagtggctggcagaagtatgcattaggcctggcacccggggacgaatggggatcagtaggaattggacatccatcctaggaggcaaaacagcagggttatagagaagacccatcaggggaactgagaaataagaggggccctgctcaacatagatagatgggagatggttgggtataagtataggatgcagcttccctatcaaggaacgtccacgctaaatagctttccctgctctgtattgccagtgctaacctctttagggcttggaagatagctaggagaggtgactagggactggtccctgccccaggagtgcagagtaggctggtatgacaagacatctccttctgatgagcaggagattgggaggatttccattgagatgcacggcaccctggaggaccaactcagccacctgcggcagtatgagaagagcatcgtcaattacaagccaaagattgaccagctggagtgcgaccaccagctcatccaggaggcacttatctttgacaataagcacaccaactacaacatggaggtaaataggcctggcctcttcctagcctccatttggggtagcatctcccaatgaatcaggctggaggaggagaaggagggttatgctctctgcccctgaaactctgcaccttcaatctgctgtaccttctggatgccagacaacttgttgcaagtatgcacatctggtccctagctggaactgaatgagccttggtttgtaacaagcactccccagtgattatgatgctatgggctcaagacatcactggcttaggtacttcctaaatgatgtgagctcttcatcccttaataacaggatatgttctgaggtttgcctcgttaagtggtctcctctttgttcaaatatcagagtgtgctttcattggctgcagtgttaccatgcagccacttgagaccaccgtggtgtatttgacttgtcactgatcagaaggccattatgtggtgccagctgtgtgggtttccctcaaaggtttatttgtggatgtatatgtctgtatgtgtggctgcggggtaggtcttgctgggat

SEQ ID NO: 21256 - DNA, 1127 bp, Mus musculus
agcacaggtccttggagatgcttcgcagcagatcctgaagactccaggcacagtctgtgtggtgccccagcttggagtccacaggttttctgaggcctttactatgagaagaactgtttgctttgcatgctgggtatcagagcttctattttgttatgaccatgagaacatggccactctacctttgcagcacactgagaggaggccagagctgtctcttgcaggccattttgcatctgcttgggtccacaggtgctgctggcttcggcctcctcacacaccagggtagaggtacttcagggaagcaaccatgtgatcacttgggctgggcatgtcatctttgcctgccatctagggtcccagctgacactgtccaataatgccaccatgatggcatttttttttctttgctgcttttgattgttatagacagtgacttttctttttcttggtattctcagaactgtgtaaattgatgggaagcaatgggtgtgtgtgtctgtctgtctgtctgtctgtgtctcgtgtagttaatgatggtcttgaatttcaatcctgtcttgggctcctgaatgctggtaggaacctaaaggcaggaagtgaagcagagaacatggaggaacagtagcttgcctctaggctcacagttttaacaaccaaggcctactttcccagggaatgctatcaccctcagtgggctgggccctcccacatcagttagtaatgaagaaatcccccatagacgtgcccacggaccagtctgatggaagcagttcctcagtggaagttccatcttcccaagtatgtcaagttgacaaccaacgttagccatcacagtctggaaacaagacaaaaaaaagggtcatcatagttctaccatcccaagagcattggtgaacttactgcctttggcaggcagacctttgaacttgggacaaccctattgccaggagctaggggcacatttttcaagacagggtttctctgtgtagccttggatgtcctagaactcactctgtagatcatgctggcctggaactcagagatccaccactgcctagcatcttaaactatctcatccacgaaccttgggcttatatcggcaggtcctgaaggccatggtcctt

SEQ ID NO: 21257 - DNA, 1206 bp, Mus musculus
cctccattctctggagctgctgtggtcatggtgaccctctgttgcagagtctattatgactcctgccaatatactgtcttgtttttatccccataacaaagtagggggcacttggctctctggacaggtgccaaaatcaactctttgagagctcaccgaggctgtcagagcagccagccagccacactaggtctctaagactaacacccccagcacctcacacccagagtgaacataaaatggtaggtggtgcagaaaccgcaacacactgtctaagctggcccgcagcatcctgggcctgtgagggtctccctaggctgtgtgtgaagcagtcaccaggcgtctgggaacgtctccatttgttgcgtatagctgggctgggggctgggccattcattgcagaaaatcccaggcaggtgaacatagtgatgtagagagagccagaagccagactgagactggccctctaatggccttatcttagcgattccttcttttcaagtaaagttttcggtactcaccgtcatccagacttgttgagaggggctatgggaatctgatgggttgcatgtgtcagggtgactgaggacctgatggtcctaataagattatgaagttgaaaacttgctgctgctgacgacaaggatgaagacgatctcgttgcctctgccacctcctttcttcccagttttccttctctttcgcttcctcttccgaagcccatgctggcctccggtgcactgtgtggcagaagatgactttgaatttctgattctccagcctccaccaagtgctagggtcacaggcatggaacgtcacacctggtttaagcagtgctggggatgaaacctgaggctttgtgcatgtcaggcgagcatactagcagctgagctacagtgtcagctcgtgctgggttcctcctccacctctgcattgctgctgtgttccacttgcctaccacagtcagtacagtgctcccgtctgggagcactaggctacagtatctaatctaggtgcacaggaggccagaccgcttagctttgtgtgagtgtaagcgcaggtctgtttacatggtgacaaaaacctcccaacggcgtaggctcagaggcatccccattgccgtgtgatgcagagcaataatggtgattttaatagtaatgttgggtggtgtgggtgcaaacccatctcatagcgtgtggctggaac

SEQ ID NO: 21258 - DNA, 1176 bp, Mus musculus
cggcccactggtccagccaagtccaccaacacctacattggagaggacaattacgactacccacagatcaaggtggatgacctctccccctccccagactcctcccctgagcggagcgcttccactctggatgttcagccaagccgggcaccaccagccgccaacatggaatcagttgagcgtaagatttacaaagcttacaaatggctccgctgctcctatatctcttactcgaataacaaagatggggaaacctccttaatggcagaggaggcagatgaaggaagagcaggaaccagccacaaagacaacccaaccccttcttccagtaaggaagcctgtctaacagccacagcccagagggaccaggacctgccctctgaaggctgcagcagtgatgcttgtaaagaagggacttccgccggaaatcccaacagcggtgcaggccatgagcatagtagccatccttgggcagaggtgccagagggcacctctcaggacactaacaacagtggcccactagaacactcttttgaaaccaagaagctcaatggaaaggctctgagcaaggccctgagcagtcgggctgaggagccacccgcctctcctggccccaaggcatcgggctctactctcaacagtgcatctggcaactgtcccaggacccagtctgatgacagtgaggagaggagccttgacactgtctgtgccaaccacaacaatggacgcttgcaccccaggcccctgcacccccacaacaatgggcagagctctggggagctggagacagtggcctgctcttccccaggacacctagacactgaccatgatagcccatccctgacagggacatttctacacaaagattgttgtgggtcggaaatggcctgtgagaccccaagtgctggaatgagagaggacccccctgacccttcaggcctggacagcagcaaggttgttcatggccaaagcggcctcaaaaggcaccgaattgaattggaagatacagagtcagagaattcctcctcagagaagaaattaaaaacatgataaatacaaagggaaaacaaaagctacaaaaagtagccttacagaataatttttcttgtttagtgaacacagaggaaaggaaaaagtattaaaggcacataaaaccagggcctgaaacgtgtctgc

SEQ ID NO: 21259 - DNA, 1237 bp, Mus musculus
gtagggaggagaaacttgcatataattgactaaaagagagaacttcacacccacaagtatattttatatattcagacaagatgtcattgatttcatttagatagtttctggtgtattctcgtagccatccttctttgtcagtgccgacatcccacgtatgccatgctcggacgcctgcagtagccttggaacagtctttagaactgaggtcctctactgtgtagagaatggagagaaagcaattgtccccctttcctgctctgcccatctgattccttcattgcctgttttagctgtctactcacccaccatctcctcccctttccatctttttggtttctgtcaggagctgttagttttatgtcaggtagccatctctagctttgacaaggataataggggaggtggttctttctctcctaataataaaaccaggcaagtcaggaatccccataaagatttaacctcatgagatggtatcttaggtgttgtgtaaataacatgtgaggaagtgggcaagtacaaattcctaatggtgtggttggattttgttagcttgacacaaacctagatttctgagaataaggaatctcagttaaggagtcgcctccatctgattgggatgttggcatgcctgtgggacattttcttgattgctgattgttattggagctagcttactggggtggtgccaccatgtggtgggtgtcctgagaagaggtataagaaaggtatcctggtgactaaggatgtgtagcatctctttaggtggttctcaaccattcgggtttcctcagttgagaattctttgtttaactctgtaccccattttttaaatagggttatttgattctctggagtctaatctcatgagttctttgtatatattggatattagccctctatcagatatagggttggtaaagatcttttcccaatctgttggttgccattttgtcctattgacagtatcctttgccttacagaagttttacaattttatgaggacccatttgtcaatttttgatcttagagcataagccatttgtgttctgttcaggaatttttcccttgtgcccataagttagaggctcttccccactttcttctctataagtttcagtgtaactggttttatgtggcgatccttgattcacttggacctgagctttgtacaggagataagaatgaatccatttgtgttcttctgcatgctgaccgacagttgagccagcac

SEQ ID NO: 21260 - DNA, 1140 bp, Mus musculus
tgtagtattttagctttgtcattttcaagactgaatttcattgttttctggtttccattgttgctgttgaagataattgccactctattttattgattctttgtagataatctgattttttttttttataactgtgagaatgtgctaagttgagtctggattcagcttgggattcataaagctgtctggatataagaatttttttatcggggctggtgagatggctcagtgggcaagagcacccgactgctcttccgaaggtcaggagttcaaatcccagcaaccacatggtggctcacaaccatctgtaacaagatctgactccctcttctggagtgtctgaagacagctacagtgtacttacattaataaaataaataaatcttaaaaaaaaaaaaaaaaaagaatttttttatcattttgaaatttttattttcttttttggtttttgagacacggtttctctgtatagccctggctgtcctggaactcactttgtaatccaggctgtcctcgaactcagaaatccacctgcctctgcctccctagtgctgggattaaaggcgtgcaccaccactacctggagaaattttcttttaagatgttttatgctatttattttcttttgtgctctcttgctcgctatgtagatcgggttgtcctcatactcacagagatccacctgcctacacctcctaagtgtaggggaatcaaaggtatgttaccacacatggcaccagctttctcctgaggagatatacaaatgacccacttggtaaaacagtgcctagaaagaaattctcaggctttggtgagttaagtcaccaaatttaactgtgctatgctgaatagaaaggtagaacttagggcaaagactcttacattttgtctttagtagcaattctttgtggtgttgactgctttctcttggtaatcttgattgtctcaagtataatatagttcttctccaggaacttatgacacttaaggtatttatcatgccattttctgtatgtgagagcttggtctgtatgtctcttcttcctgaaaggttctaacgttcctgaggctaagggctgtgccatccataattctgtatgcattgtgtgatgtgagcctcaaacaaggtcagagcaggca

SEQ ID NO: 21261 - DNA, 1607 bp, Mus musculus
cgtgtgtgaagaggctgaaagcaaggcagctagagaagaggaagggttgagaagctccggccactgggtgagcgagggagggatgcagcctgggagcagaggatggagattcacagaagaacgtggatagagaagcagccaactgtgaagtgccagaaaaccaaggtctcttttcaggacatcatcaccctgttgctgctttgccagccccaggtcccaagcccaacatatgtctgcagcccctaggtgaccacagtcttagcaagaaactggagagggatctggggtataatttattaagtagaataatttccacttccgcttagccatatgtcacgccaagacctcacacttgggcgtgtccccactaactggtcatacaccctgaaatacccttatctttgctaactgttttggactcctactttttcaggttctttgcctctgtaaacattgcattgtggggcaaggtggctagtcagaattggacccctttcctggagtataaccattcctagtcagtagagactgagtcacccaggtcaaaacaccgcgctaaatcccttcaccaaaggccagtggttgtagtgggtttcgaagctggctagtggctcctgtctgtgtacagaataacctgctctctcctctcccgatactgagaacacggagactataggttggtatcatcctggaatcccgtccttttcctcaccattggcttacacaatggctcttgggtaaaagagcccaaaattcttggggtctctatcccaaagcaagtctgcctaagaaggccagtcctatcccaggagcacccagtctttcataaaccaggcagccagatattcacagggaatcaacacacttgagaaggttgagaaatctctagtaaattgcatgtgtatgtacatgtgcaattacataggtgggggttgagcctggattttccctgcttcgtggtttttcaaagcctctgatcctttgcgctggattagcactaccagctagctatctggggctctgccccgaatctccctctctgctgggcccagcctgtacatcaccaggtgttagaaaccaagtcctgggtttgtagtgcccactctggcgggtactccagcagtttccctgcacctctggctctcaccagcatcctctcagctgttctgtgccaaatacgtctgcacccctgggttcagcccaggggcccctcacctcggtgactaagcttcgcccaccttgttacgatgtcttatatatatacacactgctatttacagacctggccttggatcctgtgaccctctgggaagagtcctgccaaagtccaggacagcattggggctaaggcagaggcttttctctagaggcttgggccctgtcccaacgtggactttggggctaggaacctgggcttctctctgtgaatgtaaggacagctactcagagagccttgatgggggcctctccccatttcctgtggtcagacccggctcagcacttggcagctgtcccgtgcggggactcagtccaactctgtgtttgcttttcttcttggccaaagcatgtgccactaagctgtcctggaggacattgtctttatgaaa

SEQ ID NO: 21262 - DNA, 1238 bp, Mus musculus
ttagctattgctattaatcactaaaggaattataaaaaatagatcaataaaaaatgaagctatgtagtaggaaaaaacacaaggtttttggttagaaagtgtgttaactgagtgcttcagagttctgggccttggcttttatcaccatcagatcatactaggtgatacagatctgtttgttaaaacagcagcattgggttagagacatggctcagtggtaaagactgctcttccagaggttctgtgagttcaattcccagcaaccacatggtggctcacaaccatctgtaatgggatgccctcttctggtgcgtctgaaagagagcagctgtgctcatatacctaaaataaataaacctttaaaaacaaaacaaaaaacccacagcagcattgtccacttttggttctcttcatgtgtaaaaatgtgcaggttgaagccaccctgggcagttctaactgaccgctgtaactttctgttctcagttaccgagctgatacacagacataccagccgtataacaaagactggatcaaagagaagatctacgtgctcctccgtcggcaggcccaacaggctgggaagtaattgagtcggaagcattggggctgggggtggacttggaacaggtacatacagcgtgctgtagtgaaccttttgtatgatagcgatcctgtttcaacgttgttacactcaagccaagattgaatgtctgacatgaaccgtgaatgatcttgtcactctgaagccaccgtggccctttgctcctttactttcatttttttacttaaacatttttatgataatacaaatagaaaacatttttgccatttaaggttggttccggtccttgaaactgtcgagtctgcttttaagcagtgagcgcactaaccctttgtgggggtggggtggggacaaggttagtcatatagcctctgggaaagtctcagtgaaaaataaagaaatgttctgtagttgtattttctcactgagtggttttcttatttatttgggttttttgtctctatatatcgaattgtctgacagaccatttcagttttagaatcagcaggctgctacacaaagaacttgagttcacatttggacacattttgctgtgatttctatgacattaagcctttacctcatttttccagcaatcagtaaatctcaattgtgccaatatttgtatctattgtagatacaaatattagatgcttctatactcaatagtaggaca

SEQ ID NO: 21263 - DNA, 1145 bp, Mus musculus
atattaaataaataaatctttcttaaaaattagctatttataaaacaaacaagtggactgggatgtagttcagctgatagaatgtgggaagccttcaggttggtccccagcactgcataaagccaggtgtggatctcatgtctgtaatctcagcactcaggagaggggcaggaggaaatgcaaggtcattcctaattgctgtcaactctgaggccagcctacgctacacaaaaccctgcctccaaatgaagaagcaaagagtcatgatcttgtgctgcccaggatccctcaaacctctgggcccaagcagtcttcctgtgccagcctcctcagaagcctgtacccagcttctgtctttactggcattacttacgaagccaaccatttttcatgcttactagccattgcagctgttggtttcatgaatagaaaatgttcccttatcatcagtcggcctttctaatggtttcttctgttgtttttctaggagcggctgaagctggtgacggtgctgggtgctggtcttctctgtggaactgcactggcggtcatcgtcccggaaggagtgcacgcactttatgaagaggttctggagggtgagagacaagcctcacttgagacgtgttggcagaagaatttatggaatttctcctagatatagcttatgtttgtcctgagagcgtgcttaagagatgcctttggacatcttagatattgtgcacatccttagcagttttgtgaatgccatagcttgtgaacactacctaatatttgcttacattaatgagtaatttcagtctttttaagtgtaacagttgttgtgagtgtgtgatgcatgcacatatatgtgtgtgagtgtgagtacatgttactatgtgtgcacatgagtatggaagccggattgatatccggtctcttgctctagttctccgccccttttcttcttcctgttgtgtttacggttttgtatgagggtggtgcacacatgccatgctgcatgtgcagaggtcaaaggacagtttgtgggagtcacttctcctcttctaccatgtggtccttgggattgaaccgggcttggttgcatttatgtttagcctttcggccgatatactcaaccttattctttgagacaaggtccctgacaa

SEQ ID NO: 21264 - DNA, 4125 bp, Mus musculus
cccataaatgacagaatttccaatctcaagacgtatccatgtaccaagcagcacaaggtattaatattcagatttagttgggacatcttcctgtctctaactttgaggtggcttgttttaattctaattctaatctcttctaattcacagagcagtaaagaagccctttcagaggtcaatgccactggagtggccatgcttttctctgctgggacatttctttatgttgccaccgtccatgtcctccctgaagtgggtggaatggggcacagccacaaacctgataccactggagggagaggcctcagccgccttgaggtggcagccctggttctgggttgcctcatcccgctcatcctatcaataggacaccagcattaaccattcaggttccagcctcagtccacggccattgccatctgggaagaagagcaagtgtgtgacgctcctcacttcctcagtgtcttgtctcgcctcgcccatctccacccgtgttcctagagtccgagggagatgagagtcaatcgtggagaagtggaacagcgtacagcaggaacatcagaattagacaaagactttgtgttgtcttttaaagggactttgatatattgagttttgatgtttctcttaaccctattctcagggaagatggaatttagttttaaagaaaagtggagaacttcatacagtgaaatagtaattatgaaactgcagtgttctgtaaagctaaagtttttccccttagtttagaggctctgccactttacccattggtttttaacatggttctcaccatgtaagactggtgctttagcatctgtgccacatgccatgagagaaggtgggaacacacatcccttagatgctaaagacgatggcaactaatttgaggttagaataaggaaaataagggcaggagacataagctgaactgaacccaaaaaagaaacatccatcaaaaggggtgtttagagtcttcaacaactcctttgcacgtgcctccctaaacaaagcctgcccttccttctaaggggctggctttggaagaggggtctgttatcatatagcatttttttttttaaagtgtcctttgcagaatacttgtctacagcacactcttagtagccagattctgttcaggcccagggtttccatcaagaacagtatgttcacaatgaaattaaggggtgttaatttttctgggaatttggatagttactgacatcttgtagtaacctttttaaaaagtaacactattacaaagtatgttgtccttttcttctaagtcggtggttggtggttctcaaccctctgaaggctgcattcctttaatacagtttctcatgttctggtgccctcccagccatgaaattattttgttgctacttcataactgtaattttgctactgttatgaatcataatgtaaatgtctgataacaggatatcgatatgccacccctttgggtgtcgtgactcacaggttgagaactgctgttctaagtatttcttttagcagtcagcagtccctctgactgagcccttgcccagggtggagagcatttcttccttctccctagctcctgtgcaggagacggtagggctgtatcagaggggagtatccgctgctggctggtctcaatctccttgcaatcatgtctgcatcccactcttccctgcgctctccctgcccccattgtgtagtactactgctcctggtgatgtcagtcctgtgtgaggtggattctcactacttgaaccatgatgatgaagacagcactgtctattcttcatttcctgtaactaagttacctttgtgtcaagtacaaccttattacaccctcaaaaatgtcacctcctggtgggagttgacacagtcactagtactctgataatttaagcaattgagacagcaaaagtatccaacagaggtaattcttccatgtttgccaaaatctgaataaatcctagtcagataagtgtataatactgtatttatattttctgtaccatttcaaaaacactttacataaagagggagccaagactagtttcttcagatcagtgagtgcagtcatttgtatttttctatgacacctatgccagcatgcctgtagttttctttctttctctcctaaattgtcactaggtcagccagcagttatgggattaaacatgtgtgccctctgctggctgcagtgaagaaagcagaaatgggatgcagttctgtgtggagctggtgcccattgcatcccatgctaaagtgttaatgtgtgcagtgtggggtgtgggtgactctcttgattaggcacaaacaggtgactcggaaaggtttgggctcatctagtccttccaaagtacagatgtcttgatctctctagaagttccctgtgtctggtttgatttgggtagatgtagcttctgtcatctcgctccatgcagtggtcagagatgttgtcctggccagagcctctttcgttcagcagtgccttgccatctcactctaagtttggccagaatatcatgttgggtagggccttggactctggcaaggactgaaccatcaaacttccaaatctgccttcccctccgggcctcagtcatagtgaactttccaaagctggggcctttccaggcctggaactatttattgcctgtggacagtgcatcccttccctgcccagcaggctcagatagccatgtgactctaaatagggctcaaatgcattagaggcagcaggaaccatgcagaggcctctgttagtggggggaggttgctcatgtggcaggcagtgcccccagagcagccaccttggtcactttacaacacatttcagttccattttcttcctccttaagactccctctggaggtgtggatgccttaatgcgcaaacacatttgaacacattggtgatacttaagctgctgccacaattacaagtggaattatgggctaccaaagaagcaactgatgaaaagcatgggccctccttcctcatgaccaaagcagtcttaattgggcttggagtccctttctcccagaatctagatggtcttcagattcggagcaccctcccctccccagttcccagtgttgccagtctctaagtcagcagggcagtgatgtcccatttgactctgctttctgtgtgcactgtcgccagcttgcatccttacaagcagacttcccggcctggacatgtcagcagttggaacggtactacccactgagacagtgtcctctcccctgcttcacctcagtcctcagattctcagttcagaagagccagttctactgacctgggggttggatcattagaagaaaaggagggtctgttcttatagaaagggaaatagaactggctggttctgttttcaaggattagagataggagggacagagcagtgacagtgttgtttgccctgctcctcatgctagtgaagttctgaacatgggactgtatgtcaatagcacaagcctctaagaccctcctgtcttttttgggtcagagccccagaccattgcatcacagtcattcggcaagagggtccttgcggcagacttctgttcattgcagagtgggactcacccctgaagaacactggtcgaaatattatacaactgcaacccttttctacttgagacattgaagttcagctcaggagacctgaagatggggactggtgggaaaggaccagcagacatgtaggacttctttacatgtgttcagtcccccacagtagctaagcacagagactggctttgctctctgtctcgtgtgtcttcctgtaaactgggactctaatgggatggtaacaccacgattcccctggtttggtggcctaaacagtgatttttttaaaatgtccccttttctggatcctttgtacacataaactcattccatggatggctgccttataattttgtgtctttccactttaattgtgaatggtttaaaatcgctgttttctgatttgttttatgatattaaatttttattagcgcataccttatgtgagtggctctttacttacacatcggcagcgtttgtgtttggcaaccacacttgatgcacaaaaatggtggccatcaggatatcttagctggtaaaggcacctgc

SEQ ID NO: 21265 - DNA, 1186 bp, Mus musculus
tccagaagagaaggtaggtacctgttactattttctcatgagctcttcgtgccacactggcgctcctaatgagttccttatctggtagagcggcctcagcaagtgcccttccaggagtgtttagaatatacctaacccagggagagcagacctgtggctgatatgtgtccttgaagatttagttagcagtcacattctgattgggaaacacctgagaaaactgttgagtgagagaactgggctctggtttaggcactcaggcctgtgtccctaggcaagttgcagctcatgctgaggttatagtttctattaaattgaatagataggacatgataagatggccttatagttcattttaggtagtaatggttagggtctcatgctagcagcaaaggtgggagtgattcccaattctcttttgcctcttaagttgtttctttttggaatgatccttatgtttttctctacctctttcatgtctgtttaggtaacatctataaagccagggtctgtttggatcactgcattctgggtgtctctggcctaccttactgtttttgccctggactcagcacttccccactgtactgccatctgtttacttgtttgcccttacattttagagaacttcctgagagcaccacctttgtcactgtgacaaacttccttttgtccccacctctgtcatcactgtttccctagttgctggtacactgcttagattgtggtgtgtatgaccactcctgggccagtttgagagttgtactgggtctttccctaactaaactctttacccagtctctttatgagctctgtgggtgctggagaaccttggatgctgctgctgattttgagctgtgccaacccccaggcacttttgtaatcagggatgggccttagttttgtcctgttcatattcagccatctgcctagggctagggccatctgctgcctgtgagtgacctgagcaagggaagcggttgtgaatcagtgtgggtgagcagcagcctattttttaagggactaattatatggatgagtctagggctgcctccccaactctgacttctgtgtaatgcatgttatgtctcattttatccaggtcttagttttgttctagatgctgccttctaactactctactagagagcctttgctgagtttttgtttactttgtgagtgcttt

SEQ ID NO: 21266 - DNA, 2466 bp, Mus musculus
gtagtaaggcactcaaagcaggaatagctcatgctgggtccagaatgtgggtccctgagcttgccctgtgtgttgacactgatggcggcatcttccttaactgaggacagaggtttgggaagtcatgccaaagccacccagcactcgctgaccagctctcgtgcaggttcctggctcttttgagagtttctaagaagcacccagaagacctgtgggaaggaggaaaggtgtcagataatgattgtcttcctaatactcaagttctcacttcctgcttccagcactggctgccttggccttggtttctgttcctggataaggggaagttgcatgctgtttcctggactttgtcctaggtagctctggcttccttgcagcccacagaatcctgagatttgctgagatgccaacaaaagctcatctggcttttggcagtctgggcaagttgcccctttttaggtttgtggtgatggaggggaggctgataggtacagaccaagtccccggtggctgcaggcagctccggcaggtcctgaggatcctcctcaccacggtcatgtgccttagtaactgtgcccaggaagtggcctgctgtgccactgctcccactctgttctctcctccctgcctttccacacgtcatcgttgaaaagccactccttattttccctgccagctgatagagatggtgggcacccagaaacctgagatacaggtcctgggagtgggaacgtactagcctagaagaaatgctccagccatttccagcctcctattgccctgtactgaatgctgacaagtctgggtaactgagccccaccaggcttctaccatcttgagaagacagatgtggtatcaaggaatgtgtgtgttttttttttttcttctcatctttcttcctttcttccttttcttcctcttcttcttcttcttctttctcctcctcaagccttggggctgggaaactcttcagagccagtcctggactgaacctgtgatgagcctctctggggtggtaaaaataataaaagcccagtatatttatagttcctgacacaacagggttagctccaggcatctgtggcctcaaaaataggggaataacttctcctagccaactgcctccattcacaatgcactttagtccctgtcatgcctggcttcctgacaccctcatctcctctcagggtaagggcagtgtctgctgtccctgctggccactcccacactaacccaggaggccagtccagtgtgcccagtgtccagacaagtatggttggctgaggaatgagctggaaaaggtgcttagactagacgactagaacacccctagcaggtgctgccataggcttacctgggggtgggttccaaggccccaagccacctcaccatggcgcttcttcagcttcagtggtgtccacccccctcaagggagaactgggcaaggaacacgagtcttctgaatgggcctgcctcttttgcttactgctcttctaaaatctgagttctgttttagttctgtgtcgttaccctgggcttttgccccttacagattgcacttctttggcttattatttagccttgtaggtgcctggctttggccttgggaaaaagaacctcctggtgcctcgttttctctcagcattcattagcctgctgtggggaaatcacaggcccaggcttgcctaactgaaggataaagggcacccgtgttccccatcctcttgtcacaggcttttagaaggtctgttcttgaggtctcacacctgttgctggcatctgtggcttcttcctgcattgttttcttctacagcaatttcttaaccattagccatgtgctgtggtttctggggcatctgggctttgtccattacagacggactggggacttaattgccttgaagtggagcctgctagaaacagggtcagtggcaggtggcaggcggatgggcaggaagaagcttcgagcaagtgggaagaaactaagcagcctactttactgggctcacctccagggacatcctgagacttgtccaaaagaggcagtcagcaccaaaggacttttacacagggttttttggtttgggagatgtttttgctttttcatacttacactgactcaatgcaggttttatatcctggtgacttgctgtcacattctatcagttttcaagggccagaatgatgaaataaataaatagaaaattccgtccttccatgccttagtttaacaggtgagctctacctgcccagttctgtgttttgtgtgagaactgtgaaatgggcggagtcctgaccactttgtgggttcgtttggttttataaggcatttcaatgtacattcttcaagcactccatttgcaaagagaacttaaagtcatactgtcttccccattcatcctgccctccttgcacccccagctttacagttctgtaaagaagccaggctacaagacagacaaaggt

SEQ ID NO: 21267 - DNA, 1176 bp, Mus musculus
ccgctcgggtcgcaagtggccggggcttcgctctttgcggaggacggcgactcagagagcgcagttgatttgaggtgggcgctggggcacgtctccctgtgggtgttgcgtgagggggacacgaggcggaagggcgggcgtggggagggcgtttgtgtcgggaagcagcgcgcccctccctgccgcccttaatggctctcatcgaggcccggacgccggggagccggcctggcccagggcagcttagggtttccccccgtgggccggcgcaggcgcagcgctctgggccccgggcttgcccgtgtctcgggggcacgcagctcggctcgctacgctcctcccccccccacaccccgccgcatacttcggccgtcgccattttgtgctgcgaacgcgccccgtcgcccactgcgcaggctcggtggtggcgtcgcgagattccggcttgtgacgcgcggggaggccgcgacgcgggcgcggccggctgctattggaccaggcctggcagagggcgggctcggctccgcccgcatttctcggcctggccttaactgcggcagatgggaggggaaccccgggatccggggacagcgtgtgcggctgcgcagtctagaaaggtggctactggcgttgtggtgggctgccgtgtggaacctgggaagggggtcttttggagagttaagttttaacttggaatttgaatgtggtggtcgtgaacgacttaaaaggtacatggcgaccttgttagtagagttggtaaacgtggggtgtgtttgactgcttgactgaacatcccccacccccatggtgtcaatcgttgatattgtctcgattcaattactgcctaacaggaaacactagccgggcatcatgagtggctgtcgagtgttcattgggagactaaatccagcagcgagggagaaagatgtggaaagattcttcaagggttacggacggatccgagatattgacttgaaaagaggttttggttttgtggtaagtacttgaaactgagttgaattatctgtcgagaagttaggtaactttgtggtggtgacacatgcctttggtctctggcccttgggaggcaggggcaagccaatccacagagaaaccctgtctccaaaaaaagaaaaaaaaaaaaaacaaagtgggtagagctcttgtgatgagcat

SEQ ID NO: 21268 - DNA, 1247 bp, Mus musculus
taagtctagttagtccacatgctgagaacccagaaacttgatggaatcactatcttggcttaaacttgtcacatagcatttgacattgtgacataacatctgacactgaatgcttatttttctttcttcagaaatgctccacctgtaagaacagaaaatcgacttatagttgagaatttatcctcaagagtcagctggcaggtttgttgaaatacagttttgagatattttttaatgtggcatttaaaagtgttaatgggtagttaatgttttattaatatatatcttattaaatgctttatcttaaattaatttaattgaactataattttaaactttagttaaatgtaactgggggatgtttcagattttaatattagtgatcaaatgtaaatgttttgaggttattttttcatgttttttaaaatcaattttaaccaaatattaaaccctttatttgccagcctatctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgtaatcggtgcacttacttgaagtgccgggttgcagcgatcccagaaccgttgataacgtgatctgatccctaagttgagagctgtcttcctgtaacgcttccgaataagaggtcctggtcgaaagagttgaaagatacgaaattagttggtcgttggaatcctgatcgcagtaaagtggtccttggtaactgcacaagagtaaaacatgtctgcatcgccagtagtctgctaatagggagggctgtgcgattaaaggcttccatcgattgggtagtatccttcaagtgggtggcgaagagccagtcgggcctatgtcatgaaggtttctccgaccgcttaatggtttgctgcttgactagcctagggaaatgttaataaaggtaaagtaaaattttttaatgacatatggggcacaaaataactggtgtctttgtaaatgttgttttatttttttattttttattttttttaaatataaaactagtctttaaaggatgtactgttcctttttgtttttttttgttgtttgttttgttttttgttttttcccccttttgtactgagctcagttagactaatactataatgttaaaaaattggaatgccctctagcattttgcttaaaagca

SEQ ID NO: 21269 - DNA, 1265 bp, Mus musculus
gaccagaagttcctctaggtcccgtagccgatcccgttcacgaaggagcaagtcttacagccgatcaaggagcaggagccggagccggagcaagtcccgttctggtagtaggtctcctgtgcctgagaagagccagaaacgtggttcttcgagtagatctaaatctccagcatctgtggatcgccagaggtcccgatcccggtccaggtccagatcagttgacagtggcaattaaactgtaaataacttgccctgggggcctttttttaaaaaacaaaacaaattcccaaaccatacttgctaaaagttctggtaagtatgtgcttttctgtggggtgggatttggagggggttgggctggatttctttgtagatgtggaccaccaaggggttgttgaaaactaattgtattaaatgtcttttgataagccttctgctcacacttttgtgactgtctgaagtatatagtttgtgtatattgatagagctcttttataactaaagcatttaattttttgtactagaaaaacttttgaatattttagttcattgttcagatatgttaactcaagattagtttaattaaactaacgaatagttttggacactttaaaagagctctaaatttgcttgtatataaaggcttaatatgagttttacttgttagggtcaagggtgtcttgcccattaacagctgtagatagacattaaagtaaagcagctgtttgttattgataataaaatactaagtattataaaactgcttttggtctgtttctctcaagttctgtattatttattctatcacatttgtgtattttaagttaaaaactacacatgtagaaccctgaagtgtaagctttttaaagtattttattattttgctatttgaagctagtgaaggagcctgcaaatggattgaaaactacagctaagttgagtgacagttccttgtattccttcaattctttcctgttgccactggacttgaattaccatcaggttactaaccctaaacagaaagggcagtggtttggtaaacacataagatccagtgcaagttttcttgtcagatgtaacagttgggatggtcataaatgtaatttctcaatgattgaaggcatgagagatctttacatgctggttttagttctgagatacgtgaccatatgttttatttaggtttttaaaggtgtgtgtgtgtagagtcctggaactcaatttgtagaacagggtggctttttcttccagttgctgagataaag

SEQ ID NO: 21270 - DNA, 1222 bp, Mus musculus
accttcccagcattgagattataagcaggcactagcacgcttataatcttaactttttttgttagttgttgttgtttttgtttttaacttttaaaaaatgtttgtctttcatgtgcgagtcacaggaatttggcttgggtgtttgtttttgcaaggtgaacacctcactgagctctgagccttgcatcttttcatttcttaactgtgtccttgcacaggctgtggtttatagttattcttcagtacatctgactgctttctgcttagggcgatttcttgggttttgctcattccgttaggaaatatctagacctgcgtgcttccagtaaaaacccaatttgaagaagcctgctaatttaagttcacgtgaaaattgggagcatcaacttagaaagatggagagggagggttaaaagctggcaggtgtagacactgattgggaagagtcatgagcaaactggctggaaactcaaggccacctagtgtggggacacaaagtgccatgctattctaaagtctctgacatcttaattatgaaggtttggcttggtgcctatatctcaggaacatggtgggattccccagccatatcccatgctgtagtctgtagacatgtgtgttgtgaactcttgacagtctctttgaaagaccaaactaagcaaactgtgaatgcgcgttcagacccttgtattaggggtgttggagaaagcatagggcacttagttaaattagaatttcaggtggattttttttttttagtgtaaacatatcatagattgtacgtggaacacactaatgctcaaaaatatcaattgcttatttgaaatttagattgactagccattgtgtattttcatttgctaaactggccaaccttggaggatgaggtcctaacacagctactacatcagaatctttttaactgaaccagtcttgcttgatacaatggttagaaacacctaaaagtgtaacccatgatgctcttctaagcaaagaaaacttccccttccacaactgttgataagccaactcagtgaatcctttcttggggactgaaggaccccgtgacttgtatgttcccaaatcttcttggcacatcccttgctcacctggtctatctttagattctatctaagtatatatctcatgtctgtgtctgcctttcatcctggagttaggatgtgcaagttcatgttcgccagagtcatgaatgcaatgctct

SEQ ID NO: 21271 - DNA, 1149 bp, Mus musculus
ggaaacaaaaataaatgctttcttctgtgaataaaaggtcagatgcccttttggtgcacagagaaggtgaaaacccagagggagttgaagctgtgagtctgctcacccaataaaaggcaggctaatagcatccccacaactgcgaagtattgtccacgaggcagcagacccttccctgcagatagctgctttgtctctagagcctgtaggaccgagccccagtcattacctgctgtggcgaggctgcagttcttggaggtggctgtggcttcaggtttgccatgcttgtctgtgacacccagtcatgtcgttagtctaaacacgctccctatcttcatttctccctttcccatcaccaacctccttgctttttgccccatctctgctggatatttctagaactcagatctgatcttgtcctttatttccatcttgcaaccgccaattgtttaaaaggcgaaatagaaagacaccgttacgtttttaggaccctgcacggtgtcatattcaacatggtcctagagccttacttcttctgtacaaggctatttatgacctgtaggttgaaataagtttgctctccacttccttgtatccattaatgtagtttttgggcaaccctgtctacacgtagaacctcttcatgacctagatagcaatctcctctctgagaagttcttccagatcgttccagtttgattcatctctgactgaggattctctggagcccaggtggctgctttgtccccagcgctcagcacacacagccccaggatgtcagagatgccctgggattctgtgctgacaggatgccatctttcatttcctcttcttccctctcctgtctcttctcctttagaagagttagctgggcttgtagtcttcagctttccacttcacacatcgtgtccttttgtctgctagagacgcagaaagcacagttcctgtggagttggctgcaccctcgtcggtctttgcaagtagaattgctttggggcatagtgcctgtgttcttgttgtttattttcataaaccccaatgtgcctagcgtggtgccttgtgactaaaggatgtggattgagaggtctctagaaacttctctgagtggcagtagtgtgatgggggctcggatggacccttcaaagacaa

SEQ ID NO: 21272 - DNA, 1131 bp, Mus musculus
cagcttgtattttgctagagagcaatgggcagaacagatagatttggggtttaatgctattgatttggcgataggtttggggttcaatgatattacctattacataaaacttcccccacagaacttagagactgtttttttctggagttgagcatttgtaagcagcagttgtggtagccatccgtgtgtggagagagggtgcatggttttcaggttaaagctttgattttctccccatggatttaggctgtgaggagatcctcacgccacacagtgtgacagtggtcccgtcaggggttccgtctcacagggtggttgtggagattgacaggatcctacatttggagcatcttgtggtcagttaacaggaccttactatctttgggatgcatacgggaggccttccttggttaaacatctatcaggctccctcatctctagggttttataacttcagatctatttgagatttactaactaaggggaagccaagactataagtcatgggtctctccctatttttcttgcaaaaataacctctgtgttatttcactttttttcttccttcccaacgtagttcctaataagtgaccgtgaccctccgtgcaacccacactgtcccaggactcagcccaagcccatctgcgcctctgacggcaggtcctacgagtccatgtgtgagtaccagagagccaagtgccgagacccagccctggccgtggtccatcgaggtcgatgcaaaggtgagtgtgtacgctcaggcgggcagaggctgctgggactacagcgccacaaggtgaaatcatcactggggcttgaatgcctttgctcttctgctcttctgtctctctccgcctcccatcagggtgtgagggaaggaagaatggtaaggaacacttccctgatcttcagacactgccaccagtgaggagcgaggggctgaggggcagtgtcttgtatgcttgtggtgttttgttttttttttctcaaaacagagacacagtacattactgctggccccgggatagggattccaaactgttggttcacagaagtgttttgtttgacctgctttaaagcgcgcaaagtatttgagataacatttaaaaactgggagattcaacaataaca

SEQ ID NO: 21273 - DNA, 1197 bp, Mus musculus
tctgttttcatttttaagatagggatgaaaaaacctattgcaatggaagaggtgtctttataaaatctgtgcaaattctgtttctgagtccccacttctatactggtttgaacaaagagagggtaactttattctgttagtagatggctttttgccttttccctgcactggtctctcctctgggcctctccttttcttagcagatagcctgtcttttgttctgaagggagctaggagcagtggctctgtggactctccctctctgtggggctctcaaggccacacagatgactccaagatgacacacaaaatggagagctgggaattgcctttggccaagtggccctcactgacagaggtgatggaaaacccaatggtgaaaggttctcggaaaattatcctgggggggggggggcggcacttagcccctcttgaaaaaaaattgcaaagtccacagtaagaaaaacaacctattcatataaatgacttgaagccataggtgccaagactccatgtggctgcataaacagaaagggtagctcagtgatgttctataaatcattcctaaagattatgactctaactggacctcccccacccctcggcaccacacttccggttcccacaccagccctttcaacagtaaaggcagggccataaagcccaggccttccttgttgtctgtccttttcctgcagtctgcctcttctccagattctcagccactaggctgccctggggtagccccagtaccagacacccatgtgctctcagacctggagaagcctgtgataggagctacacggttccttatgcaccctggagtttcatgtcactatttagaaagattctttttaaaaatgtatggcttgttattgtgggttattgttcagcatttcattcatttttgataagaaatgagaagggcaggaggtatttgaagaggttttaaggtcattgctgttgacacaaggccagtgttttccttaatattcttggcctagcaagatgattccttttgcaacaaatgtaagcaagctcccctccttttcccaggccgaatcaccttttcttgatgtttacccccataagagcatgcagtctcgaggggctgagggttgagggtgcgcatttcccaggatgagctggggtcagcccctgcagtctcatcaccactggggggcgctcatctgctat

SEQ ID NO: 21274 - DNA, 2046 bp, Mus musculus
ctagcccatgtctgctgtgcaaaggctgtcctcatgcagatagtttcgtagctgaacattttgtacactaatggctcacatcgcttttttctttttgctctctccttcccgctcccagtcggacgccttgtctaaagagtggaaaaagcaaaaggcccatggaaactccgaggagacaggactgaccgtcagacacctaaccctcagcgctgcccgtggcccagccacagtctgtgtaacataagtggtgcccgccatgtttgcacttttaataactcttacgtgtgtggtttgtttctggttccatttgtaaacaccaattatctaataccatagcaggaacaggaaagggaagaaaagctgtttattctctcttttattgttaaggttttttggatctgctactgacatcttttaggttggggggggcgagggacggggtcgagaagaaagagatttatatactgtatataaatatatatgtaaattgtatagatcttttgtacaggcatcgacatcgctgtttgtccctcccttctacttcctctggactcccagtccaggtctctccttagcttccccaagtttcactgtatatggactctgagagaatagatgggagccctgtgcttgtgctgtggatagcatgttttcttctggtgggaagagggtactggtccattagctgtcaaagtccagtcacttggccattggctgggtaggaggggagcccagttcctgtgctggccagcatggatttcagatctccggtggcccacatgtccatgctatccagatcccttggcagtctacagtgaataatggagcaatctctacctgaaggggctggatttggctgctttaaacatctctacccatgtttagcatgtcccccgtgtaggacatgagaggtgagaccccaagcatgtgaggaaaaggacacccagcaccagcagggttctcctgcagcagcaggtgttgggcatctgaggagatggtgaagaggactgaagacctgaaccagcccttctgcaaacccacaagagagcctccacaagcatgtagctcccaacactagagtccaactaggttttactttcgtgctctccctccatctcttggatcctcaccgattgggtcagccaccttgttggccaatcccggagttgctcttattcctctggcttttctcatggacttccagaattgttgaattgacgtggcgtcccttacttctgcttcctcagaggaataggagcgatgatccagctatagggaactctaggcttttgcacagagtgtcaccggaattgcaccagggcagatgagcaactttttctgtctaggtgacatgctgattcagaggtccttcagtcagagcagcaagtgatacttagcagctcttccatggtcagccatgatggcagtgagggaggccaggactggttcttttgctggcttgctctcctcaacctgccttccctgggtttccatctcagtatcctgtaaatgcatccaccctggtaaaccctgctctattttgggtctggaaggcatggaccacataatgctgcccacatgtggggaacatagccttctcggagcttgattcgatgaagtctcagctccagaaggttcccgctgtcctggtggaagtcacacatgctgtcccatgatgaccagtaaccctgtcctgcatggtaaggtgggaagaacaccttctcttggagccttgaacagaaacaccgcacgcagcaggctggagctggatggccctcccagcagactccagtcccatttcctggccagaaggaaatgtgcacagagaagccacctttatgtaggagtttagaatctgaccagccaacttctctctcacagatgggcgtaggctgtgctgtgtggttttcccttggggaggcgggagcaagaaaaagtatttgtagcttgttttataaaaaataaaaatgggtaaacttgggcagctggtgcctctttctttgggtggccttctctgaaggagaggccccatttcctagaaggttt

SEQ ID NO: 21275 - DNA, 1125 bp, Mus musculus
tatgcaccagtgtttgaggattatattcaatatccctagatgaaatataccttgtccacattttcaaggtgtatttcaaaattgaagacaatgaatccgaaaatgatggcacattctagggactgaatagacttctagattttctatcttctcattctcattcctggattgtgctaaatatggtctattttatgttctatgttaagccagcaggggttggaacattctccctcattcaattacatgtttatcagctttctggttttaatggtttccttcactgcttaagcttgactgtcttagaacttgttctgtagatcaggctggtcttgaacttagagaagcatctatccagtatgtctaattttagtcttaactttgtagttgtgtgtagtctaaggaggaagagaaatgtagaaaactgaaattctcctgaagagaagaggaacagaagcgagttttggaagtataccacagagtaagatatgagatattttgggaccccgtgattttgaaagctgaaaagacaaagtgggcagttcagacaagctttggtgcattgccagagctctggcatcagcagctggtgaggatgggtttctacaacttcctctccccctccctctccctgtcctcctccatgtctctccttccccccaccccccgtgtgtgtgtgtgtgtaggggggggacatatgggtggtggcagtactggccaagaggacaggctcagagcattgcaatcatagtatttctttggaactatggcagaggttttgaatgtataacagaagaacaaaaagtacaagggagtggctgagaaagaagcagatgggacaggtggaggcacatgacatctctgagagggaaggcagggacaggtggaaagtgggacatcttggagaggggcggtacatatcttctcccttcagtccatgtccactaaattgtaaagactgtcttttttcttttttcgttatgaatggctagtataatggccattcctaagtgttaggatggcaaggagggaaccaacgtctaagggttatcttctaatgtccacttgtgtgccagaaaacatgtgcacatgtgctgtaaaaagttattaaaaatcccagcctgctgc

SEQ ID NO: 21276 - DNA, 1099 bp, Mus musculus
cctgtgttctgtatttctttcctttttttttttttaaagattatttattattatatgtaagtacactgtagctgtctttagatacactggaggagggcatcagatctcattgtgagtgtttgtgagccaccatgtggttgctgggatttgaactcaggaccttcggaagagcagtcagtgctctgacccactgaaccatctctccagctcctctcctgtatttctttaagggagttatttatgtccttttaaaagtcttgtatcatcatcataagatgtgattttagatcagtgtccattttctgttgtgtatctagggcttgctgtggtgggagaactgggttctgatgatgacaagtaacattggcatctgttgcttatattcattcctttgcctcttgccatttggttatctctggtgttagctggtcttgctgtctcttactgtggcttttccctcctccaagcctgtgtatcagtaattctgggagaccagttctctcctggaggaatttgggtatggagagctgtggtacagggttagctccagggtgtagacagtaaccagaaggatactgtcccctgctgatccttggttcctgtatcctgatggctctgagagggtccctcttgggccaggaatttgaatagaagtggtggtcatacctgtgctcattggggtgttggcattccggggagactggtcctctcctagcagtatttgcatatgtagtgctatggcacaagatcagctctgggcatagagggaaaccagaaggctcctgtttcatgctgctcctcagttgctgtgtcctgagggttcctggtgggtctctcttagtagcagtggtagtcttatctgcagtcacaggcttctctgcactcccaggatgctagctctctcccagcagtatttgggtattgagtgctgtggcacaggatcagctacagatgctgtggtacaagatcagctctgggcagagggaaacccttattatttttgcaccaatattcttaagagaaattggtctgaagttctctttctttgttgggtctttgtgtggtttaggtatcaatgtaactgtgactttatagaagg

SEQ ID NO: 21277 - DNA, 1177 bp, Mus musculus
aatcccagcactcaggaggcagaggcaggcggatttctgagttcgaggccagcctggtctacaaagttgagttccaggatagccagagccatacagagaaaccctgtctcgaaaaacaaaaagaaaaacaaaaaagaaagaaagaaaaaagaaaaaataagcctaccatatacagcaagccaatagccaacatcaaattaaatgggaagaagtttaacccaattccatcaatgtcaagaagaaggtaaggctgtcactctctccatatctcttcagtatagtacttcaagttctagctaaagcaataagacactaaatgaaatcaagggggtttaaatgggaacagaagatgtcaaggtatcactatttgcaggtgatatgatagtatacataagtgaccacaaaacctttaccaaagaactcctactgctgataaacaccttcagcaaagtggttggatgcaaaattaactacaaaagatcagtaaccctcctttgtacaaatgataaacaggctgcgaaagatatcagggagacaacaccctttataatagccacaaataatataaaatatatggatgtaactctatccaaagaagtgaaagatctgtatgacaagaacttcaagtctctgaagaaataaatgttagaagatgtcagaagatgaaaagatctgccatgctcatgtattggtagaattagcctactgaaaatggccatcttaccaaaagcaatatacaaattaaattcaattcccatcaaaattccaaaacaattatttacaaaccttcaaggacaattttcaactttatatgggaaaaaaaaaatcccaggatagctaaacaatcctgtacaacaaaagactgtctgttttggtttttgttgttgttttgtttttctttttcttcttttttttattttttattttttttttattttgagacaggatttctctgtatagccctggctgtcctggaactcactctgtagaccaggctggcctctaactcagaaaactgcctgcctctgcctcctgagtgctgggattaaaggcatgcgccaccacgcccagccccaaaagaacttctggagttatcaccttacaaatatcttagaaaaatgtttaatgaatagagagaatcttaccttgttggggattacaaattgctccggaaaag

SEQ ID NO: 21278 - DNA, 1179 bp, Mus musculus
cttgtattttacagttagctggaacatggattatggacttccatttggcttctggcaacagcttgaaccatggatatcaacatggcctctggtggcagtacagaccccagacatcagcatgggcctctgttctagtatggaccattgacactttcatggcccttggtggtagcacaagcctcagataccaacgtgtcctctgggccgtaggccataaaccattatgtccttggtagcaatccagtccattaacatcaccagggtttcaaacaggagcacagaccaccagcatccacatggccttcagtggtaagacaggtgataggcatcaacatgttcttctgtgtgatatggacttctatatggtgaaaccttggaccacagacatccacatggcttctgttggcagcatggacaacagacctcaacatgctctccaacagcagcttagaccatagatattaatatggctcttggccaaagcatgggccacaggcaccttcatggacctcagatgcagcataggtcatggatcaatatggtcaaccaacagcttaagtttccctacctatctattcctgagactgggatctctccttatttccctgggatctctccatttttccctagtttgaagactcccccaaataccaggaccatgaacctaaaagtttcaaatttatatccatataactttgatttttgaactgaatcataaggtttctgaatcactctacttatttttttctgacttataacctgcctttcctgatttctttgtatcagtatagaatgacaaattgctgccccttttacactgtagaggagaatttagttcttttcataacgtgtaattgcttgttttggggggtatttgttgttaatttctccctccaaaattacttcaagttttttttgccaatattcattttctgcttataatgagacaattaaagcattagtaaagcccttccggtaagcaccagctccgggtttccttgggtgcaagttggtagacacccccacggtccccaggggatcagtggaacacaacatctgttccaaactaatggtgatgggcctgtgacagcaggagcaaggacacaggaaccctgagtgaccagaggctcgggttccttctgatcagtactgatttaccttggtttataacagactaga

SEQ ID NO: 21279 - DNA, 1120 bp, Mus musculus
tgtgtgttgcactgaatatattcttgtattatttttcatagatgggatgatcacatttgccctaattaggatgtttttgaaattaaaaagtgtatcttaataatactaaggcagtaggtgcatatctagattcccaacacaccagaatatgtgcctgctctgcttagaaaagatttttctggtgtgtattctggtatataacagctgttagctgatacagactagattttttttttttttttttttttttttttttttttttggtttttcgagacagggtttctctgtatagccctggctgtcctggaactcactttgtagaccatgctggccttgaactcagaaatccacctgtctctccctcccacgtgctgggattaaaggtatgtgccaccactgcccggcaataatatattaatctatcctctctagttgtttttagctgatacctgttctagttaattggtacatgtgctggaaaattactgtagattttaaatgttacccatgctaaaagtttatcttttaagtgtatcttatttgtgtgtgtgtgtgttttgtctgaatgtatgtatttatgtacaacacatgctagcctgatgccttcagaggtcagaaggcttctggaactggagttatgaatcaaacccaggtccactggaaaagtagccagtcttgttcatttaactcagagccatctctccagctactctaagttaaattagctctgaaggggatgtctaggaaatcaatgacaagcatacttaatttcagagaatttaaaatgtaattgagccttttgtatttgtaggtaggtagattttttttaactcctttttttctcatttttaaaagaattttcatgactacatcatatattcttccttgccccatcagacttttaattggaaattaaacagtcgctagttccttgacaggaactcctagtgctttgtcccaatgtaacagttactatgttttacaaagacatttttcagattttgttacaagagtctaacagttacctttgagagagagagagagagagggtagaatttgtaacccttattttccagaaaagaaaggtgattatcagatttccaaactcatttgcttcatt

SEQ ID NO: 21280 - DNA, 1139 bp, Mus musculus
atgggtctttggcattaaaaaccaagagtcctctctggctgatgggttttcagtgccaccatatcaagcagatttttcaatgctcccttttactgccctctaggggcaaggcccgtgcttccagaaccagatcccactttgtaaggaaaaggaagggggtccatctgtctctggagaattgctaagtttgccgaatgagttgatggcagggagttgaaatcaagccgctgtcttttgtctccatgcccagacaaactgcggcttgagtaccacatggtgtgtcccccatatgggtctgtcccacatgcactggctggatgcagctttcttgcttgattttttttttttttccttttgaagagtgaatggctttggaagcttaagcatgcgaaatagaagcttggaaggagaagctgagaaacattatgagtggagtggccggggccatttctgctggttcatctgccccatgcttgccttgcactgcaggtgtttgcattgaaatccttgtgatgttctgagtgtgttgtttggtttctgtggggtgattgcctttccattaagaatggctcagacacggccttccacaagctcagcccttactccttctgtctgcttgcccacccgctcactcactctttccatgattccatagcatgtgaggggctcggtgaaaccaccacttttcatctcctagagcatgtgcacttgtctgtgaactaggagggctcaggaagagttgtctgacccccgaggttttcagtgtgattaaggagacagacactttctgaacgcccatgaaaaaggccgtaagggaaatagccagtgctaacgagtctcctcctccttccttcagcctcaagtccctggtagatggatacaagcagtggtcatccagtgcccccaacctggggaagggcccaaggagtagccccgccctacctgggttcaccagccttatggagataggtaagtagagcattggttttctcctggtttccttagagaattcttggctagacttccagtgttgtttaaggattccagtactacttactatccatagggtttgtctcatctttgtcctctactctgtcgtctccattttaccaggttttctaaaccccagtttccatgta

SEQ ID NO: 21281 - DNA, 1101 bp, Mus musculus
tcagttggcctcttgctcctgctcttgggaaacagatggcaactgcttctttgcaagggtggttttatagcctgggccatcaactctttgcttcctgtaactaaggccagcttctccttgggtgtgtgtgggcagtctgcaataggagataagtttgagtacgtccatactggtgtggttagtagatggtcccagctcccagcttcacagacttcactctgtgtttactctgtgaaaaagcaggacctctgttgggtgcagtggtgcatgcgagtttgagaccagcctggtctatatagtaggttctagaatagacagaactgtgtagagacactattgcaaagacaacaaaaaagaaaaaaacaggacctcttggttttgtagaaaacaagacagaagccaaacaaaggaggttgtcagtgacagttgatgacagttgctctctttctcccattttcctgcacagtgaccctggaggagggattgagatgtcagaattcattcgggaggccacacctccggttggctgcagttcaagaaattcttatgctggtctagacccaagcaatcaggtaggagtgtactactatgctgtgccttagtgcctctttctggtgctagtgctagccagaaagcatacttagagccatccataatggctctctctctctgacgacatttttgattaatgtataccatctatattcgttattctttttaagttaatttttaatttgatttgtatgaatatttgtgtgccatgtatgtatcacctgtagagatgagaagagggcatcagatcccctgaaactggagttacagatggttgtgtgccaccatgtggtgctgggaatcaaacccaggtcctttgtgtaagtattacagctctgaagggaaagacttcccctatagaagtgttatagctctgctctgagaggtatcctggtagaaagaataccacgaagccacactatataacaaacctcacacaagatatttattgcgggagttgggaaagacccagtttggtggctgccactgcttgggcaagaagcagcagagaactgaacagaaggcagggtttatatagggtttgttggg

SEQ ID NO: 21282 - DNA, 1198 bp, Mus musculus
ccgcctgagcagagtgcagagagcaaagaggagcagagcgagaagcccagcctggccaccgactccagagtttgtaaagacgatggtgggaagcagaaggaaggagatgtccggcccaaatcctccagcttaatccaccggacaacttctgcccacaagccaggcaggaggcgcacaggaaagaaacgggccagcagttttgattctagtcgccatagggactatgtttcctttcgaggagtctctggaaccaagccgcacagtgctgtatttggtcatgacgaggattctagtgatcaaagcgacttgagcagagctcccagtattcattcggctcaccagttcagcagcgacagctcttccagtgccacgtctcattcctgccagtctcccgagggcaaatacggtgccctcaagaccaaacatggccatagggaccggggcacagactcagaccacacgcacagagctcatccaggccctgagggaaccaccaaaaagagggcctctcggaggacttccagcacaagtagtgccaagacgcgggctcgggtgctgagcttggatagtggcactgtggcctgtttgaatgactcaaacaggctgctggcaccggacagtatgaagcccttaaccacttcaaagtcagatcttgaggccaaagagggagaggtgctggatgagctgtctttactgggccgggcttcccagctagagacggtcacacgctccaggaatagtttgccaagccaggttgcatttcctgaaggggaagagcaggatgcagccactggaggtgagtaagctactgcagcactgtgggttgaccctgttgctcggaaagtacagttcctctgtgttaggaaagcacacgtctctcggtgaacacggtggtctccaatggccctgctgtcttatgggacacatcagcttattcttgaccgcctcccctttctaagccagttatgctagtaataacccagtcatttctcatcctttatacagtagcaacagtattacaactgtattagggtgacaaagcactcacagacgtgacttccacagtgtgcggctgagctcccggagatggatgctcaccagtcatgtgagattcttccagatgctacggtagcaccagtggtatatttggataaccgactctttttctatttctgtgcttttctctcagttcaagttt

SEQ ID NO: 21283 - DNA, 1199 bp, Mus musculus
tttccatatgaatccctaccttggaccatatcacaaaaactaaatcacagtcataagcattaatatggaacgtaagatagcaaattatgtgacacaaaagatttgtcctaaggttatagaaaacttacaagatttggcacaaaaaaccaggatgaataaaaagctgattgataattggattcatcaacataggaaatgttgctcttaacactgagctatctctccagccccgagattctgcttttcaacctttttcctatgtcaactttatttgccatccgaattggccacttattttacagcatatcttagagaagatggtatgagatcataagacagttatgttagagaacactccatttctgcagtatcatgggacagctatgtagagggcactccactgtcacagtggcataggacagctatatcatgtccacagttggtaggggttgtttcctgtataatctgaaatgttattcagaccagacatcctaaatacaacctagcaggccttaaacagatgccttcttttttcagtctgatgaatttcttgtactcacgataggcctgcttgttaattttccatccacagaaaccgtgagatcctggagaatatattagctgttgtcctggctattcttgtggcttttttggggtccatccttctcatccaaggcttcttcagagacatctgggtgttccagttctgcctggtgatcgccagctgccagtactcgctactcaaggtgccagcgccttccctgctgtgtctaaggccattcaccaactggccacaggatgagaacttaggtttattttccatggaggcttacattggattgtgtagagtccaaagaagggtgtaaactttaaaaagtaattgtatgtacattgaatttactaaaaactaattctttaaatgaaaagagacttgttaaaataagaatttgtgccgggcgtggtagcgcacacctttaatcccagcagaggcaagcgaatttctgagttcggggctagcctggtctatagagtgagttccaggacagccagggctacacagagaaaccctgtctcagaaaaaaataaaataaaataagaatttgtggaactggagagatggctcagcgactaagagcactgactgctcttcctgagttcaattcccagcaaccacatggtggctcacaaccatctgtaat

SEQ ID NO: 21284 - DNA, 1201 bp, Mus musculus
aaaatttgaaaggaactaagggaatgtgttttgtgctttctagaacacagctgtgaagcaggtggatgtggtatgggttgtcttctaattttgttgtttaaaaagttctgagagttgatttacacaagtgtgaagagggaagtaaaatgaataccagctattcagtgagctctgcttagcctgcggaatgacagcaccaagcacgagggattcttcctaatacgaaagaaagtctcataccaaaagagggcagagagaagaaagctgaagacaaaaggaatttagtgcctgatccaggtctccagagaaagagaactttaatgtgagatgtgcacttgagaggcagaggcagggttgggagttcaaactcagctacagctacatagcaaatttgaggtcagcctgagctacatgagaccctctctcaatgaaaaaaaaaaaggagtctaaattcatttggaataaagttcagttacgaatatagctaaaacattttacactttaagtttgccgtccctaaaatattgatgtaagaggattgattcgctgttgggtatttaaggttacacgcgcccttttctctggatttcttcctcaggattcctgggatggccagcacgttcctgtgcttttctctgtcttctgtggtttgttggtggcagtgtcctatcacctcagccgacagagcagtgacccgtctgtgctcttgtaagtgaatccactcctgctgtgggacatttaagttggcatttctcatagtccaggcagctccttccctagttcctgtcaagtgttttgtcctgctctgtctgtgttgaaaatacattaactttgagtcatgctgattttgttagctgaaatgtatgttgttaaagattccatttttacttttttattgtgtgtctgcttggtgtgtgtgtgtgtgtgtgaatttcaagcttcatatgtattttctgctaaaatacctttatttttttcaaataaagctctttgatgcaatccaagatttttcccaaagctgacgagaagaacccagaagaccctctgtctgaggtgaaagaccctctcccagagaagctcagcaactctgttgtaagtgtggctctgtgagccatggccgcggcgggtggtggtgttatacgacaagtacttttcaaagtctttagtaattggacaaaataagtgttattaaatatagttg

SEQ ID NO: 21285 - DNA, 1195 bp, Mus musculus
gtagttttagttccatgttagggagtgttggtacatgtttctcatgtattaaatgctgctagtattaaattgaaaagctagagaaccaggttttagaactataacttttatttttttttaaacatgcttatttatgtagaagataaaattcatagtgtgtactaataaagaatgttgtattcatgcctttcagggtttcataaacttatcatagagatcactgttattgtgtatctatttcctgagacaaaggagttgccactgtgatctcctgagtactgggattacagttgtgtacacacacacacacacacacacacacacacacacacacacaccccacttctgtacatcagttccagacgtctgtctggtctctatcaaaagcctatggagcatgtgctggcctctggctggtggatgctgggtgtttgcagcacaggctgatgggctgtgcctgtctctgctacaggttgggtgctttgatgattaccatcgctggcctgaagctgctacgctcttccttcagcagccccacgtaccagtacatcaccgtcatcttcactgtgctctttttcaagtttgactatgaagccttctcagagacgatgctgctggacctcttcttcatgtccatcctgttcagcaaggtaatctatcacggcacatctgcctctgcagaaagaaactcgccacttgctgacgtggttggcaaggtttctgctggtgttacatttgactgttggcttctaagtaatagtcttcctctctcagcagttattttggagcatattaaacccataagagccacaatcaaaaaagacttacatgtgggtggactgtgtccactggcagcaatgaggttcagacagatgtcgagtacaaagagaaattgctgttcagtattagatttctctcctggttccttgtgacattacatttggaacatatttactccaaagggttgaagttcaagggaaatgtatcctgggataaaatacatgcatgtattagagacaggtagagtttctgttgcctctactcctcggtttgctggcagtagcagtaatgctgtgattggccagaagagggcacagaactcttaagaacaccaatccataagtccatgtctacattgaaaacaatcttcgtatcaaattgatgccagtgttttggcagttgataaatcttgtct

SEQ ID NO: 21286 - DNA, 1178 bp, Mus musculus
ttcccaggcctaagtctcgggctgtctggcaccatagggctgtgtgctgtgggcttgtgctgaggcagaacctcaggacccagagctgcttgatcctgacaggtgccgggcactcttcgtgggcgtgtgcccgagccatccttcctgctgtctttacctcccagtagtgtccccagctggacatgagtctttgggggatgttgcacttccaaaccctagcacggttttctttttatatacaatttgtaggtgtatggtgtgtattttttcctgtgaaataaatgtaaacacggccataaggagcttaggtttaggctgttcattaggttgtgttgtctcaccctgtagcctaggctagctccagatttgtgtcagtctccctgcctttgctcttgagtgctgggtttgcagcctacattgatacattgatattttagtgattttattcctcgatacaacaggtgaaagttgaagtgaaataaacgtttctttacctctgttcttacagggtcggatgacaacaatttgaattctatcttctatgaacacttaaccagatctctgcagcacagtctctgtggcgacctgctcctaggacggtggggaaactatagtactggggactgcttcatccttgcctccgactatctcaacgccttagtacacctcatagagataggcaatggcctggtcactttccagctgcggggacttgaattcagaggtaagccgctcagtcacctttaagttgtgtaggtacctgtggtagcaaagttgtgtctatttaaatcccaaatgaaagctgtcagagttggtagctggcgtacagcttagctggtaagagcatttgctgctcctccagtggacctgagtcctgctcccagaacccagaccgggtgactcacaactccacttccagggaatctgacccctcttctggcctccaagggtacctgcatgcatgtggtgcgcacgcacgcacgcacgcacacacacacacacacacacacacacacacacaataaataaatcttgaaaaaattacaaaattagatctttgaggttgttgcccctcccaccatcccttcacaattttatgtgctgacaagccaattcattctacacagaaaattatacattcaggaaaataccaatttaagttatcaaatcctgcacaa

SEQ ID NO: 21287 - DNA, 1170 bp, Mus musculus
caacacttgtgtgtttgtgtggcacaccccacatgtttctccacgtatgtgtgtgtatgcctacatgtatacatgtggcacacgtgtgtctccctttatgttttttatttctatcatttgacctatgaacaccaaaagttttaataacgttttgggagaatttttcaaaataaatgtaatataataatttttcacctctttaaaaataagctgattcaaaagcactgaaattaataatacactgcaagttgccttgctgaactcatggtggggtcttaaagaagtacatggcgtttttatttaggagggcttcagatagctttcttaaaatgtaggcgtaggacacggagttaaaatacaatattgtgaactatactgtctgtaagaacaatgattgttcatgtaacattaggaataaatttatttttgttttaatataatgttaaattagaataaatttgcattgtgatttgacttgaattctctgtgtttcttaattagggtatcatttactatgtcacaacctcctccaagttggaggagtggctggcgaatgagacaatgcaggaaggattgcgtctgtgtgcagaccggaactacgttgacgtggacccaacttttaacccaaacattgatgaggactatgaccaccggctggcaggcatatctcgggagagcttctgtgtgatttacctcagctggatagagtactgctcttcccggagagcaaaggtagagtgcaaccatatcctttgcagttctctgaatccaggttttaacaaaaagggcgaaatagcctgttagttaccgtgagctggcttctgcccttgctcacagatcctctgaaagagaatggttcacctcacagcagcacacgcaagctgtggttccatacagtgctctctgagatctggtccataagcactgaccaccgacctaactgtgtgtgtcccaaatgcaggcctagaccattgccatctctgagaacttccacccatgacacatgtatcctctgcggtccagtgtcagactggctttaatatttgaaattgtccttcattttgcttagctgtaatcattgtaaacagcttgttcaactgtgactactgttggacagtgcacatctgggacattccatgggaatttagataaaatggtgcactttggaaa

SEQ ID NO: 21288 - DNA, 1163 bp, Mus musculus
tctaaaagaaattcctattttaactgtcttttgattacatgttttacattagactctctttaatttcctttgaatcttaggctccctgcctgctgtctgtctgtatgagctatttattaccatggttcataagcaagcttcctagtcaaacaggacctgtctcctgagttcagactttagttcctggattcttctttcaacacactcttagagcagttgttgaaacttccctgacgctgctgccctttaatacagctcctcaggttgcggtgactcccacctccggccataaaattatttcgttgctgctttatagctaacttatagctaattttactgctgtcatgaatcgtatctgatatgcaggatatctgacatgtgaccccaaaggggtctcaacccacagattgagctctgctgctctggatgactgatgcagagcagacatgaggctgagtgtcatgaagactcctgtcagaatatgtgcactttatctccaaccttgcagtaacctggagtccttcctctatggattgcatgccctgtttaaaggggacttccggatttcttcagtccgagacgagtggatcttcgctgacatggagctgctgaggaaagtcgtggtgcctggaatccgtatgtccattaaactccaccaggtcagagacgggctagctctgctgtttaatttgttttgggagtttgctgatactttgccattgatttctatgttatattttggagacctttggaaaggctctcatctgaaccagggaagagccctagcaaagcattaaatcccagaaccttgaacctgttcctcatagtaacagtagtagtgaattctaatattaatatctgttaatattcatgatctagatgtcagcagcaaactgaaaaggaaggtctctaccctgaaatgcttgtttgacagcatgtgattgcagttctggtcccttacccagtgtcttagtcagggtttctgttcctgaacaaacatcatgaccaagaagcaagttggggaggaaagggtttatttggctttcacttccatactgctgttcatcaccaaaggaagtcaggactggaactcaagaaggtcaggaagcaggggctgatgcagaggccatggagggatgttacttactggcttgcttcccctg

SEQ ID NO: 21289 - DNA, 1422 bp, Mus musculus
ccattgagggctgtgtggattttctttacatttcatagtaagcaggggagagtttacaatgcagagtcctatgagagaaactttgtttcgtttatttagcctgatacttttcactaaggaggggaaatgagctggcagtgatcctcatgtgtctgtttagattgtggatctcagtcagattctggaaggaatcaacgtgtcaaagaggaaggagctgcactggcctgatgaaggaattcggttaaaagctgggaggaacagctggaaagactggagtccacaggagggcatggaaggccatgtgagttctccaggaagctgctgtgcactttaggtcgtcagacccatgcatgttttagctgctctgtgtctttctgcttgagtggttagcagagctgcactgggggtcgagagggcggtgcattcaaggtctgactgtgtgtgttcttctgcgttactaggtggttcaccgatgggtgccttgcagcagagacccaagtacaaggtcccacatcgacaagacagtgcttctcgttcagatcgatgataaatacgtgactataattgaaaccggggtactagaactgggggccgaagtgtgagcctgcgctgcatacctgggttcctttctctggcttcccagccctcggagagaaagcaaggttgcagaagagccacctgtggggaccgaccgcctgcccttcgcagcaaagacttgaccagtggcttggttaagctcctctccaccctgactcctgtcactgtcttcatccccaaataaagctgaaatatttttttaagttagctgcatgaaaggcaaactctgttggagcctctcgatggaaggcgctctatgcatttatgctttaacccatggactcttgtctctaactctaaactcatatttttctaatttctttgccaaaaacagttgccatggtttttgttgtagaagatgaaatccattgaccatgatttttgcaaacagacctatgtggaagcatttggttcgacatataacagtataaagatttaatgtacagtgagaaagatgatgactagacataggtttatcttattccttgaacactaaaaactttaatgaaaaaaactgcactaattttttacagtgatgcactaaatctgagatttctcagaacatttatttatatataaaaataaaataccattatttaaattgccttcaggactagcccctccctttcctgacacacaggcagcagaacccgctgctcctatccgtcagtgcgctggactccgggacacagcttcacccctcccctttcccagggctggtgaccagcaggtatgcctggcgaaggccagcaccagctgccctgtcacggctcccgtgtgccacgcttctccggccggtggcaggtcctgtcgaggttgcttctg

SEQ ID NO: 21290 - DNA, 1242 bp, Mus musculus
aaactccaaagaaagtagcccccaccccccctctgagcacctggggcagccgtctttctcccctggacagacagtagaaaacagtaggtcattttgatgtcccttactcttgtcaaagctgtgaccattccagtgtgtggcactggccagcttagtagcttctgtgttaggccaccctggtatggtatcttctgagatgagaggagaaagctgctgaggatatgggtatcagggtgtgtccagacactacaggaaacagctaacagcaggcgagaggatctctctccacatggcttcaaaccctgtttgtgtttccttttgttattttaaagtcggtgttcagaacccaatgtgccttgtattgacgtttccatagacttcaaactttgcagactttatcctttaaaaatatttgtcaaaagacttactgaatctttacaatagagccctttctctttgtaaactgaaaactgtaaagggtatttccccactcttactctattccctcccgtctcttacttgggcagttctgctctgtctgtatttaaagcttccttcccaaaggacttgagctccctgctgcttgcttgttccctgctctcggtgagtctgcctttgtcacgttggttcctaggtgacaaaagatggaagaccatccatttgccagaggaagaatcagaagataatctttggatgacttacttggtcaaagggtcggcgttctatctatgcttgctctccctgatagttgttagatgctatatgctctaaaagtgaaattccatatgtaaggcgggttctggatggaacatgtatatcaagtcttaatttgggagagttggacactttccttaaaacaagttattgtttgttaccatataattttattaaatttgtaagttaggaagcctaagagaagtcttgtttttagttttttaatctaaaaccaatgaccttaagaaaaaaaagtactacttttctaactacagcaggaaagataaagatttgtgttttaaaattaaatttattataatttgtttttcttcaagtaccctagtgatttaggttttctgcttagcctttttcattaaaatgcagaactctggcatcttttagtccttttagtccataattactaaaacttcagagatccatagttttgcaagtagttaaaaacaactttgtatctccttagatgcagctgcataattgaagtctctgttcttcttctttgaatttctc

SEQ ID NO: 21291 - DNA, 1909 bp, Mus musculus
agcctcatatttgagcaagagtcacactgcctctttacactctacatagtttcctaccagcatcctcttgcctcagcctagaacctaccctatgagggtgtcctgcatcagtcatcaaattctgggtctctagtgtttgcccagtgtctaaaatcatctcttttttaggtaaatttaagtcatcctttgttctgaatatatgacttgaaaaaaatagtaatctgaagttgtgtttcctagctactgaggtataaactgttgtctggtatattcattgctttcatatttaaagtgttttttcattagtataagcaaatttatttctgtatttttgcctttaagtccttagtattctttctcatctctctttggtagctacataaagttactttgagcacgggcccactgaacttttccacgggagatgatccatctctcctagaggcgttttcttaactgcaaggtgaacggagactatcagttaaagctttaagtggcgcatgcctgttgctggcccacccttgaactttgtgtttcaggtttagatggctgctgagatttactgagggggcaaaggagatatagtagatactgcagtgtatttaggtgataagaattttatacataggcatttttttaaagtatttgaagaccaccagccgttttcttggtttctcttttcaaattaatctagttgatgaacacccaggcagcctcatttggaagttgtcacctgttcacaagctctgatcagaaaggaattgcttatcaaacaggtctggaaagatctaaccttgcttgaaggcagaggtctctcttctgtggtgcatcacctcccagagtcatctgtccagagctgtatggtgagaatttctctggtctttctgaattggggcagaagttcatctgtaagctgagcatcccggcgtgccattttgtagactcggcatcgaggtgtccggggcctgaagcagatggtcacacagggttccactcagctgtacgtcactcttatacctattatataggcttggccttttctcagccttcagctttgtacgtgacccgttgtggttcgtgggaaccaacgggagggagggcggctctaacagatgttgagggtgaatctgtcacctgcactgtagaggatgtggctgctccaggtgactcttgggttaggtgtgcttgttactgaacaaaatccttttcatcctaagcttgagtctgcaaccaaaacgataggaatgggacggctctatttggctgtgctttcttaaaactgtagtttgagtaaattatcgacatggatgatgctagcctgtacaagcctggcatcacgttctgcctgaggaaaaggaaaaaggaatgttagaaatggttgtgggcgagcgtgcctgtggaaggagcatggctttcccttttcttctcgtgggctctgaaagggcattgcctctaccagcattcagtctacaccagagatgaggatatgtgtccatgcgcgttgtctgtgagtgtgcgtgcgagtgttaatgcaaacagcttgtaaatactatagttgtttaaaatggaaaataaaagctgagaagtcttttgacatatattgatcagaaaaaaatacagtattgaccgtggataaaaacaggaaataaattttttttcattttgccttctgtcatttttttttttgatcaaaaatttttaagaggattcgatatctcctgtgtggccttggttctgagctaatcattctatacctgtaatcatgggcttggcttacaccagataaaagtgcactctggcagtaactcttgcacaaaggtatttctgccctctgcgttaaattgcatgttaatggtagaactgtcagatgataaatgtatataagtgctcagttacactaagttacaat

SEQ ID NO: 21292 - DNA, 1149 bp, Mus musculus
gtctggctgccaatcttgatttggttttccagtgacgccttcatttcagtaggatttttttttctgaactgactgactgcggcttttggaaactgcgctgtctttgggtgctctctaaaatatgagtgtcagttgaaggcagctctctttaggtttagtttggtttggctttttcttgcaccctcttgcttattaggcatcatgctaagctctgggaagatagtatttttccaagcaatcatcatagaatatgtggattagtgaatgtcatgaaaaaaataggaccacctccatatgaaagtatttacacataacggggcagtaaacacacatgagaacctgaggatgatgacattttatcatgctaggggcctcacatatgctgggcatgctctctctgagccggatctccattaaaaaccaaatgagccagaagcaaggtgagcaagagccttgtagactgcgttcccagtgggttgtatatgaaagattatgacggtaagcattgggttggtgctctcagtgggtcagtgggtcagtgcctcaaaatttggaagatttgctggattgtctgcgggcttttggatcccgtcagtaatttgagatttgatactagatttaaagaggcatggctttaggtaagtacataaacaaactgacaggaagatagtgacaaccttctaccaaggttttccaaggcatgatgggattggttacctgcctcacacccgccccctgttgccttaccgggtgggtgcatttcagagcccttccttgaccgcagtttaggctgtctggtgtcttgcactattgtcttacttgtgcccttgagtgtgggcagaacgtgatgtagaggaggggacagagcctctgaacttgtgtggagacctgggttctattcttaccctgaggaaaagaaaggactgtctgtgctctgggggaaattctctggtggtccatgtctgtcggcacattcttgtttaaacttgtctgatagtgaggagccaacagagcctacataggtctgcaacagggacaacaaggtctttgtttggaccctttgagaaatacaggccactgtattcagggctgaagtgcaaagagatggtatgctggcttagattttcctgcttgcagcctaatggcttg

SEQ ID NO: 21293 - DNA, 1593 bp, Mus musculus
acagggccagcggagagcatggactccagattcctcatgcctgaagcctaccccagttcccccaggaaagcccttcgcagaattcggcagcgcagcaacagtgatatcaccataagtgagcttgatgtggatagcttcgatgaatgtatctccccaacctacaagtcggggccatcattgcacagggaatatggcagcacatcttcaatcgacaagcagggaacatccggagacagcttcttcgatttgttaaagggctataaagatgacagatctgaccgaggtccaactccaaccaaactcagtgacttcctcatcactggtgggggcaagggttctggtttctccttggatgtgatcgatggccccatctcacagagagagaacctcaggcttttcaaggaaagggaaaaaccactcaagcgacgctctaagtctgagactggagactcgtccatttttcgtaaattgcgcaatgccaaaggtgaagaactcgggaaatcatcagaccttgaagacaacagatcagaagattctgtgaggccctggacatgtccaaagtgctttgcccactatgatgtccagagcatattgtttgacttgaatgaagccattatgaacagacataatgtgattaagaggagaaacaccacaacaggagcttcggcggctgcggtggcatccttggtctccggacctctgtctcactcagccagcttcagctctcccatgggcagcacagaggacctcaactccaaaggaagccttggcatggaccagggagatgacaagagcaatgaactcgtcatgagctgtccgtattttcggaatgagattgggggagaaggtgagaggaagatcagcctgtccaagtcgaattctggctcatttagtgggtgtgagagcacatcctttgagtctgccctcagctctcactgcaccaacgcgggcgtggcagttctcgaagtgcccaaggaaagcttgatgctgcatctggacagggtgaaaaggtacaccgtggaacacgtggatcttggcgcatactattacaggaagttcttctaccagaagggtgagtaggtgcttagttttaatttttttttttttattttgctctactcatgggaaaaaaacaacagtgtgtagtatactgagtgttttagcggtgacctgagatgcctgtgaatctctgtctttcatgatgaaagagtttttctgtaggctttgttgtgattcatttctttgtattttggggatgttcttttccccttttaggtattgaaatcttttaaaattaaatattagtgtttcattttttaagttaaaacctatttgatttagcgagtgaaattaaactctgttttgttgacttgctatgtcatctttaggggcaactatgtaaagttgcaatctgatagataaaactttttaaaattacaacacaatttcaatgctgtcctctactttttagcacttttttttttgccttctgagtctttttattaaagttataatatatttctgtccctttcacaggatctctggtaaaaacacattgcattatttgatgaaaatctcagaacagtgagtctc

SEQ ID NO: 21294 - DNA, 1118 bp, Mus musculus
tctttctctcagtctctttgtggaaagagtatagcgcagtgaagaggagtttggcctagcaccaaggctgtgtgttgttgcctcagcccatttgagtcctcattccacttagctgtttaatgtgcccctgactccactgtgcctgtcataataataataataataataataataataataataaatctcttatatgataaatattattattacctttactgaagcacagccttcaatcaatattatgtgtaatatttaatcatgttcagctgattaagttgtaatcactttgatattacattatttttatgaacattattatcctgtagatataaactttagagaccacttgattccaacagaaaagctgggttttatggttaaatgctgggcaaagagaggaaccatcccttcaccttagataagcaacatccatgttctttcttctactgcttcctctgcctgctcttgtcgggctttttacccagcatgaagtggcactggcgatgtagttgatacttactgtgtttctactttatgctttatgggctctcctcacttgatgcttttaggaaactggcatgaacctgtcattgtgggcatgtacaaatgatagtactatacgttcttttttcctttgaaaatggttgaagttttgtgttcagtctttctttggttaccacaattaaaggacaaggagatttatagatggcaaatattaacctggagaaactaactccatggttgcctgtagccagcatggcttgtcaggaaggactctctcccagctgttccccatgtcatgcggtcctacagtgtgttccccgttgctcattgtccaagatgaactgccactgtaagccaactgatgagaaactactgtctaataaatctggttactctaagccagtggtcttactgttcctaccttctttttctaacaacacacagcgaggagacttgatggtgagtgaaggaaggcaggggccatgtgtcctagtttcatagattgagaatcccacgtatggtttagtccctagttgagcatttaaagtctgagacttgtctctgtttaggcaggagcaagcagcctggagagcttagaccttgcagagatg

SEQ ID NO: 21295 - DNA, 1146 bp, Mus musculus
ctcgggtatgtgaccacagtttgtctcattccttggaaattgttgataaggccaagagccctctgtccagcctcctacttcccaggccaccgtgaagcctgttcctctgagctcctctgcctggaaacagagggctgctcagtctcttctttccagtgcaggggcatcactgtaacctggaagaagtccctctcctcaaacactattgtatgtatacataaaacataaaaagccctatcacagggtacatatgaacggtagcctgtggaaacggtgggatatggagagagcacattgaacacataggctggtgcgctggagagcaggcagaacccagcaggcagaaccttctctgggctgtgctcccagcaagcctgtgtagctcagtgtttatactcagtgaaggatggtagggtttcttaaacatacatatttcttaccagtaatttctgggaagtgatcttgaacccgaagagaatatgatattttgcagtgtcagataaattttctaattttgttttatcttgttttacctaagaacactggaactattttggggctgatgagaacctcggtccagtggctgtgagcattcgaagggaaaaaccagaagacatgaaggaaaacggatctccatacaactaccgaataatattcaggactagtgaggtaagtggcaggtgaacagatgtgaggggtggagtagaagcagtcactagggactggagtcacggaggtcgtcacagagtccttggaacaaagaaggagcaaggcaggggagatagttgagttcataaagtgctggctaagacttgaggtcagtccccagcacctggggattgaaagctgtcatggtagcatgtgcttgaaatgaggcagagataggcagatccctggagcattctagctagacagccaagcccgcttggcaagctcctgggcaaccatgttattattattttttaaagtgtggataacatctgagggtctgagggcagatacctgagatgacctttgacctttgtacgtatgtgcatggtaatactcggaagagggatctgttctttgagtggggatgcctaggaaaggtgttgcctatggctggcatttggcctagctcgcagtaagagtgcaatgaaggagtgg

SEQ ID NO: 21296 - DNA, 1102 bp, Mus musculus
atgaaaaccatcgccccctgagcgcggcctccaacagtgaccagctggaggagcaggccctggtccagatgaagtcctacagcaggttggtcacccggtgctgaggtcatgaatgtacaccatgtgtctcctcagtagtgccagacgtgatgaagaggagatggaaggccattgatgagctggaagctcaacagccatgccagacacttgattttagatagaataccttacaactaactactggaaatacaattaaactggtcttgatggcttaaggatacaattatgaatactctttattatttaatgtcataagtcacctttgcttttcttactttacctgtgtagtaaagtaagaaaaagccttggtcacaaatactcagactggagttagccttccagtctggttttcggcttttctcagttgccactgtggctgtgttgtgactgtactcatgtgtgctcggcttccagcattctgtctcggcttgcctgtgtcagaaaacaggatgcaaggctggctgagagtgtttgtaagatggagcaaacagtaataaccgaagctcagagagcctctcaatgatgaccctcgactgagacttacactgcgcaggggctgaggttcctgcttcccctgcgttcctgtggttgaggtgtgggctgaacatgaagtgttccttagcatgccagcagccagctgtggagcacaccatgacacttgtgcgcagatagtcaactggaaactcctgccctaagtcctgaggatggttaggaaccaaggtatctaagccaagtgtggtagtgcatgcctgtagttccaccctctggagactgaggcagcagggtcaggagttaaagaccagccaggctacattttgagaccctgtctcaataaaatgggtgcatttcacacctacatttatattcagatacctataagatgttgtggctggcaggtaataacagggatggtgagcctggctaccagcgtgctgctgcttaggacttctgaacaagtctgaaaggctgtgagcttagctccttgttaattgtaacagagctgtcgcagatcctcttgccactgggacaactaggttaagct

SEQ ID NO: 21297 - DNA, 1148 bp, Mus musculus
ggccagaagcttgccaagttttccaggagtgggaactcccaggattccagggatggctaatgatgagtctggaggtctctgcaaaggggaggcccctgagagccagctccacttcagacccattgctctgaattttgtgcattatctagacattgttgaccttggtctgtgtgcccaccggccttacaactgtttattcacccagcctcagatggaaaatattatagaaaacacacatctgtattgaacaggcccaggccttgttatccttctctaaacagtatagtgatacagttgatgttgctttatattgtattaggtcatctagaggtgatacaatgtctatgggctgttatgctcagatcatatgcaaattctatgccactttacctaagggaccaaacatcttgagattttgctcttggcggggttccagatacacttacttcttggtggacactgaaggagagcagtgtttcgtttcagacccaagcttgttcaccgtggtttagagatcaacctgctatctgcttttgtggtgctacctgtgtgcgccagcctgtacttcagtgacatcgaatgcttgtcctgctgcaaaacagaacttattgactctgccaagagctcagccctcagataggttttaaatattcttaaccctgggaagctggcccaagaaatggcttatttgttgccccataccactcagtatgtaacccctgacttcctgctggctggagacactcagagtgccaatcaataagcactcctactcctgtgtttttgagcaatgagaaaatgcatgaaggggaacccctgaaagaggaattaaatattatcattctgtggcttaacactgcccacgctgtgctttaaccaccatctttttattgcagtgaggggattgtaaaagcagtgttattgagacataattcactagaatacaactcacccgtgcaaagggtgcaattcaacatttttggtgtactataataatgtctttgatatattataatcattagacattttcttatactaggcagagacgtttattaacctttcctcggaccttattccagggcttcttcagcttcatttgttacaaagaaatgaattgtgtgtaaacgacaatttcaaagagctgcagt

SEQ ID NO: 21298 - DNA, 1171 bp, Mus musculus
ttttccctgtacaatcacaggcttcttcttgtattaatatttaaattaatcggaaaattctgctacagtgcccaccccagcaggttcctatggaagtaaatgaagccaggagcatttagccctgttggcatctcactgcccaacgacttatggggcatgcatcttaccactgaacagaaaaggagactgaagtcttggtctgagagttctgagcaacagaattccagcaggctgaggcaacctctggggagggcagcccactactgctgacatctttctgttgtaaatccaccattgccatgtgagagctccatctgcatgacctcatcaaatcctagtcacttcccaaaggccctgtctctgaaatacgtcaacatatggtttgggggtgattgttgcaaatatgaactctagaaaacacctaactccaagctggggtctgagccctgtttccagtaccgtcccagatctgtggttgctagcctggtatcatggagagatgtccctgggcctggaaggcagccctgttttccttcgtttctcttagcaggtacagaccagcctggcatgctctgtagtttccggatccctggggcctggtcctgtgcctggtccttgaacgtccaggcaaataactgcttcagtacaggtgagccatggccatctccctgggtgttgagtacagaactccacagacctgaagaccccatccagcagctcctcttccccagactgccagcatccctggtcccagggatccgtttcttgtctccatcaggtttgtctcggagggtcctcttgaccaatgtggtgacaggacaccggcagtcatacaggatcaacagtgatgtcttggcccagcagtttgcagtcaaggtgggttggcctgggaagggtttactagaatgctctgtacagtggaacatttgagtgaaactcggtttccctgctgtaactctgggctggtgcctcttacaaggaaaacaaagcatgggaaggatcagggagctaccttgtttgtttgtttgtttgtttgttgttattggttgatggttttggtttgttttggttttcttgaaaccactcactatgtagccatggccggcctggaactcattatgtaggccaggccatccttgaattgagaggtccttctttctgcctcatcgtc

SEQ ID NO: 21299 - DNA, 1197 bp, Mus musculus
tcagggttgagctcaggcctgagaagcagagcttcttctcaggaaaccactgtagatggatgttttttcctgtctgtgacaagaatagaatttagagcatagttctgggtcccagactggtgtacagttctttcttatggagaacactggcttcttaagagaaattaaccaaggcatgtacccctcaactggtgtggtgctttgtattggtgggggggaggggtgtgaggaggtcatggagcccagagtacctagtataagctgacagagtaatctgtgtttcaggcctgctatgagagaggcaaggaagtcagcgtggtgcccaaaacatctgcctccactgactctccctggatggggctggcaaagtatgcctggtctgggtgagtttttctaacacgctaaagggttgctgggttttgctgggcttgttttctcagcacctggcagagtaccactgctgacttactgacttgcccccttgtaggtatgtgatcgagtgtcctaactgtggggtggtctatcggagccgccagtactggtttgggaaccaagatcctgtggatacggtggtgcggacagagattgtccacgtgtggcctggagtaagaaccattccttggcttccctcgggtttgcttgtcctgttgagttattgagtgtttgtgtctggagaggtggagtttgcttacagtagaaaagtcagccatgagttttagcacgtgagtggttgagtttagggagacaggatctgtagagcccattctgttcccgctctttgcctcttattcattatccagacgattgcaacacaaactggaatgaactagctgaaaattagtctaacactctcactagcgaataagatgtcattgtgtacgctcttactcattttctatatgcatatatgcataatttttgaaatgtacttgctgttcatctgtttctgcagagatggggccacagtgtgatgctcaggctggcctcgagctcctggactcaagtcatcttcctgcttaagccttctgagtagctgagactgcaggcattccccagcagtctttgctcaaggatagcttacctgccatttttcctgactttttcttatgacagtttacttgacttagtgctatggtttgacttaccattttcttatttttcacatctgttcaatttatggtttcttattaatatgtt

SEQ ID NO: 21300 - DNA, 1187 bp, Mus musculus
caacaacaacaacaaaacctagaaaggcagctgacatacaggcactgttggaagggtgtgagtgaggtgaatgcattctttccaagtaagaccataaagtggctcatgggcagctactaagaacttccctcttaaaatatttcaataattaaaacaatgctattctgatgagaatgattcattagaaacggggtaaatgcatgaaagagaccagattggggctggagagatggctcagtggttaagagcacactggctgctcttcaagaggtcctgagttcaattcccagcaaccacatggtggctcacaaccatctgtaataggatctgatgccctcctctgatgtgtctgaagacagctacagtgtactcacatacataaaataataaataaatctctttctttctttctttctttctttctttcttttttttggttttttttcaaacagggtttctctatccagggtttggctgtcctggaactcactctgtagaccaggctggccttgaactcagagattctcctgcctctgcctctctgcctctctgcctctgcacctctctgccccctgcgcctctgcccctctgcgcctctgcctcccaagtgctgggattaaaggtgtgcgccaccactgtctcgcataaataaatctttaaaaaaagaagggagggagggagggagggagggggagagagagagacagacagacagacaaacagacagacagacagacagacaaccagaggcctcacatgctggaagctcagccccagtctgaggccatcctggtctacacagtgaggtcctctctcaaaatacaaatgaaaaagaacagaagagaaacagcagagagttctcagtggaggagttggcctcaggagtatgacttatgtctgtgtccaggagagtgtggatcctgtggaggtgtgtgtgctgagtgcatctgtaagctggcttactgtttgtttcccttgagaaatacggagtgggattatcaggtgcaacatataacattatatatctaaaatcattagagtttttagatgtggtgtggtggtctgccctttaaaacagttacactgttcacatctatctgtatattcagtcaggaaagtacccatgtcatgtgccaggcagagaggtgtagaactaaaaacctctcccctcagtctacttggagaga

SEQ ID NO: 21301 - DNA, 1101 bp, Mus musculus
ttcaaatcccagcaaccacatggtggcttacaactatccataatgagatctgacatcctcttctggagtgtctgaagacagttaatttacatataataataaataaatcttggggccagagtgagcggggccggggtgagcagaggtcctgagttcaattcccagcaaccacatgatggctcacaaccatctgaacagctacagtgtactcatatacataaaataaataaataaatcttaaaaaagaaagaaagaaagagtatagtaaatcactttgctccattcacctcacagagagaaaattgaggtcaatgtaagttaaatgatgtcagattgttccagccttagggatgggtagagccagcttaaccaaacctccatggtgatagtgctctcctctctcccctagagagagcatagcatgtagacattgttccattcattgaaacaatacaaacggattgtctggtgtgctaggcatcatggcacagatcagacccctgcccctcaacaaggagttcattgtagttgtgaagctgagagcttggaagaatgtggactgtggatttgttagcaacaagggccggggagcgaaggggctgcgcaggacagggactgcattagctgtttctggtgtgacattttcattgattcttatttgttgattttctatctgtccgtccgtccgtccacccatccatctatcttgtggcctgtttctttgtgttctagtctgttacttttctttctaagtcccaactgtcactagcgcttatgctagttttgctgtagctagatggagtttgtaaaaaagggagctagctgtgtgtcccctttggaagatttttggagagatctcttgagttggcatttccagtcctcaggattggaaggctttttattcagatataaaaggagagctgaactcggtgaattgggtatgtcaaagaaattcatcatggagctgacaagagctgttttggaagaatctgtgtgaggttcctttctctgtggctatggtctaagctgctaggacagcagaggagctgtgggcagtgtctgtgtgtctgtgtggcaagggtcagcgctgctgggagggga

SEQ ID NO: 21302 - DNA, 1145 bp, Mus musculus
ggagatcatttttcagttcatgtttaagtgctgatgactgatgagacgttagaaggagctagtggggaccccatgatgaagggaagggaaactaagccatggaagtttaggctggccttggatccagttggtagtgaggttgaccttgaactcctgatcttccagcttctgccttagccctgtgagaagccaagagcgtctcggtgcctgggtggtgcagtgctgggcactatacccagggctccatcaacagtctgccaagcgagctgtagtcccaactctctttttgcctttcttttaaaaacaagacaaaacaaaacaaaacctttttttaaattaatttttttgttttttatttttattttatatgcattggcattttgcctgtaagtgtgtttatatgagggtaccagatcacctggaactcaagttacagatagttgtgagcagccacatgggtacaagagttgaacccaggtcctctggaagggcagccagtgctcttaaccactgagctatctcaccagccccaaaacaaaatcctttattctgtatgtgtgtaggcatgtgtgcggaggtcagaggataactgcagaagtcgattctcctttttatctgcgggttccctggtcatcaggcttggcagcatgtgactttccacattgagccacctcactggctgttcgtccctcttttttttttaagatagattttactgactggcctggaacttgatttttaaaccaggctgtccttgaactcacagaaattcatgcctccgcctcataagtggtaggatcaaaagagtgtgccaagtgtgccaccatatctgttcatcagtcaagaagttccctttgaccagtttgtgggtcagcatggctgtggttggaattttagggtggagatgtatgctagttctctataagaacctgaccactggcttgccgtctttggaggatgtagttctctataagaacctgaccactggcttgccgtctttggaggatgtagttctatataagaacctgaccactggcttgccgtctttggaggatgtagttctatataagaacctgaccactggcttgccgtctttggaggatgtagttctatataagaacctgaccactggcttgccgtctttg

SEQ ID NO: 21303 - DNA, 1219 bp, Mus musculus
agttaatttttctataaaagtcaaattgaaaacatttcattgaggatacatatgagctttctatagtgaaattcataggggatttattctgagtttaaagccattccagttctcattcgcttctggcttttgagttctgggattgtaactgtcctgccccagcaaaatacaaaatgcccctggttaatgctatatcctatcctttgttatttttttaatttttaaaatttcattattttttagctcttagtaaataatgatttgctggattttcttctttcccctggtctttttttttttttttttttttaactctccctcccctctgggttcatcaatgttaaagtgaaatggttattagagggttaaagagcagtgttgtggtgatgacttcagtgacctcataagtattacctttaatcattttgccttgctgtattttttcatgtttttaataccttaatatttcacaaattcttcttatttattgttagcttttggattttgtgagtataaagagcctgaatctaccctccgtgctctcagattattgcatgaccttcagattggagagaagaagctacttgttaaagttgatgccaagacaaaggcacagttggatgaatggaaagcaaagaagaaagctaatggggtatgtaatatcttttctagcctacctgtgccagttctgtgtaaatacttcatattgtaagtaaatttagcatggagtctcacaagattattgtcattgtaatatgtgcttgtggcttatgcaggagtgtattttatagtttgtagataagtgttttatctacccacagtgggtggatgactgttggtttgcttgttccaggttgggatgaaagtagtaagggaggctggacaaggttaacttgccagagaaaacacttgtacagactattccaatcagagctaattcattaaggcagctttgtaagtaagtataaaatatatatttcaacctacacaatgtttattagtaatcctctctcttttagtgcacacagattggattctgaaatgagtgaaaataagtcttaactacttcatgtatgagtgaccttattcaggatttttatttttcattttaattcttttactttgcatgaggataaaggaggtctttttgtcttgtgtgataatatatattgcatccttcacaaaacaatcttaaacttgagtatatagtgtcttaaat

SEQ ID NO: 21304 - DNA, 1161 bp, Mus musculus
gagttcaagctcattagttgtacagggaatttgaggctagtctgggtgacatgagacttaaaaaccaaaatgtattattgcataattcttgtttctgttacttagataatttcactgacatatactacatatatatatttacagggtaaaataactgttgcttgctgggcgtggtgtcgcacacctttagtcccagcacttgggaggcagaggcaggtggatttctgagttcgaggccagcctggtctacagagtgagttcccggacagccagggctaaacagcgaaaccctgtctcgaaaaaccaaaaccaaacaaaaaaacaaaaataactgttgcttatttgtcagatttagttttagtagtttggatttccatatgaagtaaagcctgtgttgggcatagtattaaggttttgttgtattacatatcccttggatttgttttaacttattggaatttttttttgagagatttttatttatgtgaaagtgagcatgtgtgtttatgtgcaccatatacgtgtatttcctgtggaaaccaaaaatgttattaatttcctagagttagaagcagctatgaacccccatgtttgttgaggaactgaacccatgttgtcaagagcagcaagattcttaactgctcagctctgttcagtctctgttttgacttttttttttttttttttgagataggatctcatgtagcttcttactactctttgtaatatgaccttgaactcttccccacccccactcacttcaagtgctgggattagatgttatctcatttattggatctttaaagaaatttgttttatttatttgtatgtgtaggttgtgaatgtatatgtggaaattagaagacaactcatggaagttctcttctaccatttgggtcccagggatcaaactgaggttgtaaagtttgtggcagggcccctttacatgttgagccatctattggcaccattccacagactttttaaattattatttgatctctttgttttattgcccatctaagctcattaaaattttgtttatctaattaacatgatctgattcctatacctgtgataaaacctcccctaaataaggcactcatgacagagcagagtgtaaatgccacaaaaggtcagcttggtgatccgtacaggaat

SEQ ID NO: 21305 - DNA, 1125 bp, Mus musculus
atgtatgtgcattacagtctagtagataaaaggtgcttcaggagaaaatgttcacataattgcttccaagttcatttagtgagtcgtgttttctgaaagaactgtatttgctttgggtttccctcaaaactgcttgtgtttcagatgatgagagttagtctggagaacgtctccagaagctctgtttcctctcactttggatttggaggtagaagctgaaattcagaaatgggtaattgtttggaaattgtgtgagctttggataatatttggcagcttatctattgactttttttttttttttttttttttttttttttttggtttttcgagacaaggtttctctgtatagctctggctgtcctggaacttactttgtagaccaggctagcctcgaactcagaaatccacctgcctctgcctcctgagtgctaggattaaaggcgttcgccaccacgcccggcttgacctttttaaataattccaaataatcttctgtcctgtgatctttttgtgatatttttgtactactgataattagcaatcagttaagagactgattaggctcataagctttctttctgaaaatgtagattgaggggcagttagccatttgaaaggtagacttgaattctttttttcttaaatccttcatggttgtaattgtggaaaatagctgtatggatctttcaatttcagtttgtaggagatgataatttagggtctacaggttaattctatgtgggaagccgtgcacaatcaccattacaagatggggctggcttcctcagtgcctaactagtaaataagcaatgtgcgcaggtgctggagtaaattcatgccaagtcactgcccatcccggggtgtaggagtggggtgatgagcgagcaactaatcaggagctgacacgtcacacagaggggtatttaagcagctccattttccgggttcggggtcttcctgagaagcaataaagctttgccgtagaaggatctggagtgttttttgctggtgaaacgttacaaggacagttctatattagcaggcctttgaatttacaactccattcctattcctatggttagaaacctatggagagtcttccaagggaaaagaaatcaggaa

SEQ ID NO: 21306 - DNA, 1218 bp, Mus musculus
cacatctggctttgaaatcacagagatccactggcctctgcatccttggtactggattcaaagagtatacctccattcctggccaggtgtatggttatcataagctgcttttgctgcacatagacatattggaagctgggctggttaaatggtaaggaactttgatgctaggactgactacccaagtttgattcctgagattcctgtggtggaaggagtcctcaagttgtcttcttgacttccatatgtatgccgtagcacacacagatatacaaacatggaaatagttttttaaaagattaaaaaacatgtagaagcatatgtggggaaagaatccttcatttgcagcctataacctttctggtgattaggttttgtagtatagctatctagtattttccttggttagcccattgatatttttttctttggaataatttttgtctattctcctcaaatttgtgttggtttttaagaacgccagaccagaaactgtcactaatgatgatgaagaagccttagatgaagaaacaaagcgaagagaccagatgattaaaggggccattgaagttttaatccgagaatattccagtgaactaaatgccccctcacaggagtctgactctcaccccagaaagaagaaaaaggaaaagaaggaggacgtatgtgttctgacaatagtaatttatataatttattcttctggaaagtacaatgtttctttagaaactcaggagttgtctgtgtcatgaaaaatgctataaaatacacatatatattgtttatttagggatagtgtaagttctgttttgagtttcagtgtctttgggcattttagttttatcattggccagatacaattgtattactgtaattattcattatttggtccaaaaggtgcatctacttggtattattgggaatactaatgtaaagagttagtcagataattaggtaaagttgaaatttttcttcctccattgatatggaaggataaaaataactgatagtaatgaagagggtaagttacggaagtattattttttggctagaattataggcaaatctttttataaggtagataaattttgtgcatgcaaatacatctcaaatgataatttcttacatgttagaattccttatcttaggaaacagtcctggtactcttaagagtattttggctattgaaaaaaaagcatgtgatgggtgatagaggga

SEQ ID NO: 21307 - DNA, 1143 bp, Mus musculus
tctaattatagcacaatgtgagctgttttttaaaaaatctttgtgggtttctctgcagattttccgtagatttccagtggccccattgatcccttacccactcatcaccaaggttcgtttgaactgtaggctttgatttttatgtgtgcactaactgccagatatgtgatttttatcattattattactattactattattatcataactttacaacattagattttacttccaagttggtgggttttacttagatgtatttgtaatacttgcattaaatactaaattttgttatttttctattaatgtatgtaaatctattcctttctgttcacttaattttaggaggatataaatgctattgaaatggaagaagacaaaagagatttgatatcccgagagatcagcaaattcagagatacacacaaggtagtattcttgatttttcacttgataccaatctagactttttacagaatccaaagcaaaaagacaagaaaatcaactttgcattagagtataatttattattgcctttaataggcttaattgatactaaggtagaaacaaaagaacagaagactaataccatatttaatagtggccattgctaattgttctcagtcactgactgctgcaagcatctcactttaatataacaaaagttaatttagatttcaacatgaacatcaaggtcagattaaactattcagggggcagcaggataacatacatatagttcagtttatcttgtgggcaggtctttaatcctaggaaaaacttttttaaagagctgagattaaaatttaagatttatatttgtgtggattaagtttgagtgggggagattttaaaacgtaggccagtgattaccagacttaccaaattatagatgcatggaagaactgtaaattcccataaagctaatctattcattgacccccaccattatgatagagatcatatggtgactaatgcaagatgaaactctcagcttggaaagtaacaaggaataggatgtaagtatgagcttctgttttttattatatttatggatgccccctcagaaaaatatgcaaaggggtaactggcttggaaatgggtgtttgtatatagtaaatcccactcatgagttttgcctat

SEQ ID NO: 21308 - DNA, 1153 bp, Mus musculus
tgccattccttcccaaacatttgggattagaattgtttaccaccatgcctggcaatatttttttttcaaaaaattgtgtatttcagtctatgattaggcacagttagtaatttttcagtcttttatgtaatcttacattgggttttatgttttattttttgtaatgtgtataattgctagcattgacttcagaatgcaatttagaacttttagttagaattaaagtctgtggctttttgtttaattcctacattgggattaaaatgcagggccctgttcattttagaaaaaatgccttatttgaattttacttttgactacctagtctatgtccccttgagtatagagaaattaacactaaattttgactttttgcttattgatttatcatacatgttatagttccccgtggttcctaaagaaaaaggatagaatgctataaaatatatgatatatttaatgttctatttccatagagaaaaaagcagagatcgtgaaagggaacgggagcgggaaagagagagagaacgagaacgggaacgagaacgagagcgagagagagaacgggagagagaacgggaacgggaaagagagaaagacaagaaaagagacagagaagaggatgaagaagatgcatatgaacgaagaaaactcgaacgaaaactgcgagagaaagaggctgcttatcaagaggtaaactgaggaaatgctctttctgaaaagcatagttatttccttaggatggtgaggcatgttttacagaatcctttgttaaagtttaaatttctgaaacttttttttagcgccttaagaattgggaaatcagagaacgaaagaaaactagggaatatgagaaggaggcagaaagagaagaagaaagaagaagagaaatggtgagattttaggtttaaaaaagtgtattgttaattcagaaacattcagacttactgtcaaacagaaatccttacaaatgaaatttgtcagtttctcaggtaattgtttttggttgagtgagtgcgtgcgtgcgtgcgtgtgtgtgtgtgtgtgtgtgtgtgtgtgtgtgttttgaggtggtctctctacttagctcagactgttttggaatcacatatcagtgtatatcaggctagtcttgaactcctagtaatggcct

SEQ ID NO: 21309 - DNA, 1147 bp, Mus musculus
tatctttattgtactggatgtatgtatgtatgtatgtatggttcaggcttgctgttgtcttttgactgcagggattaaagtcatgcacatcacagccagttgttttggtaggacagtcagcctcaaacaatgttaagcatccattctgtattgtctgagttatgcctttatcccctaaagccaattagcaatttgtgtatagtcttcatacttcatatctgaaaaaatacaaattaagtgttgagtcttcagtttggaataggcacaaagcaactgtcttccccttgaaagttatctttgggcttttagacacatagtgtgatttttcagaataaaataacacctttgtgcttacttgtaacacattaatgtcaacagcacccagtcctggatgtttacctgagtcttagcattcacttacttgatttctagtgttgaggaaattctgtattgtggacattttgtgtactaagcaatgatctgatcattaaatgctattaactttccaggggtagtgctcttcagaaacggttgcgtgatagggaaaaagaaatggaagctgatgaacgagacaggaagagagagaaggaagagcttgaggaaatcaggcagcgcttactggcagaagggcatccagatccagatgcagagctccagagggtgagttattataacatctgaaattgtttagttttaatttactttatcatctatcagtcacctatgatatattttagtttgtagataaaggaattacaccatatgcgcttttagacttgataatgctgttatttggaagattattagtatttgttaattttagtacagaaatcatcagtcttaaatgaactcagaactttgtatatgtttgtttagggaacactttagtggtggtgcatatgtgcaagccggaagtaagtctcaggtcttggtgtagtccatagaagcagttcactgtggtttacttgagacagaatctggctagggatttgcctgtcaccacattgctccagttgtcatacttgaacatttgctgtgttgagtttagtaggcattggaaatcaaatgtatgtcctcaggtttgcatagctgtcatttaaccaactgaggtatttccccgcaccttgaatccatacctcccatcatc

SEQ ID NO: 21310 - DNA, 2184 bp, Mus musculus
atattgaaattattagtatttagtaagtcattgagtttggctgaatcattatctttctttgtaccgtaaatgttgtgtttaaaatattttcatactggacagttgttcttttaagtcattatgttgattgtatttggtggatgttttggtatgttactgttgttttaatataccaataagtatctttacatgtgttcctgtcttttattttctaggtactagatgaagaagcagaagtttttatagtcaaaatgtggagattattgatatatgaaacagaagccaagaaaattggccttgtgaagtaaaactttttacattcagagttacatttcagatttcttctttcacacccttcaaaggactttgaattttcggtgtcttcaaagacatttgtgagatctgtaattttttaatgtagaaaatgtgaattcttttgtcctctaatttgttgatgctctgtgtactcactcgggtgtaaagccatctgtgtccttggtcctctttatgctcaccaggcacagactactggtgtgttttataagctgcagctactgtacacagcctatctgatagcatcttgttctgctgatttgttccttgtaaatattaaaatggctccccaattcttttgcagaattctacttactattaaaactgtattgtataggcgccaacatgaataagttgaatactagtcatacccttacagcctcgttcccactttcctgatcagaaatggcaagcccttgtaaaggcatggagtttaaaattagagtgcaaaacctagcagacaggtccttcctaatgtatctctgtattaatgtgtttatgtgaatgtatgtataaaagtcttttttttaatttttttggtgggctcccttaaacatttcgtaatcatcaatgcacacataaaggaaaagtgataattgtgccaacccaaatacctaggataattacggtgtattttccagagactggtattctgctgtgagcaacacactgctgaccagttttgtgttcttctgtgtataggatgatacatcataatcttatccctccctccacctgatggctcagaattgaagcagagtctagaattctggagcattttgctcaatatattttcaacttgtcttcatttaattttggcatattcattttaataaaacaattccagaagtgtaaggtggggggaggagctcactttcttatgacggggatgacctcagtgagagagctatgcttgcttagcatgaacgagggcctgggttctattccccgtaccaataaagaagtgaataaggtaagtttacaaaagagatttgacaaaacacaatagtagttaattcaccatggtagttaaaaatgtttacatctttcttccaaagatacatcatccaagacacattcaagacaattttctgctcacaaaattttattactggtcatcaagctttaactatattgatgacaagaaatccttggactttattagtaattcagaagatcactaggggcaaaatttatttgaaaagtaccaagttctaaacagctctgtcaagaaattaggtgtggctgctgccatgtttgcttactaaaaagataaagactgagttgttagaataatgaaactgtgagcttgagttactagggtttttggtttttgttttgtcttttttttttttttaaacatttgagaggacgtccaaaacactgtttttaatgttcaaccttgacatggtttcattatgtaaatatttcagttattaaaaatgtatatatttgatcttggagatgctttctttgagtcttgtaaataaatgacattatgttataattgtgtagtgcatatactagaaaacaacctgaaaagatggtatcagaagatcaaagtgactatcttattttaggtgaggctgctatacaaatatctctctacgtagagttgattatattttaaattatgatttagcaatcattccagaaaaatgatccttaattataaatttattaattatttttccagattcattcaaccaccacaccacaaccttgtttaaacagtttgtttttctgtctttcagacacatcgaacttttttttttttttttttttttttggtttttcgagacagggtttctctgtttagccctggctgtcctggaactcactctgtagacc

SEQ ID NO: 21311 - DNA, 1631 bp, Mus musculus
tcttaaaacaatttatttattttatgcatatgaataccatgtagctgtcttcagacacatcagaagagggcatcagatcccattacagatggttgtgagcaaccatgtggttgctgggaactgagctcaggagagcagtcagtgctcttaaccactgagccatctctccagccccataattgtagtcttacatggtgttgtgagaaagaatatggagagatatcttgaacaccactatatgctttttaaagtactattaataatgagtcccagcactcgggaggcagaggcaggtagatcttggagttcgaggccagcctggtctacagaatgagactatagccaggacagcttggaatacatgagaaaccttgtctgggaaaattaaaataacaacaacaatactaaaatcaggtagggagtacttcatgaatttgaaaagatgagattactaagtttgtagctgcatgaagaacatttggaggcggaaagttggctctgtggtggttaagagcacttgctcttccagaggacccaagttcaattcccaattcctacatggcagcttacaaccatctttaactccagttccaggggatcatctgatgccctcttctggcctctgtagacataggtgtatgtgtggtgcatagaaatgtatggaggaaaaacacctatacacaaaataaagaaatcataaagaagaagtgttggtacaagtatatagtatttaagccaagcctccaaaggggggaatggttgcctgaggaggagaatagaaggaggggtgaagtgagccaggacccaggtaagcgggagggagggcctggcttcctcggggacagcagtaaataataatccagacattagcactgtctgtaaggagtcctggtggagccgttaccacacatcccaggtgtatgtcttccaggatgccttgtgctgagagtccggcttactgaatgcatttctcgttctttagaatgacagccaagaacggcagcagcagcatgacaggcagagacttgacaaccctgagccaatatctaatgggcggccccagagtaactcaagacaggtggtggaacaagatgaggaggaagacgaagagctgacattgaaatatggagccaagcatgtcatcatgctctttgtccccgtgaccctctgcatggtcgtcgtcgtggccaccatcaaatcagtcagcttctatacccggaaggacggtcagctgtatgtataagtgcttcgttctctgggctggtgtggcttttcctcgtagcttgttgttatcctctcaaagatctgtggaccatcttccatctttcctgatggccagaggcagtggggatgatggcagtgatgatgtgatgtcttggttttgttgttgttgttgttttagttctaaccttttgaattcttacttgtgagccagcagacatggtagcagggcctgaaatcctagcacttagcaaatggctcatggaagtttagaggtttaggaaccatggctttgggggaccaccatgtggtgattgagacacaagcatgatggcatatgcctaatcacttggcagtgagacgggtcagtcaggaactcaagtccatcttgtgctgatgcagattccagg

SEQ ID NO: 21312 - DNA, 3561 bp, Mus musculus
gctgatgctgcgtggcgtggggatggtcctgagtgcgcctctgtctccacagggcctgtgccttacattactcctgctcgccattttcaagaaagcgttgccagccctccccatctccatcaccttcgggctcgtgttctacttcgccacggattaccttgtgcagcccttcatggaccaacttgcattccatcagttttatatctagcctttctgcagttagaacatggatgtttcttctttgattatcaaaaacacaaaaacagagagcaagcccgaggaggagactggtgactttcctgtgtcctcagctaacaaaggcaggactccagctggacttctgcagcttccttccgagtctccctagccacccgcactactggactgtggaaggaagcgtctacagagaacggtttccaacatccatcgctgcagcagacggtgtccctcagtgacttgagagacaaggacaaggaaatgtgctgggccaaggagctgccgtgctctgctagctttgacccgtgggcatggagatttacccgcactgtgaactctctaaaggttaaacaaagtgaggtgaaccaaacagagctgccatcttccacaccatgttggaaataaaacacgtcctagctgaacccttactgtccaggaggttccgtgtggaggtggcactgggccgggcctccctctcaggctcctttgctgcccacttgtaagtttaaataaggacaccgccctacacaaacctcacccctgtcacatcagtgactctgaccacttttgttctcaaactctctcactattatctgtggttgccgtttcttcccaaggccagcctggacgaatttggggttgctctatcctgagagttgtaacctcaacttccaaagtttatattttcttgaaatgatggatctattgctcaacagtccctgtcatccttaagtgacttctgggtttcccacaaattcctcacttttagacacactctaagcttacttctggcctggatgcttcctctccctgtctctcccttgccccacagcggttccctgacagcagacaaggcagctctgggaggtagctagtatccaataacccaggggtttcctcatgtgatgcaaatactacgtgtccaaccaatcagtgctgtcaacgggctgccatagctccttcgatggcaaataggatgtgtgcccaaagaattaaagcgatgagtggctggtgaagcgctctctgtcctggctggttttttgtcaccgcaatccactgccaaaggcagaatttaaactaggggctgagggatagctccgagtaatgtccaatgctgggagttggtcagttcagaaccaattgtgtcggtaaaaaaccaagggtttggagaaaagctgtttcttggttagctgtggaatcacctggatttagccagctgccaagaggaaagacgggcttcccacagccgtggggcagagtgagctagccgcacaggcaggtgtgagggctgaggctttgccctcaggaacctcagaagcagcctcactcgattctggtctgcctctcctctcagctcagtgcttcattgtgtgaggtgagcagcgacagtactgttgagcttacagctgagcgtgcgcgctgtggacccttaggctgaacacagagcaagcagcagctgcctcagccagaagaccaactgaaaagacttgagaaaccagtgtggctcaagcaaggctgccggctttctttcccagcctactctaggaaccactttccctaaagtgggtctcattagagtgtagaatacttattttgggtcacacaagagtactgttgatctagccctgggcctttgggcatgctagcaagtgctgcgctagtcgccacccctcatttggtctggaataatcctagtaagagtttgacctctagtagtccccctgtggtgggtgaggtggagacaggcgggtccctcggcttgctggcctcagcccagcctcatcaaggcttaggccagtgaaaagcaaggtggacggacagctcctgaggaataataccacacaaaacacacaaaagagaagctgagggtgcagctctttgggagagcgtggtgctccaggccctgcgttcagttcccaggctatatttaaagaatagaaacccaaacagactcatctcaggctgatgaaaagagcaggaaagagagccatgcagggaagaggggctgtgtggtagaagggtctgtcgttttaattttcatgcatatgtcaggacagccctatggagtcagctctctcctcaattacatgggttctgaggctcaaactcaggtcaccaggtacgtacgctgtaggcaagagtccctaaccagcgcagccacctcaccagcccctattctaagaccttgctactcacacacagacggcagattggaagttttgattcaaggcacttttgtcagtctcagctagagcggtgtatgtaagagccccaagtgtgtcgtgtgtttggtgataagagggtatgaacgggctgtgtttgtgtgcacaagaggggtggccacgagccaggcatcatctggaataaagccactgaccccacctgcttaatggaaagacagtgggaagaaatgcagtagctttagggctttggtctgatgcctacaggatacgagagccagcttcgccatcagaggctggagaggaagggcgctccttcctgtttttgatcctgctgggttaaaggggttctaggtacacagctttcatacagaatgactgcatttctccaagaggaagagagagagagaagagagagcaaaagcaatctattagagagagagcaaaagacaacagccaaaagcaatctattgacttcaccacaaaaggagcaaaggcctgtggttttgcttataaacttgacttgaaagttaagtatccttttgtgatagatgcccgagtgaatagtatgttgactgcttgttctgtctgtggatattagttagggtcctctcttgtgtagcccgggctgaactcaaatgtataatccttctgcctttaccttacaagtgccgggtgtcacaagacatggaccatcgtgtcaagttacatatatacttgtgtatgtacatacatgcacatacatattacgtttatttctgcacagagcatatgcctacatgaggtcagaggtcagctaacagcaggtggttctctcctcccatcgtgtgggttccaggaattgaactcagatcctcggctctgagacacatgcttttaccccctgagccatctcactgggcctatggctattcctgaccctaacttattgaatgtgaaattgatattaactgccaaataaggtcttccaaggccaggcttctagtgggagtctctgtctgaagaaaagctgaggaactgagggctttattcagtctcctgtgtgcttcgctcgatgaaggaggctcacttgccctctttcctacctctttccctccctccccccctttccctccatttcctgttcattcctcttctcctttctgaaagaaaccccaggctcttg

SEQ ID NO: 21313 - DNA, 1148 bp, Mus musculus
tatatcaaaaagccaaaatctttatttttatgcacctagaatattttaaatagttctcaatattaaaaagtatgagttgtaagtaatcttgccaaaagtgagcgggttagatgtaagaaattgtacataagattgatttatcattgatgcctattgaagtaaaaaagaggaagggttggaagttgtaggcaggagccctggcttgtttgtgaccattcatgttaactagcacactgcgaaatggtcataccgatgacccgtgcagtcactaggtagtagttttaataagatgagcaagcagtgttgtcctggttttaaacctatggtgaaattctaatgtcatcatttgaatggaatcaaatctatgctctagagaatgtatgttgaatcttttacatatcattgcaatttccttatgttaatcctttagcattacggtgacaatgacataatcatatccagaaaagggaacgcaggctattgtgtcggtttgtaatgtgggtcttaatgggctctgtccttgaagttttgttcccataagttttacagggatgagattctggcttctgtgctgtgtgtgtctgtgtccccttctgccccaaccatgaacagagcatcccatgccagttgcagctacttgaccatgggtaacaacatgagaccccatctcatttttacttttgaacgttggccttacaatcaaatgtaagttatatatacatatatatatacacatatatatatatttgtactgatgagaatttataatctgctttaacaaaaataaatgttcgtggtagagcttttgcccatgaagggctgttcttatttgcaaatgggtttatagttctgtttttaatctctctttttacagctcatttctaacttgtaactataaaatcttttggggggattagtatatccttaaatttcagggtatgactgggatctgcagcaatagtatggtctacaccaagaagccagagactgttagccccagcccaggggtagagtggagctgtgggagtagagacagggtctcactatgtagccctggctggtcttgagctcagagatccacctacctctatctctcaaatgctgggctttaaggtgtgtgtgtcccaccatgcctgacagcactgctt

SEQ ID NO: 21314 - DNA, 1292 bp, Mus musculus
cttaagtcatcatgtacagccagacaccccatggtccccatcagtggctaacgcaactggcaggatcactccttggtagtactgcgactacatcaactcttgtaaccttgctttatgtagattttaagaaataatttctcatgtgtttaaagcagtagtcaatagtcctaagtatcgaccactgagattttgaaaaccttcaccctcatgatttacccagatgccctttgctttacagttatgagtagacacttaaagactgaatttggtacctatagataagtgagacagtatttcaagatatatttttgagaaaatctaaatgaaacagcttttaaagtgtatcatgtaagtgctgtggaggaaacagtgaggtgttttgggcaaatggcaatatgttgtagattgtcactataggtgtcttaacctcagacctgcaaagcaatagttaagtgtgaacagtataatttatcatgtaagaaaaatattctgaaacctgtaaaatggcatcagcaccagatgaagtctccagtgggtcaagatagaattattgactgattgtggagtagtcaggaaccgctgccaacctgtgcctaaagtctcagccagaggctgccgattcttgtccctgtctccacgtggttctccctgaaagtcaccacagtgaagggggcagagtcttttgtttctgtttttaattattatataagtagtcttggtttgagaacttataactatcatttcagtaaaaatgactcaatttctgtaagagtcacgctggtcagaagggaccactgctttgacaatcaactctaaatccatacaagaatgtctggttgtgggctggtgagacagctcagaggtaagagtacctgttgctcaggacctgagcttgcttcccagtaccatgaggaggctcacagccctctggacctccaggggctctgatgtccttttctggacctccaggggctctgatgtccttttctggacctccagggactctcatgtccttttctggcctcccacacacatgttgcacagacagacatggaggtgagacactaaatgcataatcaatttttaaaaagaatacctagtctaatacctttttagcttttctgatggggagaaactttaccctgactggcttaaacgttcaaaaccattggcatttctcttctgagcaacagtggtgagacttcttggtggtgcagaaggcctataagcttaggagacactgttgtggttgcttgtagtttacacaggcaagccctgttcccgctgatgct

SEQ ID NO: 21315 - DNA, 1703 bp, Mus musculus
cctccctccctcccctcccctcccccccccacacaaacattttcggctcctcatcacaaatattggaatgactttgatgcggctctgttcctggaattaaagccaaaatgcattcaatttgaaagtggaaggccagcctggtctacagagtgagttccagaacagccagggctacacagagaaaccctgtcttaaaaaacaaaaccaaaaaaaacggaaggaaggaaggaaagaaggaaggagggagggagggagggagggaggaaggaaggaaggaaggaaggaaggaaggaaggaaggaaggaaggagggagggaaggagggaaggaagaagggaaggaaggaaggaagaaaggaaggaaggaaggaaatggaaggctgggtacctgagagaattaaggctgtcctcgctgtccttgtcctcctcatcctccctgcccactctgatcagtcctgatgtcttcttttactggaaaaaaaaatgtagttgaggaaggtgggacttatgccattcagattggagatggaaccaacttggaatagatgttctctgtgatcatttgaacttctagtattataaataatggtagggtgcaggaacacccagtattttaatttttcaccgtcaatatgatattggtatattggagttgtacttcctatgtctcctgatcctgagctaatgaccatattatctagctaggccttggagggctttcctacctgtgcttacggcaccagagatgctcagtgtggcgctgtttacatttaggctgtatgactcactcttgtgggccgtgcactgtgtgcaggttagctgcagccctgtcctttactccctacatgccaggagctcctctccagttatggtaacaaaagatggctgcaagcgttgcccactgagccctggagcaggtgggacagccaaattctctagataggagccagtgtttcctgtcccagcattcctctgtgcaggctggtcagcttcagtctgtagtctgtgccactagcattattgtaagagaaggtgacattttaccatcatggctggacctgatcaggtctgttgcccttttatgcaatgctcagtttcatgttccccacacagccttagaagctcaggcctagaagctgaaacttctgcctgtaggatttcaacttgagtttcttgtcccctgctcatgttaggacaatggttgaccagttaatctacctctgtcactgtcaacaaaatctagcttttatgatagattttgttctgtctctaaagcttaatatttgtattacactttagaaaatgtatcaccctgcacagactcttttgcagggtgtgtcagtcattaagtctagactgtgttgtattgagttgctcgtgcccagaagttagctgatgcagatgtccagtgcaactgaccagaagggtgctgtccctcaccgctcagttacttggaatgcttcctggggctgacctaaatgtggctctggaatggaagtttctggttgaataggtgtttgttgttgaataggtgtttgtcaggggtctgaaaacgagggagcattggaaataaatctgtcattggctcagagttggtgacagagaaagcagggagtcttttacctgggtttttcttgaggtcaaaacaaacaaacaaacaaagcagttagccggcctagacagtttgcatgtaatcattcacttt

SEQ ID NO: 21316 - DNA, 1444 bp, Mus musculus
cctactacacggagaggaactgttcagaggccagaagatgcagagctctgcccgagagatcttttgacaaactcatgactagcattttatacctttgagtcccggaggctgctaaaggagcctcaagcaggtcctagagaggcctggcctgctctttggtgccagcttccttcttgcctgtcgagttctcagtagctgccagctgatcccaccgcaccccactcaatgttgatattcacagtcctccctccccccaatacggcatgctggagtttgctggattcttccctgggagggtgatgtctcctaactagattagacaggagccttcattctgtggcttgttgtcatttgggaactatttatttattttttttaatatttaagttttaacatcctcagggaccaggggcctcttgctttccagaggtccaagtgcatttatcccaaaataaggcacctttttggcatccccaagccctcccccagttccatggccctggggtcccttaccttgtggctcttggccgcaggaatgacagaaactgatcgggctgggaaggcggggagtgttatcagtcacaggaagccagcagatgtgggtgaggtcaaaggcaggtctctgtcctgccttttctgtactttcaaatgctcgagggagttggcaagaggccagaattctagttttggttatcagcctcgattctggcttgaagaaaccatatttggcttggaattactgaagggttggaatgttctagagtccccttcgctttccagttcagtaggggcctaaagccacttttctgatatcatcacttaattttagttgtacaaaagagagtcttaagtgaccgtgtgtctgactgtttagaatgttagtaaggagcggaaatagcctacagcccgttgggaattggaaatagagatggggttttgttttgaagctgtagactattgggtatttcttacattcatttacacattagtatggttctatgagagagctgcgggtggaaataacaaacctgtccccctagatacctagacagttaccttaaccttcagtttccccggtttgtttccttcataggcttctatcagctcgaagtcccgggattacaaaaatgtggtaccctctagaagcaggagggcaacaagtttaggatctcttctaaatcacttctataacgcgtgccttcacagctcagccccaaagtgccacttaggtttcccaaggttcttttctatttaaaccatatctggctcaggccccttggtggacaggtgatagcagccacatgagatccttcagccacatgagactcctctgctcagtggtaccaactaatccttagaaatcttaattaaaaacagcaaaaaagcaagaacttttctaagttcacagagaccagatgactatagccggggtgggggtgggggg

SEQ ID NO: 21317 - DNA, 1118 bp, Mus musculus
gtgtatatgtgtgcacatgtgtgcagatgtgcgtgcttgtgtgtgtgtgtgtgtgtgtgcgcgcctgtgatggccagaagagaatgttagatgtctttctcagttatgttccaccagcgtttttcagatgggatctctcacagaacccatctctcaatgcttcagtcacagactggctggtgagcgggccccagggatcccccagccgccacctccctagccttgagattacagatgtttgccaccacatctggcttttctatgtggattctggggatccaaactcatgtcctgatgttttcctgtcaacacttctgccaccaagctgttcccagctaagccatgcttgctttttgtgtaaaatctttttttctcttcaatagtgctcaattaacacgttcgcacccaggacgttaatttaaagccgtctctaacatcttcctgccatctagaagaattcatctttatatgccattttatttgctagatctgaagccatgacttcatggccacttgttaaaattgacctgaaaagccagtgggtgtgcctgtctgtgtgtgtctgtgtgcctgtgtctcttcgagtcttcccaagagcgtttctcttgacttctgctgggcagcaaagggctctagcaatcctgagtcacttttacttaatcagaaacagatgaggtgatttaagcattcttccatgtaaggacaagcctgtttgccacttgctgttattctgagccacagcttttattctggtagtttttggagctgtcaaactctgcctagccctcatgctgcgcccccccccccccccagttgcttctccaagtaataacgttcacctgcaggcacaaggcagctaagaggctgggcttgcccgtttgaccccacatccacctcaggtcttgggtctttaattctttgtcaagctgtttgttctgatatctccgggaatgtttttttccattcagttcagatttcctgtttattctgttgaagagctggcctgcatgcttgttctctataataggaaagagacagggcctttaagatcattgtgaggtaattgactcaagctcatcggatctctgaggtcttctctgtggtggggaaagtacgtt

SEQ ID NO: 21318 - DNA, 2088 bp, Mus musculus
ggggaggccccaagcacccttgaactctttccatgcagccaagaaacccccaaaccagacactgcccttgcaacccttccagctggcatttggccaccaggtgaaccgtcaggtcttccggcagggccctcagccctctaaccccaccgcctccttcccacctcagaagcagcagcagcaacagcaaccggcagccctgccccagatgcagctatttgagaactactaccccatgcatcaactgccttcgcaacagcaccaggactttggcctggcaccaggtgggccactgggacagacccacctggctcaccgcagcatggccccttaccccttttcccacaacccagatatgaacccagaactgcgcaaggctctcctgcaggaccctgcttcacagcccgtgctacctcagccccagatggccttcccacgtcgctcccgccgtctctccaaggagggaattctgccttccaactccctcgatggagctggcacccaacctgggcaggagcccgcgagcaatctgttccttcaccactggtctctgccgcagccaccgccaggcaccctggggcagccccattctgaagccctgggattcccgttagaactgagggagtcacagatgctggcggatggggacagactggcacccaatggtcgggagcgggagcctcccgccatgggtaatgaggaggtcatgagagcagggggcctcggggactgtggacagatgatacgaagtggggtgatccagagcacaaaacggagacgcagggtgtcccaggaggctaatttgctgaccctggcccagaaggcagtggagctggcctctatgcaggtgagaatgggcggcatctgctgcggtagtggggtgatgcgtataggtcaggttttattcagttatttaaaggaaatggaagctctttattcagagtacccctgcatgaggcacctgtacccgcagggacgctgaggttgccaagcacggtggttggtgggtaggaaagtccttgttggcttcttcccttggaacttgaggactcggagaagggggtgctgagagccagcattctaagaggcaagagtgtactggtagttgcacatgatgcttgtcaaaatgcattagctataatctagatgaggaagtcatgttgcaataaagttcttttttttttttttttttttaagtcagaagggaaggaagaccaatcagactttgagcacttgtgttaaccctgggttttaaattttattttatacttgctcaaaagtaactgatcatacgcaatagcaaaggtatgaatgtcacctgccccaggtttctgtaaggagctgagccacttaggataaacacctcccatttgatcagcattaactctctgcatccttagaatctgcaaccactgtcacctttaggccctggctgacacacaggaggctacataattttgagtctttgctccagccagatacctgtgagaaaatagctgcaaaccgctccccacccccactccttcatcttgccacagcgagatgcttggttacatgccgcaccccataggctagatgcaacatctgcaagccacctgtggactgatgaccacctggaatctgctgcttcaggccagggtggcacagccaggcagaagggagggggtggagaagatttgaaaggtataggaagagggatggcctaggaagtgccaggctgtcaaagaccaaccagtaagtggttgagttgctggcctgaatgggattcctaggtcagcaaacaggggctcaactcctgaacctcactgccaccccctctccccaatctccctcttacccaggatgccaatggctctgaggagaagcggaaaagcgtgttggccacaacttccaggtgtggcgtggagttttccgagcctgccttagccgccaagagagctcgggaggagagtgggatggtacccctcatcattcctgtgtctgttcccgtgaggactgtgggtccaactgaggtggcccaagtcggaggtgctgacgaggatgggactggtcttgagcagtaccccaccgagcacaagccgtcagtcatcg

SEQ ID NO: 21319 - DNA, 1170 bp, Mus musculus
attgtgtagacagtcatgtgggaaggaacagacctgggctgcactgtgccccagcctagtttatagtttaataggacaaggttctcagtttggcttttgctttcccttttccccgtttgacttggagcttaggcaacatgtcagccccacttggccccttggtctgtgtctttagagggttccgagttacacaaccaaatgcagcagacgagagtctagccaggaggtggtgggacaggaagagcgaggacacctgatcctgctgtcttgctggcagctgccccatgatccctggcccccatgagtgacttgaggcagggggacactggtgctcatatctaggggtcacgtggctaacactgtcactggtttttcctctgcaggctccaggacctggcacaggcaggcatcatgattagggaagtgtagctgagcgcaagagcctccctagaagaggaaggaccagcggacatttcctagctcttgcctgaaggctcctgcgttttcctctgcctctcttctgccctccctggctactggactggggccaggcttccagcaggacctcctaccaagggatgggcagcagctgaaggacgtctcactgccaggcttagtcggccacaccatgaacctccaggcccagtccaaggctcagagtaaacgcaagcgttgtccttttggggaccaggagccagccgccaaggaacagccaccaccactgcagagtccaccacagtccctcagagctaaggaggaacagtacggggcccacgaaggtcccacaggggtggcctccaccacccagcctgtggagctgtctcctcctaacaacctggctctcctgaacagtgtggtgtatggatctgagaggaccacggcagccatgttgtcccagcaggcccaagtaagctcggtaaagtggcccagctctgtgatggctccagggcggggcctggaacgtggcggaggtggaggcatcagtgacagtggctggcagcagcaacctggccagcccccaccccactccacgtggaatcacctgcccctctacggtggacccaaagggagccctcatccaggtgtgggggtacctccctactataaccacccggaggcactgaaggggaacaaacctggaggtccccagctggatcactatggaaacgc

SEQ ID NO: 21320 - DNA, 1099 bp, Mus musculus
gacagggtttggaggcttggggtgggtggagctacagagctctgggtgtgtcttgagcgggcaggttggagcttgctagaacaagggccaccagagtcggcccttggagagcagcttggatatgtccaggcatatctgggactccgttatcgaaggcatatgtgagctaaaaccaaattccagaacggtcaaagatctggagttcttttggtctgtggtcccactgaaataggacctcccggctggaggtttgccaaggtccaagaggaattgggaaaagaacgtgggttggggacctgcctggatgcttgtgagggatattcaggatagtttcatgtcttccaggtcaagcagtgctcattcacatgattagagtcggggtagcggtggagggcaggctgtcacatttccttggcacatggtggccattcataggtactctggttccatcttcacccttgttgacagttggcttagttctgatcactgctggtggctgaaaattaatttgctgcagaatctaagtagcaggtcgtcttcctgagctcaggacccgcccatctcagttccctaatttagagatcacgtgtttgccccacggtcgtcagctgcttggttcttttgaagcttgaaacacatttccatagaaacaatgctataaatggtttctgggtatctgggttcctaggctagcccacagagagccttggtatcgccccagaagctgccaacgtgaggcattagtaaaatcgagagcacgcctgcagcagtaagagactgtgtggggttagttaaatggcgtgggtttatttaggtaacttcattctttctgtgagaggtgtctttcaaagttgtcctgataaagttctggggtccttcagccccaacccttccccctcccttacctgtttgcatttcttgtcctcatctggatacctggggcttgagccaccttgcccctctgggaccttggcctaggctggctcctgatcttgtttaggaacacagcaatctttgtcatttaaaccgacctcctcagcctgacaggacaaacattacacaggcacagtttgcacggttcagacttctcacctgattg

SEQ ID NO: 21321 - DNA, 1193 bp, Mus musculus
aaatgaccttatttatgtatctttttttataccagaacaatactgttttgattaccacagtccaatttagaatagatctaaatttctttttagttgtatttctttactggtaaaagccaggtacatgttttccccaatttttgcagggggaaaaaaaaaagtctggagagatggctcagttgttaagagccctgactgctcttccagaagaccagggttcaattcccagcacctgcatagcagtttacaactgtctgtaactccagttccaggggacctgacatactcacacagatacaagcaaactagcagtacatgtgaaataaagataattaataaaaagaacagggtagagaaagagagacttgcatggtttcagttggtaaattaaccttgccttagtgagacctgtcttccctccagcgctgtaagatgaacgaggacactggcactgactacttggcaccgtggcagctggcgcaggtggctgatggtggaggaattggagttgtagaggagagcaagcaccagaagttgactaaaggcgattttgtgacttcgttttactggccctggcaaactaaggcaattctagatgggaatggccttgaaaaggtgaagtataatataaaactttatgattttttaaaaattaattctgcatctgtattattttgttagaaagggaatgacattttcttttaggtgatatgaaataataatgccaaatataaaaatataatgcgaataatacatataacagtgccaaaatgtggaaagcctttgtctttttttactttgtctttttttatcagacatcatctaagcacattatcatctcaaattgaatgtataatataaagctgaactataagcatacaaatatttaatactgggggctgaagagatggctcagcggttaagagcacttactattcttcttgcggtcctgagttcaattcccagcaaccacatggtggctcacaaccagctataatgggatccaatgccttcttttggtgtgtctgaagatagttacagtgtactcacatatataaattaaataatattaaaaatatttaatactaagaactagaaatcctccatatagttatatatgctaaagtttcctgagaaatagctaaatatatgaagaatgtgtttacttgatgattgaaagtcatctcatggct

SEQ ID NO: 21322 - DNA, 1286 bp, Mus musculus
atgagagactttaaaagtctttacccgaatgtttgtctgtacaccacatgcatgtctggtgcctacagtggagagtggctggagagggtattggggcattggatcccctggaactggagagagtctgaagccaccatgtgagtgctgggttctagaatgcagatcctctggtagagcaggagatgctcttagtgttggccacctctccagcctgtctgtacttaatggcataagtacataggatttcgggcagcattgggagtatttacagattgtggaacagtttggggtaggacgttttgggctgggagtggtctgagaagataaatgagtggttgggagtctccagagacaaggtttacatccagggatgatgtttgtgttctgccaaacaactaattgagtagcaagcctaacaacttactacgtgctgataaaagcttgtgtttattttaggaatttttttttaaagacaagagtctgttaggtagcttgctatgtaatccaggctggcctggaactcaaagatatccacttggctgtctgcctccgagtgccagtgttaaaggcctgtatccccattctgggcttatactttggagaactaatagatataaacatcactaagagtttcactgatgaaagtgagtcggagtggtcagggcagaacactgatcagtactctaggggctctgaggtcaatccccaatggtaccttcccacaacaagccccaagtaatcaagctccagaaagctataggattaagtaaattaaccaatggttatagacatgactattccagatatactgatgtatcacatttgttttcttaattttctcaacctttagaaaaataaaactggagatgttttctgagtatgacttatgaccactttttttttttacagtcaatatattttagaggcaaaacaaattagcagccactaaatcaaattttgcagcgttctaaccttgttttacatactttctctggaccccagtttttctttctgaacagttcttcatctcttcatatagtggtaactggtaaatctttgttttttaatcctttcttaaattttaggattttagctcctagtaaacatctccttgccaccccaagatttttgtcccagatactgtgtaggccagttgtccttgtcatggccatcctcaaatgggatcacagtcatgcttctcagtgcgcaggacaaactgtatcgaggaaatgttttctcccggaacattttgtaccaaaactatgactccctagctcatccagact

SEQ ID NO: 21323 - DNA, 1189 bp, Mus musculus
ggttgactttaggttattgtctctagaatgaccagtccctattcaaggcagctggagctgagatggtcttaccactcctgtactagaagcaatctcatgggccagcttagggtaggatagccagactcccagcacaggatgggacaggagtgttggggactccggctattcctttcctgtccagagatcccagtggcgttcatcttgcagatctcattctaactccagtgcctgttctttgcctaacttctctctctagttcatgcatccagaggctctgcttgaatacggctgttgctggcaccttttggttcagatagccacttagtcctgttggctctgtctggggtcccattctgtatggtttccctatgggggctgtgagtgggacaggctgagcagtttgatgactgcagtggttctaagacttagcagtgtcttgtctccacgcagattggtgctgatgggcacaagtcaggagtgaggcaagctgctgggatccagaatgtcagctggaagtacgaccagtctgctgtggtggccactctccacttatcagaggtaatctcttgagctgcccatcgggaccttgtcccgagcactcagtaccctttacaagaattgtcttttattctaggccacagaaaacaatgtagcctggcagagatttcttccctctgggcctattgctctgctcccggtaagtgatcctctggctagttagttcaaaggtagcttgccttagtcttaagaactttacttcttttcagcctgatttatcgggctctgttccaggaatgcactgcttccttcactcagtttccattgcttgaaaacacctgagttcagagagcaggttttcgttgctctcctttggctttcagaactgtccccaggctggcctgacactgccactgcctactgtgattacaggcgggcatgtgccaccacaccaggctgaggctcttcttttgacacagctctcggataccttgagctccttggtctggtccacatcacacgagcatgcagcagagctggtcagcatggatgaggaagaattcgtggatgccatcaactctgcctttgtgagtaccccttgtccagctgctggtgtgctgagggaaaaggccgtcaagcagctcctcttagcaagggcagagtctgagggcacagaggaaaatgcaaa

SEQ ID NO: 21324 - DNA, 1195 bp, Mus musculus
tccaggcctgggggatctgacgccgccttctggcctgagcatactgggcatgcgtgtggtgcacagacatgcatgtaacatgaaggcacaccagatataaggaaaggataaaacaatcaggaccggagagggggctcagcaaagagtgctggctgttttcgcagagttgggtccccagcacccatgctggttgctcacagcaggtacccgagaccctcctgacctcctcaggctcctgtattcatgtgtgcacaagccacagcaaacatgggggtcagaagacagcttccaagagctaatctctccctccacaggggagattgacctcgggccctgatgcttgtgtggcaagtgcttttccctgctgagccagtttgccagccctgctcttacagctgaaataagcagggctcctgggaggttctccatggggcttctgccctgtttctccttttgtcaccttggctgtttctttatgaagtcacctgtcctctctcttgcagcaccaagcatcactcacttcctttcctttctctctaggaacagattatggcctttgcgagcaaatgagtgcttctcttctggagaccgtgatgacaaagaacacctagccctggggccttcccaatgtggtttaataaatttacactagaacttgtgtctcttttcctcttctgattaaccggcctgtggtgccaaaatagtgacagctaaggaaaaacccaaaggaaaactatttaattaaaaggagctttttattactacacaaacaaaggaatctccaagatgttctccctcacttcacttggcaacagacctttctaaataaagtacttaaatgctggtcataaatttatataattatcttgacagagtaagaattagaaatacctgatacatttttgttagactgttgttttaaaattaacactggcatgccagttaaatacaaattgctttgacaaagtacactggatttaagggggacacgaagataaataacagccagatcttattagtactgctatttctccttccttatcacggctccacagttcagttttatttatggctcctctctgggataccattctctgtccagtaataaaacaatacacgatctcatcgcacgcacagctgcagaggcctcagcaaccagtcagaaggggctcagctgctgcacaggtcctccttg

SEQ ID NO: 21325 - DNA, 1189 bp, Mus musculus
ggtggaaaatcggaagcacgagtgtcaggttgtgattcacacctcctgaaataggagtctatccataagctaggcctgaggcctccctaagtgtctgtgggccagccgtgacccgaaatcctgcagagggggagagcctcagctcctctactgtggccggcccgtcacttatccaagaggtggcatggcgacaggtcctcgaagtggtaaaattcatcagggtgctaacacaatcacagagtcttgactccagttggaaggcacaattacgtgttcttccttggcctagttggtagtaagctagatgggcttcttagggaatcctcacgcttgtgtttttgtaagaaaatagcaactccatgtcgagttccttctctggtttcccaggaaaaaggaatgagtgctgctagtgttttacctcgggaagtgaactagagtgacttacagaacgtaggggaggtgaactaagacgtacagaaagcagccaagtgtgatcatttgttttactgcccccatggaacccagatttttgtatcttttctctaggtagaggagatcttcaagaattcacctttcctggtcccagatggcagcgttagcatcatggatgggtcctatgaaggtggggcagatgatgagatacacacttgttgggaaagagatggagtcagtgcaagatccagttaaagggactgggggtggggatgcatcatgagaggaaggggcgcaaagtaaataagcggggagaccgcgagagacgtgagccccagagagaagtagaacagaagaagggatctggagtgtaaaccttctttttctctcctgtaggcatactagcctgggttaccgtgaactttctaacaggtaaaacaacccttgaagtttctcttacaaccttaactggcttttacaggtagaccaggagggtaaaaaaaaatccacttctcttttcctgtactgttctttgattgagagaagggggtggggccagagaaatggcgagcagttcagtctattccttgtcagttcccagcaccactcgggtggcttacagctgcctgtgactcgggctccagggccttagctctgtgcagccacactcggctgtatagacccatacacatacccagaattaaaactggaaaaaaccccttctttaaaaaagaagaggggagagagacaagctaat

SEQ ID NO: 21326 - DNA, 1286 bp, Mus musculus
actaacatgtaacctagttttacatatcttagcattgtgacgactgctctctgctcaatgccactttcttctgcgtgattcatggccactgtttaattctatcattgtccatgttcttgtgtcttaaaatacttctcaaggatacctcaggatgaagtgataagttagcttttagttacatgtgccattcttcatggtttgcctcgacaaccattaaatcaatactccagccattaatgcagatacaaatagatccttagataaaatctttccacaaatgattttgacccagaaatcaaaggatctcccatcatgaaagtgaatacactcttgccttaagtaggcttaacctattatttgccaaattttgttattcttcttttggcagtatttctcattagttgatactttttaatgaaagaactcttcatatggaataattgattaggctactagaaacatcaaagtttcatgctttgacagtatccagtcaccttattcaacttaaccagttattcagctgcctttaagcttgcttctctgataatctaaaccttcagtcagaagagactgatgtgctgaacagaacagtgtgtctgtctgacctgtctgaagcctgactttctaaactagatggctatggactctgcttaatctttagtgcttagtgaggtgtggcgctgtcattactgtgctctgttctgtatagccatgtgtggacagtgctgctccagtccattgtgggtttagtgagttaaaataaaaggtggtaaaaaaaacctggacattccctactctttggagctaagattattaaagtaaccagccctggcagaattcagagcttcagtcactttaacaaaacacaactctgattttcttttgttttccatcctaaagctaagtagacatttatactttgtgactgcaatgcattttgttttcttataaaacacagttcacattaatttaatccaacaattttgggctgggttgaaaagtggttattatctaaatccaagtagaatttaatcacagactcctaatattttccttagatataaaggaagttactttaaaaaaattacaactaatccaaattgtgttatttataatcataatcaacagatttgaccagctacttgtgctcaaaagggtttcttgtttcttagatgaaatttatatttggttgcatttgggttaatatcattaaatgagaaaaccagcattttccctttttgtccttatatgtctttgctgaattttgtgagcttctatactgatta

SEQ ID NO: 21327 - DNA, 1153 bp, Mus musculus
ctgaggttaaaaagtaaatgctagggtttttttccaactttggcacgttcttgcagaagtacaagtctgggagagaaaggagtgtaaaactgttaggtcaagggcaagagatgatttggttggtgtcttttgtggcacacacccttgtcattccagcactgtagaaggaaggaagactgcaagacagctgtctcagtaataacccaaagtgggctggagaaatgcctccgctgttgagagcacttgctgttcttggggaggaccaagttcccagcacccacatacatggcaactcacctgtaacttgaattccagaggatctgatgttctcctggcaccagttgtggacatgcacacacatacacacatgcaaacattgtagacaataaatacacttttaaaaacataaagaagcatctttattgttttttgaggtttgttgttgttgttgttgtttttctagacaggaattctctatgtagctctggctgtcctggaactcactctgtagagaggctggtcttgaactcacagatctgcctgcctctgcctctcaaatgctggattaaagccatgtgcatctttgcaaatgttggccaatttgccaagttttatgttttgggctgtcttgcttgtagttggagaattaaatgctcagtattaactatacagtagaagcagagcccctgagaatgcctgtcagtctggagtagaactgcagtcattggttggagagataaaacagggaaggtttgtcagattcattttaaacagtagttccaatagagttgatggacgttgatcccttcctaggctttaaatttaggaatgattgtgttcatggggaaataaaagggcatattctggtttttggttgtttttttttaatgtttagttattgataagctggagattccaacctaacagtatttcctggcttagataaaatattaattcctttgttttgtctgctggcttgtgttgaaaatataatctgagaagaaatgacattgcatgagactttataaaagaatacaaagtactttgctgtgggtactagagaaataatgacattgacatatataaatgaaaagtatctccaaccattacatctaaattaatagtttgttaaaaggtacatttttatatagct

SEQ ID NO: 21328 - DNA, 1128 bp, Mus musculus
agagtggaaaagttctgatgggggacattgcatggcctttcaaacttaaagcctttaaacccattctctcgatacctcaaagtttccttttatctaaactgattttgttttgtctatgactgttttcctgtccttgatgttaaacattggggtggtatatagctcgtagtttaataatgataattactgtttattcttgtctaggccttcagtcaattcatgagtaacaggtatagtgttttcttgggcttctctagttgttggagggctccaagcctctgctgtttaaaatagtcaacaccagccacatgtatgtgtctgttcaaagtaattaataaactttagaatccccagccgcactagcagacgctcagtagctacatgtaactaactagtcaactattactggacagcaccactttgaaggttaacaactgctctacgatgatctttgctttctctatgagctaagaatggcttttacatttttgtaaggggttggggacagagaaggttgcaaaacacaaagtgagtctgacctcaaagcgtaacatatttaatgttttatgctttataggaaaatgtactgaaccttggacctccctgatcttttttgtccgcgggccccaaactcagctttctgactaagttaggttaagagctaccctgtgccgttagaatagtgtgagtctattaaggagggctatagacagaattcagagcagagttcttaggacgagtgatggaggagtgactatagagtgagacagaggacaagtgtgtttcctggttctagcaacttggatgagcatttaaaatagataagatggaattacccactgcttaagcgttgtgaatacacagctctagtttagcaggatcccattctgattctgtacactatttgtgtctcctaactactaaattcttctgtcttactctgacaggaatgtacttctacatgattttattttatttttagtgctggggctcagtgctatccttctgctcctaacttatgttggtcatttagggaagaacaaagtaaaaagttgtcaatagtcttcccaacatctgagagatatgtgtgactctaacaatttttcattaaatggaaggctcacaaat

SEQ ID NO: 21329 - DNA, 1166 bp, Mus musculus
catatcttttttacttagaaaatcctttatgctgtaggtaatgctggttttcacaggtagcttctacttaatgtgtgtactcaacattaattaacatactctttactttcccgagcactaatggaaatactagattataaccactctaatactctgtggacattccaccagacactttgcttaatgtgatttaaggcagtgtgtaatcactccttgcagtctttgggccagtcttcaattcatgagactcatatatcctgtctagttttaattaattttgcaaggaagatgccaggagagacagtgttaaatacttccatagaaccaggttatttcgtccactgggttcttgtcagccactaatcttgtagctttatcataacagaatatagaagagtttctgctatagtttctagtcttgtgcttcagtttacatgtgctggagtagccttatacttaagatagtggtactcagaatagatatttgagaatttcttagagtaattgctagttttgtttgtttgggcttgggtggtttgctttgctttgttttgcattaggacttggggaccagctataattgatatcaagtgctccacagtgtcattggtaggacaaacgtaatatataacaattgaagaacacgtaaatggttataaactaaaagaagacaggagcagaagagtccagtataccccctgccccctggggggaaaaaaaaagacaactcaatgtgactaaggagctgggagactcctcttttattaatatttttgttttgatgtcttccagttactatcaggttttttggtttgtgtttgttcgtttttgaatttgttataacctgtccttgaaaggtggggagacagttcatttggtaaagtgttggcttgcaagcacaagaagctgagttcaatccccataacccacattaaaacaaaacaaaacgaagtatgatggcaaccccttgtgatcccagcactggggaaaggagacgggagggtgccatgcctaggatttgctggccaattgctctagccaaattggtaagtttggattcagtgagcaacctggcctcaaaaaataaaatagttgagccagtgtgatatgtcagctcatgtgtatggcgcacttacatttatacggtcaaagagtcatttatttgt

SEQ ID NO: 21330 - DNA, 1126 bp, Mus musculus
aaggtaacagaaggaactctgggtagtctgttatatttgtaagtaaaaaagtgggcaggcacggttgtgagagtccccacatgactgaagacaaggaagcctgattgactggtgtgctagccagtggtagtggcatttgtcccctccttcctcctctcagccgcttatcagatgctttgcttatgtgataagaacacaccccatgaaagtgtcttggcttaactacaactctcgcctattttttttttttttccaaattgcatatgtctgctaaattctgaaaatcttgcccctgggtaaaatcgattagacctagtctctcacattttgaagagtacagcaggttccttgaacattgtagaaagaaaagctctgtggccatcgtccactgggagtgtggacacaggaaaagtgtggtcaagtttgtggtcttgtctctgttagggcacagtactcttggggtccacagcaggtcccttgactgtttttgacatttgtgtttaatgctagaattgatgttggattttccccctcattaatggttctgatcaacacaattttactttttgaaaggaaaaggcagtgaaatatataccataaaatatgaatatgagaagaaatatattctgctggggtactccctacaagggccaattggttttaaatttaattctataattgacattttttaatctcactgaatgcagttaaagtgagtgtgtactcatggtgggaacaatgccataatgtcagttgtccttcttcactctgtttttgagagttgatgacatcaggcacttttcagagtttggggaaattgaaaagtctgtggagaatactgagctagctcccccaaactaaagcaagtctataataggaagccaggagttggtgttttgatctgctacacctcctcctcctatcatcctattcaccagcacttaattaatgtaagtagatgttttagacttgtgctatttattgtttttgtattgtcatccttagaaatgttaatagtgtatttttatattgataatataaactaatgtatagtatgtatatgtattttataatgttagagaatactttgtgtataatgttgtgtctctataataaatatgtccct

SEQ ID NO: 21331 - DNA, 1157 bp, Mus musculus
ctcttactgcttactctgttgtcttcctcttacccctcactctcaccctctctctcccctctctttgtcttctctcctctcctctctccctcttactctctctagccttctccccacctctctcttttctaccttctctctttccccctgcatttctataataaagctctaaaaccatagagagtctctgctcatcaagatccgctgcgcactctggtcagtgttgggaacctctttcctcttccctctttcccataaccccagggctttagcaaggtagctctggggctccccaggtagggttgccccttggccaccccctgaagaatgggatagaggaatgcccacccagggatgagtggaaagggtaggtggcaaccctcccaagcctgactgagcagagtataggtggaactctggtgaggtgtgggcctttccccttccccctcctcccctgggcccccccttttttgtcccaacagaggatgaccttgacctcctgaccatcctgcctccaacccagtgctatgattacagtcacggaacctggtctctgtggtgctggggactgaacccgggcttgtgcggattaggcaagccttctgccaactgagtaccgtttccaacccaaggctttaaactctatctctggtctcagcctccaagtgcctggcttgtagccatgcccattgtctgctttccaggtttattacgggtctttgcggccatgtggcagcatccgtcacagtcacagtcaccagcctctttcccctcctctgactggaagcgatgaatttggaattgttgcagccattagcctacattccactcagcatttgtgtgagcatgcgtgtgtccgtgtgtctgtgtgtgtgtgctcgagtgtgtctgtgtaaaggttaattcattttgagataggatttattttattttatttttagtgtttgtttggttagtttttgagacaaggtttctctgggtagccctggctatcctggaacttgctctgtagaccaggctggcctcaaactcaaagatctgcctgcctctgcctcccaagtgctgggactaaaccatcaaccactactgcctgacctttcaaaaaattattattattataaacaaataatatataaaagtttcagtcactatatagc

SEQ ID NO: 21332 - DNA, 2126 bp, Mus musculus
gctgttcttacagaagacccagggttcaattcccagccccaagaggcagctcacaaccatctccagtgccagggagcttggttcccttctctgccctctgtgggtatcagggacacaagtggggcacatacacacacattcagacaaatgttcatacacataaaaaatgtttttgtttttttttttaatgtaagcaggaaagaagggggaaagaaatagcacacttagaagactacgttcataaactggactaggttggaggataccgttgactaacagggctcactcttctgagcttaagatcacaggtagtgggctaccctaatctggcttcaaggtgatagataggacttaaaaagaaccggaattgaaagtgcacgcttaagccaattatggataaaaatcaaggttccagtttcattttttccaattctttttctcttttccagataaaactggtggtggaatggaaacttgaagatgacaaaaagaataatctcttctgctgggagatcccagttcagatcacaagctaggctccttggcgcctgtgtctgtgtgggctgagaggccatggacggagtgggggggaagaaacagaaatcagacccgaaatggaatcagtgccatatgatgaacagaatttcaagaatgctgttttatgccttttaacctccaaagcagtaactgcaagcctactactcttgagagcgcgctcagagccattgtcccccgagatagcctctggggaggcttcgggagggaaaggggaaactggaaagattagattggtgtccatggctgtttgctgttggattacaggcaggttccaccagacaggatgggacggggttgcttagggatgtcagataacttgacccagggctatggatccactgtgaaggatggcttcccagagtcttctggctgcctgggggtgttacctcccctgtttctaagtgcctcctgagtccccagcccctggcttatcagtcagatgagtctccttggtagcctctgccccatcgcttcagcagtagcgactagctctcctcggtatccagactggctgaggggcagtctgccgcagaaatttgtctctgagtggctgtgtctttgtggttagctctcgttctttggtagttttcattaaagccaatacttggttgcaggtgcttggttttgttttttaacggtatttgtctgtatcctctctctgcatgtaagattgagcctccccataaattctaacttgccactcctgcgtgtgtgttcagtctgtggttgcctacttcttccagatggcagcctcctaggtccatagcaggcagccacccagttccgaagctctagagaagatgtgactcacaggactcacgggcaccgcctctttcctcgtttttatttataccagctagactttatccatagaaagtggccttgttctgcattgctgtcagtgtgcctgaagcagcaaccaccacctagcaccacttgaggaggcgtggtgacggggacactacgcgccctcatggggaagcctagaaaggagagggaggaagaggctgtggctctatggaggcaggagggatgtgagttccaggccagtccgagtggcagcatagtgagatccatttaaataaagaagtaggcccaagccgacaaggggcagaagggtcgtgagttccacaccagcctggacttaaccactctgccgtcccacccttccctgactcaatttcagttctagaaggcaacagaggcatgaagactgctgcaagttggagaccaaccccgtctacaaaatgagctcaaggccagcctgagctaaaggagacctagtctcagatggggagagagaacatcatagcagataacagttccctttactatatctcaagatgactgacaggtatggtcatggatcatagtttttggtagggaatgcacacgctgtttttgagatgaggtctgacgtatctcaggctggctttgaactagccatgtatcggagaaccttgactttctgagcctcctgcttctacctcaagtgctgagattgccagtgtaggcccccattcataaaatccgaatagcataggactggaggcttgcgggtttttttt

SEQ ID NO: 21333 - DNA, 1264 bp, Mus musculus
gagatttgatgccttcttctggtgtgtctggggagagcaacggtatactcacataaaataaatgaataaataagtgtttaaaatatatatatacaccaaggttccaccctaagaaaaaggctggactagtttcagtccgagcccttaaataatccttctgtttttttttacgttgaatctttctgcttcagtccgttccgtcccagctagaagtcctaagcagtgttccatgcattggagaacaagatgtacacctctgggctcagggtgttgtgtgggtgtttgtggtatttgtcattcatgctttcctcttgtcttttcagggtatttgaacagggtggggcaagagtggtggttgactctgatagcttggccttcgttaagggagcccaggtggacttcagccaagaactgatccgaagctcattccaagtgttgaataaccctcaagcccagcaaggctgctcctgtgggtcatccttctctgtcaaagtctgacacaatgacggatgaccctgagattgccaccactgcaccagtgtgaacaacctagaatagtagaattctagaggtttctttctcatcatgtccggctctcatcttatttaatttaatccagaagtgtcttattctaccactgtaaattatggaatgtgaagcttttaactcttggccgaaatactctcccctcccccagtacaatgtcaaggccacatccaaaggctgttacctcacctgtaatcactggttggaacccagtataatttgtagcacctctaggactccaaaatttggagttaacctctctagccttcagaattgtttatatatctgtgtatagctatatataaaacatcattataaactaagttcttatcgtgttttcaatcaggatccagtttgggtagcttgaataccagaattgaggccaaaattggttagaaaggcaaacaagatattctctgctgtctctctctttcttcttccttccttccttccttttttccttccttctttcttttttctttcaacagggtcttataggtagctccagttttggactctcaattctcctgcctcagcctcttcatgctggaactgcagacatattactactaggcctgggttgttgtttcttctacttctactacctctactactacttcttcctcctcctcctccccctctttctcctcctccccccctcctcctcctcttcctccccctcctccttcccccctcctcctcttcctccccctcctcc

SEQ ID NO: 21334 - DNA, 1170 bp, Mus musculus
ggtctgacaagcttgtgattctcagtgatagtgaagtgctactgggtatataacgatcaggtgtataaggtaggactgaaaattactcaatggtaaattatccccaaacttgaggactgagctagtatttcagactcagtaggaaatctcttttttttgagtcacggtcgctatgtagtccagtccaggctagcctagaactcacagagattctcccacctctccttcctgaatgctgggattaaagtcatgcatcgtcatgtgcttggctgcagaggcatttgaggatgagtccgttaatttttcagaacccaaacgtgacagttttggtttgtctcttgaagatgagtttagacagagagcccaggcattgggccaccagagcttcctgcctgcctcacgtttactccatgcaggatgtgacagatgagcaaacactttatgccttggtttacctactagtcactgggatttggagttgatggagagaaggccctactccagggtagagaatttctaagaggtgcagggagtggtcatggctttaaaatctacatggaggagcttttgtagagctatgagctaataacctagggaaagaggctgccaagtttggaatgatccctcataaagaacacaggatacccttgaggaggtaactgaggggtacgagtcctaaaattatttttatctctacgttggaaaacccttagtcacatgcaaatgggataattacaatgaggtcagacacagtcctctgatgtttatctggtaactgtgtctgcagagaaagactcatttgaataaatgtcttgtctatactttccttatatgaaacagcaccggttagtaaaggccaaattcctggagcacacttcactgaaaagcatacaatttcaagagtggcagaagaagggaaacaccggtcccctgacctaccagtgacaccatggttctgttaaagctatcagcagggtcagtttttgtggtgaggggatcttgcacccccccaggatgaattcatcttgacaaacccccgcttttctcctgcactgtttgttggtttgtcagaggtggagtctgaagctttctatcctctccaggctgagtgctccctctctctagaactcccactcagagaagctgccagggcattcctctgcccatgag

SEQ ID NO: 21335 - DNA, 2827 bp, Mus musculus
gaggtgcacaggatgctacagctggccatcagtgagggttgcgagggctttggcatgctctgaccgctcctctgtcacctgcttggctcccaagctctctagagcatctggacacatgttaacaagcatagccactgaccttaaccacaaccattagccagaagatactgcatgctcccttgtgtctggagtattctgtcatctgcaagccctgttcttacctcacctgtccacgttcaccacaggccacttgagcacgtggcacctatctgagctctactcagtcatgagaggaggaccatgctgctgtcacttcgttggtcccttgaagatctctgtgaccggatctgcctccgtggctgggagacattcataacacagaggactcagttctgttggaaagccagcatgtgagacccttccaccatgcctcattccagccctccttgagctcactacttgaccagactgggtaatgcatcacctcttctcatcagtggtcaggagaagtgcagctagaaagtggcccacacaagccgtctgatttgtcctcccacataatggcaggcacaggccatggcactggattagttctcatggggactggtagtacaaaaggatgtctttaaggtgacagaactggaaaagatactccctgtgggcatttttaaagatgatcattaatctataaggaatttgctaagctttctcttgaatttgagccagtgagaaaagcagtcagaagaatgtgaaggatgtctgcgctgcagcctccagtgctgggtacgcttctctcgtggggaagggccgtgtccaggcatgtggatggcttgaagactactgatgctttcctctgaattgttctttgcactgaaggaggacttggactgacctccgacttacatagtttgttaagagctgtctttagcattctgctggaagaattttgggagcaacagactgggacagagcctgccagctgtggtggtgatctttggcagtgctaaggcaaaggagcggtgaagccactggggacagacaaggtggagacccagcagcagtaaatacctagcaattccaaggacttggtttcatcagttaccaggaagtgggggaaccatggagggagaacgctatattgggttcacagttacatggtgatcaaagagaacttctcagtctccaggaagatagcatcttttcatgagtgtttgaatgaaaacaacacgaaggctcaatatcacatggatttcccagtttctgtctttaataaggctttcctacaagccactattttccatggggcactcactcagaatattacaagccattttattgccaaaaccagcaagtacaccgaatcctgagacaaggcagttcttgtgacagtgccttggcctcctggaagcagtctgagccctcctgttcccaggatcacgagaaacaagctctcctgagctgctagaaccctgcctgacctcctttgcagtcatcatctgtcttttcttggcgtgggtgctcacctcacttatcctcggggtttgggacctggcatcaggacctctccacccaggatcctccatgccacatggtcactgctctcctcagggactgggacaaggtgctgccgcctgcccacagttttcccaaggaacacgtacaagatcatttagccactactctgctgcctctcagcctctgctggggcttccagctgggtacatggctgcttggccgtttggggcggttcttcctcctaggttctgcaatccaggctccagcacccctctgcagactacacagggggtcagtgtgtgtgtgtgactagacctctcattttaagctctagtcgtagcactttttcagagtctcctaggcgctgttgcagcccagctggggcagctagcatgccaggttggtctttaggcaccagagtctttaacaaaaaaatcctctagtactgtgtggttttctattcttccagttcactctcctgactgttcagaagcattttgctctcttttgcattttcttttaccttttttttctaatactgctttggtactagccagtgtggggaagagatacagtatgttggacagataaaaacatgtgttatttcttggtcaattttctattcatattccttattttggccagttcttttgtttgtgctttgtaacataggtacttgggagaccagctgccctcctggcttttggctttttggtgtccttgaaggagaccagtcatgagtaccaaggaatttgtcagcttggttctagaacttagcagaggttgagctctgctgcacattggcagaccaggtcaggatgtctgcagttggagatgtaaatattttgtacagtaaataaaatgcctacaataataaagagctaaatgagtgtttgagtggggggtgggacaatgcttacatggaagatggaaaggaaaccgtttagagatgctttatgtgttcttggaagcaggaagcaatctgctgtgaacagagtgtgtacttggcgccctggcttgtctccaatacctgtcctaagggtcacactgctcactgtagatagcaatccagtggggaaagtgtttgttctcagagcctgaggaaggaaactagtttgatatgaacaatatctattatgtctttttgtttttgttttttgtttttttcgagacagggtttctctgtgtagtcctggctgtcctggaactcactctgtagaccagactggcctggaactcagaaatccacctgcctttgcctcccgaatgctgggattaaaggcatgtgccactactgcccagcttatctatt

SEQ ID NO: 21336 - DNA, 1151 bp, Mus musculus
tgtaccatggcacaatatttacaatgcttttaacatttcagtagttcagtcttgctgccgattggttgaagtatgttagataatgctgccatgatttctacatctagacctgaagtcttccaagcactgctgccttaacgtttggtttttgataggtgacatgggatttgctaatgaccgagagtcactgttaaaaacaaagtctaaggcaagagtgccttgaataatcttacatggagaattttcttttcctgctttactgtcttgagtaatatcttttgttttacttgtagatttgatggtcctcgaagatttgaggatttagggtcaaggtgtgaaggaccgagacccaaagggcctcgttttgaaggaaatcgccccgatgggccaagacccagatatgaaagtcacccagcagagggcactaaaagcaaatggggaacgatccctcggggcccagcatctcaattttatataactcccaatacatccctaagtcctcgacagagtggaccacagtggaaaggccccaaagcaactgttggacagcagcatcagcagcagcctaagcagcaacctaagtcacaagcagaacctctttcaggaaacaaagagccattagcagatacaagtaataaccaacagaagaatttaaaaattcagtcagctgcgttttccatttccgcagatgtcaaggataccaaggcagctcagtcaaatgagaatctaagtgactctcaacaagagccaaccaaaagccaagtctcggaagggcccgtagagccctctaattggaaccagaattctcaaagtatggagactgaaatggacaaagcagaaggtgttactcagcctgtatcccttgcaaacaaacctgtacctactcaatctactttcccctcaaaagtagggagcatggagggaggagccgcagcagcagcactgactgcagacgatttcaaacctttgggtgttggtttgtcccactcagaaaaccaccaagaaaaagatcttcctcagccagacagcagagaaaatagattagaaggcaataaaggcagcagctcatcatatagaggtcctgggcagaacagagtggaagagtcacgggataaaggactagtaaacagaggtcgtggccagataattaa

SEQ ID NO: 21337 - DNA, 1137 bp, Mus musculus
ccctttcattattctggatgctatcaatgacagagttagacattttgatcagttttggagtgcagcgaaaaccaagggttttgaggtatagtcttaactttgaagcacttttagtgtgaatttgtatttcttggcctaattgttacacatttttatttaggtgtatttggctgaaatgagtgctgataaccagacttgtggcaagagaaatattcatggaagaaagcttaaagaaataaacaaggtgatttttagaaacatggtatgctggagaatcccagacatcattctttcagcactagtaatgctgtcttaagtcgctcagaaatctttctgcctgctttaataaatgttctcctttctgtcttataagtggaaagggatgcctagctcttcttaaagctagtctgttaaagttatagcattagttgtgtttctcttgacactctccttagtctttattggagtagttgtcagagttaacttgttctgaacatctcaatagatggctgaacactgggaagttgcacctcgtcacatgatgcgtctagacatccgctccctgctacaagatgctgcgattgaagaagtgagtatactctgcctcagggcagtgcagataagcaacaccttcttcactgtgaaaatctgaaacttccagaaaagttacatgagcacttacatacctttaaataatctcaaccaattcaggtgttaatatttccacacattttaataaacaccttataaatacttagtaacattatttcataccattactatacaatcatatgagaattgtgttgaaaaacctcataacccatcagtccggaatatgttgttgatggctatcttctaagaacaaggacattctctaataaatccatttaattataaaatttaaggtaagcattagctgggctaatggcacacacttttagtcccccaaaggctgacagatctgagtgagttcaaggccagcctggtctacaaaatgagttctaggacagccagggcttatagacctgtctcaaaaaaacaaaaaggaaaaaaaaaagtttacattgatatgatactataaattaaattcttttgtgtttttatttacttaaccttctcttcccacaccccctaggc

SEQ ID NO: 21338 - DNA, 1157 bp, Mus musculus
agtgagccaacactttcttaaatgcttatgcaatcctttttaaaaaatgattattggcatattgtaggtagagatggaagattttgatgctaacattgaagaccagaaggaagaaaagaaagatgcagaagaagaggaaagcgaactggtaggagacagaccaaccactttgagcaaagtgtctctttgttattcttaaggagtgttatattcagatctgtagtttgattattggtgttaatacacactctttacagtaaagcttccgtcctcatcctcctggaggctatgtacgctctttatttttccctagtccaagaaaaaaatgttgttagggaaattttaagagtactaagaaactcatctttgtactcatctatctgtgggtggttgtaagggagtagacttttcaagaaagtaattacatatgaaagggcttttttccattccagcaggtatgtggtatagcctacccaacatatgcatactcttacctctttgctgtaagatctcaaaactgagttctgttaccttgaggcagaagaacttactgaatgaagagccaaagggctgtcactggctgctggatttgttcttgttctctcttgttaaatgatggcaaaaatgactgtgtaggcaatggatttttacccaggctgctgagatacttaatgatgtgagtttaaagttctgtgtacctcctgtaagtgcattgattacacctctgtggagatgtttcccttactctgtcactcaagaagtaaaacctataaaattactgatgcttcagtgttggctaatgaggtacatagattaacaatgcctttggatggtattgcctttaaaatccacagtattgcttggtttatttgacatttcagctcttgctaaagttgcttctccttacttctcttaatgaaaatgtacacaccgagatccctgattcctattccctaaagcatagtctacaaggagtggtctctttaaagccatgtatgacattgaagattcgtggtagaaattgtgtttatatagcattggtgtcgacctctacattcctagatgtcttaaaatgtggattaaaagctaagctttaaaggtaatgataattgagtctcagtatgttttttaatagtctcatttttcttaatcaggtt

SEQ ID NO: 21339 - DNA, 1198 bp, Mus musculus
gatagaccagaggatgttcaagttgcagagtcttctcagaggcaagcccagcgctgaatctgaaagacaggccacagcccacacggagccgctttctaaataccaaggaaaccacagtcggtgaaactaatcttaagggcagacactgttgtgttgttgtatcttggtgcccagcccagtccccctcccccacacataatgggcattagtaactgtttcatgagcaagtagaaagaactgctaactcagaggaaagagtgagtctgctgactttgcataagccgggaagaatattggacttagctcctgcgtataattagtaccgtttggaatggtagtattcattgtgatctttagattatctgtcactgaaatctgtgactcatagaactaaaaggatctccttaaaagggctcaaccatcttaagggacaggatggcgctgattcttctaggctggtattttgtgatagagtactttattacattgactactagagaatgtttcaaagcttgaacttagatgcttcaggccaagggaaagcccatccatttgtatacatgggtgaaaacttgtgaaagtccaaactagggctttagctgttctggtgggtagtacaggcctgccatcccagctcgttgggagattgaagcagaggaagtgcaagtttaaggctagatcatgcaatttcagtacacctagtctctagactttaaaagggtgggatgcatcagtagcccccagccccttagcactggctcagctttaactgtatcctcagccaatcagatgttgaagaccatgggggtcctcttgtttaatttgtccttgtgtatctattaaaccttgatcagggtttctagaatggctgcagtagattttgaaaacagacttaccgttattgatttggggttccccagagatccagttcacagttgttggactctaatacaactgaccattgaaaagcgaacaacggcttattgttttgtaaccgtgtcaggtgagccctgacatttcaattgaaacatgaattgtcattataactcaatgcaaattcaacagttgttgaattattttaacaaataacagttggagttaaattattttaacaaaaaatttatttaatgaaaaaaaaaagggtaggatgcaggggtgggttggggagcacggctcaggagtaaagccgttgccagcg

SEQ ID NO: 21340 - DNA, 2180 bp, Mus musculus
gaaagtagctcctacaggcagccacaactgcagaacaaacctctgtgggtaacagtagctgtagagcacagtgtagcttacttgtgtcaaggcggttttgagtggcctgtttccttgtttaaactttggttctaaatctcagagctttgctcaaaagaaaataaacctaagttatccagaggcagcagtgggaggaaaggttttgcaactagaaccattgggtgggctttgctttctcacatttccctcagcagggctttgtctctgatctgctggatacagatctgttgacctctcctctctgcaggtggaagttcgacctatgatgtatgtagccctgacctatgaccaccggctgattgatggcagagaggctgtgactttcctccgaaaaatcaaggcagcagtagaagatccaagagtcctcctcctagacctttaggaggaagccacacatcctacctatcgatcatgcaggaactgaaaaccactcttctccctgtaccctcatcaatcccaggttagcctgatgacaggcaggcacatactattggcctcaagcacggaagccagggcacgatgtaaccagcgttcacaagtctgttcttagtgttccctcgaggctctttctctctccctgagactcttatcttctgctatcttggacctgagagagagtgagagccttaatggatgctcattaatgttcctgcctttattccagtcctctacaaaggcaattttgcttttctccagtaacagtatgctatagggataccaccagggaccatgtgatttgagtttctatcttaggaaagtgttctccagagatgcctaggggatgctttgcctccatcccagctgtgcacactctgacttgatgccacctgtgtggaggtattgaacacaggcaaagaggtgctgctttgcttcttaaatgcaccatcattctgacctgtcagtggcttcaaggtgctctacctcttccagaaagcacaggctggggtatttggggacaggcaggattgtgcagcatcccctgagcttacctgttatagtcacaggtgggagttgaaccctggcttgccctctctggctccattgtatgctggcactgggaagattcattttggcataattacgtacaactgtcgtcataccaaccctttccagcttctaggaatcgttctaggacactgttgtcacttaaagcagattttagcacatcatggcagtggggcagcctgacgaagggactgttctcacaagatcaggctgaagagagcttttaaattccaggtggtgtgagcatgttctgggaagaggctgtgctctccctccctgggatgtggcctgtggggagcaaggtcttgttgcctctggtgcagggcacagagacaggggagggtggactgcggtgggaaccagcctcaggagttaggacagcgacgagatgatggtgtcatctctaagatcaccctcaggtgcaggtacagttgttggaatattcttgaagcatggtaaaatgcttaagtggttttgagcgctcctaggcctcgtatcctgcactgagcctgagcctgctgacagttgccgtggccattagtgctgaatgcccttttttcttgtaatccaagacaagctggggggaggggaagaggtcagtattgagtgcctgcagcatctgctactacatctacaccattcagaacttgtaactaaaatatttaaagagactgattttgaatgaaaattaaagggcaaatgttctcaaacagggctccgggatctgtgctccttttgaccctcgaggctttacagcctccatcattgttggcaaccacaatgtcgttatcaccgaaagctactacttcctcctgagttggctatcttggtggagctactggtggacgcaggatctttgtatattcttatctctgagcagcataccaagcccccatcccatattttaggcatattgcttttaacagccagccaggagagcccactaatgtcttagtgccctgggttcctgtcagggggccccatgcccctgagaagccaattcttgagaaattgaggctcccacctatgtgaatccccttcaaaacaccaggggcagtttccctttgaagggcttgcatcatttctgagatagagtggggaggcacgaacactcc

SEQ ID NO: 21341 - DNA, 1335 bp, Mus musculus
cgcataaatgcccttgaatgcctgtgcttgctacctccaaagtcctggggaggggcttactgactgggttagcgaggaaagaacaccctaggaactttggtgatagtagccccaggagggggatatctccctctaggatggggaagggctgcagtgattgactctctccccacagctgctgcagtttgagccccagcggcgcctaggagctggaggtggtggcaccagcagactcaagtcccatccctttttcagtactatccagtggagccggctaatggggtaggaggcggggaatggacagtgtggctggcccagttctcttgactgtctaccagctgggctggcccctcccctcagtggacttcaggggaagcatgtggcgcagcagccactttttctgctcacaacctgcttgggcctcagactggtgaagctgctgcaagggcagagaggtgcaccccgtcgagcaacctacgctcaccagccaacagatacctgctgaccacacagcttggacctttagctgggacctagcatctcaaagggtgccttctgttgctctagttccaaactgctcaacacccattgagccgactgatgaatctgggaacactgccatctgtacaccacgtagggcatctctggagacatctcaggacactgaacctctggctcagtagacccaaaccaggactgtcctggatccactttagtcatgctaccagtgggctgctacaaccagatgccgttcctacagaggtccgggtgctgggagggtctgtaggaaagtctgtagggtgaagtggggagaggtgggacacagtgtgagccactcgccactcctgacccctaacttctgatttctgactttggagaataaaatcaaggcaaagagaagccagtgtgtttaagagcgggataagaatgcggttgtaccacttaagacggagtttgaaaacagaataaagcgctttattctctggctggctctcctgtgtcagaagagctcgctccacaggaccagcagtcagttcttctcaggtgttgttttccactctgcattttggtatgagcttctattcaattcaccgcctactgacttttagaatgagatacatatggaccaattttacccagtgccttcagaaaggtatttctggtctctgaagtaagtggtatgtccaaagacagccccctccctaggtctgagggcttgcctcaagacaacccagttgctgggccatgcatggtacatgcaacaaatttcacttgaccaatccccagttcgtgtgtgtgtgtgtgtgtgtgtgtgtgtgtgtgtgtgtgtgcgcg

SEQ ID NO: 21342 - DNA, 1170 bp, Mus musculus
aagtacaaacaacagagccactcctaccagttccatccgaagactgctgtcttgggatgggttaaccagagacactgttacgggatgccagaacggcttcaaatgtctctgccactgaatggcgatctctccgcctgagctccacatctgtgaaagggttaacactcctgtggtgtgtggcgaagggtgaatgagacaggacctggcacaaaactgggcacctgagctggtgcttggcaagggagacacctgcttgctggtctgggtatgagcaggcttgcccaggtgctgtttcttggtgctgttccttgtccctctgggtctgaccctctctctaggaggggacgccatcctcacagcatcctgtcctctgacttgtctgtgtttggtttctggcaggtgatgtcatttcccggaggtaaccagccactcagaggagagccccacacccagctcacgtatttattaccgtcaccctctcagaaccctccctgctggtacctaccctctatttattagccgactcgtccctgctgaatgacgtgccccctccaagataaggggcatggaaggacaagacgctcaggaattcagtgccttaaaacagaacgagagagaaagaaagaagccagccacggatctgtgggagcttcggcttgggaagaagcaagacatggacatggccttacaaggggcaagccgcaccccagaggccctggctctccagggaactggagaagagaagaggaggcctagaacctgccctgattcccagctccacccagagagcagctctggccccggctgcattgaaggcatgtagaggggacccagtctactgtatcctggagatgggacaggacattcggctctggagagcagagcttgcctgtggagtttgcccttcagcctagaagtttatgcttcaccctttgcaaaggtcctttgtcccctctctggaacacaggcagagtggcctggggctgagcagagggcaggctggaggagcagtagcccgtggactttgaccgatacaagtctgggttgtgtgtcttcgtggtacagctacgggaagtgagccgactcctggagggcccttgcagcccaccggttgtctctgccgggactaactgccaagccagattctcttgaataaagcattctagtctg

SEQ ID NO: 21343 - DNA, 1343 bp, Mus musculus
tagaaatcaaaaccaggtcctctggaagagcggctagttagtaccttggccagtgagtcactgctccagtcccaggtttgaattttatgtgctatgaaaagacatgagagaggttggtttaactggtatagtttgttctagtttgaggcagtgtctctggctgtcttctcactggccgtctacctgactcagccactggaaagcgttagcgtgagaatcacaagttgaagccacatctcccggtttgaactctgccacaactgtctagcattattgaactcacactctgtgacgatagagctggatcctcagtttacccctagcatgtgattgtcttgcaggagacattctggagaaggtcagcgtccactgtcctgtgtttgactacgtgccccccgacctcattaccctctttatctccaacattggcgggaacgcaccatcctacatctaccgcctgatgagcgagctctatcatcctgatgaccacgtcctctgacacggcctgccctatgcggacccagagtggagtggagacacagcattgctgctacagtggggaggggaggccagcctgagccctcagtgtctcctgccttcctgctcatctccagtgatgagtgcgtccaggactgctcctgccttccaggcttagctgagcagcagggctcgcttacctggggattttggagccactcaggctgtgtttgcttcaggaacttcaaccttctagctcagtagtgtgctagacatgccatgactactttgctgggttggtgtttgctcagaaatgccttccagaccttttgccaataaaagctactggaaactcctcaagttcgtttattgttctgagctctgaatggactgaagcgtcagagtggccccttctctgtctgcatagaggctgtggtcagagagggaagcctaaaacaagtacaaataaaagcagtttctccgtacaactaactggaaagggccccaaacatctttttggtatctacagtaatggctttaaaacttgagcctcaggctggaaagatggctcagtggttagaaacactgactgcttttctagaggtcctgagttcaaatcctagcaaccacatggtgactcacatccatctgtaatgggatctgatgcccttttgtggtgtgtctgaagacagctacagtgtactcacatacatgaaataactctttaaaaagaaaataaaaagatgagcctcatggagcttaaaatacaccaccttggggtctacttctagactgccacatcagatttcgggaagaagggaatcacttaaagcttccttttctgacgaggctgaggactgattagt

SEQ ID NO: 21344 - DNA, 1192 bp, Mus musculus
ggcttctaaattatccaaactaaaggattctgaaaaagagatgcaaaccgtggggatgacaggtcatactagtgaacttccagattcaaatcccagttggaaagataatagccagtgcactaggttagacttggatttttgtgaattattaaaaaacaaacttgaaaaaatagagagtgatatgcttccaatggcagattctgccacagaggatggtcccatcaataaaaacagtgaactacatcctaacaatacaacggatgacacagagaaaccagaaactcctttgctgttcccctgtaatgattctaaaatcagcagagattcagatgttcttatcagaacttcagaacaacctacaggaaaccctgactctgtcggtaaagtgataatgagtcaggtagaggatggcattggcagccaaggtggagtctgtccccagggtgatgaatctaaggcaagatcttgttccaaaaatgaaccaaacgcacactgtatggattggcagcagcattttgatgtaaccctgggaagaatggtttacatcaacagaatgacaggacttagcacattcgttgctccaactgacgaccttcatactgcttgtactaaagatctgacaactgtggctgtggatgtcctgcttgggaatggtaagcatgcaggactcattggtgtgaaatgtttttgggaaagagaatagtggccaaagagcaatataatttttgttcatagaggtgacctcagcagatagcattggaagactgtgcttcatatttttttgggagggggggtcaaggaataatgagataaggtcttgctatgtagtccgggctggcctcaaactctctttgtagccaggttggtcttgaattcatgatagctcctgcttctagagcctgtagaagtaaaggtatgtgccatctcactcagcttctgaaggcaagtttttaagacctctgctgtggttaaggaataacacagtaggttcactgatttacgagtgacactcataagtcactcatggagagtcactgggtttaacaatgtttaaatataagaatttagtagctccccctcttctctttctgctgcctcctcctctcttctctcccaataaaacctcttccacaccgggggaaagaaaagaatttagtaaagactgataaaagatgtaaatgtatttacatgt

SEQ ID NO: 21345 - DNA, 2352 bp, Mus musculus
cattgcacatctggatggatgaaggaaaatataaaaatggagtgggctgcccagggtcctccagagagtggaaagtattcatgccctctcagaagcctggagtccaagaaaacttagtggtagcgtcagtctagagcttattttcaggaagttcagttacttcgtgcagctgggtgatcatgagaaagctcaggttgctttcaccgtggatgtttgaagcttcagtgaggagcagagaaagggcaggccctcatcacgacggccggactctggggctacagtcagtacagggtgggggtgcctccctccaagacacaagatgtctacaccctcctcggggagtatgtcgagctgtgggggaaagtcaagggggaggtaacccttcctacagtgccttgccttgctatctgggaggacctcagtgatactgccctttggaggtttctctgtacctctagcatcgtggccatctgaatgggatgagcagccctgggcactccctgtctttgtctagtcagtattttttcctttggtgtgttttggagccatgtcatacccagtaaatcagtatcatctttgtacttgagaagcccaaagccagcaccaaatccttggggtcacaaaagcttgacagatagaacctgccgagtaggaggggattggcttcaagctcacatctgtgttcttgttgagaggagcagccaccttctccaaggacagtgtatgtcctagaagagaaaccttctaggccagcagttgatagtttcccttaaatgtgagccttgcacttccaccaagtctaatggattgcttgtgtttgaggccacagcagctcctttgataagtaccatatcctctgtactacacacagctaaattaatattgtttcatttaaccaaaccccccccccaaaaaaaaggttggctatctctcttaatattgcaggaggacctacctatgcaggagaaattttgccatttccttaagctagtggtatagaggctggtgctgggaggaagtcccacctctgaggatgggcagctctgtccagtggcatcattgatgtcccttgttttctcagttctgagaagcacagtacagtggtactgctttcagcactgaggcttattcctagaataggggaaagcccaaacctgacgtaaggttacaagttctaggggtctggcagtaaaccctgcagagagttttggttcagtttggtcaatgcagctttggttttcgtcaggactggctggcctttcaaggtcctgtatccttacgcttaccatctcagcaggcctgagaggcagggtttaaggtgttcagtacgagcattgcttctgctctggagctgaggggtgtgggcatgttgctgactgtggggtgacagtgcatgctgaggcaggcaggaatcctagggagccgtgctcaagtagagcatggcggcggttctctagtatattccttcgggaagtctagatttgctattactctagctgggaatctaagttctgtgccttagagacaatttgcactttccagaattgtgcctaggacaaccataagatgttctcccctaccaaacagctatgcaaacaaaaaccagttcaaaagtcacaaccatgcactgggttgagtaacagtcaagacagcagaaatgtcttcaaacggttttctatagctaaatcttcgtaaattgtcctgtttatcctctatgcagtgctctgtgtttgaagcttgccggtagtgttgctttgagttacagtatagcctgcgtttatcctctgtgccaacacttggctgaagagccagcttattgttagcctgaagctgggaaggatgaggatggagtggtgtggcatttctgttttaaataaacgtttaaactctcagcgagggctgtgtttgagtaagcctgtctaccacctcagtcaccaaagacggaacacccacagttcgaggccttgggaaatctctaattctgtgagtcttctataaataaataactaaaagtgttctttatacagaaatgacacaagagacattacacggaaataatctctgctgttttccaatctcattcttgccagaaaaaaaaagcaaacaattttttccccagaagtttgtaaaaatttagaaagtgcagaagggggaaaagccattaaaggaaggattgtcagcaggtcaagagtggcttgctaggcactcaaggtgaccagagtccaacctacagagtccacacagctgtgtgtggtctcacacactggcgtgtgcatgcctgcactcatacacaccatgggcctacataacattgagaagaatcagagttctacacacctccttggttctcat

SEQ ID NO: 21346 - DNA, 1211 bp, Mus musculus
agcacattccaacaggctgtaaaacagttaaccaaaagtcatacgaaggggaactaaggatttaatataagtgcaaggacagaagataaaatactgactgggtttatctatataaaacttcacagcctggcagtggtgcgtatgcctttaatcccagcactcgggaaacagaagcaggcagatttctgagttcgaggccagcctggtctacaaagtgagttccaagacagccagggctacacagagaaaccctgtatcaaaaaaccaaaaagaaaaaaagaatcattattagggctggagagatggctcagtggttaagagcactgacttccaaggtcctgagttcaaatcccagcaactacatggtggctcacaaccatctgtaataaaatctgatgccctcctctggtgtgtctgaagacagctacagtgtacttatatgtagtgaatctttaaaaaaaaaaaaaaaaaaaaaaaaaaacttcactaataacttagtcacaaaaatgatagtttttcacttttagtgaacctgttgagctaagtagtgaaatgtttaaccagataatttttgttttggttttttttttgttttttttttttgagacagggtttctctgtgtagccctggctgtcctggaactcactctgtagcccaggctggcttcaaactcagaaatccacctgcctctgcctcccgagtgctgggatttaaggcgtgcaccaccactgcctcgctcagataattactcttaatggatatacatgtaaatattctccgctgtaaacttcttattcaatttatggtttaaatttatgtttgaagttctagtgaatttttgtaaaaaaaaaaaaatggatgcttgcataagccacgtgatctcttcttctaggaaggtccaaaagactaggaaacattgtattggaaggcatagcattggaaggcatagcattgggaacaagggcattgttacatcagagcaaaggagagagcaagattagaaggagaatgcagagtggagtaacttagaaattataaggcaacttaaaaaaaatgagcaatgtgcagaatgcaaaggggaagaggaaaatagaagaagctgcagagagcagaaggagcaggcaggcttctccttaccactcgacagaacaggtcttttcttgatagcaaggcaggcttcatcttactacagaggacaaagctttcttct

SEQ ID NO: 21347 - DNA, 2957 bp, Mus musculus
cagtaccatcaaggcacagctgagctttcttgccagaactgatacttttggtatgagagcacatgggcaccacctatacccaacaagtcaatgaggactttaatgcagtaggatttggactggttttgcaacaagattattaaagtcgcctatggaaagaaaacaaaataaaacaaaacaacaaaccggggttacctagataacgccaaagccagccttcgtcctgggtcgcccgcctcacaggatctgtttgagctgtttgctttttctctcccacctgctcatcgccttgtccttcactctagttctcctcccaagatttctctgactgcggtcagctctttcatatcagttgtctctttggtttccttgtgaaaacaccttgaacttctcttggtccttagatgaaatgtttacatagcttctggtgatatccttcataattttatgtctcctaaaagggtcatgggtgggacacattaaaaggtgagctttgaactgtagataatctcttaaaaaaatctcattttagaccattaaaatgtttgtgctcaactgcttgaagtccttgtgtatgtgtgtttagttctgtccagtttatcacttgtagatcctgtcgatcatttccaggtagagtagttccatcccatggtcttcatttgcagtgttgcagctagccactcccttctccacccccccccccaccccccccccgctctggctccctaatctgctgccctgttctgaactctaactctgttatgtaaatgggtcatctagagtgtaacctttggaggttggctttctccactcagcataattcccatgaggtgcctctccaaggcggtgcacatcctggttttcctccaggctatggatggtactgcattgtgcttaaaggtcatgtgggtggcctggggattgggcctaactattaaagttcttaggtgaatgtaagttttcatcactccgggataaatacctaagagggccgttgctgtgctgtgtaggaagcacatggagttctaaaggaagcctccctgctctgtctagagtggctgtatggcaggttacagctctacattctctgtggtctttatcattgctattttaacttctccccttgagtggatgcctgtaatatctcattatggttttaatttgcattttcctaatggcagatggcgttgagcatcctttctcattcttgtcgtttgccatctgtctgtccttgtcagtgagatgtccgttggtggcttttgcccatttctatgtgggtcatttgttcacttcactgttgagttctgtgtgggttcctctatcaaatgggttgttgcttgaacttttcatataacttctaccaggaaaaataagtaaattttaccagcccttcatgtatggtcaatcactgatctaactcctgttcttcagtgttatctctgagatgtggatatacggggtttaacttggacatctgggaaagtcacagatagtaaatacttgaaatatatatgttgtaaaatcaaagccaaggttcattcggtggaagttttaggtacctcaaggcagttctggaaagtgtaccccagtttacagtgcctacctaccatacagaaggctctgggcctgattgccagtggcgggggcgggggtggggtgggtacaaatgcttgtaaacaggaaaaatacttgtttatcatctaaagtctttcccacttctcctgggaaagtgggtaaccttttaaccctgctgacctgttacagggcttatctcaattgcagttctgagaattacagggcttgcagtaaagaagtggaatattgaagttaccagagaataccgttaggatgacctggatgaagtatgcaggtggatgggaaagatgtagtggttaagtctcaggctgtgctgttaaggttccagttactatgaactcaaaagcctttgtcttatgacttccataaattcctcttgcatggcatcaagtgttctctggtacaatagtgccatctgctgttgaaaaatgatctaagatctaagatcttagaatacaagtcctcaccatggcaacagcagatggtcagaaatctgtaacattcatatatcaagtgataggagaacaatgtaagtatgaaaagaataaactttggggtcaaaatccatttgtagacttttaagtgcaaaaccatagcctgtctgtcccattagcctaacaagagactcctgttttctgacgtgtgccttcccccctaaggagcagtgacagccgctctattagatttctattttcttttctgaaaaatgtcaatttttcagagaggagaaaatagagcattctgtccatgtttttgtttccaagaacaagtataaacttaagctctgtagaactgaaattctttcaagtcctttcgatcattttgatcatgcccaaaacaaccaaactggacaacatgcttttcagttcagttgaagagcatttgcctttgacagtaggcgtgcacaacagcatatccgctttataaacaggtatattatctgcttccctccgttccagcatagtcaaaataactgagaatcatacagtttcaacaaaccttgttccttaccattgtcatgaacccccatcagagccatcttctgtttgttaatgggaagaggcatgtgggatttatacaggctcacctgttggagatgtttgtgtaaactttcacaaataaaagctagcagaaaccatttgaggtgtatttgtctgttaatctttagtgcccctttgtctgggtgagcaaggattcctctataattgttgttttttaaagcacagggagtgaaaacagataaattaaagaaaaaaaaagtcactgatttactgcagggcacttaagcaaaaggatgttttaatcattatgctaatgaaagaaatcttgagcagatttcctcagaaggctagagctttgag

SEQ ID NO: 21348 - DNA, 1221 bp, Mus musculus
accaggtgctgagaccaaggttgacccgcagataggggctgtcccactccagggcccagcttgaagagcacctgagccagagaggtgccaaaccaggtagtagcctcaggcactcctttggcctctctgccaagacccccacccaggggactactgagcagccaagaaaagccatgcattgcaaacacagtgtggcccgcggatggaactcagcatagactgcaatccacctccccagccctgcccaagcccagtggaagggggtgcactgtggggctgcaatggcccagctggagttggctgcggcacagaggcgcgggcgcccttccaaagcacatacttaatcaatgaatgtttacagactggctgtcctggcggggcttccaactgcacacggtttttatactttctttctttttctttctttttttttttaatattttttacaaaaaaaaagattttatacaagcaatatatatatatatatatatatatatatatatggatttctataatcactcgatgtgacacagtacaaatatgctatggtctgttatggacatccacccaccagttaaggccattgtaattcctaagtactgtaggctctgggtgttggggggtggccaggcgggtgaggtacatttccatccttgtaaccccttcctagtacccagtcctgtatcgttcagtaaacattgctcttaattacccagctgcctcgagtggtgtctgcccaggaagagggcatagtttccatacctgcccttccaggtaagcctacatatggccatttcacagatgaggagcccaaggcctagagatgttaaagaactctgcatataccattttgagagtacttgcttcatttatttaggccaagtttttttttttttcttttaatagtttgtgtctgggtgggggtggggtgagtaaagcatgagtgtctttgtgtagatatgtgcagaggttagagaatttggatccctaggagctggagtttcaggctgttgtgagccacttgatgtgcttcctgggggttgaacttgggtcctctcttctccagtttccttttgagtgtaccaggcactgcagtgagctggggagtaaaccagccttggtcttgcacggtggatcccgcaataggtttattttgtgcttgcttgtctcaaacctgtctcccttcatctatctgcgtggcagccttttcaaagggcagct

SEQ ID NO: 21349 - DNA, 1269 bp, Mus musculus
cagggtcttctggaagtcttctctggtcaaatctaatctttattaggtttgaaggagtccatagcttttcttctcttgttaaaacaaagataaaacctcttccccaacataacatatttccttccttccattctgaagttaggatatctttaatataaacaggctgggttagctcagcgtttttttttttttttcctgtaatccaatgtctctcaacagctgttttgtttgcttgtttattttgttgttcattagcatttaaaaaatttaaagttgggctggtaagatggctcagtggttaagagcactgactgatctttcagaggtcctgagttcaattcccagccacaacatggtggctcacaaccatctgtaatgggattcgatgccctcttctggtgtgtctgaagacagctatagtgtactcataataaataaataaatcttaaagaaaaaaaaagaaaaaccaaaaaaaaaatgaagttagtaaaatcttatgtaatttttctctgggggtctttgttatcccttttcatttgttatgcatccctttaaaaactcaattaggtctatggccataccaccctgaacgtgaccaatctcgtctgatctcggaagctaagcagggtcgggcctggttagtacttggatgggatacctcctgggaatgccaggtgctgtaggctttttggactccctttgccgggcgtggtggtgcacgcctttaatcccagtacttgggaggcagaggcaggcggatttctgagttcgaggccagcctggtctacaaaatgaattccaggacagccagggctatacagagaaatcctgtctcgaaaaacaaaacaaaacaaaacaaaacaaaaatacaattagatctctctacaactgcttgtcctgtaggattgtgtgggatacctgcaatatgctttctattgtagtaggcaaaaatattgcttcattttactagagacatatgctggagccttgtcagttttaatttgtagggtattcccatggttgccataacttctgttaaatgtgtcattacaaaaccatcctttccagaacttaaagctgtgcccactgaaatcttgaatacgtgtctacggtatggtgcacatattttaatctttctaaactctgcaaatgaaacatatccatttgcaaaatttaatttctttgggggacctttagggttactccttccagttaacggagtttgattatacaaagaacaagcaggacatttccttataattccctcag

SEQ ID NO: 21350 - DNA, 1214 bp, Mus musculus
tgctggtcgggctccggtacctagaggcagaaccagtatccagacagaagaaaagaaattgaggccagccttgccagctctgaaacatcgtcttccacctccactgtcttcttcattcaccctctatccttaaaccatttctgtttggctgcatccttaactccttcatctaggttcagcatcttaagctttcgagagggttttttgttttttgatcttaaattttggtttttggggtttttttatgtttttaaattttttaaggtattcataagaaaaattacttaacatgtatgtataatttaggagtcatttaaagaaaatactcttgttagtccttcaaagtcaaggaattctgagaagccccctaatgtgtcctcccctagctataacccctctagctccttttccagtcttttgcttttctctgcattccttgatctgttgtggtgggaacataactgtgaagccgcagctgctgcctgcccagagcagccgcgggcaagggctgcttcaaggtcctgagcacatagactgggctcctttctattgctgggcccaggggacaggcagttcttctgagaaggactgccctcatgagcaggaccaggctcctcttttatctacaggtggatgaaggttggaagagtctgggctgtttttagaccttttggtcaattgtatttgtgtaatgcattttataataaatagggaaaccttctattctgatccgtctgtgtactttggcctttcctaataacccttttaccctccaaactctttacccctcacaggaacatcatagcctgctttaccttcccacccactgttgtcagtaggacagttcaagactgggaaagcaaggctgcctccagttcctcattgtcagcttgataacttgtgttcttgatgcctaatctcttcttcctcaccgtcaggactcccatcggcagctcaacagttatggccctttcccgttttcttccccaaaaatcagattcttgagaacagctatagcaagtagaccaaagcagcctaagtcagacagctgcacgagcgtgtaaagcaaggtcagaccaggcatggtggtgcagatctttaatcccagcaacttgggaggcagaggcaggtggatctctgtgagtttggggccagtctcaaaaagccagggtgtgagggcaaggctaatgcctccacgtgaatctcaaacagaa

SEQ ID NO: 21351 - DNA, 1220 bp, Mus musculus
ggggaatatttataaacttctttgagaagcattattcattaaaataccccaggagagcaaaggagaaaggaaagttatttacccaccacagggttcatttacattggatcagaaagcttcaaatatctttccccagcccatttaaactctctccagaaaggaatgagaggagagacaggaacaccaaatccatggcttggtcatctaccaaaatgtaccagagaaatagaaaacacccaaaattctggtgccactcaggcagtggcattctactgctgacacaaagcatgttgtcctgtgatgaacaacttgtaaaggttagagaactgagcaaaaaggtcgagatgtccctcagtgtactggcatccagaagggtaaatgtgacagcctgctccaaaccaaactgatggcctgccaaggagtactggcacccctccgtttccaggtctgtgagacttggacctgcggtggtgtatcgctttcctcgagcctctcttctggtatcccttgcagtcctctctgaagcagtccttggcaatgtagatctgtcagcaacacagccctgagaaagctcatctcttcacctggaattctggaaaaaacacagtcgtgctgagctttagcttgccatcttctggggagacatgccaatgatacatggacatgggtccagagtcaggcatggtctcagaaccagcctcccttgagcagtacagctacgggaaagcgtcgccaagcaggcccaccagcctggtgtctgcagaaactatcactttggttcatgctaccctctgcagggggctgccttccttgaacagagaagtagttcacgtggtgaggaggcccattccagcatcagacttgtgaactggtagcgagcagagatctctgcagccacagttactgatgagcagcagtacctgctgcaacagacccaggtgccttacgtaagcaggttggagagacagacatgatggactaaagaagatgcactgtgtttgcaaaatacttatataatgctgagaaaataccagctgtcctcttcaaggagtttgtgcagagggtatcaggagcagaagcccatctaagacccctccccctggctgccctaggcacagttataatcagacagagacattgctgttatttgtcttcttagagtctatttttaccaatataatataagtatatacattatattaactgtattttctttattc

SEQ ID NO: 21352 - DNA, 1105 bp, Mus musculus
aactctatttatttacaccatggataatggtcagaaacacagtttgtttttttatggaaagtaccttaggctttgtcaggttctggattcaaattctgacttcatttactagctgaaccccaacttctgggcattaattgcctcactataacttggagctattgtgtgttttggaagagataaattatttgcgggttttacacatggattctggagggcatgaggctagatcttagattttacaatgtaagtggtgaaaacagaccaccatccatgaacaactaggttgatgcctcagttttcatcttgctgtgcactaagagggactggacagcttcttttgcaccttggcttacttgaaagtatcacagctatggcgttgagaaactctcctggcatttggattttatcatgacagctcaggacacgatctgtttgctttaggggatgatgagcagagtgattggttttatgaaggagaatgtgtccccggattcactgtccataaccttctgcccaagtgggctcctgatcactgcactgaagtagaaaggatggactccggcctggataaactctcagaccccacgttccttttaccttcccggccagctcaaagaggtgagtgtggagatgatgaaagtccagggcatggctttatgttccctgtgggaagatgcagcgtgctctccctgagcacttgcacgcctttgaccatgcattgctctctgaatcgtggagttaactcagggttctaggggattcaagggtgagtctcaaagctcagagttctcttctcctaagtcaatccatgtaggcttttgggacacatcaccagtgtgtgctgcatttaggaagcctggtatcagtcgcagacacatatcatggcaatgctgatgcattactttttgagtgctcattggaagcttggaagattggctcttacaagggacaggcttttgtaaggacattcacatgcaagaaatgatggcattttttaagtggatggtttaaaaatacttatttaaatgtaattgtttacatttacgatcctcttagtgtgtactttgacacaaatgcgtatcaacttttttttcagttctaa

SEQ ID NO: 21353 - DNA, 1256 bp, Mus musculus
gttgatgctactttgtcaaggtgaggaggaagtgagtgcctggagctgctggggaagagccacatttcccaaaagtgtcatctggagcacctgccattcagggctgtgcttgacacagctctctctttttgtatcagctgagtgtgttgactgtgaaacacatggtagcgttgttaaatgctcgctgccttggtcatgtcagagagaaaaacctctccttaagacagctagcaggtgatccggtgcgtcctctccctgaagggtcattatccctcccagggagtgtaagcagtgtgttcccccgagagctacattcatttgggaggccactctgtgactcttcagcagtgaggtgggcaggggccagaatgtgagtctgtttgcaaagggaagcctgaagctcggtggctgagaatgtatcagctgaccataacaaaaatggtagagggggtgcagaaagagattgcaggatgagaagagtaacaccaaaccctgtccccccccccccccccccgagtcactctggtcacaaggtgacttactgtaactgactgtcttatgggcgtctcagctgcatccacagaagacagggactgtggcactgttacatagttcaaaggtgaaagtggatgtgtgtgtgccgtctgctcctgcagtggccagtggaacacatttctactgtcctgagttgggttgagggagaaatctactgacgatgctttttaaatatttccaaactggttcactggtcttgatgacggcttgttgagacctccacagttaggtgcagaggtatcccctagctttcctctgtggtacattgtggtatactgcctggtccgtcgtcctctttttacctgggatttaaagtagcttatatatacatatttatttatattttaaatatctctctgaagccatgccaatattcagaggtgaaggcagagttgcatgctttactccattgtatgagtgagcccacactgaaacaacagacgtccctgctaggctgccctggttatataatctgttctttctcattggtgtcccgagtcagcctaaggcccacacctaggaagcgctttcatgactgtttatcatctttgtttgtcatgcatttctacacatttctggatacttctgacagggatcatccaagactacagcatctacctataatgaatgggaataaagttatttaccaagaaaatagaatattaagcacataaattctttctaaaacagggttgtaattt

SEQ ID NO: 21354 - DNA, 1144 bp, Mus musculus
tctttattcttttgcctgtgtggttggtttggctctcaactgttacacctgtttagaacatgatacggcttttctttcccatcttaaacaccaattaaaagtacctgttgccaaaaatgtcagcattactaaataactatcaaaagtctcttggtagtgctgggcctggtggcacacatctttaatcccagtatcagggaggcagaggagttcgaggccagcctggtctatatgctgagttctagaacagccagagctatgtagagaaatgctgtcaaaaaatgtcttgatggtggctcatggctcatgcccccagcagtgccaaggtggaggcaggggcattctaggctggcctgaactttgtagcaagactttgtctttaacaaccagttttaaaagcctcctaaagttttaataatgcaatttttttctacaaggtagtttatggcccttgaatcttcaaatattataaattgaagaatgaaagaagacagagaatttcaaaatagcccctgggtagctttttaaacttaactacatcgtattcttgccgatggccgatgaacaacagctgaacaaaatgacaccaccccagagtcatgtaacagctcctcctgcccagtgtccctgctggtgcccctcctggtagcagttactgcaaagcagccattcctaaccctgttaaccccagcctctcagcaactgatctcactccccccccccccccgtctcccaaccgcactccttctcttgcccaggtcggttgccttctcccctcttgatttgtgcattacttgagctagctgtcatagatggtgttgcatttttaatatgctcataagctcttcccttcaaacactttttcttaactctggacacctgcctttcactgaagtatgccccctactctacctatgaattctcttgtctattgaagcagggcttttaaatcctggacacacatgacgatcaactgggagttttagagggaatgatggttcagcaggtgaagggcatttgtcaccaagcctgataatttgagttctgcccctgggactcacaagtgtccgtcctctgccctgtacagatacgtcgtggcacatgtgcacaataaatatgactttcttttcattaaaggcaaaac

SEQ ID NO: 21355 - DNA, 1195 bp, Mus musculus
tattattattattattattattatatggaaaaataaaacaggaaaatacacaaagaggctcaaaagatggcaaagcaatcaataacaacatccttatatggctgctttagtcttttgaatgcccgctcctctcatcatcagaaatacaccaggggcaatgtcgggcacagctcacccctcaggatgagagcagtggtcactcctctccttcaggccccaggggtgctttgttcccactcccctaaggagtgccctcagcttgcttagctaatgtattcgcaaaccaaattagggggtccctggctccaggggaggccccccagtctgcttgctctatgcagggaattagatatcatctcatgcccaaatgcgattaggcccacagtccccaccccacatgcaaaagcccgctttctaatcagttttatgaggggcctctgcagatagacactaatggtattgagctgaaatctttactgagagcctgcctgagtgaagtctggggagataaaatggccatgctggatcaagcaaaagcctgttgccagcccttgtccttcctcttccttccttcccagccttcccttccctcacccaaacctgacttcttcccacagtgtctcttgtcacttaaggttgcccaccagaaatccaggaagggacccagtagttaatcaggatgttctttctccaaaatcttttgtttggttgtttggttgtttggttgttggttggttggttggttggttggttggtttctgagacagggtttctctgtgtagccctggctgtcctggaactctctctatagaccagggtggcctcagagtcagagatccacctgttcctgcctcctgagtgctgggattaaaggtggacatcttgactgtctggtgtcccccaatactgggactaacggtgtacacctccactgcctgctgtcccctaaatcttttgatctcacgattatacctgatggtcatttgttgactgtgtggcctcagataagaacttgattttttttttcctgatcttgcagctgtgtaactgaaaactgggaatatggacaacagggaaaggaaatagaatgttctggaacaaccattctcagccaaagtgatcttattccttttccctacactataggttacactaaatcccttctcacttcctgatggctcctcaaagctgtctg

SEQ ID NO: 21356 - DNA, 1160 bp, Mus musculus
actgtcttaccacgtaaatgcatttttttttaaacataagccatcgaaagcagaataatataaggacaactgtattcttacacttcggaagaagcaactggcacagagtaaggaagtaatgtatccctggctcacaaagctctgcctgcctctgtccccagtgctgggcctggcttctcgcttctcgttctttggttttttgtttgctgggagacaaggtttcatataccccagtagccaagggtgtgcgtgtgtgtgtgtgtgtgtgtgtgtgtgtgtgtgtgtgtgtgtgtgtatgtgtgtgagagagagagagagagagagagagagagagagagagaggaggtacaggggcagccatggagctgggtgggttgtgttgggcatagattgagtgtgcttcaagatgagtgtgcttggggctggtgagatggctcagtgggtaagagtacccgactgctcttccgaaggtcaggagttcaaatcccagcaaccacatggtggctcacaaccatccgtaacaagatctgactccctcttctggagtgtctgaagacagctacagtgtacttacatataatcaataaataaatctttaaaaaaaaaaaaagatgagtgtgcttgagacacaaggatcagagaacggcttcactacagggaagaggaaaaccagcctcctgcggtcctgaggaggtctaaacagaccggtggcagggttctagaggaacggaagctcacagtactagtaatgactagctcctgtgtgtttgcacatcctcctgtggtgcactgcggaagtcacaggacaactggcagggggttagttctttccttccatctttacctgggttccggggatccaacccagggcatcaggctttgatgcaagcatttttacctgctgagccatcttattggtcctgaacatccttttgtctcaaccaactcacagctttttgcaggaaagaagacagatctagataaagctgttgaatgtcacacaagtcactcccctaagctctcatcaaaggcagcacaccccccaccaaaagagaccctgacaaagaagcccttgaaagtttccatcccactctgagaaagcacaagccaaaaagtaacagcaaggaacagttctagaagtgaaagccaaagtatgtcct

SEQ ID NO: 21357 - DNA, 1099 bp, Mus musculus
tctgcttttattcaccctggcagggaggagcctagtgaatcctaccaatttcagggagttcctggggctactttttagttgtttacctgcttaaggaacctccctgcaggagggaatggtttgtttgtttgtttggttggtttgttttgtttttgtttttgttttttcgagacagggtttctctgtatacagccctggctgtcctggagctcactttgtagaccaggctggcctcgaactcagaaatccgcctgcctctgcctcccgagtgctgggattaaaggcgtgcaccaccacgcccggcttgtttgtttgtttttaatgagaggaaattgttacacaacacctcctccctcacttgtgttgggattggggtcaagggtctgcaccacaccagttcctggctctaccaaggtacagccacctgccctattctggctgcgtagatcaagtcctattcttccatgagactaggagttccatttggcttctcccttgctttccaccaatgcctagaactctgatagactgcgctggctagttttatgtcaacttgtgacaaactggagtcatttgggaagagagaacctcagttgagaaaagaagcctatgggtaaacctttggtacattttaaaaattggttgattgatgtggaagggccctgccctttgtgggtggcaccacctctatgctggtggttctgaggtgtatgagaaagacgattgagaaagccatgaggagcaagccagtaagcacttctccatggcctctgtattagttcctacttcccgacttcctgccctgacttccctggatgatggactgcaagctataagaaagtctttcctccccaagttgctttgggccatagtgtgttatcacagcaatagaaaccctaactaaaacatagacaagtattatttgaataagaagtaataaggacaggctgagaactggttgtgccaaactggcttcagatagtcccgagaagatgtggaggtcacaggctgagtatcagtacagaaacagggtctgagaagggggacagccaatgctctacagaggctggacccccagtcttctgagagtgactatcag

SEQ ID NO: 21358 - DNA, 1170 bp, Mus musculus
aaacaaaaaagcagaaaaagagaagacaggatcaggaatcatactttagatgggaccgccattatccagcccggaccacggggaaaaactcacttggtgccttttggttaaacggtctctctccgtccagttagaaaacttggcagtcttggtgactgtgaagtcctattgaagcaaatcccaagcttggacttcacagctctttgggacaggcacacggtcagcttccactttttgtgaggtaggcaggttggccaaatatttaggagggacagctaacatcttgccatccttaggccagcaatttgcaaaagacagggtctctgatttgaagtttacgaattcaaagtttcttagaactctgaagtcgcagacttttctggaaagcagctacagacctggccaccctcgcagctctcctacgtcatacccgtagacacgcccatgtggcccgcccactaggccatagccccgcccaacctctcacctcacttagaactgactcccgcgttctgtgttcgcaggctgctgaaccgaatgtcgtccgaagacaggcacctgggctctagttgcggctccttcatcaagacggagccatccagcccgtcctcgggcattgatgccctcagccaccacagccccagcggctcgtcggacgccagtggtggctttggcattgccctgagcacccacgccaacggtctggactcgccgcctatgttcgcaggtgcggggctgggaggcaacccgtgccgcaagagctacgaggactgtactagtggtatcatggaggactccgccatcaaatgcgagtacatgcttaacgccatccccaagcgcctgtgcctcgtgtgcggggacattgcctctggctaccactacggagtggcctcctgcgaggcttgcaaggcgttcttcaagagaaccattcaaggtgcgtggtgggcagctcaagacctggattcaggctttgggtgggggccttggtctacaggtctagttgggttattaattccaagtctcgtttcctgggggcagaggtgctctagaagtctcctgatctgtgtctctgggatcctagacaaggatttcaactctaagactcatagatataccatgtttcttcctgcttggtccctgaaacgccgtagaaagagccacaggaatacc

SEQ ID NO: 21359 - DNA, 1210 bp, Mus musculus
ccacagaatttcttaagttttcatcaggtatcatttaaagataactaaagaccatatagaaacactggttctcttttttaaaattggtgttccgctttgtttatcatgtgtgcgcccttatgccacagcgcacacgcacacatgtagagatcagaacttggaggacttggtagatctctgccccggaagtcttgatccttctcaggttctcaggcctggacacaaacacctttactcacagagctatcttatctcggtggtcttagaaatacaaatgtctaagggaagataagagcagagcccggcccatctcggtaccttatccaaagataatctttaaagaaacccaacccaaccaaaccaaaccaaacaacaaccaaaccaaaacaaacaaacctaacaacaacaaccaaacccctctagcatattctctgttactgtctttatcgcttccctccggtacttactgccttagatagcttaactttttcaaaatagggtcacttgcagttcaggcttgccttgaactcccaaccgcttagccctgaagttatagttatatgtgtgtgtcattacacccagtcttcctgtttgtctgtccctacccttgtccaccaccccccccccaatcatttcctccacttattcggttaaaacctattttcctgttttccttcttgctttgccatcctcttgtttctaggttaaatgatggttttggtttcttccaccttttgtagtttttgttccctgtgaggcccgggctgcttgagcatgctggagaggactcgcttcttttcttttcttttcttttcttttcttttcttttcttttcttttcttttcttttctcttctctttttaaaagatttatttatttgagtacactgtagctgtctaaaaaacacagtagaagagggcatcagatcccattacagatggttgtgagccaccatgtgattgctgggaattgaactcaggacctctggaagtgctcttaaccactgagccatttctccagcctggaaaggactgtatatatatttttttaacccttggactcctactatattcacaccttggtttatgtgggattctggctgactgtcaccaccacctgccactctcctaacctggacacttgttgttaaggagaaaagcaagggcagggaacgcgatgcaggtacttcccctgagagcaaagtgcagct

SEQ ID NO: 21360 - DNA, 2251 bp, Mus musculus
tggcagcgggcagaggcggtggtggggagatccctgggctggcccctgaaagataagcccatggataatgcaggcctccaatggtgggagtcgtgctgggaggatgcacactggccaagtgggaggacttgcagggtgatcccagagttgcctcccctccaggagtggctttccccatgggcagccagatgtctctctgtcctgatatactgagcctgatttggctattagggagctttacttgagggaggaagagacagtcaccagggcacatcccaccacacctccagtgctggcaggcctgtatctgaaagagaaaaactgacaggaagccccctgcgtgtggatgaagctgagctcttggcttggtgtgggtccccatagagctctgtggtacctggcatcagaaaccccacagggaccctgccttggaggagcctgcaggagtctgggtctctgccaggaagagcttttggcagtagtcctggctcctgctttgtttgggtgtccctccttgcttacatgttcaaggtctagtccctgggggctagcctgggctcctgccccactctgacttgattctggaaacaaacggcccacttggctgtgctgcttgctccctgtgttagggtctcacagtcagtggaataacagtggttcccgagtcttcagggaagcagggaatagaaacatgccctcccctgcccctgcccctgcccctgcccctgttctacatgtcacaaatgtcagaaccatattttccattatagggagtattttttttgctaccctgctttaagctgctgggctcttctaatctctcacagctattgtgcccttcccagtactcttagctcagcaccctacagcagttcaatacgccaccaataactttcttagtaaaatagttcatgtcactgatccatgatttgggggctccagccattactagggataatgtcagatgtgtggtgtctctctgttgtgggatcaaagctgtcccattccttagctggttggagatggatcctgttccccacgtggcttcctttggcattgccctctctatcctggggtgattggaatagtcagtgagtgaaggcggtgtcctagagtctttgtgcagatcctttgaatggcaattcatattttcttggaaagtcgacctttttcagagtgtagaattgaatataaagtgtgacttgggttcggagccggtgactggcatttgtggttcctgtacggaacactggaccctttcttcacttgtattgatacctgctgttcaccaggtgtgtcagctccctggcgccagttcagctagctgttaaattcactcaggctctgcttgtctttccttcggctgcccacagagctgagtgaggtcaacaggacccattgatctcctttggatctgttgggggcactctaaagggggtggcattactttaagcagatcctctctaagttctgggatcagaatggaatgagacaggcctccagaagaactctgaaaatcaatccacttgctgcctctaccaggcacccccacctcctggacttgcatacgacaaccgtcccccctcccccgccaccctcccccaccgccgtgccccccacagctacgcccccacccaggcaggttgtccctgccagccccaccttctcctctcccgacctacccactctccagccactcctgctgtttcctccctgttcagccctgcctgtctcttcccaagtgttttctgagagaaatttgatttcagcgagagctgggctgacggccatgcaatatgctttcacttgttccgtgcgcgatggaaaagtggaaagatcctccagggattctgggtaattgggttagtggccagctcatgtcaggaaattaaaagggggcctgatcaggttcctgctgcatgggctctaatagttttgtatttatagagtgctctgcctctagtctgccagaaatactactgctcttctggtcttgtgaatgaaggaagagacgttctcttgcttttccaaaatatattaatgttttgaaacaaaccaactctccagcatgtcagaggacagacagtgttgaactactttctgcctatacacatgtgccctccagcgccgcccccccccccaaatctgatagctcagaaggtctccccaaagcatcctggacatgcaggtacaatgacctctggctggacaggtgttgattgaatacagacagctgcttctggctgtgtgg

SEQ ID NO: 21361 - DNA, 1245 bp, Mus musculus
actgaaggttttcaaattcccacatgaagtcacataaggattaagtgagctgttggccctgtgaggttgcctattaccccaccttagaggccaagaaatggagatacaagaagtgtgtgtgtgtgtgtgtgtgtgtgtattcatgaggtactgtctaagcattaaagttctctgtacatctgaaggggttaaacagtatccaacagtagttaggacaagggccacgtgttactaagttaagtatttggagatcagcaaggattttcatattagcattattaatacctttttatatttggaaagtctcaatgagatgatagactctactaatctgagaccgcaactataagttaattagtattttatttgttcctcctgactgctttttaaaatatatatatgtatatatatatatatatatacacacacacacacacacacacacacaataagacatttttatttaaagactcccattttctctctccccaggtttgaagtcatattctaatttagaagtaattgtctattgtatcagtcagtagggataactctttactgccacaccctttgaaaatggagatgtttaccccctctgtccctagtagcccagacgagcctcaaacttggctgtatagctgagcatgaccttgaactgttgctccttctgtcccggattcccaagggctggcattaccggctggtatcacctgatttacgaggttgctttcttttgctggtggtattcaactgcaaagttgagctatcaagtcattggcaaagaggacaaagcctttggatttggaggtggcccacgaattccacagatccgggaagcacaggcccacgtcctccactccaaaggatcattaacagatcctgactgtagtggtgctgacggcagggagtatagaacccacaacgtgaccggaacaagcctgtggtgattgcccggaaagcagccaggccacctgcagcatccctgcttcaaggtcaactgaaaagcctgggctccagcagagtggctttgaccactgctgcctcctttagccagagggtgacactggagcgttgacccacctcctccaagggtcaggagttagatcagcctgaacaggaccactgggtcctcataggctttgtaggtttgaatgggacaggagtttcgaatgagaacagacccattttgtaccagtccttgatgtgcaatccttgattagttccagtcgacacattcatcctttg

SEQ ID NO: 21362 - DNA, 1164 bp, Mus musculus
tggggggtgggggggatgagccagcagccaaggtgtattccctcccctcatgggctcgcatttaacactctattactctactttatcacccaatgatagtaaatacttgagcacttcctctgtgctaagcagaccaataagtcttatgtgtgtgcgcacacatttaacctctgcacctctaacatgggcactgttggccccatttgacaggggagtgtagagacagaaggtggccttgcctagggtcacctttggtggccagcagagtgactactttgaccagtagttggctctggagtctgtgcctccaatgtgtctttgcacatctacataaatagtcctccctcccgtgttggatttatataataatacatgtatcacattacatttccatagtttcctgcctggcattttctgcatgtgagctagcaacaaccccttcctcacctccaccctggtccctcctggagttgactatccccgttttctcttgtagtgtttcttttctcaactgttagaaagcattccaatggtttcaagtagtgccagcacgcacttgctgctgcctggtggctaggaggccgcatgtgtgttggcgtttttttggggacctctcagatgttggagaggaggaagggactctttcccagggatgagcccgctgctcagacctcccagccagccggcccagcggtatgagagtaaagccttcggcacgttctctcccacagcagcctagaaatttccaggtggctgttgtgcccccaccccttcccatggcactccagcctcttacaggggatctaatggggtctctaagcaaatgttttaggttgttttcctgctgtcccagggtcaggctgtggcatctgtctgtccttcactgtgactgcttttgaggctgggtgggtaggaaggcaagcttaaggctcgggagtttcccttcagagctcagccccccaggttgcttgtgcagggattcactccctggactgtccttagttagcatcgatacgggttgcatgttctcagaaccttccagtccaaaagtcttctgaatttttttctttctttttaaaagtctatttattttttggtgggttttttgagacagggtttctctgggtaactctccctggttgtcctggaacctactctgtaaac

SEQ ID NO: 21363 - DNA, 1237 bp, Mus musculus
agcagagagctttcctggagcttgcagtatgttggagacacccatcttgccacccccaaatcctgctattaattcagcagctccttcaattacaaatgcaccttattaatcagtgttgtctccccatgctgggaaagacctagctagacccaatgggcatggtgataataactgtcaatattgactcaactcttattatgtaagtcttttccatgaattccagtgtgactgattgactaaggggatagcaacaggcacccccagggctccccccattactccccacccctgcctccagctgggtctgaggatgcaaggacacagctcaccctcccttgaggctgccctccagcaagcgccaaggaagcccctgggaccatttctgatcattggcttcttccccttctgcaggcttccccagtctgacacttggggaccagatgagcctgctgcagagtgcctggatggagattctcatcttgggcatcgtgtaccgctcgctcccatacgatgacaagctggcatacgccgaggactatatcatggatgaggaacactctcgcctggtagggctgctggacctttaccgagccatcctgcagctggtgcgcaggtacaagaaactcaaggtagagaaggaagagtttatgatcctcaaggccctggccctcgccaactcaggtaagggtggcacgtgaccctcagagggcttcaggggttctgtgggagcctaacaagcgccgcaagcgccgcaccgctgctcagtctgtgggcggggctggcttacggatgtgggaatgaccagcattgcttttatcagcggaacacggcattagttacttttcttttctggtgatgaaaagcaacttacagaagaaagggtttaattttgtcttaggattcctgagggatagaggaggtactggagcagggagcgaaggttccgtgtggcagccggaagtggagggatagcgttttattcacacacagggagcagagggagcgaactggaagtggaatgaggttataaacctcaaagctggtcttccagcaagtctatgcttctgaggttccataacttctatatacaccaccagctggggatcaaatgctcaaatccaggatcctatggggaccgcgcccatttaagccactacatcccgcaagggtagcctggagttcaaaggacagtagtcatggaggccagcactggtttaggattttctaggactttgac

SEQ ID NO: 21364 - DNA, 3964 bp, Mus musculus
ccaatgtttcagacggccggccgagttcatgggctgtaagcatcccaagccgatggtgctaaggatccagattcaagcaaggccaagcaagggatacactcatccctgaacgatatccccgccggctccctctatcagcacaccctcccctcgcccccaaacacctagacattgacttccatccctttatatctgttctgagttgtaaggttggtggctgtactgcatgtgagtggtacccatggcccagcatcatcatgaagacgtgatgatgtcagggttaggtgatagccgtgaggttcctaagacccaggtgcttaattgttgctgtataactgtatgaggtaggtatggctaggaaaatgggggacagagaagttatataatgtctcacataactcaaaagggactgccagccagatcccagagtcccccgaacgcctctgagacatccaataggtctgcccatgttcatcggcagtgccctcctggtggtctctctatgagatctgagctcagttctaccctcctcagtctctgactcagccctgcatcaaagatcctcattctactctgaatagtcagtcagcagacagacagacagagacaggctggctgctggtctgtcctccactccagaaatgccttccgtgttggggggtggcagccagcccctgctgacactgcccctctcctgtgtccacagattcgatgtacattgagaacctggaggcggtgcagaagctccaggacctgctgcacgaggcgctgcaggactatgagctgagtcagcgccacgaggagccgcggagggccggcaagctgctgctgacgctgcccctgctgaggcagacagccgccaaagccgtgcaacacttctacagtgtgaaactgcagggcaaggtgcccatgcacaaactcttcctggagatgctggaggccaaggtgtgatggcccagcacatggacggacggacacgatccaagtggagacctccacagccaccagcctcgacttttttcacacccgcatcggggctctgagctgtcccagaagaaggggtcttcttgcttcctggccatgtgcagactcctggggacagcagatggggaggtggggatggggagggtaggggcggggggctcatctgtcacccgcattttctttggaattttttttttccttctccatgggcagtgctaaggcttgggccagggacgacttcccttagagctggagaccaccagaggaagcagccttcctgcaagggatccatttctggacctctccctatttaggacctggaggtatctggatgggcagtgcttagtgcccgggacccaagagacatagattgggggctcctgaaggtgttggtgtcacggtgggcagtcccttggggcagaacgtctctgtggcctatcccgaggctctgttcctcctccatctagctggctccctccactttcccctttcttattgtcccagtacacccagttctcagtggatgctcctgctagagtagccacatccccaccccgaagaacccctcccctgcttcctgcccctacctcagccagccggaactcactggctcagaaaagagttgggttctgtacccactgctctttttgcctgctgtttctccttctcctcttgggcatggccagtctagaaacctatggagaattcaggacctggccccaccagaggtcacttgagggactctcaaggtcagtagcttaggttggggtgtaggatagcagagagacccagcggtagagggaaagtctcattgcacctcggaaaggaaggagctctaaaggtcccccttggcccctcccttacctcataaaaaggcaaggcttggctttgtgccataggagggcagcctcctggcatttgcaccagggatgtttgatgcagccctcctgggtcaattcccggcaagaccctgcagtctggttgtcgtatagggtgctccaccaacccaccgcagtcctaaaacccctcagccctaggcacatgaatgcacctttcacccacccaaaaggcagtcccaggctcatgctgtgtgtgtccttgggtttgggttgacaggatgtcctaaagatgaagcggttcattctggaaaatggacacgccactttcatgacaagtcctccggctttacctgctctgatcccttcctggagtgcaagggtcccctctttcaggcgttctggcacctgccactactgctggctctgcctcccgggtgacacctctaggagactggtcacttcacagacttaatgctaaacttccccagagagcctttccctgcccttttgcccacaaaggggttcatgcctctgcatgggctctccttgcccatgatccaaggtagataccacttttgtgttaaactgggttaactcttaggggctgggtttagctatcctggcttctgaaaactccccccagccacactgtggagagggggtgtcacctaaaattccacctagttctcagaatgtcttctgggcctatgaacacaccagcaagggttggacaaacacccacagctgcctgagcggacacactgctttgaagcagcagcagcagcagttaaatgggcacctcggctcggctccttgatctagtgatgcaagcaccccatacggctgcttacctgccgaagagaatggaccagtgacagttgggtgccctgtagggaagctgggtgccctgggcacctggagtcagagggtagagcccacttgttcaaagactagccagatgagagacatctgtgatgccagggtgctcaaaacaggaaaaagcaagagagaccctctcctattcccacctccccccagtcagagcaaaaacccaggctaccttccatatccatttctggaacccatggagaggaggcctctctctgctagtgtgtattcagataaagattatttcaacccagaaatataaacatagctaaccttgtaccttgtagaaggaggtgctggctgggatctctttctctcgttccctaacctttctgaagattctggatggttctggcgtgcctcccaggttttgcatccgtgaacagatgacttcccatggacagagcttgagaaatacgaggctctcatttgggcctagcagggtcagagcctttactatctgtgcctggtccttccctccagacttgactactcatgagaaacaggtggcaggcaaggatgacagacgtgtgacaaggagacaggagggcccagagtccaagcccatggaacagcaccaaagagaagcactatgtggagagattgctttattttctgataatgacgttgtggctggaatgacttaagatgtatatattttttaaccggcagtccttcgtgctgtctcacccccctgtatggacatgtcctcccacggccctcatgtaaactacatgccctgggattatctcccatccagtcccatgtatctgaaatctaataaataaggaaaggtctgctgagtcgttcatgcgttgtctgttggagtacacggccctctggacagcatcgctcttagggctcctgttgataactggagaggtcagggagagagcacctgtgcctgagaggcctcgtgggtcccggctgcatggatattgcaaatgtgagcagggcttagccagcatgcaagaggccctgggtttaatatccctagcgtcgcatgcattgtgagcagcaacagttgggacatctgatggaggtcggggacgccccgaggctgctctccagggagatgttcttctccatgagtgcctgagaggtgggacatcacccacctgagcaccgcatgcgtccaggttcttggtgttttgtttaacgcattgaagttcccataacttgcaaagtcacaaggaacttcattcaaaagtaaggtaccgagcagacatgttgctttgcagcaggctccttaa

SEQ ID NO: 21365 - DNA, 2968 bp, Mus musculus
tagctctccctccttcccccctccctgtctctatttccctagtaaccactcgctcctcttctgcaccctctgcttttcttcctgcaggccttcaggggagaagaagcccgcagagcccaaagccatgccagacctcagtgggtaccagatccgggtgtgaggcagatgccagcatccccagatctcctctgcgtctggaggcccaggaaagaaactacttcatccaggcaggggctagtgatggggtggacttggggtgggaggccagaaggaggccttgccattcagccccaagtgacttgccctcccatgaagccaagcccctaactttgggccaagaagcagttagtgttttatttggagttttagctctacaactgaagtataaggtatttgaacagaaagacaaatggatatgttggtagctgtcagggtctgttctctctctctgagcactgcgtggcttggggaggagggctgcctcgttctgtggtgctccttctctcaacagtgatcaggtttatgagcctccccagcctgtggggtgagggtggggcagtgtaggaatggaggtgttttctccaactgggcctgtcctggcagaatcatgacccagggaaaggaaagcagggtgggaggttctcctgagaaaggtctatttgtttttcaaatcaggaacttggcagaagccacatctgcctaaggtccaggagagccctttagatagtactgtgcaccccccccacctccccctacatcttcaccatggccagtttaggactaggctataggaggaccaggagaggactatagtgggaagagttctggctcttagcacatctgctggctccgtctagttctgactattgctgcagcccaggggctccctgaagaagggctgggctttgtagagagcccagccttgtactggggacaccatgaccttatgaaacttggctgggcacggggtagttgagaagaactacctactctagctgtgtgggagtgggctcttctctccccatctaataatctcagcacttggtggggaaacaagaccagagcaggctgcctaacctccagggtgccttcccaggcctagctgcctgtttaggcttggagtagtggccagttttagcagctctttgggacactggcaggagggggtgggagttgtctgccccctggccctggagcacaagatcccaggtagaaaagtgaggtgtggagaggggctgtctgggctggggaggagaaccagcccttgagttgggaatgtaagtgagaagggctgagagaggcagttcaggatggggatgcggtggggactgtgtggggaccgagttccctgcagcacaggtggcactcttcaagttgctggagacttcaagtgacagagggcagctggatgaggtggtgaccgttaagggactttactgagaggtggagtcagcttgggcagctgccaataagactgcagagggctgagggctggctgggataagagctagagacctagggactcaaatgcctacagggccagcaagaggcaaagaagagggctggatggggactgtgtcccaccaaagagaacatatcccattaaagtaggatgctgccattgtactgtcccacagtgcaagccctaaggggtgtaagcccttttttttttttttttttttttttttaggccaaggctctgaactaatatatgaattgtaattttttaaaagttaccagttcaagaagtgatcaccatagctgagggagtatcagtccacaatgtctggggtagagagcatgggctggttgtggggagactgtgggtggaaaatgtgacagtttaaagtttcccaaaggcagcaggagccacttcctgtatctctctccttagccccatcctgcaggcagaggctgagtttgtgcttgctgggtagagtaggatagaagggtggaattcttcctgcctggaaatggatggtggctggaatgaggaggaggaggaggaggaggaggaggaggaggaggaggaggaggaggaggaggaggaggaggaggaggaagaagaggaggaggaggaggaggaggaagagggatgcccctgctggtgacacaccaacagctcctgggcccagcacaggcaccatgggggggggctgagtgtttagtcccttgtcttgcctggttcctcctggggtcaggggggcccttggaaagtgcatagcctaggctacaccctctagccagacccatgaaaagacatgacactatttgatccatctcagagttcagggagtagggatggcagtagctcccatgccttctttgagaggtataagactggacaagatcttttttggatctcagtgtggctgcttatccctgggacagcagccctatgtgtctctggaaacttcaagatatgacaaaatatgggagaaggaggtgtggggagagctagagtcaggtgtatttggagaacagcaccaggtcccagagccttaggacaggagcgctgagctccagttcctctgaggcccaggaaagaaggaagcagggggagccccgacttgttcaggatttgagggagcagctgatggctaggggtacacacacccctgctgttcacctctcccaggctaagggcgtccggcctgtggagactgtcataggctgtcatgggccacagtggtgctttttttattattattttattttttactctttctcatatgtagcaagccacgcttccctctgtggccatttacacaggctgtgctcttgggggctggcctggctgtctggtttctggggaggcagaggcaaggactttgaggccttagtcaccatccatgacatcacctcatctcacttcctataagagccagggatctggcagatgtctgcagacctcctgactcaggcctgccctttcagctcttctaccccacccttggggactgctggc

SEQ ID NO: 21366 - DNA, 1226 bp, Mus musculus
acccatccttagtgggcatggccaagcgggtagaacagcagcccgctggccccagacttgatgatgaagcctagagactgggtactgaggaacagattcaggagactgaccatggctgatgtctggtccagtcagatcatgccctgacccctttccagctgggaagacatcctggctcaggggaggagtaggtctaatgatagctgtgcaggctttgtgctctgaggtctgtgcccgtgtaccaccccagctttcctacctgggatgagtttgggcttaacacatcagcgcccaccctgacatgctgtcagtggtgttaaagtgcaaggatgcacaggtggggaccaataagccagaggtgtgaagggcaagggtattctctgaaggagtggaggtgggagctagggattctccctacgggtaccacagcctctcccagcagcatctccagccaggtggggctgtcactgtactagctgtgagtcctgtgctaggaccccctcactccagttcgatgcactggggtcccaagcttccttgttaagtctggaaagaaatctgggtacacttgacccctgggccagtgatgacggaccgcccatcccctgtgctttgttaggctcttgtgttgtccctgatgccattattgtgcccttgtatcagtattacccctgcctttcagtgcacactttgtctcattcctttctcaccttcccctgaaatgaataaagtctcccagctcccatcgtatgggctggcagaaatcacgtgaaaccttgtctgattttctttgggagctgtaacccaggcccattcccaccctcatcagccccactggctgcatgcaggaagaagccaagattcccaagtagatggaaggggaaccaaactatgaggaacaggaagcctggattctgactctcagcctgtcaaggctgttcagctcctcctagccctaatctggagtcaggtttcccatccagctatgaggtgcctcttcctcacccggctcccaggagatagcccagccaaagctctccacagtccatcaggagaaaggcagtccatttcaggaaaccacagccaccaagatctgctcatcagatgcccatccatggctctgaggaaacctctggccccaccactttgtccactggctctagacctcttagctacccacactaaggcaagtgccaaactgaaaagcaaaccaacacacacacgaa

SEQ ID NO: 21367 - DNA, 1219 bp, Mus musculus
tctcttggagcgggactgcccagcacagccaaagcctacctctgcctagtccatgtgctacctatcatgagctgctgggctagacacaggttgaaagcatgacatagtagctgtgtgctgccgggaagcagcaggtgtggggcccttctctcccagtcagtcatctcagcatcctgggcacacttgttatttctggagacaaattggcccccagcctggagcaagcagctcagggatgccctaacctcagatctcctcactgccttccttgaggaaagcgggtggatgccttgtgctggggttcactgggctggcacagtgctgggaggctatggcatttgaagggtgaggagactgagccttcagggaactgttgtctcaccagactctgaagaactgggtaagagttggagtcccagcagaaagagcaggaggctctacagcagccttggccagcactggagccccagagggcttgatctctgacctctgcgtacctaagaaagtttcttttcttcttctctctcctcctcctcccctcctttgttccctcccattttctctctggagaagcccgctgtttagctcaggccaaaacatctcaacagaagcctggcttggggcaaactaggtctaagaactcagggtggcagtgcttgcccatgtgctctgccttttcctccccaaacatgggctccgcccgctcccctaacctactgaaaacccctgcagcccagaccgtgtcacctgcatgccttactcactgctggggtgcagcctagggtgacctcaggccagagcctccacatagcttcaactcagaagatctgctggcccagagatgaggggattgactgaggctgcagttaggcatggtggagcagcagttacacccttcccttgagttgaaagccagagacctgtctggaatgctgctgctgctgctgctgctgctgcgttgctgactctcagcttcccatgctcaggtctgggggacgtcttttcttatgtgtgtcttatttttaagttttgttatctgggtactggacatctgcctgtctgagccccaggcccatctgtctgtccacagcccacttttcaccgtcactctctgggcacctcctgagatggttccacaaccgtgccctgttggttctcagaacaggggccaatgattgttccccctgccaggaaatgcaggttcaactgctaaaggagg

SEQ ID NO: 21368 - DNA, 1209 bp, Mus musculus
ggggacagtcagtaatcactagtggttattattagtgtaagatttgtaattgtatatggtattagtgttcttggtaaataatattaacttaaagaacatgaagtgacttgtccaaagtcacagcctgtaagtggccgttaattcctttttaaagtatttatttattcactttacatcccaatattagctccacctctcatcccagtaccctgtcccacagatcttaccctcacttccccctcctcttctctgagataggagagcctcccccattcccccagcacacgagtcactgcaggaccactgaggccggacaaagtggcccagttaggggaacaggctctacaggcaggcagcagattcagggacagcccccactccagttgttgggggacccacatgaagaccaagttgcacatctgctacatatgtgcgggagatggcccttaattctaagactctaacttgggattgcatactgaatgtttatgccctttgagggcaagggaatggtgtctatcactagtctatcccagtgccatacacatagttggcattcatatatttgttgttaagtgaaacaaagggggttttgctgcccacgtggagatgtgcggtgactgctgttgctgaatgtttcccctacacgctctgtccattcccaggctgctcatgactttggcagaggatggtgacgtagacacggtaaagtgcttgctgcatctcccatttggttttgccctgtgtttccccaataccagactcaaggaattgactttggtctagaagatgccgagctgaggatggcagggtcaacctgtgtgcattatagattaagatctgccgagagttggtctcccttgtgcagcactgtgtacatgtttctgaggcgaacctcaggaccacatgctctacagctctgtttgccttgacttggtccccactctctcttcactgttttctatcacacggacgtttgtttctagtgagtaggtaaagttataattagttccttattgttgccttccctggagattagtggcttgctcattccatgcgtacactgttgtctgatggcgtatgtttgtatttgttcaaatgtcccaaatcacgagtcctttcgtttttctatcctggcttcctcatgcccacctggctttcctttccttttctttttttggtaggtttctggacaggaagacttctctc

SEQ ID NO: 21369 - DNA, 1173 bp, Mus musculus
cagtgactggaccggccttgcccagtcccctgatagcagcctgccaaacctcttcctcttgcctcaagacctccgcacttgaggttccctgttgtggtttgaatgggaaagtccccacaggctcatctgttcgaagacttggtcatcagggactggtactatgatgagatatggccctgttgttggaaatgtgtcactagagggtgggttctgcaatctcagatgctcaaaccacgcccagtgtggtactctcttcctacttcctacggatccagatgtagaactctcagctccttctccagcaccaagtctgcctgaatgctgccaagatgataatggactgaacttttgaattgtagccaactccaattatatatatatatatattataaagagttaccataacataagcaagggggacccacagcaagcaagggggtgggggaggaggttgtcatgagcatagtgtcttttcacagcaacagaaaccctaaactagcctggtggtggtggtggcgcacgctttaatcccagcacttgggaggcagacacaggcggatttctgagttcgaggccggcctggtctacaaagtgagttccaggacagccaagactatacagagaaaccctgtctcgagaagaaaaaaaaaaaaccctaaaccagacactctcctgggaggactttttacttgttatttgcatgaaaaccttcaggtctcccctagaatgataccttctcttgttttcagtttagttttttatttgtctgttttcttttccttttaaaaaagatttatttatttatttttggtttttcgagacagggtttctctgggtagcactggctgtcttggaactcactctgtagaccaggctggcctcaaactcagaaatccacctgcctctgcctcccaagtgctgcgatttatttatttcatgtatgtactgtcattgtcttcagacacaccagaagggggcattgctccatgttacagatggatatgagccaccatgtggttgctgggaattaaactcaggacctctggaaaagcagttagtgctcttaatcactgagccatctctccagcctctgtttgcttgttttcttttgggggttgtaagcctggcctttaacagctgagctatctctttagcccagttgccaccttctca

SEQ ID NO: 21370 - DNA, 1272 bp, Mus musculus
gcccttcccccacctgcctccacctcccctatccaccaagatgtagaattgtgaatataactgcaaaaagttagtcttatgtatagacattattttcgtcgtatgtttctatattttgaaacaggtatgtaacttcttcatttgaaggataagctggtttgtgttaagcagtataatattgattgggtctttcgcatcatattcgttagcatttatttggtggcagaatgtttgcctaggtacagaattaatagcccttagcaacgactgctgctggtgtgtatttttgtaaatgttatgcactctgaaaggaaaacacacaaaagaagagattttgtcgttttttgttttgccaaggccagtgttgctgcctaaaaaaaaaaataaaataaaatacaaaaatacaaaaaaacattgatactataaaatggtaaaaagcgtcttctttctaaacagccccagtgttgaagtctatacttaattttgttctgttctgttttgttttcctgttttgtttgcaaaatggtaaggggggtgttgggaggggatgggtggtttgtttggtttttttttttttgttgcaagtttgtgaagggggaaaatgttttgatttgtttctactgacctgaatgtgttggatcttcacgtgtcgttttgttttggctttattgatgcacggatgcttttgaacagtagagcgaaatgctagacatggagaacttgctctgtttgtcctttctacatttctgtagttaacagaacactgtaatgtgccttgcagcttagtaacttgtaataaattcaattgatattaattctgccctgagtcagcaaatttgtctttctagggttgaagctatgctactccaattaaggggggacaactgtttacctcctacttggatggaacctggcatcctggttccttggaaggctcttgagcaggctgccccaccccctgggtaccagactgtttacatttacctcccctgtaatctacagttgctgactaagcgatttctgtttactcttaagcatctttacccaaccccccatacaggacccagctgcaaaaaaaaaaaaaaaaaaaaaaaaaaaaattgtcaggaatgctctttggtgtctttccccggagcgatgagtagatcctggtacccagtgcagctgtgacttaacaagtgggaacagaagggagtttattttgcctctacaggcaaggcagaattttctgtccttgcacacttaaaacaaaaggtgtctggctgggctttg

SEQ ID NO: 21371 - DNA, 1175 bp, Mus musculus
gagtaacaatcacaaccccacattccaggcgagcgagagcgggaagggatgcgacccgggtggaggcgccgagcgagcgccctgcagccaacgtgagcgccgccagcctctgtggccggagaggtgctcaggccagggggcggtgggagcctgcgtgcgtgcgctcctctcctctgctctcgtgtgtcttggaaacggtggccgcggcggccggctccctccggcgtgcaaacccagacgccgccagcgcaacggccgtcgctgcggaggggaaacgctcctctcttggcagccaccacctcctcccccggccctcccggggaatcagcggcttcagcaagattggacctgggcaccgggtggcacaaccttctaaccctctccccggggcgcctggcgtagagaggactcagatcgtagggggacccctccgcgcttccacgcttcaatcactccggggagggggccaagaggccactggcagccggccccggacaccgtagccccctccccccagacccggagctcgcagccctgatccgccgcaccaggaagaaggctcccggtgctcttctctggaccagacagccgcagtaggaggtgggggcgaggagcgtgcggaacccgtcggccgcctgggtggtggagcccccgccgagagagaggcactgctgcgccggctgtggagactcgcgctctctcctgccccaggggcagaactttctcgctcccctccgcccccctcccccgcagctggacttcttccccagccagctagtcctcccgtaggagaaggcgcctcggaaacagcccgggcgggggcctaccttccccgaggctggcatcatgtcggcggcgcaggtgtcctcgtcccgaagacagtcttgctacctgtgcgacctgcctcgcatgccctgggccatgatctgggacttctccgaacccgtatgccgtggttgcgtcaattacgaaggcgccgaccgcatagaattcgtgatcgagacagcacgccagctgaagcgggctcacggttgcttccaagacggtcgctccccggggccgccgccgccagtcggggtcaagacggtggccttgtccgccaaggaagcggcagcagcagctgccgccgcacagcaacagcagcagcaacaacagcagcaacagcagcagctcaa

SEQ ID NO: 21372 - DNA, 1211 bp, Mus musculus
tctttggcctgcgagccgcttaagagtagttgaaaacaaacctgtgggctgggccctcctttggccttggcgaggctaggaatcgccttgcgccaggaaccccaggggtgcggccggttattgagctttgcaaacccccagggcaaaggggctgtgggggctggaggctgctgtgtgatttacacatttactcctcagtcggatccgtggcggaagtatttgcctttccctaaaggattaatcttggtattaaaaaaaaaaagtattgagttagtccagggcatagggttacacaagagccactagagcatgaaatcccaggaacaacgtgattcgctgagaagccctggggagctgagcctgcaccgcccgccaagacctgcccagcctcgggcgcatgggcaagtcgagcacttagagagaaattggggagaaggcaagggcgggcgggcgggcgggcgggcagaggggttggggttggcacagtggccgaaaaaccgatccggtctcaggctgttttcttcctggaggggcggagaccagggaggggaaaaaaaggcgcagaagagggggtagtcgagactagttcctgcctcccggcatcctcttcttgctgtcgtgccagggtttggaggagctccccgcaaaagctggtgtgtttcttacttccaaaaaaaaaaaaaaaaaaaaaaaaagtctgaaatgagctgtccagggaaacgggcctagaggaagagggtggaagatccagacaagggtgctattcactgattcagttggaacaaattttcaaacccccaacaaggaaacttgagaggaaggaaggcttcgagtaggcgggacctgtcgcggtggtcagtggccatgaagaccacaggtgtgcctccccttggccctctacttctaggagccctgggccttaaagggaagttcccaccagtctacaataatcctgggatttccacaagccagagcctttgccgcaggcacttttctgcctggacagccagaaagtgaggtctcccgagcagaaagctcctcctaggtcctcaccattcctgggtcaaggctggtacaggacagccatcattgctttccttgaattgggtccatgggtctatgggcttgcctgtgcttagcagttcagcctggaactcactgggcagagagagggggagggagggagagcaagaaaaaggggcggtacttgg

SEQ ID NO: 21373 - DNA, 1198 bp, Mus musculus
tgagtttgaagccatcatggtctacagagtgagttccagggcatcagggccacatgatgaggccctgtctcaaacaaaacaaccaaaacaaccaaacctcccaaaacaaatttatcattagtattaccttctttttcttttcttttcttttcttttcttttcttttcttttcttttcttttcttttcttttttcttctcttctcttctcttttcttttcttttttctccttctcttttctcttcctttcttttttcttttcttttcttttcttctttcctttttcttttttttttaaggtttatttatttattttatgtatgttagtacactgtcactcttcagacaaaccagaagagggcattgtatctcattacagatggttgtgagctaccatgtggttgctgggaattgaattcaggacctctggaagagcagtgagtgctcttaaccactgagccatctctctaacccttctttctttctttaaaaatttttaaattaaaaaaaatttttgagacagggtctctctatgtagtctgtctattctggaacttattatgtagaccagctaggccttgaactcataatcatcctcctgtctccaccatgacagatagatggcagaagcactatctcatgtggtctcaaaaaacaaatgtttgaataaatactaaaaaagaaaaaaattgatagtagagcaactttcactgttagctgctgtcttagggttttactgctgtgaacagacaccgtgaccaaggcaactcttataaagacaacattttgttggttctggcttacagaggctcagtccattatcatcaaggtatgagcgtggcagcatccaggcaggcatggtgcagagttctacatcttcgtctgaaggctgctagcagaacactcacttccaggtggctaggagtagggtcttaaagctcatgcccacagtgacacacatactccaacaaggccacacacctccaaatagtgccactccctgagccaaacatatatgaaccatcacagctgtcctgagccttacccaaatgggctggctgcatccctccatgagcctcttaaatttgtgctgacactcttttttttatttctaggtctgaaggtagtcagtggcttgaactacccctactgggcgactagtgccaacagtgttatcccagtagagtctcagggggatg

SEQ ID NO: 21374 - DNA, 2085 bp, Mus musculus
taaaattacaagctatcatcaacatcaaaacaaggtaaaacaatcaaaagcttgagatgacttcagtgggtcctcagggtctcgtgtaagtccaccctctgttgtctcttgtctgtgcctctcccagttgtttctgtgagggaaaaatgattgtgttatacatttaaatgaaataaaacccaaggccacaacaatcagaaaggatccttccctgttctcacattgggttctcacgcatgccctgtacgatggggctgccgtggagcggtcttgcatctggtgttagatgtgggcagcagagctgaagtgtggtgtccctctcagaggcgggtcttagggtgaagagcctgaggagtctccatgtcttcggtttccctgtgccggtaacgaagtgtctaaatggtaacgatccaaaggcttgtatcctctgttataattttcatcctcctggaaatctttgttctttatgaattaacttggttttttttgaccagtatctttttctgcagagagaataaatgttcttgggggctttagtaggtcaggagttaaaggatcccatttattacagagttggttgtgattctaacataatttaaaaagtataagactcaggttggctctactctgttcataaagatatatgacttagatatgattggtttaaaaataatcaacttggtaaaatctctattctttggttaacatagaactgttacctgctgtttgctttctgaaagtttccaaaatcagagtcggcgtttctgggcaggcttggctcctcgtgctgtgctcccccgaatctgcatggtatggtggacattctgcaccccactaggaagcggcctttgtggcagaacatttggcaggaaagctgtagagacaggtgcattcagagcagcctgggcaccaccgtgaggcttaccgcgtgtcagaaggctggaagcacttgctgggagccaaatatattactccactggaaaagccctctagtgctctaagcctcttggtctcctcttcttagatttgggtttttatttcccttcctgtccccatgaaagatgatgaaagccaccatggatcctcgctgccgagtggtgggagggttagcgccccccacctctacccccagtcactgctcctctgtgatcttagaggcacagctgcaagtctctaggctgttagcgtagcgctctgttcctggtgcagctggaagcaggtggactccaggagagaagctagatcttagaaggagcactcctttgaggccagaggccagaccagcacttggaggaagtcctgagtggactggaggagtcttcattggttgcccaaggctgtaagtagcagaggcctctgcatggtatgagctcttacgaagcgttatgtaggactgctgcctccccaaggtgagaagttgatttttaactcggatcaacccacaggagtacctttgtattggcaatattgaaacacatttagaaaggttcctggctgagattggctctagaacttgctgtcgtttgtaatttactgttttcttattgattgtggtacctctgacttttcttctctagtatgattccttcagcatacaagttactcttacacacatacggaagtggctttttagccatatcctccttagggtagagactatttaccaaatgtgaattcttctaagtgtgaagttatgtagaaattgactgtgaaatgtcaaagaaaaaaataaaagtcacttacttgaaagcaatttggtctatttgctttgtaactgcttaaaaattttaaggcctgggcctatagccatgggtagagtgcttgcctagggtgtgtgatgccctgggtgccacccctagaaccactgccctccatcccactgcctcagaaaccctggaagtttcaagcattgccttgtgttgtttggggtcggctgctgaatattgaagactgaatgctgtgtgtagtggcctgagtagcctgccaagctggcagggttttaatgcaggaggtggtggaacaagaaggccatgcagtggcttcctccatctgacacgtcagagagaactctgaaatggcagaacg

SEQ ID NO: 21375 - DNA, 1129 bp, Mus musculus
ccagcaggaagtgcagcttgtgcacaaagtctgggctgcctgcttaattgcattgctggcagggactggggagctctgctctcattgccctccccaacccttgcctgcaggcccaggcagggctggtttcttctgacccagtgggggcaccatgtgggtagattctcctggagaggggatacaggaatctgtgcttggcttttaacaaggtagcccatgggacatctaacaggtggctaattttctcttatgccttatttctggaggcactgttagagggaaggaaccctagagtaaccagagggcagcctttagagccagagtaggtagcagagtttagtgggctcctacgtgtccctccctttagtgtcacactgagggcagaagggtctcttcttatttccaagtatgggaaaaaggtgccccccacatagtccctcttcttccatacccaaactggcagatacttctatggaaaaaaggccacttggtcacatcactaagtgcttattctatttggaagatggaggggcagtgggcgctagggtgctgctttgcgtgtgggctgcagcccttgggaactgacagagatgtggtccatctcagccggctggtgagaaggaagatgtgccaggcagcctaacacagccagggtcttgacccaccacactttgtctttttttttttttaaaactttccagagataatcagagatcattacttttgtaataaataactcttgttttcaatactacattgttcttgtgcttgattgcatctgacttgtccttgacaaaaatggcaagaactagccatggtatctcatagctagggccattctaattccagctgaggctctggccaggcagagcctaatgccaggggaatgtaggctccctgagcacttgcttgcttgagagtcagtggctgttgtttccatttcttaacaaaaaccagtaacagctgagcctgctctctcttgctgaactttcccagacagtatagaaagaaacaagggaaccattttctctcctaattctgagagagctgtgcagcccagcatggtagcacatttccattccagttaactgagggccccatcctggcatggtcgtctgtcaagagtacc

SEQ ID NO: 21376 - DNA, 1196 bp, Mus musculus
cagatcaatggccccttttaggatgagcatgccccctgatttgccatgaattttgttacatttgggcccctagaatgtgtgatctaagattaaagggaatggaagttaatttctctggtgttttctgggtagccatttcatagcaggactcaggaacagacaataagcacccatgcaccttcctgcagacaatatccacaaagatgcgacagaaatcaacactcagatcacctacaactcctcggaccacagtcatttcacctaagttcccctccttctgctgtctcctcagaccaagatactatgtgaagcagtttccctgtcccaagggccaccaacacagaagcccacaagagcaaggcaacaagtaggcccaggttctctcagggcggcccccaagcccagggcctgtgcctcctcagcaccttctgtggggaaagggaagatgggcatggctagagcacaggcgatgcagccagtgtcctcggaggacgtgggagaccacagtgcattctatctggagaggtatctccttctttatctgggaaggccaggggagcactgggcccaacagagcttagagacactgaccacgagggagtggcaaaaatgagaactgctggagaggatgccttatgtagtatgtgtcacaaacctggctgtactaagggtgcctagagtcatgctaactactcctacccaccccatcgtaggaagccaactctaagatggcactggtttccggtgtgcctttgtggtaaacaacaccactgcataggcgctagctagcccgaatctggcgccgacccctccggagcaggtgcatgcaaattagatgccggcagactgaccaatcccggggggccacggagccttctcctgtgctagggtgtatataagcagtcctccctgggtacccgggatccctgtagcagcatcgaggcgttcctgcaataaaggctgttgagaaaaatccgaccgtgttgtgtcttccttgtcagccgaggtgggcacaacaaattggtggcccctatggggacccgaggatctcgtggattcagaactcttcagctggggaatggcggtacaggtaagtctcccaaattgattcccggttaaaaggggggatatgtttttctcgctcgtagacccagtgtgggtagctcttatcgttgttgttttgttttttgtaattt

SEQ ID NO: 21377 - DNA, 1154 bp, Mus musculus
gatctaagcccctaccctaccatcagtcacatcaacaaggagctgctagccttagaggttttccaagtgtctcacccccgtcgacagccagatacccctgccgagctgaggacttagctcccaaaccatgcccattggtacagggaagggagtaggcccagatgctgggtgttctactgctgtgaagagacaccatgaccatggcaactctgacaaagaaagacgttcaattagcttacagtttcagagattcagtccattatcatgatggtagaaagcaaggcacatgtaaggcagtcatggtgctggagaggtagcagagaattcacatctggatccaaaggcagcaagaagagtgacactgggcctgctgtgagcaatctgaaacctcaaagcccacccccagagacacaacgtcctccaagaaggccacacctcctattagtgcaactccctatatgcctttttattcaaaccagaacaggcccagaaatgaatgcattatagcagaggatttgaacttgagctctttcctcaggaagcagcagattcatggagtccaggctatttcttccaggtccccgtattaaagttttctctagcaacatgaagccagttcgatatatcttccttctgcttgcactatagtcactacagtctgcattaattctcttatctgtcacgtgttaggagggggtaggcagagacatgaccagctctcaccggctaatgttaattgtcaacttgaaataaagctagaatcaccagggagaagggcctttataaatgtctgttgggggttatattggtaccattgaggtgggatggcacccagcatggatggcaccattccctaggcagaggatcctggggcccagaagagtagagaaggagtggagcaaccaccacacgtgcattatgatcagctgctcacgctgatgtcttgacttccctgccattatggactataccctgaaaccatgggctaaaataaaccttctctcctttaagttgcttttgtcatggacaatttgtcacagcagcagagaagagaccatgagggcagccaagaagattgcatgaggatgcaagtttaaaatgcctggcaaagccaggtggtcatggctcgtatctttaataccagcacttgggat

SEQ ID NO: 21378 - DNA, 3618 bp, Mus musculus
gtcttcacaaaactggccattggcctccatctttcagaaagctagctgtatgtcccttccggctgtagcctctctaactgcctatcggtgtcaaggtaattgtgtagctgtgttggaaagccttccttccccatctgtggctctctgacacatcctcaggacgctcatatgcaaacacactcctcagataacgcatggacataggtagtagcttgaaagtagactattcttaggtattttcctatgaatggattcatgcactttaaaaatattttatttggtatttaggaaaaatggacttttaaagaagtatatattgtcccattatatgattacagacaagttaatctgtaactgtcatatattcatgggattaaatattattgtggagtttataatatatacattttgattttgacgagctgtactcagttccttctttatgaggaatgggcaaaatccaaaccctaaagtctgtgattgtatatttatgtttaaagaccactctgcgaaaagttgcctttaatgtcagagtccatggttctaaggtgtgggattgagtgaccctagtaattatgtgaagacgtttttagtggacagagagaaggtgcaaattaagtttgtgctgcttcagaactgtcttttaaatggacagtgaagggtgtccatttaaaacaggatagaacagaggctggaaaagtgaacaaaccatcacgtatgtcctggaattcattcactgcattagtgctactttgttcattggaactgttttgtaagccagagccttacttgttcttcttgtgctcagtggagaactctccagccctttgtgccatctgttagcaggatcagctagatgcatttttgggtaggtcttctctgctacaggtaaccctgaccggaggattggtttcctgtctccatcctttggggctgaagagagagtcagtcagttccacttgtggtgcagacgctacagttgtgaatgtgtcctcaaaggcatagttaagatgcatttgtctaacagcacaaaccctgcagtcacgtgagtgcttaggtaacaagcaggcctcgatagcctgacagcattgacatgttaaaccacacagagcacaccacacagcgttttctctgtcagggcttctatttagagtttctcctgaggctaaacatccacattaactcctgcccctatttttttcccatgaccagaagtgtagaatgtctacactttgggaaaggggaattacatgttcccttcagaccctttgctgtttgaaaaggcaagttttcatctgaaggaagggaaccagggtcctgttatacgggtagttggttaaagggtgtgggttctgtaaaaagcaagtccttgtgcccattgtgtgcctgaggtcagggagctgcacactccttctttggggagtagaaaatgaggatcagaacccaggcacgtgttgggtacccagttcccaatgacccgagcaagcactctttagtcctggtagcattttgggtgactctcaggcaagaacttctggatctctgtgtatctgatgctggtcactgacagacttgccctttgtgtaacttctgtaacacctgtgggcattcccaaagaagatccatttatctaggtgatgtgattagagggacttgtgatccagtgtgcagagaaacactgtaagcactttgtggccaaatttgcagtcactgttcctgctgagatgtaatgttgcccccttgaaccaagaaggctaaccagagactctgaaccactgtctcaaagctaagaaaacacaatcaatgacataaagcctgatagggtatcgattgatagactggctcctttacaaatcgtcattcctcatgaactaagtgcaaagatagtacaccctggctgtgaagttgtagggctggtccctggtttgaacccatgatcggattcttagcatgtagactactggcatggctcttcattcttagatacaataaaaatggcaccccagagacctagaaatacaccctgctttatgaaatttcagtttcctgtcatttaattggaagcttttttgcttatctggaagtaaaattgtgtatgtgacagtatattttctgaagttctgacaagatcataaaaggttctgaagtttggagttgaataatgtatagtcttacagaagagcccctaacccactgtcagtttaaggggtcctcctcggctcctccccactcagggttgaaatgcctggtttttagtggctctttgttatggttattgttcattcttaggttcaggccagggctcatccagaaaacattatcttaattccttccctcatagccttaatagtacattttattaagacatgttgaaaatacatctgtgtcctgttttgagattattgttccataagtgaattagctttcatctaatcagtctgagttatttccatttagccttgttaaagaacaagccagtctggaaaaagcaatcccgtgatgcatgacgttggtatatccatgttctctattttaataatgggaagtattttgaaacccacagaagaaatgtttgatgctttgtaataaaaaccaaaagcatttgcaaatgctttgtaatcagagtgatagattctagagagcagagtagataaggataatgggaaggcggggaggtgcttggagatttcctaaaccacgctatgccatttgcttatatatccaaagggctactctggagccattgcctgatccatcagtggttaaaagtgattgtgtttccttgctaaatgtttaagcagctgacaaccatgagacatgctttccttactgtttcgtatcgtatgctgatgccaaccaaggtcaccaaaggccttgaaggagaactatcacatagtcttgtcttttttcttcaaaatataaacaaatccaaactaatccatttgagtcaacttgttttccatgtctccctgtcatgagaaatgctgtccacatgtatggtttccacactaagaactcggtaccaattgttacttagtttttctgttctactgagtggtttttcttctgtcagactatattttctcacctcaaagcactgaatgtgttgctgtgatacacggatgaatcctgagccatggttttaacagctcagttctggtgtttttatattatgtgacagttttgtgagatgcttttgtgcatttttttgtcttcttttccaagttttgaaatctgtcatgaataaactttttcactgtgcacctaaaatatttgagttctttcttaataagcctttttttctcttcagcttaagaggaagagtattcagtgaacacttgtgaatctttcataatctaagattataaaaattaagaaaaactgagcctaagatgaatgtctgcttgtatgtaaaatcctatcaaagggtatagaacgatagctcagccatcaagagcacttgctgctctcgtaaacgatccaggttcagctcccagcacccacacagtggctcacaaccatctctaactccagttccagagaacatgatatactctcttctggcctccggtggcattgcacactcgcggtacacagacatatatacaatcaaaacac

SEQ ID NO: 21379 - DNA, 1145 bp, Mus musculus
ttactaagggtgctggtagttgatgaagaaagggtggaaggtaaccactgagttatctcagaccctgcccttttggaaatcaggtattagtccccgcaccccatcttaggccatgtgtgttatgtagaaaatttgctttggtaccaaatacagtgaaacccagacatgtttgccgtgattctgggtttatgttttttacactgaggacagaaagcttttggtgtccatggtccttagggaaagcaatcatgggattttgctgttgctgctgactgtgtgtgcatcttacttgaccaaagcctgcaggcgacagacagcctctcacagccggttccttctgaggttctggagcggcagaatgtattgtagtgggtggccacagagcggcaggtgctaaggcctctggtggagtgggcacacagtggcatgggtctctgcagccatccatacctctgtttcccagtctgtgttgtctgtcattcttctgaattttgaataattaggtttatttattactttatttatgttttttaaagcacatttcagattgcctttgaaacagctcccatctgtttctcataaggcttcccatctgctctgagccacgaaggccacctcttttatggcgctaaagatgattttagggcttagaaaatgatcatgtgtgtttattctaacatgtcatcctgcgatgcttgggaagtctggcctttcagagatggaggactccaacctagtctgtgttaggtacatctcagtgctcccactgcgggattctaaggtgtgatggacgcagatcaaactgactggggagtcagagataactgagcaccatgattatgggacgccaaagtccttttcctcctctgacaccctcttcataatgtttccgttggcaccttcctttatcatgtggttgcctcacaccaggcctctctgtcctacagaagtgatcacccaaagagcaggatcttgccagtaggtgtggtcaggaacaaaggacgcaccctgtagctgtcaacctggaagcaaagtgtgggctgtatggcccgccatagcctctcagtgaccagtcagcaccacaccgccgttctctcgtcattgcagatgtgctttgtaggggtactggcaaaagtctctgtgcc

SEQ ID NO: 21380 - DNA, 2564 bp, Mus musculus
gccatcaccaccaaagccgactgtactttgcctcatgcttttcatttagcattgtccttactcctgtgtttgtaagacccacttcacagcccacgtcaggaaccagaagataatcagaatcatgcagaagatttggcccgaggggcaagggcagggaataaatatctcctcttcatagtaaccttgtttaaaggatctagccttggagctgaagagagggcttagtggttggggacactgacttctttttcagaggacccgggttcaaatctcagcacccacggggtagcccacaactgtctgtaactccaagatttgatgctctcacatagacatacatgtaggcaaaatacataaactaaaggtaaataaataaaacttggtgggaaaaaaataaccagcccccttccacccttcattcacagtcttcacttctgactcaaaccctctcgtaggctgaagggtagagcgtcctcagagagatctgcctctgagcctggactgacattctggattctgcctccagaggacactgacaagtgctggtgcaccatatggggagctgtagggcagacaacctgctccttgcatgcacaaccatgcactttggtgtttcttcccttattagttaagggtatccatatctgagtctctgatgactggcaaggtatatagccacattacctggtgtgtaatatatcttgcaaaaagcaagataaacatctggcttagatttcttgactttagacaaagggggaaatgatacctgctaccacctgtttttccaaactgatgaatctacctaattgcagtattttgacaaaacccatagaaatgtaaataaatggttgctgtgggatcaagtatggtacacacctgtaatctcagaaggcagaagcaagcagatctagaattataaattattctgtgttacaaagtgagactctacagaaggaacaaaaagagagtggactattgctatgacttaatgtcaggacgctgttctcccagtgttctaggtaagacacagctgcgtgttcgtgcctctctgcttccaacatggggttagttaagaaaaggagagcagtaggctttcctctcttcctgtgccaagctgatcaggagctgtcaagtatttctcacaaataaaaccacgttagcctggggctatgaagggggagttattaaaatcgggggttagttaagaaaaggagagcagtaggctttcctctcttcctgtgccaagctgatcaggagctgtcaagtatttctcacaaataaaaccacgttagcctggggctatgaagggggagttattaaaatcgggattctgcttggcagtttatcaaagaatatatagtgcctccaccccaccccctccagttccagaacctatggataacctcttacctgcttactagtatactcagtacccagcaggcatcttaatccattaagctggttaatcaaaacaccttccaagtggagaaaagcatatccttcctcccctctgccttatccacgtgaagtgtgtgctcgggcttctagccagcgcacagggaacagagggaggcccaccagggatcctggcttgcctaccgaaggctattgctgctgtagttttcagtgacttctgtcttctaagatgctttttcctgtagattgaaaggtttctaggaagaaaacaaacgggaacttgcttaggccctaatgatgagcgttttcctctttgtggagtctgaaggctcacattcacagtttacccttaggagcagcctggtgggcgggagctgtgagcttgtttgctacgatgtggccttaaaactgttactgtttccagtgtgatgaattctaataagtcaaccctgaagaatgctgtggctcttgtcccgtgtcactgcttttgtgtaaagctttgttctttgggagcagttattggagacggaatgaaaggtgcttgcaagaacagcaccctgatgtgctcagtgtctgtttcctgcgccctctgcactctttccgtgtgcaaggaactccagttaactcaaagtccagcacaggtcccaggtaattcgtgtacacatcctgagtagagaatgtaccaagggtggtggagttatcgtcccccttaacactgtatgtcaggattagtttagccaatagttggaattaagagcttccttactagtttgttcttcacaggacatagaaacctctcctgtttgtttagcctgcatgcccacagtcttgatgatccctctctgtacaaaggcagctaacaataagggacgggggaagagaagagaacaggtgtctgtgggagagttgaattagagtgatcttgtagatccacgttttcccactgaccaagttactgtaggctggagtctgcaaggtgtactgtgtcgtgaacccttttcattcttgtaatgttcttatcatctgggaatgtgagatttttaattttaggaataatcttacaaataatcactcttctgtagccgtcttgccagatgttttatttttctttattttattttattttatattggatgactgtgaagcta

SEQ ID NO: 21381 - DNA, 1210 bp, Mus musculus
agaaatatacatgcacacacacaccccttattttttggtagagaactgctaagtgttgacatcgtaaggcagcttttttttgatatttaagactgagaaaattgaatcaacaattcactagggtaggcaagtctagggattcggttgcaaatacatttgggtggtttagtgcaggttcctgacactgctgcaggcagaggtgaatcaatggctaaagccctgtgaagctgctgccttttggctagagtgacaggagttctgtcacttctcccagtctgctttgggcttctttattgcttggtggtcccagagtatcattgtcttactgggcagcaggcttttcctacattaagtactgctttgcatttgcatttgtcagagctagacactaaggcagcccagggtcaaggactgtggccatagttccccacctctccgtaaaaagagaataaaggaattctatcaaattccatctgccacagtaactcccacaacataccttaaagagaaagtaaaaaacaattatgcaccatttcatttcggctgctttattcattcatgcgtttcagactatatgtgcacactatagatcttcagaacatcattactacttttcctagtttcttaggaggcttctgtagttgtttatgctttgatttttatccccagctctctttcaagagtgggtgtcattgctgtgggccaagacacataaatacttattccttgaaaatactcagctgcaaatttcaactaaaagtcaattctcgagagacctagaatatgttaaatgtatttggttggtttcccttctaaattttcactggttctccactctacttcttttggaaattaaagggccagtgtgtgctttcttagctctgtaagaatctttagatgtctatttgttttgtcttttcttccttccatccatctttccttccccccaccctttttttttttttttttttggagacagagtctcaccatgtagctctggctgtcttcgaactcactatgtagatcaggctggcctcacactttgagatctgcctgtccctgccttccccttcttagtgctggtatcaaaggtgtgcaccaccgtgtctggcttggctctattcattttgtttggtattgttcttaaagtgtatggctacatgtaatatggacatttttgatctggaagtcctctaagtgtttaagaata

SEQ ID NO: 21382 - DNA, 1744 bp, Mus musculus
ttgtgttttctttttgttttagttctggatttttgaagatgtattccttatgtatccctggctgtattggaatttactatgtgagccaggctggcctttgtaaaccagatctgcttgactctctgctcctgggtgtctcgattaaggttgtgcaccaccacacccagccatatgtcctttattttttggctagtcagaactttgttgtttgaggcagggcctcttatatatctctggctgtcttagaatatgacatttggaccaggctgactgaaactcagacctacctgcctgcctcattaccgctgggactcaaatgtatatgaataacttgatacttgtttattattttatataaatgttgcagttgaggtttttaaattagctgtaaacatggaaatgttaattcctaagtattcagatccagctttggataagtatacctttatttttagtgtccttcatttttccacagggtatggacagtggatttgcaggtggagaagatgaaatttacaatgtttatgatcaagcctggagaggtgggaaagatatggcccagagcatctacaggcccagtaaaaatctggacaaggacatgtatggtgatgacctggaagccaggataaagaccaacaggtaccgtgtagacagacagacggttggtgttccgtcccgtttacagcagccaaggaagagtgctcatgacctctgctcttttcccctagatttgttcctgataaggagttttctggatcagaccgcaaacagagaggccgagaaggaccagtgcagtttgaggaggatccttttggtttggacaagtttttggaagaagccaaacagcacggtggttctaaaagaccctctgatagcagtcgccccaaggaacatgagcatgaaggcaagaagcggaggaaagagtagagggacctcttaaaactaaatctgacatatgcagcagaggactgcctggtctggcctcattgtgaacagatgtccccaccccctccagacacttgagactccagggaatagggcgtcctagtgggtgggggtggggacatcctcttggaaatgggggaggaggaatgggatgaggaatcatcagagagatgaccaggagggagataaagactggactgttaaaaaaaaaaaaaagattaaaaaatctcgatgatagatcccagcactccttttcattctgggatgtaggggcattgattattctatttcggagtagtttttttatatggaatggggttatgtttgtgcttctccaatcttgcagcacttagaaataccactgccccacacagaattgagattccttccttgtgtgtgacactaatccagctgtaaccttttctgtaaacgttatgaataacctcacctcaaatggtgagtgggctaatgttcacacactggagctctgtcaactgcatttgccctgtgtgcttctccaccgcgccatggggaactaaggtcttgcttagtgcacctcatttcaaataaaaacgtgtagaaaaagtctcaattctgtttatttagtggacggtacactgatcatctcagaaatctttcttcatcagatgtttgagctccgtgcaaagcctttgctctttgagcttgaacgtggatctatgggagggaaagcactgtcagaaaaggtaattttttttttaaagaaacattaaaggataatatagctacttacaagtttagaaactcatacccagtgact

SEQ ID NO: 21383 - DNA, 1156 bp, Mus musculus
atcagctagctcctcagtggggattataaccaaaattagaacttaggccctttctcctccaccttctctgtctccctcccacagatccatgtgggtccacagtagaactttcagccacttgtaactgtcaggaaattggcagcaggagggctgaatagacccctttgttagcagcacactgagaatatccaatagttccccttgctttcagctcctagggtagggaggaggacagagcctgggtaactcacagagtctggctgcagtgggaactggctggtcccactgggaggtcagctcttagagtttccctaaaacgaagcagagcctctgcctgctaattgggagatccagcatctttgccctgtgtcatcactggcctctcctgctagagatggacttccagtccaggggccacccccatccactcattgctttggctctagcaagctaaggctgtaatggtatctcactagagggggctctgatttttccagggggagtgtagacacatgagtaggtatactgatattgtggcttgcttgtgaccagtggactctgggcgggtggaccctctgtgagtctgggccactatccctgctgctgggaaaaaccagtatccagatggagagaccttagtagacatctaatttttcaagaacgaagtaaggtagtcctgcctctctggccctcagttctcttagtggagatgatggaccagttgacctccaattaaggatcctttatatttgaatattttatagaccagtgactctacggcttagtgagcactgactggctcaagagccatatttcagaagcgttggaggagtgcgtatagctatgcagattcctgagaaccacccctgggtacacaggagagtctagaatgggaagaagggttgcagagtgtccaagtgagtctgcagcggatctcactccagtgcaaagcccttgagctatccgtgctcacccgaatgtgtacatgcaagacctaccttccagtattcaccagtagccagcagcctgctggagcctgtttatatccctgaccatggtagcatatacagccaggatcatatttacaagaaactttaggagatggtgacagcaatttccattggtcttggattcagccctagtcatcaggatccca

SEQ ID NO: 21384 - DNA, 1140 bp, Mus musculus
cacctgccatctttgatttttctccatggttctgtgctggggtttctcacttgtttcttttctcccctctttctttctcacccctcctctagacacaagaagagggatgccggctctttcttcagaaggactcagatatctttcagtgaggcctttagcctgtggcagatcaaccttcatgaacttctgcttcgagtgagggccttgaggctagcttgctgggtctcagctctcctgggctggctgactcgggctccacacagaatgtgatggtctttccctgccccttcgtagtgtctttccacacctcattccttccttcacgctgggacgacccactgacccatggctgcctagggttggctgtggtcccagagtggtcatccatggcaccctcatgctctgccattggagcccctgccttggggtggccttgtcttgaggtcctggaatgtcctggagagtgagatgggataaagcaacctctctcccatctcctgtgtgtgccattgacttggtcatccctacttttatgaggactgtgagaatggaccaaccacctgtgtcacaggggcgtgtttaacttgtagggaataagtagaaactcagaacctgcagagaacagactttatatttttgctgtatcactcccaaagttgtctcgcctcagtgaggaagactgcatctgagagggaacgatgcaactgtgggctcatgctgtcatggtgacaccttcagtgttatatgtattgtatatattgtttattgtaataaaccaataaacagtttcaaggttgcagggactgttccttctcaatcattgtctccatttagactttcagttgctcttgctagctgcttccttgggaaacccctaggtttctcagagaggcctaagaaagtgaagtctggtttggttatagaatttatttgctagattgggagcaaatcctcatgggtcacagtagacttaaacaccatgtaccctgagaccttgcctccagaatccatgcaggctgtaagacccctgctgctgaagtggatgctcacagacatcttttggatggaacacagggcccctaatgaaggagctagagaaagtacccaaggagctaaaggggtctgcttccatataggagg

SEQ ID NO: 21385 - DNA, 1174 bp, Mus musculus
aactcatactggcagagaaagtgatcatttttaccttatattttcctatttctgtgtcacaattttccaacccaaccttgaatttataattgatgcctttccaagatgactggctacaaggaggagaagggattccctccaggcaaatgtttccagcagtttagattcaggcacatctgtacacagtgaattcataattgctttctccccaatcaagtgtcatgttttgtaacctgttgtggaggtgcctgtggaatagtagactgcttcttaaatgcttatcaccactcacctgtcatttcagcagtctgtaactacatgaggtattttcaaactattccaattatcattttaattgcaaaagaatttctaaatgatagctgaatcatagagcaccataaagaattcttaacatcatttatattatttgtcatgttatggccagtcgtcccactgtgatcatcctggtcatactctggatggtcttgctctgacctccatcccaacacccctctcttggctcagtggcatccactctgtaggaatccttatatacttagtgggatccacgctgtaggaatccttatatacttagtgggatccactctgtaggagtccttatatcctttggtcctacctgactgccctccacatcccagccttttcaacatcaatgtgcttttaaaaccttaacgctctgtcatgcccatctaccaatgaatgctgaataatggtcatcatcctgaaactgagtcctactgggccatggtggaaagacctgcaccgaggcaggaacaataaagcaattcctttataagaacattgaatgatgcgtctgttaaaatacacttgtttattacatttcttacatttctcacatttcatgaaagtggtatattttcattcctaatgttttattaaattaccataccatttgaaggtgtagaagaaatgactctctccccacacctccgccccatgaacatgaatgcagttcttgcagcaggacatgcagttgttacacatgaaagaatttctgcatgctgcgtgagttccgagaccacttactcagtgtgacaccctcttcttcaggaccttccacttatcagtgataagaaaagtttcaaagcaggtgtacctgtactgattcacacttgctcttataaagtccacg

SEQ ID NO: 21386 - DNA, 1205 bp, Mus musculus
acctagaacagccaagcacagtgtccggctctgtcagcccggctctgtggaggtggacacaggtgggtcctgagggctctcgccagccagcctggcctgcttggtgagcttcacgccattgagagaccctggccaaagaaagaaagaaggcagacagcacctgagcagtagcacccagggctgtcctttggcccccacatgcatgtatgtacatgcatatgggtgggggcttcatgccttgcttcttagccatctctatttcaaatgaaggcgtggactaagaaggtgtgatcccccgtgttctgctgttttaatatagtaatgagagatactttcaccttttgtgtgacttcaatttgtatgtttttattctgtcttttaagaaatttctctttcccattggtttcatttttttcctgattactgtgaagaatagttaaaaataaataatttttgtgctgtatacatgcttttgtccttgaacattttatttaacacattccttcacgtgtttgtgttactgtactccttagacccttttgttttgccctattgtaaagtagctctaactgtagtaagtatctgatgaaccgacttcaccaaataacctgcagcaggtgtcccaccgacggctggaaatgtccaagccttgggatgaaatgaacagttattacggtgaagtcataaagcctaaacgtctgagtttgaatcccagggcgttgtcaccctggagactgtctcagcagttttggtttttatttcctctgttcagaacagctgataatgttttcctgggaaggggccagcaccagatccacagctatacataaagcatataaaaggaagaagtcagcaaacgttagtggcccttgtactacaaacgtcatggtttttgcttgactctcattggacgttgcattccagtggctgagcctgagacagggtgatgaggatagtataaggggagactgcacaggagcacatgtgaggtcacagcccatgcgtgagtataggacatcaggtcactgcttagttaccacatgttgggtgcctactaaagttctgttctaatttcagaactggagaggaatagaaatctctgcagtcccgctgcttgcactgcattgggtgagcacagaatttaaaagcagctgtattaggtatataagactgttgctttgcgacattagagggctgcagcttgt

SEQ ID NO: 21387 - DNA, 1193 bp, Mus musculus
gcccagacaggtctagacattgcagagatctacctgcctcatcctccacgtgcagagagcagaggcttctggtactaccagggccttatgttttttgataatggtataggatgttcagaatctggcatatactgatatttcatattcatagtgtgtatcaatttgagctggccaggtttctattgtcatagccatataactgctgcactggacaggcaagagagaagatgaactttgacagctgtagcttggtatagggcagtggttctcaacctgccagtcgcgtcagcatggggaatcacatgaccctttcacaggggtcaccttagaccattgcaaagcacaggtattgaaattataattcatgactggagcaaaaccacaggtatgaagtagcaacacagataattttatggttggaggaccaacccatgacatgaggaactgtattgaagggtcgtggcattaggaaggctgagaaccactaacgtagagaaatttcatcgtgcctagggctcgtcatgtgatgaaggctgctttgttagataagtgtgtagtaagcctttgcttaactggcctcttgaacatctcctagtctcacatctcttttcttttcccagaatacccttcttggaatgcttattgaagtatacagatatcggctttgttagatgatttttctaagggtccttacagttttagaagtagccataaagtgttgagaatcctttctaccctttgcactttcctacaaccaaatacacaatgcatttgtttatttatttgtttgatcactgtgagaactgatccaccatacatatataatattgcctttaaagaggtggaggctagcctagacttacaaatgagcctgcatgttaatcttactactaaagttagtctcccacctgatagatatactcagagtgagtactttctctagacttggggtacaactcaccctctagcgtgacctagcaagtctagtgatggtgagttatggatagaagataccgggtgctagggatttgcaggctgggcatctggtaccacatgggcttctggacggcataggagtgtattttcactcctcccggtattctctgatctgtgcataggaaagtgtcttagccagggtttctatttctggacaaaacatctcgaccaagaagcaagttggggaggaaagggtt

SEQ ID NO: 21388 - DNA, 3164 bp, Mus musculus
tgacccgaagaattacccttttgatagactgaactgaaattgcttattgtatgtggttatatttggtaaaaattgcgtgtgagcttttttcagaagggcaagaattatggtgttgaattttaattcacttgtataagaaaatttaaaactcataataggtcttaaacacatttttacttgtcactctcctcagtactcatacctctcgcttccctgctgtctgaacatctacgtaagatttaaagaaaaggatcgatgggcacagcttggagacgaagttgacccaggaatggatgcttggtttaattaggttttcctgcttgttaaatgcaacttaaagacttgggtcttacctaggttgactagaattaaagtgacagcttaatttctgtacagaaaaactgctcagtcccactctataagaggaaaccccaaatgggctctcaggaatctgttttcatctcacaaaggtcccatggagctgcagttgtacagcacacgtgagatgtggaggttttccttctgggctgcgtgtgtgcttactgtgcccgagtctgtgtgagccctgggatgacagtctgtgcgttggtctaagcataagggcaacggatgaggactggatttttattaaacaatttagtaattataaagtttcttgtgtttactagtaaaggatttttaaaattattttaattaaacaaaatttttaaaaaaaactttgtaatttgagggaaaagtttgagggtggagggggtagaggaaagtgggccactaaatacaaatttacctctttttcattgggtggcccttccaggccattggtgatgtagacttgggctccaatttgcacattggaaagaaaatacagagatttgacttgtatatcagaaattctagacatttactgtgtgttgagaatgtgtagctctgttcctgtaaggggctccacagaacaaagaggcagcctcctgggacctgcagggactctcgctcacacagctcacttctgttctagtgactaacaacatttgcattcgttacattcattcgataacttgcctgttgacttttttttttttttgtcttccatttttgtcttcctttattttgactttatatagttctggaagtaacagataaagtatatcacaaaagaaaaactgtgagctatattgtgcttttttaagaacatattttaaattttgttaatgcagttgatttctcctccccacttcgcacccttctgaaccaatttatgttgtgaaatttggcatcagtggtggggtcctcacatgataggagttagagtttgcttgtattccattactggtaatacaggttttttttttttttttaattttgtttgttttcttaatgtagctttttgaggggaagttagtttaatctcttattctcaaagcacacagcagttctggtttaagtatagaacttggcgaacaacagaatcccaggagttgctgagttgtccctccctcagtatagtctctagtctgtgtttactcagtgagatcagtaacctgaactacctatggcagcccagcagtgctgctccagtgaaacttgggctaatcagtagttcttatgctaattcagcacaggccctgcctccctgtgtagtcagacatactgaaggttagcattgcccactggcctgtttcttctagctgtacattgtcaaacatgaacaaccacttctttcagagtgacacaaagggggcttgtcttgaagcaggaactgaccatttatatttgtacctatgtattgcctaataatgacagcgtcctggactaatcctttgatctgggaaagctctgaaaggtggctccagcagccccgcactgtgctcttacgtgctgttctgttgtgttccatttaaatcaagtagcatgcggtgttctatcgtagtatcgtagcttttgctgtgtaaatgtcacttgctttgcattctcaatcatgctttcgccataacatttaactgatgatgtcatgaagttctaataaagtgtcattcctttggaaagcaagggattcccacttggagagttttaggatgaaagtagcaagtttatccaaaaggtggaaccagggacgcaagcagtgtcttcagaaactgatccgtttcgacgtgtacccagagtgacggcaccttttataggacacgatgccagtagtgtgccaaggtcagttcacatagatgactaacatggaagtgtgtgcctttcagtagatgagctcttgcctggtggtcatttgtattctcacaccaccggaatgcccgcgaacacacgcactttcttagtgacacaactttgtcccgtgcagtttctagagtcaaacaggataggaggggatatttatatgaggcgtttgtatttgaaatgttgaaatttctgttaaataagtctcacatttacactgttgcagttttaaaagtcaggctggcatcaaaattcacgaagcgtgtaccgagattgaaatgtgttattgacaagcatattctggctttagaagacaatgtaaaaaagtactagtttttatataaaggctttcttttgctctattgaaaatcaagtttttcttttggtggcttgtatggacgaatgcagagttgtctccctctgagagttttttttttttatattatagcaataatgtcaccatattagaggataagtataccgtgtataagaacagacctatctcctcttagcagttttccctttataacagcattttcttccacttgagaaggctcttgtattttcatattacatcatatgagaatatgaagcttttgagcttttgtgcaatgtgttattttgttgatctgtgtacattttcatttcatgtctccttcctacctgtctgaatcagctgtatcagatgtggaggttttggttaatggtttgtgtgttttctcatccttattgttcagtttagcttttcatctgttacccttatggaaattattctggtttatattcttcctcctggaagcccacctttgcccttctgttatcttcctttggtgcatgatttaaggaagactgcatcaaatttaatatttttagttttgaagaataaaagtttcctcccgtttgcggggagaacaaaccaccattgaataaaccattggtctttc

SEQ ID NO: 21389 - DNA, 1135 bp, Mus musculus
cagagtaatttccaggacagccagggttacatggagaaaacttgtctcaaaaaactccaaaacaaagaaggatctcgatccatcatacatagttattttaatatgacaaaaatctattgagttataacattttctgaatactgtagttagatgaatttgactagaaaggaaacttgaggtaactgaaagcttagtttaaggtggcagctgttgggtgactggtttgcttcatctgagagagtatgaaatgcacggtgagtagtcagatgtagcagaaggcggtgtgactgggtttaccagttatagctgatagatttggagtgtcccttttagggattctttaacttcatttcgtgtgtgtgtgtgtgtgtgtgtgtgtgtgtgtggaatgtggtggcccatggtatccatgtggcagtcaggacaacttgcaggagtctgctctctgcttctgccacgagggctctaaggatggcactcaggtctttaggcttggtggcaaatgcccttgcccactgagccatttccccactcttcagacctgcttttcatttcatctttgatggctgttcctcctgttgcctataggcatggcactaggattttaagtcatcataaattaaaattgacttttttcactcagagaatatcaagatattgggtttatctatgtgttctctgaaatttgcggggtcaaacattacttttttttgttttttcttttaactaacattgctgttgtttctttcttgagtgtgatgtttgtgtgcacacatgcaggtgtagatgctcatggaccatggtgcatgcatggaagtcagaagacaagttcaggtgttgatccttgctttccactctgagacaggatctctgttgttttcctctatatacactaggctagctgtcttcaagcttagagctctcctgcctgactcctctccccacctcatagagcagtggtattaagagtgctcatgctacgtagctggcttttatgtgtggtctgcagattctaactcagggcctccggcttgtatagaacaagcatttttaatccattgatttgtattcttcaaatagttaattaaaatgccatgatcatggtagctgtcaagttgctagaaaaggatgttgt

SEQ ID NO: 21390 - DNA, 1898 bp, Mus musculus
gttcctgagaaatgtaacacgtgagcctatttattcattgtgattcaaacgcctatagagtgtgagccacagcagggctcggccgctttaaatacttctaaatcaaacgtactcattaaagaaatggaaattattgacactctgactctgagactatcctgtgcttacagctagcaagccgcaatcattttctggaggacttaagtcatgatttggctctgctttcatccctgcctccagtgtcacccaagtgtcaggatggtggcactcaatgtgttgctgagtctgacctacagagtcacctattcacatcaaggaacacttgtgctctacactcagagggggggggggggggacgacacaggtgctgtccacagttacgctattgattcagtttcgttgctgccaatcaaacaaacctgtgagcctctgcctcctcactgtgacagtgactcatggaagacgctcacatctgatggagtgctcagccagtcctgctgagtcgggtgtttgtcctcccatctgtaaccatgtcctcacaggagatgggagtctgagccaggaaggcggggctcacaggtgaaatcatgatttcaaagctggcttatattttgtctttttttttttttttggttttttcaagacagggtttctctgtatggccctggctgtcctggaactcactttgtagaccaggctggcctcaaactcagaaatctgcctgtctctgcctcccgagtgctgggattaaaggcgtgtgccaccactgcccagctggtttatattttttaatcatctgttaaagggtagaaaaacaagagaatgagctgactttttttttccaccttaaaggtcttgggaattaattgctatgagtaggaagcattgccatttatacttttataaattcccctgataaaaggtggtaaatttatctcttctaagaatggttggctcagattaatcctagcaggtctgaagttgagattgtgataagattagaatgtgatagagaatccaatcgaaattaacaaaaaattaaataaaaatataccatctaataagtgaatcttgtggtaacgcttcactgccactaccatgacagcattttatataacattcattgctcagtatatttattgcctctatggttctgatgggtgttttcgaaacatgaccactgtggcgttgccaattctgtacaaatcaccacatattaagtatgctctttgaaaatgagattggctttagacattctcattcctaatcgtgtattaaagagattaagagtgaaggagatacaggcgggcagatcttaagtgtgggaacaaatgcatgccagtaacatccccgcggtcgcctaagcaagagcatggaagttttctatttcttctagtgtgccttagccaatttgccaaagtccagtcctgtactttaagagttgaaagggagtttgggaagagcatgcatatgtcaacttacaattccaagccataaaggcagaacatttcaatagtactatgttctgcagaacctggaaaaaggcaaataaaaactggacataatgaaaagctacgaaaaaaacagactaaagaaaataaatttcagtatgaaaagaattggaaactatccagcactggaccctgaaatttagtacgaagctataggaaagaaggggcatcgcggccatagacagcaaaggtcttcagctctgccaggattgctcaagtgctgtttaaggtactgttagcagccagcttccctgcggggacaagatgccacacactaagctgttggtaaggcatgctgtgacagctttgtggaggaaaaagttgggctttctgtgactatttaaaggacccaagcatggagccagctagtattgctgactgacctgt

SEQ ID NO: 21391 - DNA, 1081 bp, Mus musculus
cggccagcacacgcctgagtggaggcttacattcaagtctagctactgtattttaggggagacattaataagttgaccgtatccacaggcaggtgacccctggttatagaaggaggggggaggtgcagctctccagcagagcagagggcatggccgggaagggagcgcagggaagttggggaatgaggtaatggtcaattaccaaccagggtttccgcagagctataaaaaggaagaagggttagctttgttttgcataacttcaaaggcaaaaagaaataggaacagaagagaactttacagatgacagttacaggaatcttctaggaaagaagtgttctaaagaagaacgggtaaagtaagatgtcctgctgcagcaagtgcccagaggttaacccggccagctatcccagggacggtcacgctgggttgggcaagatggcaggaaagctctttttcaaacaatcttgataggagtgaggctgtctaagccccaggcagcctttccgctatgtgttttgtgctgttggagggcagtagagttgtcgagaagaagtctgtgtttttccacacttgggttaaaggccttgagagtctcagctgaccagtgggctgaagagttggttgaaagggtgaaggtcatctctggcttagccctgtgtcaggagccctgcctgggctgctagcaggcacagcacctgttttgccttgttcttcccatccccttggctaattcttctgccttggtacttcacctgaactatttggactttttaagatttgttttgccttaatcaaaagatgaaacaaaaagtccctctgccctatttatatttggcaagcaatttatcactaatttttaagtatggactaccctcttggttccatcaaatttggtcggcctctactgtgcttagggtcattacggatcacacgtagggaggtgatgtgtagttcaggacttactgataacctacctaaaaaacatatagttgggcagattaccttttgatatgcagaatgtttgcttgccacagtggtcctcaacttttatttttctgtgcttacaaaaacaaaaaca

SEQ ID NO: 21392 - DNA, 1118 bp, Mus musculus
aagagcaggaaaggcgctcccaaaacagttccgtttccagtaccaccggcaaaagccaaagagattctctgattgtcgtctaccaggatgccatcagctttgatgattcaggcaaaagccagccccaccccgacgccatcgaaaagctcaagcaactccaaattgatgatcctgatcccgtcggcaatacagccctgcccgatgacgaccccacggcctcggttgaactggacgccccctcacctgcctcagcgctctctcagcccagggacgggtggccaatgatgctgcgaatccccgagaagaaaaacatcatgtcctctaggcactggggaccaatctacatcaaactgacagccagcggttacctgcagctgtattacgagcaaggcttagaaaagccattccgggaattcaagctggagatctgccacgaggtgtcggagccccggctccaaaactatgacgagaacgggaggatccacagcttgaggatagaccgggtcacttacaaggagaagaagaaataccagcccaaacctgctgtggcccacgcagcggaacgggaacaggtaattaaactgggcaccaccaactacgacgacttccggagcttcatccatgcggttcaggaccgtctcatggatttaccagtgctgtccatggacctgagcacagtcggcttaaactacctcgaagaggagatcacggtggacgtccgagacgagttctctggcacagtgggcaagggagacaaccagatcttacagcatcatgtcttgacacggatccacatactgagtttcctctctgggctcgccgagtgccgcttgggcctcaatgacatcctcatcaaagggaacgaaatcgtttcccggcaggacatcatgcccaccaccaccaccaagtggatcaagctccacgagtgccgtttccacgggtgcgtggacgaggacgtgtttaacagttcccgggttattctgttcaaccctttggacgcatgccggtttgagctcatgaggtttaggaccgtatttgccgagaagaccttgcccttcacactcaggaccgcagcgagcattaacggggcggaagtagaggtgcagagctggctgagg

SEQ ID NO: 21393 - DNA, 1655 bp, Mus musculus
aactctaagatgccactggcttctgtggttttcctgtgccatccacctcaggcctccttggatggcagcagttttgcctccatctttacttcccacagaaagtacttgaagaaaatatctcttaaaatagcatacactacctaaggctggacgggacagtctaggtttgttcttcatgtagcagacttgccccttgctgtccttttacgaacggtcactacagcagatgcccttcccgagacttttaccctctgtttccagcctgcggcgtctactgcgagaactcagttctcgctgctgctttcctagatgatctcaagcgctttgctctgttctcttacctagagtctgtgggacgtgggaccgaagcaaataggcactgggttcggtggttctcttaaaaataatgcacagtacttactaatggcatccatttgaataaagtggcaataaagctagttgatgtcagtgacattaagccaactccaggattcgggagttttagcattaggatttagatttaccagctagagcgtggcttccttcctccctgtagcccatccctactgctgcctttcgtggtctgtctcgcaggtctgtcttgcggcctaccaaggctctctgacgagcctctgttctcctgcgccccgccccgttgggcaaccagctacatcagagtctagagaacacaaattttacttctgtggcggtgtacaaaagtggagtttttgtttttgaagtttttgtttctgatttctgggttttcttagttactagccgataatacagaaaaaggtctgacaggggctttattttcccccaaatttattaatacctaaactagattaatgtaaaagtacaagtcctaaatcttggtactcctgaaggcttgtagttcttctgaagatatatatagatagatagattaacttctgaacatattaccactcaccatctctaccttggagaagcgttagaaccctgctccaggggtctggtgaggagcgggtggctgggggttctctacacagaatttggtttcgtctggctgcttggttgggttttctctctctcctctgctccccaggtttgctctctggtgcttaggagcagccatggcagcctccacatgcagacctcaaccccttgtgtgtgtggcatttgcaaccagtgaccaaccacatctgcaaaacacgcaagaagatacgcaagaagtaaccggaacaaaggaaaactattttatgcaaaaaaaaaaaaaaaaaaactattttcatcagttattgcctcagatacgagagaaactatttctggatgctgtattgtcaggtttttaagtgggtatttttctttgaaaaagaagctaagtgtcttcacccactagggacttgaagaaaatttgaaataaccccatataccaatgatttctatgttaaagagcctgtttacacatcagaaagccgattttgtatgcatatgaagggccctttggttatgagcagggagccatccagatgttctttgtttactatttattggtgaacgatctgacactatttctcttttatttaagaaacaacgttgatatgatcaaagtatgaccactagagatgttgagggacatgcttaaagagcataagctgacgtcatgaaggaac

SEQ ID NO: 21394 - DNA, 3770 bp, Mus musculus
ttgaaaggctaacacaaatttttctgaaacatttcctttgctctctgtcctctaggacattcaccttgcaaaacgcttttatgacatggcagccgaagctagcccagatgcacaagtacctgtgttcctcgcactctgcaaattaggtgtcgtctatttcttacagtacatacgggaagcaaacgtaagtgagccgtggctcttagttacagatacaaattatgtcactttctcaggcctggagaataaaagttggaggcacagagtctctgtcatcccaggtaaagggcaagtgaattcctcgtgggtaacctgtggagcaggcaggagcgcagttttcccgtggcatttctcagagctctcaacacggaagcaggtggcatcggtgcaggtggtttctggttcagggaaaacagacgtaactcgtgacactctgaaacagtagtaagcattacgtcagacggatccctggcaacaactcagaccagtaccctaagaagactaagctagagggaagccggcacgctgattcactgtgtatctgatggttctcagtgccacacagttagcacgataacacagcttctggtctgatagagcctcagctgcttaagtgggctgatggaacctaaagaggaggggaggtacctgttcccctcaaagctaccacctggagaaacaaggcttacgtggaagtgcccgtgggctctaccacttagattttgctcctgtccccatattctctgaagtggattcaccagtgcagcattttgctccataaacactatgatgctcgaatttgttgttggagccatcattagggtcaaattgtccttatgcagaattataagtaagcagtgcttcttagatctacactaacataaacagtggacttccctcccttgcccttagccacgctactgagatcttccacacagtttcccagaactcaggataccttagattcttacatatgtgtaatgtcagttgttgcagttccctggtagcatgagccactatgctgtactttctgccagaaagcactaagcagctcactgtgaggactaggttgaggtgtggggacagagtagtgcctggcctgggccgggtctcatacccagccaacaggaggtggctgtcagactctgcagggctgtcccagacccttgtaccccgcactttcctcagtaggtacagcataccatcctgtatggagaggaatcttttgctgtctttttatacagatctagaaagagaacagtaagattctccaactgaaacaaaaaaaaaaaaaaaaaaaaaacaaagcaatcccagttcataaaaaaaagcaagagaaataagtattgatgagaaggaggtcagactagatgaacagacacaaaattccccgggaacataatcatttcctggaatttttttttcctacaaaattaagcacctgcgcctacagatgtgtattatgagggctctcgggcataatttcacaaaagctcagagactaggaatgtaacttgtaagttcagatttctttgtaaaatggtgtgcattttaattaaaacaaccaaaaagaggtgtttgttcatcaagtggacacccggtcctgtagctgtcagtgccatgggcggagcacagctggccgtcacctgcctgctgtcactgcggacaggttagaggtgtgccaggattcagacttgggggcggaggggtcttttattgttctgctgatcctttcagatatctactagagaaatagctagaaattgccgaattagatttctgatggaaaaaacagttagacatctgatgtccgctattaggaaaccctagcttagttcttgagacacaccctctgggtgtcagtagaagaagggtttaaaaatcatcacagtgtcctagaatttagtttttcaaagtctcatgcttatgtctactgttaagtaactagtttcagagttctttcaccgacatcgaagtgctaatgctttttgtgtttttctcattaagattcgagatctattcacacaactggatatggaccagcttttgggacccgagtgggacctttacctcatgaccatcattgcactgctcttgggtacagtcatagcttacaggcagcgacagcaccaggacataccagttcccaggcccccagggccacggccggctcctccccagcaggaaggaccaccagagcagcagccaccacagtagcagccacacactcaccttggtcggtgaccactggggagctgcttgctgagaacgcttgcatttgatgtagggctctggatggtggcaccgcctggaagaggcgtgaggcgtgttgaatcccagaagctgcttagaacctgctgccttccttttcagggatgcgcggctctcggcagagctgcagtgaatgtttgtttcagtgccatacggaatgacaactctcagtggctttcctctttcctttttctttcttcgttctgcaaacatacacaagacactcgagtcatgtctactgtaccctgtctttcctgagagacctttcgtcatcctgttgatgtgcataacttcttacctgtcttctaaggtcctgagcattgacaacctggggaaacccagttagttgcaagtttaaccctaaaaacatgcttaagtctgagactagaacttgccattaagtcaaaagcaaaacaagccaagcaggacgtcttcagggtgtttgggaaatgcagtaactgggaaattttaccagtctacatgccaggtcatatgttcggcactcttattttaaaagggattattgatcggattcctgtactgtgactctgacacttcctagcaaacttctcttcctcaaagactgaaaggctttgctaaagacttcttcgtgatgtcacatccctgccatggagtagaagtcaaactcagtcagctgactccgtgctcccacagaggactttgccccagctactcatgtgagttgcatatacagagccctagtccagacgccagaggatgatctaaatggagaaatcagaaaacagccttaaccaacttgaggtgggacctgggacatgccctccctcgggtagattcgttgcttcccggatctcattttacttcacatttcttatggcacagagaacagacaaccctcccaaagtcttcaaatatgaaatgctattgtcaagattggcaggtggtgacttcctttgtaatactaaaatactaaaatactcagacaatggaggatgggttagacccaatgcatggcaaaaccaaaggcctgggtgcaccgttgtgtatgctgcgggagctttttatttctgacggtttgatgtggctgtagaaagtcagccactgagtagctgttgtgttatcgcccttctgttgtaaacattaggaaattaaagcagttacacccagcattgcctgcttcagtaagaggcgaaaacaacgactgagagcttcacataatcaccccaaagcccaagctgaatttgtggtctgtgtaatcagatctgtggatggtagcgttgggtagccagcaccccatgggagctcacgcccctgttcattatcgcctttccattgttttctgtaatccttgtctgcaatgaaacgactttatcacttgtggagtttggaaagctttgagtttgaatgttgggattgtcatgagaattcaatgtagttcatctgtattgaacatgaaggctttaagtgtgaagttgtgtacatttgtgtgtgctcacagtattatgggaaacccagga

SEQ ID NO: 21395 - DNA, 1222 bp, Mus musculus
gccctgtgcatgccattcccctaacccgattcctcccatggcggaagctgactccactcactcgccttgacacactgagtcaaggaatggagagctgtgcttactgctgtcctcacctgttcctgtaagaagcagtgtttgcaagggtcagagcagatgatgctagtatcaaagagtacgttgaaggaggtatggaaagagcaaggccaacatctcctagctgggatcgcttcccctccgctctcacacctgtcgttggaggcacactgataaaggcttcgaaccattggagatctgtctttgctttatttcgagttctcacttgtaaactgagatttttcatagaagtcacctcatgaacagttcctcaggtaggagaatgtgctgatagctgtaatacacagctgtcactagaacagccctggccacagtaaataggatgcaggttgctgctgtttttactatgtgtttgcttctgaagaggaaggaaagccagcaggcagcaggtcatggagcagatttaaaaatcacccctagccaagctgcaaaggttcttttcctctttacacagttgtttaagaatgtgtgtgagcgaggtcgctggtcagagagactgatgactgcctacaacagctataaggatgaggactacaatgctgcagtggtccagtacctcctgctggctgagcagggctacgaggtggcgcagagcaacgcagccttcatcctcgaccagagtaagtcctgttgacgctttaaccacgttagcaatatagtttcaaagtgaagtgaacaccaaactcccctttccctacccgagtccctagactagtctccgtatgcagcgggctaaaacctgctccaggaagtagtgtcatcctggcccagtgattccttcgaacctggcgtttgctaacgcttgtttacttcccagactgccttaatttagtatttgctgtgctccatcctatcttacaagcgaaaacacttggcttctgtttcacgtctctcctgtaggagaagcaaccattgtaggtgagaatgaaacttaccccagagctttactgcattggaacagggccgcctcccaaggtgagtggctgattgtcaaaatgagccttaccagacttctcactctgttggtctcatggacatcgtcagacactgctacgtaccttgtgatcagccttcattcctcggtcagtggttgcagtcagtgcca

SEQ ID NO: 21396 - DNA, 1194 bp, Mus musculus
cagggcatggctaatagtcccaccttatgtcaaaggtttgtggcaaaggcaattcagcctgttagacaacaatggccaaatatttacatcattcatttcacagatgatgtcttgatggcgggaaaggacccccaagatttgcttttgtgttatggagacttacgaaaggccctggctgataagggattacaaattgcttctgaaaagatacaaactcaggatccttataattatttgggttttagactcactgatcaagctgtttttccccagaaaattgttattcgtagagataacttaaggaccttaaatgattttcaaaaattgttaggtgatataaattggcttcgcccctatctaaagcttactacaggggagttgaaacctttatttgatattcttaaagggagttctgatcccacttcccctagatccctaacctcagaaggattgctggccttacagctagtggaaaaagctattaaagagcaattggtcacttaatacattggtaaaatagaaggaccccctgactaacgaatagaagggtccagatccagttctaatttggggtagggactcagtttgtgtttttcacgagatgaagataaagcgcagtggctgccagataaattaatttgttagttgaacacagattctaaatcttctaaagtatcaccttgaggactaaaattcctcttttgcttagaagtcggcttgaggactcaggctccgaaaaaaaagctactctctgagccagctcccgacaggaggccggagactagcctcagctttacaatttgcatttgaataaagtacctagacttccccaaaagaagttctgctttcctactttctcactgtcgagattttgtctttcaagcaggtaaatcaacattctcgaggcggaccagcggatgtgcatccccgcccccctagagcacacaggtggctgctgttatctcctttccaaggacatttccagtgtgtggctttcagtctgagttaaaaatttaggtttacctagagggctagaagaatagatatttctatattaataaagattggtttttattttgatagacaggcttagccccttagctgacctctggcttttcacccttgctgttactgcaaggtgtctttagctcaataggctgtggaaaaaacagggatgaggaggaacgacttcca

SEQ ID NO: 21397 - DNA, 1185 bp, Mus musculus
tgaattaatttaattaattctaaaatgactcgggtttcccctttagtctattagctcaagggtttgggctgttggtttctgtaaaagtaggttcacacagtaaagggataataccatctggaacaatgatcagtgtagagttacatcatctaaaaccaggacagtaatgtggggctctatgtggtagctggatgtttccctttcaatgtcctcatgcctctcactttgtaggtaaaactgtgtgctgaaaatataatggtactttgattattttgaggatttttattttcttatataagaagaaaatcattattgtctcttggtattgcatatttaactctcagtggtatttgggactgtggaaatgtcttctttgtcccaagaggaacgagagtggagtgattcccacaatattgtatggtgtccacaacactactgggagtccaagtggtactggggagggccagtcatgtgaaacaattagggtgctctcaaaattgctctggtagaaggtatttctgaaaccgagtctttattttgatctcataaacaacatgggacgggcatctaccatgaaaatcagtacctatccatagtactgtgcttgagggactcgcctacatcagattagaaatcacctcatggaatctatactagcatatgaaaatttgaaaaaaaaaaaaccaaacaaacaaacaaattgccagcagtccttactggatgacattttggctgtcatctttaatcaggagactacattccatagttacatctcctctgattttggtcctctctcagcctcatcattacttattttgaggtaattagtcaaaagtcaaagttgagttgatcccatatattgtctactccttgtctgcccagtaactatttgcacagaggacattgcaaaaggcaaagcaaagcatgatcatacagatgttattggtagttaaatggaaggtgatcaccaatacatttttgctcatcaagatgcatttgaccctggggaggttctgggtttcacttaaacactgccatatgcactggagaggtagtacaacacatgcgtcaatcacagacaggcatgacaagagtaaaaatcctcccttgtgacaaataatgctatttgtaattttccagatgtttgttgatacaatattagacattttctcttgagagtaaaaa

SEQ ID NO: 21398 - DNA, 1185 bp, Mus musculus
tgacctatcaaaagaggatattagatgttgctttagaacttgaggataacatatcagctcataacttgtttttttttttccccaaatgaatgggaaagcaaaacagaagagttcccaacacaaaaaatagtatttacataaaacaactctcaattcttagccttgttaaactttgctgttttaaaagttaaagtaagcgaagaaaggaagctgtatctacactgctttccagtttaatcagcgggatcgaaagaatagttggcaacagcgatgcttttcactgattgtggggggaagccttttgtacacagtataatactgttttagcaaaccaggctgttttgttatagtatttggttttctagctgcacatccacgagaagagcacaaaccaagaccatagcaacaggcattttaaaattaatataaaacatgcaaatccatgcatacacatacattggagtgtttgtaaaggtgtctatgggatgtaagatttgtaactacttatggcaaaatgaggcatcaccactgtataccctcctaggatgacatttctgaaagggtaactcttatgatctgttactgtttgaatcctatgttgatttaattctagtttgtgtttagtgtgtttctctgacaagggactgcaaggggctggaagattctgtgtcatgcatcctcggagacctaccatgttgcacactttgttaactacaaacttcactctacactatacagtaccttgttgatatattcagtaaaggcttattttaaaagaaaacctattgtgtttatctgagtaaattcatcgaaatataacttgtattcatgctgcaatgtaaatagaaaatgagaaacttttcatacaaaaacatgccagagggtaagcagtttgtcgagcattcatgtcttcctactgttaacctctattttcagatcatagttctttttctgtaagaagttaatgtgatagtctagtgttccttccttctttccccactgaaatatttttagaaaattttattatatccaaatcaccacacaaaaaaaaccaggattctgtacttgagaaatgcaaatagacacacataactaatatgtatacaatacagatttatctgtctttcacaatataacctgttcattttgaacaataacgttgagaattcttgtcccttctattta

SEQ ID NO: 21399 - DNA, 1644 bp, Mus musculus
tcaaaaaatttatttcaacatttcaaggaaatttagacatgataaattgaacagtgtttatcacattaacagccatataaaatcacatggttgtagcatatgcataaaaagtagtttattccttttaacaaatgttagtaaagagaaaaaaacaaatactatgaaaaactgcaacgtttgtgattttataataatctttgaacaatcaataattagactgttttctaagtgtgtaatattttttaaaaagtaaatttcaaaaagattactttatgacaaaagcttatacacaacaatataaagttttcttaagtatttacactctataattttcaagctaaaatttctcaaatactcaaattaaagaaactacactaatatatgtcttaacagcttaaaagaagacagttcttgaaaagagtagcaagctcttctaaagagtagtaactattgtaactattcacctctgtattttgattaaggaaaagctatgaaatatgtatagaaataaagatgtggcttcaccgggcattttgtgcggagatcacggaaccaagatcaaccgtccctgctacagagcaggagttgccacagcctcaggctgagacaggatcgggaacagagtctgacagtgatgagtcagtaccagagctcgaggaacaagactccacacagacggccacgcagcaagcccagctggcagccgcagcagagatcgatgaagaacctgttagtaaagccaagcagagtcgaagtgagaagaaggcaaggaaggctatgtccaaactgggtcttcgacaggttacaggggttacgagagtcactatccgaaaatctaaaaatatcctctttgtcatcacaaaacccgatgtctacaagagcccagcttcagacacctacatagtgtttggggaagccaagattgaagatttgtctcagcaagcacagttagcagctgctgagaaattcaaagttcaaggtgaagctgtttcaaacattcaggaaaacactcagactccaaccgtccaagaggagagtgaagaagaggaggttgatgagacgggtgtggaagttaaggacatagaactggtcatgtcacaagcaaacgtatcaagagcaaaggctgttcgagccctgaaaaacaacagtaatgatattgtaaatgctattatggaattaacaatgtaactatttgacagcgaagacaactccccctttcccccctttttggtgtttgaaaagtggaactacagcttggtttaaaatttgtactgtttctatcactaataaagttgtggcttcttgttggatggaaaaaaaaaaaaaaaaaaaaaaagaaataaagatgtggttatgttgaaacaaaattttgatttatgggctcaaaattgaatccaatatatcattttgtgtattgtaattttgaaagttatttttctttttccttataattcattttcttttttaaaaaaatgtttactttatttattttttattagatattttcttcatttacatttcaaatgctatctgaaagtcccctatacccacccactcccacatcctggccatggaattcccctgtactgaggcatataatctttgcaagaccaagggcctctcctccaactgttggcctactag

SEQ ID NO: 21400 - DNA, 1193 bp, Mus musculus
aaaattacagatccaatgataatatgtggtggaggcgtggctgtggttgaggccccggggctcatggaagtaaacctgaagacgaggaatgaatccccgtcatcaagttgggccgtgggttaaggacatgaagattaagtccttggaggagatctacctgttctccctaccaattaaggagccagagattcttgactttttcctgggtgcatccctaacggatgaggttctgaaaatcatgccagtgcagaagcagactctggctggccagtggaccaggttcaatgctttcagggactacaatggtcatgttggcttggaattaagtgctccaaagaggtagtcactgccatcggaggagccattatcttggccaagctttccatcatccctgtgcagataggctacttggggaacaagattggcaagccccatgcttttccatgaaaggtgacaggctgcaatgtctctgtgctggtgagtctcaaccctgcccccagaggcactggcattgtctctgctcctatgcctcaaaagctcctgatagtggccgttctagatgactgctacacttcagccagaggctgcactgccaccctggacaactttgttgccacctccaagacatacagctacctgacccctgacttctggaaagagactgttcaccaagtctccttatcaggaattcactgatcatcttgtgaaagcccacaccagagtctctgttcagagggcccaggttccagctgtggctaccacataagtgtttttatacaagaaaaataaatgaattaagtctgttaaaaaaaaaaagaagtatatcaatactatattgagtaatctttgctaccgaaaaaaaaaaacactactatgaaaaaaattatattccttaatccttttttacagtacagacttcatccccctcccgacctctccccactccactagggctcactactccctggggcctcaagtttgtcaaggggttaggtgcatcttctctcactgaggccaaaccaggcagttctctgctgtatatgtgtgaggggcctcatatcagctggtgcatgctgtctggttggtggcttagtgtctgagagatcttgggggtccaggttagttgagactattggtcttcccacctggctgccctcctcctcagcatttttccagcttttcctcaattcaac

SEQ ID NO: 21401 - DNA, 1099 bp, Mus musculus
ttacatttagtaaataaaaatttaaagtatgagggatgggcgtggtagtataagcctttaaccttttttcatttgatgtatgtggctgttttgtctgtatttgtgcaccatgtgcttgtagcacccatggagttcttcagagggcttaggagcctctggaactggagttatacatagctattagttgtcatgtgggtgctgggaatgaaacctggattatctggaaaagtagccagctctcagaatcactgagtcctctagccctagtacaagcctttaatcaaagttcttgggaggtagagtcaggtgggtgtatttcaagccagccagagctacatagtgagatcctgtctctaaacaaacaaacaaacaaacaaacaaacaagaatgactataatttgaaagtagtgaatgactatttgaaaggcctccatactacttaattaaatttttttctgaataaacattcctttaagattagtgaataatgctttagttttggtataatgttgtgtttttcttcgcttatagacattcatatgatgatggagcttccacccggctaatgtcaacagtgaaacctctgagggaaccagcaccctctgaagatgtgattgatatcaagccagaaccagatgatctcattgatgaagacctcaattttgtgcaggagaatcccttatctcagaaaaaacctacagtgacacttacatacggttcttctcgcccttctattgaaatttatcgaccacctgcaagtagaaatgcagacactggtactcacttaaacaggctgcaacttcatccgcagcaaagcagtgctcacgctgccaagcagctggatgtacaaagcagccaggtatccgaagcaggacggttgtgtgagccaccagtgcttagcagcgtagaagacacttatagccccttcttcagaaacaacttggataaaatgagtattgaggttcgtatagatgtatatagattctggcttgctaggctagagattggcagttgtggattccaaatataacttacgtaactaaacacattgtgtgtttctcttaaatagtgtcctctcttggactggctgtctagagga

SEQ ID NO: 21402 - DNA, 1458 bp, Mus musculus
gcagtttgaaagcttccatcttctgatgagagatgttctacagaacttgtcacgtctttgaaatttagaatatattgctttcataatacgaattttactgccccactgaagtgtctaatttttcaagtttgtaagtttattaagtggtttcaacattttttgtttgttcgttttgactatgaaaaagacagtttaaagaaaagccaaattctattaaaacatttgcggcatgtttgtacattgctgtttaatatcatttttggtaatggtacttgcagcttagggctgtagtgctgtgggaaggccagtgtcctcagagctgaagcacttttcagcttttcccaaaggtaatgcagtgtctgtaacccagcgtggtaacagtggccaggctttgaaactgaggcagctttggaacaactagtttaaatttctttttttagtgtctaaatgaatttgctctgagaagcataatgcagactttattttgagtgctactttggtagagtggaccgaggtcctgtgcctttctgaaagtgagcagagacatggtcataaagggtaagcatagttggaatgacgatgtaaaaatatatggacagttctttggaatgctcccatttactattagcttatcattttataagtaattttggagggactacattatcacaaaagtatacaaaaatttttacaggcatatgtacagaaagtatcagaaaacagactttgaactcacaagaatataaatatacgtatatattcccatattctgaaaaatatcatcagaaataaccccacagaaaatatacttatgttattactaaagatcattcttgaaatgtagaagttgagatttaagtggtatattttaaatgacagaactatattgcagagataggaaggtaaacttgacaataggatgaaacttggcctactgtactatggagttttatgtgtggtttttgaaactgttaaggcaagatgtgtcatgttttagaactaaataacagacaactgatttcaaaaacgtgttgttttaaaaattaaagtgtaaacggtggttagcaaaggggataataaaagctcaaacattttgaggaccaaatttaactgttaagatacaataaagtcacatctataaaagtctgtgtttaataatgtgaagccagccttctactgtggtcattgcctttccattgaaagataacagaattagctagttattcagccatttgataaattggccttgaccatgctaaccccagagggtaaagatcagaaacagcaagagaacaaaggagaccagggcctaacgctgtctgctgcacaggttcaggtgaaatggcaattcttcatacagtgaggacactgaatttaagggttcagctttggaactaggccattaccactttgtaaaaaaatacgtgtagatgtctgtcttctcataattgtctagta

SEQ ID NO: 21403 - DNA, 1203 bp, Mus musculus
gatttgtgaccttttccgttccatcaacatcaggagtttagactccgtgattggtttcttgttaaaaaggaaatcttatttcgctagggaaaggaaacacttgacagaagactaacccaagctctgcggtactcaactcttggccgtagttattagttcagatttcactatctgcaattatcagcagatagcaaagaaactcatgtgttactcggaaggcaattcactagaggttaaaattcgcacgctggaaggcacttggagggtatgtcttttatgagaaataacctttaccacaccgatttccgattctgtttatcttcatcagagtaaccttaagtttactttcttattagtaatttcaatcacagggtgacagtatcttgctctctattgatctgaatcttaacgttggccgagatgtttggtaagctgtacatataaagggtaattttccacatttcagtcgaactctaatgttaaagttgggagcgtttgaattgattattgcctcaagcacatttctgtcttccaacaaagcgaatgtattacagaaaaatttgcaagtgtgttatgttgttgcttctgtgttcttgacccgggttctgtgagcaggcatatttgtttcttcgtggatgtttcgaattaggcacatcaaaaatcagtatagtggtttgatgcagcgtaagcaagacactctggtgctgaaactctacgagattgttattttagctctctgtacatatataagggggaaggggaccccaggcaattggaaggtcagctgggatggaacaaagtaaaagttaacagcatataagattgcagagaagggaaggcttggtgggggcttattatcattctcttgttcattagacactgcagtgaaggttttccagattctagttttttggaaaggaatctgacaagcagttttatttttctcaatttaggaattttctgttgtagtggtagtcaaggcatgagacctagtgaaagccccaaatcactaatttgaacagaagttaatagtaatttcccatcttattcaccccaagaagagagttatctcattttcttttcttttccctctgtcctgccatgtctgtccttctgtatggattgggcctctagctttacaaaactacatgaatagcttttgagtagcagcctcccaccagatattaccaggttaaattaagt

SEQ ID NO: 21404 - DNA, 3147 bp, Mus musculus
aggctagatttacccgcagcctgggctctctcagcgtgagggttcggggttagatgagagcacgggtgtgttctccacaaacctctggcacccaacaagccatccacagctctggaaccctgagccacgctttggtttctgctgtcaacttaccaagtccaaaagattccccacccccacccccaccccacccccaagatgttcaaactcagacctgaaggtaaaggtaagcactcagcactgtttgtggcagggggcttcttccgatgcaaaccccacacggctgtctcccctcggttcattttttctgaaggggcagaggcccctttcagaggtgacaagatgcagtgtgtgtgtgtgatttacttttctgatctcgtggagatctggagaactatcttatacaagtgtgttctgaaccgcagaaccactccgtttgcataaatacctcaccgggcagctttctaagtgttattttcctgagcctcccttggcaccttcgttggaattttctggaagacttgttggggaaactttagtaagggtactgttttctattttccttctgttttgggcggcatacgcattatgcataaccaaaacaatggctcaattgtgtttaactctgtattttgactgttgaggcgaaaaacaaagtcatcaatgtgtatgtggctgtttgtagcgaagtctgccgaatgaggctgtccgtgtccttaacaagccaaggggcaggaggcaccctctctttcccctcccccaagagcagtagagaatttaagcacaagcctatttgtgaaagaatattttgcttaagtgtaattcactttagtgttggacttccttcccaaatgtcaggtgttcttttagctttcaaactagcctgtgtatccattagtctgacagatcgcctgagcatcattaaagggatgtggtggggttttgtttttggttttgtttttttggttttttccttgcatttctcctgtggggagaagtggcgggttaatgtgtcattccagtatctcacggactcacatggggtggggggaggggcaagtggggaactatagcaatatctgcagatgctttggggacacatagcaccgcgacataacaactgccggctgtcagccctcagacacagttaagagaagagagagactcactctcttttcttaggtgatgctcacatccacgtgttttaccccgctcctgacagtctttcctcattctctagtacttttttggagaaagggtctgcaccgtacttaggttttctttctaatatacatcaccaagctcctacttccctctgcatctccagtcagtatgtttttttttttttttcaggagttcttttagtaaagctggctctctgaatctaaagctgaaccaaaaccacacacagattgtggcataaggaactcgtggtcaggatgactggggcaggtctccatcttggggccacgtctttcaaggagggatgggttggcgccctttcccaagagcgggtttttcctgtagtcgctagcctgtctattgcctcctgttcagagcagttccgaccacggagctttcttgaaggacgattgcattctgtggcgcccgagccacagatggggtggttttggtgcttacagtcccaacacagcaggcccatgtgcaatgtcccaagccaccaatttgggctttatcgatgctactccaacctctgtactgtcccttggagggtggaggagcctatgacatgatgccagagccagagttagggacgagtgaccggaatggggagttttcccatatgtgggattagactaaattcagtgtgatttctctttgccctttcaaaccttattcaggttgggactcatttctttctggtggatcacagctacccagatgtgtagattgatctctatgttctatagagaaatccttttctttcatcttcagcagggtttttatttcatttttattttgccaccaaaagaaaacattggagcatacgtcccctcttgattgtgactttccagtgttgaccgttcagttctttgtgttgtaggtcccagcccaccagtactatatcaaacactgttaggctcatgatgcagcactgtgatctaatttaaataatacttttttattatttatactactatatataatatacatcaacacttttgctatataacctaagtgataaacccctttttttggttacctgtcagactctagactttggtttctattgcagttaacacagttacagaattgtaatggtgtcttggttgttttgttttgttttgtttcttttttcttttttcctttgtaacggaatgtgtaaatcaaagtatatacattgtgtggtgttcctgtttcttgggatgtcatgaggagttacacacagcattcagtgttctgtatagacctgcccacctttgtgaattcatctgttaactcctcctttgagagcacgccagccacggtggctaactcccagcgtcctctctcctgctggctattcttgaattaagcacagactcgtccactcggttgctttatcatgaataatgggtgtgacttggtcactcttccgcccttcagcaaacaagtgctagcttcactgaccaaaaattaaggaaggaaaacaccatttttaaaacgatccaccttttcatggccgagacggatgttagtctacggtgctgcctcgcgctgccgagcctccggaacgagcccgctgtggaatgaccatttctgacttgctgtgggatgctcaaaagtacccttcctgtctcgttagtattggaatcaagactctttatttggactctatacagcagtgttcctccactgtgttgcatttgcaaaagtagagaacatgccttctccacccttttgcaaataattgatactccatattggattctcaaaagacttcgatatggtgatcctgtcaaacctagaaattgtattatcttttcatacctgacttccccgtttctaaaagtaaacagcacacttttagttacagacacagtcgccatttctagagtatgtgtgttgaagccatccaaggtcatagctggctcagccagcctcactccatcgttctcactgcctgtcctgccatggtgaacatgg

SEQ ID NO: 21405 - DNA, 1714 bp, Mus musculus
tcagttgtgtttggagtgaggctgggaagcagttacagagactgaagagcccttgtcccctagaggataaccccatgctctggccctggcatcccaaggtaccacaaatgccatcggccttgctgtgtggcaagcccagggcctggctgccagtcctctgtgtttcttagccttgagcctggtaacatctcccaggctgaataccagactgttcaggtgtattaggtgtcagtgactgaggagggaaaacagggatcgtcagagccattgataaccactgagttctgctctatgttaaattaagaagacttccaaagccataagcctgaaggttggtcctgtgtgtgtgtgtgtgtgtatgtgtgtgcgcgtgcatgtgcacacaaacacacaacttaaaggtgatgcagaaaataggctgtgccctcttaactgcccaaggaaaagcaatcatgcccaagaaatgacagtagctgttaagaaaaatggtacagatttttttcctcctaaataaataatctgacccaagttgggagggggggtgctacggaaactgccattagtattatggtgtctttatgagattaaaggcacattgatggactcaacaaagcaaaaacatgacaaacaatacaactcctgtactgtcctcaaaaagggtttgcaattaatatcagtactcatttttgcaacaaagaaaaacagaacagatcagtgactttcacattcagccagtgtagccagcagaaatttctgatccacaaatgcatggattcctttgaagaaaaagaaaaaaaaaaaaaagaaaaaggaaaaaaaaatcacaaaaacaaacttttttttattcaaaaataacaaagttcttgtaaggtaaataatgtatttagcatgaagcatgaattattttcatataaatatagagaatagagagaagactatgcctctaacttttaagccctaaagcttagaggccctttgttctttttctttctttctttttccttttccttttttttccttttttttttttttttgttattattattttgtttttttgttttttttgaagcaggtgtttaaggtttaaccttcttcagggacaaattctgactgttggggaacttactctgcaatataaattatcttcatgctctggtaggggcttggatggttgagctctgtactgccttgtctgcactcagccccgaccccctctgattctctactgaagagtgtgtccttccctatgtctgtatgtgtttaacacgacgcaataattcgagggcaaacttagtgtgtacgatagactcgagagagttatgggacgcttacttgaggaaaatccttaccgtgatctggttctaggaaaaaggcagtgaataattatgcaaattcgccagaagaaggggaaacacgctaatgggccttactgggtgagggtaagaaatgggtacatgggttggaggaagtacgccatcaaggggttggatggagcagccccgagcgagcgagcgagcgttctactgtgacagtgtgattgcgcagtgaggagggggctggccatctctgccacttcggcacagtaaccaccttgggactaagaccacctagatagtgagagctgaacaacaaccagaccatgtcacacaagccagaaactccagttacctttgccaaaaaaaaaaaaaaaaaaaaaaggaaaaaagaaagtttt

SEQ ID NO: 21406 - DNA, 1208 bp, Mus musculus
ccccatagtgggttggcagagggattgcttctttttatttatttatttatttgtttatttatttatttttcaagacaaggtttctctgtgtagccctagctgtcctggaactcactttgtagaccaggctggtttcgaactcagaaatccgcctgcctctgcctcccgagcagcccattgtctcgggctatgggtactcaacccgggccaatcagcctttgagctgctgcagggcaggtgcccaggcttggatgaagcctggccccaggaaagaggatcatttcatctataagcccggcacttgaaatgtcaacagatccctcagcctggctttcccctgtgagaaaggccactgatagtttaaggttaacagaaacactgacttcagggagaatggttttattgagttacagttcacaaacccacacactgtgaggttcaacgctgtacaacctggggggtttagtaacttcggggagcatgggcaggcatcactacagtcagttgtagagtctttacatcccactgtgtctggggaggaggacaactgtatgctctctagccatcattcttcctcgataaatggtttaatgaacgaagctttgcaagtcctggacctgctggaccatgatccctgatgctacatagtcgaggggagcggccgtaggtcgcagcctctggcacagggaactggtggtcctgttgaacgagtgtcacttggggtgctgcctgtgctgtgaacattcaggaatctctctggttgatctcaaggctgtgtatggcgtgcagacagaaaagcgtcacttagttaaagtcagagtatgtgctctgaagcatccagaaatgcctgtcagcagtgagtcccttcctcccttcagaaccacattccaaaatggtcccggtgcatgggccttcttcgttttgtttcataaatggtttctagcccagaggccggggagctagaaatgggtggtggggtgggggcgggggcgggaactctgctccaagaaatactttttaaaggaatctagccaaaccaagcccttaatcaccctcccccgaaacaaagccaaggaattttgaaatgaagactgtatcatgaaatagttctcattttgaagtaaaccgtttgctctggggaattccatgcccagaaaacactttgttgtttcaagttcgagggtaaggatgtcaggctaggtcgatgg

SEQ ID NO: 21407 - DNA, 1188 bp, Mus musculus
actatattagttattatctgctgtataacaaacaccacaaattaagtaacctggcccttgttaggtgtgctggtaggttggcctggactcaactggaatgatgtattgtcagttcctgtgacttttgtttgtgctcagttgtgtatttagggttctttcggggtagctggggcctctttctccaaggagtctaaaatctattgataaattacttcatgtttatttacaagatagtataggaatccccagtggggaataagtaagcctgaatatttaaggatattcaatttctgtgttgtatttgctcatatgccattggctgcattaagtcttgaggctaagctagactccacgttggtatatatgcacaggatgtagaggcttggttgaggtccattgctgtagtgaattacaaggagctcacgacagaaaccaaatcaacactacagttgaagtctccctccactattgtcctccagagtgaagttcacagccactgtctgcctgggcccctttagtactgcttcccttctgcctcagagattgataggcatcgtttgtctctaaggggccactggaagaatgtgcctggatcaacacaaatcttgggctgacggtggaagtagaagaggaactgagtagatagcaagtaaagcccacacagagtgttgtgacaaaatgacatctcaaatcccccgcagttgtctgagcccgggctgtgtcttctttccattcttgaatgtatctcagttctcaaatgccaacaagttctagatctgcctgttgtttgttcttctgacagtgagtgggcattagtgtgcagtgcagtcaagtacgcagacaacagaatagtggcatacagagagacccaggaccccagtgcttcagctgggtcagccacctgttaactttgaccttcagcaaagtggatggattagataacatctggttttatctgacttgcagtgatttaatgttctgtatatcgggggttctagtgttaaatatatctggtgattaactgtgctaactcattaaaaatgttgtcttgggttataccaagagaacagaattgagggaatagctgtgtttgtaggccgatgtttagaaagcctaggataggctaggtaggggaagaagtaagcagagtggatggatagtctgtgagacttaggataaggctatgcc

SEQ ID NO: 21408 - DNA, 1273 bp, Mus musculus
gccactaccgcctgaccaaggtcaccattctgctgacactctgggctcatttttcttcattgtgtaactgtatggtgggctcgtgtggctgccatgcaggagtactgccctgccttcaccttgtagttgagagccagataggagcagagggagtcaggcggaaactgatctgattcctcttctggggttctccggctcatgacttctctgccttgtccttcctaggagccttcacgtaaatgggtccagtcatgcctgccagtaagaaggccgagagctcaggaatcagtgtgtccagtggactgagtcagcgttaccggggcagcggtttctccaaggccctccaggaagacgatgatcttgacttccctctgcccgacatccgattagaagagggggccatggaagatgaagagctgaccaacctgaactggctgcatgagagcaagaacttgctgaagagctttggggagtcggtccttaggagtgtcagtcctgtgcaggacctagacgatgacaccccaccatcccctgcccactcggacatgccctatgatgccaggcagaaccccaactgcaagcccccctactcctttagctgcctcatatttatggccatcgaggactctccgaccaagcgccttccagtgaaggacatctacaactggatcttagaacatttcccgtattttgcaaatgcacctactgggtggaagaactcagtgagacacaacttgtcattgaataagtgtttcaagaaagtggacaaagagaggagtcaggtaagtcgcccgtgtcttctagaactgagtttagttattttttgttttaaattaaaatttttttttaaccattaaaaatgaatgtatagttaaccatgctgaagtcgttatgaatggataatttaacacattggtgagttgtggaaaatcttccttgtttttggtttgtttgtttgtttgtttgtttttggtttttcgagacagggtttctctgcctagccctggctgtcctggaactcactctgtagaccaggctggcctcgaactcagaaatccgcctgcctctgcctcccaagtgctggaaatcttccttgtttttaagtgtattggttatactttctgatttaatgtaatcacacaattaagctttgccaaatccactgtcttcattcatgtctcggacatgccctatgatgccaggcagaaccccaactgcaagccccccgactcctttagctgcctcatatttatggccatcgaggactctctga

SEQ ID NO: 21409 - DNA, 1178 bp, Mus musculus
tgggcgttggtaattctcctcgtggctatattaggtgtcacccagtattgtgcaacaaagagcaaagggaggaaggcaggtgaaggcacttcgtagacctgggattgttccatatcagagtgagcttcaagtccgggtcttggttcatcactacaatgcccacgggaagatgttactatcttcccataactcacaaactcccagagaactctaggctttctgccatggtatatcacttgtgcagggatatggatgagggtaacatttcaaagaatccccagaaagtcaggtttccaaggccttacttatttttttgagttttgtttctgccgctgtgatgaattactctgacacaaagtaacttagggaagaaagggttcctttcagctccaaagccaggttgtatccatcactctgaggatgcgactgccctccacatcacacccacaaacaagggcagagaaataaaaacgagcgcatgcttatgctcactttagtttctctgttctgatacagtgccccaaaccgaggactagtgctgtctgcttcccatatcctttaatgatcaagacaacccctcagccctatactcacaatccaggcagttccacattgagacgcttcagattttagattctgtcaagtcgacagctaagactaaccattacacctgtgaatactcatcagcctagcaattcctctttaggattcattacaaggaaatgatggtctctctatgtgggaatatggttattcatctgagtgtgttgacagcagagaaaactggagctaacttaagtacccacttgagggagagaccaaatcatcagttatagcttatgacaccgtacaatggatactcactgtggaactgttccttgaagtcctactgtgtgggtaggtagagagtaggcaggaagtgtatggtaccattaagaccgatgcagtctgaggcctctcagagctcagagttttgtcatagaagcagattctgtacagtgggaagcagagcgaagcaggcacgtcaggactgtgctctgatatcaggtcaagtgcagaaaaaaatctaggaaatttgaatccctaccagggaggcagagactctgagtgatagaacacgactatcccttttcgtccccatcactgctgctgctaccaccactgccacagccgccttc

SEQ ID NO: 21410 - DNA, 1169 bp, Mus musculus
atgcagcctcaagttgttttgctatattttagcatgaaacagactgagctattaatcacaggagctaaagtttccaagaactttatctctgaagatatctctaatctctgtattacttacttccctgttactgtgatgaagtaccatgaccaaaagccacttaaggaagaaaggagtttattttggcttacggttccagggaccagagtccatcattatggaaaaaacatgtgtcagcacaagtgcacaagcaggaagctggctgatcacatttcacccacacacgggaagcagagagtgagagcaggaaggaggggctaagactacaaaccttcacgcttgaccccccccaccccccgtgacatacttcttttgacgaggctccacctcttaaaggttccatgacctcccacagtgccattaattgagcatgttcaaataaatgagtctgtgggagatatttcttattctaaccactagagagtgtctttttgtatataacactaggtgggtcatctttagggcatgctgtgtctgcagtggcccatgtgttggctggaaataatgtatagcgggaagctgagagcacaattggaagtaatggtttagacatttggaattgtgagagttgtgaacattcagagcttagagaatatatgatgtgacatttgacgggaatgccagtgtctttaggctcgttgcccaaaatgcctagaagagtgtgttttctttctcttgtcccaagacaaaggcgggatgtttgcagtcttgcctcagagtgttcttgtggtttttcttatgacctggagctaaatatcagctttccatacctagaagttctcacacacacacacacacacacacacactcacaccccttcagactgtgttaggaaactgatggttcagggtgtgagatgttgggaattgaagatacagaatcgattggtatttgtggtgacaatgggaggctgaacactctcctgggttttttgttttgtttttattggttgatttgacacaagttagaattacctggaaaagaggaacctcagttaaggaaatgcttcttttaggttgcctgtaggcaagttggtggggcatttactagattgctaattgataagagaagagtccagccctgtggagagtatatggaactctgagtgg

SEQ ID NO: 21411 - DNA, 1190 bp, Mus musculus
agaaaggaaacacagtgacttgaacttgaggcctcactaaccatgtgcctgatgtgctgttccttggccttaccatgtgtgtgctgccccaggtcactgtgtttgcaggtctgatatatatcaagtaagaaggtaatttgaaaaaaaacataataagaaaggccacaggtctttgtttgtctctagagcctgggacagtaggtagcagcctgggtcggtaggtagccgtgcttcctctatagaactggtaaggaccagccaaccataaccctgtcccagcaacttcccattcagttgagctacctgactgtaagatacatgttccagctctgagctgagggctaaaccatgagcgtgctgtgctgcccaagtaagcagacactaaggggctacagagttcttttgtttgcagtttattaaaaaaaaaaaaaaaggttgatcccacaaagagggaattaaaaaggatgctggagaaagtcatggaacctaaggaattactaataattcagacaggaggatggagaggagccagcccagctctgggtccgatgcagtcctctctggctgctgccaccagtgggcttccgctcggtgaagaccactctgcagatctttctgaaccctgggcttctgtctgtcttctatttctgggccctccccatgcatcccccaatcgtgggcctgtctctagagaagggagggatgctgtgagttaaagccaccccagggctggattcccagagcacatcaccaaaaagtgagctggcatgggccttgttggtctatgggatgtagtgtttgtttattttatataggaagagactatagcagagcttctgtgtaatgggaaccttctggaaaagcagcagaaatgctatgtgtggtattgactttgaaggaagccagcaatcacccaagttctggtacccaagtacccttctttgcaggagaggtatactgtggaactactcagtttccttctcaaagcccattgcagactcagagctgaacattcagcggtcagggtcaaccccatcactgccagctcatgtccacgatcacccaggacctcccctatggagggccctggggaggaacgagaaacaagctgtggtcctcgttctcaggactctcgaggattcactgagatccatagatacaaagcatgcagcacatgatcagaagcatgc

SEQ ID NO: 21412 - DNA, 1129 bp, Mus musculus
tatctgggatgcagaatatctgatatgcgactcccagatgggtctcgactgctgctttggatgatactttgggctcagggtgtgaaaataaccaggtagggctcacaaaatgtctcagtgataatggtgtccgtcacaagcctggcaacctgagtttgatcttcagaccccaatgaaggtggaggaagggaggtgcttctgccaggttgtcttctgtcctccacaggtgctccgcggctcatgcccccattaaataggcacaaaacaaatatatattatgatttttatgagaaaaaaatagccaggtaaaggtattgctgacatcatcatgatgacttttagaagagctcagagtatgttgttaggttgggagagcagaggagcagatagctgcggtgtgttgtcattgttagtgtccatccactgggatggggcgctcctaacagcagttacatggttttcttcttatcgtattctttttacccaaaataggtaaaactctattggccaaagcagtagcgaaccagacttcagccactttcttgcgagtggttggctcagagcttatccagaagtacctaggtgacgggcccaaacttgtccgggagctcttccgggtcgctgaggagcatgcgccgtccatcgtgttcattgatgagatcgacgccattgggaccaaaaggtagactcaccctgaactgtcgtggagataaacagtattggccctccctgtgcagcaagcccttgctgggcatggccctctggatacttcactctgccctccaaggggccttaaacacctacccaggcagtgtgtggaacccagttgtgtccgagcttgcatggagccagtaccatgcagacgctgcagactcactgtactcatggtagtctttgccctgcagctaaaaggttgaaccaaacagggagacaaaaaatgggcctttaggcagagttgctgtgcagcgatgtggttcaaaagtgtgtctgtctgtctgtcccgctgaaaacgaaacagcacaatctgggtggtttaaaaagataagaactcgtttcccctctgttctgggccatgaaatctaagaccaggcactaaccgttgtctgcacaggactgcatctgccccagg

SEQ ID NO: 21413 - DNA, 1163 bp, Mus musculus
acccccttatagtcttcccagtttatgcatcttggattctcagaaattatgatacatgagacatttaaaaaataacctgttcccaaatgagcaatttgtgtttagtctgtcttatactttatttcaaaatatctctctgaattccttaagttaaaaataagtgtttcggtctgaacatactgttctttttttctttctttctttctagtcagggttctctttgtagccctggctgtcttcgctctgcagctgacctgcctctgcctgggattaaaggcttctggcaccacacccgactgactcatactgttctgtcttctaggcaatctgtacagaagctggcttgatggccttgcgggaacgcagaatgaaagtaacaaatgaagacttcaaaaaatctaaagagaatgttctttataaaaaacaagaaggcacccctgaggggctctatctctagtggcccacagtcgtcctcagggatggggagctgtccccaggaacccattctccagttcaggtttgccagtagaaagcctgtatcgtggaggacactgtgcctccatctgttgttggtcattgtgccgtgctgctctctactcccaataaaggattggcctggtttgctttctagcactgtaatgagtaccatgataaaaaaacaatttggagcttgagggaagagttcattttctctcagcttgtgatggaagtcggacctggagaaaggaactgaggcaggagctgtcctgggatcacttcccgcttctgtctgctgtccaggcaaccacctgcctagggctgctaccggctgctacccctcgtgctaggctgggccctcccgcataaatcatttattaagaaaatcccagagacttgcctataggccagtctgacagaggcattttctcagttaaagttccatcttcccaaatgactgtagctttgccaagttgacaaaaggtagccagcacaagcgtgtactttgacagctggtctgtggctgcccgcctacagctccctgcagcagatgggagggtcctgtaacagagtgggtagttcacgttcccaagaggctgagatccacaaggagtcggtatagaatcctatcccaaccatgcctgcctcggttctgggttcataatcttcctttcttaacagatggt

SEQ ID NO: 21414 - DNA, 1370 bp, Mus musculus
ctactttcaactacttttccccctctagaagaatcaaattgaaatcttttacttacctcttacaaaaaaaagaaaaaaaaagaaaaagttcatttcttcattctgtttgtatctagcgaagctgaatgtcagaagcccctctgtccacacacaaagtctgcatgtattggtcggtggtcctgcccctaaagtcaagcccctacatcagttttacagtataaatactcgtactaccttataaggaagcacttagtggactccttaaagttccatttgctaatgattaatacactgtttgggctggccagtttctcatgcatgcagcttgatgattgagcacagtcaggcatttgtattaaaactgaaaaatggaaaaaacaaattcaaaatctcagatggcttctagttcaatctgttcagataaattgtcagcagccagtttactgcaagcaaacatttaaaattggtttacctcaggatgattgatgtgcagagaatgggggaaggctaaactctgagacacagccccagaagtaggacagtcctcatcaagtgccccagtcccatggtgacagtgacaccctggtggcgagcccgagtgtgatggttcattgctgtgcgcattgcattggagtgactgaacaacaaggctgtcaccaaatcccacacattttattaagaaatgtttcctaagggagcatttttggactgtgttttaaaacctagtgaaccatgactcggagccagcagagtaggctgtgtctgtggacttgagcacaccatcaacattgctgttcaggaaatgataatttacgtccattccaagttgtaaatgctagtcttttatttttttttttccaataaaaagaccattaacttaaaagtggtgttaaatgctttgtaaagctgagattggaagggggacaaggccaaggccgctggaggggaggtcagcatacacagagacacgcaacatccagtgcaagctggatttcccaccaggttctctagccacaactcctgaaaccagacagactcggagttctttgccgtctatgaccacgtaagtcttgttattttctgtgttgtgtgcacatgcgcagatcacagtcaggtgatgttcagactagagccctggtgagagaaggcgtctccagcgtacagttaggatgtcttggctgtgctgctgctgacctgttgtaactacatgaggccatctgtgcgggagacatgatttagtgtgtctgtattcctatactcactgtgtatggcaaaagcaggccagacaaagacactacctttgattcagtttgtaatttatggttatacttatctttagccgctatacttctttattattattatttaac

SEQ ID NO: 21415 - DNA, 1128 bp, Mus musculus
ctatattgtaaggaatggctgcccggtaggcctagtgttatgtcacacaagaggaatagcatctatcattcgcccctcagcatcctgggaacttcttcttgaatgaagactgtaaatttggtcaagtcaactcttagttcagttatcttaatcatttgaatgatttattgtgtgtcctatgtgtatttctctttggcagcgaccagagttacactgatgtgtcccaactgacccactcagctggcggtcacctacttaatttttttcaataccccttgaagttgtccggtagaagtcagattatttgccatctatccctttgagtaagaaatcagggatgtgtgctcctcccctatatcgacgatgttcattaaaacacctatagcaaggatggtggtggtccttctgttaccgaagtcacccttcactgtggctgtttgacaaagagttgtacttggacgttgtgtaaatcttgagataaactgttttggagatttaaccacctctctgacgggggaccaactctatggaaattgtaaataagttttatttataaacctggcactgtattcaataaacatttctgcagcctttcatctcttaactgtgaactgtgtaggtttttagctcttatagcttccagttccctttgcggtatacgagacaaaccttcctgccctcaagtagaatccccaggacctatctatctagcaggtgagagtgtggagctggagatagcaggggcaacagagggcctatgtagtctattctagcattaagtagtttggaggttacccaatctccaataccaccttgactttgagaaatgtatttttaagctggctgtggtaaagcagagacaaatggatctcttgagtttaaggccagctggtcttactggagttccaagtcagctaaggctgcatatggaaactcagaacaaacaaacataaaaagaaactaaagaaatggacatttcaggtggcaggatggaggtgtagttcagttggtagagttcttgttcaccatacacgaagcctaggtgttacacttggcaccggacatcctaagctggatgtgatgacgcacgtgtgtaagctcgacactctgaacgttggagaggtagag

SEQ ID NO: 21416 - DNA, 1141 bp, Mus musculus
ctcctaagtctctgtttctacctcccaacagctgtgattatcagagtgtactatcatatctagctgatgttacaggttttacacaagagaatttcttctggactcagaagaatgcttttagaaaataaggaaggataacctagggttaagttccttgtcattggaaacaatccaaaaagtttgaacaccatcagatacggacatttgtgttggcaggagatttgacttaataagtacctttagctacaatgtcatttgtgtgaatggatgtgtcatggctcacatctaaaagtcagaggacaacctccagaggtcaaatctctctgccgtgatttccagaagccaaactcaggttgcctggttctacatggcagagtcctttaccagagccacttcaccaggctccttcgtgtgtgtgtgtgtgtgtgtgtgtgtgtgtgtgtgtgtgtgtgtgtagggtccttcacagaccatggaggtcccttgaggttactgactggactaagctcgttggccagcaactctaggaatctacctgtctctgcctttcttggctgtgattattgcattgctgtgcccggctttatacatgggtgtcagaaatccaaactcaactcaggccctcatacttggaataagtcatctctctaacagtaccttttataatgttcttggttcacttcaagattttttttttctttttgatttttcaagacagggtttcgctgtttagcccccgttgtcctggaactcatgctgtagaacaggctggccttgaactcacagaaatctgcctgcctgtgcctcctgagtacacccgccactgtattttatttttcattatgtgtacatgggggtgtgtgaagggacactggagcacatgacagggctctggcaggccttgccctcctccccagttccctctacctggataaaagcctgttggcttatctattcctgcagctggcccccaagctctattccttatttggccacttcctccttctgaggctgactgccaaggttcagcaatcaacccccaccctttggctcacctaattaacatgcccagataaaattaaacacctcatcctaacgcaggtttcccccttctcctttagtaaccgccacttgccctgtg

SEQ ID NO: 21417 - DNA, 1550 bp, Mus musculus
cttgtagttgaaagatgaatttcagcagtttcgtgtggtcagtgtcttcagctgctgctcctaagctcaggagttggcaagaacatgtgtgccaagagtaggaggtacattcctgcctcttgggtctctgctcagagcccaggtcacgtaggtacctggccctccttgagtgtctgactgtctgtctccgcaggctctggtccttcaccagctgggccgctacagtctagctgagaagattctccgggatgcagtgcaggtgaattcgacagcccacgaggtctggaacgggctgggcgaggtcctccaagctcagggtaacgacgcagcagccaccgagtgcttcctgacagccttggaactggaggccagcagccctgctgtacccttcactgtcatcccccgtgtgctctgactggccgcccgcctcacctgccacacgggctcagatgctctgcgcgggctgccggggccatcctgtcactcagtggacgcacctgcagaaccaaggccctggatggatatgtaaccagagtggattaacctcaccaacccagaatcattgctctctgctcctgcatccattcattcttgtttttgccagatccatgactgtcctctgaatctactgatgtccccaatggattatgtgccatattcagttagtcgacgcctgagttttaagtaaaatgattacggacttaatcagcgaatgtagaagaagatattccaggttaaagttcagtggcagaacagattatttttatcagtgctgtaatgaaagcaactgtcctgtcctctgaccaccccgacacctctcccgccccgccctcagcccaaaaccaaatgtgaattttctgtttcccacctcagtactcgtccatgccaggacaccagctgacaacgtctcggtctcattgtcaccagttgtaccatgtggtgaattactgttctctccttagaacaaagcccgagtctaagaatatttatattttaccaatatatggctgttacaagagaaggaaatatgagttatttaagtttaacttttttatgtgaattcagagtttatttatcgatggaaatatgtacaaagaagcttcaaatggaatatttaccgacattccttatacatgacagacacttggctaaacaggaagatgatgttaataaaaaaaatgatttttaaatggacccctggcttttgtctttcacaaagctggcagaccagacaacagccattgctcatctatgaggtgtaggctctcccattccggggcctgccctgaacagtccgcctgggcacagggaggggcctacatcagctgtgcaggcagctgctagagagagcctcaggcctggctccttattccaagtctgagctgcgtgtgttcttttctccttcccggcctctagcacctcactcccattcattcattcattcattcatgggtgaggagacatggggtcaagacacttacctggggaaactacctggcaaaaagggcctgaggctttacctctgccagatgtcagggtctgccctgtgc

SEQ ID NO: 21418 - DNA, 1136 bp, Mus musculus
ttgcaccctgcatgaaagtaaaatgtatccagtaaacaaatacgagctatagaggggcaggtgagagcatgcacttgtaatagttgttttcagtatatgaagttatttgaagcagatcataacaggttaaaaccaaaagcaacaaatagcatttttgctagtacattagcaagtaagagaaataaacactagccaaacagaaggcagaaaagaggaagaacacaacacaggcatgtgtgacaaatactgtttcaataaatggcattgtagggatttgttagttttttgttgttgttgttgttcttaaagatacagtttcactgtgtagcccaggctggcttcaaatgcatgatcctcagcctccagagtactggggtcataggtatgtgtcatcatgtttgcacaaatataaatgttccaaatactcaacccaaaagatcactagaatggaaaatgaggaacatttgaatgttgactacaggaagattatttatttatttatttatttttatttatatgaccacgttttagccatcttagcacaccaaaagaggacatcagatcccactatagatggttgtaagctactatgtgattgctgggaattgaactcaggacttgtggaagagactgctgagccatctctccagccccctccaggaagtattttaaatatactgctagaatagattgtgagggaaaaggatgagaaagctgctgcggtcccactcactgtaagataattggaggagctggattaaagtctgcagaggtggcgttgaagcaaggaagtcagtccagtaagtgtaataagaactctgaagttcatgtacccagttgcaaagctttgaaacacatgaagtgaaagttgttaacagtttacagagaagcaggtagctatatagttttgctgtgactcagtaaccttgtctcaatcaagtctaaagcaggaagacagatccgtaagttatagagagaagccgggagacagtgtgctgactccgatggcatcctacctaacaacagaacacatattctcttctagcacaagactgaccaagagcaagtgtattctaggtcggaaacaagttgtgacaaagttagaagagctcaactgtgtctctaatgcaggtcag

SEQ ID NO: 21419 - DNA, 1222 bp, Mus musculus
cctccaaaaagggccaaaattatctttcttttcacttctgaccttgtgctctcaagaatatagaagaattctgcttattctttctagacgttgaagcaggcaagtgtagggatagtttagtaacctgggatattatgtggtttaggctatgcacacattcctcttctaataatgcacttaacagcctgagacccttatctgtactaagatacatagtcctctctgaacagtcccacttgactgttaaactcagtttctcttcagatgtagtcccaacagacacaaggaccagttcatccattagttttgctcaataaagcaaaactcagatgaatttttagatataatctgctatttaccattttatgcctatgcataattgggtatgcatttgattaaaattagatacttaatggcaaaggacatatagagtagtgttatttacatgatctactctatcagcaaaaatagagaatctgtggcactataccccttagtaactgtacttcttctcttggccccatcaaaggaagcccatacagtaaccaaggcccctgagtgtcactgttgaggcctgctgcacccctgtgctgcatttctgtgctctgttctgacctgttctgtgtagcttggctttgaataaaatttccttgctgcctctgcaatctgtttgagtttttatttcaagtctttgattagagtctgagaatcgggaatcacctggctcagactcccgatcactggtaacattattactgcagatatttgaagagagttttatgtaggacagaccttttcagttctgttgactgtccctaagaaattatttcagatccctcacaccatgttagacagccaacttgtcgatttagacttgcgtggttgctgtttagcttttgtgtacccgttccttatctttagccatatatgtatcatgggtacacatctttctcatgtgtcttcccactaactctgtctgtgtggaactttgccttttagagcatgtgtaacttctgaacaggaagatactgctccatcaagagagtcgttcttcctcctcctacagaatggggtcatgaaaaccatgataaatgagtatcttttcacctgaaaatcaaggtgtaaatgtttatcttccaaaatcatctcttgacaactgtttctatttttctctgcctttgaagtgatataatacatttgccatgaagtgtttatttggtgt

SEQ ID NO: 21420 - DNA, 2293 bp, Mus musculus
agcacccacagcctgcaaggctcccacatcctagcccgggagagaacgccaatcgtaggaaaagctgacagtccctctccaggccagggtacccgaggccggccactggacacaagacgcttctctctggcccccccaaaggaagagaggctggcccccctacagcagtctgccacagccccagcccttgctactggatgtagcagtggtagcaacccccagatccagcacttttctcctacagtggctcctgcagtcaggacaaaatccaaagtgccacaacactcaggggaggtagccaccgtagctcctgtgcgtccagggctcggcacctcagagggagatgggggcccagggcatggttacagcgaagggcttctgaccaaaagccctggcaggtcttctgacttgcctccccatgtcaaaaggggccccgatgacttcagtcaagggagcagttcaaagagcacaccggcgtccccagagccaggtggggacccgcagacagtgtggtatgagtacggctgcgtgtgactcgcatcgtggatctgcagcttgcaaatgctaaactactggtgcgccttctgattacaatggcctttccccctgtttgcctgtggtggtggtggggggaagggtgaaaaatgaggagtggagttcccacggtcatcctgttggctgaagggaaacactgtgccaagccctaagaggattaccctccagggtctgtaacttattttctgtagctgcggcttccagcagctggcatcttatggacaaggccgtttagcatgggagccagttaggagtcagtggcaaagcgactttacccagaaacagacactacttgagtaggaatgctcgtttgcaacctgtcaacctccactaaatagcatgtgcacgtgtgagtacatgcacggacgccaggttcacaaagctacgtcctgatgggtctcgaaactccactcctgcctaaaagccattggtcctgggaaaggcttagactgggcaaaccacaaagatttgcagggttttggggaaagcccagagcagggctggctgctaaacccaggacccttgccatcctatttctgaggtccaagcacttccctttaaaacaggaccaagtttcaggatcagccacgggtcttagctctcgtagctggctgttgggccctgcctagtgggctttaagactacctaggaaccagccttttgggacttcccaggcttgctttactacaaacactggatctgccaggcctagggtgtgaggcaaagagatgccctacgagtatcccagtctggcaggcatagttactacacagaaggaaggccaaagccacacttgctttgtaatgtggctgttgcacccagcccttcttggctcaaacaattttttttatttctgaataactttttgggggtagaaaccaaatttctatatacacatacatacacacacatgaatatgtgtgtgtgtgtatacatatatatgtatatgtacacacacacacacacacacacttacttttgagggcctatttatgttctgaaagtcattctttcagtagtctgacctgctgtttgttcgtttgtctggtctacttcctgacatgttttgtttcctattgtaatggtgcttttcctgggatggactaaacgatttattttctgttttgatgtaatgtgctgaagaagaaacgggggagaccttgaatgttaacaggatccatggtgagggtgttggggttgtgtgttaaatagccattcgttctggaagaccaggacagggctgtaataaagtggaaaggaatgtgactgagccctggttttcttcagtaaatgctggctgcatgcaagagggcccctccagctgtggaggtccatagttgtctgagtcatttgctctataaaactgcacagccagcaagacagatgtaaagaacagagctgtccttagaagtgacgggcagcctgtggtccgcatcgcattaagtcagcatcaggtgagttccggttgggcagggggttctgctcctgtcaggacaggatcccaaagctacaaacctcccaagtgttgggtttggacctagggcgtcgtgtttaaatcagtgaagtagatgaaatggggaaaaggtatatataagtcttcccaggtgaccaaaccttgtgctgtcttctggtccacctgatacctcggtggttctccgctcaccagacttcctgtgtgcaccgctcctgcctcctggccttgtgccctcctttcctaagtcactgcaatctgttggat

SEQ ID NO: 21421 - DNA, 1142 bp, Mus musculus
ttaaaggccaaggaagggtgggggcggggagggggggtccgaagggaaataattcttccaggtcttaggaggttggggtatgaaaaagacattatagtgtttttaaatacatctagccaaggaggtgattttagaattacagactgttggtaggtgtttcgggtagactgtatcctgacagcgggccagcctgtcattaggtgtgtccggtgtcctggagtgggaacggcagctgtatgtgagctgagtgagtagtcagggagcctgtcattaaaatggctgagtaagagatgctggctgcagccttaatgagcattcttattcaataatttaacacactgaaattgaaaaatcctccaaaccagtggctcctggggcattgtgcagctctcctgttgtgcttcgtgagtaatggttggcaccagggcgccactaaattaaattgagtcagcgcctaaatggttctggcctgggtatcaggcgtaggttggccaggattccgcttccctaaatacgttttgctgacttagactcatttgtaattattgttcatttcatttgtgtttttttttcttcctcttttctctctctctctttttccttcctgtcacaatgataacaatttagcattccagcgcaaaaagagtccttttttgagaagcaaaagcaaggacaaagacaagtctccattggtccatccagctctctctaaacgcctgcggttctggtcttcctctgacatcccatcctcccctaacgagtctgcctctttctcagacattggggatttctgatcccctcctttaccatgtgtctacatcatgtgtccctccttcatttcaaaattcaaccaacaaccaaaagaagttagtccctaaaggccactcggtccctagcggacccctgtccctcccccagttccaaagtagccaccgtggattctgattgcaaactagaagatgacctgtcatgtttcctggactggtgcttcggcacagcacagtagtaggggacccccgggatgtacgtgcagtaacttgtccttgggccaggagattcatgctaagtaagtgacgtgacctcatgctccgccccctcccgcatctgcaagcttctctcgtgcccttgtgcaaagcggaagt

SEQ ID NO: 21422 - DNA, 1229 bp, Mus musculus
gggaaacactgcttccttccacgtcctggtgttcctttatcctagcaaaggggccctggcaagcatttagggaaatgctgccccctcgggtgcacaggctgtgattcggagcatttggacggtcacaaacactgtgacctgtaatggacagaatttggccaccttgggatcaggtcattcctgtttccactctgtgaggccaggtacctcatatgcagctggggtttttaagatttacttctgtgttttaataattgtgtgtatctgtgcgtgggtgtgtgcacatgagtgcagctacccgtggaggcagagatggcagctcttcctctagctggagtttatagttagtgtgaggtccctgcaggggtgtgggaatcaggccctgtgcaagagctgcacgtgctcttaactactgagccgtctctccagcctgagagtcaagtttttggaaagctagctgaattatgagagttaggacggcaataattgtattgttgtaggtttacatagtcccttacctacacatcccattttataatctcaggagttagaaagccccaccgagttgggcacagcattttttttattttatttttttttcagtgactaactccatatgttttcttacaaaagcgtaattaattatgagtgcatcagacctgattatttaggtaggtttccaattggttaccaccgaggtgctcgcaccactattacacttgtaagattatcaggctgtgctggtggctgatgtggttcatgggcatcacggctgggtgggactgttgggcacagcattttagagaaaaaaaaaattctctgtttttcttttattagcacagctttttgtttgttttgttttgtctttcacttataccagaacgcctaaactataatgtaaaaggccatgtcttttacaataggctgagatgtcttcttcgtttcagtagacatgagcaaaacggcctgggttcgagtgtagctgcctaggttagctcctgggactggatgagccagtggttggtgacacagagctgggtcacgctggctgttacgggaggcaaagctcctcagataatccctctgtacagagagtctggggacagcaagtagattcttcctcgtctctgggaggcacagtccacgatgtccttttgtgttcagtgtcttaacctggttcttgtcctcctccccccacctagaccagtatggcatcagggatgtcgtcc

SEQ ID NO: 21423 - DNA, 1816 bp, Mus musculus
attacccagctgtctaaacaaattaagtgtagtggcatgtgctgctgaagatgaattgtagcaatacataaagattaggtaaaaatagcatgctccggacacctctgctgcactgtgtcttttttgtaaggtgagcggctactaaaaccgaggtgcttgctaggagtacctgcattatagcaggatttaaagaagcaagtggaaatgttcagttctgggacttgggagtggggtgtctggttaacattgttggttctgtcggggtcctggcctttgttttgggttgaggctttgcatttgagtcatcggattgtggaatgtggccaaatgaaagtgtgtctgtctcacggagaagagagccaggagcccaggattccactcagtaatgaaccccgttctgtgtgtcaggctaacaatcctgcagctggagttggttttagctaaggctgctgtggcccagcgtttgctggggggtgggggattggggtggagtctgtgttgtcatagttaccctccccctgcttctgtctaggcaccacctgtccctccagttcaggtctcccttcaccaggatgcctgctggctactgtgacctcagccggatcctggtttttctcttccttaaccacttgtttcctatctgtgacacacaattagtgtacggcctccctgggtaatcgtttccacatgtgttcatgtgggtctcccgtgagatagtaatccccacaggtcagaggtcaagttttatctcctcttctgtggaagatagctccctagctctgggcctgcttgctgctttctcccatacagccgaattccaagtctcattgtagctgtgtggccaggcaggccatttggctgtgtgaagtgtatgtagggtaagccttcctgagaggagctgcctgcctgcctgcctgcctgcctgcctgcctgcctgcctgcctgcctgcctgctccttccctttcttcctgcagagcagggaactgaccatggtcccagcctccatccaaagggcactgagatcaaaagtgcccagggtcacaacaccctgtgccggggctcacctgacttctcataaactggagtttctgagttgctgcttttcaaggctttgtcaccacagttgagcataattctctgtgatgtgtctcatagcctgccacttgttcttagcattgctgttacaagatgcggataccatgaactctgcagcttaaaagcctgcgtacagcatctcctgttgacttctagaccctgggatcctttgcattcttgtgctgagagacctggagtcccagtgactcctttggtcctgcctcctcatcctcgagtgacctgagcatcccttgactcttaaatcctatctgcccactagttgtctgagttaacaaggtacttgtgccagtcagatagtttgccacatagggtctgtgtgttcagactctcatttgcatgaactgctgtttttgcagcagtccacggtggggtggggtggggtggggtggggtggggtggtccacagggaacaggctgaaagcccagcatctctgcacaggaatgtacgttactgatggtccaactgaattgagggtggctgtcctacactgatcctgccagtcatcagccatcattcctgactcctccctagaggaaaactgatatgtactgtggggctggaaaggtggcccttattattcagtttctctttaattagtcagttcattttggtggtggtggtgtgtgtgtgtgtgtgtgtgtgtatgtgtgtgacagaatctcacaatgtagctccttactgtctcccttctggggagg

SEQ ID NO: 21424 - DNA, 1203 bp, Mus musculus
cccgtcagctgaggttcccctctgtctgggatgctgccttgagtcagctgagagactactactgcctgtgacttgggtctgcactgggcccaggccctgcctagggctatgagtgttgcagggcccttgtcttctctgcagtctggatttgaaatgggttgggagagggaagggtattctgttatgattatgtctgtcctcccatcaggggaggtaagcagtataagtgtacacacaccataaaagtgtggccatggcacatgcacagacacacctgtacgcacacactcccacacatgagaacacacatacacatacaagcttaccacagatgcatcatatgcaaaacagaaagaatggggcctagattagcacatttggtaaaataacttggtgtgcaagcatgaagacctgagtttgatccccacgctccatgtttaaaagaatccagacgtggcggtgggcacttgtagccccagaactggggcagcagagatggaggatccctaagactcactggtggccagcctagcctcattgatgagccttagatcccagatcgaaaccctgtctcaactaagtctgtggctactgaggaacaggttgacctttggccccaaggcccagagggtcccctgctgccggtgattagcagctgtaagggaccaggtctgggcttggtgaaaggcctcatcacccactggagacagtgtaccgctgagaggtgtttgctgccgagttccaagtgggaaattatctcacaaaggagggactgggtgaccccgaaggacttgggggtggggaagaggacctgatgatcttgtcattttccattcttttagctctttgagagtggggatggcactggtcgctgtctagccccagctaagcacagtgcacacaagcacttgcagggagcgacagtcactgtccccctcatctcgccagtttggaaagagctgctacaatgtgtgtgcattagtggctggcacgtcattgtgcacagtgttctgtctgttccttctgatttagggggagcagaaattcagttcgtatattagaagactacttggcctgtataaacagcttgaaaaacaagggccatgaaggcaggtggcgctcagctctctggggacaattgcccatctcatgtagtgtttcctaccggtggttgagtgaatgggttttgttttgtgctgttat

SEQ ID NO: 21425 - DNA, 1827 bp, Mus musculus
tcaaattgtactgtcatagtttctgttgaagaatcagggctaaaggggaaatccagaagaaatatcccatctgcctgcattttgatagcattttatcttttatattgaaatacatttgagccaggcattgtactacacacaggtcagtaatcatagctactcttgacactaggaaagaaagattgctagaatacggcctgcctgggccacttaagaccccggctcagaaggtatacaagagggctaggtatgtagcagtagtagatagagccagcccttggcctgagcatgtatgaagccctgggttcaaccccaataccataaaaaaatgaattttatacaggtagtcataagccattttaagtagcttaagagaaccttacaaaaatatggaaattttagaatgtctataaaaattattttgagcatgctggcatggggcctatactttttctaagttttacaacaggtaatttcaaatgtagtgggttctttacataattcttatttctcaacagggaggactcgtgggtctggtagattatcctgatgatgatgaagatgatgatgaggatgaagacaaggaagacacactaccagtgtcaaagaaagcaaaatttgagtcctaataatagcaactgcctgtgatcatcagtacctgttgacaaaactggttctttacccctcccccctacaaaatccacatcaaagtgcagtggtctcttgtgaatgactgacccagatcagcaccacactggacttctgctcatcaagtgccaattcaatggagcaggaggaggggatgccgtgcagttaggggaagacataagcctgtgagctctccagcttggaccacacattgcccttttctcagggaaggaaatggaaataaaaagccaacagggcaggggttttgtcagtggaactctggattgactggtcagttgctacaatcagaacctgctttcttggaccatgtttgagacttagaagaatgggtctttctgccatagttcctcactagtaaagaatgccagcagtttctttgtataaagagacctgcctttaaaatcatacattctgaacattttagtcaagctacaacagatttggaaaacctttgtgggggaggggcagaataaagtatctttttttttttttttttaaatctgttccctttgcccttcaaactgcagattttttttttcaaagtggggatttgtccctgcttgattaaagattgagtggaattctagatgtggtcatttgtgtcataatttttctttttgtttcaatttgtttctgttttttttttctctccccctgggtgtatgattagttgttgaatatatatatttgggaccattaaaacttttttgatgtaatatagcctaacgtgctggcacctgctttacatgtgtaatttgtgttctacatcacagttcttaatttgtttagagttttatgaaagatggtatagtttttattgacaaaagcaaagtaatcttacaactatgtgcatacaaaagcaatactattttgtgactaaatattttatattaaaatttgcatcagcagctgtcttgagatttcagggaaatagagtggaatttaaaacttcaacagttttgttaaacttagaaacatgaaattagtattccaaagagattcggaaatttcatatcttggagaaatgacggtacattaaatcaaaattgaggatggatgatttaaaagtaatacttgacttttgaataataaaaagaaaagtgaagagtaagagaaattgtattaattgtatgtttcttttctttctttctttttttt

SEQ ID NO: 21426 - DNA, 1170 bp, Mus musculus
ggttaatcccaccacctgagagacagaagcaagaggattgcttaggatttgaggctagcctggtctacatagtgagtttcaggttagccagagcaagagccatagtgaactcctccttcaaaacacacacacacaccaaaaaacctaaacaataaaaaaccataaggttttcttgcacaaacgcacaaatacacgtaacttttctgtaaggttacactttatgtatggctgtatccacgtaaaccttagagcactgttagcaatatcctgagacccgtcacctcctgcctcagtgtgagctttccctgtgtggggtgcagcgctctgtgcttactctggaggccgtttcagtgcaccaacaccaagtgttgggacttccaagtatttctaaacctttttccaaagccgttagaaagaaaacatcctgatccccagcttcactgtataaggatgctcacattggtattcattgttggcactgtacatgtacaagtcatgtcttcttacatattttgtaaattaagataagcctttaaaacagaaaagcctatataagcaaggaacagtggaaatgagactaagaaagcgtcggcagtcctggcgcctgtcagtgctaacttgggttgtttgtgaatttacctggggtaacctgcatatttctaatgtgtttggaagcctggaggtgttgatgatgtgttgatggttaaaacgtctttttctgaaaaattaagtaactgagataatgctgctttctgatgtcacctgtgtccttaactaacttattatgctaatttctctgctgtgtgttagaaaaagttgccctcagagttaatggaaatgctacgttgctccagccagttttgctgatgttacagatgcccctcaacttacagtgggcacacagcccaataaacccaccctaataaaaaacgtcttgaattgagcatttgtttgctctactcagctgtcagttggccccacaggggctctgtgcccacggctgcccagcactgagaggagagagactaaatccgaggcgtggtttcagtttagtgtgtatcattttggccaactccacagttgaaacagttaagccattgtaagttgagggtctactgatagaggtttttatgtgtttcgtaaaaagttactctctctcattagcctgga

SEQ ID NO: 21427 - DNA, 1109 bp, Mus musculus
cttaattaagaaaaaccagattggatcagtagtatttttgttgtttttcatatttaacataaaaattcccttcatccctaatttgtttataattaaagagacaaattgattttgtattttttcaaagttttatacatattaaaagggttttgttgtagtctatcatgaatgaaaaggatatttttttttttaatttgaggaatacttttgtgtgtgtgtgcctaaaatggtctgtcattttaagaattagcacaaaaaaaaaattagctagttcctaaatgtatggaggtttaatagtaccagtacacagttgtgggtgaggcactagtgagaagtgtgtgggaaatgcagctgggtaggtgggactcacttgtctctgaatggtttaaaggtggtatttcctggaatttttttaatgattttttttttcaaggaagacagacattcgaaatgtgcttatcaaatttctacaacactggactaataggaataactttttttttaaaaaaaaaagactgttctgtataaataaaatatatgaaactcaagtgcaaaagccgtgaaaataaaaggcattgtcttctgtcaatgtgatgcactgtggccgagcagttccctcaggactcaactctgcagcccttcctcctgtgcctcaagtgtcggctgccactccacaggtcttccgtctgtcggctcctttgaaagccgggcttccaaagccctgttgaacactgagggttctggtgatgtgtgttaatgagttgtattttaaatatcagagattattaaataaagagaatgattttctattaacctttctctatttctaatttctaattcaaagtctggtgggaggcaagctatttatctgtctcttggaagcatttcctaaatgcattttcaggccacgttcagaccccgctgtaccaggacttggagctgtcacttggagaagcactgtctgtggagttgtttgtttttacacagctgcagtctgtgaatccctcacagatttctgtcagaatacatcgtctcctgatcccagacataagagccttccacagtgatcttttcattgcttaggactaaacccaatgacttttatacgt

SEQ ID NO: 21428 - DNA, 1208 bp, Mus musculus
gctttaactttagagtttataaaatgttcatataacacaccctacttaaatcatgtatgaaatacagcatgttagtcttttattagaaatgttttaaagagaaactgagcacacactgaatctatttgagtgaagctttttagtttgttatatttatggcattgtccaggcagatccaaaatcaccattgaattgccatcctctttgggttgacctaggcttactaaacatttagatttcattattaatgagtagccagtatgaaaagatgccaatgcttattctagccacagtatccaaagtgtaggagttctatgacattctaattcataaccaggagttgctgtttatagtactgcaggacagacaggggcaagggactccactgccacggctggtcacagactcgactaacttttccatttgtttttttaccaattggaatacttaaatgtattgtatgtaatgaatactaaactactgataatcattttttttaaatctgtaacttgttctgccagataaaatgcgtacagccgtgatgctagtgttataaccaagtgtaaggaccctttggaaggccagacatggtgctgtgttcctttgatgctggtacttaggagaaatctgcagaggtaggcagatttcttcttgagttcaaggccagcctggtctacatagtaagttccagactttctggagctgcacagtaagaccctgtcttaaacaaaaaacaaacaaaccaacctttggaaagatcactttcatattttgggatgtcatgagcttatctatgtttcaaaattcagaatagctgtcctttggcctaaaccataaatctacacccccaacgacagtactatgcagacatttcactgatttaagttgtttgatacagtcagtgcaggtgaactccatgctaaagttttaagccttggccaaataacttacacctcacagactgtctgaggcggtgcttctttttttcctgaaaacttgatttttcttgatgaagccaaagttaatgagcatgaattctcaaaggagtagtctgctttgttttacttaatatcaggttgagtgaagtaagttttattcgtgtcagagtctaagccacacattttgaatacccacatgtttgatactatttaagtcatgctgtgccaagagttactaaattcttagaactggccctgtgccctgcctaa

SEQ ID NO: 21429 - DNA, 1912 bp, Mus musculus
ccaggaggcgacgctgtgagtgaagaggacatgcttcgggcagctgtgaccatgtctttagaaactgctaaagacaacttgaaagcagaaagaaaaaaatagtacctttaaaagtcattttgctactcacactttgtaacattgtctgtgtgattacagtgtaagggccactttggcagtatgttcaccagaagagataaagacactgtagtggtttgtaagcagaaaggcagaaatgtgtcataggactaaggaacgatcgagatactagccaaagaggcagtcagcaatgaaagaaacttttctaaatgtcccgttttgtttttcaaatgtgcaatatctgactgaaattatggaatttttgttggctcttttggaccaactgattagctcttgccacagaacttgatcctataatgtttcgttttctctctgcattgggggtggcttggctcacttgagcttttacttcatttcagacctaccttttatgaaatgtcttttatatgtcttgttacagaaagatcagtctgtcttctcatacatatgtcgggcacgtggatgcttcctggtggtattttctctaatgtggtgatgtgttgcttttaaagcctttgttagtgggatcacatttcctaattgtgctgcattcctctactctgcagtcagctctgttcttgtaactgagcacgtgagcgtgctctgtctggatgccctgagagtggctgactcctggctggagcccttcctgtaccttccttcctctcttctccagctgagaaaagaggaggcagaggacacaaacagatttccttctacgtaacatgcaccatgaatgcaccacaggagaaactcgcccttcagtcctggtggtgggtttgtcctagtttttcatctgtgacaggagctttgtgttctaatcacgattaagtcctggaaaatagatgcctgcttcactttctaaaaattaaaaatatttttttttctttttctagtagaaaataggctgctaggatgatggtctagaatctgaaagtaatttactaataaaatatatttaaataatactgtgggttgacccttgcaatcatgtttaaatcgcttaagaattacagaagtcacaaagcttaaagggtctgtttgtaaataggaaagtccttagttttgataaacattaagcaggatgcagagctagtcttgctgggtcaatacgtggtatgatttgggtggaaattaactctgtgtctttgtcatggtgtcatagataccctgatacctgctttcccctccctcccctttgaagcccctttgaatggtgacttgtacataggtaaagtccaagaagagattgtagccagcttaggaaggggcagcatgctatagtgctctactggtgtgtgctctgcacacgtttttatcagggaaagttttggatgtaggatttattgctgtctaactgaaaaagatacaaatatttttatttatgcttatgaaatagctttttcttgataggatggatgtttggtttggtttggttgtgcgagggattgaacccagggcctccagtgtgctaggcaagcgccctacctctgagctatatccccagatccagaacaggggtttccttgtttgctttttgttgtttttcttagccattttgtgccaactacagttgttttttaaaaatttgcttcatgaaaaattaggcagtcctattttaaaatctatgaagttttctttcagtaattgcaaaggttcagaagagttgggcagctgtagggtgttagagttaggactttgcttacagttgattgctatactgaagtatgtaactactcccgtatgctgctcacatgtctagacattcattggcccttttcctttaccctttgaaaaatcacattaaactttc

SEQ ID NO: 21430 - DNA, 1085 bp, Mus musculus
gcctcttttctagtggtagattgtgtattaaagattgcttctagctttagtcttttatcttctgctgagagcttagacagctagaatattctacctagtcacagatagccaagatgaattaagggttaactttgtagtatttatttttaacattaactagtatttaaaagtgctagtgtgggctggagagatggctcactggttaagagcacttactgctcttccagaggtcccgagtccaattcccagcaaccatattgtggctcacaaccatctgtaatgggatctgatgccctcttctggtgtctgaagacggctacactgtactctcagacataaaacaaatcttaaagaaataatgtactagtgtactacagattttaagaagaaggtgtgcgtgtgggggtggggtgggggaggggtgctggagggtggctcattggttaaagtacttcctgcgcttgccttttcctcaaaccctccatttcttagctggaatagctccctgtttctctaggctctgtcttggctctaagactctgacttccttctttccctccaagctggccctgctgtcagcctattactcacaggtcagcagtcttccctcgtctccccactgcctctgaaggcctcatacttaatggaaatatgaaatatgacacattataggatttcttttcttaggtaaaaatgttactaaaaattagcctactataaattcatagcttatgagtaagggttactaagtaatgtttccttgacatgacattttttttagcagtgatgtgtaaataaagtccactccggcattgttaacacctgctattgggagcataggagtcagtgatgggactgaagactgtcggctgctgcatgctctacagatgtgtgtcagcatcacttacgtcctctctaggatggctttgaatgccgtggtctatctgctacaagaagcggtgtttcccagcagaacaataacacacattcgtagccaaggagtcctgtgatgctttgactgcttattcttgcactgtagctttcatggtgtgacctagtttatcagacagttcagtttaagagac

SEQ ID NO: 21431 - DNA, 1145 bp, Mus musculus
tttatttatttattttggtttttcgagacagggtttctctgtatacccttggctgtcctggaactcactttgtagatcaggctggcttcggactcagaaatccgcctgcctctgcctcctgagttctgggatcaaaggtgcacgctaccacgcccagctatttacattttaaatgttatcccattttctggttcctctctacaaactcccaatcccatccccccccaccctctgcttctatgagagtacttccccccaccactcccgcctacccgctctggcattcccctacactggggcatcaggccttcacaggaccaagggcctctcctcccattgatgccctacaaggccatcctctgctacagctggagccatgggtcgctccatgtgtactctttggttgatggtttagtccttgggagctctgggtgtgggtgtggggtctggttggttcatattgttgttcttcctatggggctgcagaccccttcagcttcttcagtcctttctctagctcctccactggggactctgtgctcagtccaatggttggctgtgagcatctgcttctgtatttgtcaggcacagagagagttttaagatagccagggctatccagagaaactctgccattaaaatccaaaaaaaaaaaaaaaaaaaaaaaggtgtttgccagggtactgtgtgctcctagtgcccactaaagccagaagatctggaactggaggaactggagttaaagaggccacgtgagcagccacgtgggtgtgaggaattgaacccaggtcctctggaaaagcagccaatactctttgttttgttttgttttttgagacagggtttctctgtatagccctgcctgtcctggaactcactctgtagaccaggctggcctcaaactcagaaatctgcctgcctctgcctcccaagtgctgggattaaaggtgtgcgccaccaccgccgggctagcagcgaggactcttaactgctgagccatctctccatctcccccaataccttcttgacagtactgtttctcattggagcagatttcagtggaggtgactactgaattggtatatgcaaaatgctaggcttacaaagtgcttgtgagtaagcatggaagcccgagttcagatccc

SEQ ID NO: 21432 - DNA, 1174 bp, Mus musculus
ttaattactttctgatgccaagcaaacctaaagaggcttttaacaagcctcatgtccacagctagcttcctatttcagatgcagtttaaaagatggcttgttttaagccaggtgcggtggttttcacttgtaatctgagtactaggaaggcagccaggagcttctgctgaaggttcgaggtcagcctcaaccacattgtggttccagaatatagctgtagtcaaatcaagctgtctataaataaataataaataaataatctccaaaccaaagtgtacttattaacacgttaattgtacatattaacataatccctgttcgtacagctctcgttgattacatccacttttcttccacctttgtctccctctgctgtgcattgtgcccggccatcgtgatccctgcctaccacttatttcagtatttcaaagactgttgtactttgtatttaaggttggttttttgtttgttttgttttgttttctgttttagcagtcaagatgaccttatttcagcttctacgtgagcactgggttcatatacttgtccctgcgggatttgtctttggatgttatctagacagaaaggatgatgaaaagctaactgccttcaggaataagagcatgctatttcaaaggttagttcatgcacctttggggagttctgtctcttttgttccaaacaaagaagtgggtttttttcctactctaatggttaacagtcaagtgatacttcaggtttgttatttaatcgttggatgaaactatgattacctctgtagtgcaaacaatttttagtttatgatctagccatttcagatctttgaaagtttcatttttttcttttattaattttcacctaatatataaaaatgactttaaaattatttgtgtgtgtgtcacatgttgtatgtgggtgcccttatcggccagaagaggggatcagatccactggagctgtagctacagatagttatgagcctccccagtgtggatgtcatctgagagctctcatgactactgagccattttcctgcaccctcatggcctcttcgtacatgcgcatatttgtacttttcattccctgtcactggctcccttcctctccaaatagagtctcttctgtttcatgtcacatatatttacatctagatcctgcatatgacagaagacac

SEQ ID NO: 21433 - DNA, 2965 bp, Mus musculus
ataacctcatcatttgaataaatgttatctaaaagaaagcctctaagctgagtgtggtacgtgcgcttctaatcccagcactcaggaggctggtgtaggaggactgtgaattagaggccagcctgagctgcatggttagagcctgtctcagccagcaagaggagagcctgctgtgttaccaggtctgtacatattttatttagactcatcttaactattggtccggtaactgtctctgaaaccatccaatgctcggtctttttaaaaagcaaatgtggaagctcgcatttttataaggtaacagtgtgatttaattaaaggttgtaaatggtttcctttctgaacttgttttttaagtttatgtaaacagtggttggattttatgcttatttttacaaaaatagtactgaacctggggaattgccaccctcgatacagtacaaatgaattctgttggagagtaaaaactgaaaatatgtaattctgttgacttgaacaatgaaccatgctgtcctgttgtagtttcccagactaatttttagaaagtagcatgaacaaggcaatccttgatgccttacgtggaagccgtcttctctacacttagcactcagagaggcctcactcttgtttaactttggaactatgtctatttcaacccagtgatctgctatcggtctagaattagtcttttattcagcttcatgtgctaacagaaccttctcttgtggattatagccctgaagcaaagtttgtagccttttgatactgaaaaccagatgcacaaaatagtgttgcagagatgagtgtaaagagcgtattgtccttttatcagccatgaaacattcctctttcactcctgttactagatagaggaggcctataattatatttccattccaggggaagaaatcctgcggttgttacatgctataaagctctgcatatacctattacatggtaattatatctaaaactatttcttgcctaacctttctgctgacctacgaacaggaatcagactttaaaatattccttgaagatgattgttgtacaataatgtcattggagagcaatccaactgcctgtgtctagatgacatcatccaaaaattcctgaaatggagaccttcactctagcctcagctacttaagaaaagcatgacttctaaagacaacagtgagataagtcatgagagcagagagagtctcagatgcaagaataaacacagggtgtgagacaccagtcgataactgcacatagttttcttataaagaaattgtatctgggcacggcacggtggcacatacctgtaatttcatcaacttcattcaaacttggctgaaggccagtctggaccacatacgaccctgcttcaaaagaaggagaaaggggatggggacataggtcggtggaagagtgcttacctagcatgtgtgaggccctgggtttgacccccaggtctagaggttggggggttacttagtgtatctgttgctgtatggttatacatttttgcaattattcctatatttttgtgactccgtaggtgacctgagacaataaagaagaaattagtttgtacggtgggttgtttacctttttttttcctttccttttttttttttttcttggtgtctgtatgcagtttacataccgtaaaatatttactctttttaaatatacaattcgctggttttggtgacatcttcaaccacttctatgtaattccagaattttttttaatcattccaaaaaagaaacccagtaaccatttgtaccccattttaaccatttgtaccccattttctcttctccctgggtactcatcaatcttcctgtctcttccagacattttataaagaatcatgtaacacgtagccttttgtgtcctctttcacttcaactaacggttgttttcaagattcgttaacgtagtaaagcgttagcataattcttgtttgcttcgggatgtagtcttgcattgtgtagctaaagctggttcaaactcataatcctcctgcctctggtgtactgggattgtaggcgtatacttcagtatccattttgtagttatatgacactcctttgcttggatatcatgtctgcttgtcagctgatgtacactgagtggttcccagtggtcttggctgctataaagaatgttgctttgaacattcttgtacaagaccttttttagaaaaacatgaacatttgtattgtacatttccttgcgtgtgtgcttaagaataggattgttgggccatgtggtaactttgcttaaccatctaaggagctgctgacttgtgaagcagctgtactgtttcctgttccgatcagcgtatgtgtaaggaagggttccattttttgctacatgcattgttgtctctgtcttctcgtctcaccatcctcagcatgtgaggaggtacagcctggagggtttgacttatatttcgctaataaataaaagatgctgagcatgtcatgtttcttgtgcttattggatgctttgtttgtttgtttgtttgtttgttttgttttttgagacaaggtttctctgtgtagccctggctgtcctggaactcactctgtagaccaggctggcctcaaactcagaaatccgcctttggagtaatgtctcttcaactcctttgtccttttgtaaactgttttgtctttttcattgtcaagaagctttgtatgttctctagatatttctatatgtctgtggtagatatccctgtggcttgtcttcactttgttggtcacttgatacaagacaaaatttacaatcgtgaagtccatttcttctctcttttcagtcacttgtgttactggtgttttccttagcattttctttttctgggtgttttaatatagttcgtagtggaggcaggtataggattagtatagggagcatgtggaggtcagaggacaacttgcaggaatcggctctcttctttcacca

SEQ ID NO: 21434 - DNA, 1203 bp, Mus musculus
tcttccggggataagggtcaagctaggacaatggcagtgtaataatgaacccagggagagtagcaggcatggcgttgagcactttgcaccttgctgtcttcatcttttcatcttggttggtgcaagaatgatgtgacctggtgtgtgggaagcaccaggtgtgtggcccagcaccaaggaggaagacacaacacctacaactcacattcaagaccccaaaagctgacggggagtgttagtgtgtgtatataagaagggcaagtactggggctggcaagatggttttgtaggtaaaagtcccactgtttcactgtatgactgacttctaagcattgtcctctaggggctggagagacagctcaacagttagcactggctgctcttccagcaccaccatggaactcacaactgtaacctgtttcagtggattcaacaccctcgtacagacatacatgcaggcaaaacactaatgtacataagataaaagtaagttacttaaaaaaaatgtcctcaggactatactttcagggatcatttctatagttcgttactagaaaggtttctctgactgtgtagagcacccgaaaccacgaggacgagatgtagcgtcccctcctaagtgtgaagccggttctaggtgctgcttgattgcagctgcctcttgccattgatgatcgttcttccctccttcaggagggtgagagggagagaacgcagtctgagtggaaaaaaaaaaaagaaaaaaatgtcctctaaacctccatagaacacatgcacacccactctcacaaacacacacacagatgacaaaataaaatattgcattacacacacacagttctgtatgtatttattttgtgtgggtgaatggatgggggtctgcatcatgatgctggcttgtgcaggtcagaggaaaacttgtgggagttggttctctccttccaccatgtgggtctgggtgattgaactcaagacatcaggcttggcagcaagagccattgtcttatgagccatctcactggccctcaaatatttcagaaacgaagtattcacgatcctctgaagaacacacacagacagttctccagaacagactgagtgtgaggctgtagaaccagacccactgaggttagaaggactgacatcagtcagagtgcacttgccaacctcaaaggaatggaatcagaattcagtattgggagg

SEQ ID NO: 21435 - DNA, 1169 bp, Mus musculus
ggcactgggaagatgggcatcattccagatgtactggggagggcaccactggcctgaggagactgtagttcctgaggccactcattggtggaatgggagggcgggttcccagtggtgatggctagggactttgtcccgcatgactccccccatgtcttgttttctgcagggttgacttaactcatctgattcatcttcctgtttcttgcaggatagagatggccatggacaaagtgtgtcttagtcactactgaacagctcgcttcccaatgagtgagcacagtccactggaatatgaaccaaccagagactgaaagggcggagccagaggcagcacccgcgcccctggcccccaggaatactgcccgcccaccccagggcttgctttttgaagatacctgcttactaagaagccagtttgggtgggtaaagctctctggaagaaggaactttgcttcttaggagtttttttgtttgtttgttttggtttgttttgttgtccattagctttcaagagcaaattccccgcggcttctctagccagggaaggaatcgtctgagaaattcaaagctgaaacctcttgccgtcttcacagtgatttcactgaagaagagggtggaaagcaagcccctatgggagaattatttttagaattatataatttttgattgcttttatattttattctgtaataatggatgtcttaaaacaaataagtgaagtgagacatttgtttctggactctggctttgtggtttgtgttttaccctcatggtgggctgacccttccctgctccacgctctgtgagcttgcagcccccctcaaccccccccccgcccacccctgttccttttgccctacaatgcctgactgtttagctcttcaccccgatcagtttcaggggcctttcttccttaagtttcactccgcctcttcatcttcctacctgttctgattggaataggaaatatcccctacaggcttgtatgctgagtgtttggtcctagctggcagcactggtttgggaagttctggaaactctaggatgtggggcctcgctagaggaagcaggtccctggggttgtactttggaggctatgcttgctccctagactccatccattgctccatttcttgccactgagaggggtggaacttttccctgcc

SEQ ID NO: 21436 - DNA, 1165 bp, Mus musculus
ataaaagaaatgtaaatacattttacagtaataagtatttattataataaaaaggggcagtttaggagattgttctgatctatccattacccaacaaaaaaactcctgttttatttatatgtctgctttgtacattttcccacaaacaactaggaatgtgtgttcttgcacaaatagttcagggattggtgggatgctatctgcattctgagttgaaaagttctaagtgttttctgacttttggttggcagttaggtagggttaggaggtagggacaggactgcccacccccagcagtgaccaaaggtcttagaggctttttttttttttttttttttttgtctttttatctcagttgttatcctcagcacattcctctgggctgattggccaatcctcttgagaccaggtgatgttctcgaccctttttaaattgactctgtctttcctttcagtcttctgtagcggacacggggtgcagaatgacctggagagtggctgtgcttctcagcctggtgctgggtgctggtgccgttcccgtcggtgtggacgatcccgaggatggaggcaagcactgggtggtgattgtggcgggctccaatggctggtataattaccgacaccaggtaagaaacccatgcgttcttgtcactggctttgtgcctacaaaatggccattccattttggaagacagttttgctttagtctcaagtgggatttcctcacctttccccagtggcggcctttagaaccaggcattaatccctttttgggtctgcactgtatcacttgcctgcctgtcacaactcaaaaatcaaaatgcatttagatatcaccgcatatcttgggggctcaagattaccaggtgagagctcttgtgttaacaccttcccttcatgttatagaaaggacacgcaggtctagagagaggaggtgatttaactgagaccattgacaagaggcgagcagtgtggaagctctggggaacggactcctggcccctctgtcctccatgcctctgtccctttacaccacctcctccctcctggtgtttcctgcaaatcagcttgtggaagtgagagagaagggcatagttgacagtccagcctcctgctgggaggaagggggtagccttggggaagcatcagtcctgtggaagttgga

SEQ ID NO: 21437 - DNA, 2482 bp, Mus musculus
ctttgtcagtggggtactggaagtgcctcctcaggtcccaggagcccgttatgtctgcttctttctcctctcctatcccctggctaatgcccagtgcctgctttgtctcccatctccaggctatgaaggagtgagtgagttctttaccgacctcctgaaccacattgccacagttctgcaaggccagagcacgggaggagctgccacggaggaagtggccccgctaaggcacaacaggctcctggcggaaccggcaggcagcctggctggggagcggacgtgcagtgccagccctggctgctgtggcagcatgaagggccaggacacaccctggaagactgagaccgaagcaggcaacatgggcgctggtgcttccgccaagctgccgcaccagagacttggctgcaccactggcgtatcacccagcttccagcagcactgtgtggcctctctggccaccaaggcttcctcacagtagccacagagcccaggacccagaggggcagagcgtggaaaatgcccactgggccagcagctccacatgggaacactactaagaattcctggtgatctgaggcttctctgttttaattttttacctgattttctgatgttatgatcggaatgaagggggggagacagagcagaacatcaagtggcccagcctcgaggacgccgcctgactcctgctgtgcagaggtcctcactgagtttacacacgcttgtgttctcaacactaggtctgaatgtgaggggggggggtgcgtgtgtgtgtgtgtgtgtgtgtgtgtgtgtgtgtgtgtgtttgtcatggcaagggtgagtgtgcatgtctgtcttcatggctgttgtgggccaggctctgggcaccgaggaaggaagcccatatctggccaggctgttgcagctaagcaggcgaaggacgaacggttttcccagttcccctcctcttcacacctgcccacacccagacctcaccctccctcttgtcccagatgtgctctcctccaaggctaacccttgcccccccacctcgctctccaaagccagggaagcagtagacgccccctcgggagctctgcatggaggatctgggttgtaggaagggaaaggagcttcctgtgggtgtagccgaagcccactggctattgctagtcttcactggctcgtggaatacagcaggccactatccaccctaccctgaccctattgctcactgagatccaggaaggagccatctgactaggagtccaggagtctgccaggacccaggatttaccctgggacttccaacagatcattccgtgagtcttcaggcctccaccacctcatctcttcagggtggctcctgaaacagagaactgaaggcctggtctagtggtctagcccacgaggatctctgcttcctcatgtcatcatccggtccctcttttcaggtgagaggagaccacccacagggctgctcctgttcacacgcgacagcccctcctggaacagcaaggcccagctccttcctgctgtgttcatagcgagtcccttgcactgagcaccaggcaagcccccaagggagttgtgccccatttcagactcactctgaccccacagcagctggcagaccacccactggccccaaagcccacaggaaaggacccctgtggagccccaggtcagcagcccaggacccccaagggtgatcttgtgtcttaagacatcagctcactatgtaaagagaatgaggcctctgggttgtccttaggtctaataagatagagtacactagaagcagcagccctgggaaggccactaagggccatgcaggggcatcctttgggcaaggagaagccgattggcttcctcggaagcagagccccaggactaaccacgtttacaggacctgagtgttgaactgattgatgtctgtaagtcaccttcccaggcctgaccctgaaaacagggggtgggaagcgtggccgcctcttgcactgctttgtctccggaataaactactgagatcaaaccgcattctgtacgtggtcacagtctttaaagagaagacatttaatgacagctttgccctttcagagtagaatcaccagactctgccttgagaacaagcagagtgggcagtgctgcgtcccctggagctccttcctctacagggtcacacatggtaaaccagccccggttatcaagtacctgcctcctggccaggcagcattctccacgggtcaggtctcccgtgcaggaatagaggagggtgggcaggtgaactttccaggactggaaacaggaacagaaacctgggccacctgcattcttgcagacactttaatgatacagaaatggacctttgtaaacattgaccctgaacagcactagttgctagtgtctgtcatcaccaaaggagccgagagggatcttccctgggactgggtcgttgtgggtgtcatggaagagtgggtggggcctgccacacaccatg

SEQ ID NO: 21438 - DNA, 1176 bp, Mus musculus
gtgtgtccatctcaggcactgtaaggatggcccctgggcacctagttcttgtagtaaagttataacaagaggcgactctgaccaaaggcctcctcctcctggctggcaggagtctcctcccttttgggcctttgtggaagaggctccaggtgttataagcaatgagtagcacccaacctaggggtccccaggattgcagtgattcatgatctggggagctctggagttcacagcctgctctgctttatgtgacagacccaggaaattcaaggtttcccaactcgaacagcatagctaccaagttcacggatgttcctgcaccctgtcccactcgctatgactcgaaactctttgggagtgctcaaagagggactcactgtccctgagggtattagaggggcccccttggaggatgctcacctccatccgtcttgggcaccagctcttcgccacagggccagggagaggtcatggtggggtcgcccaggaaggtgactggccaccgtgttggagattggcagctgatggactctgatgcagcctttggtctttgtctccccagatggctattgtgttcaaccaagagggcctgaatgccatccagcctccctgtgtggtccagaacttcatcaaccacaatgctgtcctgtacaaggtgtttgtggtgggcgagtcctacacagtggtccagagaccctcactcaagaacttctctgcgggcacatcaggtaatccgatccactgctcctgattgtgtcactctgtgccaaaccctggggcagagccgaaatggatacctggtgtctgtctcctggtcttccttgttatttctgggttagtgagagatgacctgggttgaaagagttgtatgagatagatagatagatagatagatagatagatagatagatagatagatagatagatagatagatagatagatgacaaaagggtcctgaagggccatcgagagaccctgtgccgtaggcaccttggggctccatccctcagagctgccgccgactccaggaaatttctagaagcttcttattcccaggaaggtcccttggcccacccagtgatggtgcccaggaggagtgtgccagagtgggtgtggccagcccagtgtgggacatgaaggagggagatgacggctgacccaccacattgcatgcc

SEQ ID NO: 21439 - DNA, 1179 bp, Mus musculus
caccttgggagcctggctcagtctgcccgggatgctgtgcaagctgcctgctgggcacacatagatagcatcttgcagctcagagggccacgagctgcttctgttaagagcgtaccgcaggccaccctcttggtatatcctcacaactcgctttgcacatctgagaggaaatagcgcaccgtcacgagggctctcaagagagatccatcctcgagacctcatccaagccttacacctacagatgccgtccccctggggtaagggcctccatgtatgtgtttggtagacacacataggcagtttgtagcagagccaacagaaagcacaccagattgatgtgtcatggtttcctggcctcgggtccatcagtgataggtgctggctggactcccgaagaggcatttgagaggaatgtctcagtcctactggttcagaggagatttgaggagagagcccacatctccagtgtgctgagacccttccttctgcatggctgggtgcctctgtctctgcgtgtaaaggaatcttgcccagatgtcagtacagagtgtctggagagacactttgggggtgtggggacagtaagcatgtaaggacttagaggcaagaggggcagtggctatgcagaccacccttaggtccctgtagtgttcttagcaaggccccacattctccagggtgacctaagtagccccatggggaaagccttccggataaccctattggcagaagtgctccctgagagaagactaaaaatggaagctcagacgccatgactttttccagatctaggtcattttcatctcctggcagatgtttacggggaaatgtctataaacagtatcagaacaccaggggacagtctgtgccaggggttggccctgccatgggaagccatcatcagctgcaaggacagctgtctgctaatgtcaagagccatgtgggggtatcctggctgcttgggttcccagctgcagcagcaccccaaggtgctttcccgagtaagccaggcaggaagcaggcagactccagagcagccgcagcacccttcccatcaccaccgaatagctcctctgtgacagaggggaacccagcctcgggatagcacacagccggcactactggcagtgttacacattgcctgacatgcaccttcagttgctatgcctccctgatcat

SEQ ID NO: 21440 - DNA, 1191 bp, Mus musculus
cggtgttctgtttttttgagcctttatggcatctaagggtcatggggacttctgatttgtagttcctttggtttctcttgcatccattgctaatgtcccccatcttagatgaaagggggtggtctcaagcctctgtgtgaatgtcagtttattctactgagtgggacttcagtgggcagacatgctagaaggaccaacagcgggttcatctgcccagaactgctctgaggctggccaggaagcccaatctctggtttactaccgcagtggttctcaacctgtgggtcacgacccctttgggggttcaccgaccctctcacaggagtcttctagctaagatcatcagcaaacacaggtatctatattatgattcataacagcagcaaacgttatgaagtagcaacacaaattttatgatggggggatcaccacaacgtgaggggctgtattaaaaggtcgcagcattaggaggtttgagacccgctatgctacagctgccccgcagcttttctgggatgggggtgacacaaggtgactcagagtcagaggaaatgtaggagggctccctgcctgctggatgcctttggcaaatgacctgcctgggtggacagatgggataggcaaggactctgagactgccaggcccgagagtaaggtgggacttgggttttgtttacaatgtttctgtgcttgagcaagtgagttgagattctcacttgtcagatcaggatagatgtggctggaagcagccttgaacagcccatcaccagtgtcctgtgaggagaacctagcttctggatctcttgacagtggcttgcaccagctcgggctctggatggaggctggggacaggctactggagggaaggtgccaggcagaaaccattctgctggatccatagccacagtctccaagccttgcctgccagggcttacaggaaccacggactgttccctaaagcaggattggttctgggctggcaggaagtgttgaggggaggggggagcttgtgagtgctgcaccctgaattttccttattgcctgcacaagccagcttgtgttcttccaggagggcagtgggctgggaacttcctgcgccctttcctgcacatggggcagtttcatggcagggctcctggtgggctccctgctctttctgtgccagcccctccacgggtgtaggggcccttc

SEQ ID NO: 21441 - DNA, 1134 bp, Mus musculus
ctgagttcatgcacacttgggttccttgtccttgtactctctgtggcccaggtggctttggaaggaccagacatgaaactgcagaggaggagcaggcacatacatgttcactgtagagtgctcttggtgtggagaaccacgaggcatttactctcaggcccacttttagcctcacatcctcatgctccaaaaatgcttgcacgcagtttatttaactttaagtggggcaaattctgaaatgggttgtttattgtcgaagttgaaattttaatttctcataaattcccccacaaattgctgtagtacatttatatttattgaatctgtcagggttgtttgtagtactgaagcctgggctccccgtgtttgtgagccgttgccacagcgatgctggggtctgaggctccgaagcagaggccttgctctcatatggtgtagaggttccggactgtgctctgggtggaaaatgtcgctgtagccagccttggctggagtgagagaactatttaagatggcggataatattctaattctgtccctcttgtctgtttccccttcccttggtgggcactttgcctgtcagctcggtctgctacccccaggcccttgctgctgcagtgtcgtttaggaccaagtgtgctgtcagttcaccagtgaggcattcaggctctgtggggacctggctggggtaacctagggaccttctcagtatggtcacggtgaagcccacactgccacacagccacggatgacccgaggccttgtctagtgactctttgtcctgttgttaccatccgtattctttagtctttcttcagtcttctctgtcaggaatgggttttgcttcagcctttccacacccagtccagtcccagtgaatgggctcgcacggcccaccctgcttcctctctgtaggcgcttggaatgggcagccgaagagacgccactgctgtggaaccctcagaccaggtcgggcacagttcacccgagcccccgaggcctgagtacctcaccgagcagagtctccttgactccgtctctgtccccaccttcctcactgtacctcccctaagtgggtgctataccagttttctggatgctcagccaccatctggtggtcaggaaacctgagtc

SEQ ID NO: 21442 - DNA, 1161 bp, Mus musculus
agaacttcacgatttctacttattaagggttttagcttgcaagttccttgtttgtttgtttgtttgtttgttttaaaagacaaggtgcatgggtacttttccccaactaaggtacaggttgtttattttttttaaatgcagaaaattattttcactctcagccacttaattggatgttaaatagacaaatttatgttcattcctgttttcttcttctttttttaataataatgacatgtgatgggaaagttatgtaaattagtgtctgttcatatcaggttttttgtagccattaaaaacatctcattttggaagacctttagtactggcacttagagcaaggggtgagtagactcctgtgtgctcaaggccagccagggttacatagtgagaccctgtctccaaaaacaaaacaaaacaaaacaaaaatcccatcttggaagacagtgtgagagcattctaaagatggctgctgaatgctgaagcacttgtcaggcaatttctgctctggttggtgtgtgcacatgcatgtatatctgtgtgtggggtgtgtgcgtgtgtgtgtgtgtgtgtgtgtgtgtgtaacactcaggatggacccaggatctgaacattttagcaaatgccctgctactgaatgatccattaattacaaccagctttatcttaccccagctctcagcttcctggcacggatgcgtataggtgctgtcccgagtggctagcaggttctgtgagcctttctcttccccagcctctgactcactgagccaacaggagcaaatccttggaacaaaaagttctgcgtcatcatctagatgggagaaggtgaccggggaagcaggctcctcatgattgccagtgtgtgtcctcactctcaggtaccacgaaccccaggccttcctatttcccattgagctgagctgggactgagctaacacagggtctgctgtcaaatcgtcctgatgtcctttgatggagtgtggcaagcaagttcatgtgagactaaaggaaagagaagcaagacaaagaaaggcgggaaggaatggaaaaggatttggaagaggaaaagcaaaaaaaaaaaagctgtttggaaggtagcgtccagttctggggtgaaaccactgctcaaaggatggctcctgagacgagagcaccatt

SEQ ID NO: 21443 - DNA, 1232 bp, Mus musculus
tctttttgttttctctgcaggaagcgagggatagaagtcgtgcaggtgagtgagaccacttcttcacattgccctgtgctgagctaagcgtgcactttgtctttgggagagtttgggcgtctgactgctgtacatgggcacctggattgtgatactccccctcgcctggagatctgacatagctcctgccccgcactgggtgcagacttgctgctggctgttcctgtttggaaagttacagtgggtgacgagtaggaagggccaggggtcccggaggtcaagacactcctaacacaagttgtgttaggaaggatgaagggacagtcctgcctaggtgactgtgctgtcaccctgtcctctgtgctcagccttgagctcattggctggaaagaaggagggatggatggatagagggaggagtggtaggtggaagaagggaaggagggggagggaaaagcgagtatggatagaatgaaggcgggagaagagagagtggagagacggccctgagatggatatccaggctccagcagcggcatctcagaacggttggcacgtttggcctgtctgtgagagctcgagcccgggattacctgtggatattctggtaagagacactggcccccattggttatgtctttccacggatggtacagtggtagatgtgaactcagattaatagactcatagtgaggggtaggttatgacatgtgcaccacagctgtgcctggtttcctgtgtcaccgtccctgcacaggacgaacctgactgtgtaccaagctgtccacacttggatttactctgacggctgagtcttcatgcatctgcagagggctgcctgggattgggaccaggtcaaggctgaaggcagacatctggaggaagtttccagaaagcctgctagggcatacacccttcagaggtcttcgttgttcaacttcaggagggctctacttcgcagctgtaggaaagggtttcccgatgcaggcgtgcacatacctggccagcccgagagcttcccggttccctgactgggggtggacaggagccttggagccattgtgtagagtgtgccagacaaaagggttctgaaatctctcaagatgtgtctgttgttcatttggatgacggcttgagggaggaagtggtgtctgggcacggagtgaagccaaactgagcgctttctactcgggcatctaaaaataaaggcaacggcaatgcctgtccccaca

SEQ ID NO: 21444 - DNA, 1186 bp, Mus musculus
ttcatctgctaccagccaggagtttaaagtttgggggtgtaaagatagggcacacccctgcttcctgaacggcagttgtcagtcaggacaggctaggtcaggctgcagggacactgcaagagaaacactgaaggcctagctcaggctcttacagagtccactgtggttccctccgcagtatccccttaactgtgcactgtggtcactttagaccagataattctgtcctgcacattatggagtctgtcttttggttgcttgtggcaccactcccagttggcagcatcccctgctcttgtggatggcgtttgggggaaactggtctcaaactcacagtccttctgcctcagctttccaaatgctgggtgagggtccacctggtaactaccttctttgcagactggcccaggtcaggaggactggtgagagggtccagtggtcacagctgaatgctgctttctgaaatacatgctgtatctgttcatgtgtcattacccaaggccaggactgtgcccacggcagaccgagggaggggccttagtggtacttaagagtccaggaagaggactgctggtgtggacagccaccatcttgaacctggagctgttcctctccaaaggaggggccatctctgctctttctgcaagtgtttagctccccaagggtgtactctccctgcagttctggggaggggtccagctggaagacaagattatgactttgagtctgctccaaactgaacacattttaccaagaaaagtcccctaggcacaggcttttaataacatttaaattattaagctttaccttttattgttactttcatggtattgttgaaagtaatggatttgcccatagcctgggccctctgcccccaaggacccagatgctgaccctggcctagaacctcagttctgagtgtctgctgtgaccgtggtgtggccctgccttggggtcacttcagcttgtctctgggaaggacttgggagactgcctgatgtttctttctctctgtcaaggacacaatggagaagtctgccttctctccagcccctcctcccagctgcccttgcccttgccccgaggccttgctgaggtcatcgtgtggtgcttttggattcattctgtgcacacaagtccccattctccttctggacattgaagtccccagtctccttctggacat

SEQ ID NO: 21445 - DNA, 1228 bp, Mus musculus
gagtgtgtccatgtggttccttcccgaggctcctcagggtgctgcagaatgtgttccaaagccaacctgttgtaagtctcattgatttcaaaaacataataaaacgctgctgcacttgctagcaaatacagtcccactccaatccatcccatccgctgacggaagttcatcattctccatgctctgtgccttcaatgcaaacacagaaaaattattgttaaggtctaataatgttgccatggcaactattccaagtgcacatgatttaaattcaagagttctgaaaagcacgagcattttaagatttaacagctgtaaacagcttacaggtggttttatataacagttgtaagcacataaaaatactggtttcagtgtctactgagtgctgttatttatgtgaaccccagagtgaatgaatcatcacttcttgcttgagtagacccagtacaccttcgtttcagataatgaaacatctagtttccccacaggacgttgctcttgacagttgaaatgctttctggcttaacactatttcagacgtgggcactgggttgagttctactcgttaaaccaacgtcggagtccccaagttaagacggtaactctttcaaacacttacagtggtcccgaaaatcttcctgttccccctgcaagcgagcaagagtcactcagttctgaacagtcaggtgcctttggcatttcagaacaagccaccttaagagaaaccctctgggtcgcgcagctgaagaaggtgagcgcggcggcgggagcacgagctagtagtgattaagctcagcgtgactacggctggtcacgcggcggcggcgggccccgtcgccctccggagccccaggcggggggaaccacctggagatgccgggcccgccccccactgcacccgccgccgagctgagctgggcagtggcgccaggcttggcctgcagaggcccgagctcggctcccggccggacgccgggccagcctgacagccaagccgagcagccccgggtctcaccttcctgtcctgagtggcccgcccgctcgcagtcccggataccgccgcattcagagcttccgtctagggccggaaacgcgcgccggcctctcatgacgtcaggctgtcagcttcgcgccgcctccagaggcggttgtctgttccctgaggcgtttgctgcggtcgttcttctgccctcggccgggaggcgggcgcggggagcccgggtct

SEQ ID NO: 21446 - DNA, 1161 bp, Mus musculus
ccctggcggcggccacttttcccgcctcctcctgggcccacgcagcggagcccggtgacagttgaggatggccggagccgagagccccaccgagtgccaggcggagctggagcccgtggtgtcgctggtggacgtgctcgaggaagacgaggagttggagaatgaggcgtgcgccgtcctgggcggcagcgactcggagaagtgctcctactcgcaggtgcgcgcggcccggctgctcccgccgtcctgtctgtttcccgctggccgcggccgggcccactcacggcggccctttactctgtgcttctacagccccggcccggctgccatttcatcctcagcttgtcgccaccagggctgtccctcggttccgctgatggtacactgcaggctccggtcctccagttgtcgcctcttggtggcctgcttttcacgaggttgttctcgtgatctctcaaacccagatattcttcgctccacttctcccaccgcccaagaatcttaattagggaccagatggggaaaagtaaagggaaagtgggccggctttgaaaatcttccggtgaggttcggcttccggacactcctgtagtctagtttaactgctagctgcccccacctcaccccctttctggttaaatgaagtttcgtgtgtatgtgctatgtgacatcccctctctctggggactggaaagccaagaggagaaaaggatctgtttggcatttgtgggaccttttgaacgagagagtttgaggggctgagatgtagtgtttagtgacgcatactgtacatttaagtactaacgtggaaaagggtgggtaggaaggaaacttaacaacaaggatgagaattggtggaaggaaacaggctaactatgcccatgggtggagtgggagactggggtaggagtgaagggacttggagttatggtgtggcgtggactgaagtcataatactagttgtcttcgttgaccaagttgggtttgcactgtaaaattgttgaataaatcttgtatcccagaagtagtcacagcatggtcgctggtatttaaatttggaggatcattgttaggtttcaaaccctggactctgctgttgtgcctatttaacatatcaaagccgatggtggcctcctggttctccctgcccttctgtccctt

SEQ ID NO: 21447 - DNA, 2487 bp, Mus musculus
tcttggcttttcatcaacaggttgttaagagagaagacattcagcagttctttgaagagtttcaatcaaaaaagagaaggcgagtggacgggttacagtattactgcagctaaagtggaatgccacttcctcggtcaggttcacgaaaatgccactgttccggaataaagagacctgtgtcacacttggtcccctttccatcctcccgtggcctcaggccttctccttaagtagctgcagggtttctactggtctctcagcaagcggcctctgtgacagctcattccacagacgtcagctctcctgcccaggatgcccaagacttctttctgttcatggtttgagaagtttgatttgatcttgtgaaagcaaattagcttcttttctagcagtttgttccatgacttccatatgtacgctcacagagctattgccctctgggtcttctgggtcttgcagggtctcttcctgttagcccgaacctctggggagcagtcccctctgccccatgatcacggtgccttgggtcaaagcttcctcaagcccgctctgccagtctgctcagcgctttctgagattcgatcgtggcttgaagagatgggacttttctctgtaccgaccttcacggtagccgcgactgatgtcgtctgtgggaggttggcttaaggcaggattgaggaagcaagcctttgttctgaatttcgctgattagtttgaagtgaaatttcattactattctaatggccctccaacatcagcgttagtactgtactgctcccagggcttccagggaatctactcatgtgagcccctttgctgctgcctaaaaatgaccagatcctaccccctaacgtgggtgctttacagagtcctctggttccttacattatcagggatatgcagaaacatatattaaaaatggacctattttaatactgttctgtcaggaaaatgttattggaacctgaatatttttccccttgaatctgctgaaggcaaggatactgactgaccatagtggtagtaagtggggcagtgacagccctagaagatggaggattccagccaaagccctcagctatatacatattgagtctttgtaaaagtgcgcacagccactccctcctgacggctcggagggtcttcatggattgttgtataaagtcctgtgtttgagagaagtctttcagatggtgtgaagtctttttaagctccctcagtctatgtggaaaacatcttttgatccacaaagacctaagtggcaccctccagaggaacaaggtcttccctagtacacggtgaggtacattaaagacattttaggccacatgttggtggggatttttgtgtgtgggcagcagttgtatgcatgaatactcgagttccttgtcacgatgaagtagcctacaaataaggcctcaggaaatggcatggcttcggtactgtatacagcttgcagccttctagtgacagatcctgggaagactgctatgtggagctgcaaggttcttcccgctgcaggcgaagcctgtgtgcactgagctggcctggatagggctcaggcagacccccggtgcccacagcctcggggtctcctgagctgaggatttgaatttgagagttgcactttctatgtaccagcacatcctcaaaacttctctcttcccagatgtcagatttaaccaccaagttcctgtctgcccctgataggtcagaaccaaggcttagcagcagtgtcagtgagcagcaaaaatacagccagcctatgttgaagggcttgcataagaaaggttccctacttaaccagaaaacctctttttgtacctattcacaactagttttcttactattctcgtagagatggtttgggccaacatgtggcagttgatattaatgcatgttttatgcagaagaaaatgtgatactagttgcttttaaggaattctggcattgtatgtacatttttgtagaaattattactcaatatacttcaatcaggtttctgtaaaatccaaattaaacctattcaaaatagttgcttttctgattgttcttggtcctgtttgttagccttacctaaatctacaaggctggtggtgtgtctgcccacagctttcctaccccaggttccaggttccggttctgaattggaggcagttcattttgtgtctgctactctataaaatgggccctggctcttggggaaatggctcagcagggttaagagagtttgctgccaagtgtgacctgagttcaaatcccaggacctacccaaaaacgagtactcacatgctggtagcccatcactgttgagtggtggatatgaggttcagggctaccagcctctgtccaatttcagtaacggatgctgtcagagagagatggggagagtgatactgcccacagtcaggtgaatgaagtgttctctcatccttgagctgttcctgtagttaaaaccttgatgaaggcatcctctgagccaggaaa

SEQ ID NO: 21448 - DNA, 2844 bp, Mus musculus
ggagccctcacggccaccggagaagtgaattgcacgcactttgaagtaaataggtttctattgggtatcagcaactctgatttctcctgaaactgtagtttctcttacaatcttttcctactttaccctgtggatatacactcaggaacgatctgacatctaaaccatccgaacagtagatattctcagggatgggaacatgcccatctcggtattccccaatcgctgccacggtcctgctgcctgactagttagctcagagtctggggaatgaggctgaccctgataatgtgcagtctaagcttgcaggcttgaacagggcacatagatagatagatagatatctgctgtaaggtgggctcacataacctttcaggctcttggttttgtttttgttttgttttttcttaagatagaaaaccacagggctctgctcatccttaacggttgtatcttttgaagcacagtctcgggttgcagaagcaaaagcagttccatcctgttcctgcctgtttctgggacctaactgtttgatgtgggttgagattgttccagatccgactgtactgtgctggcgctgcagagaagcaagtacatcaacgctttctcacctttgataggttttggtttttaacattttagaaccattgatcacacactttttatttttttctgaaaattcactaaatgtactctccaatccacatgatgtaattataaaagtaaatggacactgttcgtagtcttatttaatttataaggtttgtctttagtgtcttagtaggttacctggccgaactgtgtgtgtagaaatcgtgctttaatctgtgggattgtggattgctgtgacttgcaggtgtggcctcatgtgtgataggataggtgttcatgggaagctagactacgtgcctctggctgtgaaccatctatgacgtttcttaatgctgtacttacaaatgtgaagtgtgaatagggttggtctcagaaaagaaggtatttatataaaccttaggccacaggaactggcatttttcgtagtatagaaatttaataagaaccaaatcacaaaaatcccagctctccttttgaggccagggacaatcaggccatttggacaatcagcattccagtcccactaagtatcgaggctggagaatcaccacttaggttcttaaggcgctgttgatccttttcttgtatttttgttttagttttgggatttaaaaaaaaaaaaaacttacatttaaagttgcctgtggctcataaggagaaaaacctagaaccattcaaaacatagatccttaaatttccatgcaccgtctcccttttacattcctccattggctttgctctttagtgcagtccctaggcccgagctggcctagcatttcagtaacctgttgggcttttagggcttagagtgttaaatacatgtcttctgtgcccctttttaattcagcctagatcctgattgtgcttcctcattggctattctctttggttgcaggtcttttgttaacacttgtcatcctttattgcatttctttcattgtttgttgaagtcgatagcaatgggtacaactcttgtacatttgaatgaaactgattctacagggtgtaatgagagctaatgaatgccatgcggcgccagctgggctgaagcctggctgggtgcattctctagtgttgaaggatcaacactccctgtatctacaacaaggagatatgtgttcataatactgaacttgacttttaagggaaaaatgcttttcgtgaaatttgcttaagaccattgttttgcagtaataaggcaattgcgtgtttcttagggctgagtttgttgtcaagactattaatgccgcagtgatgggtgctatccccgggttctgcagcggttcacaaagtctaccatgtagctactttcaagcctcattcagataatcttgctaagagctcttctgcacgccctgccggtgttctactatcctctgtcaacactgctttgaacagtgctctgtgaagtgtaagttcttttgtcccaacagttgtactagctgtcatgtggttattgtctgaacaagtcttttgattttgttttccttaaaaagtatatccatgaccgtaccaatcttctgtaatcagaatattataatgctgcggccatttttatagaaggactgcaagtttgtgtcctgggaatatcttgtactcatgtgtttctgtgagctctgagatgaggagtccttgggtatgcctgcacatgtctgtctgggttatgtgggtagacgctaggaattctgctcttaaatgagacagtgggaagccctgaggctcctgagctccctcgccggccaggatttgccacgtctggcctccgccgctgcgtttcttgtggttgtgctgttaatggtaaagtcaagtgccttcaatgctaaaggctcagaaacctttcttaaactgatttcatgtcctatgcaagtgtttttacaacctgcataaccagtactttgtaaaacttgtttacgcttcaattgtacatagtgttttttaaagaaatatatagtatttttatttaggtacctccaaacttgaactcgtctgtgtgaagcattgtaaacgacacgtttctcttttgagtaccatcacagttgtacagaggttttcactggttctatttttctactgttactgataagcatgtaacactgactttatcctacatagagttggcatttcaaataaacagcttgtatagaaccgctgagttggacatagtctgttctagcttacagcatttggtctccatctacaggtgtggttgtaccccttaagaatagggtctgg

SEQ ID NO: 21449 - DNA, 1086 bp, Mus musculus
ctgcatctgtcttttgtgtttaaaagttgtgtggggaacatcttaaagagcaagcaagctggcactttttctcctttacagatgactaactttttgcacttgtacattttatttgtattgattttataacagtgtgttaaactactttattgctacatttaaaggactgtattttcatactttttgcattttacctatcatctaccagtttccatgtgcattgggttgcacactaagatgtattttcttacgaaatagttgtgtttattttttaattatagaaattccaaagaacagcacatcaaacgctcctctcttttttggtgatcgtttcagttcagatctctttgtgctcattctccataaatctgatgtcattctgttttgtaagtcttgaaagccagtcttcattccccacagcagaagtccgggtctcggtgttctttgattcagtgaagaacaggaggaggtgtccagtgtgtgtgtaattagtgtgggttttgttgggaccctgtagattctggagtagagttactcactcagtcacagggcctaaggaacttagactttagtgttagaaacagtagagctgggcttggtgtgaacgcatggcttcaatctcagctgtgggcgttggagacagctgatcagaggttcaaggtcattttagactatgtagtaaattcaagattaggctgggtatgtgagccctgcctcaaaaaaaacaaaatgaaacaaaaaacagtagcagagatggtgatgtcacacacagggcatactgatggggtgcctggctctgcatgtgattcaccatactgggggaaatgactgcctttagttgtcttgcattttgtgggaaaaacaaaaaaacaaaaacaaaagggctccagtcttatgtctgtcatttggtatttgtaatcatatgtttttcttaatattgtctagtatgtctggattttggtgtcttctacaaagttgtataatgcctagtgctttaaccaccaaaaaatgattttgttttcagtaaaacactacatgtcctacttgaactccactggagatgctggtttggtgtgtactgaatca

SEQ ID NO: 21450 - DNA, 1100 bp, Mus musculus
gaaccagaagagggagtcagatctcgtgatcggatggttgtgagccaccatatggttgctgggatttgaactcctgaccttcggaagagcagtcgggtgctcttacccactgagccatctcaccagcccgcttcctcactcttgtttcctttgttgtacagagcttcagtttgatacaattccttttgtctctttttgcttttgttgcttgtgcaaacttgccaaaaagcctttgcctgtgttttattttagaaatttcataactccatatctcttaatccacttggagatacttttttgtaaatagtgagaggtatgaatctattcatatttctacatgtggttatttagttttccaaaaaccattttttgagtagtctactactaaatcagacatattttgcccatcatacagtgtgcatatcatgagtaaagttttgaaaagagagtttattctcaagacttaacacattagcatcaggaaagatacacaagtttcaaatctgttttggggtatttttggaataaagaagttgagtgatttaaggcatgtattaaaatgaaataatcagttgtacgtgcatatgtaatcagatttcttggttcttcctagcatgcatattcagaaaatggaactctagcctgatctgagtatgagtttttcgtcctactgagatgtcacatgttttagacacttgattagactaaaatcatgacttggattcaataaaaatgtttacatatttaaaaaaataaccaagacggccgtttttgtcataattcatcagtgttggactatggtatttttattttgttttacttaaataagtgttttgcctgcatatgtgtctggtagccatggagaccagaagaaggcattggatctccttggactggagttaaagttggttatgagctggaaatcaggtcctctgcaagagtagctagtgctcttaacttctgagccatctctccagtttattaaaagtcaaagcaaataactaaggcaagtgactgtttagttggatttttcctaagtttcaacattatcctttctgtttatgtttttttttttctctctttgttgcagatttgttaac

SEQ ID NO: 21451 - DNA, 1429 bp, Mus musculus
ctaaccagtaccccccggagctcgtgtctctagctgcatatgcaatgggccatcagtggaaagagaggcccattggtcgtgcaaactttatatgccccagtacaggggaacaccagggccaagaagtgggagtgggtgggtgggagagcgtgtgggggacttttgggatagcattggaaatgtaaatgaaataaatacctaataaaaaataaataagcttcttcttcttcttcgggaaaacaccaaatggcggatgacgccggtgcagcgggagggcccggaggacccggggcccaggattaggaggccgcggcggcttccgcggaggattcggcagcggtcttaggggccgtggtcgtggccgaggccgcggggctcttggaggtaaagctgaagacaaggagtggatccctgtcaccaagctgggccgcctggttaaggacgtgaagatcaaatccttggaggagatctacctgttctccctgcccattaaggagtctgagatcattgatttcttcctgggtgcgtccctaaaggatgaggttctgaaaatcatgccagtgcagaagcagactcgggctggccagcggaccaggttcaaggctttcgtcactattggggactacaatggtcacgttggtcttgttgttaagtgctccaaggaggttgccactgccatccgaggggccatcatcttggccaagctttccatcgtccctgtgcggagaggctactgggggaacaagattggcaagccccacactgttccatgcaaggtgacaggccgctgtggctctgtgctggtgcgtctcatccctgcccccagaggcactggcattgtctctgctcctgtgcccaagaagctcctgatgatggccggaatagatgactgctacacttcagccagaggctgcactgccaccctgggcaactttgctaaggccacctttgatgccatctccaagacttacagctacctgacccccgacctctggaaagagactgtcttcaccaagtctccttatcaggaattcacggatcatcttgtgaaaacccacaccagagtctctgttcagaggacccaggctccagctgtggctaccacataagggtttttatacgagaaaaataaaagaattaagtctgctgaaaaaataaataaataaataaataaataaataaataaaaatttttaaaaatgttttttaaaaggccataatatttatatatacttatggggtgcaatgtaatattttaatcttcatatatatattagataatatgtgctttgaaaattgtagttaggtctgttctgatggctaaccaagagtaatgacagtatcctgtattgtttcttaagcccaaagtctagtaaggaggtgtccaatcacctctggtttctgggaagaacattatataccggtggagg

SEQ ID NO: 21452 - DNA, 1196 bp, Mus musculus
aaaggcactgccccaggactgtgtggtactagctatggcctacaacatgtgtttgtgtggctgaggcaagagctttgactgagatagtggcttacaatcagggaatatttctggggttcacaaaatcttctctctggactgtttctcttgccaatggaagatgcagatgctgtggtctctactcatggacagtaaatggagtctgcttctctgactccacagggatgaagttttgagaacttgcatagcatgctgctgtcataggtagggtaagacgagactgttgcacagtcactctggatgaggtgacagctctttcttgctcacatcacaaagaagatgcctggtggagggggttgggaccccacttccttcttatataccagatcctctggccaagcagaggggcttcagccacaactagggaagcaaggaaggcacagttgctgagccacgtctcttgctgtacgaattaagcaacctcttttctctctaaataattttggcacaaaatattgcttagtgctttctccagctccctgtgtactattctagttctttcccagccttcttcacttcccttcctcctactttctctccctctccctcctcctattcccctacccctccctcttcctatttccttacccctctttttcccatttctctctccttcctttctccacacttctactctcccagttctcctctctccccatcctccctcctccttcttccctcccccttctctcctctcttctctcttctccctcctccttcctttctcctctacccgtcctcctctctccttttccctccctcctctctcatctctcctcttccccctctcctctctccactccttcctctgtctcctgttcctttaccattcaccttcaactttacacctgaacaaatgatcagaggctaaaggtagatagccatgattgcaagctttcaactatagtgcattaggatgcctgtgcccccctaactgggtatatatagaggatatggacccctaggcattccagaaaatcatttccaattcccacaacaagctagccacttaccaatactgtaacttggacctctcaccaagctgtacagagaggtccacgcatttgcttgctatcacacagccaacaagaaatctggtccagagatcagagactagtacagctctttcttattca

SEQ ID NO: 21453 - DNA, 1656 bp, Mus musculus
ttttagagaaaaagttgttctgccccctccctcgatgactccatgagcctcctccactggtgtagcaggaggaggaggaggagacagccagcgcccatgaggaggaagcagctgcacagatcctgtggctgcatgcgagctcggcgggcactgcactgttgggccgtcccctgtggcccttttgcaatcccaggcaggcagagtgagtgaggccctgtcctctgttgggttgtgtctgtgtggcacaggctgggcagtgctccggcactcacgcttaacccagaggggaggccatgcttgggcctcaccgcggttccgacttgagaacattctgggatgcctgcagcttgtcacacaattgcacatttgaactgttattatttttgtctgtgacattttcttttatctgtaaagttgaaagcatggcagagatttgttgactgaacacttaattatgctttttaaatgttttggttacgtttcttctttttttcgttcatattatgtgaaatgattaaatttagaataacctctaacactcctataattatcgtttaaaataccgatgtttttattttctcgacagtagtccgtcctcagaaagatgcagacaccctgtgtaattagcagggacttgaggctgcttcggttctgccgctcagttcccgtgtacagtcaccagcagccaccagacagtggctgagagcgtggagggagaccagtcaaaaacccacaaccacccgctttgctcgtggggcctgttgatttaaaactactccttgctcggtgaaggcacctagtcctcctgcacaaacttaactgctggcaatccgaggccttgcacctttatttcacagaccctgagctgagcctacagccgcatccttagccacctcgggctctgtgtgtctcctctgtgcttaacaacgcccaagaacccatagcttcccatctgctgattgcttctctggaatttaattatttctcaataaattctgtattttatattgtacgtgagacattttaaagatatgtttgagaccaaggatagttaaaatgactgtaaaggtagtgtgtctgccatggagacggagtgctgtccactggcagggaaaatgatcacctcaaactaatttgcagttattatttgactcattattttcttgtctgtctttctttgataaacaaccacagacagtttaaatgtcatacatggcctcagaatttgccttggctgctggttccatagcagaagcactgaggtgaagggaagaacatatctgccttttgtgctgtaaataaagggaaatgactaacggagtcaggctgagtgttctgccgacaagaaacggaatcacatcacactctgcagccttctaaagaaacctgtatccatgcacacagctatcactgcagagctgtgccagcacctatggaccacagttacctttagcttttccgttttgttttgtttttctttttctttttaataattgtagtcaataaagttattgtctgttcacactgtgtctttagctttgtttttttgttttaatgtttatacttggtgcaatgtaaccagttcagctgtggtagcagaaagtggtctccaagggttttcattcagtagacaagctcgttcacattctcctgaga

SEQ ID NO: 21454 - DNA, 1107 bp, Mus musculus
taaaaataattttgtctgcttttatattatgttattaattgtaaagatagtgctctttctacatctggaatttcattttgttggttttgaaagtcaagcaaccacattcaaatgctgatagccaatggaagattccgctcggcaccgcagggctcggctatccttgcagtctggccgctcacttgacatctgcatggtggatatcaatttaacttcatccttgttcagaattcttcacttacagatttatactggataaaggtcattttataacttagaaaatgagcattcaaagagcatgtttgactttgtttatatgattaaataacttattttatgttaattgaaaacaaatggccatgatttttaaaagttgcctttcagtatttgtggttgtcatttgaaattatccataacccttgcttttattgagtttcaaacccttttaaaaacagcagctctgtctctcctccttccccgtccccgtttcagacaaaagactgcttgctggctaatggcaaactgggtgaggcctgtgaggaggaggaggacctgacgtggagggcccccaaggaggaggccgaggatgaggacgacttcctggagtatgaccaggagcatatccagtttatagacagcatgctcatgggctcgggcgccttcgtgaggaaaatctctctgtcgcccttctcagcctccgactctgcatacgaatggaagatgcccaagaaggcctccttgggcagtatgccgtttgcctcgggccttgaggattttgattacagctcttgggatgcgatgtgctatctggatcctagcaaagccgttgaagaggatgactttgtggtaggtttctggaatccatcagaagagaactgtggcgtcgacacagggaagcagtccatttcttacgacttgcacacggagcagtgcattgctgacaagagcatagcggactgtgtggaggccctgctgggctgctacttaaccagctgcggcgagagggctgctcagctcttcctctgttcgctggggctgaaggtgctcccagtaatcaaaaggaccagccgggagaaggccttggaccctgctcaggagaacggaagc

SEQ ID NO: 21455 - DNA, 1206 bp, Mus musculus
gacacaacttataaaactcatttaccccttcaagcccgcctcttctgattaattttcttattcaaaacacttttaatcttaattgttcttctctgttctaacatctgctgggtaattgatttgttgtgttggttctgtttcttagctccttatccaccctccttgaaatccacactgtcctttctatccatttgggtaccagtcctagtaagctgggttgggatggaggttgttaggtgttcagtcctgagcgggagaagcatacctcgtgtagggttcagtcattcgtgccattttagggaagtggcctgtgcagaaataattattaaatgacattgctggtgccatttcaatgtttgtttccagcagcacagctgtgtggcagccattttactcccctgttactcttgagtaaatgtgaagatagtggttttctttttgcaaagttgtatgcagaagattttagaaaacggggacatttctctatttaaagcaagccgattcttaagtgtggtgcctggctaagaagtatgtgatcttttcccatgtttcaggttgagctgctggaagcagctctggaccataacacaattgtgtgcttgaacactggctcagggaagacgttcatcgcggtcctgctcaccaaagagctggcccatcagatcaggggcgacctcaacccgcatgcaaaaaggaccgtgttcctcgtcaactctggtaatcaaacatcatttcccacacgtgaggagaaaattggatgagccttcatagttaaaaagattatctctgtgggtattaaattattgatagtaaaacgagtttgacaaatagtgtgcttactgaagtcctgctagccaaaataccattttatttctcagtagaatttctctcaattgttcagactctgtgtttctcttagatgaggacttctggggagatggctaagttgttaaaattccttccattcttgatgttttagcttcataaagcaggctgaaggcttgttgactagaggtgggtgatttttgctgaggctgttttagaacgttccatgcttcttaaaggctgttgggtttatgtttggggactgcagactgacctccgtttctgtctttaaagtcagtctaagccgactgtgatttgaatagtacttgttggtggattgacttgctctccttaaggagagcaggagagcaggtgtagact

SEQ ID NO: 21456 - DNA, 1131 bp, Mus musculus
tcggtagcttcagtcaatactgagtcctgtccccggctgctctccccagtctccacctccaacttatgtttctcagagaaagaattcaggctttctccttcaaacacagacctagagaaagggatgggtttaaaagaacacagtggaaaacgtgttcaacgccagccctggtgatgcacacccataatgctagctctgaggaatctagagcaggaaggttgccagccaggattaagaagtgaaatcctatctcaaaacaaaacaaactgggcggtggtggcggcggcgcacgcctttagtcccagcactcaggaggcagaggcaggcagatttctgagttcgaggccagcctggtctacagagtgagtttcaggacagccaagactacacagagaaaccatgtcttaaaaaacttaacaaaacaaaacaaaaacaaaaaaccaagacccaaaaacaaaggaaaggaaaaacaacccacaaaaataaactgtaaaaaaggactttggttttagtgtgtgcgaatgttttgcctgcgtgcacatatttgtattgtgtgtgcagtgcccttggaatgtagaatagggtgctggaacccccggaactggagttacggatggttttgagccaccctgtgaatgctgagtgccaaacccaggttgtctgtgaaaccttccaaatcattaaaacgggtagaagaccacaactcccttggatgaagttataatcacagggatccatttttttttaagtttaaaagtcatgaattttgcattgttattttttaaaaaggaagggagaaaagataggaaacccttacttgtttcagtgacctcaaaagtcaataggaacagattccaaggctgcgtggaaaggacagccataaaatgcctgtgttcttaaacgccgcatgagggttgaagcgtgttttatttaaaggaaatttggggagttcccaagtttaagacagtctctgacctgagaaccataccatgcatcgctcagcacctcagagaatgcacttagctctctgggtggagggccacacacaaaagccccctgggccttaaagccccaggcttaaggggggagggggtgtctctttgtttttatcacaataagtggcctgtttgc

SEQ ID NO: 21457 - DNA, 1119 bp, Mus musculus
tctgatgtgtgtggctgtgctctgagtcagtcaagggtaccctaagtcaggaggtttgatggcgcgttcatgtggtgtgctgacagtcttcctggggttcatgccctccttttatggaacggaatggtagaaactgcaggcttatggcttggggcacattagagttgtgtacctgtattttttttaatgcaggttttagctatcaagagctttctggatgctctcctaacacgaagtggtaagagcagtgcctacacgatagaactgtggttggggtaaactgagccagtagtcataagtacttggaagactttagggtggtgtccacacatggtaagcactacatatgttttggtcagatacagttttccccattaggtgtccccaagaggtggcctttggcaaggacaaatagcaccaggcagtcagcagcatcaggcttcagagggtgggaaaggtggtaggtcattttgggagctttgcgctcatcaaccgcttctttccaggtcaagctggttagcatcgatgcagcggaaatagcggacggcaacccctcgctggttctcgggctgatatggaacatcattctcttcttccaggtaagcctgccgctctctgtgacacttgaacatcatcgggagcgttctaaccacgggacagcacgcccacatcaagggacaccgcgagacttagtttccgtgattcatattcctctgttttctgatggggaccaggaaatgaagactgaggctcattgtttagttacaaaggtgatccgctaggggaagatttgcaggggctttggcactggtgttggccagaggcacgggcgctgtttggagctatgggtccctttctgcatcagccgagaacttgagcctcagtttccacctctgtaaatgcaggagtggtcacaagatgtgccatgtgtgagggtttcacccactgtgtcaagtttacacaggactcggtcactccgtagcctggcttctcgagggatgctaggaacatcaggaaaggtgttgaatgccttaaatagaccacagagaagccaggcgtggtggcgcacgcctttaatcccagcacttgggaggcagaggcaagcagatttctgagttc

SEQ ID NO: 21458 - DNA, 1176 bp, Mus musculus
ctcagaaatgccatcttccaacaggctaaccagatgctggagtaacagtggcctgaggtccgtaagggagagcaaagccacagaggataaaagcgagttctacacagtggcagaaagccaccagcttgtggccagtcagccctgggttcagcacctaaacctagctcttaactctacagcccagggtctccagagctgggccgtatctcaggcccttccttactggtctcctctgctctcttccctcaaaactagacaagagtctacaggctctgtcccacatccacacactatcaccaggagtccacgtggcacctggctgttgagctagcaatgaccattccacaaaggaagcctgggatctcttgggaagccgactccctctaccatcactgtctcctgtgttcagggatgcctgggtatcatcctgtgagcatctataatattaccatgggaaccaaaaggcaagcaggtgcctggggaacactgagtcttgtgggctgtcctgtaaggcttgtgctaggagactccatgcttgattcttctgctgtttttttgaaaaaaaaaaaaaaaaaaaaaaaaacctcccttgctcttctttgataaacggaaggccttcctctcattctttggggctgaggaagaaatgtcagctgattggaagtcctttggttgcaaccttgtactggagaggctccaagctctgtctattaggtgatggtgggtctcagtgacctgctagaaggtcagaggctggtctgaaaaagctatggctctctttcccttcccaggatttgctcccaggagctccttgtggctaggagtggctggaagttattgtgaacttcccagaagatctgaacacaaaacagggtggtaagctcagcctaggctctgcaggacaggggagcgctgcctctgtactcctaggttgggtgttccacaagcacactgaagggctcgggaactccttcctgtcagctaacaggggctggcaggtagcacaaggacttcaaagggcccctatgttctaaaggagtatgagacccagatgtggggctctgggtgaacctgggattcttgttccaatagtggctgataacctgggtaccagcctaatctcatccacctttgttccttcctaagaaaaactgaattttacctgaatgccctaaa

SEQ ID NO: 21459 - DNA, 1188 bp, Mus musculus
tacatatgtatgtgtgtttgtatgtgcgtgtggatatatgtgtgtgtgagtgcatgtgtgtgtgtgcctctgtgtgcatgtgtgtatgcatatttgtgtatatatgtacatgcgtgcatatgcatgtgtgtgtttgtgcatgtgtgagtgcatgtgtgtatatgtgtgtacatttgagtatgagtgcatgtgtgtatgcatgtgtgtgtatgtgtgtacatttcagtgagtgcatgtgtgtgtgtatgtgtgtatgtgcatgtgtgagtgcatgtgttaatgtgtgtgtgtgcacgtgtttgcatgtatgcatctgtatgtgtgcacattcatgtgtgagtgcatgtgttaatgtatgtgtgtgtgtacatgtgtgtttgcatgtatgcatctgtatgtgtgcacattcatgtgtgagtgcatgtgtgtgtgtgtgttcctgttcctttgtcctgcagacagtgctcacatgtaaccctcacaggttagcctgtgagagtggatgtgtgagaagcccttgacagtatcagtgccattgaccccctggtctgcatgcttcctcctgccctttcctgccccatccttcctctgggatcagaatggtgcttttaggggcagagatgtgtctataacccggacagaatgagtggagttagtggtcctgactgcaggggagccatgaagacctagaggtactggcaaaaagggcagaggggctgcccctagacacaggcgatggtgtcctcggggagctggcactgaaaagctggcatttcattgattcctctttgaggaatcccctcatcagccacatccctgtaggcgatagcccatcatcaccatcctcacactgctccgagaggcgggacttgccgtataccctggagctcagccccactgtggagtcctccgtcattggcctcacttccctgtgggaccagggtcctaagaggctttagaggaaggaaactggggtcgttctgcagcctggacaaagagattgacagggtcttagtgagctactgctgggagaatgggtgccaagggtgtgggccaccttgtgaggatgctcaggctgcctgagagcaagagaggctgagggtacctttgttctttatgcagagtggagccaggtctgagcagatcaacagagagcttgagaatcggtgcttaagctgatcaggctca

SEQ ID NO: 21460 - DNA, 1235 bp, Mus musculus
aatgatgctcttctcgtagaaacgtgtaaagtgctctagccgtgggacggctggctttggggtctcggtgactactggggtcgggaaggattgaaagaacaagggaattggtgggttgccgggccctgtggccattgtctgcaacgttgccttgcctcttaagaggctgaggcaggaggatcagttgaactcaggagttctaaataagcccgagtcagcccgggccgtacagcaggaccctttttaagagggaaaacggagggtgaggatgtagctcagtaggaagtcgttttcctagtgtaagcgacgtccagagttccaccccgtcacatgcacacagacagtaataaaagagagtattctcttagtgaattccggtgtagatgatgatggccccagggtagagtgcttgcttgcacatctgctggggatggtgcagaagagtgggcaggcgcgtcgtttttttacatggacttccccctagaacagagccccgggtgtggtcagttctcccgccggtagtacgcagatccagatcctggccagcaggcctccgcagcccactatctaatctgcagtcttggccctgcgctgggttagcggtaccctagagcacaccagacttgcagagaaagcagacaacagaggaagctgaggcatgcctgctcgagaggcagcaggcccatgtgcaattttcctctgatagggcctgggtactgttgccacggtgataatggctgtgccgtgtcattgtcgatccaccaacagtcagagaagcttggcagtcaagatattgtttagcagacggagcggtttctgttggacactaagtactgccacaaaacctcgagcgactaagcgtgttgccggaggtggtctgtttgcacccggggagtgaatgtaaaaaatcagagttcacacagagtgagccatgggatgtgctaagctgtggctcagagggaaaccggagccactcgctctgaagacagatgggaaccaaccgcctggcgggttccttgtcattgtattgattcctggtttttttatttttttctgatggcaagccccaaactaaaatcttgttattttgcagatcctctgattccaggtaccatacaaagatgtttacaagaaatgcagaggtaaaacagctgctccgaaagccaaccttttgtgtccttaacggcagagtgtcagttaaatcgccccagcgcccggaagcttttattcatgtt

SEQ ID NO: 21461 - DNA, 1235 bp, Mus musculus; identical to SEQ ID NO: 21460

SEQ ID NO: 21462 - DNA, 1235 bp, Mus musculus; identical to SEQ ID NO: 21460

SEQ ID NO: 21463 - DNA, 1317 bp, Mus musculus
tcccccggctgatgtgtctgttttaccaagagccttacctgactctcatgaggccaaaggttgaaagagaagccgaggttcctgctaagtcatcgctgaccaggagcgggggagggggcctggaattctgccaggagtgctggatgcggcgtttgtgttagaaggctcccttgcttctgatcatttcagtgacccatcttccatctctccacaggtattaaagactactccaactggccaaccatcccgcaagtgtacctcaacggcgagtttgtggggggctgtgacatccttctgcagatgcatcagaatggggacctagtggaagaactgaaaaagctgggtatccgctctgccctggtagatgagaaggaccaagactccaagtgagggccccgggccctcgccgagcagagcgccctctccatcctcggggccagaaaagccttactgcgtggtggtgccctgttgctgtgatgcttgcgctgggcctcctggcagcaagcgggcaggtgcttttactttagtctctggctcagaattccctctggtgaacgtacaaccactgcactgtaaatcaatgtcgcgatcctgtattgctataaccgtgatctgttcttacgttgtctttattctctgccggccggctttgggagtcacttctgattcttgtttgggttgtagagatggtaaagccccctgatgtttttgtaacttcctgtaaaagggaaatgatggacagaggagaaaatgtggtggctagagttgttttgtaaaattaaattgccaacacagacgtgtgtgtgagtcattaaatccagcaagaacagctccataggacgtggagaactagctgcttttctttgtgttttcttccatccttcccccagctctctgccaccctctgcttctcacgctgcccctctctcctccctgtccctccctctgtctttcagtgcagcccaggccggcattggctcatcaagtagccaaaggtgagctagatcctcttgcctccctcaaccttgcagtgctgagatgttggctatctgccaccatagctcatctgccaccatagcgctgagatcaggctccagggcattggtcacaccaggcaagcactttatcagctgaggtacagcgccagggcctgcctgtgtcctctgattttgagaaattaacagtactcccattcaccatttggctgctctgaagttcctttcggctactagggagcgcctgtacagtgtgtccttgagccaggtggcgaggctgtgcaggagggatgtcaccttgaaatgggagaagccatgagct

SEQ ID NO: 21464 - DNA, 1119 bp, Mus musculus
tgaggttagcaggataatgcagctggatccagagacgtccatgtcatcgctgtggagttggtgcgcaggttagaacatttggaattgcccttggtggggttaagagggacttccagaagctcaactttgtgcatgttggctctggaatgtttactgaccactcaggcaatggcagtaggcatctgagtctggagatagggggaagttcctgctggggtctggtccagtgatagcattggagcctgcatcctgatgagtttgccactaagccaagcagccaggagaaggctggccagaccctttggcatgctatgtccagcaggaaggaactgggaagaaacttctactctgtagctgggtattgggaagaacccagtgatggagagtggtgaggcagggggacaaccagatggaccctctgtgtgtctctgatcctgagtgtttccaagacaggacgctagtcagcccaatgtcaccaaaggtcaagtagaatgatatctgaatgtgaccagacaaacactgtgctgggcacaggacacagcagaacagtagaggagacccccacagctggcttcaagtgcggagtgctttctgttacccagtacttgtggcacagagcaagacaatccctccggtatctgtttcactttctatgaagtgagggcttgctggattcttctggctgggcattcatgcagacccaggcacacctatcactttcttcatgaagtcctgagtctctgagaggtctctcaaggtgagctactgcctgggacccttgggacaagcaggtgatctgagaaggaacactgctggggttaaggcagaaggtcaagggcctgtcactctactctgtgcgtctgcatcagatttcctacccggctgcccacagcaggaagagcgtttgagtcagcaggccactaaaaactttgcagaaggcgacagactggggacaggtgtggcactgggggagtggaacagacactctgtgtttgtcacaactgtacaaagtacatataatgtaccatagaacacgcaggacataggcactgcatattaaggtgtgcccatgatccctgtgtttatcattggtgggaagagccctgtgctgtggtcagg

SEQ ID NO: 21465 - DNA, 1214 bp, Mus musculus
ctaccctgttaaccccagtttcaggtttgaatggaaactacccactccgccattctctgtgccccacagcgattgtttcagaagtgatgtttaggaatacaaccccaaggctgggtaacaccatcactggggcaggacatgcaggcaggaagaacctgcagcaagagaaagctgttcacttcgtggacgagcaggaagcaaaaatggggaggccggatctcatgtggcattcactttccctgcctttaattccatgtagacctgcagcccatggagagggtgcctcctacagtgtggtctccccctcagctatttctctttggaaacacactcaatacacatgaagagacatgactcaatagccacctaagtgattctgaccctagtcaagttaccacctaggctacccagggaggagaacttcttaggaaccagtgtcccagatcaactcagctgctcacaggaagaggcagtatcaggctgcaaggcttggtcactcctgcagggtaacccttatggctctgagcaccctccgtatactgatctcttgaccacatataccagtacatctcaagggtagtatacttaactggaagcaatctcaactctcaacccccagacctgtggcagtgtctggagacacctttagttcagtgggcagatggcagggatgttgctgttcaccctgtgtgcttgctcagaacagcccgagacaaagcaggatctagcccaaatgtcctcggtgcccacttcagaaatcctgctccaggaagaggtccagagatggttcaagcttgccctaggagccaccaaacatccccctaggtccaggattatctccaaggcccagaataaaggtaagcatctctgggtttcaaaacctgccttcctccggtgttcctgtctcctcttgttggctgctctgctcattttcctgtccttgggtttttgtacccagtgctggtctaacagtgtgctgctgttgctatcttgtttggggcttttacttctcacagaccatgaacataactccctacattttctacaaaaatttatctttaaatacaatgtctcagccaggtggtaatgatgcatgcctttaatctcagtacttgggagtcagaggtagttggatctctgtgagttcaaggccagctggggcttcagagatggtttcaggatagttggagctacacacacacagagaagagaca

SEQ ID NO: 21466 - DNA, 1942 bp, Mus musculus
tatcttcagaggcagcctagagtaggagaagcttcttggacatgtccatgtctctcctttaccaccttaggagccccggctacatccatgtctgcagggcccctgaggtgactcgttgttcaccatcggttgtctaagagatgactgctgggccatctcacgaactcagccggggatccacagataatactgaagcaggtttctccatttcttcttcttttttttttttcctcagagatttttttaaattggatattttctttatttctctctctttttttttttttcaccccactctcttcacggtgtttgtgtttggccctgacctaggcatgagatacgaggttcagcatcagggactgagtagccacacccacccagcaactccactgcctgctccttgactgtccctctaaccctgccttctcttctcttctctccccaggtcctgcagctcctgtctgccttgcccaggcctggccccacaggggagatgttggtacttatgttctgtctgttcgctagtcatgtcctttttcctctacactgggctccaagaagaaaactctggccagacgctgccccttcccatgctgctgttgcctgctcggctgccttggttggtccctcagctctgctgactccctggcaaggggctccagagaagatcccagttctcctcacctcctctaggtgctcagtggtgtctgtgcctctgatgatcttagctgattgactcttccgtctttccctttggcctcacaagacaactagtgtctctgacttatgaacttgccttcttcctcacgggtccctcagcagtacatacaccatgagggacaagacctcgtcattggaatctggccaggccccagatcagccatcactcaaggtgttgtgcctgtacccacctgacctgtgaagccccacctacccagcaaacataggctttgattgcagagcggtgtaagacctgagagctctcttgcccttccttagaacctaggtgcttgcagccagggatatgcaaacctggggcctatggcctcactagaacaagaggccaggcagtgggcctggttcagatgggccctctgattgcctgtgtgcaggcttcctctctgggtgttcaggttctgtatttagtgtaaacacgtcctgtcgctgattaaatatttcactcacctaagttgggccaaatcggcttccatccttgaccgagatgccaataaatgagggagagaagactgctccggggtctcccagagaagccagggtcacccagggaagccttggtctcctagtaagaatgttgaaagggaatgtgtgggattttatgtggttctattttagagatacggctggatttaataaagctttgtagaactttaaaatttctcgtgctcttggaattatgatttgagaaccattagaaacagcagcaacctcaaaacaattactggccagttctggtacgcagcccctttggtatggtcctaccttctcctcaaaccctgaacgccctcaggtctggatgctgaccaggtgtgtcattccaagtgtctgtcctctttctcaatctcagcggttcctcacatgaaactccccttgacactttcatcccagccctccccatacccgtgcccttcagacacaggctagcccagtcacaggttagaccacccatgccctgttctcagctggttttcatggcctgctggccctcctgctccccttataagtagggcctcagaatacaagggacatcttcgaaaaggagccagaaagggccacggggcaccttgcttccttcccatctctgtatgaagctagtcctcagagctgccccaaagatgcagccggataaggaaggagaagtactcttgagtgtacagcaagaaaactataagaaatccaccacctctcatttcctatctctcct

SEQ ID NO: 21467 - DNA, 1162 bp, Mus musculus
tgacttctcccagacatgtgtgcagaagacagagttttagatggccccaagttccccaacctttacttacccttactcttgaacaatatcatcgatttaacgagggagagggtcattccatgacttgcctcggatgggcacagtgaggcaaaagtgagggaacagcattccgcaagcatgttacatagactgtgatatgttttatatatcacagagctgtttgcacatcgatactcatggtagcattgatcacaatagttaggttgtagaaccagcttaggtatctgacagtagagtagtgagtaaacaaagcatggcatgtatacacagtagacactttgggaatccacgaagattgatgaaggtttgccacttacaactgtgtatgatcaagagtaagtgattaagacatctcagaaagacaaatagcagttgctttctcatatttgtggtctctctctctctctctccaattctttttaaaaagattatgactttttttttctttgttggctttactgaaactagtggacacattacaggtgtccatgtggtggggaactgagggcagcctctggccaaccaccagctaaagaactggaggaatcttattgccaacagcagcaaacaacacacaaagattatagagtgtgttcatgtggccttggcaggatgtctgtccccatttgaactttgagatgaggtggggactacagctgacttctcaattacaactttctcaagacattgggggcacaaaaggtgcaccagattcctgactcaaggaagcaatgggggccacgtgactcaaataatttgttttgtgctacattgtcaatggcaagtgagtaacatcacaggcatgactcccaaagttcttgggcccacatattagacttatggatctaatgagaggctctgactggctcagcttgtgtcaggcactcttgttcaccaaccaatggggatgttaggtgagtagagtcggcagtatagccactctcacggtagtagttaacggaatcagataggatatttcctagcaagcttatacacaggcaaaacatgagctttccacagtaaatggtcaacagggccaacacatttcttgcctacaaaggcagataagttaattgccaattaaaatgcagtcatgtttgct

SEQ ID NO: 21468 - DNA, 1400 bp, Mus musculus
ggggcctagtggcagcttcctaggaaactagttcaattcatgtgcccatctcaggaacaaaagcagttcttagtaaaataatttaatatcaaaacaacacacagccaaaaacttgtgacattttagggcctggcacttgcctttcagagtggctggtgtcagtcactagagatttgctgccctgtggaatgcttgctttcattaaagtgactctaactgtacttgttactgacaagagctcattgggaatgagtttgtaaacagtgttgagtgcttaaagaaaggggagcactcctgaggcactggggagcactcttcatagttctgaggagttgatttttcagctcacagtgacagaagccacagggaaagtgaagcagctggggctccagtgtctgtcaggtagcgaaggcctcgcctccctcaggcaacatgtgctgttctgcactttatcttctgtgagcgtgcgtttgtgtctgtgtgtctgtgtctgtgtgtgtgtgtgtgcatctgtaatatgatgcaaggtatgctgtgttctctgtgttatttacaaggttatataaatacgatgtgaagtgaagatgtctcagagtttttggtaaaggaaggtaacctagtgtaagtttctgtatcctaaatgcaagtgagaatgtgagctctgtggtgggctggggcccgcgcattgcttatgtggccactgttaaggacttagtgcagcccgttagtgtcaagggcattggaagtgggctttattcttagaaagatacataaaaatactcccaagtatgttctagacaactaattcaaagtaccatttttacttggttaataatgtacattttgataacttgttgggaatgaataaagtatttttatttaaaggtaagattgttgtatacgtccatgaacatttgtttctctgaaaagcatatttgttgatgcagtgctctgattgaccaaaggacatgtggagatacctcggagctgattgtcactgtcactcattaggaggaggagtgtgtgatttgtgcctagagagtagcccagcagaatggacctggggctttgcagcgctgcatgttcttactcttggtttgtagacgttggtggctcttggggatgctggacaccgcagcagcatttggtttgtgcgtgagaaaggaagtcagtttcaccctctaagaactctgaacaaggaaccaggtcaaccttgactcacagccacagccacagccccagccccaacctctagagctggttcaaaaaacaaaaacaaaacaaaattaaaaaaaaaaaaaacaaaacaaaacccagtcttgtagacatttgcattcgctcgatttccttttgttgccaggaaacgtcaaaagctaccttggagtggccactggtggacc

SEQ ID NO: 21469 - DNA, 1198 bp, Mus musculus
ttgctcgagtacgtgccgggagtctgggtctcgcgaacgcgccaggagcgtgtctcaggcgggagcgcgcccagtagatgacaacaaattagtcgcgccgcgtcggagtcttgtctcgcctcagccgccagccctctctgtctgtccctctgtctccctaccgacggagcgcttcggaagctcccggcttggggcgcccggttctgctcagcgcccagtccccgccgggcctagtgcgagcgtcgcgacgcgggccatggggttgccctgagggacggcggcgccgaaccgacatgcagcggccaccgcgaacctagatccccaccgcggcttggggacgccgccgggccgaccctgaggcgctgccgctgcctggagcccaggtcggatcccccgagtcgccgccgcgtgcagccccggctccctcgagccgccagccctcaccatgccttggccattttcagaatccatcaagaagagggcctgtcgctacctcctacagaggtacctgggccacttcctgcaggagaagctgagcctggagcagctgagcctggatctgtaccagggcaccgggtcccttgcccaggtccccttggacaaatgggtaagctgctgtcagccagcaggggtaggaactggctctccccagggcgagacctgagcgactgtcatccagcatcgggcacgttcggttctcctttgggaattgtttagattcaagtgtggcccggctcagggaagtgtgtaaagtgtagcaagtttgcgctcctagatcacgtgctccggcttaaacggtgtaatggaggcacacacggggcgaaacaatcgagtcattggttgggggggggggggggcgcttgtgaggcaggcccaggaaagtacgtggccacccttgcctcttgggctgcgagtgtctgcggtgttcctaggcaaacaaaccctatttctgtggatgacgttaagaaaaattaaagatgaagaggaggtgacagaaatccccagttatttattttggtctggatgctggtatatttgcgtttgctgggttggttgtcttcattcactgaaagaaagttaggcgaaggcccctcttgccagtttgcctgctctgcttgcgtgaggttgtgaatggccccagtagtgctgtttagatttgcccttttgcttcacgtgatagatcgacaggtcgtaaacg

SEQ ID NO: 21470 - DNA, 1159 bp, Mus musculus
aaaggacttattattattacatttgtaaaaataggtttattttctctactgcacgctttctggtagtgtgttgatctgagtttttgcatttattctggtgtttaagtgatgttaaagtttctggaggaggagaaatgtattgatatattttatttcaaagtatctagggatacattttgtcgggaatgtattttcaaagtagaaatgtggaggcatggtgacacatacctatagttctagcattgtgggactgagagagagggcagcattggccagcctgggttgcactgcagctcctgtctaaaaagaaatcccagtgtgggcagtatggcaaggagcagctgtgtgacgagagctgtccctgctctcgtcctgttgattagtttcaaattgtagacttttttggaagtaaagaaaatttatccaattccatttttagtccagttacaacgcagggatcacaacaaacgcagccaccacagaggcactatggcattacctctcctatcagcttagcggcccccaaggagactgactgcctactcacacagaagctcatcgagacgctgaagccctttggggtttttgaagaagaagaggaactgcagcgcaggtaaggagatagcagtgagtggagtgctttgggatgcttaccgtccgaattttgaggcatttcccactcactcagtagttcagcttactctaaatctttatacttgtttcacacaagaatgatactctgtgaagaacttgttttctatagagtcctgttgctataagtgtgattccttggcaggtaagggggagtaaaacagttgtggttagggcttgaacattgtacattgtaggcaagtgctcttaccacagagctacccttagctcaatgaaaattttcttttgatgggggctggagatggctcggagatggcgagcactggctgctcttactgaggaccttgattcaatttccagtgtcctcttctggcctctgcatgcagagtgcacatgctgacatacatgcaggaaaacatacataaataagacatacaattaaaaaaaaatttctggtggttcttggttacagtgtaggagaaaaggaaatgctttaaccagtttacaagtgccagtgtaaaaccacgagtttctgatctcttataaa

SEQ ID NO: 21471 - DNA, 1101 bp, Mus musculus
atagggctgtgtactgtgccttggcccactgctgtctctgtctcattgtttatatagtatgcttactcgtgatatgtgctgtgtgcctcgtgcccagtcttgtacattgacctgattccattgacatctctagtgaagtttttagttttaatactttgagcagagaagcaccgaacaccattgaaaaagacataaaggaaaactgtgtgtgtatagtgatgaaacaggacgatggaaagtcctggctcacccctgttttgacttgtcatagagtccattttaaatacagtatgtctgaagaaaatcatgcccattagttagcagtatctttccctactggttggtttttttttttttttttttttcagggggacaaagttctagaaagcatgccaatattctgtcaaaacaaatcttatactgttactgataagacaggagacagtttccttgtactgctgtgttgtgatgattggtttcctttttttaaggtgctgatattgatgcgttgtgtgttgcaccaagacatgttgatcgaagtgactttttcacctcattctatgataaattgaaattacaagaagaagtgaaagatttaagagtatgtacatattggggcaagagaggaagagttaaatgccatttagtcttttgagaaatgtatttactggtggaggaatcatttaattgagccggcaatttttgccaggcaattttaaacactcagcatgcatttgtctttgtattttacataaaactagaatgataaacctgtaaactccttacagattgggaacagaagcaaacacagtgtgaacagccacatttcctttggtagaaatggaggattttgaacctccaggcttggggtgttaaagctcacagctaagaacttgtttttgttgggaattatgctaaattatggtgaaagaatttcagtgccgtttttaaaagtagcaatagtagccacatagcttacctgtaattctggtacttggaaagtagaggcaggaggagcgcaggttcagggtattttcagctgtgtggttggtttgaggccaacctggtctaattgagaccctggctcaaactaagtagaag

SEQ ID NO: 21472 - DNA, 1329 bp, Mus musculus
caaagggaatggaggcagctgtaggtcttcccttacaccgcagatcgttcagatcctcactgttgtgtgtgatgacataaatgtttatttataggtcaaaggctgagagtgaaacaaagaacaaacagtgttccggacctgtgtgcaaggctcagagagattttcattgtatttattcattcactatggtgcttagcttaagtgctcctgaactgcctttggctccctgatatttttaatttttaagatgtgtttctttttcagtttagtttttagtattgattttatttagttattctgtagacagtcaataactccttagagtaattgactagcgttagtgttggctgggacagttccatatgcacacaagcagtcttgtcttgctaattcacaaaccttcaccttctttatttttcttcttgaatccttttaaacttaaaccaaagtgtaggtcaaacgttgacccaaaaatcagtgtctcctcatagcatgtactaactagattacctgaggcgctgagctagctgccagccgtgtactcacctgtggcttagagtctcagtgcttgtgggaaacacactctgccatactctgccaacaccagtgttctactcagtttctcaaagttgtttgtctgtatgctttccctcagcctcagtagccaagaggtcatcgaatgaggagtgtgcttgtgttcctccaccacatgtttcccactctgctgcactgattgattacgtgcctgcagccatggcgccccagtggggttggctttgaaagtgtttttttgagtagagtttttttattcagttgtgaaaggatttataaaccagtcagaccaccccagttacgctgtttttagagaatgtatcttgtgtcctgtgattgagggagggcctttattgcggagggtagtgtctaaatacagcagggccacgtatttgaggtaatcacagataattgggagcagcttcagtttcgcttcagaataatccttggttgaaggccacaggaaggagtagattggctttgacttaactgttgctgaagctggctgagactaatgtgagactaataaatgctctcaacttctatgcctgtgtggaaacgtctcatgaaacattttatgattcatctctgtattttggaatattaaagatgccttgtaataaaatttgtgatacaattttttttaattccctaaaagttgagttaaattattgttcagttatatagttaattttataatttagagtgtcagaaaataactgctaaatgctagctgtgtgtctcaggtgaatgtaagtgcttcctccacacgagggc

SEQ ID NO: 21473 - DNA, 2726 bp, Mus musculus
aggcggtgggacacgcatcccattttaagtcacagtgctttaaactgtggtgtgttgtttgctttcattctcagaaaacatccagtacagacctttctgatatccctgctctccctgcaaatcctattcctgttatcaagaattcaataaaactgagactgaatcggtaaaaccacctcagggtccataaacagtatctgccaactcaacccgttgtctccagatgcttaaacaaaggaaagaaagaaagaaaggaaaagaggagattggagggacaagactagacctgactgacagtgggtttagctgtttggtggcctccctgccttgggctcatgagcacttgatcagaagtccaggttagtatgcgaagccaggagtgctattattactgtgttagcgacagctgcattaactactcagaaaaattactgcctttaagaaggaaacaaaacaaaaccctcgagctatgtttgtatccataactgacatccggatcgcgcctctgtgtgctgcattgtttggaaaactgcaatacaagctggcagaagaactcctcattctgatgatgcacttttatgtatttttttttaattagaaagtagaactaattttagattttcagcttaatggattttcaattttttttccccaaagaattttctttacaattagtctttaaattggatacgttgtgcattggtgtaccattctgtcccagaaagggcaggaggacaccgagctcagcccagtccttacgggcagctgtagcccttagggtgaattgtcaatgctaaggtatactttggacactgaaagaagaattaggcgatacttggttttgatgaggttatgattaagcagtatatattccttttatttatagagttgttttatagtgcatacaaatcagcattcggccaacaagtgtggtctttgagctttcgcaagctctgttcttttgccttcagtctgttagtcttcagaaagacagtgctcccccacccccttttattttattttttgcctttcttttttcccctttgcttgtatgcacaaggtaaggcttatttcacagaaaccagaatgccagtattttcctaagccatgacatgtaaccttgaccctgtggctgcgtgacacagacactaactttggtcccatggctagaacttgagagtgactgaagccatacctgtgaagcatccccggaggcggccctttgatctctgcgaggacttttgtacactccacacaactcctgttcctgtcttagacaaattgattttcatttttaaaagtgggcaaaaggcattttcttccagatttttaaactaatttttatttttaaccagtttatcaaaatttgtcagtgaattttacatacaaaaacattttaaaaatcatttctagtaagcacttgacatttagtcagctttccacttttgaatttttttttttgttctatcaaaaattagaaatcttctttaaagacaatgatttctcataattaagtagcagaattctcgtccatcttgtgacatctgacgggtgccagatgttgataaagttactctttgttaatctgggtaaaacagacctgtagcagcagatctttgtatgagcatggtttttgaatccttcatttcgctgcattctatcacacgtttgtgcattttcatgttacactgcaattacttaaactctcccctgtccttccaaattaatttccaaagttggagtatagtctttcccctgaagctatgcattaattaaggctttctttaccacttacattgtttatatacagtgttctactctccacctcttgctctgcagtcaccttgcccttcctcccaccatttgagtaaagaagacggtccgctaacaggtgacatgtactggtgtctgtgtgtgtagcttcagagttagattgacatcaccaggcacagatttagtcttgtcgttttgtttacacattggggaaaaattcagtttaataaacgttccatgtaactgcatccaagtttcaccaggctggagacgtggatcttttctgtgtagtgactttttacttctagtttccataacctggagatcagactgttgctttcgcatgatgtaagtagtgtctcatgactggagtttgctttgttttatagtatctgtactccttgtatttttcaagagctattttgtaaacagatgatgtatttctccattgaaaacacaataaaaaaaaaaacagcacaaatcccatagttggctggtttcttttgactctctctctccctctccccctttcagcaatctaattaattagttctacatacaaatatatggtgtggccccaaatgaagattggaatttaatgtgcttatatttggcaggtttgttttaggttagcctatttgtaacccagtactaatgtgtcacacgatagcaggcaatgttgttaacctagatgatcgttagggagaaaagggtggttatagctaccactaactcactctgaacaattccattttctacagtagtgttctgtctagtctgagcactgtacatttcccggtactgatgcatatggctctttcatgcctctactttcatttctctgtcagcaggtggcactgttgtttttcagtaggtttataattgtgtcttacagcttgaatcttgtttattttactggatcaaattctgacatttttcttaaatcctcacac

SEQ ID NO: 21474 - DNA, 1150 bp, Mus musculus
tttggtaagaaggagaaactttgtacagcttcgtttttaaatggcagccagttgcttttggatggtgccattgaaatatatcacattttaatttttttcctgttgtcatcgtcattttgacacttagaagtcttaaggaaacgtttagtgatattctagttaaaatgtcagtcccaatttcttttctaaatcttggctattatagagttggcaaagtatttcaaatttgaaatatgttaatacaattttagttctgagttaaggtattttctccatagatggctcgcttcagctggagcgcagcgccaagaagtaactccgtcaccttgtcataatggacgcctactggacaggaaaatgtctgaaggtgctcaggagccttcattagagtgtcctgatttatatggttgattcgcattataagtttaataaattattccttgaagggaacttgaaaattaaagttgatatgatgtaggctgaaactgaataaatcaaaaatcttatactgttggtaataagccaggagtggtcttgggagagcgtcttttaagttagagttttattaatgagtcattctgaaagctaaccaagattccttttctttaatttcactttcttcatttttcacactgattctgtgacttacttggtcatagactggaaacatttgcttccatgtctggcttctgttgctgctaggaagggagccacaggtgtgggagagtttcctgcatagcacatagctcggcattcacatctgtgtacagatatgatcctgtggggcttggtgacatgctgagcccttgaacaccactctctgaggctgagctgtacacatatggcgaactgcccacgttctttctgatccgagtgttggccatttttggcttaagtgttccctgtggctaagtactgtgtgattgcagatgagcagagtcctgtaaaagcatgttacctggagatacccgtcatttgaattcctgtacatctgagctgatagaattatgtgtgacaaagggtttaattgacacttcaaggaccaaaattaacttctgtagttgttgaggtttcctcaatgaagaagaagtgggtggatgttattttcatcatttggagcagatacctctgaagtggagaacacacactg

SEQ ID NO: 21475 - DNA, 2069 bp, Mus musculus
atggagaggtttgcatttctgatcctgtgcttttgtaagttaatgatcacttatgtgactttctctgattccttttcaaggttcacgaaccagaaagaaagcccagaagtaaacgagattccaggaaccatcttctctgcctattcatttgattttttttctccttttctgatttctgttttattttcatgtgagtcttctggggtgttagtaataattgagtggctattttttaaaaaaacactttattaaaatgaattttttgtgtactttactgaagggtaatttataaaattctgaatctttagtcgtcataacccatgtggtctggggctcaggctgctgtgcgattcccagactggacagagtgctcagcaggctccttgcttttaaggaatgaagaacctttaggtctcttttgctcgatgtagtatacaagtcgttgtgacaataaagtctggtctacatggattccggtcttttacacaagcgtttattgaatgcgtgctgtgtgcactaaggaagaaagagcacagtaaggtatggcctgtctgagagcagccccacagtctaaagtcagaagcaaggatgagaagcggcagggtgcccttcaggggagtcctgtcagtagggggcagagcctcccccacttagattttttgtttttataagtttatttaagagaaatgataatttgtaaaactcaagttctctagagatgtttgtttttgttttttgttttgttttggcttttggggatttgtttttttggttttctcagtctgacttgtatagaccaagtgttctcaaactcctggcctgcctgtgtctgcctcccaaaggcagtagctgagggattgcggctatgctctgcacgagagcagaagtgattacagtctgtatgacatcctagctgcagaggttacatgcaccccacactagctgcagatatgatagctgtgcaccccatattagctacaggggttacagctgtgcaccttgcactacctggagatattgcaggctcacacctcacactagaagcagggattatcatgtgtaccccttacacatggttggaaaacaagatacacagagtattttccaactcttttggaaataaagctcagaaaatttagcatgtttatgaacaatttcaagagaccttcctcaaaaattactcttagagcaatcagggttgggcaaatgggtaagcaagttggctgctggcaccgtgtgtattgtgtttttgggcagccgtggtgtgttcagaatatacctcacacggcctaggacaggcctgaagtcgtcacctcagtacttaagagactggttgctttgaagacagttctgtgtaaaccattgtgtgatggacaggagcagcaactgtgactggctccgcccgtggactgttgagtcatcacgtgacgtggaataaggcgcagtcagaagcggatcgagctgcgctgtggccccagaggctacttttctcagcgtcccagacttcccgtgggccctaggagaaggggcctagagacttctgtttcctttagaatataggggggttgtagtacagagtagtgtgtcggttggtcccaagtgtatttgtgacacctaaaatcaactcccaagttctgttttaaacatattcctgcttaaaataggataaaatgtgtgtgatacggttttgtctgtatactgtagcctttttttaaaatttttttaaaacacaaaacagcacaacctgttggttaaatattaagaaaacaaatatttcctcacatattgttttaaacaagtgctgacattttctcaaatgttactatattggcagggctacataaattagttaaaagctactagccagcagtagcctggttggtcgtcagctgggctccttgttctgctgcgttttcagtccctacggagggagcgtggttcttcctgggccagccgcggcagcgcccacagttgttgctgatttctgccctttgcagttccatgagtttatcttcttgccagttcctgagcgagtgtgcttgcatccgctcttctccctcgtcatggtg

SEQ ID NO: 21476 - DNA, 1235 bp, Mus musculus
acagtttgcgtcacacctgccttttccctgagccaccttgtcccccactagtgaagtcgaatcccagataagattattggaagaagggttttggaaaataatggggtcaccaggccgggtcctgctgtgtgagatcagtgcctttgtacgaggaagcagaagacgtgaccctccccgtgtgtcactccagtgggaatagcatcttgtgcacgtggcctgggaccggatccctgttgtttaagcctctgggtttgttctagcctcagtcaggacaagattgtttttctggtcaggtgagtttgttgttactgctagctaaacaattctgtatttgtaaattagctgtcctgtcttctatcctgtgtgcttgtatatgttgcttgtagattaaagaccagagacatttgtcatgttttttttttttgtctctaatttttaaaaatttttaaaggatttatttttatggctttagtctattgctttctattataatttctgccagtgttttaaattattttctaactagaaatcagaaatatttaatgtgactttttgttgtaaagtttttggatttacaattgaagtgaaatttgctgtggtgtttgtgtgtgtgtgtgtgtatgtgtgtgtgtgtgtctgtctgtctgtcattaggtaaggctgactggtactccaggacacccaatcagtagcttctccctctgctttgtttatgtcgcattctcatgccaggtctattactggacagtgcttgctttcgctgatagatcctcatgtcagcgtcccagcctcgtaagtgccaccacgtgctggttcttactcatggtccaccttatattaacaggaataaaagtgggagaaaataacttactctgtcaccacaacagaagtcaagctcttggccagtgagatggctcagtggggaagcccagtgacctgactctgatccccagaacccgtggagagaactttctgcacaaagttgtcttctgacctctacacacacttacctggcacacccctcccccagataatagagttttacacagccagctcttacctcagagtatgctgttcctagtctactccctgtgtgtgtgctacttaattgcagtggttgtgtggataaatggttttgaaaggttgacaggccattctataacactatgaacacacacatcgcacacacaaacataccacgccgtacacacagcgtgtgtgagggaagaattttt

SEQ ID NO: 21477 - DNA, 1147 bp, Mus musculus
agtggccaggtcttcatgggagctggggacagccacaggtctgccactgaggagggagataaattgtaagctgttcagcaattaggaatggatagtgattggcacagaggaactgaagagggtgggaaagaggaagagacattccgtggcagtggggttgttaaggagccagagccaacgtggaaaactgaagcaaatttgcctgtggcatctccaatgctacatgtgagtcactgttctatgttttctgaatataagcttgctggggaggggggggtctagtgtgtgtgcaacaccgggtgtagaacctgaggcaggtgatgtagaaagaaagggcagctggagccgtgcagggagaagggcaggtaccaccaatgggattcacagcctgagtctctctctgcccgtggttaccggggaggcaggcagggccctctgtgaattaaacgtagaagacacgcaccggaaaacatggcagttcagaaacacccggcgtgtgtgtaaatcctaagtctgttgtctgtagatcattaataacaacaaccgaggggaaagagaaaaaaggaaaaaaaaaaaaaaaaagacaggtaacggtgccatcctcgccacgccgcccagaaaccattaattacacttgaaaaaagaaatcggagtttactttaaaaggagctcgaagacaatgctacgtaattaatttaccgatttatcttatgaaaagccaccctgccatggttaaaatgtaatcacaaccttcaagctgaaggttcgagggagagactggatttcccgtaaaccgcttgtcaggacggaaaaggtaattattcggtgcctcctctccctttaataatctaacattgagcaatactgtttatattgaaaagcttgcacctttaattaccaattacatatacataatttcagagccaaaggagaggactgcgcaaagagtcctccagaaatatacagatgcattgtgcccgcccggcacacaggaaaggaagaacaccgactgagacataggagaagggtgtcaaaatattgtttggtcagaaaagaaacaaaaagggacaaaggaaataaactgagaagcaaaacaaaatggggatgggcggggggcaaactgaaattgaaattgagaattcaaact

SEQ ID NO: 21478 - DNA, 1194 bp, Mus musculus
ccttacctttgttttgagagtcccaacttcctataacaagagccctaggtcagactgtagttttgatgggtgtgttgagtcatgggtactgtgagtcctcagtttaaaaactgttagcacccttaccctttctctgtgcagctttgctaatttaagtcattaattggtgtctcatcacatccccccccccccccccaggaagataagatcgtcttgaaaaatcctgacctctctgtccgggccacaatggccatcaaattgcgcttgggtgaaaaggagattttggaaaaagcagtgaagagtgcggccgtgaaccgggagtactaccgtaaacacatggaggagagggcaccactgcccagatacgaggagagtgacctggggctcttggagggtggtgtgggggactcaaggctccctctggtcctgagaaagttggaggaggaagcaggtgtgcaggagtctctgagcctcacagagactgtcagcaaagtcaaggctgctgaaaatgggcttgtcaatggggaaaacttgatccctaatgggaccaggtctgaaaatgaaagcttaagcccagaagaaagtgaaaacgtgactggagaagagtcttcaggcagcatggccaaggtgaaggagcgactttgagatgctcatggaatccagtcgagcagaagtttcggacagcccaccacatcaccatgttccttgttaacatttttcttttcgcagagaggaaaatatgtttttgctgctttatataaaagtgatttttaagttattttaaagatctagcttccctatttgattaagattgccatcttgcttttgggcagaaaaaagtagtgaatagcagcggagaaaagaggaggcacccttgaatgactgcagaccagctgtgggcactcgctgctcctccaggaaagggtgaggtccgtgctcagctatgcttgcaggcctgctgtcctcactccagaatgagtgctggctctgcctctggctgcagagttgaggttggactctggagtggatggtggagatgaggcacagtggagagaaagctgggctaggccattgaaatagaggctgggttttttaataagaatatccccagtaccaaaagaaaaggtgaggtggcaacctgatttctaatggcttaaaatgttgatgatgatcctaattacataaacacacaca

SEQ ID NO: 21479 - DNA, 1195 bp, Mus musculus
acaaacaaaacatttataaagaggtagtatttatttacctctttctttataaagaggtagtatttaaaagaggtggggcttaggtagctaaatcctaagggagttagaacaatcattcctgtcctcttagactttcactgtgatatgtatatttttatatctaataatttgagtagaggcacagttaagtttcccagtcaatttgaaatacacatctataaatctctgtatttatcagttttataacccagcacatagtaaaaaactaatagagacagacactgccttccacttggtcttctcttgagaaacgttcatagcctgttagtgtgaaagtgcacaagctgtggaagtgggtttctgacaggagttaagttaaaggcctattctagagtattcccctgttttagaaggaaaggaagacatggtacattctaaagtacagttttagaggaggctgtgtctggagaggcttagcgtcctgggtcagtatctccctaagcctagcccatcttccctgcctcgtcgtggtagacatgtgcgttgggcttactctccttaggtatgcatttggcatttgggagcgtaggaggattgcacacgttcaccttccatgcagcaggctttaaccaagtggatgtgtggttactttagaagtctgtctactgctttaaagtagtgctaatatatgagaactaagcttttgcttgctctgctctgttttaagaatgcatactaagtttgttttatgtcctattttcttctttactgcatcttagatttacattttttatggcactcggtcaaatgcagagtttgtgatccacagtggttttttctttgacaataattcccacgacagagtgaaaattaagctgggcgtgagtaaaagtgacaggctctacgccatgaaggctgaggtcctggctcgggctggcatcccaacgtacgtacacagtaatgtggcttggcacttccctttggtgcatgtagtattcccattacgtagtgtttaattggtgtgttaataaaactcctccacagtagtaagtaagtagccttaatccccttatccctgttacacaagattcagaccagtgcttccagatagatataagtgtgttgctagcagcgtccacagctagttccaggggatctggcctgcagtccttgttaagttaaataagtgctctgg

SEQ ID NO: 21480 - DNA, 1294 bp, Mus musculus
attcctccccctaccccaggctaccctccccctccccctacctacaaccccaatttcccacccccacccccacgcctgcccccaactcatgcagtccctcctcaccctcctccaggcttgggtttgccaccagccagctacccacctccagctgtcccccctgggggacagccccctgttcccccacccatccccccacctggtatgccacctgttggggggctagggcgggcggcctggatgagataacggggcgcccccccctttgttttaagaattgttttccaaccaacttgaagaatagactgagggggcggcagcagggcgccttgtatatgctagacagttgcagtgtgggagggctgggccctggcatgaactgtgtgccctgggcagtgcctgctgtggtgtgatcacatccagtccccgctgccgtctgtgtcctgcacggggctactttaatactagtgaagatgttaagtagccacattggctcagttaatagcttcagtaaggagtgactaaccctctagaaatcagtgcctaattttcctgagaactaacttttggtatccatgtcctcctgtctgcagtctggctgttgttcttccattctgtggcttctctctgtggcccctagtaggtgaggtgactccccacttagcttgtaactctgtcctctattgtcatctggggggctgccttgacgggtggctgtctccttccctccatggagaaaggaggtgtgtacttggaaaacaatgtatgtttacatctctttgcaaagtcttgtacatagagagatattttttaagcgtgaatgtaacaacatactgtgaattccatcttggttacaaatgagaatccttcagtcagttgcccgaataaaatcagttctgaaactaccgtttatgtgtgagtacagcctctctctctacctcagttgatctgtcccacggcctgtgcctcctttggaggacctggtgttctgggctacatgagcttctagagcttctatcaggcttaggaccctcatgttcctgacctgacagtagccatgagtggtctttcctatccagggtgggaccagctgcccacccaacaagccgtcagctcacaacaggaaaaaagcactacacactcggctccgaggctcacaaagaggcctttattatctagttcaaagtagacactgtcacaatcttatgttactccttttactaaaatagttcaaatcaatgcttttaccacactatcaaaagttctattttttttctctctccacaaatcaaag

SEQ ID NO: 21481 - DNA, 2686 bp, Mus musculus
cgtttgagctccatgttctgtcagcaagaagcctctgagactccaagccaagggactgtctgggaggtagcctgctcttggtagaaggtccctcaacaagtattctaactctctgtcccttacactggacagatgccaccggagcctgaatcgtgacgcgggtggcacttttctgctaccctgccagagccaggaccctgggtcacagagcactgggtcccgtgtgtccatgactggctgggagctcagggttccctgtcacctgggggtcggtgctcagccaccccgaagccagcttctcctcgttagtattcactccttcagtgacgtctcctcaccaatgccaggcttagccactttgtaggtctctcctgccaggcttccttttctggtttacagcaacataggaaagtcctggagagtgtctgagccaggctcagcattctcaatgggcaggtagaactgggccattgcccagggtcactgtcaatgtgacggagcacccccccccccccccgcccgtgtgctacaaggagccacccctgatcccctgatgaggtttccttgggaaggatgggggcatgcctggttctggctttaatctgctgtgtggccttcagccagccactcagcttccctgggcccccagccgttccttctgcctcttgctcactctagaaaccaccccagttttgtggacctctgtcctcacagtggaagagctcatgtggcaacctactgggaacatgctaggccagcctgtttgtcatgctgtctcctcacaggtcacatctgagccttagcccctccctccaagggacctgtgggcgggggcggggggggggcgggggggtcaaatgcgtgcttcagtgaacgttgctcgcgcctcagccggaaggcggcacatggctgtcaggagttttctctagtgtggttggaggagagtgaggtgcttttgtgaaccatgcagatgctgtctgtaggaggccctggccacactgctggcttcgccagttccgtgtatttacatccacacccatcagctgtcctcacgcaatggtacttagagccccatgcagcaagcccaaagagcttgtccttgcctcaggtccctcccaaaccctgtgagcagaggggacaggccaagaaggtgggtgacatccttgctccccaacaagcccaggccccgtaaccttgggtggtacccagcacctttgctgcccacacccttgggtcccacactctcaggggaaaggcccatggccctcggtgtgcccagggagtgttgcgcaggggctgtaggggaccggcctactgctccggctgttggtggcactgggaagctctttctaggagctgctggatggtcaatcgatagaacttgcaactccatctgccggccccagctggtactgggtatttctaagtgggctgctgggcaggcaagacccttcctggttctttgaagccaagaaaccgcagaataatgttgaggtatgtggcccacacaaggtgggagccaagtcagagagtcccagtcacatttgtatcaggacagttcagccacctctgaaataagcaataagtaagagctcttggagtctgaagacaagaaagatcctgtccctagtgctgcagggcatccagggaatctaaagagaatttctcacaggctcctctgcccttgtgcaggcagagagagacaagctataccccagccctcggcagtaggctggcttccctaggacagcctgggtcatatctcaaacctaacaggagaggccagcagcaacccagttgagcccggggccagggagggcaggtggtcttccgtgacccttcccttctggagccttagcctttgcagtgctgattctccaccccaagctcacaatatgcttgtgctggctccacccccgtccccactgtgacaggtcacttggccccatctagggtggcctggccttccccggagtcagaatctgctgagcacatcttcatttgcgatcaacagccacgcgccagtgtttcaagacaaagtgacctttcatttttctttcttgaaacttgagaggaagtgagatacatactactgatctttttttttttttttttttttttttttttaagaaacaaaatgcatggctgcagagtggcagaggtgtctattttcatactgtgggggaaagcgtgctgcttttgggaggggctggagtgcctggtttctgccctgggccggtcttctataggagttggtggtgagacctgcagctgcccctcctgccctggccgtgtagagctggagcctgtgcacttcggccgtttctaccttctatcgaaccactttgatttgtggagagagaaaaaaaatagaacttttgatagtgtggtaaaagcattgatttgaactattttagtaaaaggagtaacataagattgtgacagtgtctactttgaactagataataaaggcctctttgtgagcctcggagccgagtgtgtagtgcttttttcctgttgtgagctgacggcttgttgggtgggcagctggtcccaccctggataggaaagaccactcatggctactgtcaggtcaggaacatgagggtcctaagcctgatagaagctctagaagctcatgtagcccagaacaccaggtcctccaaaggaggcacaggccgtggga

SEQ ID NO: 21482 - DNA, 1169 bp, Mus musculus
ctcatgctctagatgccaagttctagtttactttgggggaacggacacccctctttacagagctggcatgcatctctttggcttcaccttcttggggggggggctattcactcatgctctagatgccaagttccagtttactttgggggaacggacacccctctttacagagctggcatgcatctctttggcttcaccttcttgagggggggggctctgggagggccagtgttcagggtcttgatttccccaagtgcatcatgaaggaggggaatctttgcacttagggaaacacagggctgctggttttcagctatgtcatcagtaacagtggtcagggtgagtctcctcaggacactgtctcgctgagtgtctccacctctttgcagacagtcttttttttttttttttttttgctaggaggtgtgggtctggcccagagttgcagttgcagtagtgaataatgcagcagagaaggaactggccggactggaggttttccacccctattgggggtgggtaggggcagaagtgtcctgtttcctacagaccccaccccctccgagcgtccttgcaccaaaaactgctgcagattttgtagtagccaagctctgccttggcacagactgagaacccagcattggcactactacagacttcagccacacactggattgttctttttagttttgtctcttgaagtcagtgggtggcggcaaggtatcctcccttgatcgcgcacagaatatttccaggaaacaagggaaactgggcttccctatactgggatccaaagccttccttgcctttgaagagcagggggctgagctgagagagtctaggtggtgcccagagtggagtcggacactggacttgtgccttagcacctggcccgaatgcgccctttacatacatgcatggggaggcacagagaggaccccagccttgtctcgttggggtctccaccagggctattgggggtttctgccaaggatggcttgaggctctggcagttgccatttttgttttccggttggttcaggaaacgtggctgcctccctgttgttgattcctctcggatgggccttatcccctcccgctctggaagtgttccttccttatcggtgagcacagagtggctcattgataacccagttatccacagggtc

SEQ ID NO: 21483 - DNA, 1167 bp, Mus musculus
ttctcagcctcatgggctaagtagcccgtggggccaccaagactacccactagagctgtgtcaacaatttgactattcacaacccttccttcctttctcttatcacccccccccccacacacacacacctggaggctggggtgcaaggcgagtgggtggagtaaagagggtggggcctgcgacttctgtcctctatagtaagagagttccttgtatgtgaagggcctcactggtggctttgtgccttgtccctggagcgagctctggatagctgtactttacatcagatgggggtggggctagggaagcaaccgagtcaccaggcaggcaagacagggtatagcccatgtcaggcagtgtggccagggctctgggtgaggctcctggtccaagctttgcaggaaaaagtcattcctgcactgagttccaaactgaacaggcctgcatggtgttccaggcagggcgactggtaaggctcaggctcctggtcatcacagccgagaattgagcgctgttgcacaggctctccctggttgctctgcaactttggagccgattgttctctgggaaaaaaaaatttttttaaattacttgaactgttaagaaaatgacaaaaaagggaaaacatcattttcaaatttaaaaaaaattactgaactgttaagaaaatgacacaaaaaaaggggaaatatcattttctgcaaatctatgcagccccaaggtggagcagctggggagcctgtgctgtctgcatctctgcagtgcagttcctggaggggcacagcgtgtctacaccgtctatcctggctcttgataggagggggaggtttgggtgtggaggacggtgcactgggcaggtgcacttggtgtgccaggactggctgggaaactcctttcaatcttcagttcccaaggcgcctgtgcccacctcttatacacattaaactagacgggggtgggtcctagtcctcgctgtgtgaccggacaacagtcagtcacttaactcctctgagccttatgggtaaatggaggtaaccaacaggatttacatacacacaaagatcaaggtagcatcatagatgtgcattccatgaagtgagagattagtagtgacttggtgacatccaagttggcacctgtgttagacagggaggtgcgccatgtgga

SEQ ID NO: 21484 - DNA, 1149 bp, Mus musculus
tggttagactgtcctgtctgaggacacagccagtttcttcagcacctccacaaactgcaccccgtctctgtccatgcacctcgattcacggcgagacatttagccaccactctctgcgtattgatggcatgatacggtattgtcctcgtatagagttaacaacttacgataaattgcccaaagctgggccttgctgtgtgtgctctggacactgtacatttgtacccaaccaagtgggtcaagtcggagagggactcttcagtatggaggcagcctgtggagtgcagcgcctttgaggctctgggtgtaagacagtttccttccctgactctcgtgcacagacagcatgcagcatacagactgaaactgtgctctgccgagtagaaagtaggtagggtctgaaggtgtcgagaaggccttacctgtggtgtgacagattgaattgattgtttacactggggactgtatctcggatctttaaatagaggaatcacaaacagacttaaggacagatgctgagattgctttttgtaaactcgtttaagcgagtgagtgagttgagttacctgaactctgtagcactggttgttcatagtgatgaaggacagcactgcagacatctcccttgccatctctagcctgctgtggaaggaaacaacgtgactcaagatgaagctgtttgtatgtatccttatcaaatatattctataaggaaataaaatctgaaaagtgactttcttattgacctacgtttctgaaagtatgtgaattaaagaatttaaaattagatggggtccacactacatcctgttccccatcagagggctcactctcatggatcccttgcacacagagttctgttctgcatacagtgtggaagccttcatcagcccagacaactctaaaggaattggcttaatttcttgctttaacaacctaggcttagtaacccaatccaattgttagtttctttgtctgtgtaaatattggcaaaatggtcgcttttaattgacagttgaaggaatacttaggtatcaaggaaggggaagagacccatggcaacttgcatagtggctcatttggcgtcatcagaactgaataccacctcagggaggtaggacttgacttaggctatgatgtcagaggctt

SEQ ID NO: 21485 - DNA, 1177 bp, Mus musculus
cggccctacagaaacatgagtgcttcaagtcaagaggttattttttttaattgattgattgtttgattgattgattgattttggttttttcgagacagggtttctctgtgtagccctggctgtcctggaactcactttgtagaccaggctggcctcgaaatcagaaatctgcctgcctctgcctcccaagtgctgggattaaaggcgtgcgccatcactgcccagcccaagaggttatattaacacctatcaccaccattcatctaggagatgttagatacctgctgacagaatttgaaccaagccggactgtgaggcccactctttgatttcctagatccttttcaggtttgccaccatgtgggtttttacaggaaacagtaggagcacctggttggaggaaatcagcacagagtagggagttaaggtcaaatcccagcaaccacatggtggctcacaaccaccctaatcccgcaatgagatctgatgccctcttctggcacatctgaagacagctacagtgtacttaagtataatgataaataaatcttttttaaaaaaaagtaaggacgggggctgggaacagagtaatacaggtgatcttcactaataccatggttttggtagtaacttagaagccacaagcaaaacaaacaagttagttgccaaaatggcaaggcagaatgctccagtctgcctcaattaatggtgagcttactcaactagaggcagggccgtgggtctgcaacccagagactgacgtcagtgcttacaggagaaacagacactgtgactccaagaagtcatctcacctggctacctgtcttattaaagcagcctgggagtcatgtgtagaaggactcctgtgggtgatgaagcattgctttgcttgtattctgtgtttgggaagtagtgagggctgaatctgttagcgcttatctggctcggtgctaacaaccccagtactggcccattctagtattctcttacgttaaaaacaaataaatctgaggtgacagaacaaaactcattacctgaaggaatgaaatgatgtgatatgagtcccaacatattctagaataccacctcagagccatgtagcctttggcagtgacttagagtttagaagttgctcccattttgtaaactctaccaactccaggaggagcctttttgg

SEQ ID NO: 21486 - DNA, 1190 bp, Mus musculus
atgatgtcagtccagagcttgttcaaagtataaccaataagaaggagcaaagcacatccttgaatgcttcaggaagagcagaagtaagggagccacttcctgcccagggagtgctagctgaagtgctaccccagcatggagataactacagtttcatcaattctggttgatttcaccaaccagagttcagctaggaacacgagctcctggtggcagaagacatgattagtaccacccctcctcagtgaggcaggaggcacagacgcagtctggctcagttgcctactctgcataaggcctttcaagccagaagactgttcctgtatgaccccatgtcctgacttagacttggaaatgtggttaagggattgtggagagacctttcagaggcaggacttgcacagcctttcccagcagccctaggtaaaatacagcagaagggcaggggagcccaaaggagggaactctgacaccccagggctccccagcataggtgcctatagaccctggcaaccaccttcccattccagggtgaagcctgctgggagtgtgaatgacgtgggcctggatgccttagatttggaccggatgaaacaggtgagagccgggggactgggggtggggggggccagtcagcaggctgaggactagctctatccagtgggtctcatacttgactgccacaaaggcaggaacctagccagaagaggaaaaaggagagtctgagttccctgcagcctgcttctggaacccctccctgtgggcagccatcataaactgaggggtggtgagggcagggtttgcccagggccaggctgagggaaagagccctgcagcatacccctggagccagcgtctgtcccttcactgtgaggctctgcccagcaggagatcctggaggaggtggttcgggagctgcacaaggtgaaggaggagatcattgatggtgagtggacctcagccagggtgcgctcactgccctcccagcaccccactcgccccagtgagcagccctggaaacaggtgcagaaaaacaaagtgctttaccaagactgcatttctcgctgggtgtggcttctgtgtctgagacctccctctcctcagcatcctctcagatcacgtgtgcaggagagggtgggtgtggaaacaccccctagtttctgtcctttcctgttcacatctgttgcctg

SEQ ID NO: 21487 - DNA, 1142 bp, Mus musculus
gggaggataccagaggcctgtgaaagagggagggagagtgtggggagctaagcaatggggtgcagaatgagggggccggaagaagaaaggaggcatttgggaggacttaacagatgttcaggtgtccagaacagaacctgtcctagaggagaaaggccaggccatggtactagcatagtccataacagctctgcagccagagactcccgctctatcacatacacctctgagtggatgtcagaatcagggaaactctgggtccctcctacaagcagcccaacccagctctggggtgaggcatagtttttggctttttcacgttcctgtctttagtgggtagaagcccatgagggctaggtttcctccccaaaggtctgtatcagagctgccatgctgctgggcctctagcccatgtgtgcccatggcagcctgagcagggtccttccttctacactgagcccgctctcctgtcctgcccttagccatcaggcaggagctaagtgggatcagcaccacgtaagatggcaccagtcctggaggattgcgaggagccgtgctggccccagcgagcatcgagcctgcagaagctgggatgtacttaagtctcaacctgtgatacaatcttaaaatgaggaaacaaacttcaactcctggattttttagtgtatctgacacagaacaccgggtctattcttttttttgtattttatatttgcttatttaagtgtacgttcctttggtttatagagaacacccccaaatcacctgctttattagatggcttccaagttttctcctaggtgacactgttggtgcctcagctgacagggagcagctgggtgcagtgtggcctttccatgccacagagctgtcagaatgcagcacagctccagcagccacggtgttgcagtctgtctgtccacgcagtgcgcgttgtgtccacacaataataaactgttcactgtccaaactcaggctctggctcactctcacgcgccggctcttggctgccctggtggaaatgtgcaggccagagcatgcgaggataacaggagaaagagggggcctcagaaagcagctgggctccatcaaaacagccccaggagggtagacaggttaccaggcacctcctactggtagag

SEQ ID NO: 21488 - DNA, 1138 bp, Mus musculus
ggaggaagagttttgttagttggagaggattactttatagcagaatccaagatgggtcgatccctttgtgtacgggagaaagcttcaaatagaaggctcaagctagaagagtagggtagatagagtagacattagagatgacaagaggtaaagaatgttttttgtgtgtctggttaaggaagacaaaaggccaccaatatccacctgattacatcataaactcatatagacttgatgtttttaggaagaagttagaaggaagtcatgctaaaatcaagatcttatagaagttctaagatggggagttttggggaaacccttgtgtttggagagtaagaggaagcagagaaggcagaagagaattatttgaagtagagacttggggaggtgaggcagcctggctaccgatgaagaaccttctggaacaccaaccaggagagcgaaaaagagaatctctgttacacattgcagcactggtgcagtggcagatagaggactggaaaagactaaagagagagggaagctacaggttgtgagcaggacaactcagatgtgatggctcttggcattgttttgactctccctgccccgatgatatctcagagcaccaaggataaagaaaccagggagaaggccacttacagagaatgatgtcatgaatgccatggccacggcaagtgatgagaagacagtgcagcaatgtttgaagaggaacattcactgtgacaagtctttttggagcccagagccttgtgcatgtttggcagtgctgctgaactggagcccagcccacatggtctttccttttacaatcagctctgaggactctcattctatgttagaattgggtgttatcttgctcagtttgttagaatgtaaaaatagggaagtgtggcaccaaggtgttgaggattggactccagtcccatgtagaattagatcccttaaagatcatgttgacctacatggactttattggtggtagagaaatgccagaacctgtatgccttgctgttttcaaatctccatattgtgagactgtattgtcttggagtggggtcttcaggggcctttgactgggattcccacaataaaatatcaagtagaggcaccatgtttcactgttgtggatcagacc

SEQ ID NO: 21489 - DNA, 1647 bp, Mus musculus
gcacacatgtgcgaatccataccggagacaggccctatgtgtgccccttcgacggttgtaataagaagtttgctcagtcaactaacctgaaatctcacatcttaacacacgctaaagccaaaaacaaccagtgaaaagaagagagaagaccttctcgacccgggaagcctcttcaggagtgtgattgggaataaatatgcctctcctttgtatattatttctaggaagaattttaaaaatgaatcctacacacttaagggacatgttttgataaagtagtaaaaatttaaaaaatactttaataagatgacattgctaagatgctatatcttgctctgtaatctcgtttcaaaaacaaggtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacactttttggggatatgcttagtaatgctgtgtgattttctggaggttgataactttgcttgcggtagattttctttaaaagaatgggcagttacatgcatacttcaaaagtatttttcctgtacaaaaaaaaagttatataggttttgtttgctatcttaattttggttgtattctttgatgttaacacattttgtataattgtatcgtatagctgtattgaatcatgtagaatcaaatattagatgtgatttaatagtgttaatcaatttaaacccattttagtcacttttttttccccaaaaaatactgccagatgctgatgttcagtgtaatttctttgcctgttcagttacagaaagtggtgctcagttgtagaatgtattgtaccttttaacatctgatgtgtacatccgtgtaacagaaagggcaacaataaaatagcgatcctaaagaaagattacggcagaaagagctctgtaagcacagccttattttcttctgttgtccagaatacttagaattcttgagcctcccagaaattggaagcaaataaagcaacttgagtttcctttattttgcactcagtgacagtgactgtgatgaggtccgtgcatggacactagcatttcctacgtgccctgaatcccgagagcaggcaggaggcaccccgagctagggaactacctcagagtacacagacgacccatggctggcaggattgcccttgatatcccggtgcgtgtgggagtgagacgtttgcatgggcctgatgctttctgaagggaaggcactgactggcagtgggtgcgccaagggaggatgggcctgccttctttctcatcatcactcaggctgccttcaacggcggtggctccatgggttgtccaacaggaaatctcagtgcagtccttattagatgctgtcagatgtagcaattgagtgccagtagctgtttgcttgtagacacacttaagtgcagagcggcaaggcgatgagattattagaaagttgtactcagtgagtacttgacttgtcatgtgtgacctcttcaatgtataatttttgaacttttacttacctagggtcaaataccagacttgttaactatt

SEQ ID NO: 21490 - DNA, 1139 bp, Mus musculus
tggtgggcatgtaagacctcttgaagagatggtgtgtgcaaagacggcccatgtttctaggcagttttagcttgtgtcttcacatagatgagagccaactgtcggtgaagtgtgtggtgctccagggatatggtgctggcatggcttggcacccaccccacctttccactcggcaggactcacctgtggtacagccctcaaatcactgactagagtgtatgtctatggcccaggaagtcttgccccctaagtttacccactccccacaatagacagggatttgactactacttcctttcctctgtgctccgaattgacatgatttagccagtctgcggtgcggtgggtttttattctcttgacttctagcctacaggaagaacagggacttcaggatcagaacagagatgagcagagttgccagtagatagatgccatccgtgactaactactcagaggcattgccctagcagccctactggctgcagaagctagctccttttctagcacagactgtttgaatctctggccataagaggccgcatctgactttgcagccctttgttgttaatgtgacctcttctagagcccaggcccaggacctggcagatacactctagctgaggacagggaagggactcagaactccaaagcagatgtgcttgcttgcaacatttaactctgatcagaacaaaagctactccatgcttcaaatcacgtgccagcagcattgaccaggtaggttaggtctccaaaacagcgagctttccccacagcttgttaactcctctcagggtaagctcaggtgcctcagatggcttaatacaggcccttcaggtgagtaagttgcactgagcaggagagggtagctgtgtggctaacaggctacccggcatctttgggcatagttggtcagtaccgtgccaggaaggtcattccccagctgggacagcatgtagacttcataggaaagggtgggtggcagatgtgagcagcttaaggcattggtcattgagtgtcggcagtaggtcacaggcggggtgcaccttccaaggtgtgcctagccagcactctggagaccatcaagggggggctagtgagcagcactgtgctccgcatttcagagtggcagatttgat

SEQ ID NO: 21491 - DNA, 2080 bp, Mus musculus
ctccctgtgtctttggcgacagtgtattctgatgatggcctccgctccgcccagctctggctcactttcctctctccacgtgcactccctttatggctcccattagcaaacaggtttctagggcttctaggttatttaataataaacgaagataaaacagacatgaagaaaaggatcccaaggtgcaggacacaagacatttaatgtcctataagacccaggctaccacgaccctgtcaacctaactcataaagggacataggctgacccagagctcagggagggagagcatggacacacgcacgcacgcacactgctcacagtatcagccttctacaggattacaccagcggagccatgctcaccggggagctcaagaagacgctcatagacgtccttcagcccctgatcgcagagcaccaggcccgacgcaaggcggtcactgaggagaccgtgaaggagttcatgacgccccggcagctgtccttccacttccagtaatgtctcttttctgtggcaagcctgtctgtaacccaccctgtcaaatcaagtcacactcccaataggcttctcacgtggtaattcctggacctgggtctctgtgcacgtgtgcatcctggatgctgtttcttctctgatgtctccccgtctgttgtctgctacgggtgatcaagcgatgctaatgttgtgtggtcagatagaaccccagcccgcagtctctcccacaaagagcccagaggtagtgcttccctggcccacagaagactgtccagctagcagcctggggttccagaacaaattctgaaatgtattccagtttttctttaaagtgcgtgtgcccggttggccacggtggggtgcactgtatcatctctgttctcaggaggctgagacacgaggtctgagccagcctggtagtaatctgcctttgattctgctgctgtggagtcacaatgtcattactgtaaaactgaacactgctgtgaggaactgacaaggagacatgtagtgggacatgccgctgctccagcccacgcccccccccacacacgcacacacacttacatgtaatgtgtgcaaactttgctttatacttggctaagaagccatcagctttgttctgaaggtgtagctcagtagtagagcactcgcctagcacgcctgctggcccgggttcagtctcctgccccacgaagccgggcggataactgagctctctgcttttaaccctgattatggaccaggctgggtctttccactaacctgaggctgaggtagctaacctccagctcccgtgtgccgtccactccaaaatcatgcttgcgcccttggtgtactaacttccccacagatggcccagactccaccctgtgacgtgcagggctgcagctcctgacccccgggtcctgaggacggcttgttccctttgcaggtgcttctgctttgacacttgactgacggggagggcaggccagagcagtgtgctggccatgcctcaggccgttgaccatagctagacagaaaagaacagcagccgtccaggccgcagcgttctccctctgggcgggctgcatggaatgagcctccactcagagtcttggaaaagcagaagccgtacctcagggaaagcccctggttgaagtgtctgtcctctctgaaggcacaagggccactctgagtgttctgtccttgcatcatttttaggaaaaaacaataaactttgttgagctcctgtctgtcactgtctgaccaagcaggccacagaggaacgtggacttgctaaaggcctacgcactacacctactgctaaggctgtagctgttcccattggcggggggtggggggcagcacttaggaaaattgggagctgtgaaatcccatggtgcttagaggcaggctcctagggatcattgtgtggggccacttgtcctaagaagcccccctgctccctgagatggctgttccaccttgtttgacagtctcacagcctgaggagagtgtgtgcgtgtgacgtaccatttgcagccagctgggtactcagattctgtagtgggcagcgcaggcctgagccagcggtgcg

SEQ ID NO: 21492 - DNA, 1195 bp, Mus musculus
agtgtggggttgctcaggtccctgtttctgccctgctccttctgcctttggtccacagcagtcccctgtgcactgtctaattaagcacttccttattaatcacctctggttggctcagggactcagagcagcctgtacattgatttccaagtgggggctggcatctcccctcagcccctcagggtcgtaggcttccgtggcatgcatgaccccttctgcctatccccccccaccccaaccccatacacactgggtagtttcctgctctttatggctgcctcaacttgcctctcttcttggaagcatctgctaatcctccatgggagtccatcccctccgatagctttatgctatcagattgtggtcttttgtttgtttacatttttcatattgggcttttttttttccctttcttactttgcttctgttactgggggaaacatgatcacctagaggaatggaaaagtactggaggaaacaggaagcaggctgctccatcattacctgcagcttgcagtcatgggctgctctagcagccttgggggtgctctctctagttcagcttttcttgcctccccaggctctggggcttgcgtgtctgttaggagggcctgggtctctctcctctgcacacttctgaggtgcccctgggattagttggtgctgatgacagaggagtaagtgctgaaaggactcttgctcaatcgcgagaggcttttaaaacccagttattactgctgctcctatgaatgcccataatggcacgggagtttttctgaacctctctttattgcgcaaatgctgcctggatcagatcctgacaattcaggtgaattattattctgcccctcagaaggtgaagggaaagctttcagtttgtaacgtcttcttcccaagtgccctctgtcaaaaggtagtgacatgtgacagccattagtactttgctataatcacatgccattccatctcatgcccaaaagctttccatctgccgggtaggaaggactacctttatttcagacaccttccccctttcttttgttgttaccttctcttaaaaacaacaacaacaacaacaaaacagcctcctgactttacaggcatgatctgtgggaggagtgactcctttctctatgaggttattgccacggacaggggacacaggtgggacacaggggacagatggagtgatgac

SEQ ID NO: 21493 - DNA, 1171 bp, Mus musculus
ggagccttcaaatggagcttttagaattgttgagggctctgttggaaaacaaaaaggccatttcattggaaagatgatgaccttattaactataattaggcaattcacagaggtttccaatatagttcagcatctctccttgctgaaagggtgggggctatggtaatgtctttagaaacataatagtctttaccacattaacagtcttgtatctgctggaaggtttgtcagcctggtgttttcatttagaagtgaggtatagttttgtagctgttcgcattaatgtagtaattttgacatgtaatttcagacaacaatgtcaagagctgtctccatagctggaagaggatcgtggatagggctgtggacatgtccacatctctcaaatgagccttgtgctgtgccccaaggcagtccgtggccctggcctagcctcagtgctaaaggccacagcatatgcttagattctcttcttgagctaattgttcaaggatgtgcatatttgaaataatgggaagctaaaggattttgcatataccagcttatgctctgaagtctctctaggatcatttaaaaaaaaatactgtattcccctggattgtgggtctgaacctgggaataaactgtgctgcagtgcttgcctggtgtcagtctatagctgtacctgcagtgcttgcctggtgtcagtctatagctgtacctgtagtgcttgcctggtgtcagtctatagctgtacctgtagtgcttgcctggtgtcagtctatagttgtacctgcagtgcttgcctggtgtcagtctatagttgtacctgcagtgcttgcctggtgtcagtctatagctgtacctgtagtgcttgcctggtgtcagtctatagttgtacctgcagtgcttgcctggtgtcagtctatagctgtacctgcagtgcttgcctggtgtcagtctatagttgtacctgcagtgcttgcctggtgtcagtctatagctgtgcctgcagtgtcgtcacagggagcagcttcccaaccctagccctgccaggaggcatcccagggcctggagctgcagcctccacagcatgcttgtatatggcaccacaccccaactgcctacctcctcgcctccctctgctggctagggcattgaagcccacagcaaataacttctattttgtatc

SEQ ID NO: 21494 - DNA, 1195 bp, Mus musculus
aggtgaggaaggatcgatttcataactccgctcatacgatgagcatggggaaggaaacactcaaatgtgtgtgtgtgtgtgtgtgtgtgtgtgtgtgtgtggagagcattgcatcatgggagtggagttctgactggcgtgaagggcgatggcggaagcacaaagtgtgccttgtgccttgaccgtaagtgcaaggtcagaaaggctggacttggtgatgtctacagatatgtagtggtatgacagcagttctgtctacaacagaccaaatgtgtggcagttcctacaagagtgtaagagctgacaaatccccacacttggggtgtttctccccaccccctgccctgtctctcttttcttctttttctttatttcctggcagtgagactagaaccaggagcggatccacaccaggcaagttccctatcaccaagcccctctcagccgctctctgcatatttcttctggtcttagatgtgttcttaccatgtgcttgccaccggctgtgttcataaaggtctatgctacatgcatctgcaatctggatgtcctgtgccagacatacaagtcaaatgtaccacagactctgctgtgcagcttggtgcagggacactgtgacctgctcacagtgatcaaaggacctaattcacaatgcacttcctagaatgtgtttttgtcgtttgtgcctcgtcttagcacaacttttaagtgccctcaaatttaaaaaaaattatcaaaaaatttttaaaaaattaaaaaataaattgcaaaatgttcaaatgtctgggagatcttcgctcctaacttcccagcgtctgcccttgcacctcttctggctggggcgcctcatacagccctgtattctccctctgctttgcctttactcaggtaaccttgttatctcagtccaagtctctgaccacactgctctggtgatacctggcaacgagaaaccatggataaacacttggtgaattaatgaagtaggaatgaatgtgtggcttgcttacatccagactctccatgaagtcttccttgtttccagccccgacaaccccagtgcaccgaatctctaggaggaaggaggctgagcacagcagagaagaaaggtgtggaccaggtccttcagcagccctgagaactgaaaaggtacgctcattgggtgacagcccatccatcagctggtgtgtttatg

SEQ ID NO: 21495 - DNA, 1127 bp, Mus musculus
ttggaggctaattagtactctcatttctaccagcactttctttggccttttaaaccaaccatttttgtccagacaagaccaaaaaaaaaaaaaaaacaaaaacaaaaaacaaaacaaaacaaaaaacccaaaaaaacaaaaaacaaaacaactgggttgctttagggaagcccggcttggagtggacaatggtgtccaggcccctgaaaggggctgattggattatgaggcaaatggaggcagaaggagcacgcaggagacaaatgcagtgggcggagacccgctctgagttaatcaggctgattgaagggaccttttctgtcttgccgagtggcccgggggggctctcactagtgcactgctgtgtgcacatggagactggagctaccctggtccctctctggcaactgttcattcatttgatgctcacaactccctgtcctgacccagggccggcctgccatcacgcagggaagcagaggtcgccaagcggtttccgacggggcccccccacataacgttagcctcgcggtctcttcggttttagcagcagtggacatgaacctgtttccagcctgcatcctccagttcctctcgggactcctggctccactgtgctcacctggagccccgccagcccgcctccccctgtcctccttcctcgccactccagtgtctgtctttccttcacagccccggcttctcgaggcctgtctacactcgctgctttccttcctcacctccaatttcccctccaacccactgcttcctgactcgctcttctccatcgaacggctctcgctcaggtaaagacttttctgtagcttgacccttggcacaatgccagctctggctggacacaaggacacacgcatctcctccattcctgctgctccattggtttcacggctctggttcccttctatttccaacattactggcttcacggacacagctcttcttactttccctgggagcttacattcctagcccctctcagtttcccaaacctgccttgtgccacccagctgccaaggccacctagagcactctgggccgggtggtctgggttcaggtcttagggaaagctcttaaagctgggaccacggtgtaggtcagctcttcca

SEQ ID NO: 21496 - DNA, 3177 bp, Mus musculus
aaagagcaggggcagggggtgggggtggggctgaaggggtgtacaagcatgacagacagtaaaggcaaagaaaggggattaggaaccactaagacctccccagacctcacctagcaaaagctttccttctaggctagcctgtgagaagaaccagaaggaagcttttaagttgattacccagtgacacatcccaggaagtctccgtatcacatagccccattgaagggttttgagttcctctcctgaggtttaacctctgcaccccttgccccttccctaatgcctccccagactggtgattaagtcccgatggtacaggaggggtcagaagggtcttaaggaatgattggctcactggacagagccacccctaccccccccccagctatgtttttttttttcttttttccaattctattctactttttgccctttctccttaatgaacacagggctaatcttgggccttgtggaaggaggaggctgcagcactagttaatgaggaagctgctgagctccaatcgtcatctcataaggagccctctttgtctgcgaaggaaaaacactgattatcataatgagctgagctggtggctgaggggtagggggccttgggttcttaaggcacactttaatgtcagtgttgtagatttccctccccccattgaatggggttgcatgttgaaggtagctttgcttcaaggaactttaagagctccacactgcccagccattccttgtcacctagactcctgccaagttccccagtctcaccccagcaatcaacaagcccggtgaaggggactccctcctcccaccccctttcctcagtgggtccactacagcaccacccctgtgctggacttgaaggtagggtactaggatagagcgaaggtctaggagagtagaagccacacacaaggctccctgcccacagtgcagtcagttatagagacttcactgtctgcagggtcccttgtctcaagtatctatcaataatatttatattgagataataggtccctgaagccacttctgatattcacaagtcctaggtcaccggttctccaaacttagcagcagccttgagcaattcaaacaagatccccccccagccccccaccccttctgccaccagctcagctgcccttgatggcaggaagcttctaagtaggattccaggtaactacttcctgaagcacagtttgctctccccccccccaccccaccccccagtccacttcccgggactctcaagggtgcttgtgtgcatccgagggtataaaagtccccttcccctttccgtccaggcatccagggtggcttcagagtagttggcccacaggcccagagcattctgggtactcaacatctatgggatcaatcaggacatattggggagttacagagatgaagccaaggagggggagggaggaggcaggaaaagcactgcccccccccaactcttctgagaacaaccttttctgcctttactgcccattcccctccattctctgtctcagcctccctctgtttgtctccctccctctcccaattggatctggcccctgttggggtgcccctaggccaccccttcctcttctgggtgtcccagcaccaacccggtaaatagtggggctcagtaagagtatgtgggatgatgtacggtgggacaggcggacgaatggacgggctcaactgccacatctgggcagctaagggtcagggggtgtggggggctcaagggatgtgggatcagtagcaacctgccctaggctcagccccctttgaggggtcctatggttgcgccctgcattcgtccgcgcgtttactctgtcatccacagttgatcctaactgagcgtgcccatggtcctggccctgggcttggcacctgccacctagcttgtcccttgatggcctctgcttcccagggagggcaagctggggggttgtctgggagccagagcactggtctctggctccatagagggcattcagagggcatggggtgggcctggtttgcctgccctgccttcacgcagacctgcccacccccagggccttgcccccctctctgcctccctccccattcatggctgagtacgggctacttgccccccccccccgcctccccaaactcacctcagttgccaacagcctcctggtgcctgttggaccatcccttgctggttcttcatttcctgtgggcctagtttccaggggctgagtgaccagggtcttaaaacaggtttaaggcttggcttgctggccctggagatcccgtcgccgtcttcgtcgaactcgaaatcctagccatcgtccttccctggtgggtgtttaccacacttcccaccaccttgtccttgagagtccatggccccgccctcctaggccccttgctgaccatttggtgttgttttgggggctactatccaggcctgtcgcgtcttcctgtgccatttgctgttgtgctcaggttccacgagctgcccatctccacagaagagcaggtgaggccgctgcctgtcttcatgcgtgtgagtacaggtggcttttctttttagggtgttctgctttgtaggaattctaattttttgcctttcctcaaagctggcattgcccaccggccatgccggctgaagaaaagaagactgaggaccccaggatgcccagcgcgaggaccccaggaagcccagcgcgaggactccacccacgacgcccagcgcgaggacttcacgcacaacacgttgcaaccctcctggattagggtgagtcacttgcgccggtaaacacaactttgttagaatccactaacattacatcttcactttagaagttgtacagggggagggtgcaccttaccaagcgccgcacactcgcctggacgctgcctggagctgagagaaagactgttgccacgagacagcacgcgtgggagtccctcctggaccctgtctagcagggaccagagacggtaggtgggggtagggcacatgtacactcccagaaatagccagggcaagaaacacagtaggcacacaacatagtcaacccgactgactatgttcgtgatatgaagaatccacaggcccttggctttgtcccatgcagagatgtggacatgggtggttatccatccacccttggtggggagacatttctccccaccagccat

SEQ ID NO: 21497 - DNA, 1160 bp, Mus musculus
tgaagggcaataaagaagccatgctggaggaactgggtgggggcagctgtctggggagccctttcttctctagggactggaatttaacaggctggaaacgagtcccaagagctaccccctcttctgcagccttgagcccccatccctctcagagaaaaggaggaaaggaagattcaggccgccattcctagttagagaagatggaaatttctatgagagctgggtctttctgagtgagactccataaggcacaggggtctctgaaagagagaggcactgggtgggtggtggggacccctgaataaagcctagctgctcgtggacaccttggtctctagaaggtttctgaggaaaggggtatttcagggtgaagttgcctttgtggcatagaaaaattagtccagtaggagttagggacactttaggaaggagtctctgatggtgtttccttctgggtacctagaaacacagcaacagggctacagagcagagcagcattaggagaggggacctgggtctccatctctgatgcaagtatctggtgtgtcctggttttgtctggccctggggccagtgtctggggccccgcctcttcctttgggacctggtggctttagccaggcttctcaggcattgtccatgtttgttttctcatcttccttcatccccaagtccagggtgtgtgtgtgcgtgcgtgcgtgcgtctgtgcgtgcatgcatgtgtgtgtgtggtgtgtgggtgtgtgcgtgtgtgtgcgcgagcatgtgtgtgaagggcaggtgtcaagtgacggaggccagtagtccccatccctccagctcaagcaggatgtgtgtgggagaggaattaattaaggtgagagcaggggtggagggtacggtacaatcttgactttcttaattgctctctagtttctttgggcttaagagaaaattgcagatggtgaggtcttccctccccgagcctgggagtggggccccagagcctggctccccaccaccttgacttggccttctcttctctcagtgaatagggtctttggctagggcttaaggaggagactcttagcctgggagctccgaggcccgctgcagctggaaacaaaggctcaagcagaaaggaatgtgggggagccccgcggagcacagccacctgggga

SEQ ID NO: 21498 - DNA, 1099 bp, Mus musculus
ggaatcaaatcttactgcttttgtgaaggaagagaggatggcaacgatattgcaggaaaagagggaagggggtaggcaaggaggcagggaggaactttcatgtgctattcgctgactgggattggtaatagatagctcttggcccaccacaagctgcttccacacagcctaactgactgggagcagctatggatcaccatggccatgttttgcttgcagggggccatttcactgtctgtcacatcttcagtccatagacacatccctgcacagtgccctttccatagacgtggataggagggaagggctcaggcctggggctgtggagatgattgcatgaatagggggcgctatgcccagtgggtaccttgtctcctctctgggaaaggatctcttctgatcctgatgggaaggggcttagccagccaaagggcagggataggaggctttgtctgctgcctgctggctaccatcttgagtgtgacttacaccagggtgcagacaaagtgagcttgacctggaagcctagaggcccaagaggcccgggtgaagcaagtatctctgagatcaagcctacccttcagctcagagagtggacccctgcctaggctcccacacatgatcctaggtcccagatatgccacccctggagcccgtttcaaggcccatcttccagaatgtttaaacctgtgtatgtaaccagtaaaatgggagtttgtactgtgtattgaatctgtcttcttattggcctctgtgggctgctgggggagacctggagagttgtttattctagtgtcccccaccccctgggactctttgcttttgcccagttttctttctctgttgtggataagattttgtagagttgtgtgttgtatgcttgtgtttgaccattaaaaaaaaaaaaaaagtcacagccctccttgatttctcaattcctattgggggtgctaaattccaaaccaaaccaatccaaaccagattcatgtcaagtgcccaacaggaggataatagcttggctggatcaagggagcatgtgcagacccaagaacagagtggacagatgggctataccgcaagggggctttgagagctgagt

SEQ ID NO: 21499 - DNA, 1232 bp, Mus musculus
tgagactcggacagagtggagggcaggagggtagcacctacccagctctggagcgacatagaaagccttgctttcaaatgttaggattcagcagttttgatgggaggctctgagatacaagaccaggaagactattaagaacacccctctaggagggcaaggccaaagtctttggaaaaccaccaaggtttaatagactgtgaattggctagaagtcttgggggtggtatgagaaagatggaaaatcctagaataggtttttatttattggaaaagtcaggagctggtgtgtaggtgttgccccacccccatggctgtccagaagttgggccttctacatagctcaggctttctgagcacagggctgggttgccccctccagttcctaccctgcctagtgcatgaaaactctttatctgccatggggatggggagcagatggcttcatctgcagctgtgtctctctcagcctctacagccacggggacgccttgcacatttcctgtgggacatgctggacccaagactctggaccctggcctccccttgagtagagagacccacctactgactgatgaactgcgctgaccctggggtcaggcatgtggccttgatccctacccatggaccctgagacttgggggggtgggagaaaggctgttgtgtcttcactgttgagtctacatctgtgaaatgggctcaggttcctacctcacagggctgttgtgaggcagccgcaatgtgcttagaagcatggggcctagtggctcatggtgctttcaataaatttcttgttttaactaaagcagtgatgggtgtgctactaatacgagggagggtgggtgtcttgctggggcttccttttgtagtgtagtggggtagaggagttgcctcaaaccccagaaagtcacctttgtgctgccctgtgtgtgcttaagagatggatacactggggcccgatgaagggcctgtgctcggtgggtttaggagaaccctttcctcgtgtgctcgggatgccagtttccttctggaaatgaagccatgcaagagctgtgggaggtctggctttggagcctgaggggctcacagctctggtccttggagctccagagaaaatgttgctccggggctgagttctgtgcaccccccttgccctccacactccccggggctatgccagggccctagctgaggcgtcatcttgacccagatgggtggtcccattgggactt

SEQ ID NO: 21500 - DNA, 1232 bp, Mus musculus; identical to SEQ ID NO: 21499

SEQ ID NO: 21501 - DNA, 2944 bp, Mus musculus
tgccccaagccctctccattggggtttctctcccctaagtggagtggggcaacctgtccactctccagctcctgcccccttgcttggggttctaatcagctccccagaccccacctcaccaccccaccccactctccagtttctgggttagctggctgggcaagaattggtctatgtccttcgaccaacctccctagccactccctggggtacctgccgccctctggtgctggcctgggtacgcccagactggatgagcttcccagattgtaacgctgcatgacagcttcaacagagacacctgcacccctaccagcaagagatgacatcatcccatcccctgggctccaggtaagttccctgcacgtttccctgagatacccatgggcaatggttttgttttcctgatgacaatgagcaccatgatttgaactgaaggtcactgatggcatcggagtttttctgagaaaactcattgctgggtgataaaccagcgaggattggcataggcaaactcgggtgttgatggaaaagttctgacaaaccagtcacaaatctactcggacaatatgctgaaggccactttattgcttgccaactttccaacttgccctggaagtttggtggcccatttaaaattggaaacagttaaagaaaagcaaataagatgcgtgatatcagagagaagggtcagcaggtagcggtgttatctgtgcaagcctgagggacccgagttcaatccccagaacctatcctctgaccgctccattgtgtaccaacgctctcgcatacacaatgataagtgtaatttttaagatggatttagggaggagagatggctctctagaattgtctgtaaacagaatctgtttaaggggccctgttcagggcatctgcttttcctacctggtaggatgaccaggctcagaaattctccgaacaccatgctgggataatgatctgccatgttggatgttcagggtgggggatcaagctagacatgtaatccatagtgatcttcagagagagaggtttctaggctcagccttagggtcctggctttttcctcctgttctgttctgagaggggcggggggtctatctcatgcatgtctgtcaccatggacttcatcatcatgactttcatcacctctacctggcctctgtcatctccctgggctcagcatctcacctctggccagtccatcaccttcctcacctccatcatcctcgcttctgggctcactctggccgccagggccttgtacatggtaggctttcattcattttttgcacattcggtgaaggtcctactgtgtgccaggccctgtgccaggcatcgtgtagatggacgttgcccttgagagcccacacctcggggagatgcttacaaactgctggatgggaagggagcctgtgtcaaggctgcttgggtgtggatgcagggaggaggtgtaggtgcagcccctgccctacgatttccaaaataatctgtaaggagaggccttaggtgacctctttgttccaagtgggtggcttgtcccagaagtggtactaggtactcagtccactagcactaataccctcccagaatggctcactcccagattcctgcccccagcagccttgtttccctatcatctacacccaggtctctgggtcagcaaacccaggagtctgctttgttggagattgatccctggcctattttctgtgcactttggggctctgggtggggggagggtgtgggatctctctgtctgctgttattaatcattttttcttgatcatatgctgttaaactactatgttgggagttcctggttctgagaaacctgtcagttttctttgagggtgggtaatgggacttaaaggttcccttaaggtttgacacgtacttgacatttgggtactgtggtggccctcaggcctataccagggctctcaggaatgtattgttgcaatgaatctatttatacatttcaggatgttcaattaaatgtgtggttttttttttttttttttttttttttagatttggaactggaatggggttggctatgttaatgccttggtgcctacagggctgaggtagagggacatcaatctctagatgcttaaggaggagagcccaaaccccaccagtgatgtgaccctaccgccccctccccatgtcacaaccatgtgtctcacctccttacctgagtcacctgaagtttctgtctacctgagatgcttccccgctcacagatccccttcagtccctccttctacccatgtgtgatgttcaggctctcattgtcacacttaacctctgtcacctctgtgttacactaggtccgatatctggtcacagatcacaggcttcctcctaccacaatgaatccctctctatctaccctttcatcacaccgaatccctctgtgactcatgccaagctgcctccacgtgtgaactgagcctcctgaggttctctcactcttgtcagaccgccctcctggctactgtgtcttcttcctttacctgagacacagtacggggtacttgaccaaacccctctttcaggtgtgtcctatcctgaccccttttccactctgtgtctcatgaactcccctccagttatcatatgaacccccaacctaaattgagtctaatgtgtcctgactatctcgtcttccaatgccataacaaagtcccccttttatgtcctactaagtacccctccaccgaattattacttgggtcctctgccctcattcctgggtcacattgaactatgcttctattctagtatcacacagagccatttactaacctataaatctctatctagtcatgtgtcacaatctgtgaccctactgtatgtgacatggacccacctcctcttttgatatcacctcgaactcctcccctacccctttagtccctgccccacctccatgtca

SEQ ID NO: 21502 - DNA, 2176 bp, Mus musculus
atgttgaagcccaagatttcagcggtctggcgatggaactgagttttgtccagtgaacagtagatgttgtgataccgaaagcggaccaggacttggcggacatgctgggagtgttcctcctggctcattgagtagaccaggacctctctgccatggcaaatcacaaacaaccctaggatgtcttttaggatgaagtgaacaatgttgttcccttcgtcagagtatgagttcattgtgaagggccggtagcatctcatctggtgaaggccgaaaccgaacgatgctctccaagtgtcttccgtgtgtgtgaccgtgtgcctcatctcactttccttaatcccaagcagctccagttttgtgaaccatgccgctccatgtagctggtcgaatagctctggtaccatctgcgtgtagtcttgtctgtcagtcagcatgtcatacagtatccagtattcctcttgctccctggctttctcttgctgcctggctttctcttgcatcctggcgctcacaggttccaaagtctctcgggccccagactcgtaaaagacgccgctttgatcactgtctccagcctgctgaagctcagagggctctgattcagaaagatcatcggatccgtctgagcttggctggtcggaagtctcatcatctgcctccctcgggttaaacacgtcggccaggtctgagtatgtgtgtggcaatccgggcagtaggcttatgctgtatgtctctagtgcgatgcatggtggaggtggggtgaagcaattccgcagacagtagggagagtggaaggtacaccggcctctcatccagtcgacttcaggggcatgggttcggagccacttcatgcctaagacgatggagaagttgggcgaaggtaagatgtcaaattcgatgtactcataatgcttctggtggacacataccaggggctcggtgcacagccagacgggttcattgccaattgggatgccatccacaccttggattatctgtggataaggcttctcatagagttccacatagtgttcctgggcaaacctctcatccatgtagttcccttctgctcctgagtccaccagggcccgcactgcgacactgtggtaggggtccactctcaccaagagcagtaagaagaggtgatcgcgatcaatgtctgggtggaactcattgggcagccagctgcttaccctccacttctctggggcgggagcatccatccaggctacgcttcttgggcgcgactcaggtggcagcctgagtaatgctcttctctctgccagcttttcttcaagttgcaggacaagtacaatcaggttgtctagggaattcggctgagggatccggaacagatagtgcctgatctcttcgttgagcccctggcacaggtgggcctgcaggacttcatctggccagcctaaggtgggtatcagaccccggaactcattgatgtaatcggccgcacagcggttcccctgcctgatgttgaacatggcgtcttccgccacacgcagggtctgccgatactcaaacttttctgacatggcctccaggaaggctgagaagttgtttatcactgggctgttctgctctacgaggtcgttggcccattccaaggctaggtcagtcaggtggcggatgacgaatttcacccgcagctcatcattgtatagcatacttgggtagttctgcattgtcatctggcagagcacgacaaactcatggtagtctctgcgatctccagagaagggcctgagggagggcaggcgaccttcgttgatagcctgcatcatgagcctttctgccactctctgttgttcttttaggtcttgcatccggaggaacagcgagatgacgttccccatggtggccacgacttcttctggagagttcttgggctgaccttcctcttcaccaccttcctcttcctcctcttcctcgtcatctcccaggtcagtatcatcttggtctgactgggtctcggatgagttgattgtttcatccatgctataatcggatgcctcactgagtggttccgacccttcctggtttgaaatatcacttgactggtttgaactgtcgcttgactcctggttcgaattatcgcttaactcctggtttgaattatcacttaactccgggtttgaatcatagcttgactccttttgtgaac

SEQ ID NO: 21503 - DNA, 2176 bp, Mus musculus; identical to SEQ ID NO: 21502

SEQ ID NO: 21504 - DNA, 1128 bp, Mus musculus
ctggtaggggccactggatggctcctccacttcccggagtagatcagtgggtagctcttgcatttcctggtaggggccactggatggctcctccacttcccggagtagatcagtgggtagctcttgcatttcctggtaggggccactggatggctcctccacttcccggagtagatcagtgggtagctcttgcatttcctggtgggggccactggatggctcctccacttcttggagtagatcagtgggcagctcttgcatttcctggtgggggccactggatggctcctccacttcttggagtagattagtgggcagctcttgcatttccttgagggggccactgggtggctccttttcttcctgggctgggccactatctgagcccgcctgggcctcaacctgggcctcaacctgggcttcagcctgagcctccgcctgggcctccacctgggtctccgcctgggcctccgcctgggcccctgcctgggcccccgcctgggctccactgctgcctggtgtctcttcaacggtgttggatgagccctcggaggactccatttgttttgatgatggattcttaagctccatcatcgtctcaaatgagtcttcagagggttctatcatgtcgtcggttggaaaggagtgtgctctgaagactggtaagattgtgatgtgtgtggtcagagaccgcaactgtggagaccaaaacctagggacagagggataaaagacaggagaaaatgtagcaatttaggttctcaagatggcagggtcagattctatctcaaggacaaagcagatgccaagttactagaatcagagagaaaatggagaaattcctcctgcattcagttcagcctccttttctggttacttggggcacctccaggggaaagaccgtcaccccctgacctgccttccaggcggagtctgactaccccacctgcctacttcctctagtggaatgagaaattcacagcccataaattttgtggagcaactggcctggagcgtcctctgtggcgagctagcacctggcagggcacacttctggcccgctttgccctggccaggttcccttcccatttgtagtcacccaaaagtcataaaggtcacatctcaatg

SEQ ID NO: 21505 - DNA, 1128 bp, Mus musculus; identical to SEQ ID NO: 21504

SEQ ID NO: 21506 - DNA, 1281 bp, Mus musculus
ttttgctccccataaatgtttataaaatgcctactatgtgctgaaaacatgcactttcatggcttcatcctaggtcacactttgtgcatatgcaggataagaggggggtgggggagggatagtatcatttctcttgttcggtttgatctctgtccaaagccacgttttctccagctctgagctgagtcggagctttctaaacaccctttcccgggctttcaaaaaaactgttctcccaggattgcctggtctgcagggctcctgcagctttaaacatctggcctcaattctgctcatgcaaacatttctgcacgtctcacaaatgctatctttccaagtttctcctctgcttcggcaggagcagggttttcgttctcaaaagtgcccccccccccttttctgtcactgttgatttcgtctggtacaggggtatatctaacagaggtatgaagttgggtgaaagggggggcatgggacctttgaaatctgattgttccgtaatttttgaaaatctagccatggagggtttagtgcacggaaattgaatttaaagggatgtattggtttgcaaaacaaattaagctagttattcaatagctcagccatatagctattgtctttatgaattctgcaccttctgttacttctcaattttcttttttaaggtcactgggctgacctatccaaaaacagaaacacacacacatacacacacaaaaccaaataaacagaaatctcccatgttgtcattcatgtaaaactcccgttggccatcctccaaaccttgcagcaggatgcttttgggtctgcagtttctcagaattagacatctccttgttagcatgacacttaaattcgatcatgcaacccctctgattaaagcctctcactgtttatttactgtcggcaatattaaatccaaaccttttatataaacatgtctgacatgtaaacttaccaaaaaaaaaaaaaaaaaaaaaaaaaaactcctggctgaaattgaaaggccttagcataatgtccacgttgggcttctcattcctagaactggagatcacaggtcctgagcctgctgtacagaccatcagctcagaaacatgcacagcatattacataaatcaacttatttcctctttcaggaaaagtcgtctattattaaaatataaaatttgactaattcatccccaagttcatctgcgggacataaaaatctcagcaggtctccacctaaaaattgctcatggtttcaatttttaaatttgcagcaatccgattttaaag

SEQ ID NO: 21507 - DNA, 1168 bp, Mus musculus
ttggcttatatggtgtcaacagagggacaggatgggataagacagctggctgaggctccactaattataactgctcaagtatttggacagcagtggtagtgtgtaccccagtacatgcccaaactaacctttaacctttagtcctgagcatggccatacccttgccactgaccaggtaagcccctctccactgggcagaggccagcatgggacctctacccctgcttaccttggcttcaagtgtccaagtggatctccgatggtcctgctcggttcctgcctcttccttagaagctgttggggaaatatgttttcttcttagtcacagacataccatgctgttgcaactccccagcccagccccctcctgttccccaaaacaggattcctgttttcagacatctctgcccttctgtgtgtttcccgtgtgccaggcatgactggtgagaaatcatacacttgaggttttttttttttttttcactccttagaatgatctctgcatcgttgtcttgctttttaaaattgccacattggagaggaggaccatgaggcttggggtcatgccaccacctttggtgtgcctgacagtcctaatggagaccaagcaaaagcatttcaccctcagatggacactcagtgtgccttctcttcatgagggagccctttaagtctccataatgacctcttagttcccagtattggtcagcaaatgttgcctttcaagcacacagtaggtctactggtagcagtgaggcttgggtcaagggctcagggagacaggggactcctgactctcattctttctcttctaggtaacccagagataagatgctttctcccaggaagggagcagatgcctggcccaggatcacagaaaaaggtctgtggaatgttctcttaccttctaaaatattaatttagagaacttgcaaatttgcagattttcccagaatggaactaactggaactcttcattttacagctatggctcactgcccctcagggggcagggggctggtgattcctgagggagccctgcccccttccagggtgaattttcctaagtcaccatggagaaccagcagcccagaatcagtgccctgccaggcaggtaagcccatctctcttgtactttgttcttttaagggtaaggggcttcctagag

SEQ ID NO: 21508 - DNA, 1141 bp, Mus musculus
ttgttggctcccgactgggcactggggctgcttctcaaaagcctgtccctttgggctgctagccagctagagaaacctgctgcagcttccccatcacctaccggcctgcctctctgctcgggtgcctccagtagcagtgagctctctctccccagccgcttgcttgggggctcacgtactgagacgctcctctcagccctcccctgtcttttacatcagcctccgcagctccaacagcagcctgcttatgtctcggccctcaggtctttagaggaggcaagctccctctcttcagggtcctctctgtgctgtcgtcaatagcaaaacccccacccaccctgagaataaatttggggcctcttccacctgtctgggggtgcttctcctatgctctcttgccattggttactgagccttttgccctgctgttcttccagcagcccaggggagggcgtggtgctccccttaggggagggggggcagctgctctgtctctagctcttaatcagctctgagaccctctctccctctctctctctctctctctgtctctctgccccttcaccagttgctagggagaagcctctgaatgcaaagccccctgttttctatttttttttctttttcctgactgagcagtggctgcctggccagctccgtttgacctgcagaagtgggagctacaagagcagctgcagtagagccagggggctctcaagctgcacagctaagcttgactctccctctgtagccgtgaggccacacaattccctttagttttcagagtctcgggctttccctgtgaaatgaagatgagagtttttctctcaccggcttgaagtgaggactgaagcagatgagagtagcttagcctccaccagacactttataaacgctcgtggagtcgccagtgggatccaggaggagggtgacatgtaacaagtgtcataagagagacaacagtctggcttttcaaagctccatgctgcatacacgctacaacatctcctggcagagtcccctctgcaggcttaatcacacaaatcaagccagcccggaggcagctcttagcctgaggaactcacaggagatgtgggagatgtggcaggcagcagaaagccctgcagagcccacatctgca

SEQ ID NO: 21509 - DNA, 1232 bp, Mus musculus
cggtcggtcggtcagtcggcttcctgtcttcgaactgcaatcattcttatgagaaaacaaacaggaaatactttgccacacaccaatgcaatcagggtgggtgatggcagtcgggattcaagtcaccctagttgaagccctgagctgggtgggctgtctgtccagaactcacatgggaaatttcacaaagaggaaaagtctcatgatctccattggattggtgaagacaccatggcacagaaaagcaaagaagtccaatactcacagtctcccagctggtgtgaggttgggccaggatgaaacccaaggctctccgaggctccccaccacaccctgctgctgaagactgcctagcaaggctgtgccgagtggtgtgggtgggcaaaggatggattgactagttataagcacctcccagaagtccttgagatctcagctattttgtggcccaatccctttgaagggcagggtcaaaattaggtgtaggcacctacctattagcggaggcttatgaaaatgacattattaacctgatgcagagagggccctattcatctgtaattaaattataaatagagttagtggggggctagggtctctgtgtattgactgcagtctagagtgctcagaattttccagggctctggtgaacttttcgatgaaaagtgtcacctctgagcatctggggcttaaagctgggaacagagacctcctaaggcaagcccctcacactagggatgtgccctatactgacccctttatggtgggagagcccccgaccacctcctcaaacacaaacttagaccctgaccttcctctcatctcaagttgccatctgtgagagagaaatggaaactgaaccttctgagagacaatcccattcctgtgtgataagagaggggaaccaaacatccttcaaagagacagccttctcccagaaactttcctggttattgctacggttgccagacacctgtctgcttgtcagagctgtattcaacaggataactctggcaacttcccttccttcagagggagatgtggatggggatagaggagtggagaggggactcttaaaaaggagcagaaagcagagttctgcatccgatagaagttgggccacttaagatttgtgccaactcacggtgcagtggaaatggtctgaaatctttaaacagcagccaagagtctgtggcgcccccaagtgccacaagggggctgcctgggctaca

SEQ ID NO: 21510 - DNA, 1232 bp, Mus musculus; identical to SEQ ID NO: 21509

SEQ ID NO: 21511 - DNA, 1206 bp, Mus musculus
acaggatcccaggagtgggccactaaaaatgtttttttgaccaaaaggttaatttttattcgttgatgtataattgtagccttaaaaaacttctattttacctctatgtactaagatgtggtgagattcgaactaggctcatctgtgtttattgtatttaaaatgtatgaaaacactgggaagaccaaataggcaatgatgatgagattgtatctgtaatcaaagatggctgtgtctcttactctgtactgggtctgtttcaaaaagggtctgttgtttcctttgtggtcaggacatataggatcaatgtttataaaaaagaactgctttggggttgggggttttttggatagtgaatttgtacacattcattaaaatgataagaaatgataaatgaatgaatgaatttatgaatgaatgaatatgtgcttgggcctgtatgatgatcctagattaagataatctgccctgctcactaatggctttgaagcaagtgtttctacttcgtcctttttaaatatctgccttgtgttctacagaatggaggccctaatgtgaatggagactagcctgctggtagagaccttggcagtgaccgctgtgggcaatgagccatgggccaacaatgtgagtaatggctagttttgttattttgaacttgggtagttggctgatgggtgtttattgcattattaaacatgattgagtttgtaaataaaaccaaagatggccaaagccctagccagtgtggagactgtcatgaaccaagggtaattaatccaattaggcataataattaccgaattagaagtaatatagtaagctatttcgtatggggaaaatatcaaaggaaaagggaatttcttatgcttgggtgatagttcaattgttcatgtgcttgccttataagcaaatgggcctgcagttgatctggtggccatatataaaaaactggtcacggtggcattcttagagtctcagtcctaaggaggtagagacaggaagacctcttaggttctctggccagacagattaccctacatggtgtgttctaggcccatgataccgtatgtcacagatagtgcctaggggacaactttcaagtttgatctctggccttaatatgtatgtacacatacgcacctgcacagagtgagcacaccacccaaaagaagtatgcatatgcttatttgcatacacccatac

SEQ ID NO: 21512 - DNA, 1188 bp, Mus musculus
atggaattatatgtggataatgcccctttcaggacttactttgaattgaagccgtgctagatattgagagtattcaaatcactcacacgaacccattagtatgggcttttttactattcaatcttttccttctttcttcatattatattctacccatacacatgcactttatatataatacatattatatataatactttcatacactatagatacattgtattagaggatctgtatataagggagttataaataaaattacataaattactaatggaagaagccaataaataagatatgaattcctctttggctaatcatgtgtatgtgtaaaagccgtggttttatagagtgtgaattaaaagctatcagattgagggccaagctggtgttgctcctgaatttcctgaaacctgtagtttttaaaattcaaattttccaaaatttatacaaatcatgctaattgtttctaaaatgtttgtcacccttttgataaatattattgccacttactaaaattatttttaacccacagattcaatgctgtgtacctgatggatggttactgtctgagactgaggctttttgggccaggagtaaaaggacttgggtaagttcaatgcttggggtcctggtgtgttgagtgatttgtgccatgcgtgggtaggttcacctcaaaaggatgaataacatctaccaacaggcataaaagcaaaggttaggcaggaacgatggctgatggctcactcttcttattctagtactggggagactgaggcaggaggattgtttagagccgtcctgggctacatattgggatcttatctaagagagagaaagaaaacagactccaaaccaaaaccaaatagctgtagacaaaaccagacaaagcaaaacaaaacctaaaaggagcattaaaaggatgccatgattggagaagatgtgaagtgtttttagcacagatgtgacaatcacatagtgcagatattagctagctagaaattagtcattttgtggtgtttaagtccttgaaacatcatgtgcacacttaatgtgcacaattttatctttcagttataaaagcaaaccaagaacaaaatgaatcaagctgccaggtgtcagctgttggtgggtttgagattgactggttttagcctaacccaggtcctctagagataagtctggggc

SEQ ID NO: 21513 - DNA, 1726 bp, Mus musculus
agccctggctgtcctgggaactcactctgtagacctggctggcctcaaactcagaaatctgcctccctctttctaatgctacgttctcctatgctataccaataaaacctgctgcacctccaggccatgttagaccaataggcatacagacatacgtatgtgtattacacatacataggtgtattaaagtgtcccccatagacatttttggcgtggtaggaggaagagaggaccaattacataaatgaacaattttataagtatgtagtggaatagaagcaagtgtggccagcagagagaatgttttctataatgtcagacatcatttttctctcatatgtggaatctttaaaaacaaacaaacaaacaaacaaacaaacaaaaaactaaaccagaagggactcctgtatggggatgggaagaatgtgggtaatgggaacagagtattgtttgaatatttggtagacatgtttgaaaccgtcctttgaaccccagtgttagtgaaataagtacgcactgctgaatctaaccataggctcttttattcttttgaaagtttgtacttgattgcgtcctgtggatgcttgcctaccaactgactcatcctgacgtgccaaaggtcctggctttcccctgtgtgggtaagggaagaagagagttctgtgagtaatagcttcggttgtatgttcttggcttgggaagttgactcatgagtgggtgttgcttgcatttttctaaggtaaaaaaaatggttataattcataagcaaaatttataaatgccagtgttaggcagtgataggaacatcatcagactaaggcctgataattaatatgatttagcactatgaaaaatccaccaaaagaagagaagcagtttttcatttccagggttgcttactattctattctatatattattgaatgtgatttatttatgtaccttgtcactgataacacttagaggttattaatttcctgatgagaaaggatagagaacaatgacaaaagtcacttgttaattttagttgtgtagatcatggccctttgctcatccatggcaccttctttaaggccaaaagagggcaaactttagactatagagatggtaggagataagaaccctgaatgatttaaatgtggaaaacatgcacagatattggggaaaacgactactaattctgtggggaatggacacttgatagatagatgtattattcagtatttggtgctctcgggcattttgatttattaattcatcacatatatatataaacacatcaatgaataaagcagcaagcactgggagaaagtatatcaataggtatatagagcagcgagttttctaagatgtgtgaatcaaagagtttggcctaaataactcacaggtatatcagaacaagaaaccatcctggtgtaagccatgcttctaacacagctggatatattgaaagaacttggtcttagctgtccacatctgtgacttgtattataatgggacagattcaggaatgaataaagatggccaatttttaaaaagcaaagacaagaatgaaaagaaacaaatattatcattcgttgttgttatcttctgacccactgagcttcattctccacatagatcaagtctttttgaccattcccctgaaggacatgtcctgggtcatgaaccatgatgttgctatttgaattgtgttgggcagctggcggctggttttatttagaca

SEQ ID NO: 21514 - DNA, 1210 bp, Mus musculus
ggacctcgctgtgcattgttgagggtctaccttgcaacagcgatctcaggtcccctaatttacacattcgctgactggctcattatctttattctgtaggtagcttatttattcctaaattacaccctgggaatagatgcctggatatgaataaaagaaaagaatgcttgtcagaccagcacacactttgtggtttttatgatcttgcagagctgaagtctgctaatcatggaggctttttatttgttctctgggtttttcagtattaggatttgtttgatgtcattagcaatttacacatttcatcaatggtaaatatctgggccatgcactccctgaggtgggcacatgcagtctgagggagaaggcaatgttaatgtccttgttgtgactaaagaacagttcctggtggcacagtcttatctcctctaacctgaaaagccacaaaggttcttgaatctgagatgaataggggatggtcttcgtttcttcctggaacctcgttttgagatagttcactgtatttactgaaatattacaaaacttggagcgtaaaaccccaaatttgaaacatttaccgtgtcaaggatgtgagaaataggaggatcagctgtgactgttgtagtctctagatgtcctggagtggtgacccagtgatgtcatcgctcaaagtatgaagcacattgtttctttctcacagttcccacaaagccagaactcgggagtttctatgtgtgatctctcgtcagtttgcttgtgagatgtcaggtgatgtggcggtttgtctatgcgtgggtgatctgtctgcaaggttcatgttcatggctggctgctgatggggaccacaactttgccacaagagctttcttcagtgagtgtccttgggacatggtagttaatttccctagagagatctttgcagaacagagttaggtacatccttcgtaaaacacacaaaccatctccctaaagcacaaacttctccagggctctcctgctcacatggtgagccgtgatcccaggtgaatagaggtaaaccaggactttttgtgccacaggctgtggttcccccacctgcaatctcttagaggctgactaagtacctctaagttagttacctacccctaagttagttacctacccctaagttagttacctacctctaagttagttacctacccctaagttagttacctacccctgttagtta

SEQ ID NO: 21515 - DNA, 1212 bp, Mus musculus
gtattttgaatagctgctatatttttaatagtgacagggcttgggggggaattttgaatagctatatttttaatattgatagggcttatgggttaatagatcctacagtgtcttttacatggtctcagagaagccctagttcattaaaaagaaacctaactaggctctctttgaatttctaaatcttgctaagtgtatttttcttccacaaaatgctcacagacagctgacttactgagttttactaagaaacaaaatcacacacggtatagctctacacataaggaacagagaggatgttgggagtgagacaccaggttcgtggtctcccttgggatgctttgttcatgaacctttagtggtacttcaaaaggatacagctttcaaacaataagttaagctctgtaagaatggaccggtggtgaggatgtgctaggacccatttttttttttttttttttaaagattcatctaatttggtgtagtggcaaggatctttaaaaaatggcaatatcctgtaaaggagattttgcccctggaacattgtgttgtgtcctatggactaatgagttggcccgacgaggggtggaagggagatgtggaggaaggaaggtttgtctggaccggtgatgagttccacagggtatctgaaccaggatattgtgagaactgtttactgttgtttttaatttcctaccacattgatttgaagatttgcctatcagtgtggccctggctgataaggagggcgtcacaagtggtagaagatgctggcgtcattatcttccatcagatgtctttagacaagggcagattcacttagtgcaaggtccagcagagcagcagtcaaagcagacagagatgagctctgggtgctggtgaaggtctctcttccccgagctccttggttaaggaagatggatgccttcagtaaagggagagtttggtccctggagtattgtgttgtgtcctatggaataatgatttaacacgagaggagagatggaggaaggcttttctggatcagtgaggagaacttgggggatctgaactaagatattgtaactaaacccatgtatgtctctgaggtcttttacaactctcccttctttagggaacactttgtggggctgtgtcctaggctgatagacatgtggatacattggtttctttatttctatactagcagtgaggtgggtggtggcagagccc

SEQ ID NO: 21516 - DNA, 1158 bp, Mus musculus
atagaaattatctttgtgtagaagtctgaaaaacttagccaacttgcccctgggctttttggctcagtggtatgtaatcttttatttcaagagtattagtatataaataggaaataggtacataaaataatgaagacacattgatttgtgcaataggtagtgcaagaagccaaagataactcatgctattgcctactaaaaagcaagtgtgcttgttaattccaagtaacataggatagagtctgcaaccctctttcatattgagtatattagtagctgtacttaatagagttgcttgggtgtttgttggtcattaagaaaagcaaagtgcacaagctagccatgtgttaactatccacctgcttgacagatggttgtaaatgctgtaagacttactcttggacattcaccacattgaaaatcagaactttgatattaactctaaactttattattacatagttctgcttgacccactaaattctaaatcttctcttccctcttgtgctgaatgtaggacccctgatttaattatttactgtggaaccattgtcctgagtcaggaggatagatgaggaaaggtaaggctcttagttcatggcctctgtctggagtcttgtttatggctgctagctgatcattttcaaaatcagtaatggtcacctacctaaaacagttaacttacaaaatcatgtttaatccaagttgccctaatagacatgattttaaaagaaaaaagcagttatataacttgtccccagaactttagtgttaccttttgcattgtggttgagctctgctccccaacagtagttctttgggaaggcccccatataaatgctagctcacgagtctatgaggatttctgaggtggaagatgggatgggagcttcattatgtttgatggagccaaatttgacatctggatgaattaaacaaaagtgaaccacacaaaaattagatgtggattggatccaaaacagagacactagtgtgccttggagcatgtgccctaatggaagcaatgtggtctggatatcccgagaagagagccccaacccaaagatcttgttttagggactgtgtattgttaactgtgaatcaatcagtcaatgaatgacgcaaacacccagcataggccaatgatgaggagcatgg

SEQ ID NO: 21517 - DNA, 1187 bp, Mus musculus
tgtgcaagttagacaggggctgggcggtcatcttctgaggactgtctgccacagttgtcatgctcacatgtgaacatacatccacatgcatgtgcaagtgcacatataaacacacaccccggaaaattaagcttaggccataacagagattataccatatggtaaacctgtcacctccaattttgaatttcaaagtcccacctaaaagacaaccttgctcttaatgtatgttgggaacaaacaccagatgttcctaataattagagttatttttcttcttcttactgctgggttcagtggtgttcattacattatttaaaataaaacgtatgcaggttcataaatataaagtgctgttctcgcttagaccccatgaggtaataaatataaaggagttgctgccttcccaagtgttccgagcggaacgcaaacctaagcttatggctaattgatcacccccaactgcagttccccccaaaactaaatgacaccaattcatttgaatgtttgccttttactctccagaatgagagcgtggctggcatcgcttcatgattacattctgggaaagatcttgcctgttaacctctagagaaggagggacgatacagacgtaagtgggcatcaaacttcatgacctttgtgagagaggggcaccatcatgcccatcgaatgattcttgaggaacagattcaaagtggtcatgagctgaccattgatgagaatgttgtgtgagttaatgttgtgtgagttagtaaggagtgatccacttcagtcccaacaaattgctctcgaccaaaaagtgtatttcaaccatttctagaacgtttttacgtgatttgggtcataatacatgtggatacttcatcattgtattgccttcctggtcccctcccagagaggagaatatagtgaaacaatgaatcttctcatcatatggtagtccattgtgccatctttatatagatattaagtgagagaagtggtgtgattgacagtgattgatagcatgcacagatctggattcagtcagatttcccatgttgaggctcacagcagaaaggccagactttagctctgtgggatatgcactgtcaagatgtatctgtatttccaagtattgttcctcccttaattcatggatattgattacattattattgaatcgatgaataagtcaagactag

SEQ ID NO: 21518 - DNA, 1158 bp, Mus musculus
ttgagtcccttctgaggctgtgtgtgtttagttagtagtaggatcacaagttcagggccaacctgagctacataatcaatacttggtctctgcccctcctttcacttaaaggaaaacaatacatccagaatgttttgtctttatattcaggtttcattttcttttctatttttatgatttacttctctttttttggataaatgtgtgctaattatacattctggaggaatatactgtaaattcattcatttctttcaaaactagtcaattggaaaagggattcttgtgcctctaatgagacccttagacaggcaggcacactcttgatcagtcctgtttccaagtgatgaattgaacttgattcattttatcttttcaaagtcacagttagacaaatgaaaaggtggcctattgttgggtcagtgaaaaaaatgggaattgtcgtcatgaatattttagagttaaactaatgctgtttaaagtgatctaaatagctcactgttttaaaacctggcatttgacaccatagaatgaagactatagcagactgaattactctctgagatgaggactttgctattgccattgcaggtaagatgttttatgactccataatcagcaaagaatcctgtcagtaaggtctgatttcttcgcagtgttcattggatcttttaagtctacaaaccaatgatacaaatgcaatatgaaacaattgctaggaagctaattggcatattttactcacagcccattttattttcgcacagcagtgtacttaagttttctacttaataatctcagtctgcatgtccaatatggctgccaccatacacacatggctgcttatatataaagtaattactgtgaagtgaattgtaaaattcaatttctctgttgcagtgctcacactgcaagttctcagtagctacctgagcctttggggcactgtgttaggatcaggtttctattattctgcaaagagctattggacagctcttcacagagaaggctgcacacaggaagagggaagagagacagatgtgactgctttgaggcaggcatgcgaattgatccatccatggttcactgaaggcccctggaaagagaatcaggaagagaactcagcaatgagaaaagaaagaaactgtaaggagaccc

SEQ ID NO: 21519 - DNA, 1952 bp, Mus musculus
tgactccagaaaaggcaggccttttgcaatggtgactgcatctatttacttagacaaccttccagttgtaggaacaaaccatcccatatgcaaccagacagctccattctgttttcaccggccctgtgagatctacacactcagttctgggtgagaagacacaggtgggtccttgggacttggtggtcagtcagctgagcttaagagacaagctgcaggccaatgaaagatcacatctcctgagaaacacatgaagttgacatctgacccccccccccacacacacacatgcagacattttcatacttatggaaaatttgcaaagattttattgtgaagtaatgcaacattcatgacataaataatttttaagtgacagttgatttatcttccactgtcatgctaagactttagagttctgtccaatatacaagctcatgctaaagtctcagtggatttagtaagacttatatgactatatagaaagtgcattcattctcataacctgtgttttcccccccagaatggactcacaattgctgatgtataggttctaatgttttctattgtggacacgggacacccagactgaggttcgtggatttttgaaatttctaataataagataaatttgtgacttaattttgagtggatgaacttgatttgttgtggttatattgttcagttagtatgtaagtaaatatacaaataaatgaaaaaggggttggccaactatcaatgtatagagcacattgatagcaaagttgtttacataacttacacttttagtccttaaataccatacgaattgagcatgttttatctctccttctgagatcattaaatgggtcattaaatatagggactataagcaactgtcaatattgattagggtagttcaatgttaacattgttgatttttgaagctttattatgaacttggaagcaaaggcgccacacactgaaattaaggagatccaaagacttactttgataatagaaaattcatagcgattatcataggttcatatgatatcacattaattgttatgcaaaacttattcttgtgagttctcaaaggtagttatcctctctattcatcccacagaaccaatggctccagtctgatttaaacatgggtccgtgctcacacactcaatacctaccctctgtgctcacaagtcctgtgtgagtaagactccaaattattctgtcttgttttactcaatggtatgctctaccttattatagagtataccatgtattgagacaagaatgccagtcattctgagaaacaaaatgcaaccattagttgtcattttaattagtgacgaatagttgtgtcaatcatcaaacatgcttgtataattggatgagaagaggtgtaacacgggccaatgatgacgaggtttcgggattataagtcacggacgatgactacgtcactagaggtctgaggtccatagcagaagatgcctcatgtgaccctctcatgcaggggttgcatgtcaggcatgtgcatacagtagatattagccatgcactctcaccatttcatagtagatcacagaatcaagatacaaatctccatgcacggaaaggatttaaggcattgatcaatcctgaacataaatatttggccatcaatgatatttacgcacacactgaaaaatctattcagaatgacttacacaaaggtttatataacctttatcaaaggtaatttatatagtaagattcatggctgaagtcttcatgatggtcaaggccttaatttttaaaattatcaatttttttcttttctttttttttaacttgaatttttttttaatgaaaactatcatgacaatttgtctcttaaatgaaaggagaaatgtaaaactaaatggacaaatatcaacctttttattatctttgctgttgtgccctccctggatgggtgctggcacatg

SEQ ID NO: 21520 - DNA, 2999 bp, Mus musculus
gctcagtggataaaagaacttactgttcttgtagaagacccacagtgggctgaatcgcccatgtgacagcctgtaactctagttcttatgtatctggtaccatcatctggtctctttaccacatacatgtgtcacaaatacaaaatgcagattaaaaaaatcattaaatagataaaaataaaataaatatttgagaaaataattccacatgagttattaaaattagttataccatcattatattaaaaaatacagtaatttatgaaaacaggatgactgaggagtagacaggaaagaaaactgtaagaaccttcttagtatggttcagagctatatgtctagtgttttacatcataatagaacatatagtagtgtcacacatacagatgtttgagaagaggtgcgaggcaagtacacagatcatctgaacaaaggaacaaaataccaattttcttttgttgatctcttctgttttgaactctcagaatgcattcttccaccaagatgatttacacagcctagctggatcaggagccccctaataagctgcttcagattgtaatatagacacagtgtaagtacagtccatattctgctgtcgcttcatgttgcatttaaaggccatttactgtattgataagggcactatctgttttaggaagaacagtcaagtaaaggctgcgtatggcatgtgtttgacgcacaaggtttaatgaagttgtttcaaattaaggatatgtattgaaaactgcttcataactcaaaaagaaactgaggaactctgaagtttactggaatctcttgtctttagttttttggtgtttttttggtggtttttttgtttttgtttttgttttttttttttgtgaatcacaatgatcccagtagtacttgtaatcgtttgcacactaaagatgcctacgtgagtagagaagcagagactgatgttggatcaatgatgactgtgggtgctgtatgagtcgtgtattatgactatgcgtctgagagtctgaggttcacatcgtaatatatgtagagcatcctatgatcttagtgacagatgttaggagtagtctacatttacatgtagataaaatggtgatacatttggaaatcatttctaataagacataattccatagcaataatgttaagcacatagactaaatagtgtttcattcagatatgataactgggggttccccatgagtgatctaaaattgttagcaaagttcttgctcacctcagagccatgcccatttgatctgtaatgcagagatagtaatagaataatgaagacctcatgagggatatggtggagaatgacccagagaagcagacggaatgcagttacctaaacagaatcttaacctttttataatttttctgctttttgctctcagaatgtatgcctgcaggatgagtcccaccttcttcattagtcttgaggtttgagattccctgtttgtgtctgcaggattcagatagtgtgagtatagtctgtgttcttgtgttggaattcttttgcttgcataaaaacagggtagaaaatatttctggggctggtgagatggctcagaggttgagagcactgactgttctccctgatgtcctgagttcaattcccagcaaccccatggtggctcacaaccatctgtaagggctctgatgcactcttctggtgtgtctgatgacagcagcagtgtactcctgttcctaaaataaataattattttaaatacattattatctctgaagagcagatgtagccataggcatataagatgtatatgaagcacaatgtttaataaaattttaccaaattaagattgtgcaacaatagagataggcatcagtgcagaagatcccgtagaggtttaactgcactcacggatcttatagttagggcttgtctccagtggagattttcgcaatggtcctagtcatccattgctcaataattttacatagattagtagggaagaggaggactgatgttggatcaatgatgaatgtctgtgagcattcttagagtcatgaatcatgacgacaaatttaattctgagatcaacatcataaagtatccagtgacagctataagaagtagtcttcttttataagtcagtaaatgtaaataaaaattgactaggaagtcatttaatcaaaaggcagctcacaaagaagactacatatatgtatatatgtatatatgtaagaagaaagtgtgacagagtaatgaccatggaggtgagggataagatgaaatgagcagaagcaggcagaatacatagataagcgaacggaacatcaatctctttataacctcttctgtctatacttcaagaatggatatcctgcaagtcggcttcgtagagtctcccttgaaagtggacctcatgatctagcctttatgtccgtggattgacactgtgtgagtatcatcagcgtgtgtgccattgtttatggtacttacagatggccctataagctagaagagaaatcttgagaaaatgataaacatggctattgtgtgtagtacattgttaattttcccaaatttaacaacaaattaattttgccaaatttagtgcatataaataaatactcagtttgacaaaaggtcctttagagatctaagtctcactcaaggatcttgctgtttgagatttgtgagtcataattatctgcatagtgtctttaattactcaaaaaaaaaaaccacatacaaattaatagaaaagaggagggtgcatgttggatcaatgatgaccagcggtagccgtatgattcatggatcatgactacagatctgggagtctgagttccacatctcaataggacatcatcccccaagcactgttaccgttatgagtgctagtctatttatataattagtttaaaacatagatataaatttgtagcatatactccacttaagatgttacttcttaggaaaagttttaaggatatatcccaaggcatgactgaggataccgtat

SEQ ID NO: 21521 - DNA, 2999 bp, Mus musculus; identical to SEQ ID NO: 21520

SEQ ID NO: 21522 - DNA, 2999 bp, Mus musculus; identical to SEQ ID NO: 21520

SEQ ID NO: 21523 - DNA, 2999 bp, Mus musculus; identical to SEQ ID NO: 21520

SEQ ID NO: 21524 - DNA, 1146 bp, Mus musculus
gagcggaagatgatcgtggattaatgatggccgctagtgctgcatgcatagtggattgtgactataagtctgggaagctgatattcacatccttaaatactgaatatatacccatcattctagtgacaagctgagtagtttacttttataataaaaagtattagtgactactaataaattatatttagataaattagaaaaaaatataaaaattggaatttatgttttaatcaagtatagtaaatgtatacatttactatacttacattacaaacagtaattcatttgaatttgatatatgagaatttcatactacatccaaaagactataggcaatggtcttggtagggtcagtgccatgctttctttttaaaaagagcacactgtagcatattgtatccagagaggagtaataaagagtggggttatttacagtaggcacaaagtgaatatcagtctttttattttctcttctgctttgtatttagaatggatacccctaagctgatgtatatacacccttcctcggttgtgagattcctgctctggtggttgtagtcataagatatacatcgttgcgtacaccttggttgtgggcacgcacactactgttgaattaccaccttgtccaagtggtaagtaagcctctgcctcagatgtttaacgagatttttgccatgtaggcaacatataattaaaccattactataggataaaagagcccgtggctgttggtcatatactcagtgatgttttccttagatgtttttgtgatgcatgatcacttgataacgatatagatattaaaagagatagaggggtctgatgttggatctgtgatgacaaagggtggcgtatgagttgtggatcatgagtacatgtctggaagtctgagattcacatcatgaaagatctaatatatcctcatgaccttagggacagatgttaggaacaacctatttttacaagtaaattggctcatggtataaacacagtaaatagtttcttccagtcaagacatccttctacagcaagagtcctactaatgtaaaccaaacagagtcacacattcatacttgctgacattggatgacacatcaagtaaaatcaatggcaataattttgccatggttagagactagttac

SEQ ID NO: 21525 - DNA, 1146 bp, Mus musculus; identical to SEQ ID NO: 21524

SEQ ID NO: 21526 - DNA, 1212 bp, Mus musculus
tttaccaaatttaagaatgtatatgagatgctgaagaagacaaaagattctataaaggtgtgaagttccctaagaattttgttcttggatttttgtgaatcataattatttcaataatgctggaaatatattgcttgataaacatttattaattaatagagggcggttgatttttgatttataatgaccagtgtttgtagaattctgagtccgcagcatagcatgtagcttatgaccatgcacatgaccgtggcagcagacttgtatgatcttccccctctactaattaaggactaattccgcagcaagagtcatcgcaatatataccaaaccaaagtcacatttatttgatagcattattcaggatgccatataaacaataatgctcattgtgtaagagaaccatggccaaatattttgtccagacatgtacaagtataaagcagacttagctgagagctagagaaaaagacgctaaatacacagacagaactcatggatgagtaaacacaatttcagtctctataatctcatctgctttgtactctcaggatggatgccctcaatgggattggcactttctccattgctcctgcactctgttatcagcacttcgggttcataatgtacacacagcgtgagtatagtcaaccttgtgttgatttggggtgctcagaaatgctcacactgtgttgataaagccggcttatcatttgagatgagaagccattgccaatgactaatatgccatgtgacttaagatagtgtttaacagttttttttgtcaaattaagagttagttattttccagtgaaaagtattttgataaagcttttcattttataaatatactgagttaataccccatccaaaaataagagagtaacaaaatctatactcagcatggcaatatcttgaataatatcttgaatacgtatttttaagggccttattcttaaatctttgtgattcctaatcatttccatagcagtagtgatcactgcttaacaaagatgcagacattaatagaggagaggaggctgatgttggatctatgatgacctctggtgccgtatgagtcggggatcatgatcacaggtctgggagtctgaggtccacatcttaaaatatctagaatatgccgatcatctctgtgccaaatgctaaaactaatttatttctagaattagataaaatatcaataaaaataaa

SEQ ID NO: 21527 - DNA, 1212 bp, Mus musculus; identical to SEQ ID NO: 21526

SEQ ID NO: 21528 - DNA, 1734 bp, Mus musculus
accaattcagggtaacttggggaaaagggccgttgatagttcagtggtagagcccttgtcttggatccgtgaagcgctgggttctatcctcagtatcacaaaatcaaagaaataaaaagataatatctaggaatgttagtttttttggacagtgatttaaaaaggcagtacatggtgtactaattatgaatatgaatatatgaatgattaatcaatcaatcataaccataatcagcacacataccgtatttattttggtttggaaacctaatatacctctgaacaatagagaaaattgaggcatgtccactgagagcactgtatcagattttcaaacctccttttcactttgttcccttacttaccgatgtgccaaagatggtggtggctgcctctgtgtttgtctcattgagattagattagtaatgtctcatttgcctgaataggcaatttctaaaagtatctatcccctcttaccttggaacactcagtcctaactgagatgtctccatcaaatcccttccttcagggctcagggaacccagtggaagaggaggtggagtgtgagagccaattggaatggaagacagtgaggaaacaaggccttcgagacacaagaggactgctgagctcacaaagactgaggcagcaccctcaggacctgcacaggtctaagcttgatgcgatctgagtactgagagggcaactggacacaattctatattgataacccagaagctttctccagttgataaactctttcaaaggaaaaacttgttttctaccatggagtgacactggatatagaaactaccgttaacagcagactccatggctcagacttccaatacaatatgaactcagttgcaattttttgcaaggtttttcgactcatagttctttgtctgggtactttttcaccctacagagaatttctgtatatattatcgtttctgattctagtgttttgaattttcgctgggtctaaatatctctgtctcagtgtcagtatgtgtttctcatgatttttctttgcttctctttttcctattctttgcttgtattccctggtttgtgtttgagtgtctgggaactctgagggtctggttggtgatattgttgttcttcctatggggttgaaaaccccttcagctccttcagcctttcactaagtcctccattattatgattcctatgctcagtccagtggttggatgtgagcccccccccccctctgcatttgtcaggctccggcagagcctctaaggagatagctatattaggctcttgtcagctttgtttgtttttattctgtcttctctatactgtttattttagataactgtgtttattctaatgtatgaatgaataaatgggtgtgtgtttgggtgggtggggaattggggagggtgggggtggatgtgggaggggaaactgtaacacaaatacattgtataaaagtacattttaataaatgtatttcttctatgactaaaaaaagtgtgaagtacaattattgaaagtgagtagaaggatcaatggaaaatataaatgaacccatgggtgagtgggtacttgcctcgttgtatcaccctgagatctaacagggatgtctgtgtgggatggggatggatttgactgacccatgttgtatgcatgtgtgagtatttaataacattttcaaagagaggtagcactaatgatcgtactatcaaaataaaacaaggcaatagt

SEQ ID NO: 21529 - DNA, 1102 bp, Mus musculus
cacaaggccaattgggaaaaaagatgaatatggaattagcctgaaatattacatttataaattcattgatggtaattggataacatgatatgagtatcatagatgatcctaaaggcatgaagaatattcatcactcttaggtttcatgaatcattgtttttaaaattagatccattgaatgaattacttgtttaataaacacatgtaaatgagtgtaaatggtaggggtcccaaccaggaccaatgtgggcagtacagggctaatgagatatgaagcatgttatatgtctgacatgcggacacccatttatatacattaaagtgtatattttaccacaaaatatatataatccaagtgtcttctttctttaagaaaggcacaagaccagttgagctcattttccttacagacaattcagttgttccccacctcacatgttatgtgcatgacagggaagtaagaggtagtttgatagcttagtgaagccttcctatcattttgtattaattgtttagtataggtagcatgatgcctagtcaaagatttatctaagacaacaagtaaagacattgaggtttcttgcttctaggtttgtaaccattgtggtggttgtattgttattaatgaattagtaaactgaatagtgatcacgtgaagggagaggcatgacacagacccctccgactcagtaaagatgaatagttcatgtgtgggactgtaacatgtgtacatgatcatgtagacagccttcaggaaaatacaaggactttattctcacttttttgttcatgaaaaaaaattatttttaaaaggaataatatttaaaattaatcctttgaaaacattgtacatgtatataatatatctagttcatatctaccgccaacacctctctctagttttccctctgccctttcaacacaacttcatgtcttttcttttaaaaaggtgccctttttaaaagtataactcatgtaatctaattagtgttgtgtgtctatgcatgggcttggaggcattcactggggcatggactgcctaccagtgattatatattcccctcaccccccagacttctttagcagaaagtagctgctgttg

SEQ ID NO: 21530 - DNA, 1459 bp, Mus musculus
cttaatggcagatttccctctggtctctctctgtcgggatcccggaggatgatgtaagtaatatttctaattccttctttggtttgggtggtttatttagggagaatgcactgtatttttacagttttaggatgcagacaaactgaagccatttttacatttcagatgaaactgaatacgtaatactgatcactattatgcataaagagctaaagacatattttgacccagacattattctggattataaccagccatgaccttgttggtttttgttttctttttttttttttcaatcatgggcttttagaaacattattagttactgaatagattggctaacacagaggataaaaataagtgacggggtattgggtctccctgagagacaaatgtcagggctgaatgccatgtgaggtccaacaggatgggtatgctagtgagcaaggattagaggaggtgagtgtagtttttcagcctctgctctcatctctactcttcagaatggaggttttagagagaatggaatcttctctggtcctctccttggtgttcacatccctcttcttcattgtgaacaatagttaagtttttgggtttttttttttttttttggtttgtttgtttgtttttctgtattttcccacaggttgatagaaacatttagtcattattccatacatgaagaaatgagcactgtcaccaaaagatgtagtggttgacaggtttaatcttttggggaccttcatgcatatcatttttctattatgtagtttatataattttctctcttaatgaaacaattcacaaagccagaatgtattgtgaatggagatacatgcagcacctgatgcccccggattgctgtggcatgtgaggcatgtatgttgaatatcatatgtctagaactctgatctaaaacgaatgggcaggtccttatttaaatttgggtcctgtgttcaagtatccatttcaaggatctcatttaatatctttgttttcctttctgtaaatattattgtaaaagaataaaggcagtttgaataaacgtatgcatagagatgacaaaggtaaaaaatttgctcattatcaaaatacacaactaggatataagtattaggatttctaatgaagtctctctatacagaccaggctgccctcaaactctcagccctgctgtgtagttcagtcaaatgctagacttttattcattagtcaccaaaccttttacaagagaaattgttctgcactaaagatgatgcagacaagtcattgtcaatcattaaactgtatcaattataaatgtaaagctcattaagaagaggatggctagataggcttgcagtgattctgcagaaggtgacggtaatgtcatagtaatatgagtggatgcagacaccctcgccacctccctctttgtcctcctcagatggaggtgttaagctgagctgggaactcc

SEQ ID NO: 21531 - DNA, 1150 bp, Mus musculus
aaacattacatcctatagccgaagtttacgttctggagtacataaggaatcattcatattatttagtcatgagttagatatatggctctgtaagtcaaagctgaaagctgttgctcttttatctgcttttaaaagtcatttaacaaatgctttgttttgttttgtttgttgttccccacatcgcgcctctgagagctgactgcaggatttcctatgtttaatgactgcctcaaggtaaacatgggtaaaagccatacattttgtcgatgttttggttattatggctgtaactttacaaagcatgaaatagaatcctacaggtctactcttactttgtcttttggggtgaagatgggcttgtgtcctgagtaaatacgatgtctgaagatggttcatagcactttcttcatagcgctgtgaatactacagtctgaatatatcagagagctgtgctcctgttgaatatttgtgtatcaccagcattgctagtgaattattggcttagccagtaaatagtatctatgagaacgaggaaaggtcaagccatttctggaccaatgatgatagttaccaaggtatgagagagatgacgaataacacttgtctgaagctcagaggtccaacccaaaagataggtagataatcaaaggtccttgaaggacaatggcattttttttttcttttgtgctctgttttgtactcctcagaatgtgtgctcctaggctgatgtctgcattttctatgatcagcagtggaacatttgcacctctgcattgaacatggggcagtgtgagtactagttacttactatccctgctttttatgcagtctgttgaaatttggttacttcattatttaaaaatatctaagagagctggtaaggtagagagagagagaacagattcctagatattaagcccttgtctccatgcacatgcccttggcatgcatgttcataaacacaagtgaatatattcattgaaaataagttttaactatggttgtattaattcagccaaatacaaccagtgatgcctatggattttagttgaaataggacaatgagttggctatgtttgatgctcttcggctcctcattgaaggagagagacacttggaggtaaactggatctttagaggagtgtctttc

SEQ ID NO: 21532 - DNA, 1897 bp, Mus musculus
tagtcagctcaaatactccatgagttttattttctggtactcagtatctgagaatggtaaaatatttgatataaaagtatccatttctactaatagctattgccttttatcctcgtcagccttgtgtcaaatatggagttcatagaggaagctgaccctggaactctatgggaatagataaaaccatttagcaggacaagtgcatgtgtggcccagaaataaggagttggtgctctctgctcaatttgaacttttggatgctttatgagaggttttgctactatgctgtgaggtctttcacaacttcagcttactgccaggagcccatgacgtcatgaaaacatggaggtcactgccaggcgcaggccagtaatgcactaatgactaagttacacagcgaatcactacatggggagtctgtgagtggatgcatgagaaagcaggccagcatggcagaagtgagcgatgaaagacaaagcttttgagtgaatgacaaacataccagtgggtcagccttgaagaagtgaatgtgtactcttgagtgtatcagtcattctgtgaattcctgaatggttttatgaatggatggataagtagatcttcatttctaataaaggaataaaggaagtaatgagtcagcatttgggtccgttcatgagaggagccactgttggcccagatgaatggatgaattaatgaatggataaatgacctattgacggatgcttgatggactgaaaaaaaaatgaaaggaaggaaatcactattacaactgcatgtgtaactgaacgaaatgataagtgaataagtgaatgaaaggccaataggcagacgaatgagcatcacataattaaggaataaaagaattgattaggtagcaaatctgtcagcaagtctacaattaaagagtaaattgtattcttgtgaatgagtggctgaactagtgaatgagttggtgtatgaatgagtgagtcagctgtctgggtgtgagacagtgaatgaactcacagctactcctcctctgttccaaggagagtggccacacccagctccacactagttgtaaatacttgagctccctaccctctctatcatggggatttgtttacatgtcagcactaaactgaagagtcttgagggccaggaactgggtcaaattcttctctctgtccttagcccctgcccagcctcgagcctggtaggcgcccagtaaattattgctgaatgaatgagcaaatgactaaaaatacatgtgcttttgtggaaccagtatggcctggtagctgctctttggaggagtgtgctgtatgtcagatggtccgtggcatcctccctgcaagaccagactcttgccagggccaggcttcccatgccagataatgagacaggatactggcagttcttactgcccgggacactggcccatccttgggtaactctggcttggcatggtggaatggaagccctgggtcttcccgaaagctatcctagcctctgccaaaatgggagatcaaaaataaccaaagcttgtttttatgcctctgctgagtgggcgcatgacatgcctttccaagcaaaccaaattcctctgacttccaattgtgggactgtgagtttaaggagaagcactggcccctattatgcctcagctacaggacaatgctatcttcccgaaggattcatgatttctgcaggagcttggtataggatatgtgtggttttcttgtgtgcagtatgacacctgggaaaggagatacccttagaaaattaaaaagtactgttctgttccctatccacccatggggctatatttatttggtcagttcagttgtgtttttttgaatctatgaaccaagttccaagagggataacacatatggtgcgcctatccagacaa

SEQ ID NO: 21533 - DNA, 1112 bp, Mus musculus
gagaacggagccagccactttggcattagttagacatgtgtaatcgcgtgttgagaatctacagagactgagaatctgcacatgagggcaaagctcaagcctgtgaccatgtgtcaaagtggattcttaggggaggggagtacctgggggaacagaagaagagagatggatgagagcctgagccagggagatgagaaaagccagactggatggagatgtttcagaccaagctggctcaagggtgtagggctataggcagaaagctcagctctccaggcactcttgagaatctggcttcgtcatttggcgttcgctcttcctttcatcttacactgtggcatgcatgtgtactctgtgcttagcacaggattgcagatctgaggaccatagatgcactttctgtccctaaaacaagaggaagatgccggtgacttttcctctaatgctttctgaacagggacttcctacctcagcctcatcccattgttcctttgtttcttggagtactttgtgcctcccccaccccaatggcatggggctctgagcttccaccccaccctctatctcttctagaatcttacacacttctccattctgttgtcaactacccttcacttcttacagtactctagtgagttccttcatccttagatctttcaacaacctgtttcagctcccttccctcttggcagctttgcagaactcacatatttggctccctgccaccattcccattaaatggacccctgtgcatgggagcagcctctcttctgaacgctcacctgtgcctaaggctccacccactgtgaagttaatctcaacctgactctactgcctgtagcaagccggccgcccaaatgcccccctccaccagccctatgtgtctctgtctctctgtgtctctgtctctctgtgtctctctgtctcccccccccccccgtgtgcgtgtgcgtgcgtgcgtgcgtgcgtgcgtgcgtgcgtgcgtgtgtgtgtgtgtgtgtgtgtgtgcgcgcgcgcgcgtgggtgcatgtatgcatttctctgaacacttacttaattaccacctgccaccccacacctacactgggataccctggtttttcctcctggga

SEQ ID NO: 21534 - DNA, 1981 bp, Mus musculus
acctttttttcagtatcaaatcccatcttggaggcttcgtggtccagatcccagtctcagggaaggatggtcctgtcagcatccagccaggggacaggaataactggttctccacaaagccagcgagtggattatcgttctgaatggtgtcctttgtcctctaaaccctcccaggcctgccaggtctgaaggtccagtttgggaaggtgtcattgttattgttaactgaggatgtggaagaggggtttctgtgtttgaaacacatttggtcaacctctcttcccatcagaacaaactatggaggccttctggtccatacctcagcctcagctgaggacacactaatagttatgaacaagtgagtgacggacaaaacccatcccatacatcagatttctgttgcctgtgcttctaaccttcagtatcttgtccattctcaggaggacttctcaaccaatatggtgttccaaagttggggaagatggcagccaccgaggcaactctaccccaggtcatcacaggtaggttgcacccactttgcttctaacaggttagacacagccacccccacacatgtccagcatgctttggaggcacggtgatgggcttttaatcagccaacccctgctataggactgtctattgtagagaacacccactgtgtcagatggtacctagatccatgctattcacacacacccacatccttgtaataagagacttggaatcagcagtgttctagcagtaggaaagcaaacctgaaattggcacacacatttgcccagtgagctttaagatatgaaatctggagcggggcagtggtggcgcacgcctttaatcccagcacttgggaggcagaggcaggtggatttctgagttcgaggccagcttggtctacagaatgagttccaggacagccagggctatacagagaaaccctgtctcgaaaaaaaccaaaccaaccaaccaaccaaacaaacaaacaaataaacaaaagatgtgaaatctgttcttagtccttaactccacccagggttgtggtcagcagtagagctttctgtggggttccaggtagaacacaattctcatctgcaaatcatgagcccttttcataggcatttcatatcagatatctacattatgatttataacagtagcaaaatcacagttatgaagtaacattgaaaataattttacagttggggattacccaacatgaggaagtatattaaagggtcacagcactaggaaggttgagaaccactcgaccagggggtggaactgcctgcccctgcctgctgcttctttatactaccacatgtgctggcacacatttaccttcctactaactttataatgtgtctgcttttagaatcttaccttccctggaaactacccagactcacaaccagagggctgggtcgcttctcatcacccacctacctcttggaaccagaatccgaggctcattcctgaacacccccaatgtactgtacttgttgaagttgagagctactattcccctgttatctcctgaggcacaatttctggggtccctggttcccttcagtgaccccccctaaacctggagagataaggaatgcaggtggtctgtgttgttggtaaatagtctcaggcaattctgtggactgtcaaattgcacaggggttttggttgctctccagggcccacagaagcagacacttctgacaaggcacctggcactttccagctgcctttgtttgctttctgaccagtgctaattgatacttgaaggagaggttgtccgtgttgtcttctctttatttatgatgaaacatacacgggaaacctcttttttagtatcaaatcccaccctgggggcactccctgtccctgatgacgccttcagggaagggacctggactgctgttccctggactctgggacatgggacatgggagtatggcatcaggactcagccctggaaggaaagtcattt

SEQ ID NO: 21535 - DNA, 1981 bp, Mus musculus; identical to SEQ ID NO: 21534

SEQ ID NO: 21536 - DNA, 1149 bp, Mus musculus
tttcctttgtggttcagatatattgctgtagtgttgtaaccttccagtaacggtaacacacactaatcaatgcgttttgttttcagggaagggtcggtcatatgtcccgttcaggacagccgcaagatgatgaacggacattgcatccccagacatctcacacgctcagaatcctggagcctcccatttcaacctgttcttctgcttcccagtaccctgtgagctctttgttgtatttgtctacatcgtaagtcacttctgggtgcgggagaggggggacctcagagggcatcatccaggcactcacacagctggtttaggctgccctggattttgccacctagttctttgactttttttttttttctcagcttcagaagaggatcctggaactgagagaggagattctgtcttggagtttggcaccatcccatttcccccgagtgacacttcagaatgactggcaaggatggtaggcaacatctcagaatcttcagtcttcgtcccaggtcttcctgagatcctgaggtagagggggtttgggctggattgctatggcagtgatgagtactgagccactccccttgcctcaggacccccatccctgtccccctcccggccaagtatctgcctcacccaccatcccttccttccgcctgtccctcagcatcccttcacactcaggcacactgctggaacaagcaagagctcagccgtggtacctgaaaagaagttgcccatgttatttttcgcttttatttgtgacgaaacaaacatggtgcacttctttttcgatatcaaatctcaccttggagagctccccatggaccagagggaggacgggaggccagggggtttgggtcaccatgtgcacaggggcatttacctcaaagaagcacaatttcacctgcccctcttggctctgtgcattgttaggtccagaatgcccacctcctgggacaggcacagtcagtaagggaaaccaggaagcgcacttttaggctctgttgtaggatggagttcagataagagaagcccagaaaattataaaatccaaacaatagcaatttaatcaaacagccaatacaagccaaaccaccaattccttctggagacatgtgtctagatgtcagctgcaggtgtctttac

SEQ ID NO: 21537 - DNA, 1180 bp, Mus musculus
caattctcctaacatttgctcctcaatccattcttaggaagacttgctgcatggtggatggcccagagacggcggggctcacagatggtcacgtttagtgcttgcagattggtaatgcctgtgcccttggctttgtttattctggtcaaccagttgtcagtgctgccatcgagggctttctggacagcatggcaccttccgtaaggagaccttggcttcagtagctagtccaggtatgtacaatgacagtcacacactcgcattatgatgtatagcggtgctgtgcttcctgacaagaacctaaccactgatgaaagggttgtgatatttgggagggtgctggtatcatttccagaccatcatgggagggagagaatcatgcagcagataatgtgtgtctcctgctttgggtgagccctactccttgatgatttgaataagtctgtggagtcaggcgagtgtaagggtgttctggtgttaccctggtagaaacacgagtatcagctggcacgtaattggtcactcttcctgcttttgctccagagatgattccttgaccgacacatcttgctgacaaatgtcgggctgtcttgcttcatagtgggaagttcactgggaactacctgggttttgtttctgatgcctagcacttggcttgctcctctgcaggagagttgttatcctaacggatgctgggagaaggctgaggtcttcccatgaccctctttggggatttttgattttatttaagttaaattttttttcaaaagttaaattcttattaatatcccaacttcatgctccacaaattggtcaagaacagtgacaagagaatccatgcgggctgttgtgcaggttttagagagctgataaagatatcacgaggatgagcaatcttcccaactggaagagtggagactgggggtgctcttaaagtagggctagccggtgtacccagggactggatgagccaacatcagatgtgaacatgtaggaagaggaggggccaaagtagtacaaccgtaatgttggtggaaccacaatccctgaatgattcggtgggctgcagggagcatccttgctgctatcatggctatctcagctaaggcaatgaccctggatgctctgaaaggctgctaagatggaagaaagggtaacagaaaatgaggaagtcatagga

SEQ ID NO: 21538 - DNA, 1393 bp, Mus musculus
cccagggtctatatacctgcagaggacttctgacctacagcaagtgggctcccttctcatcttgaaaaccttccagtgtgaactctagaaccaaggaagacagagaaaggggacaatgtcagcatcgttgcaagggaggtgagtgaccacccctgccccactccagtgtgtttctagagcacttgcccccacctcactaacactcagcatccaatctgcctgcaggttggtggttggaaaccatagcccttggagaaatggaaggggccctttgtctgtcttgtctctgcttttctgtggtacttgaagagaagttgttcgtggtggattcgctttacttgtgacgaatcattcacggacaacacttttttcagtaccaaatgctacctctaaggatttcctggacatgatggcaacttgcagaaagatggcggttcagtcaagctggtagagaagccaagtatggatgtttggccacggacagtgtgcttgagctagctgtaagtcacctggtcgggttacctgagcatctgatccacctgtaggcctctcatcagtgggccgtgccaaccttggtgaggcagctgtggctctgcccccaagtatcagcttacaagactttgaaaagaggtcatcttccggaagagatgttggtgccagcaccattcagggtgtgtgactggttgaccagaggggcgtgcactctgttcaccctgtgggccacctagtcaccaaccctcagcatcaattccactcaaagaagactttccagagatcctaccaagtttggggatatgtcaatggacttgatggctgtgcctgctcagtggaccaggatgaactgtggtcttaggggtgtatgtttacataagatgccatgaggcatccgtggtagctgctgcatcactgtcacagcctccttgaaatgttgacttcagatgtggacatgatgttgacttcccatgagggacctgaagtcccttctctcctgggtgtgtgactgaattgtactttactaagcatgtgcctgtgccttacttatctgatggatctatcttccagttgtctaacctcaatatcctgtctctacaggagagtctgtgagatgataccaacctctagaagcaggcatggttgtcccgacatcgccacactaccacaggagcttccagaatacattctcttcatggaaactgtggaaccacgccccctctggtccaggaggactaaccagattcaaggctatcaccatcccccttcaggtaagtgtgcctcgggtgagcatgcacttaatgtaggtgtatgtcactcggctcggcccactacccaatgctgtcccaccccttcttcacaggacagtggaagcagccaccttttcgagagagtcgatgtg

SEQ ID NO: 21539 - DNA, 1393 bp, Mus musculus; identical to SEQ ID NO: 21538

SEQ ID NO: 21540 - DNA, 1393 bp, Mus musculus; identical to SEQ ID NO: 21538

SEQ ID NO: 21541 - DNA, 1109 bp, Mus musculus
ggtgactctatcgttgtttggccatggctatcaagagcatagtgcattgtgtcaagcactgtattcagatgagaaaacatcacagtgttaggcatgctgtagggaagagcaaatgtcagtcaccagtggggtggggctagctacaagccactcagttactcattccttaccagtttcaccagtccagggaagatctctaagaagtagaaccagatgtcaggctggtgaatggggagaggtggctcacagtgacatttagtgacatgagaatgctgatgtcctttccctgctccagtgtcccttgggaaggagagaacccagcagcattcattaccacccgatgcttgctaatggtgtgaccttgaatgagtcagcctgtcacctgtctgtgcctccgtttgtctgtctgagagtgttaatggctgcttataaggtatgtattcacgctgaatgtgtgttcagtattttgagagtgcctggtttcccccagaaagttggaaaaccattggcttttataatgatagttgttgcatgaatgtccttactctgtggatctcttcccaccctctagaacacaggttccttgagctcagaaaccccatctaatgctcgtaggtgcacacaggacgaatgatgctgagtgaatggcagttggacatgttttctttgttgaaccctctttgaggcctctcagaagccagagagaatagaggacggtgcagacaccttgtaccctgatgctgctggtttgtctgtgcggtctctcaggatactgccttggaaagggagttatcctcttttaggtcagccttcattggtgggcaggatggaccctactacacagagagtcatggtttcttctatgtcaaacctacctcaggacttctctaggagaaacactttgggattcagacttggtgtccgtgtgcttctgggtgagtgaccagtttctggccaaagcctggatgtctgtacaagtctctggccacctgtaggcaggagagaactctgcaagtcagtccattgctagtctgctttgcagttggacctgggggctcatcggaggtaatgccagcctccctagagggtgggagtcagggagccagagc

SEQ ID NO: 21542 - DNA, 1226 bp, Mus musculus
tggggaaatctatggatatagactagagctagtggggtgataagaaggactggtcaccatgtgggtttttttttttaatgtggctaaactttattttcccatcccaaacctttacagagagcttcatggagtattcagaagctggcgggtgtcacctggaggatgtgactgggtaccagtgccagagcacgtgcccactgagcagtcttcttcactttcctcgatcctcatgaaacattccgggtaagacactggttctggggagtctgctcttgccgagcagttggtacctggaacattctagggcctgcccttccttgggtttccatgttgccagctcccagggctaggcttaaagacgtacccattgttggtgctgaagggctaggcccgtacgggaggtcattttagagtggatgtatccagggtctaatatactatctggggtgtgatgagcaccaggtttcatggtggctctctttccaaaaggatctttacctcaaaggactccagaggctacatcattgtcttggaactggtcagtggctggagctctctccaggacaagtgcttggaggaagaacctggacaagcttccctccccatactgttgactggatcttgtagctaccgttagccaccatcatcgccattgtgtgcctcttaggagcatttccaggaggtgatgccagctggggaaagagcctctgtcccacaggtcagtttccagaacacctacatgaagctgcccgtggcgtcttttccccgtatgacacactgcatgtgaccagtctcttgctgccctgcagcaaggctagaagcctgtgtgaactcttgccaaaatcagagaagggattctgatgttggtcacactccaagagttttaaaatgagtggcgaacacagaatccatactctgcttatggcctaagtcaatggatcctgacccttactggagagccctccctggcgtgctcgtgcggggcagccatacacactggcacaaggggaccctgcgggatctccttccgctgttctttctctcctccctccatgtttatctttgaagcattacttgcttggtttataggactggatggtcaagcagttcttgctatgacatcaccgtggggggagggggcaggtgacagggcggggatgccagggtcgtggggctgcagtggttgggtgggcccaaggaggagcatctctggatgatgcagtcat

SEQ ID NO: 21543 - DNA, 1226 bp, Mus musculus; identical to SEQ ID NO: 21542

SEQ ID NO: 21544 - DNA, 1099 bp, Mus musculus
ctcggagagaggttacccgagcaactttgcatctggaggacgaatgttgctcggtgaaccccttttcggtatcaaatccctccagggaggccacctcagggaagaccatggactcatctcgctctggggtatgggacggatggtcgaccagctggaaagtaattgtttctaatgtacttcacctggtccactagccgtcggtgcccgctgcagcctgcgcccaggatgtcacagcctcagctcaacacctctgctggtacttgaagggagatcgaccgtgttatattcgcttggctgacttcgaataatacatggttgatcttttctcagtatcaacgctcagcttggagaagctcttggagttgcagcccctgtgggggtggggacagcatggtgcttctaggttgctgcctccgcggggaactgggctgggtggaacaggctgtgtgctgcctgtgtcaaccctactcaccatttatatgcaatcccccccttccccccaggacagcttcaggtggtgattccagctccagggttgctgcggtcaacactgggtacttgaggagaggttgtctgtgatgagttcgctttattaatgacgaatataacacagatggcctgttttcaataccacctgccactccggtcactcggcagtacataccaggtgtcacaccactgcccggtaggtaaatgcatggactctgtatgacgcttgtcaccccctcttcactgaacctcagctctgaggagcctcctgggatcgcaccaaccttgtaggctgggccacgaagcattggccagatgtgcaatggatggctgtccactttccatgcctctttcccgccacaacaatgggtgtttgtccctgtctaaggcttccaccgagggctgcatgctcaaatgccctgtaccctgggtgcttctcaataccatgagggcttggaggggctagcatgatacttagggaagagccaggccagttggttacacgtgcagttcctagtatctgaggtgagattgcccgtgacgggtttccattcttaatgctggtacagtgcatggtcacctctctttatcattggctcttactgtgtga

SEQ ID NO: 21545 - DNA, 1099 bp, Mus musculus; identical to SEQ ID NO: 21544

SEQ ID NO: 21546 - DNA, 1099 bp, Mus musculus; identical to SEQ ID NO: 21544

SEQ ID NO: 21547 - DNA, 1099 bp, Mus musculus; identical to SEQ ID NO: 21544

SEQ ID NO: 21548 - DNA, 1099 bp, Mus musculus; identical to SEQ ID NO: 21544

SEQ ID NO: 21549 - DNA, 1137 bp, Mus musculus
ggacaagtgactgaattggtgggccgggtctcctgggccttcgaagcccacgtgcaaatgctccaaagaaagtcaaaggttgtgggggatccccatgacacagatgagcacagccacagaactcaggctgagtctggctaacttgagactctgctatagtgactcccttttgtacgtttttggcttgctctcaggagcattgctgtggctcgaactgacagctttgtccctgctggagtttacctgctggactttctgacaccaggtctccagcgctgcttcggcaaagcgcgaaagtccccagcatttcacagctcggacttgttggccacgcccgcgcgccctgagcgcagctgggttccagcagcgcctcaggctctagctagttgcctggcacccacctgtcgagcgcagggagtcctgctgcttttgtgtttatttcttatccctgggttgggggaggggctcgagatagggaaagggtgggcagggtaatttccccgcctagctttgggtgcgctggagccctggctgctgatgacgaaccgcctctaactgggcttgaccacgggtcggctctgaattgcagagaggctcgaaacagcgcctaaagtaagagggggagagtgctctgggttccacagggaaccgtcgaaaaaggggtggaagagggacatggtaagggatggacttcgagaccaaaggaagtggcttggggaatcaatctgcgaggttcgcaggtccccaggagggatgcgagaactttttggagaagggattagttctaagacaaggagaaggggaagaacttgggagtcctaggcagaaagcgcgggttgtggggcggggtgaagaccaatcagtgaatgttgtgttggaaacattccttgtgtataaacttttaagctacaataataaagacttgaaggaagttgctctgattgcctttggtccgtttattttctcgtgtctttgaaaaaccaaaaagaactaaacacaaatttctccctggcatccccatagtgactctaggggaaagtagggacgggaaagaacccaggtcctgcaggggtgggggggggctggagatgggcggaggaggaaggagtttccctgggatggcaaatgcacttacac

SEQ ID NO: 21550 - DNA, 2317 bp, Mus musculus
acgacgtgtagttgctttgcagggcatacaccgtgtgcttccttgtcttgtcattaggactgctaaaacttcttacggttccccaaagctttctcgctcaaacatacctgtgtcctgttgctgttgggggggggggggaaatcacagagaaatatcagtatgtatgttcatttctccctagtttatcaaaagaaccttgctgtaagggtaggatggatattaggtttaaaccccaccccatcccagttgaaagatgcccataccactgctgtgtagctgtctgtaaagtatgtggggattttactgtcagtcatgtagggctctggagtgtggcctgcagtgtcccatgtgatgccccagttgtctttttgtatcttttctagtgctactgtctaagagctggagtcacagagctcgaaatggcccctgaaaagcactgagatgttgggcccttcacccctatctcagaaggatgcacgaggcaccatggcatgctaagcccttggcagatcactgttgaaactatttcccaggaatacagatcctggaagtgcagtagctcctgtgacctctgagttactctttctgatggctgttgtctcccctcagccttgggctctgttcttccctgcttttcccacccacttagcaagtgtgattgactcatccagtgaattaagtcttgactgtactcgctcctctcctcctattactccgactttgaatattttagcctgaagagtgtaaatgggtttggtattcatggttgctcttggagcccttctaatgtcacgcgagcagcggtggtccacactgtcccgtgaaggctcagagcctagacagtttccacactccagttttacagcctggggaggtaaacagggctggtgttgcagccatgggtgagctgcggaaaggcttgagaagtgatcccagtgagagtcgagaagttagcctgtggttgacttagcacaccgctctccctccgggccatggaaagtccttacgctggacattcggctggcctcacgagagacaggcctcaagtggtttacctcgaagaacactttttggctagcccgtggctttttagataggagggaaaagtactggagtggaagacagcatgagacccaggaaggtcctccaggctgggagtgagagcaaacggggattcaggcctgtcaggagtgatgcacgcgctcgccttgggaaacgtgtttcctcatctcttgagacactttagtgagctaaagatgttgggggcccatttttactgtgcgggatagattgggccctgctttgcctaagaagtttttccctgtaagatgcacaacagcgtagatccagtagcgtagttatgggtcctgctaaaggttgttactgctgctgggcattcgcacatttctctttccttttcttctctgtccatgagtatgttaaactttgacttgttgcatattcctgtgtgtcctgaaaatacagatttctgtcccgtgccaggtacagtttgtttagtacaggtttgcttgtctttaactgacaggccacagctgacccacgggctacttgaagttagaaaacgtggagatggacggagagaacaaattatcacttggatacggaggaacatgactaggcacattttatgaatactccaaatcctaaattacactgagatctagaccttcatttggcagggtcaggccattggatggtgttgctgtattgtcttgtcgtgtttttaaaatctgtgcactttgtccaaagttgagatttttttttttaaatgtgttgatgatttttacaaagtgatttgttttggacacattaaaggtggtttgagtctcgttttccgtctgtgcgttttgcatgctgggctgagttttgtttgaaagtcttttcagcatctcttatgtaacatgcagtgcttggaaggaagctggagcagccttcgctcagactcggtctcttacgtcgaccctgtttacctttatgaatctcctgtccctttgcactgccacagccctcggaggaagggacagtaaggcggaggcttgccaggggtcacgttacgctgggagccaaataatgtttttctgtaagttaaactaaaatttatagacgttattaatctaataacagccattacgtgggaacataggtaaaaattttatgaaaatatctttcaaaattatttcggggctttctgttcactgtctgtggagcagacatctttcttgaataagttggaaggtggctgtgggagtagtttggaaggagccacatggtcacttacctgacatcctctgtggaa

SEQ ID NO: 21551 - DNA, 1212 bp, Mus musculus
gcgctcatgctgtgtgtgcatgtgtgcgcgctcgcgctgtgtgtgcatgtgtgtgtgtatttcctacatttcggttgtgctgtattatcagttattttaaataatccattttacatatttatttctttttcttttgaaaacagatagccagcaggaaaaatagcctcacggttgtccagtcttcgacatctactaaaataaaagtaccaatccctcaacccgtcgtcgtccctgtgaagaaagacaaacggcagaattcttcacggtttaatgccagcaataatagagagctacaaaaactcccatctttaaaaggtaattgtggcttgtggccaggggagcaaggcagtctccagccctgcgggctgcttgctttggtgatcggttttgtttttgttttctcctgattcggtttctggttggattgggtgctgcttgctttactgcgctaacagttttcattcccgagctctggaggataaatgtctactcgctccatacaccacaagtgcactacagtaagacaactgaaaatcttaaaagctgtgaggaagcggccgtttctttttctcgtggttctctggcttgtctcacaatgccagcctttagaaggggtcactccaggtcatcaccagtgtccaggcagggcttgctcctttaaccatggccagccagatcagtccctcacctgtgaccagccgtgacctagggctcctcacttggagctgctcccattggcacagccgcctctttccaccagaggatggttaaagccttaagtttcctccaggaggcttcagggttgagctacgtaagactttgacaaggagaatggttcaaggaccatggtcagatgggaatgtctgatgagcgctacatattctgagacctaaaactgatacacagagtagctgtcagagtctgtcatacctgaagtttgtaatgacagttggttttataattaatcttggccttcttttttttttttaaagatttatttattattattcattagtacactgtagctgtcttcagatgcaccagaagagggcgtcagatctcattacggatggttgtgagccaccatgtggttgctgggatttgaactcagaaccttcggaagagcagtcagtgctcttaacccctgagccatctctccagccccctaatcttggccttctttagagttgtattcccagtgccacccacagg

SEQ ID NO: 21552 - DNA, 1102 bp, Mus musculus
ctccacacatcttggttagttccttttatctttttaaaaatctgtttttgaaattttttcctttgattcgtatataaataagccacttttgttcttttttgtctgtttcgttctgtttgtttttcaagataagatttctctgtatagctctggctgtcctggagctcattgtgtagacgaggctagcctcaaactcacagagatcctcctgcctcagcctcccagattaaaggtgtgtgccatcactctctggcttcttgcacttttcttaatcagaactaaaaccacatctccctggcctcgtccttgccttctgcatccacctgcacagcagagtgcttgccacatgtttgcagtctgctgtgggcgcttgaaggcgcttgcctgtgtgtgtgtgtttacttacaaacacaaatactataaaagtgcgtttattcacagaaagtttctagtctttttatttcttcagttagtaaggaaaacaagtaaaatgaaagaaatgtgagaaaacagacctttttgtaagtttgtaacgagggatgctctgagctgctggcacctttatgacctacctcatgtggtttatgcattcaggcagtaaacactgggttcagtttcctgcaccttcagtaaccgtgatttaacatttttgggctaggtaagcatttggaaggaggaggcaagcatgtagcgtttgccaccttccagagcttggtgtaggctcatttggtcagttttcaggtgctggggataacaaggcagagcatcttttcctggtgtagcttcagggcggtgtccccgtgttctcccttatcaaggcctggagatgggggcttccttttcttagttcttcagtcctgagcctaagtggaccttttagtcttgtgactgtcagtggtcatttgaaggacattttaattttaaaggttaggccacactcactgagtgactttctgcccctccagacagagccctttctaggttgtcagatgacactgtccagacatcaaagctgtcagatctaggggaggggccgctgtccttttcggagtctggcttaagtctttaccttccgagtctgcaacatgttttctttagaagt

SEQ ID NO: 21553 - DNA, 1165 bp, Mus musculus
tgaattaaggtggaaacaggtgagaaatgagtggaatccacctgtttagatcccagcacagaggcagtgtgtagggaaacccagctactttgtcgggctagtacagaatctacctattgcttaaagataaaaataaataaataaaagacacaacttgattttttaggggtgttactatgggaaatacacattagaacaggcaaaagaagatatttgcactttgaaattagaaaatatttcaaattcacaacagcttggaggctgagggtatagctcagtgattgagcgtttgtctagcatgtgcaaggccctggggtctatccccagcaccagcaaaaataatggtgtgacagttattttcactgtcaccttgacacggtctagaatcccgtgagaagggagtgagcacgggcctggtcagatcagattggcctgtaggtgagtctgtggtgcgggtggtcctgattactgtgttaatggacataagaggacccagcttacaacgggcagcacccaccgttctttacccgaggcatcctggactgcatatgtgtggaaaggggctcagaagaataggagtgcactcgttcttcctctctgctcttgatgtggatgtggctcgccggccgatcaacctcttgctctgacttctgcgtgattataacctgggactataagccaaacaaaccctttctcccctacattgcttttttgtgttcttattttatcatggcaagagaaacaaaaccagacatgtcctcatcatacttgtccccgttgtcttcgttgtcgtcgtcatcatcatcgttgtctggtggttttgagtcctaaagttgttctttagtactaaagttatgaacattttaaaagcaaggcttaggctccagtggccccggccagcttgctctgctgcttggcccaccgtgagtagtggtgaaaggcagagagctttagtcaatcggccacagtggacagaggaacaagtaaagagatccagtgatctccctgtgtatccttaggggtactgacctgaaattcaggtttaaacaggaaaagatttagagcaagtggcaagaggtccacatagttgggctgtcctggcttaggtctggttctggttccgagaggtagtccctatcattacttgaagggctcaatccagttt

SEQ ID NO: 21554 - DNA, 1173 bp, Mus musculus
gaacttagagaaaaatcaagaggctgcccttactgcgggtctttgggcagatgcagttgctatgtttgggcagccagaagtctctcccccatcccatacctgcctctgccgccatcacgcagacctggcctccctgtctgctgctttttctcacccccttttctcccagaccagggcctggcatgtgagtgttgctgcccagaaagtatttgtccattgagtgccttcagaagggttggttgtgactggtgctgtcaatcatgccaagcctgtgatgtcagcagcggccagctgtggggcacacacgcccttttcactgtttaaaggatacctaaccactgtccacctcacccatcttaattcacagtaaaaatcggaggctacgagtgtctcccggccatgtgggttaagcatcgttgtgactgacagcccccactctctcctttcagatgttcctcctgcggatcaagagaagctttttatccagaagctacgccagtgttgtgtcctctttgactttgtctctgacccactgagtgacctgaagtggaaggaagtaaagcgcgctgcgctgagcgagatggtggagtatatcacccacaaccggaacgtgatcacggagcccatttaccccgaggccgtccacatggtgagtgacagcgctcacagcacggccccaagatttggagtatcccaaacacaaaccaagccctcccactcccaccctgcagggtggtggtgagggttaagcgaatgcaaacagctcctctgcctgtcaggagatgtcatctgttcttcccgggagttctttggcttgactttttaacacctccctgttggtgccctcgtgtagttcagaagtaagtgccctgcccacccgtgtgccctcagcaaagagcagatgcccagggtagcaatgcccagggtggtgagcggcaggctcttgctcctccctctactccagctctcacgctgtggacatcgacagttctggaactgtaaggagctgtactgagtatcttcaaagctttgtttgttctggggtggccattatagtcagtcctggagcttcatccgtggcttaagtcaggagtgtagcttcattttcttctatggttattaaatttgttcttatatcagatattaagatccatttcctccattcattgaaga

SEQ ID NO: 21555 - DNA, 1150 bp, Mus musculus
tgagcttcctcttctgccatgcccttcactgaacccctcgtattcgagcctcaacattgagggcaccacctgaccaacccagctcagtcagtcagcaaggtctcaagggaaggagtgaggcttaaagagagaaaagacaattcaacaacattgtagcatgactccagcaagtactgaagcaaatttattttttcccagcctgcttttgtaccattctaagtacatgcaaagaataaggtcagttcttggtcaaggacaaaccaggcataaacaaaggtcccatggtcactatatttggggacttatcaagatgatcaagatacaaagagtatgtatgttcctcagctgtatttttcttgagcttacttccttgtcttagcccaatgtcagatcttcttgcgaatttccttgaagcagccccagggtctctggttccctggggatgccaagagctctccacagcaggtttcccggttccccggggatgccctgacacactcggtgttcgctgccacctaggttgctggcaggtgtacctgtcacagggtcagcagagactgcggcttccttctgggctcaggcctgggtcacagtgacgtggctgaatgtgctgagctcagggttgttggttgcatggacctgtcgccgttcgttcctttttatagaaaagaggagagagtttgagatcagccagcatgccaagtgcactgctcctcctgtgggaagacaaggtgaagagacagccccagcatttgtcactgtggctcctgcataaacgtggtggctggagatctgggcctgcagcattgcttctgctgtcacagtcaggtctgctgcccaaagactgacggagatggaaaagcagttggaagcactgccattttaaccattcctaccctaaatttcttaatttatgtaaaaatggagcagagcccttctgagagtaaattccctaagaggaaagttgaggtcctgaattgctgaattcatgggacactactttctctaaagccttggacacaggaagggaggccttgtgggcagaaagaggtctggctagggcactgtttggatagattggctggctcaggagcccttcgcagcacatggagctctggggttacccagacacctgtgctggatcactaac

SEQ ID NO: 21556 - DNA, 1177 bp, Mus musculus
gtgctttggtgttcctctctcaggcaatcctaaagttcttgtccacttagaactccatgattcatgtagacggcagactgcaggctctaccctcaagtctggtcatggtcccaggggtagcagctaagccatgaaaagcactgtgtgccatttaagaaatagtctgtggttctcactaaataaaagaattccaactgcagttataattatgctaagccacagaattcagcgttaattttgaatgcatgtgtggtttttcttaagtccagtgttttgagcagataaagaatgaattagagaggtgataaagaatgagttagagagttgtgcgtgagcctgatgaagtgccatgtaacttgactcactgttgttttcttcttcttcctagcttgtttatgaatttttcttaagatttttagagtctccagatttccaacccaatatagcaaagaaatatattgatcagaagtttgtattgcaggtaagttcccagccaggcgttcttcggcagccttaaggacagcatggccactgtcactaagtgccgttttatttttcttaaagcttctagagctgtttgacagcgaggatcctcgggagagagattttctaaaaaccaccctgcacagaatctatgggaagttcttaggcctgcgtgcttacatcaggaaacagatcaataatatattttataggtaagtcccccgtgtggttctcatccacccttgctgctgtcacatcaaagatgcggagggaaactgagtcatgtgctcatgtccccaccacgccaccgctcatgctacacacacacacacacacacacacacacccatgtcttactgcattccctacccttgctgggttcctacagagttgtccagttgctcacaatgtagatgcttctgtcccaggcacctgcttgctaccttgttattcctgctcagttccaggcaagacaggaaggaggaggaggcggcaaggaagtcggcagcctttgccttcgaggatctgggaagtagatgaacagtttgagggccagccaaacacagagaggagagcctggcagctggcagacaagacagctttcctatctatgcccagacttgggacttcaggatctaagaatgaccacagacctgcctgtccccacaacccccagctcagaaaggacaaatac

SEQ ID NO: 21557 - DNA, 1906 bp, Mus musculus
aaaaataataatgaatgaaaaaaatcagtgcatctaatgatggaattagaagcaaccctggttccccttggaatactgtcacctcggggtaccagctctggcctccttggctcctctgcagacttgtctgcacagtgggtatagactgtagcaggcaggcagccaagctgggaacattggaccaacttggaggggatgggggagggagggctatgtttaaagtcttgttaaatttttaatttttaggtgtctttagtctcactcttggctagtttttaggtttcttttcacgttacacgtgttgagagccgtggtgtgagacgtgaggaggaccagagagcacaggaaaacgtgactgtggcacgggtgtccccctgctttcgccccctaacctgcctgcgtgcgactcttctctaatacaagtgatgttttcttgtttttcagagagaagctaaaaatgaaagagcgagaagaagcatgggttaaaatagaaaatctagccaaagcgaatccccaggtactaaaaaagagagtaactcgggagtgttgaggctttgcgtgaatgtctgagatagggcctggctccaccccaggaagggaggccaacgtcactaacactgtatgtgcaaatgtccgcaataaaacactttccaactttgtaacttcctcttgtataagtacttatttgccacacgtaacttttaccacagaatcgatttttttctcttctttttaaaagtaagatgtgatgtggtaaagagaacaccaggatgtaacctctaagattgtaatgtcctttcttgctcgaatgtcatagatgctgtcacttgaaccgtgttcctccgttttattctcatacatgagagggatgggggggaggcagatgaagaatgctgaaaactaactgaattctgccctgctcacactaactgttcctctaccctagccgatgcagtgtgctcccgcaaggcgaagccaggcagatggtcctgtctgtcagagctgcaggtgactcagcagcctctgtccagggttggcttttaggctggcagagcctgggacagctttgcagccatagctctttggtgttgcctccgctggtccgaatgatcagttattggggtgttgcctctgctggtccgaatgatcagttattggggtgttgcctctgctgctccgaatgatcaatgttactgggtgtttcttttctccttgttgcgtgtgtctgattataacagccacttgatgaaatgtctgaccttctccacactaagatctctcaggcttctctcagctctccagggaagaaaatatcttactaaacagtgtatttctttttggttgagaagtgtgtattaagtgtgtacataaattattatgtaagttggatgtgggtttttttaatctttgtcatttaataaaaacaatatatgaagatatcagtgtgtattttcctatgagacagcattctagcctgcatccctttgaagaaaggatacttaatgacagtctgttgcggatctgcggttccacctaaaacaagtagctcacatttccctggcagcactttacatgctatagagaagttcttctaaggcttgtagcttaattacagagatctgcacgtatggacagggcttatgtggagagtgggcagaagcaccggcagttgttttaaaactcggcaaaagcctgtgtgggcagggttaggtgactcagccttgctggcattgcactggtggccttgctttgtttggaactttgtttgtttgtttgtttgtttgtttttaatctggccggtggagagccttggaaggcttgctttgcctagaaaatggaaatactctgttgaaaactgcacagagctcccacttacaaatgaagagcgttacggggtcagcactgg

SEQ ID NO: 21558 - DNA, 2535 bp, Mus musculus
gctggccaagcagggggctgggggagtcggtgacagtgtcatcaccatgttgtcaccaccccagcacagccctgagtgagatccaaagtcagagctgtaggaaagcaccctgactgtcaccttctcgtacccagtagaccctgtggtcctctgaaatagggattctgtggtaggtaacaccgatgctgtggcaaatcaaacgcacatggtaaaaggtgtctcctccctttacaaccctgacgctgtccccacgcttgctgtgccagccgcccgtggtggttggttaggtctctcagagatggctcctcgctttcccgttctagctgcctgccgggaaagaggccaacttttgcgctggggccgtccacagtgtttctttcctttggttaatggcacggtcaccatgtcctgcttaccttaatgtctaccgaaagccatatttcatagtctgtggtagaggccagggttccacctcagcgcaagggagggttctgagaagtgcttcctcagcccaccttgaggagaaccgccacgttggaatgacgtgttcatgttagttgcagaatcagtttttcacctacttacacatgatccttcaacaaggctctcgagtggataaagatcacaggatctaagaattccacattggtagaaagtgacagtaaactcagccccttggcctagtgcagcctgcagctgcctgtggcctgactgcgggccgcactgtgtgggcgccctcagtgagcctttctttctgttggaaaaagcacatgtcaccaagctcgcgaggaaaggcgcggtgcccgcgttcgcaccagtctccacatgctgctccggccttcacagaattcttgcatggattaagcttctgttttagatgggatagcacgaggagatacatccttaaacttagtgctttgtcttcttgtcctctcagggtggccagtattttgacttatttatcctgctcaaaagctgcttgaaatgtgtgctgctctctgaacagtggcgagtcttctcttgtctccagcatatatataactcagtgttacatgtcttgatgcataagataggttaaaaaaaaagaagaagaagaaaaatggggcttcttttaaaacctgattttaatcgtggtctcagggatccgtgaaaaagttgtgaaatcagacattgctctctcgcggccttggaggcgggtcccacggggaagaagggcatgtgcagggagggagagccagcacggctagtcaaaaaggcggccccagctgagggtgaacaggttggccacttgggtgagaacacttcctgagaaacttgacaagtacctatccactttaccattatgaaatctataattaaaaaaaaaaagttgagatgccttctccttttgagggaaaaagggtgcttttattgtataaagcagtgtctctgtgttttgatagcccactgtttgaactctcgtctttagctggtagagtctcagatatccctgacgtgtggggcattccgagtgtggtgagaggtcccaagaggctcctttgccctgcgtgaagagcatgctatcagtgtacgggtgattgtgcaaagctcagcgcgggggagcatcttctgctctaggttttatttctgctctttattgaagacaaacattcgccaataaagaaaagggaaaaaaatgttttgagagaaactaattttctttggcaaaagtattacttaaatttttggcctattaaggttcccctagttagtactcggattccccatgctaattgttcagcttgtatgttgttaagacactgttgattctgtaccagactggtttcaaaacaaaaaaagtaccacgttgaaaataaactggtgactgtttttcttcatatggctctagtttggcaccttcactctttccaaaacgtgtctgtgcgccagagatgtcacagttcaagtgtctttctagtgtggctttgtatggcttcctttgaacattgtacatacattgtatctttgttttatggtaataagtaataaaaaatgtagacttcgtattttgtacaaaatgtcctatgtacagaataaaaaaaagttcatagaaacagcaaaaataggttaagtggcacagttatttttctttagaaaatatctgtaactttatgctttagtgaaacgttaagtaccaacatattttttaacattttgtaattcaaaacttttttgttttgacattgtttatgaagaaagacttcatgcacttgccatttaatatgctcttttatctaattttaaagaactctttaaaatggtgtattatatggactaaataaagaacatgtgaattttatcgctctatgaaactaaatttagccatggcgttgggcagtctggttccgactcgctgttactgtcaggtcagggaccagccactccaggggcactggcttgaggtgggaagcaggtgtctgccctgtgtccccctaatgagcatcagctgtgcgttagctcctggtctaggtccttctcagaagccgatcctgaaag

SEQ ID NO: 21559 - DNA, 1221 bp, Mus musculus
atgtatgtacgtgcactatgtgtgttcacggtgccaaactgaggctagaagaaattactgaattctctggacctggaaagttatgatggttgtgagctgccctgtgggtgctgggaaccaaacccaggtcctctgcaaccagccagtattctttgctgctgatcttttttcagcccactctacttccccatcctaccacccaggcagggtttctctgtgtagtcctggttctcctggaacttgtattgtagaccaggctggctttgtactcacagaactccacctgtctctgcctcccaagtgctgggattaaagcttttatacctttatacctggcttcaactgcacccctaagaaaaccaaaaccgagtccattagagatgttgtttgtttgtttgtttgaaataccgtgaatgatttttctgtaactagaatatgttcagcatcaaagtgcatttcatagttaagacctactttacttgattttattacttgacgtgaaaaccgttaaccctctttgtcaacctaggtctgaagcaggcgttggaaacggtgaatgactacaaccctctgatgaaagacttccctctgaatgacttgctgtctgccacggagctggacaagataaggcaggcccttgttgcaattttcacacatctgagaaagatccgcaacacgaagtacccgattcagcgggccctgcgtctcgtggaggccatctccagagacctgagttctcagctgctcaaggtcttgggcactcggaagttgatgcatgtagcctatgaagagtttgaaaaggtaagttgtggtctttaaaaaccaccccgagccagtgagatcactgtgacctggcgagtgacgagccatctcccaactgtacccaggtcatggtggcttgcttcgaagtcttccagacgtgggacgacgagtacgagaagctccaggtgctgctgcgagacatcgtcaagaggaagcgggaggagaacctgaagatggtgtggcgcatcaaccccgctcacaggaagcttcaggcccgcctcgaccagatgaggaagttccgccgccagcacgagcagctgagggctgtcattgtcagggtcctgaggccacaggtgtgtctggcagtcacaggcgctcacagcccttgttttgttgcctccttataattctttgaaagaactgacggcctggtactccatgtttttcctttagttccct

SEQ ID NO: 21560 - DNA, 1104 bp, Mus musculus
gaagcacctgaaccccaagacatgaaagtggccgaggtgctctttgatgctgccgacgccaacgccattgaggaggtgaacctggcctacgagaatgtcaaggaagtcgatggtctggatgtttccaaagaagggacggaagcctgggaggccgcgatgaagagatacgatgagaggatcgaccgtgtggagacccgcatcaccgcccgcctccgagatcagctcggcacggccaagaatgccaatgagatgttcaggattttctccaggttcaatgcactgttcgtccgcccacacatccgaggggccattcgtgaataccagacccagctgatccaacgtgtgaaagatgacatcgaatctctgcacgacaagttcaaggtccagtacccgcaaagccaagcttgtaaaatgagtcatgtccgtgacctgccccccgtgtcagggtctatcatctgggctaaacagatcgacagacagctcactgcctacatgaagcgagtggaggatgtcctgggcaaaggctgggagaaccacgtggaagggcagaagctgaagcaggatggagacagcttccgaatgaagctcaacacccaggagatcttcgatgactgggcgaggaaggttcagcagcgcaaccttggtgtctccgggcgcatcttcaccattgagagcgctcgcgtgcggggccgcactgggaatgtcctcaagctaaaggtgaacttccttccagagatcataacactctccaaagaagtccggaacctcaagtggcttggcttccgagtgccacttgcaattgtgaacaaggctcaccaagccaaccagctctacccatttgccatctcgctgattgaaagcgtccggacttacgagcgcacctgtgagaaggtggaggagcgcaataccatttccctgctagtggccggcctaaagaaggaggtgcaggccttaatcgcagaaggcatcgcgttggtgtgggagtcctacaagctcgacccctacgtgcagcgcctggcagagacggttttcaacttccaggagaaggtgagttgactgaccttcagcatttctggttggcctagtcaccaagtcagggacgtg

SEQ ID NO: 21561 - DNA, 1231 bp, Mus musculus
tcaggctgcaggagcggtagttctcccgcagcacatccctagggagttacacggcatagggcccaccggtgccgaagacatgcagaatgcagaggtcctgtctgtcacctcgaggaatgtagcctggctctaaatagagaaggctttcttccacttggtgaagaaaaatgtcttcatctccaaactgcggtgttcctagtttcacctctagagctaacgtcaagctctacaaaagagcacttgaagtgagttttacatcataaggaacagctaccaacagcttgcccgcatctgcaggatgcagtatggtattaagtctccttgtcacttaagagctgaggagactggcagttcacaagtctcaaaggtgcagagcacagctctgatcctgctgcacacgtcacacacagaggtagacactgactggcgcacctgcccccttctcattctgtactttgtgagccaaccttcaaaggcagccactcagtgaccccactttctctgtagattgaaaggatactgggcgtccgcctgcaagctggccttcgagcttggacccaggttcttcttggacaagctgaggataaagcagaagtcgacatggatacagatgctccacaagtcagtcacaagcctggtggagagcccaagatcaaagtgagtctctcccgtggcactcacctgggtatagcaaagcaagtccctccccttggaactgtctgtggacgctgagacaagagggtcacacctcaaggccagcttagcataagcagtgagatcctgctttaaaaaggtgccaggcggggaagctctgggctgaggctgggggttagaggactggcttagaatgcaggaggcctagactagatccctggcacggaggctggcactgcatgcgagtgcctgtgaagaagtcacctaacagtggaagagcctgatagacaccatttaaccagttggtgaatgttagcaccgccagtggtgtgagtggctccccgtgtttgtgacatcttgtggtgacaagggcatttcacatctgccctttctccagaaaacttatgagaaaaatagaggctcacagaaaatcagtctgcggagcatcgagcagagcagacaatgccacaggctggggtgggttgaggagactgagtgcagggtgaggggaggcggccatccagtgtcagcgaagctgctgaagcgccttgtgctttctttacacatcttctgtcaa

SEQ ID NO: 21562 - DNA, 1174 bp, Mus musculus
ttgtaccctatgtgtggcttctgtggttcatagaaattgaaagtttgttttagagccctcaaaaggatgtagctcagtaggtagagtgcttgcccggcatgcacgaagccttaggttcagtccccagagccctgggtgatggaggcaggtgggcttgtgtaacgtcaaagctagccttggataaattcatgactgtgtcttagaagaaaaagtaaaaaacagcatatggggtgtgtgtggaatgtgtgtctgtgtgtctgtgtatgtgacttcattctcctgtgtctcctgacagcttcgacaaaacctagacggcctcttgaaccagctgaagaacttccctgcgaggcttcggcagtatgcttcctatgagtttgttcagaggctgctgaaaggctacatgaaggtaggggactgccacacgtgggtgttggatgtcttcaaaaggcacctgctcacgtaactctgtccctgaacagataaacatgttggtaattgaactgaaatcagaagcactcaaagaccggcactggaaacagctgatgaagaggcttcatgttaactgggtggtttctgagctgacgctgggccagatctgggacgtggaccttcagaagaacgaagctgtcgtcaaggatgtgctgctggtggcacaaggcgagatggccttggaagaatttttgaagcaggcaagtgataggagagggtatcaggccgttgtatggatctgaccatgtaaaacgaagctttgtcatctacagttatctctgtcccctaatgtttgctgcccctgcaaatgtttgagtgtttatttgtattgctaacggcctcttcctggttccgctcagatacgagaagtgtggaacacatacgaactagacttggtcaactatcagaacaaatgccgcctcatccgaggctgggatgacctcttcaacaaggtcaaggagcatatcaacagcgtctctgccatgaaactctctccctattacaaggtagggcggcagcgcagggtgctcttccttatacctcagatgcctagttatagttccgtaaagtgtgctcctaatttgtcattttcagtgagctccggcatatctgagtgaaaaggtcggcagttaagttctgtcctcttgtgtgcccactaggtttttgaagaagatgccctgagctg

SEQ ID NO: 21563 - DNA, 2222 bp, Mus musculus
ttgctcagttttgacttgaaggattttgatggccaacgcactgagccctctgcctctccgtgcccatctctaacgctgcctgaactcccagttttccgccttaatcttactaagcatcactaagctcattttctctgtaagccacttgaatccctccggggttagctttgctgtctcctgagtgctctctcctcctctccaaagagtttgcgtagggtgagtggagcagatgctgccaaaatgacttaagtgactggcattgcgttctcccacgtcttactgtaacgagtctttctccaggccctggcagatgtttgtatgagatctgagttcagacctgaggtgtcccttgcagctgcttcctcctgtacgtaggcagtttgctcggtcaccctctgtacaccaggcagtagcagccgggttgtttgatttcaggttctactttgtgggtgatgaggatttgcttgagatcattgggaatagcaagaacgtggctaagttgcagaagcacttcaagaaaatgttcgccggcgtttccagcatcatcttaaatgaggataactctgtggtcctcggcatctcatcccgagaaggggaggaggtaagcgcagtgcctttgtggcttagaaacttcgctcacacgaggacgccttcattcttatcatgtctttttatcttcaggttatgtttaaaactccagtgtccatcactgaacaccccaaaatcaatgagtggctcactctggtggaaaaggagatgagagtcaccttggctaaacttctggcagagtctgttacagaagtggagatttttggaaaagcaacttctattgacccaaatacctacattacttggattgataaataccaggtaatcttaaatagaagcaagcagcctgaagatcttagctctcaacaacttgaagatgatggtcttggctaattggtggttggttggttggttggttggttggtttgtttatttcccacccattgtccccctggtttcatccctatcactagatagaagagaaaggatagaggggagggagagcgagagatctctgaatcttaatttcttcccttttgtttctttgagcgtaactactagcaaaccgcaactgatctctttaaatgaccgacaacccctcttggggcccttatgtttatataccctctcaaaagttcccagaattccaaatgttgtacaatcgtagaaactgtctgcaactgacacaggcatgagcacaaggcaaatcatagtcagttactgcagacagtccgaagcagccccacgccccacacctgggattaaaacgaaagcacattcccataatgtttgtgtgtttgtaaagaaaccaacatcccaaaattgtccctactaatgaccccttgggaaccaggcggtggcacctatactcaggctcttggggaggggggtgagggcagtgagataggaaggccagttgagtggtgagttcagaaccagtcaaggagcagcgatgctctgtctcagaaagcaaccctgtctctctcttctttcctaggcccagctagtggtattgtcagcccagatagcctggtccgagaacgtggagaatgcgctgagcaacgttgggggaggtggtgatgtggggcccttgcagtctgtgctgagcaatgtggaggtcacactcaacgtcttagcggactctgtcctcatggagcagcctcctctccggagacggaagctggagcacttggtaagcctcctgcctgagccccgtcttaactctcagcccacgcagtgagagggaaagatgctttaaaatgtgccgtttgtatcaaaagaaaaataggctgggagttggggtccacacctgtaaccttggctttgggaagtgaaggcgagggaagggcatcaggctgtctaggccagcctggcttacgtgaggcttttgaccacggtaatgtgtggacacaggtattccacgtgcgcctgcctggtgtttggttctgttcctctttaagagtaatatatgactatgtaagagaagggaagggaccagctttggtttgttgttgttgtttttgtttttaaagttttttcgaaacagggtttctctgtgtagccttggctatcctgcaacccactctgtagaccaggctggccttgaactcacagagatttgcctgcctctgtctcccaagtgctggtattaaaggcatgcgccagcaccaccg

SEQ ID NO: 21564 - DNA, 1106 bp, Mus musculus
gcatcctcttcccagaggtgtggctgcagcagggtgggggcacaaggtcggcagcctgtagggtgcacctgacgaagctgctctgtcacattcagctgcccagggctgttacttacggagggttcttggcttttgtgttttctgtcactctgagtctgcgatactgtcccatggataacttttccagtgtcccttctggtgaagttctgtttgcagtttggaaggtttgctgctggtcactgcaactgggcctgaagcctgtgtcaacttaacagatagtctgcagacccagacagcacaatgttgctttagcttatggcaaatttctacttcctcagatcacagagctggttcaccaaagagacgttaccaggtccttgatcaaaagcaagatcgacaacgccaaatctttcgaatggctcagccagatgcgattttactttgaccctaagcaaacggacgtgttacagcagctgtccattcagatggccaatgccaagtttaactacggctttgagtacctgggtgttcaagacaagctggttcagacgcccctcactgaccgttgctatttgacaatgacacaagctttggaggccaggcttgggggctccccatttggtaagttacttcacagacctggacagatagagtcatggcagatcttaattttacacacaaacctgatggtttggatgtgtttatttattccatggttttacattctaaaatctttaatttccttgcatttattatagcaattttaaaaataaatattatggcttttttcaaaccaagaacttagtaggtaatggacttgagtactaaattatttttctcccaaataataggacctgctggaaccggaaagacagagtccgtcaaagccctcggccatcagctggggcggttcgtcttagttttcaactgtgacgaaacctttgatttccaggtaagaattatttcacattgtctaacgccatcaagcttctcgtctcacaaccccagtgcagacaggccttccctggtgctgtccgacctgcagcagagcctagcacacattgaagcctgtctgtgtctgtatcggagactgggtttccttgtat

SEQ ID NO: 21565 - DNA, 1126 bp, Mus musculus
tttgcagtggtaatgttcttatgtaaatgaggaatggatagctaaatgtccattttgggaggtggatagtattcccattttgaagggagatgttgtaggtttcagaaagatgtgacttgctcagagttggacaagtcagcacagctcagactacaaagatgtctctccacaggccagaagcccacagtggttttgatggctctagctcccagtgaggcctctctgctttgtgtgtagattgcttaccttacccatcatctagcatgtgcagagaggaggagagcaatggttggaagggtggactctagtaacttactcctacaaggaccccagtcctctctggtcagtctcccttcattttacctcctgtgggacctatgtccaagtacagtaacattggggctaggacatggaggaatgacgttgggaaggggcacacgtcagtccataacaaacgatttaagcctctttggttctttttactctaggcgatgggacgtatctttgtggggctttgccaagtgggcgcgtggggctgctttgatgagtttaaccgcctggaggagcggatgctctcagctgtatcccagcaggtgcagtgcatacaagaggcactgcgggagcattccaaccccaactacgacaagagtaagacttctgtggggtttgtttcgttctctttttgtaaccactgaggagctggagggaaatgtgatatgagctcatttgcttacttccatagcaagcactgagtggtgggtggaggtgagtgtgggctgggtgatttgggatcagtttgcttcttgatggtggcagcagcagtgccagagcctgtgggtcctggagcagagcatcctttgcaagaccaaggccacacacagcacattcccttccacaaacggaccccacagtggctcttgggaggcttttccttccagcgtcactggaaagccagcctccttagcacccatttgacctcagtgctcccgccatgtagtctgtggagtcctctgtcagcattggagtagctgttctggaaggctccaggggtggccttgctctcgtcacctgacagagcccaggcacaagtgatagaggtaggcttggtgccagaagatgtcctggc

SEQ ID NO: 21566 - DNA, 1100 bp, Mus musculus
tttgggcttcgggctttgaagagtgtgcttgtaagtgcaggcaatgtgaagagggagaggatccagaagataaagagggagaaagaagaacggggggaagcagttgatgaaggagagattgctgagaacctacctgagcaggaggtttgtacagaacgctgtctgtttccccttcactctgtagaccaggtcaatggaaattgaacccactatgtactatgtagcctaggctagccttgaacctcatggctgtcctcatcctcccaagcattgagatcacggtacccaccaccacaccccgcttacaagtgaaaacatgcatgttctgaaattccccctgagttctcagtatgatcgatccctgtctgggcttcttcctcccaccccgtagattctgatccagagtgtctgcgagacaatggtgcccaagctggtggcagaagatatcccgctgctcttcagcctcctgtctgacgtgtttcctggagtccagtaccaccgtggggagatgacagcccttcgagaagagctgaagaaagtgtgtcaggagatgtacttgacatatggcgacggagaagaagttggcgggatgtgggttgaaaaggtactgtaactgctgctcccgcccatctgaggagaccggttcaccgaggctagtgtgggcatagagtgacttagatttgcccaaggcttgcttgaatgtccctttactaacacccaggtaggaaaacatgtctcttacatgtagcactacctctaaaaatgctgactaaaagtatgattgtaatgaagtgcttatgcctttaaggatttcccaggccgagagttaagtctcagttgacagtcagctgcacttcctttctctgctgttatttacactgcgtgtgttgacctgagaactctatatgaaatagtcctttgcatttgctcttttctcatccttggagaatcttcggatgtttccgtatacagagagcatagaagccgtctatcccgctagccccgctgcctccctgtgtaggatgcctttgagatgtggttcccgcagattcttgccgttcctggctttagggattaagacattccatttcttgctcagc

SEQ ID NO: 21567 - DNA, 1365 bp, Mus musculus
cggagggtcagacctaaccctgccgtcagtcttccatttggttcagatttcatcaaaattgaatttcacttatccatagcgctatctggtttacgccatcctctggtccttatctggagacagccggctgaagatgagagcagagctgggcgagtacatccggaggatcaccactgtgccgctgcccactgcgcccaacgtccccatcattgactatgaggtaaggtggtgggacacagcctgatttgtcctagagcagcagcctgtccggaacttggccttatcttgtagtgtctggcttcaccagacagcaggaaatgtggatgagcttgtcctgcctgtactttggagatttaaactgatcaaactaggtagtcctggaagacaggaggcacggaagccacggagtgacttatccttgtctgtatgtaggtgtccatcagtggagagtggtcgccgtggcaggccaaggtgcctcagattgaagtggagacacacaaggtggcagccccagatgtcgtcgtgccaaccttagatacagtccgccatgaagctctcctgtacacttggctggctgaacacaaacccctggtcttatgtggccctcctgggtctggcaagaccatgacactcttcagtgctctccgggccttgcctgacatggaggtaagagcggcagatggcataaacaagagctttggggtgaagtgtgggcttgaacattgaagctattttgtgtttacttaccaaaggttgtgggcctaaacttctcaagtgccactacaccagagctgttgctgaagacgtttgaccactactgcgaatacaggcgtacacctaacggtgttgtcttggctcctgttcagcttggaaagtggctggtcttgttctgtgatgaaatcaacttgcccgatatggataaatacggcacacagagagtcatctccttcatcagacaggtgtgtgccagggctgctcctccccactgcagcgctcatccacagcttgctaactttacacaatcttctccttcagatggtggagcatggaggcttctatcgtacctcagaccaaacgtgggtaaagctagagagaatccagtttgttggggcttgcaatccacccactgaccctgggagaaagcccctctcacacaggtaagcaactccatggacttctgcccactgtgccacatgtgtgcacatgcatatcacactggccaggtgtgtgggtgagtaaaagaggttcctgcaaacctgacaacctgagttcaacccccaggactcaaaggggagaaagttgtcctctgacttccagaagcatagggggggggaacacacacacacgtgtatgttcatgtatatg

SEQ ID NO: 21568 - DNA, 1598 bp, Mus musculus
tggcaccagttagcatcctgcaacctccagctagaactgggctcatctctctcctgccattggcatctagagggcaggcctgtgtctgcctggtctttgtccattagccatggcatacagcaactgctcaccaaatgctttgatacacaaattcaagttcagatttggtgaaaatgttgtaagcaccgtcctagaaaagccatgcacagccaggcggtggtggcgcacgcctttagtcacagcactcagggaggcagaggcacgcggatttcttagttcgaggccagcctggtctacagagtgagttccaggacagccagggctacacagagaaaccctgtctcaaaaaaaaaaaaaaaaaaagccaatgggaagcgaggcctacaggcctgaaaatgtatcacctctgatgtttcagaatattccgacaacctcaaggccatctgcttctgattggtgttagtggagctggaaaaaccaccctgtctcgctttgtcgcctggatgaatggcttgagtgtataccagattaaggtgggtctgttaggtggcatcttagtcccagagatggggatcttgattctgcatgcagctgtcgaatgaggaaagctttaactcgcggctggttctgtaggtccacaggaagtacactggggaagacttcgatgaagatcttaggacagtgctgagacggtctggctgtaaaaatgaaaagatagcattcataatggatgagtccaacgtcttagattccggattcctggaacgaatgaatacccttctggctaatggcgaggtaagggagcttgcgtgtgttgcactgtgtcacatggcacctcatcgagaggtgaggaggcacagtgaggctgttccgtccccaggttcctgggctctttgaaggggatgagtatgccacgctgatgacacagtgcaaagagggggcccagaaggaggggctcatgctggactcccacgaggagctctacaagtggttcaccagccaggtgatccgcaacctgcacgtggtcttcaccatgaacccgtcctcagaggggctcaaggacagggcggccacctcaccagcccttttcaacaggtaacgctgcccttgctggtcccgggtctgaggcctggactccatcgagggtcactcactgttaggatcaggtttgagatgtgggcatctttttcaggtgtgtgctgaactggtttggtgactggtccactgaagcactgtatcaagtcggcaaagaattcaccagtaagatggacctggagaagccgaactatatagtgcctgactacatgccagttgtgtatgataaactgccgcagcccccaacacaccgggaagccattgtgaacagctgtgtgtttgtccatcagactcttcaccaggtgtgtgcaatttggggtgcatcacaaagagccacgctgtgttcttaagactagacccaggggagcttcccacctgaccctgtaccatcccgacaaagcagatgctcttccacacctcttcttgacacccattctcgtcagcagtcttttcttcccttcactctaccttctccgcccaggcctgttccctccagagcagga

SEQ ID NO: 21569 - DNA, 2003 bp, Mus musculus
caggcagttctgagtttgaggccagcctagtcacagcctaggctgtgctgcttaggggctgatcacttacctggctggctaaaaacaacattagtgctgctcttttgtgttggggctttttgttggtggtagtggggttttccctgggtcactctgcctcccaggctgcccttgaacttggggtcctccttcctcggcttcctgggtgctggggttatagtcttgtaccatacatttccaatactttgtttggtccttcctgacttgaagtcttgaggaagtgtcactgtctcagtgacttgggtgtgcgaccatggccagtggtgactagcttgctggtcactggtcatcctaaccccgttcctaaaaggccttcggaatgctggagcagagcgcccatgttgggctgtggttttccatgcaggtggatatgaaggataacttttctgttgagtaataaaaagtattttactactgcatttcagttttgaaaggtgctggcttctgtttggaacagctgtagattgtagcagattattgaggcttgcgcaggcctcagcctgtctgtggcttggggttgctatctgcctcagaaagcaaaaatggaggctttatcttctaggagaacaagtcatcttctctgaaaagttcccctctcctatatgtgttaaaagagaaaacagccgggtgcggtggcgggaggcaagggtaggtggaactctgtgagttcaaagccagcctgatctacagagtgagttccaggacagctagcctacatagggaggacactgtctcaaaaagacaaaaataaagtaaaattaaaattaaaaatagaatgagaaaattactgttgttggttggaaatgtaattcttgtttgtttggttttatttttgttaaactaatacaatttattttaaaatacacaactttaaaatacacaactcagtatttacattttttaagtcatcaaaataatttatgagttaactgcctcttatatatacatgaagcttcttctgaagctaaaagtaatattcactcagccagtttttaaaatctatttggaatattaaacatgatagaagtagaagaaaatctcttatgaagtcttctatgaaaggaaattatgacaagtttctgatcagacagaaaccgttccatcaccagtggagaataggcagcgtacctggcttcatagaatgggaaatgtagttcttgaaactatgcagagtgtttccaaggaacagcttgccttagcctgggggaggtcagggatgctgtctagcagactcggcccttctccagcctctctgagtggagcgggagccctggtggtcatggttggtcctcacttggatgctgtctgtctcccccatcccacgcctgctgagcagctgtgaagtccatcaagaagcagcacctggtggaggtgaggtccatggccaaccctcctgcagctgtgaagctggctctggagtccatctgcctgctgcttggtgagagcaccacggactggaagcagatccgctccatcatcatgagagagaacttcatccccaccatcgtcaacttctcggctgaggagatcaggtgaggctgtcgctgcagctgtgggggaggcgtgagcacatctgggagaggctctgcttgttgtactctggcatgtcatctaccagacgggaacgtggtcacactcatcccactggtgccttttcagaatgcctgagagagaaagctagcattctcctctgcatacgtttttgatatcacttctgccagcggtcagttaaatcctcccgagctgtgagtgcttgccccagccgagcagggctcttccatctgttgcaccaggactggctggagttactgtagtgaggagggcagagccagtgtgcctgtcctcgttggccctgtcagcttcctctgagaaccagggcacagcagcatcgtacgtgctagccctttacttgtcttgcatggaaacacatttttattctgtgc

SEQ ID NO: 21570 - DNA, 1132 bp, Mus musculus
gccagcgctgcaggtgagaggccacggctctgtcacttggtttctacttgctcagtgctgctgctgtggcgattgactgggttttctgtttgggtttggacttagttactttttgttttgttttgtttttttttaaggttcatttacattattttttttcccacatctgtgtgtgtctgttgtggatgtgtgcacatgagtgcaagtaattgaggagcccaggaagggctcagacttcctgaagctggagtgcaggaagcggggagctccctgaatgagtgtttgggaaggccttgccttgctcctcactgctgagccggtcctctaccccccacaggcttgtgagagagagagtctactttataacccaggctgcttcagcctccgcacgccagggtcacaagcacaagccaccatcctggtttctgtttatgtggctacactaaggcatgggtgtcattacggcatgccacacatttcaccctgtgctttgccttcccagctcaattatgcagacatgttaaagcgagtggagcccctgaggaatgagctgcagaagctggaagatgacgccaaggacaaccagcagaaagccaatgaggtggagcagatgatcagggacctggaagccagcattgcccgctacaaggaggagtacgctgtcctcatctctgaggcccaggccatcaaggcagacctggcagctgtggaagcaaaggtcagccttcctgccaccccatagtctccatagttacctgcgggaagccaaggtcaacagtgctgatgggctcagcagcattgggcttgctgaggcagtgagcttgggtgtctgtgtctctgggtatacgtgtatgtcgtgtgtgtgtgtgtgtgtgtgtgtgtgtgtgtgtctcgcagtcctggctttgcactcagtacattggcttgcactcacttcctccttactagccagcctgccttccctcctggccacacccagctggtcctctcctcaggctaaaagttagcctctgcctttggctggtactctgaagagatcccagcacctgggccgcttagtgtccaccacagtctcgcctcgccaggactctggacggtctgagtgcttttagtcctcctcaggccctgcaca

SEQ ID NO: 21571 - DNA, 1200 bp, Mus musculus
ggtaagaggcactcaaagagaagagtcggcctgggcacagttgcgctggcacagtctgacagtcacaggagatggataaccagtgtcctctttcagttccgcacagacattgcaaggacggagtacctctccaatgctgacgaacgcctccgctggcaggccagctctctgcctgccgacgacctgtgcacagagaatgccatcatgctaaaacgattcaataggtgtgtgctcttaggccgaaggtgcagctagagattggtgtgggcgtcctgttaaattgtactcacacagcttgtttgaagaaagggaaggagaagtggttgtggggaggcagtgctaagaggtcagcgtttgtctttacatcttagtgagttctgcttaccacagcttttccgggagatatcttgatttaagtcgcatctgtttaggagtctggcagtgtgtagagattgcctgtctggagtaatggtctcttcccatccgatcaggagactgactttcctgatggagctttgacctaatcacatgtcactttaccctcaggtacccgctgatcatcgacccctccggacaggccacagaattcatcatgaatgaatataaggaccggaagatcacaaggaccagcttcttagatgatgccttccggaagaatttggagagtgctctgagatttggcaatccccttcttgtccaggtttgtgtctgtgtttgaattgtcactcctcctaggcgcatctgtggttgctgtgaagtaaatggaaattacatagcacaaacaccagtagaatttatttgaactttgtatttgaatggggtttgatgctaaaacaaacacacaaacaaaaaaaaaagccaggcctggtggtgcacgcctttaatcccagcactcagaagacagaggcaggaagatttcttaagtttaaggccaggctagtctacacagagtgctccaaaatagccataaaaagatcctgtctcaaaaccaatgaccaggcagtggtaatgcacatctttagggaggcagaggtaggtacatctctgagttcaaggccattctggtctacagagcgagtttaggccaaccagggctacacagagaaagcctgtctggaaaaaactgggtttttgtttggtgctggggtggaacccgggcctcacactacaagaaaagtgttctgccactcagtcacatcc

SEQ ID NO: 21572 - DNA, 1101 bp, Mus musculus
taaagcagaaaggccagacgtggacgagaagcgctccgacctcctgaaactgcaaggtgtgcctctggtccctggcttcccaaccgagttgggtagcaggctgagctccggagggtgagggtgacactgctccccagtggcagagtgacacaaatctgtcttgtcacaggggagttccaactccgtttacggcagcttgaaaagtctctgctccaagctctgaatgaggtaaaaggccgcattctggatgacgacaccatcattacaaccctggagaatctgaagcgggaagctgccgaggttaccagaaaggtggaggagacagatattgtcatgcaggaggtggagaccgtgtcccagcagtacctgccgctgtccactgcctgcagcagcatctacttcactatggagtccttgaagcaggtgaggccattggcacagcagctctggttcccagctgtggcccaaggcacactctgatggtcacatggcttcctccaggttcacttcctgtaccagtactctctgcagttcttcctggacatctaccacaacgtgctgtatgagaaccccaacctgaagggtgccaccgatcacacacagcgcctctccatcataaccaaggacctcttccaggtagagcgtataggagcttgcttctgtctggtgcaagggtgtggaagtgtggcctccagaccaccaccatcccctctctctcgcttcccaggtggcctttaaccgagtggctcgaggcatgctgcaccaggaccacatcaccttcgccatgctgctagcgaggatcaagctgaaaggcaccgtggggtgaggcaggctgctcagcagtgatgtggctctgcgggctgccctagcatgcattctgtgtaaaggcacctgcctgacctgtcccccacttcacagggagcccacctatgatgcagagttccagcacttcctcagagggaaggagattgtgctgagtgctggctccacccccaaaatccagggcctgaccgtagagcaggcagaagctgtcgtgaggttgagctgtctgcctgcatttaaagatctgattgccaaggtgcaggcagatgaggtaagtgt

SEQ ID NO: 21573 - DNA, 1099 bp, Mus musculus
acgacattggaacaaagacagacgctccctgggtccaagagaaacaggaggctggggtccgagctggatctcgggggcttcgtgcctggctgagctggtgctctggtggagatgtcagcacctttaccctcccttgccacgcctcgtttcagctcccattgggcaggccatccaccgcctgctcctgattcaagccttccgacccgaccgcctgttggccatggcccacatgtttgtttccacaaacctcggagagtccttcatgtccatcatggagcagcctctcgacctcacccacattgtgggcacagaggtaatggatgtcctcgtgccccatccctgctccccatgcaccctgtgatatagcccagacacactgcttcttggctgcagtcttccccgagccaacactaccctcaggccttctcctgacaggtcctgtcttataacccgtcatctggggtgtgccatgtcatttacaggtgaagccaaacacacctgtcctgatgtgctctgtgcctgggtatgatgccagcggacatgttgaggacctcgcagcagagcagaacacgcagatcacgtctattgccatcggtaaggatgtgtgctggtttcgtgaacaccgggcagcctggaagcataaggctgcctgccgtggttcacacttgtcttccttgtctcaggctcagcagaaggctttaaccaagcagataaggccatcaacaccgccgtgaagtcaggcaggtgggtgatgttgaagaacgtgcacctggccccgggctggctgatgcagctggagaagaagctgcactccctgcagccccacgcctgcttccgacttttcctcaccatggagatcaaccccaaggtgagctgagggtgctggtgcctctgtcaagcctttatcagaaccagtgggtcagctgggtgtggtcacatgtctgcaaccccagaacttgtgatgctgggacaggaggattgctgcaagcttgaggtcaaccacacattgtctctccaaaataaaagaagacatcaatcacagagactaccttctccctcaggtgcccgtgaacctgctccgtgctggtcggatctttgt

SEQ ID NO: 21574 - DNA, 1426 bp, Mus musculus
agaggtggctcagcggttaagagcactgactgtccttccagaggtcctgagttcagttcccagcaaccacatgggggctcacaaccatctgtaatgggatccgatgcactctactggtgtgcatgaagagagcaatggtgtgctcatacatataataaataaataaaagccaatcttctagaaacctgtctaaattcaagggccattctgccaatccggatctttagaaagctaggtgctttggtcagccatattgcttgattctggtgctgcctgcgctgccggtcagatggttgaagggtgggggtggcttgttctgcagatctttgcttctgaagtaggatctggtttccttagacaaacacatgctttctgacgaatctgtctgtggtcattttcttcatctagtctccaaatgagcgcgcccgcttgtatttcctgctggcttggttccatgccatcatccaagagcgcctgcgctatgctccactggggtggtcaaagaagtacgaatttggagaatctgaccttcgatcagcttgtgacacggtggacacgtggctggacgacacagccaaggcaagttaggctacatcacccatcccgtgatgggggcagacagtggatctgaactcaagggagggctgatactttgtagcagccagaactagactgcagcagaaagctggcccctccagggtacacatgtaacccagcctctgtcctccccagggccggcagaacatctcaccggataagatcccatggtctgccctgaagaccctgatggcgcagtccatctatggtgggcgggtggacaatgagttcgaccagcgtctgctcaacaccttcctggagcggctgttcaccacccgcagcttcgacagtgaattcaagctggcgtgcaaggttgacgggcacaaggacatccagatgcctgatggtatcaggtgcggccgcatgtgggaacagaagtcaggcttgggggaggggtgtttggggggaaagcgtgtttggagccacagtctaccggactctgattccaaatgtcctgctttctcaggcgagaggagtttgtgcagtgggtggagctgctgcctgacgcccagacaccctcatggctgggcctccccaacaatgctgaaagggtcctgcttaccacccaaggtgggtagtgagtcccctcactcctggacccctgcccaccctaagccttgctggaagggcttgttcatggggagtcctgaaaagaaggtttgagggctagctttagttcaggagttggaagcactgatggaggcttggtggtatgcaggctgtgccctagcctggagccaaaggcagaaaaccgtggagttcaacatccagtctacacagcatgcctcaaacaacacagcataccttgtattaagtcagttttactttt

SEQ ID NO: 21575 - DNA, 1237 bp, Mus musculus
ctgtggggttggatgcagtctctccagcacacaggctgattggttctcagtgctggtgtcacttgacccagcgcttccctaagccctgtacccatcaacactgtcaagaaccagggcattgcccagcttctccacctttctttgcacagtccagagagcagggagcctcagcagcctgggcatcaattcccaagtgtgagggacaggcctagcaccagtgtgcttttagtaacgtggcatttgtgtgagcagagttcagaagagtcccagtggccatcacaaacccctagcagggtctgcctttaggctgagtgaggcttctgaggcctgcaggctacagcctcacagcacacaaccaggccattgggtctggctttgtcttaattgccctggggtagacgtgtggcacgaggacagcctacaggctgccgtggtgagctgatggtcaaacagctcttggcctgtccactgaagtcctccccacccgggcctggcctaggcgtggacatgatcagcaagatgctgaagatgcagatgctggaggacgaggatgacctggcctacgcagagacggagaagaaggcaaggacggactccacctccgatggccgtccagcctggatgaggacactgcacaccacggcgtccaactggctgcacctcatcccacagacactgagccccctgaagcgcaccgtggagaacatcaaggtagctgggctgggctcagcgtgctgctccccaggcaggcagatctctgagttcgaggctagcttggtctacagagtgagttccaggatagccagggctatatagagaaaccctgtctcgaaaacccaaaatacaaaaaaaaaagaatggccaccgctttaattaaactctttgaaagctgtgatctgagaggggcagagaaattcatcaggccagggccacactgcactctggccagctcccaaaaaggtctggtcaaaagctctggtgctgctcccaggtgtgccttgtctctgcacagagcccgtccttagccctcttctctctggctttaggatcctttgtttaggttctttgagagagaagtaaagatgggggccaagttactccaagatgtgcgccaagatcttgctgacgtcgttcaagtgtgcgaggggaaaaagaagcagacaaactacctgcgcacgctcatcaatgagctggtgaaaggtgctgatggggtgtgcggctgggagctggtctgcca

SEQ ID NO: 21576 - DNA, 1391 bp, Mus musculus
gtcaatgtcaccgcctcacagagtgccacccttgatgcctgcagctttggagtcacaggtgagctggcgtctgatctctcagcctggcctttctgtgaaacctgtttccaaatgaatgtacccaaagtgtctgggcagagccgcccagctgagcctgtgggtgtcctggaagccgagctgtgtggctctgtatggcttcagccccttctccacatctcctcacaggtctgaagctccaaggggccacgtgcagcaacaacaagctatcactctccaatgccatctccacagtcctccccctcacacagctgcgctgggtgaaacaaacaagcgccgagaagaaggccagcgtggtaagtgtcgtggcctcgctctttggctctgccgtgctgggactctacttgtgtgcaaacaactgcaccccagccctggacccccatgggagcttgtccctagagctgatgaacagtaaagtccctctgtctgtctcacaggtgaccttacctgtctacctgaacttcacccgggcagacctcatcttcaccgtggactttgaaattgctacaaaggaagatcctcgcagcttctatgagcgtggagttgccgttctgtgcactgagtaaagctagacttttctccagtcctctttctggaataggaaactcccaatatttaaccttcattcatccttaacggtgtggaagggttgatggactggaaagcaagtggttggttcgcgttggcgggtgacaggtgctgcggttggagacggtgggatgggagaagagaagagtgcgctgtccgagggctgaccgaatggctgggtttagtaaataaaacactaagcatgacgggctcccgcctcttgccgctctgctcagtctgctgtgggaatccttgcgtcccagcccacctcacctttgtcaccgtggtcacagatgcagaagcaacagggtgagaccaggaaagctgcacctcctccctgaggcctggcagcaactctgttcgtgactgacacccctatccctggggaccttctctctctcagacctaagccctgccaccagtccatcctcccacacttcctttccacatgacctgtggtgagagagtggcctcgtcccacaggaagggtgacaattagcctggtcctagcaactcaggatctctaaatccctctgactgtgtggtacagggtgggcagaggctgttgtcgtagctgttaaggactccttagcacagagaggcactgtcctaactcccttctctgggagaagacacagcaggttcctctgcaggaggaaaagcctgtgttctcttaaggaacctaggggtggtgcaggtgacacggcacccacggcttcttgctccgtccaaacacctcagaggat

SEQ ID NO: 21577 - DNA, 1336 bp, Mus musculus
tccaggaaaaccaaagctatatatactaaccctggctttaaaaacaaaaaaacgaagttgacttttgtagctattgaaacaattggattattgctgttatggaagcctcagctaaagggtttgaatgaaatgaacagtgacctttgtgtttgaggatggctttgggctggttctgcctctgtcccagtgctggggtttataggcacatacttggcttgccccctatgaataaagtttcctttcaggggattggatggggtgttaatgtctaaagcaagtctccgcctcccttagcggacattaactgtaacatttatttccaaaacaaggtattgatgaggatgatcctactgtggatgacaccagtgctgctgtaactgaagaaatgcctcccctggaaggagatgacgacacatcacgcatggaagaagtagactaagtcaccagaactatgtgtttgcttaccttcattccttctgataatatattttccatgatttttgtttatttttgttaacatttaaaacatctgtgtggcatgaaaactaaggggaagataaaatttctacatgtgatactgtgatactataggtttaactcaagaggttgatagagcgtttgttataagacgtaacgtaacctactgttcatgtttgctctggtctgaagtgtttagctgttgagctggattccttaggagaccaaattaagatggcttaaattacatcttaaaattttcatttcctgtagttaattctgcatgtattagtcttagaagtaaacacaagttaaaacaacctgacaggaattccccaagtggcttgttttccaaagtcccgagaacaaccctaagtttcctaggtcttgtaactcagcaaggcttgtgaatggaaataacagtgcccaatcacattctgctttaaaagataaatacagaggagataaaaagaagtgtggaatgtgtcttttctttgcgcacccccacacacacacacacatttgatccataaaaattacactggtccagagacttaatcttgtgtgtcctatatgtggacatcctctcttccccagcacactcagaccttcttgctagagtgggaatataaaacagctggtctgtggggttctgggattttgtcctagcacctcttagataaaggcatgtttgaagacttggctgggtagtttgaggccagcctgagttccatgaaatcctgtcttggaggctataaggaaaaatagtgggtatttactatagggggcaggtaaagagcactaaccaaagccgggcggtggtggtgcacgcctttaatcccggcaggcggatttctga

SEQ ID NO: 21578 - DNA, 1151 bp, Mus musculus
gacagacagaaaatcccattcgttgggtctgtgttggtgggggactgaggatgtaacctagtggagacggggtttgcctaacttgtttgaggctctgggctcagtccccttggaaaaaagccaaaaagattccttaggtttcagaatgattaaataggtgtctttgtttttccccagatttcattagaggggtagtggattctgaggatctccctctaaatatttcccgtgaaatgctgcaacaaagtaaaattctgaaagttatcagaaagaatttggtcaagaaatgcttagaactatttactgaactagcagaagataaagagaactacaaaaagttttatgagcagttctcaaaaaatataaaggttggtggtacattttcttgttactggcagttttccaaactaacttgattgggggaggggtcctcacacacttgcttctgcctcccaagtgtggggattaaaggctaatgcttcataaatggctttcctgtgcttgtgcttcagcttggaattcacgaggactctcagaatcggaagaagctttcagagctgttgcggtactacacatctgcttctggggacgagatggtttctctgaaggactactgtaccagaatgaaggaaaaccagaagcacatctattttatcacaggtaatggtcaagtaaacaggtgttttctctacctgttggacagcacttaaggaggcaagaatgtccagcctgtacctaagggaaagctgaatacatgaaaccatttctaaaagtaacttaacaatataaatatatatattgtctcaggtgagaccaaggaccaggttgctaactccgcctttgtggaacgtctccgaaagcatggcttagaagtaatttatatgattgagcccattgatgagtattgtgtgcaacagctgaaggaatttgagggcaagaccttggtgtctgttaccaaagaaggactggaacttccagaagatgaagaggaaaagaagaaacaggaagagaaaaagacaaaatttgagaacctctgcaaaattatgaaagatattttggagaagaaggttgaaaaggtatgtgaatggttacacatcactcgtagtcagtttggtccttttatctgagttttgactaaatcactgctaatg

SEQ ID NO: 21579 - DNA, 2140 bp, Mus musculus
ctggcgccgcggcggcagcggggccaccatccgagttccctcagcccgcggaggtgggcggccatggcttccgaccctaggccccaggcgggcctcatatctacgccccaggccggggatgcggcaatggccgccgaggaggagcggtggcggcggcgaggcgggcgcggggcgagcgaagcgagggttgggctgtcgccggtgccgccgaggcgcgggcgggcgagggaggcgccatagcggcgggttgggggagggtggccgttaggaacggcgtgcgtggagccgcccgggtccgaacgtcctcccggaggcgcgcacatgcgcttcgtaattaccgcattctgaaatgaggtcatccctttgtcatccaccccccgccccgtcgcccttttctatttcgtccctttcttagtccaaaatagagtcggtaagagacctctatagaggaggggcggtcgttagcacgcctgcagccattctgtgaggctttagagtcgtcctctgtgttccagatgcctgaggaaacccagacccaagaccaaccaatggaggaggaggaggtcgagacctttgcctttcaggcagaaattgcccagttaatgtccttgatcatcaataccttctactcgaacaaagagatctttctgagggagctcatctccaattcatcggacgtgagtataccacttggaggattggacgttgctttccctgaaaatttcaccttggggtttgcgcttgacggttttttcatttttaatcttttcttaataggctctggataaaatccgttacgagagcctgacggaccccagtaaactggactcggggaaggagctgcacatcaatctcattcccagcaaacaggaccgaaccctgaccattgtggataccgggattggaatgaccaaggccgacttgatcaataaccttggcaccattgccaagtcgggcaccaaagccttcatggaggctttgcaggctggtgcagatatctctatgattggccagtttggtgttggtttttactctgcctatttggttgctgagaaagtgactgtcatcacgaagcataacgacgatgagcagtatgcctgggagtcctcagctgggggatccttcacagtgaggactgacacaggtaggcataggccaaaaggaatgtattcaattgtagggggtgtctggttaacttcagtaagtgcttgagagggttaacttggagagttgaagagttaaagagcagtctggcatacatagccttagtgctaagtcctgagcttttcaacaaaattgttaatctaaagggagcttcaggacctgggctaggaaataggaaaaatgtatggctgtttgctcagttgtacatcttgggcaaggaagttaaagctttggagacctttgcatttgtggggaaggttagctgctaggaaacctccagcaagcatggaggctttgaatagtaaccattgcccttttcttttccaggtgaaccaatgggtcgtggaacaaaggttatcttgcatctgaaagaagaccaaacagagtatttggaggaaaggagaataaaggagatcgtgaagaagcattctcagttcattggctatcccattactctctttgtaagttacctacagggtaaatttcatataattgagataactgaggctgtttagagttctgtgaacctggtgttgtactagacagattagcctgtttggaaaggtggtatctgaagaggattgtggagaaattagagaaactactgatgagaggcttcttggttgtacacatttctgagatctgtcctagttgtataaatttataatgaagtgatttgcctttcaaggtggagaaggaacgagataaggaagtcagtgatgatgaggctgaagaaaaggaagagaaagaggaagagaaagaaaaagaagaaaaggagtctgatgataaacctgaaatagaagatgttggctctgatgaagaagaggaggagaagaaggatggtgacaagaagaaaaagaagaagataaaggaaaagtacattgatcaagaagaactcaacaaaacaaagccgatttggacgagaaatcctgatgacatcactaatgaggaatatggagagttctacaagagctta

SEQ ID NO: 21580 - DNA, 1220 bp, Mus musculus
ccaggataaggaactcaaagtgacaaatcgagcttcaggcattcagaacactaaatttctcctgggttagcccagaagaccttgaatgttctcctgggttagccaagaagccaggccgctgactaatttctgaaagtttctcaacccgtacaaaaggggctagcaagcccacctgcaccaatgacaggtaacacagcacttacagctagtgaaaagagtagaaagactacctgactcattcaagagggtccttagggactataaaccaactcttttctttctttccgtctctatttattgagacagagtctctctgtacccgtctggtctcaaatgcacagcaatcaccctgcctgtacttcctcagtgctagaattaaaggtgtgagtgagcctccagaattgtctcaaatctgaggccagcctggagtacatactgagatcctgtctcaaagtacatagataggaaagtaaataaaatttaacaataaaagtcaagacaacgggctggtgagatggctcagtgggtaagagcacccaaccgctcttccgaaggtccagagttcaaatcccagcaaccacatggtggctcacaaccatccgtaacgagatctgactccctcctctggagtgtctgaagacagctacagtgtacttacatataatcaataaataaatctttaaaaaaaaaaagtcaagacaacatgtttactatgtactaacagtgtaatggatatggacaaataaagtatggtttctgcccttaagatcagccttaaggggacaaggcaaaaacaaaaccgggaggactgtgtgaagagggagaggagtacaggggttggcctgcagagcagacaggaccaagtgtgcccgacccagggcgctgcactcaccacagaccctcagtggagctcaagcctctcccagttgcctcatcagtatctaggtgcagaccgttgtcctatgtggcatggcatttcccagttccagagccatctccagagcaatgagggtagtagataacctaaaggagtggctaaggaagactggaataatgtgcatttctagtggcatcagaaacgggttagtgatccaagttgggacagtaaatacaagaggcttctgagaagtaacctcgttcttcggagaaactgagtgctggtctccctctagcccatggggtgcagagagcctcgcacccctccaccaagtgcccacagc

SEQ ID NO: 21581 - DNA, 1134 bp, Mus musculus
ccttttcacagtttgagctaagcccagttttcatttgctcagctgtctttacctagagttatgcaagtttaaatgtggtagattaattaatgttgcaaatgtgtctttccttggagtaactgttttgtgcatttgtacagagaatgatcagcagtctacagcaggtactttaaaacccttctgtattggggtgagggaggtggcttgggggggggtgtaaagtgatacttttgattttcagcccccacatagaaagccaggcatggccacgtgtatctttcattccagtcctgggaagcggagactgaaggatccctgggatcagctagtctagatgagtcaggtgagccccagtttcagtgagagaccctggtgtttgtttatttaaaagcagacagtagaggaagctgcagcatgttgacctctggtctatgcggacatacgtgtccatacacatgcatcacctgtggaatgggggaggggacgacaagattacttcaaacttaagatgtgattttggattttttgctgctgttatgtcttttttttttttgagactgggctttgctgtgtaaccctgactggtctggaactcattatgaagaccaagatggactggaactcacattgatccttctgtcgttgcctcccaagttctgggattgaaggcatgcaccaccatacccagctcttgatatgtatagtaaaaaatagagaattccagacattgttcacatcattggatagtttcatacagatggaatgaaatgacatagtggtgacatgtcctcaggctgctcaaattacagtttaagcttctgtgtgtgtatttggtaggcatttagctaaggggtagctttcatgctcttgaaaatatttcttatacagttacctgaaatggttagacctaaaagtgaatcaagaaacacaggttttgcagtgttgtttgcactagggtcttgggcacatcttcagttctgttcagagaggaacttgagctgtctgacctatccgttaggaatatatcaggacttatacagagcagacagaagttggcaaatagattgtatttactcaggctgttacggtggcttttcagttccaagtagtagcgtgtatttggcacttttcctc

SEQ ID NO: 21582 - DNA, 1188 bp, Mus musculus
gaggtcatgcaccatggatagatgagctaatcccagttggtcctgagtacagaggaggaggccaagagaggctttctgctgaagtcatgcacatgtgttatgagtgccttcactgtggaggggttgtttggagcattatagcgtgaatgtaaagcctcttgccatgctgtgccccttgggtgtggtctgtcactgctcacactggtgtgctcagttcccagggccggaacgtaacagtgaggatggcataccgcagcacgtggtatggagagttttctctgtcacttacatgcacacattgtttagggtgaccgtagtgcacacttctggttcgtgagtgagactgccctgtaatgcttctggtcactgcagtagcgccactaaaggcactgttgctgtgtcggttgggcagtcacacttttggctgcactttcttaccaggattacattttttgagttacagtaaaatttttccattgtagtttaaggctgtagttaaaaatttactcctaatcctcctgctagaagctttcgtgaccttcaactttctcacctgtagtagagtaatagtgcttggggaagtggactcggatcagccagcagtgcggctctaacccagccctccctgcacagggaatccacacctttagaacatgcccatctgccatagtcatgtccccgggtgcagagtgaggagtgccggggcaacatgacctagtggacacacagagactcagcgtgagccttcaggctccggagagctggatgtctcttcatttcttcatcctcctaatatcctctttccctaaagctatggtctagccttgaaaatgaccagagcccttgctaagaaattatgatggcctaatggaatcttgcagagtagtgctaggtgttcaggctactgacattagcatacggcaggtcaccaagcaggaaacaggagtcagggaacaacaaacaaacaaacaaacaacagtatccccaaaggcagtacttactggtctaagatgccagtcatgttctgtgccagtagcagtggtagctgatactctgcctaaacctaagaacttggagctccaggcctccatgctgtggatagacttttagggtcccaagtattcctgccagtgatttgttagtagtctatttcttgcaaggtcttttctttttgcatgagcttgcatt

SEQ ID NO: 21583 - DNA, 1170 bp, Mus musculus
ccatgagctgggatcaaggggaaatagataggatgctgacagtgactcgaatcactcgctagtgggaagcgggggaggtagaacagggtggaaactactttctttaaagggggaaagaaaagaccctgctgatgttgtcggatggagacctatgaattctcttctgcatccccataaaaacgtcacagtttgtgatttggggtttagtcacagtatatttcaacttctgctgctaagtgttgtgtccttaatgattaacctggaaaccctgtttggggtcctttgctgtgtgtgtgtcttaccctcctgggctccctgctaggttcagggtctggtaagagcccaggccagctctagagggctgtcttagttgcatgacctggcccaggctggcccctgcatggagggcgtggtgctgctccaggcccgctctacccccctgactgactcctgcccccctttctttgacagccggcagagcagttctgcaggcaggaggacagagtgcaaggtgttctccaagaccagaactaaaggtgcggcagctccagaagagggtgctggtgctggagggcggggcttccttcctccttgtgccctgcagacagaggtggtggggtgtcatggggttgcaccgattgccatggtgggtcctgatctccaaagaatgaggactagggccactgtgcttctacagtagccacccagagaaatgtttttagttttctaaacaaactttgagcttcctcatcaaaacttccctgagcgttttcatgagcaagaatatctttggtaactagctactggactaaaacagctactggcaagaggctcttaaaggcagggttccagtctgcttgctgtgacccagacagagtctgcgggctcagtgagggccactggacagttggaccctcctgtctgtcctgcttgcccaccgcagacaacctttctggtgactcgagaaagcagctgccctgtagctatggtgaatcagcccccagctccccccccccccgttttccttctctgtgcatgtggtgccagggattatgccaaaggactcaacccctgcccaacacgccacatcccagccctctgcagaggctcagaagttgtatcttcctcttaaacaaatgctccagagagactgggtgatacctgcagcta

SEQ ID NO: 21584 - DNA, 1334 bp, Mus musculus
tcacgcagccgtggtgtctgttctgctgcagatgaggtctcccgccggctctctgaagcatacaagaaggagctccttttgaagcacaccattggcgcagagctggcccatactgcagatcgcaacctcagcctgacctacctgtccatgtggctgcaccagccctacatagagagcaacagcaagctgcagctggagagcatgctgctcgagacaggtcaccgggccctgtgactgcctgtgaccacagcttggagctccaggccactggctggacagtcagtcccttgggtggaacctgttgtgcctcaaggccagatactttgagggtcctgggatcactcttcccgctgctgcagcctctccagacacaggcactgctgagctgtcctcccgctgcttcccgggtgtcatgaagctccactgagtgacagaaacaagaacagctgagggcagttttataaatctgtggagacaacctgagtttcccatttctattttgtacctatctacttttttttttcttttttgtggtgctggaaatcaaatcaaatcaagacttcacacaagctgaatattcaaccactggtccacactgccaaccctgtgctttgaagagaatgttttagttctgaaactaactatcccaggattattagatgttaaagtctcataagtagggacagagtggtgagttagcagttgagagcactgtggacttctggcctcccctggcagcaacacacaaattacttaggtatctgtgtatcggccgaatgtatagatgaccagggcaactgtaaatgggagtgggctccttggagttagaactacaagaggttgtcagccacctgatttgggtgttagaaaccaaactccagtcagtcctctggaagaacagttcacgctcttaactgctgagccatctctcctatggctggagatacatatatttaatatattgtataaatatattaataaaacatgtattgaaatatatatacatattaatcctgttgagttaactgagtatagagtttagtatcacagaaatgaaaatcacccaaaattgctgctgcttgcctgagaaaatggacaagccaatacaaagaccagcagttgcagactgtttgtatctggggcctggccgtgctagatgtttagctttctcactgttcgccaccggtgtactccctaagtccatagagagctaacattcatcatgaagagttgcctgcatagtgaggtcagctggccctcacagttaggtcaggggccgcttgcacttcctcctttcactccttcctgatagggaacacactaagaccactggg

SEQ ID NO: 21585 - DNA, 1204 bp, Mus musculus
gactgagtagctggtctatattaatatactttgttggaaagtcaagttcaagaccaactaacgcaacaagacctttctcaaaacaaacaaaacttcccaggattgccctaccttgaactgtctgtcgtaagtaaggtagagctgggaatcgtggctcacacctggaatcccagcacttgagaagctaaacaggcagactgctgtgactttaagattaacctgggctacagagtgagaccctctctctctctctctctctctctctctcttttttaagatttatttatttatttaatgtaagtacactgtagctgtcttcagacactccagaagagggagtcagatctcattacagatggttgtgagccaccatgtggttgctgggatttgaactcaggaccttcagaagaacagtcagtgctcttaaccactgagccatctctccagtcccgagaccctctctttcaaaaataaagtaaaataaaataaaaaaataaaaccaacccaagccctttcccctggctggcagcgcggaggccgcacgatgcctggagttactgtaaaagacgttaaccagcaggagttcgtcagagctctggcagccttcctcaaaaagtccgggaagctgaaagtccccgaatgggtggacacagtcaagctggccaaacataaagagcttgccccatatgatgagaactggttctacacacgagctgcttccacagcacggcacctgtacctccgaggtggtgctggggttggttccatgaccaagatctatggaggacggcagagaaacggtgtcagacccagccacttcagcagaggctctaagagtgtggcccgccgggtcctccaagccctggaggggctgaaaatggtggaaaaggaccaagatgggggccgcaagctaacacctcagggacagagagatctggacaggatcgctggacaggtggcagctgccaacaagaagcattagaacaaaggatgctgggttaataaattgcctcattcattaaaaaaaaaaaaaaaaccaacccaaggaaaatctaggaggcaaaagcctgtgatattagctctcaggaggctaaggtaggaagattgcaactttgaggccaaccaggtctacttagcaagttcccggccagccagggctacacagcatgagctcgtctacaataaataaataaataaataaata

SEQ ID NO: 21586 - DNA, 1194 bp, Mus musculus
accatgctgtcagagcagtgtccacatcatccttactcttcctgtcctactgaattggaatcagtggttggcaccgatttgcagaagtcctgtgggcaagtcctcatagttgcaaactctgctggtactcctgtgattatactactaggacgtacttgctggccaaagcaatagaacatggatttacatattatctgtccagcctgctccctcagtagttgcctttgatgtcatttagaaacatgacacacattactgacaggccacaaagaggtgaggggagctccctggagctgtgactctgcataagccttgcagtatgataagtctggggttttacctgagcagttgtacatgaaaaggtatctattatgaaagaccacagatagcaaaagtaccaaaaaaagaaaaccacagatcaaaagagtgtgacaagcttcaactgagtctgcggggctcttcctctctcactacaggtctcagtgtggatcggccctgcgcccgagccgtgaaggtggactgtccatacccactgtcccagatcgcagcccggaacagtgtggtgtgggcactgacagagcagagggccctcctgtaccgggagggtgtgagcagcttctgtcctgagggggagcagtggaagtgtgacattgtcaggtatgggcccagcactgtgacctttattcctgagcctctcctggcaaaaccaacacttacaggtttcacggtgggagagtttttgcttttgtcaaagttggcctcaatagactggtcttgggaatgttctgcgctcctctgctggtcacattaccgtttgtgttggggtttaggtatagagctgggcaggtagagtatttgcctagcacacacaaggccctgagttccatcctcagtcatacacaaactcagctgtacttgcctgtagtctcatcacttaggagctagaggcaacccgtaattgcctcagttcagagtcatcctcagccttggatacatgtctccaaaaaagtgtaggggtagagcaatggctcagaggttaagagcaccagctgctcttccaaaggtcctgagttcaattcccagcaacaacatggtggctcacaaccatctgtaatgggatctggtgccctcttctggccatccaggcaaaacagtgtgtgtgtgtgtgtgtgtgtgtgtgtgtgtgtgtgtgtg

SEQ ID NO: 21587 - DNA, 1162 bp, Mus musculus
gtcatcaggtttgtgcagagcgcagttacctgccgagccttctctccagtcacgttgtgactgacccaggctcttacctactctgtctattctagtcttgactcagattgagcagtttctggtttttagtaatttgttcatctgtgtcatctaacttattggcatccagtttccatatggtattcttatatatggtattctcttccttttatttctgtatgattgtaggaatatcctcttttatttctgattttaataatttatttttttctttccttttttgcatgatatgtgtgttctttgatgcacatgaatatggacactgagtatgaagaagtccagcgtccctcttcctcctccttgtttgagcaggtgtgcagcaggccagctggcctggggaatttccagggattctcctgtctcagcctcccatctttccatggagcgctggaattacagatgcgcactaccgctcctgactgcacgtgggctctgagattgaactgtggtcaccgtgcttacgcgcaggtgcctgactcactaagccacctcctgctccgcgtttttctcagctcatcatagtctttgtccactttatcttctttttaaaataccatctttggttttattggttttgtatattattttcctatattttgtctctttctgttctaatccttatttcctccccacactcttgtgcacagagccttgcttggtagtgatattccgctgagagctcccagctctactgactacagtgatgcatcttggaagccatgtgatggcaatgggctgtgagtgaggctccggcacagagcaatggccatgctgagtaaagagctagactacaattatggtgccaaagaccctgtccccagcctctgccacaggaacctctgcgcatcctggtcatggggaacatgtgtcaaaccacaagcccctattcctttctccatcttgattccacaataacctcaagaaatcaaaactaaaatgggggaagaaaggtttaattggagtgatttgaaggtgatcaacagcttggcacaggaaaatgctaaaatggaataaagtcctgtgaaaggacctcaaagctgtgctgagtgaagcagtgacgccaagtggctgctgaacaccgacccgttgagcagtgctgccg

SEQ ID NO: 21588 - DNA, 1281 bp, Mus musculus
caggattgtcacaagttccagaccagcctggaccacaaagatcctgtctcaaaaaaacccctgaatttatagccgggcgtggtggcacacgcctttagtcccagcacttgggaggcagaggcaggtgaatttctgagttcgaggacagcctggtctactgagtgagttccaggacagccagggctacacagagaaaccctgacttgaaaaaacaaacaaacaaacaaaaaaaaaccacacaaaaaaaaaccccccaaaaccctgaatttaagagtaaacaaactgagaaaaagtcatgattgccacaacatttgcatccatgttgaacttgtccaaaccagtaggaaaacgcaacacaaagatggacaaaggaggcgaagtggtgactcacacaaacatcctccagtaggaaaccccaaaggcacagccctccgagaaagcctctgatggtcctcagtccaaaagcctaacactaaaaacgccatctctgaaaattagtcaggaacaaaactgagctgtgtagcagtgatctagggcttacctagcatgcaggcccagtctcactccccagaatggcagcaaatgaaaccaaacaaggagggtgccggtctttatgagcttgaacacatgcctataatgccacaggatggatgtcagcagagcatactgtggggtcccacaggcaatcttagggcggtgtgaaactcttctggcctatcagtacagtacggtttacagatagcactgcatgtggggggtaccgtgtgtacatcactctttaggagggtcagaaagacaaggtctcatttgggacagacagctggccagcgaatgtttccaagcctgtgtcttttttaatcctttgaatgttgagccatgtaaatgtattatttatttcaaaactaaataaaatttatatgtagaaactcaattctcttaattttgcagtattaacagtatttgagtcaaacatcacaaaatcaacaccaaaagcattaaaaaaaaaaaaaaaactttacagccggacgtggtggggcatgcctttaatcccagcactcgggaggcagaggcaggcggatttctgagtttgaggccagcctggtctacaaaatgagctccaggacagccagagctataaagagaaaccctgtctcaaaaaaccaaaaaaaaaaaaaaaaaaaaaaaacttttcataaaattggaagtgcttacacattggtgatctttcttattttgtatgcagtggtgttttgcctgcatgtgtgtgtctgtgtgacagtg

SEQ ID NO: 21589 - DNA, 1193 bp, Mus musculus
ggactctaatgaccaagcaagaggacagaatgtgctgaggccaaggggacaagcttgtgtggttttgagtggccccctcctgtgctgtcagcctcataaatggcccatgggttggactgatgtgtgtccagcagagctgagcaggcagctctagcaggtgttgaatgggagccagactgtgtgtctgtgttctcatctcacactgaatcattgcttctccaccccagcctggagttggcccttttaccctcagtcaggacttggcaggtgctagccttgggtttccccacctgcttccccacaggctttgggtcccctgcatcatgtctcatgagaaccaggtgtgccttccaggtccccctgcccagccccagggatggccttactcactaacatcactcacagtggatgttaggtggtgcttgtgggcctgtgttatcaccctggataggcttctcacccatccttggaatgctgctttctgctggacacttcagaagccgggaggcttgttaatgaatgcaccctcatccttcaggataaaggggccctggctgcaaagctgggttcataccagggaactttgagactgggggagggcccgtccctatcctgggattttgctgggctgtgaaattcaacctttgtggcataggcttgcaggccatgatgtgctgccaggagcagaggctagctgtctgctaaagtggccagcctggtcgggggcacctgttgctctgctcctgagtacagcatgcccgggggtgggaatgtccagggtgctgggccacaggaggggaagcccagagaacagagggccctagactttgccacctgtcctggacccgtgttattgtcaagggattttaggccatttcctaggcctgaaaaagaaagggtacttgctggtacggatccttcgtcttgactggaggctgtttcccttctgctgagtagcttctctgagtcctggcagttgcgggtgatgggtgttagtgtcttcctctgcctcaagtttggcccattcatgatcagtccccctggacttctgggaggtcccaagtccagatgccattggtggtggcattccttattcgcaggacatgacaatggcttgctatagctcctggggagcctcaaaagcggggctcctgttgggaatctctccttcacatctccctagataagtgccc

SEQ ID NO: 21590 - DNA, 1201 bp, Mus musculus
tgcacataaaatattttttaaaggaagaaagaaatagcactgagctgtgtaaccccttagctggaaatacatccattacccagggtttcacagtcctggccagtgcttggtcactaggcagctgcagctgcagccccgctcacagttttaacagtgttactgcaaatgccctgagtacactgacctgtgttttggagggggaggagaagcggctctgttaatgttgttaattgtattttctatctactcacgttacttttaggagtaattttgtgtctgctaccgtaattccttggtgttgaaagtcttttgtcatcataactaagaaataaaacaatttcttatgacacattttcagtggagtttatggatggatttgctaacggaaatcacatcacaggtttttgtagtttgcacatctggccggagctcatcttgctgcggttaatggtgtgccccactccacctggcctcagcatctctgaccctgtgcctgctgacagaaatttctgcatagttagggtttgttttgggtttttttgtttgtttgtttgttcttctctttgagtgcactcagtgacttaagttgattcatgtcattttgaacacacattcttacatagcatgggggaaggggtctgaaaaaaatctacgtccttataactagaaaagctttgttttcaggagccctgctgagcaattctgcattcggagagcatagacactcagcatgtctccctcagtacgggatggtttgactctggctactggggctacacgtatgcctataacacctgcttaaaaggtttagttttaatttatttatttctgctttttcaagacagcatttctttgtgtagcccaaactgtcttggaactcactatgtagatcaggttggcctggaactcagagaaatccgcctgcctctgcctcctgagtgctgggactaaaggtgtgcacgcgccaccacagcccggaagcctctgccttctgagtgctgggactaaaggtgtgcgcgcgccaccacagcccgggagcctctgcctcctgagtgctgggactaaaggtgtgcgtgccacagccgggaggttaagagtttttaaacaacaatagtgtggacgttttcaattttactattaagttttactcaatgttagttaaaagttgaactttaagctgggcgcggtggcacacgccttt

SEQ ID NO: 21591 - DNA, 3598 bp, Mus musculus
cccttcagcagaccacatcgtcacctttatcatacaagcttcctgatacaactcctgtttccctaagagaggacagttatggctgtagatcaggtggcttctctcccctttctctctcccctaactctttcccttttctcctttccaagtggtaaaagctcatttgcagcaactgtccttgggcactgtagcctcatgggaacgtggacctcagtgctttctgccttcagccttcagcattgtaatcccaggatgagggtgcacccatctcttcttgatccccagctgccaccatcatccccagctccgagagatttggttcctatcattgtacctggtgcttgtacatttggaattggtgccttctccttctggcaaccatgttatcaatcccttttctgtttaagtgtcttacttaaagtttattgcttgccaaagatgccatcattgaggtgtagcagatggggagggtgtctgcaggtttgagtgcagactttaaatgtcaggtcagctcaggaaaggagaagagagaagctagggatggtttcctagacgctgcacaccagtagctctcatcctcttggcgtgcctggccattgtatgtcactccatgtgtccttttgtgtcatttgtgtactggtgtgatcacacaaacactatatcctgtctcttagcagcagataggacagataagtaatggatgtgtttgttgcttagtgagaccaagatgaaaagaaacaacctagagtggtggcaatgccatttgtttggactgggaacaagcaagggttgctaataaatgttctgagacttcagaatcacttttgctctcttaccagactgtgggcctgaagggcctgaggagcagccggctgggctgtgtcctagcatccatggccacttgagactgcactaaccatgtggaaatatcttttgttgttgttttaatattttttctgctttcaataccaaaaaggaaaaaaaaaaaagtagatgctttaaggtatttaaggtatgaatggagttctgaagaatttaaaatatgcaattaaaattcgatgttttgactcctaagcaccttcccccctcccctttttttaagttagctgattttctctttagaaagaggttcagctggggataggatgtatattcttcttgagaagtctggagaaaggtcattccaaggtcaagtgcagagggactttgtccatcctgtctcacaccggcccattgatgaggaagagtcatagagatgagtcagaggcacggcccgtggtcccacccaggaacccagggacccagggacccagggaccggtaacagagtaacactagtaacttcttttgtgcttttatcataaacctgctgtgtagctgaaggggaaggcaagcacaggatgaagttagcctccgctctgcgtgtgactcacagggacactgaggcacaagataaaaccctgctcacctagcgtgtttgcatgcccttccctccagtgagcagagcagcgctgtgctacagggtggctgctgccgtggttttctccgtctgccggtggctctgtgtctgtctttgtgcccaggctactttgcttgagatgtgttccccctcagcagtgttgagacttggtgatcatctcggatggtgtggcaggcagagcggctgtgccaggcaccaggcttgttctgtctttctcttggttgtgagcgtggcgtggtatctagccatgaagagtccggtgtcgggcggtatggttatgaccagagcagctgatcttccctttcctccaaggaagagaggcgcgcatgccgttctcacttggcagaggggcgagagtgggctctgcctggctgctgctgctgctgctggaatagtctccatgttttaaacttttcatgacacagtccacagtgatataagtccaagaaactgcttagctttcaaagccgagggctctggtctggactgtgactgttacagtcaagagttaggtgcatcagcaggttaggtttggaacatgacacctgcttccgatggaatgtcacttaagctttgggttcttaaaaattatcaatgtgaatgtcataattatatatttttgtgggaaaatcttctaaatataagttattgtgcaaaatatagtatcatggacacaaataatagtctaaggtttagtttagagatccctaaagatataaactgtattgcatatgcattaaaagtttgttttatttaattttctgtgaacatgtaaagtgttaggtaattcttttcccttatccacgtaagcacctgttacttgaatattgtgttgaccggccagcggcagtgatcaatgctgtactctagctctttcctcagaggccctggcctcggccgtgctggtcagatgagtgttggcacacagtgggtgctgtgtcagaggttcacaacagagggtcacagcacacccactgcctctttgtttatttgtcaaaacagcttcctaaagaaggtttcagagagtttttgtaagaccttcccaatggtggttacaaaccttaatcaaaaacacagaaggtgacaaagcttactgtggtgggctcatgaagcaggagtcctgttagacagtttcccagcgctgcctctgagtgagctcagtgacactttaattcagctccgcccacttcgtctttctcactatgagatgtactattggtataattgcacaccaaaaataagccaaacagtgcattacactaactggatccctgctttcatggaagcaaaggaaagacacgtctcacgtctctgtcctgtttgtacacctagtgacccaggattcaagtttttagtatcaagtaaacttcgcctcagactgactaaggcagctgtaggtcatctgagtctaatgctcgtgtgcaatgcccttcccgcctctcccgggtctttgcagcttctcctcactgtagtaaagcacaattgcaggagcgtccgtcacggctcagaaggagtcagtagtctatgcatgttgtaagataatgagtgtttacagtcgccttctctaaagtgagcatttatactggagtgggtagcattccattatgtagacttcaaactttgctaagtgctttttagattgcttaaaaatttttcaagattttaaaagatgtataaggttaagtttgcaaatataacggaaatgctgtatatcttttgaagtgataaaatccatgttaaaattttaaagaaaatatgttgtaataatgctgttgtaagtaatatttccatgtctctctgcttgttttctagttcagcacagtcattgtggtgaatgtccatagcattataatcgcttagccattgaattataatatttgttagtggagattgggaaatttatttgtgaaattctgcagaattcatttttctatttccaatatttgctgaagttaaataaaaattttcaagccattgatgtaataaaatacgaaacaaaacaacgtaatgcatcgctatgtcccgtcttcctacagcctggggttgttccctccttgcaggcagcctggggcgtctgactgtgttaccgtcccggtgttagaccctgtgagacaaacat

SEQ ID NO: 21592 - DNA, 1146 bp, Mus musculus
tctgcctcgagactcaggaagggtcctctgtccttgatgctgtgacagggcaaaggtgtactttatctggttcttcctttgcagatagcattggtggaaggcagtcactgagatctgtctggtggctgatctggcttcaaggatccaagatggttacactccgatgcctgtgtggttggaacgtctagatcagggtttcctttctcattgtggtctcaggtctgttgttaccgatgttgttgatggcattgctgagtatggctgctcagaactcctagacagcaaggtctctaaagaagccttccggagttaaacggtggaatgcagatgggattgtgctgatgtgaagagtataaaagacttgtgaccacccaccagtgtgtgtgatactcaaatagcacagtgctctctcagcagtagtgtcagctaagcctttgaatggattcagtgctgttaatgaagactctgagtaaactctggagggtcaccattcataccgtggcagtcgccaaatcaaatctgtgtgtcattccccgtcaggagctactttactcttctctagacccggtcttgctgtgtgacccaagctgcctttgcagtagtggcccttcctgcttcttccctaagtggagggatcccaggtgggcggagccctggggtgggctcagcagtgagcctcactgttacctgtgaccagagtctaagagtttgatagtggtttctaggagcagctttgggtttgtggcctcttcctgtgagtttatttagcaaggttactcggaactcatgttaagaaatttaaggtagtatttcagttctctttggtttttcaagtcagggtttctctgtgtagcctcagctgttctggagttaattctgtagcccaggctggcctatagactcagatatctgtctgcctctgcctcacaagtgctgggattaaagacaagtccatcatgcctggctagtagttctgtttgttctttaaaaagcttagttgaaaaaataatagtggagctggagagatagctcagtggttaagaacactgtctgcccttccagaggacccaggttcaattcctagcaactacatggtagctcacaactgtctgtaactccagttccaagggatctgacgccctcaca

SEQ ID NO: 21593 - DNA, 1188 bp, Mus musculus
tcctgagttcagttcccagcaaccacatggtagttcacaatcatctgtaataggatctgataccctcttctggtgtatctgaagatagctacagtgtactcatataaataaattttaaaaaatgaaagaaaaatattctgtgtattttaaagaatcttgtaacacaatttactaagtacatttttcaggaatattctgaatggcagtgttaacggtaggatctggttaaagtaaaaagaaggtggtcacttggtcatgtttcttattccatggcagactaaggctgggaagggtcctggtgccccatttaaacaccaaaagtacagacctcggcacgggtgcttctctcagccatgtatgttgggccttttcaagggttcaggggttgactgacagttctcattacctttttccgggcagaatttcagtttcctaagatggagtcaagcaaaaagatggatgctgctggcacactgcagcctaacccacccctaaagctgcagcctgatcgcggcgcagggtccgtgctcgtgccggagcaaggaggctacaaggagaagtttgtgaagacggtggaagacaagtacaagtgcgagaagtgccgcctggtgctgtgcaacccgaagcagacggagtgtggccaccggttctgcgagagctgcatggccgccctgctgaggtgggtgccctccagggctcaacccccactcacctgcttcttccaagacctccagcgtggggggcctttagagcaactcaggcacatctcatgcttgagtgcctgagacctccataccttgccctgcctgcctcacatcccacttgcccaggcctctccgcccacaaagcttctgtgcctcccatctgccttgctgtactctgtgcaagaagcttatgttttatggtggtcatgtcaaatgatcctaagtccttaaaattgaagagtgccctgggccaggagagaggaaggtcagggtcacatgcagaacagagcatgtggcaaggctgcatgcttgcctgggggatccacagagatctggggtaccaagactctagaagctcatgagtctagtaattgctatggtaaagtcacaagggcaagttgggatttggaggacagagttgagtcagctgggaagagcatcatcgtgcagctttttatatttgccaggcactgtgcttgacact

SEQ ID NO: 21594 - DNA, 2098 bp, Mus musculus
aggccccagcgagcatcccatcctgtcatactgctgcatccggctagcgcgctccgaaagcaacatccgtgctcagagatggtggcatacggtacttgtgccttagatgtgacatgctgcttcttgtccctgggtttgcgttcaccatggttctagaaagtgtcagtttaaccagatctctctccaccaccagaactttgtctctgccagggccctcaggcaactctgaacctgcctggggatgccaggcctccattggcagctcttgaagcctctgctgctaaatattcacagattccaaccgtaggcccctaagagcagctcagtcccactccaagggagggaggtgtgagcagaagccacacccttccaggtctctgcaagggccctgaaatccccacagcatgaaggagaagtgccctagtcccaagcgttcccgagaccactggtctggggcctgcccgggctggcagcagcaaccctggcctccctgtgaggagggcagccagctgatgcccagcctgtgagtgcagaggcccgccctctcagctcactgttcccactgtgatgagaagcctggagccctgccccggtgccccttttgctatgcaccacacttcacggtgctctacactgatgggtgctacacgcgacaggtgcttcttaggcaaaaccaatgtgtgcaaaccaccacatctgtgccacttgcccaaaaggcgcgcccacaattggccagctgggcctgcgcttcagactgcctgcctctgggctctccccatggtcgcacggggacagctgggttggtgcccggtagcccaccttgtctctggtgctgccatctgtcctgggtgtgccttcgccccagtgcctgctggaagtgccctcctctcgcacacctgtccccgtgcttccatgagcgacctcttggtttcgagcactcaccctgcccttccatggctgaagcgtttggtttgtcctctgctccccgcttctctccattatgctgggattgctttggggtaagtcagcaaccttggttctgcccacaaggaaagaccgcagagctcaagttctttcaaaggtgccctcctcttcctctaggcctgtcaccagggttcctcccccaaagacctggagttggggggaacacccagcagtccttggctggcttcaggaagcttttctgtggccagatgtcagcaacggggccatccctgtagctccccccttcagagaaatcagtgcagtatcaacaggtgtaggccagcagcatcgtgtctgacaaaaagcatgtctgtccttagtttcagacccttgtatgagggtgaccctgacatgtcctcgggcccgtcctcccttttagtgagacttggtcaaggctccttcctatgcgaggtggccctcctggcttcccccgtgcctgtagggtgtgtgtaaagtaagtgactgctcccctgggatgagggccctgaacaatgtcacagcttcctgtagtgtgttgtgtctattgcatttctcggtaactgtagaatagtgggcaagcttgcccctctgtgccctgtctcagtgtgtgaagggcatctcctgggaggtgtggagcaggctgcgtcctgcctgggtgtgccttgctctgctccatctcagcattccttggtgctcaccacccgggggtgtggggcattgttgggctgtggtctcagcatagctgtggctaccagtcctagcagctagccctcaccatatcacagggtcctggccatgagaagtatggggtgtcatgcggcgtgtgtacctggctgtgcaaaagtgtcaagtgctcatcttttaagaggccggtagttgcatggcctctgtggggaaattggatacaactcctgcttgccggggtggtgtttgtacctgctcacagctgaccctgggaagatggcagccactaactagcagtgtgtcctgaggcccagcctgcagttttttgtgaatagctgaaagcttgtgtcagtaacaacccagggccttccaccttcgttggtcagggagaagaaggtagcctggggtgccctggccgagcctccttcacctcttggggatagacagagcc

SEQ ID NO: 21595 - DNA, 1348 bp, Mus musculus
ctaagtcgggggtttctctgtgtaacaagcttgcccagaccagcctggctttgaactcacagagatctgcctgcctctgcctcctgagtgctgggatcaaagttgtgtgccaccacacccagccaagaaagcaatttttaaaagtttttaaagcatttatacaatagtgttgacaagagcagaattaattgaaatctggccaggaagggccgggatgtctatgtttgcaggcctgtcccttcctgtcagctgccctgccagcagcctggccagttaaagagatgggtggtctctgggacaactcagggacattgacgtgagtctctagacttaccttgtttgtgacctctggagctaggcggttctaggcggttccagcgcagtccctgctctgacctggctggcagctcatgattttgtctgttttgtttttctcatgaaggtgacggcctctctcttaggttcgccttctaagaccagctcactgctcatcctgacggagaacgagaatgaaaagaggaagtgggtagggatccttgaagggctgcaggccatcttgcataagaaccggctgaagagccaggtagtgcacgtcgcacaggaggcctacgacagctcgctgccgctcatcaaggccgtcctggctgctgctatcgtgggtatgtctacgggtcctgagctgggtgggggttcgggttccacgcatgcccgtgtggtcccgtcctcctgagcgtgtagacagcttctcctgtgtgaagaagcaggccctggctcacgggacccacacgttgtttccccagatggagacaggattgcggtcggcctggaagaagggctctacgtcattgagctcacccgagacggtgagtcctgcctggctgcctcagagggttcagtgggttcatgcgagtgcggcatagagtgtgtcctccttcagggctgtggagaaggaacatcctggtacatagtcaggggacgttatgaaagtcctaggcaagaagtagagaaagttctcggttggcgtggcaggcacgcagcgcattcaagtgcctgggcatcaggagtctggagaccgtgctagcctcaaactccgcctctgccttcgagtgctgggattaaaggcgtggcccaccacacccagctaattttttttttttttaaagacacacaatccaggtattttatttgtaagccataagccaagtttgggtgggcctggaactattctatttctcagccgtaatgtcccttgttcctcctgtccacgtgctcatgatctatctcctttcatggtgcccccctccacctccgtgtcatttcttcctctctctacctgaaactccctcac

SEQ ID NO: 21596 - DNA, 2140 bp, Mus musculus
ctttttcttcagagagagaactatgataggtgagacggtaggatttcagtctgatagtgatacatgaaccatagggctaaattaactcttcatttccctgtagagaatagtgacattggtacaggaaagaaagaaaaggaaaagaaaaatagaaagggcaaggacaaggaaaatggctctgtatctaccagtgagacaccaccacctccaccaccaaatgaaattagtcctccacatgctgtggtgagtataatgctattaaaatagtgtgaaaaacctggtattaaagtaaaaaattcctttttaacttaatatacaacgcttaattaaaacagtgtgctatttattgggtggtggggggttgagttgaactaaactgactatttttagaatccattttccctgtttagcattttgatttgtttttgtttgcactaatgtgaaaggtaacattttgtgagtttttgacatggtctgtgggcagaggtgcttgattctgtcaatgtgactagttcctgtacctaatgatcttggcttttgtgtaaataggaagaagaggaagatgatgattggggggaggatacaactgaggaagctcaaaggcgcagaatggatgaaatcagtgaccatgcaaaaggtctgacacttagtgatgatttggaaagaactgtagaagagcgtgttaacatcctgtttgattttgttaaggtaaatttgtatagataactttttctctggtatctttgaatttattttttgggtgtcttttgttttcagtcagggtctctgtctaagccctggttttcttggactccagtaaaccaggctagcctcaaactcacgaagacccccaatttgctgagataaaaggcatgtgtcaccacaccctaccattctttgaatattaatagaaggcttgcatttacgtccttgcttattattcaagaaatgtattggaagatttacagtgggtgttgaactgtctttggcaagtgataaattgggtagaaatcatagagaaggaggacagctctcaagcatagcaaaatatggctatattaaaaatttttttttcagaaaaagaaagaagagggcattattgattcatctgataaagaaattgtggctgaggcagaaagactggatgtaaaagccatgggtcctcttgttttgacagaagttctctttgatgagaagataagagagcaaatcaagaaatacaggcgccattttctaagagtaagagacattttttaggtttattatccatgattgtcaccttagggctatagctttaaattcagaccattatattacctcctgaaaattgataacccccactttttaccgattctgggagcatctctaaatggtaagggtgtctacattgacctttttgagccattgtttcataggctattctttgagaaagtaaacgtgcttagtagatacagaattgtagagctgtaaatgattgttgatgctgtctacctgcagttttgtcataacaacaaaaaggctcagcggtaccttcttcatggtttggaatgtgtggtagcaatgcatcaagctcagctgatctccaagatcccacacatcctgaaggagatgtatgatgccgacctgttagaggaggaggtcattatcagctggtcagaaaaggtgaggagcatataagttacagcactgcagaagcatcaagacagctattggggcagaagaagttgtgtctagtaaatacctagtcttgtctacattaagttgaattgtaagtccctttatagttaaggcagcaaagattattttgacaatctcttgtctactgaaaattagggaatgacccaagctctttagagagctcattaattgtacgagtaatttaaattcttcaaatcttcactgagaaaattctggacttttccaggcctctaagaaatatgtctcaaaagaacttgccaaagagattcgtgtcaaagcagagccatttattaaatggttgaaggaagcagaggaagaatcttctggtggtgaggaagaagatgaagacgaaaatattgaggtaaatgctagaaacacatgttagtacttggttagcaatgggcattgcagatacacacacacacacacacacacacacaca

SEQ ID NO: 21597 - DNA, 2215 bp, Mus musculus
tgaaaatactgtaattctttcaaatgaaaaaaaaaggtaatggaaataatctagtcctgcatttgtattgccaggtcgtatattcgaaaactgccagtgtaccaaaagttgaaactgtgaagtctgacaacaaggatgatgacattgatattgacgccatttaaaagaatggatgcaacttagcttaacagtgtaatgctgcaaatttttctccattatcagccagaagtgcaacatgtatgtgcaagagctaaagtggcttaacatcatgctacacttgatactaaaaagctattactgtgagtggtctataattaagcccaatgagacatctagggagtccatacatatcagtgagcagttgtagtttgcttatttatagcatgtttctttcggaaaaacctagtggtggacacatttggatcacatttatacagttataaaaaataaagatttgattttggtcattcttcagactttgggctatgaatggcttatactgaagtaattggctacttttaggatgttacaccatttaatttaggctccttgagtttgatgggttgttaggaactgaaaacttgaagaatgcaaacaaatataatgaacttactcagccattaagaaatgaagtattttgaaagttgtatctccagtcccagtccattcagattggcaactgacaattcttgtcattctaaggaaattggtgattaaatgacagtgtgacatcctcgtaagaagtaaaaatgacctgtgtgtcctatggtttaagagcaaattttaaaacttggaagttgtggttttccagtttgtgtacactcacccccaaattgtagtctttcaagtcgtgtgcattgcacgttggataagccagggaaattgttaacaaataagtattttgtgtgtgtttagtggttgctttgtattgagagaaaagctttgaggtgtgattaaatcgtaagctctgattctatttgggagaaacaggaaaaaaggtgcacttaatctctagctaaaacagcgtaatttttcaacttttacccttaaattataatttcaagatgtttagacatactgtatcttgtgtttgtgtaccccctccccaatattatggtttattctttaatgccttttaatttggatataatagcttgtactttagattttggttgctatcttgccaaaataagtgttactgtttttcaagcttgacccccttccccaattgtcttatttaaagagaaagttaaactcatacttctgagtcagagcctgtattttggtgtaagacttgggatattttttacttcacattgaatatagctggatacctgagagactgatggccactgggtgggtgcagctagctaaggcctgaccagcccattcagagccttggacttcagacacaaaagtgagttcttacacacttgctggtgtaagctctatctggggtcctgactatatttgaaaacttgtcttcaatattaaaaacagcacatatttctttctacaaaagtgcattctgggagttaaaaatccatgtggttaatttgtgtgtggcgtgctagctcatacattatttgaatttcattctttgtgtcatccatctcacagattattagactttaataaacaatgtaaaaaattgtgcattaaaatcatacaaatatttagtaaaattagaactttaataagagtttgagtgtggagcaggagccatacacctggaatggtaacaagggaatgtgctgtgtcacaccaaagatgtggtacttggaaagtcacttgtctcctgggtttcagattctttgttgcatggtccgcccatctccatttgtcatcattttttgagattctcaagtacatcagcacattcggcctcaggttggcaagatttttgtcttagagctgttgctttaaagggaaacggtcaggtcttagacacttaggaaggtcttgggcttctgttcattctggtgccaaaccagtgggattcaaatttcacacaatctgggttttactcatggaggttaacctgataggaataatccttcgttgctctattgaggtgtcataaagtttcctgtttcaaacagctacattacttgattaaaacaatgttaaaattaaatttctgtctgctttaatattaaaaagtatgttttcattttactgtaagtaaaaagcactgaatgctgtccaggattat

SEQ ID NO: 21598 - DNA, 1139 bp, Mus musculus
aaatcacctaaaacaaacatttcataagaaagtgttgtatatcttgggtaattgaatacctgtatcctttccccccctcaaaaaaaaaaaggctggctgcactgtgcactgcaatcttgaccatcatggcttattggtgtttttagactgttaattacactgtttatcaatggctcaggaaaaagttgtaatgcacaatttgaagtacaatttttctactaaatgtcctccatgaatgtttttgtaccatgataagttggaaaaatcataaattggaactgtctcagctcttagaacaccggattgagctataaaacttgatgtttcttgtatcagtctcttgttttcctcttaaatttatatcacgtgctttggtcctttaggattcaatgaaagccttgatgttttgtttctaacctctagatgctcctaaaatttggcagtactgcatgtcctctcacttccttgtttttgtgtacattacgtttcagcacatttcacatggagacgggaggcaagaagtcacctcccgcaccgggcgctctggagctcggtgtagaaactcaatagcttcctgtgcagatgaacagcctcacatcggaaactacagactgttgaaaacaatcggcaaggggaactttgcaaaagtgaaattggcgagacacatcctcacaggccgagaggtaaatccctgtcttgcttttgctgtggtagctgtcctgctatctcttaaggaccaggacatcgttaacaactgctaatctcttaaggaccaggacatcgttagcaactggcaagtacaccaagggaatgagccaacttgaaaaattagtaatgctgtgtcttttttcaatggaaaaaaaatcaataaaactgtcttgaactgcatgtatgcacttctgtatataagcccatacgctcatgttacttgcagatcaatggttgtctgtgtacacaggtttatcccacaggtttccttccttctctgggatttctagtagcccatgtttgccaggttgtgccagaggctcgtgcttccccagcttttgtgaccttggctgcttcctcttgcattccttatccgtgttcatatagtgacacctcagaattatcttcctctttgcatcttgtatggtgcc

SEQ ID NO: 21599 - DNA, 1857 bp, Mus musculus
tggcaggtgcccatcatgcactcaggtgtcagcagcttgcttcccaccctagattatgagctcccgagggcagggccctgtcttgcccatccttgtgcatccaaacagcagtctagcgcttgctgtgtggcagctgcatagtgcctgtcagctaaaaagtggctggtttgtctctggggtgaagtggagagttctctttcccaaggaatacccatgtacagccacttaatagtatttatcaagtgtgactacctaaaaaaaacctgtgtttttaaaaggcctcttattaattgaagactctttttgaccttgaagtgttttctatttaaatttgtcttataattattatgtaattgattgttaatatcaaattaagaattctaatagtgtttttacatttaattagacataagtccttgtaaaaagcctttatcaaatgcctaatactattgtcataattgtattttagttaagtttaatttttgtcttgatgtttttctctaggctgaaaatctgttattagatgcggatatgaacattaaaatagcagattttggttttagcaatgaatttactgttggcagtaaactagacacgttttgtggtagtcctccatatgcagcccctgagctcttccagggcaagaagtatgacgggccagaagtcgacgtgtggagcctcggtgtcattctctacaccctagtcagtgggtcgcttccctttgatggtcaaaacctgaaggtataagaagcagttgtagccatgcacctcaaaaactaaagatttttattaaattgtataaattgacattgtaatgctctgtctgtatggatgtattatgggtttggtttattgttactgttttaaactaaaaatgaactcttgtttggttcctacttccccaaaggaactgagagagagagtactccgcgggaagtacagaatccctttctacatgtccacagactgcgagaaccttctcaagcgcttcctggtgctgaacccagttaaacggggcactctcgaggtaatcgtgctgggggaggggagaggactgacagaactgtccttagtttctgtgacgctgaacactgctggagctcagtaataagtgcacagtaacaaaacactgcctcattgccttcagagcattagtcagtgaaatgctgaaaatcatgttgctaaattctgtgatgctgagataactttgctccatgctgctgacacacagtttccctttcagcaaatcatgaaggacaggtggatcaatgcaggccatgaggaggatgagcttaagccatttgttgaaccagaactagacatctcagaccagaagagaataggtaatcactgtttctcatgtgcgtgcgtgtgtgtacatgtgtgcgtgtggacgtgtgtgcactatgctgttttactcctctgtgtatgccttaaataaaaataagcacgaactgtagcgatgcagtcatctgtccttagctcactccctgcagttgtgctcagcagctcttctgtcggaaatatataaccttctaaatgaaagaaaattctttctccctatgctaccatgatttccaaccaaaataaaatatataaatcgtattgtatcttttagatattatggtgggaatgggatattcccaagaagaaattcaagaatctcttagcaaaatgaaatacgatgaaatcacagctacttacttgctactggggaggaaatctgcagaggtaagagtgtttacagagggacagtggacagaacccgtttccactatagtcctagcactcacgaagtggaaacagaatcagctatcttgctgagttcagggccagcctacacgacaaaaaaaaaga

SEQ ID NO: 21600 - DNA, 1194 bp, Mus musculus
attaataacttatgatcttattctcaggagtcagaaaagtagttttgacggagtttaaagttgtgataactgctctcttattgagaggatgtgtgtgtgtgtgtctgtgtgtgtgtctatgtgtgacaaggagtttcctgacaagccattgggctctgtgcatggttgctgctcttctcattctcccgtagctggacgctagtgactccagttctagcagcaacctttcacttgctaaggtgcggccaaacagtgacctcagcaatagcactggccagtctcctcatcacaaagggcagagaagtgtttcctcaagtcagaagcagagacggtacagtgaccacggtaagtctgagaccattcctgtagtttatgaatgtgttcccttgtgtagagcctggtgggacagagattggctggctattaggggcctggtgtggttaaggtcctctaactatttgggacatttggtagctaatgttgggtaaggcttagcagaatgaaagccatagtatatctctcttgtatgtctttgtgaggtaattgtccagagcatcacatctggtggagctttctgtactaatggaagtttttttctgtttagggagggttggaacagctaaccgttgtaggctattgagcacctagataaaggaaatgaatttcacatttttccttttatgtatatgagtattttaacttcatatgtaccatttatgcctggtgcccatgaagccagagagtatgctagatctcctggaatatagatacttgtaagccataatgttgtttcattgtgtggccctggctgtcctgaaactctccctatagaccaggttagcctcacaaagagagacccacttgcctctgcctccttaaggattaatccctgggattaaagggttttctattgtaatttcagttaaaggtgaaaaatctgaggctcgacagtttgataaatgcctgttatcccagcacttgggaggtagaggcaggaggatcaagaatttaaggttgaaactagagagatgtcttagtggttaagagtacttactgttctttccaaggacctgtgttcagttcctggcactcacatctatccgtacttccagttctaggggattcaactccatcttctggccattatgtgcacaaacatacatgcaagcaaaacaattatctgcataaaatatt

SEQ ID NO: 21601 - DNA, 1201 bp, Mus musculus
taaaaaaaaataataataaggttctttttccagtaaatgaaaactcatacactgccctgtgcatttcagtcgcaatgtgtcttcagagcagaaggatgagaacagagaggccaagccccgctccctgcgcttcacctggagcatgaagaccacgagctccatggaccccagtgacatgatgcgggagatccgcaaggtgctggacgccaataactgcgactacgagcagagggagcgcttcctgctcttctgtgtccatggcgacgggcacgcagagaacctggtacagtgggaaatggaagtctgtaagctgccaagactgtctctgaatggagtccggtttaagcggatatcagggacatccatagctttcaaaaatattgcttccaaaattgccaatgagctaaagctgtaacccagtaattatggtgtaaattaagtagcaatttaaggtgttttccagagcactgatggaaatgtatagagtaatatttaggcaataacgtctgcatcttctaaatcatgacattaaagtctgaggatgaaagcgagcgcgcctgggagcgaaggctggccttctctacgaatgcactacattaaagtctgtgaccccgtgcctctgtcttgtttccattgccctgggagtcagagtgtaacaccatctgcacgcggctccttgtgtggtgtgagtggatgatgtgtggggagcactgttttggaagcggctcctcacacggcagccagctttactagtccctctgtgggagatcatttggtgctaaaacattacagttgccaagaaggaaaataactgaattactgctaagaattaaccttaaggctagttgataattaatacaggtttacagttcatgcctgtggttttgtgtttgtttcgtgatttttttttttgctttttttttaagtgcaaaaggtttaaatttatagttgtgaacattgcttgtgtgtgtttttctaagtagattcacaagataattaaaaattcactttttctcagtaaaaccttgcactgtctcctactgctctattgaggcctcagcctaagacagacccgaagcatgctgctgcctcccgttgggctgagtagtggcagaggatgtgtgtgaagcttggagcactgcgggctctgtacagagcccagcacttagatctcaagcacactgtctcccagccctcctgg

SEQ ID NO: 21602 - DNA, 1217 bp, Mus musculus
tccgtagggcttccggccaggcttccttctcttaactctcccttctccaccttcagatcgaaactctcttcaagtccaagaactatgagttcatgtggaatcctcacctgggctacatcctcacatgcccatccaacctgggcaccggactgcgggcaggtgtgcacatcaagctgccccacctggggaagcacgagaagttctcggaggtgctcaagcggctgcggcttcagaagcgaggcacaggtgaggggcagaaggcacaggtgaggggcagaaggtgcaggtgttgtcctcagccccgctgacctgcccatgtcccaccgcaggtggcgtggacaccgctgctgtcggtggggtgtttgatgtctccaacgctgaccgcctgggcttctcggaggtggaactggtgcagatggtggtggacggagtgaaactactcattgagatggagcaacggctggagcagggtcaggcaatcgatgacctcatgccggcccagaagtgaagcctggccctcgccaccatcaggctgccgcttcctaacttattaaccgggcagtgcccgccatgcatccttgatgtttgccgcctggcggctgagcccttagcctcgctgtagagacttctgtcgccctgggtagagtttatttttttgatggctaagctgttgctgacactgaaaataaactagggtttggcctgccctatttctgagtgttgcttctcctttcctagggacagtgtgtgtgtgtgtgtatgtatgtgtgtgtgtgtgtgtgcgcgcgctggccttctgtgtcatctcacctagcagatgaaacatgagccatagaagatacagggcagagagggagggaggctctgagtccagcctgagcatctaaggacatctgtgcttgcagggtggagcctagtgtttccttagtcccagccagctaaaggagtcagaaacttgacatcttccccagtttctttctgctgtcttcctggcagcctgaagagccaaagttttacctcctcacttcctccccctccaggctccaacccctactccagttcctaaataaccctctccctgcttcctccagcttccatcgtcctcaggtcgaggtgcctcctcctcaccgcccccccccccgcccccagctctctagcccctgtcccgtccctctcatttgcagctagcttcctctctggggccctagtggttggga

SEQ ID NO: 21603 - DNA, 1216 bp, Mus musculus
gactctgacgatgcagacctcgctgaccttggtggcgtccagggaaagtctcgggggtcccaagtggtttgcaggtccctggcggccggtgtttaaatctcctctgaccccgctcttccctgcagcccgctgccgccgccatgcccttctccaacagccataatacgcagaagctgcgcttcccggccgaggatgagttccctgatctgagcagccacaacaaccatatggccaaggtgctgaccccggagctgtacgccgagctccgtgccaagtgcacgccgagcggctttactttggacgacgccattcagactggcgtagacaatccgggtatgcacacccctgtagcgtcaggcttccgcctccccaagaagccccccgggcaaggatcccactgctcttccctgaaccttcggtgggctggggtcccctgttcccctctccgcgcttagccttaagagcctcggcttgctcctgcctgacggtgacgtcactgtcgccgcgcccctcctccaggccacccgtacatcatgactgtgggtgcagtggcgggcgacgaggagagttacgacgtattcaaggacctcttcgaccccattattgaggagcggcacggcggctaccagcccagtgatgagcacaagaccgacctcaacccagacaacctgcaggtgcggggaatcagggtccgggcgtgctggggagaggggtctcggcgctcactctagccaccaccttgtattcccagggtggcgatgacctggaccccaactacgtgctgagctcgcgagtgcgcacaggccgcagcatccgcggcttctgtctccccccgcactgcagccgcggggagcgccgcgccatcgagaagctggcagtagaaggtaggggtcgggtaacagcctccagagctgctgcgctcttctctgcgcgcgcgttcccactggggactgagggtcgaagacccaccttcgcccgcggggacacactgctgcaggcggggcggcgggcttgctcgcccgcccaccctgtccttgaactctgcactccgcagctctgtccagcctagatggcgacctgtctggcaggtactacgcgctcaagagcatgactgaggcggagcagcagcagctcattgacgaccacttcctcttcgataagcctgtgtcgcctctgctgctggcctccggcatggcccgggactggccggatgctc

SEQ ID NO: 21604 - DNA, 1133 bp, Mus musculus
gagtagggctgccctgtccttgcctgtgccagtactacacagcccatcaactccagcccccgcaccccaaacccaagactgaggctgccaagaacagaacacgcagctcatgatatgacaccgtctctgccctcatatgtctcctggagaggaggagctgttgatgggtgggcatggccctcaagggtcccctcaacccctcttgtttctcctgccaggcacgggcagtggttctgtatcccacgcaatcatccgcagcgttgcccccactggccacctacacacagtagagttccaccagcaacgggcggacaaggcccgggaggaattccaggagcatcggctgagccagtgggtgactgtgcacacccaggatgtgtgctgcagtggcttcggtgtggtccacgtggctgacgctgtcttcttggatatcccatcaccctgggaagctgtgggccatgcctgggatgccctcaaggttgaaggtgcgtcagtggtgttggttagggtgcaggtagggggctgagctgctgggtcatctggaacccaggaaaacccgtgtacccgagggccacaccacagtaatggtcacatcagggttccttttggctcacagcgaggactggctcaggctggctggagaccagggtcagagaagatgggtcccattctccagccaagatgggaactcactggggccctggggccctgacagctgcatccaagtgcaggcaggatttgcatgatagaacgggccaggatccaagctggagattataggcaatcccctacccccagccatttcctgcagactcccagcacccatgctgcagagccagggacccttttagggaagatgctgagggtagaggcggggtgatgggaaagccaggagaaggtcggccgcgagccagaaaagccgctgctgaggcctggggatttcgccttttctggagaagaaacaggcttggcaaccagggctgctctccaccccactctgtaccaagggcgggggaggctctgacaggcaggagcccaggctctctagctgcctcaggtcctgtgcagacctctgtgtccctgctgtctgctgaggtggcctaaggggaagcctggaggtctccacctgaagt

SEQ ID NO: 21605 - DNA, 1399 bp, Mus musculus
gggttacacttgtaatttttagagagatttcagtgctctttaaaataccgcagctgtccatcctttgttctcctgggtatttacagcttcagcctgatgaattcacagaacagatggtagttgattaaatcacagaaacaatttatatgggaattcagggctttttttcagtgttcagaaatagactttaaaacaggataatgtttgtcaaaggcaaggcttgctaggtagcaaccgtggctatgcagatgcgtggctgtgtggtcgaggaggccgagagcgagggcatgaagacagtgagcttgcctgggaggacagcagttcctcttcagtgtgtcttatgatgatggtgatcacgcctcatggaaacgggctcctgcaggcttcctcgggtctgagatatgagaaatatgatgtgagatatgatgtggctctagcaggcactgctatagtaggtcactctctagtagggtgcattcctgcgaaagctgctttgtggacattgagtcttttctagataaaagtcagatttcttagttacccaatatccatgtgattctgtgtctgttgtgaaagttgtgctccaggacagcctccaccttggctcctttttcttggggcccttgagaagcagtctcctgcccctcttctcttaaaccatattgctcttgtgctgagatttctacaagtctgagtgtgtgtgtgtgtgtgtgcgtgtgtacactgtgccagtactagggattgaaacatccctgtggaagggaagggctctacaactgactgtatccctgcctgcttcactttgtttgagacagaatgctgtggagcccaggctggtctggagactcaggcatctcctgggctagtttttcaggtgtgtccattatgggtgtgtgccctagtgcctggcttctacaagttgttggttttttgtttttggacacagggtctctctaaatagccctggctgtcctgaaactcactctgtagaccaggctggcctgaattcacagagatcctcctgcctctgcctcccgagtgctggaagtaaaggtgtgtgccatcttcttttggtctttgagacaggatctcactgtagccctggttggggaactcacagctatctgtgtgcctgtgaattctgagctctggaattaaaggtgtgaaccatgaggcctactttgactttcacaggttccaatgcgtgaaatttctacttcagggccttagggaacgaaggagctgttagtccaaagtacagttttatctatactaagagggcagcaagagtatactaaaagaagttttaaaaatgctacacctataattctattgtacagagatactaaatactaaaatcagtacattatgtgatttatttctgtttagaaacccactt

SEQ ID NO: 21606 - DNA, 1725 bp, Mus musculus
ccctcacttgctttttccaggtgacagacatggtggaggaccagcagtctgtgtccaggtcactagggtgagtgtgggcacctcagcatggcggacatggtgggctgtacaagcaccaacactcattttgtgtctcagggcttcagaagagcgcctctctccagcccttggcatcacctgggctaaccagctcctgatgcgactgatggttgaccgcacccatgaggacgatgttaccacaggcttgcccagaagcccagttcggactctccgagtgctcttcgccccccacctacccctctcctcctgctgctacacagtcagtggggaaggcattagggggatgccaggaacacagtcctactaacagtgagaccagtgggtcagcctgagcaggtcccaaggaaccctgattctgatgactctttccaacaacctgtcagtcagtggcacctggtgaacaggcacccagtgacggttagtctgtcagtatctgctctctcctccctggggttcacctacccattagaggatgactgagcagcaggagctctggcagcccagagggcgtctccgtaggaccccaaaatgacaagactcagctcttctctcttctgctttctgcctgggactcagcagcttggtggggcctaccctcctgcaggatggtcttaactccccccaacccactatacacacacacacacatacacacatacacacatacacacacacacacacacacacacacacacacacacacacacacacacatacacagtaacacctaccactcaggccaagcatggcttgcagtgagacactccccgactgggctcctccccacacatatacaccattttagggcagagtggagaaaactgtccgaggaagagagatgggccaggcccaacccagctgtctaggctaagtggctttgggcaacttatgaaagggacacccggaaacaggtgtgtgtgctcactaaggcctggcaggtgttcctggcaactcggctgggcggtgcatccaggctggaaggcaccacaaagcacccaacaggactgtgtacacactcagccagcaggtaggcctcctggtaacatgtgctctggactcagaatcaacaccttgtggacttgaggctcagcagtaagcaatgggtgtggcctctgtagacagggctgtgtgttgacgcacaggtagcacaggctcccaccagcaagtgtgccaagtggaccttcaccaaggagtcctgttgctccagtagtgtctgactccttaaaccaggacatacactgtcactgtccccactccagtagggaaaacagtccacttatggtatataccatgacatcttcagggcggccctatcctcttatgagctcatcgtttcaaaggcccctggggctcctacccgctgtggcaatcctgcagactaaacctagggcctcctgcatgcaagtgttctacactgagctatgacccactgacccgtgcctgagagctgaggatgaggggacacacagctgcttgggtggggtggttcacataaaacagctctgcagaactggagggctttagacccggaaataaaactttatttttgtaacaaagtatcaacacttgcaaattattttctaaagagactgtattgaaaattagaagacagttcccagaggcacttagaatctatgcccaaaggttcctagggcctggatccac

SEQ ID NO: 21607 - DNA, 1184 bp, Mus musculus
ccaattactgtaaatccacataaatacccagcttccaaaacatccagcccttccaccagtaagaagtcatgactctgatccccgaccgctgccagtgaagacaaaagccctgacgtggcccaaaggccccttctcatgttaaatgtctcagaccttgaacaagagcaaggtggctttggctcccccttcttggaaagcctcaaaccatcatactttctcacattgcctctcactaccaaaggagcccattcggaaactgcgtttcattacctatggcgttctgctgtggctggacatgcacgcctcagcacatgggggtctgcgcaatgatgagtcaaagtcaagtcggtggtgggctgggcaaagccacctggcagccctcgaggctgtcactggctgcatcctgagcaaggcaagtccgttctggagcttgacctctgtagacaggctttttctacaccaggattgtttttcagccaggccactggaactgtgtttcttctgtcggaacacaggccctgcctgaggctttatttttcatgtgagtcttgtgtagaactacgtgtaaatcctgtaggctctgggagcagtgctgtgggcagccgccatgtgctgatcgcacccgtgagcagccactgccatcccagtgccaccgatgctgtgtgacgtgcacaataaactgctgtctcacacctggctttgagtcctttgagtcttgtgttctggacgcaggacagctgcacaaagtgaggccagagcctgctgtgtactttcaaaataagttttaattatacactttatatacaaattactgtacagtcattttaataaagtgaaatagtaagtgaaagtagaaaacagaaagctgacgccttcctcttagaggcagcaacaggactgttcatcgccccggttagtgacagagtgaccagagtctaggaacagctaaggcattgtgaatgggctattgagagtggaagggcctgagtggtcacccccgaatgtatctgtgggaacagagccacaagcctctaatgaacctggaagtttacagaagcctgctttagcagtaatgtagtgcagcttctcccaaccctactgaaggaccacaatgcacaacaacataagctctttacagcattaatcagcggtgtacatattgcactaggtaagtgatactctgc

SEQ ID NO: 21608 - DNA, 1182 bp, Mus musculus
gcggaggccgcacttcccccagttctcctactcagccagtggcacagcctgaggcctggggcagcggctggcagctccacgctcctctgcattgccgagtccagaagccccgcatggatcatctgaacctgatgttttgtttctcggatgcgctggggaggaaccttgccagcctccaggaccaggggaggatgtttctactgtgggcagcagcctacctcccagccaggtcaggaggaaaactatcctggggtttttcttaatttatttcatccagtttgagaccacacatgtggcctcagtgcccagaacaattagattcatgtagaaaactattaaggactgacgcgaccatgtgcaatgtgggctcatgggtctgggtgggtcccgtcactgcccccattggcctgtccaccctggccgccacctgtctctagggtccagggccaaagtccagcaagaaggcaccagaagcacccccctgtggtatgctaactggccctctccctctgggcggggagaggtcacagctgcttcagccctagggctggatgggatggccagggctcaagtgaggttgacagaggaacaagaatccagtttgttgctgtgtcccatgctgttcagagacatttaggggattttaatcttggtgacaggagagcccctgccctcccgcacccgctcccgcgtggtggctcttagcgggtaccctgggagcgcctgcctcacgtgagcccttctcctagcacttgtccttttagatgctttccctctcccgctgtccgtcaccctggcctgtcccctcccggccagacgctggccattgctgcaccatgtcgttttttacaacattcagcttcagcatttttactattataataagaaactgtccctccaaattcaataaaaattgcttttcaagcttgtggtttgctttctggtgtggagcgtcacagccttgttagtgggtgggaggtgaaggggtgtggctggggtcacatcagggtgggtcctgggaactggtccctgaggctccaggggatgtcgtcctcatggcaggacactcctgacagaagtgggaggatcttgactgtctctggagtctactcttgcagtgaccctccctggccatctaagacacctgccagccccagctgtcgtgtgtctggcagagcaata

SEQ ID NO: 21609 - DNA, 1285 bp, Mus musculus
ctatctaatgagagcccctatcaaacccttgaatggccacagagccctggcctgagaggactgtcagtctacatgaacagacctctgccccatcccctgagttacgtgtgtacagtaagaagagacacactatctgagctgtcagagctggccccatttctggagtggatggtgacctgtccatctagcctctgtcccaccacatcaagggagctgtgctgtgcccgaggattgagtggattggtttgagccaaggtgccgcagccccactacttgcccttgctgtccccagctgatcccacttacccccctacctcccagcatcttcacatagacctcctgcctgctgggaccactgggtggggatgtctgcttggcagaaattgcttgtccctcacctgccagcactgctgagcatgcaggccccgtccagccctcatccaaagtgcatttgctgttgatgctggttgggactcaaaacagctctaagcaaggaatctaagattctacccaggcagccatacctaaggatgtaggtctgatgaaggctgtgggaacctggcttggactggcaatggtctgacctcactcacctgtgtgagccagctttgtggtgccatatctggtccctgtgtgtggcttacctcattatctgcccagcatcctttcctggtgcccagagagatgctctcatctcatcgggcacagccggttaccactctgccccttccctgccccctggatgctgcactgaccccaggagtgcccagtccctggccctgcatgtcctttgggctgggggtgcttctgctaggggcttctgaggacagctgtgatgcacctgtcctgcagcacggggccctcatcctgagggaccctgaggctaccgaggcactgagtgttctctgttctgttctcgcttctgaatccaaaccactcactcaagacacgaggcgtcggcagcagggttcggattacacgtccacctccgaggaggagtatgggtcccaccacagctcccctaaacacacacgctcccatgcctcaacagccacacagaccccaaggggcagcagctctacccgggctcgctcccagggcccccgagacacagatgatgacgaggaagagcctgacccctacggcttcatcgtgcagacagcagagatcgcagagattgctaggtgagtgaccagtcagggccaggccagaggccccctcccttggctgagagcagcctaagggccagggctaggctgggcttctgaccctgagtagatttaga

SEQ ID NO: 21610 - DNA, 2979 bp, Mus musculus
gacttagaggccagaatcaactctgagaatgaagtacccatcctgaagacatccaacaaggtgagagacagagaccccatccttgagcctggccccccatcctcgggcctggccccccatccttgggcctggccccccatccttgggcctggccccccatcctcgggcctggaccctcatccttgagcctggccccccatcctcgggcctggacccccatcctcgggccaggacccccatcctcgggcctggacctctaccctcgggcctggacccccatcctccggcctggctcccagccagtgggcgttgctgagctggtctgagccacatccttaatccaagtccaccaggaggccctgggggccctgcatgttcctactcttgccctccaaccttcctcctctctgtcctcccaggaaatcagctccatcctgaaggaacttcgacgcgtacagaagcagttagaaggtaggtgtggcccagacctagggcaggcaagggcgacctcagaggcttatagccagattctcaactggactctttgatctcttcctccagtcatcaatgccatcgtggaccccagcttgaacctcgacctactgatgggaaacagggctccttcagggtctggccagccaggacttgggaaagcccggccagcagctcagagctcaacttcacctgcctcggtggataccttgctgccagccctgcctctcaggagcttcccacagcgggccaactgcgggccccccggcctcccggagcctgccttccttcctgatgctgagaggtttctgatctaagctgtgaggcgggcaaggccagccttcttctgcgcgtgtgtcctgtgcatccatcccacggcccacctgcctggctgcaggaggttctctgtgaaaaccctgtatgtgccatagccccatggatgggtgcctcccatttccagaccctcctcagccagcacctgaaccacttcatccagcccatggcgcccccacctccacaggcctcccagcctagcccctggggtgtccactgccaagggccagctggtgaggccccatattcacctcctgtcaatcaccattgtttttgttggtagctttaaaggaaagagtacattgctcccttgcaggaacttgcaggccccgcttaggtccaggcccagcctgggaggccccgtctcatccctatgtgctggcttgaggccagacagagaaaggagctggaccctggggccagtcagtgccaaacacaggagctggatgggtttggcatgtccccaaactgcccaggaaggaggccacttgccttgtggctcctactgagtccacggccggagctgctgcagagtccatcaacctgggcagacgagtggttctaagtccttggtgccaacacaactgccaaacccactgagtttgggtactgtcccagcaagctctcctgagtggattcatcccagctagggacactgggcttccttacagtggggctgggtgtagctaggtgggccagcaatcccgttggttgtggcgagtgctttaccagagtggcagaaagagatttggaagctcctggctttgtgatctaaaccatgtacctgcccctgccgtcccagatggtgcgggcaggaagtggtaactgcagcaggctcctgcggcccgatccgttgcggaggcctggcagggacaggctcactactggttatgctttctcaggatttgtgcggctggggcctgccaggtgagcagggtagctgccctgctgctgccccttgctgatgcttctggaggcactaagccaaagagcccggtggctggagtgggatggggacagtcccttattgaccaggctggcatgggtgtgctctgggacctgcctgatgtgtgtgtgggcgttgctcctgaacaggacctgtctgctgggagaggtagctgcagcggggggcccagagcccaggggtagcatgggtctccctgtttacacttagctgatagagtcatgcacgggtcctgtgtgcctctgcccagcccacctgatgtttacgtgtgtatgtgtgtgtgtgtgtgtgtgtgtgtgtgtgtgtgtgtgtgtgtgtgtgtgtagagcttgctgtttgtctggaggaggtgccagctcagcctgttggctgctccgcctgcatgtcccacacattgcccacagcctgctccctgtaagtaaacggctgtcctgcagagtccatgcctcccacccttggtcatcactgtgtaattttttttttttaatgcacaaattggtgttcctctccatacttagttcctctgtcactttagccttcaacccggcattggtactgtacatgcctggcttctgaaggtatctctgtacattgttctcaggcggtcttgtggatgtctttcaggaaatggttattttatatgatttgtcatgaaatttgttctaataaatcattcctccacgtggcagcacaccagtgactgccgcctcggccctcttctctggggatggtgttgggtgaccatctccttgacacaaggagtctctgaggggctcaagacactaaaggcagtgggtgtggtggcatatgcctttgtccaaagaacttgggaggcagggatctctatatctgctcccagccagggctacttaacaagatggtcttttaaaaaaaaaaaaaatgaattcagatgttgccaccaggtggcactcaaagcaaggaagcagcaagcagatgtctgcttttgtttaagctaatgtgtattagtggtttgcctgcattttcgtatgcactcctagtgtcagtggagagtagaagaggccattgtgtcatctgaaactggaattacagatgtttgttatccgctgtgcgggctctggaagccaagtcaggtcctctgcaagaacagccaattctcctaaccattgagccgcctctccagccccaattcctcacttcattacagatca

SEQ ID NO: 21611 - DNA, 1735 bp, Mus musculus
caatggccttgagggctttgctgcagccacccctcctcccagttccacttgcaagtctgacctggctgagctggaccatgtggtagagattctggtggagacctgagaggccaccccagtgggctaagggtgaggccaccagtccccatggagctcacgtgtgttgtgacccagagacagataagcacttgtcctaagaggggctctggctcttgagctcattatccttttgtgtgacattggactcactgtggaggatggtgtgtcacagctatgtctagtctattttcaattagataggtgaactttctaaaattaagttttatatgtttttgggcaatattttgtcttaagatatattttttaaactttttatactttagatttttttcagctattttcttaaaagtatattttttctacaaacatcctctgctgctacattagaaacatttataacctaaatacgattggtgtgtcattttaaaggtttaaatagaaaacttcttttgttactgagtctctacactcccaaggcaactgtaaatgtagccggccgggtgtttacatgagaggctccagtatggtctacattctagtagagcttgaaaagaaccatgcacagctccactgccccctcactgggtctgctctggcggatcggagctctcttcctagccccgtgtgcaggatggctttatttatgcctatttatatgtaaatgccactgaaagctaaggtcttactcctggaaatcccaacaccagttcttcagggactgctgtgaggcagtgccttatgcaggtcttgtccttggccatcactgtctggttcccagcccagcacatgtgacatgaggacatgacatgcccgaaccacccagcaccacatgctccatgtcaagtgtgtacgtggagaccactggctcccaggcctgtgctcagagagggtgtgcagtcctacgtgtgctgggggggacgacggtgacctgtgcttgcttgcttttaaaatggtgcttggacgttttaaggttaaaaacaatccgactccatatgatttagggctcctccaccctggggtggcccctatgctgtctgcttggatctcaaagtcttggtactcggcactgtcagactccaccccatgtatcctttttgtttctcttgtgctttttttggacttcccaacctgagcctaaggttttattttatatgtgcttcaatatcaacaatgtaaacctcactttattaaaagtatccagcaaatggaatgtgttaggagccttttttttctatcttaatccttcaagtgagcttgctctatcctgtgtggttttggcattttatatgctttgtaatgtagacaaactttttgtggtaaacaggcaatggggttattttcctgaccttatggctcccaaggcaaaattctcccttccctttcagcccctgcttgccttccctgggcctagggggtctgaaggaacagaacagactggctcatccccaggtctgtgagcagtcctaaggctttctcctttatcaaagctagtttaaagtggtctactaataagcctaaagcaggagttttcttttaacgttttatttatgcctgtgtggaggtcaaaggacaacttgctaagtcaacctttcctctgagcccagggatggaactcatttcagctgaacaatcccggtggccctaaagctatatttgcttgtttgaagcatttctg

SEQ ID NO: 21612 - DNA, 1550 bp, Mus musculus
ctcacacaagttcaccaaagaccccagctgctccctcggaaggccagcccgctgggctccagggcccaaagtggacaaccgcgccgtcagaagtaccaaggacgtgcgccgtgctggcagggaatagccagccaccaggctggcacccagaacccttgctggcaccacgctgcctgccggaccataggaggccaaggccgtgtgcatagtttctttattttgtgtaaaaaacaaaaccaaaaccaaaaaacaaatgtttattttttacgtttctttaaccttgtataaattattcaacggctgtcaggcggaaaacaacggagtattctcggatcattgctatttttgtaaagtttccgcgtccgcacgcactgtggcaggagagcagggcgtgtgtatgtgtgtgtgtgtgtgtgtgtcctcaccaaatcgtataatgtttgttaccacaggccgtcgctgtttacagaatcttcttttttattcctcatttgggtttctctctagctcgaggcccaaaagcccacgagacctgtgggctgggctgtggctctcagtgagatctgtggctttcagtgtggcccgtggctctcagtgggacctgtggctgacagcatggcccgaggctgtcagtgggactgtggctgttgtcttagctgtagctctcagtgggacctgtggctgtccatggtacccatggcaattggcccagcctgtggatgtcagtgggacctgtggctgtcagtggcactggctgctgggctggcgtactgtcagtgggacccgtggtggcccgtgtgatgccggttacatagctgttggtggcgcctgtggttgtcagtggggttggaggtcactggtgtggcctaaggctggcacgtaaacctggcccatgccttggctagcccctccagcctgctgtccttgcttcctcctgcccagaactctccagagatctccaactgtgctttcagaagtgcccttcccaactgctcggtttccctcccgggacggcggcagtattgaagcttgtgacaagtgccttcacacagaccccctcccagctgtcagcgtttgccgtgggcaccaggccgctgcccacctgccggccccggccaccctccttgtgaaagtgcatttctgtaaatatgtacatattaaatgaatcactctgtatatttgatttaataacttaaacgttttggcctccctgttctttgggttctgttccttttctccatgtgcagttgggacataggtggaagtgggacatggcctgagggttgggtcatgttgatgtggggtcttaagaggtcaggtggttctgttgacctcagcgcagtgggtgacttgggcctcaggcactgctggagtcctactgtagtagttgacacccgtttagtggaaccctcctggggagtaaggtttggggaatgtgtgtacctggcctcctaactaaagagagggctttatgaaatgggacagtgctcagcaaaaatgaattcacagtctaagagaccccaagtttgagagaaggaagcccaaggatg

SEQ ID NO: 21613 - DNA, 1194 bp, Mus musculus
gttttgatagatattgagaacctgtcacatagtggctccttcagagtttggtcgccccttacttcctccagtggcccctcatacacatacaaggccattgccttgttatgatttccaaggctcatcttccacaggaggcactttgccaccctcatgcctgaagcccttggggcacacgtagacccaggtgttactaagtctctgtccttctctttcactttatgttcacctgggagacttctccaatacaacagacaccatgtttcgtgtcttgatccgatctgaagcatccttcttcctttagtggtctgaagcaagcttgtctacttactaagcctttttagtagagttctcttggtcttagctgtctgtgctaatgtcctttgtgtagtttcctctttttcttgaactttatctgtgtccctcttccacacatcatggctttggagcacagcagaaaacaactagctggatattctaggtccacttctacagctggggacagagatgtgcctttcagatcaaacactagaaggcactgtgtgcacgctgcaggctgtatggagacagagctaaagcacctttggcttctgagtgttgactgtggacaaccctggtgtcaggtgaggccagcaccacagtcactgtgttctgccactgagatttgtccctgccactatctttgtgtcctttgtaatggcatccacctgttctccccacttcaggctgccactggctgctttctgtcactgaattcgtggtcttttatatacttttgtgcagaaatcttttgtagacatagtgtgttcccttgcctttccttggcatgatttttatgcagttcattggcagcatgaccctctgtattgggtaggtgttgttagtgcggtgaggagtgtggcactcctgttaagtgcatctgcatcagtcccaggtagccctatgtacgggctcatcccatacttacttccttggtactgggcagatggaattgttgggtctggtggaggtggtgttggcaaatagtctgaacagcactgtcagcatttatgcagccagcccccctgttttctctccttcctttctgtttttctgtgtctagactgtcctttcagacattacctgtaaataaactatggctcacctttgtcttacaatgtctttcacagggcaggcttgtaattctcttgtaaa

SEQ ID NO: 21614 - DNA, 1140 bp, Mus musculus
tcaaagaggcctctgtcaaggtggccgagatctggatcgtctccctgtccagccagcccatcgaccatgaggatagtgccatgcaggctggccccaagaccaagtccacaggtgagtcactgccttccttcctctgctaccccgctctgctcttgccacttcctgccacatgtgtgggaggccgtcccagtgtggtcggagaaggtagagtcttttggcttttctctagctagaagctttgagggagtcgtgtgcactgttgaagttcatttataagttctctgaaccctcgatatgtaggtgccatggatctatcctgtggccttcgatgttgtgaacacccagtttctggtgtggagaaggtgcttggcccctgtcattgctgctgccatcacagtgggggtcgctctgtttcccctgctctcttactccaccaacatgccagcaggcacatgtcagcagacgtgttccttactccaccaacatgtcagcaggcgtgttccttgagacaccaatgctgtgcctccatgttccctggtctacacgggtctgtctcccctctgctcccaggggacacccatggttctgttgccacctcatcgccatggcgttgggtagaatctagaggtactctcccttctgtgtgctcattccacagataactactctgaggaggagtatgagagcttttcctctgaacaagaagccagtgacgatgctgtacaagggcaggtaaagtttgagcctgagatggggaggtacctggcacctccctcttccacctctgtagatcagggctggggactgagggccttccctgagtgagcccacacaggatgagaaggggactatatgtgccacacctgtttgtttcttccctgggcctacaacatgttagtaggcaactctgcagggtttgggactaatagtagctgactgcccagtgatggcctcccttgcactgtggggcgggctgctgtgtgggcgcggtggcctcaggctctctgcctctgtctgtacaggatcttgacgaggacgactttgatgtgggaaaacccaagaagcagcggcgctcgatagtaagaacgacgtccatgaccagggtcggtggaaactcgttttactaacactgggaaaggg

SEQ ID NO: 21615 - DNA, 1149 bp, Mus musculus
tctgccgcctctgccttgtgcagtgcaggacacaccagacatcgtgtcacgcatcacccagtacatctcaggagccaactgtgctcaccagctccccatcgcagaggccatgctgacctacaagcagaagaggtaacatggtgggcctggcagggctgggggacctaagagatgtaccttgaccctctgctccatgtaggctatgggatggaccttttcaaggggccaggatgaaacagctgagtgtggcaggagcctactccatgtcagatcagaataccaggttgggtttttagaaccccttatttttgtgcatgttgacattctacgtgatgtagtaaaaggcactggttctttagtccttctgtctagtcatgttccttccacgtggctccttcctcacaggtcccctgaccctggctttggcttctgggtgaacagttagatcatgatcccaactgcccagaattgggcagtgctcagaagttctgtgtgaaagattagacagagtgggtctgagcccaagatgctgaggggccttaggcaggacctcctcaacttagggaactaaacatatctgtcttggctcagacctctggacattgtagcctacatgcagtcaaggagagttaagtacacagagcctaaggcagcctcctccttgatgtccaggttgggcccagcaccctgctcaggagaggcagagaccctgcagccagtgacaacaaaagttcaccatctctttaagttgtgcatgtcacacactgccttccccagaccaaaagatagttgagccagaggctcatctggtgtagtagatcagcagaggtcagccttgcttcttgactgcctggtgcccaggggcagatcggctacacagatccccccatgagccctcagccaaaccaccaggagccattctgctcctgcctgagtatgtagatgacttgttgttgttcctgagtgtcctaacatgtgtgttttctctcttggtggctttccaaaaaaggaaaaagcattttcactttgactttaccctgaggtacagctgtctggcttataccctatctgtctccaggctggtctttggggcttgtttagtagggccattgcccaagtgcatctcctgatgccccaggcaggatctct

SEQ ID NO: 21616 - DNA, 2636 bp, Mus musculus
tgtgggccactgagtaactttgctcggcttactaaccagaatatgtgggcaagtggaaaggctggtaagaaaggaggtgaactctggtcccatgaaagcccagaccacaagcaagaaatgttcttgcctttgtatcctgccctttgctgacgtcaggattctgcttcctcagggagtagggagcacggggagctttggagtttagtggccagaagctaaaggtcaagggcatgtttgctctcctagcatgagatgtcagtccctggcaccccatgcgtggttcccaataaactccagcctcatggcggaggttttatagtagcagatctttctaatgctctcaaatacatttgacaacgtagctgccaagcagatgttgctcttgtgaagtccccttgctggggcagagccagcaggagctgcatccctaccctacccctgtggctcccattccacgggcacctttaggcttctgctgctcagatcgggtggtcctttcatatgttccagtgtccgtcctggaaatgggagacacttctggggtctgtctgagcccttccctctattctgcttgctggacaggatcatccaggattggccatgtgggatctgagctgagaattgaggttgtaaactggaaacaggcatctagaggttgtgtgtgtgtgccatgtgggatctgagctgagaattgaggttgtaaactggaaacaggcatctagaggttgtgtgtgtgtgtgtgtgtgtgtgtgtgtgtgtgtgtgtgtgtgtgtgtgtgtgtgtgtgtgagagagagagagagagagatttgtttgtagcccgtgaaggctccagcatgctggtctgactacaaaggccacctcccttacaggactaggtctagccaagccaagctcctcatagccacctggatctggttcttggtggcagctccaccattttcccatccaacttgaaagggttgtgctggtgtccgacagctcaggtcatcctggctgtacacgctccaccagactcatgaaggggtcactgcctcagtcctaattttcttaagaatcctttctccccgaggtatctaattagaagagttcctgtcaccctggaagctagggctctctcgggggctctggtggtccattgggaagcatggtgtctgaagaatggtgtctcgaccttgagaccttcctaagagtatgttgagaaaattgtcgagagcaggacaggctgagtttgaggactgctcgcccttcctggggtgaaagatggcaggtttttatttacttacctcccttattgacttgctgaacagggtctatttgtcctggataataggtccccaggtccctgggtccagggcttcttagtggaactcctggtgaggtattctctgaaaagatcttgtgctgagtcaggccactgtaatccttggagcctaagagcctagtttacctgccccttgtgttttttcccaaaagtcaaccttcatatgaaacatttgacctagatttctagccttgaggccacaggggttcaagctcttgcctgagggcagcccttttccagaaccttcccctgtacatacgtgctccttccttgactggttccaggggtctgactttacacacacaagaggaaggtgtaggcagcgtctttgtcccacagctggcccagggtggagtcaggaaagcctagcacctgagcaccatacaccttccccccaacccccaccatggcagtgctaggtgcagacctagacagcagtccttcctccctgtgcctcactcccccagtggttagagagatggtccattttccttgcctacctcatggagctgtaatgagaagtcatggagaagcactttgtccctttgaaggatgacaccaaagcccccctgacaggcagtgcagtggtacgaaccgcagagtgtgtttgcatccgaagctctgaggcatcaccctcagagcctgccagtcttagaggtccctgtcaagcaacaccagttgccattgctcattgctgtcagttgggggccctgcctctaccttcaagttggttcctgccaccaccctctgagtacgcagctcagtatcactgtaaaggtaccagtgctgggaggtgggggtggggaggcgtggggaggcgggaggctcagccctgaagcaatggcttgccctagccttatcctgcaagcctcacttcttcctctagcctccatctcaaatgaattccgcataaaaacgtcctggcacttctccccagggccagggtacttgctccctaaatccctgtgcccttcagagactgctctgtcctggaagggggccagcagaagctgacagccttgcgtgaggatgactccgttcgcttctgcagactgcccagcgcgctgtgactgatttctagagtgtgtatgttgctagttttgtttttgtttttttaataaaaagcaggattcatgtaaatagctttttttgggagcagatactgatctgtcccatgcgaccatgtggacgatttcaaggtgctgaagcgacactaataaactgacggcgctcaggccgcccactgctgtgatttctctgaatgtgttggggccatgcggcttgaacgctggggcgcacgcgtggagggggcg

SEQ ID NO: 21617 - DNA, 1151 bp, Mus musculus
ggagtggaagaccaccctgaaacacccatcaccactcctgtatgaccctgacccctgggccacctccaccccccacccctcctggttctcatggtttctggcccatgatggcatgtcatatgctgaagaaatgaataaatagcatgaataaatagcaaaagagtgaaggtctgggctcctgcatctgactcaggcagtgggaggtggtgagagcgtggaaggtggtctgcagggcactgaggtctcagcccgtttccaagagtcccacagctgcctgcctggcggaggggctatagccaaggccctagcaatctggtgaggtcctagactggctcatctgtacctgtttccccacggcgtggctagagatccatccctgttttcatcctgtgtcctatatctgctcctccaggacatagctggtatcctggagtgtctgaggccccatgaggataggtggctggaccctgagcctgtgtgtcaagcaagtatgtatgactaaggagtagggataggtctgtgttcctatgtatatgttggctgccaagcgtggtctggggtaccatctgtattgcctgtagtgctttgcagggtagtggtccccagagggtatccatggcaggtgaagggtcagcccctaaaggactttttggatagggaactctagtgccatcctgggagccccagcacggccttgcaatggtgctctgggtggtggctgttggcttcctgccccagtcactgcttgccagattctcaggcccccagatgagagaggacacactgtggctccctgagcaggccttggttcagtctgttgtctgggctctggccccctgggaaatgtgttctgaatagtggctggtggagacctaggttggggtatctctgcccccaccccacccccttcttggcacacgtgtcaggtttaagtttcaggaaaactgccttgccccagtgtcccaactgtgaaggcatgtggacaggaaagattgggatttgcagcacaatgtttgggcgtcctgtactccctggcaagcttgtctggaagacgtgttagggtgggttaggccggtgaaagtatgggggaggaggttgcaggagccccagaacacttgggccaagaggtcagccagggtggaaagatagac

SEQ ID NO: 21618 - DNA, 1146 bp, Mus musculus
gtgatgtggaagactaaccaagggtctgcttatactggataagggctgttccaccataccccagccccttgagttggtttatattctgcatttcagacctcagaggacagaggttgtgtgctttgtgcgtgtctcttagaacccaagatcacaaagtctttatccttttttattacataatccttaaaagtttgcgtttgactttggtgtccatcttgttagtttctttgtgagggttaagggcctttgtactttaatgcttgtgtccagttctccccactgggtcaccttgacagcagtgaggatgtgggatgctggtattgggttggtcgacccgaccgtacagttgttcggtgatcatctggcagcttttgtcagtgcaagtcttggcctggagcttactgtagtgttgggagggattttgctggtgcgagccctccctccagctttgctctttacagaacagtgccttctgtcctggttcctggcttccctgtcaaagccttgttgggctttgtttgtttgatttctcgctgtgtagccctggctgtcctgaattctcttgtagaccaggcctcaacctcacagagacctgcctgcctctgcctaggagtactggaatagagcagcgtgtcaccaagcctgctcttggttggttggttggttggttggctggctttctggtttggttttggtttttcgagacagggtttctctgtgtagcccttgtcatcctgaaactcactgtgtagatcaggttaacctcagactcagagatctgcctgcctctgcctctgcctcccgtgctaggattaaagatgtgttcgacgacttccctgactgttgctgatttttttttactgtgtagtattttacatttatttatgtaaaacacaggtgtgtgtgtgtgtgtgtgtgtgtgtgtgtgttgtgggatgtgcatgcgtgccaaagcacacatgtggacaacttaggggagcctgttctttcccttcgaccatctggtttctgggaaaatgaggtcaggttgtagggtttgactgtgagtgttcttagttgctggccctggcttgttgatttctacaaagcaaacaagttagtgagatttggatgaccctggctgatggcagggcctcttggagactg

SEQ ID NO: 21619 - DNA, 1178 bp, Mus musculus
actgggcattttacagcgacttggagcattaaaagcacaaaacaggaaaggcacacaggccctgcccccaacactgccaagctggggaccaagcctttctgagcatgggtctgtggaggcaccccatatcttataattgcacatgcaaagaacactcttatctctgtgaaggtcccaaggctttttagaagccatgtgccaggaagtgaggatggagaccacgtatgcatttcctttgtcaacagtatcacagtagctgttgcttttgtgtgtgcctgacacagcaggtcctaggaacacagtggccttactattttgagcccaggtgtgtgctgtgaatatacttgtacttagggactttgtggttttaaggcagtggcaaataatgccactagtcattgattacctcaaatggtatagtcttgcctgatatccaggactatcactgtgggaggagtacggtgtatgttggctttacagtatcgtcaacttgaagcagaatggtcagaacaataaaaaaatgtagagggagaatctcataccaaaggagcctcctcagtaagtgaggatatgttagatatgtcagatatgtcagatatgttagatatgtcagatatgttagatatgtcagatatgttagatatgtcagatatgtcagatatgttagatatgtcagatatatcagatatgtcagatatatcagaagggaggttgaagcagtgcacttggccgctgctgctcagccattgattggaggcaccagaagaggatgtgagcctctgagttagtctgtaagctggaagtagttgggagaaaactggaggtgcaaacaggagaggagtctgctaagatgtgtgacggtgcatggggctgaagggagcggggactagacaagtgaaaaaataaaataaaaatcaagacccagaaaggcagccacacctcactgagttggtgccacagacagcgtgcttctgactacagggccttgcttggccatgattctgtgaacattgttagaagcaagaaggtggacatggcgatcggtccttgaatacagctcagcatggtgacctcccagtgcttttggaccagaatggaagattcccaaaacaagacaaaccatttagagtcaccattagtaaagcaatgaatggcttagatttggttcttgctacatg

SEQ ID NO: 21620 - DNA, 1171 bp, Mus musculus
cagagggaagtgtcagaggccagccgaggctgtcacagtcacatgaacttacacagggaccagagaggtgggagaggtctcaaaggtcagaggaccttgctttcagcctctgtttctcagaatcaagctgctccaggtgtcccaggcatgtgtgggctcattggctagtgctaggagaacccccaagaaagctatgctttgtctgtggggcctgcctgtgaaaaaaagcaggacctcaggggagtctccagctaccacagtgtcctcctccttcctagtctctgcagcctttcgacacaaaggtcagcggcttccccatggtatctgtcttcaaattaagcttttagccgggcgtggtggcacatgccttcaatcccagcacttgggaggcagaggcaggcggagttctgagttcaaggacagcctggtctacagagagagttccaggacagccagggctacacagagaaaccctgtgtaatttaaaaaattaaacttttagaatatgtgtgtgtgtgtgtgtgtgtgtgtgtgtgtgtgtgtgtgtgtgtgtgtgtacacacctcctgtctggacaagaccagaagtgttgcatctcttagagctggagatactaatgtttgtgagctctggtagacaggagtactggaaattggaacttaagacctttggaagagcaatgtatgctcttgacggctgagccatgtctccgccccagtgtgtgcattttgaatgatgacatggaatgcttgccttcattcactgtattggaaatttcaaagtgagtgattctggttgagttccacaggcattctttgctctctgttccaggcagttacagatcatttgctatgaacagcaccttggttttggggaccttagaatgtcaagggttgtaccctgtgacaccccccaccccccgattaagcacagttcacatcaagactgaaacccactcacaacattgggggaaaggccactgtcctgggcctgcataggctggagtttgtagcctccagctgtagcctgtgagcatcggagaacctgatagttccattcctcccatggctcctgccgggtcttctgcaggggtgggaccctcatcctctgtgactagctggtcataagagctcccttgccttgctctgctctgtcctggatttaggaccca

SEQ ID NO: 21621 - DNA, 1118 bp, Mus musculus
caccatgggcaggggcttcttccagggctaggctaggacttagctaaagagctcctggctggttgagtgggaggctagcggctgtttgaatgaagaagatagggccccacaatcagtgctgagcccccagagcagttgtggctcagcaaatcccagcatggcctaggagggacctgtctacatttgctacagacagtgaggcttagtgtcccaggtctgaggcagctcccaatgcagtgacctccagcagacacacatggatagacagacttctctcagccagcattgagtcatgttttgtatgttgcgtgtcctctgattctttcatacctggggacttgtgccaccacgtgcatctacagctacctgagcccctccagagctgagccccagagaccctttggtgggtgtagcacctgggtcctggccctcactgactggcctggtggagcccgtccctccaggtcaactccggtggtcagtgggtctccttctccccagctctgtgggtacctttgcacgggccctggattgcagcagctccgtgcggcagcctagcctgcacatgagtgccgcagcggcctcccgagacatcaccctggtgagtgggccacttgccacctctcctgttttcttctggggtccagcaccgacctagacacaggggtcctagcaaggtaactaaggactcaggactccagcctttcctggtgtaccttagatttatctaacatgctaagggagttagggagggcttctcccccgcccccaactccccccgggaggggcttggcagctactagattgtcaccttgagacctgaaggggtgggggtggggggtcacatcttggatgcaggaagacactccttagagcctggggacagcctggtcccaggggaaccctgctgtcttgcagttccatgctatggacacgctgcacaagaacatctacgacatctccaaggccatctcggccctcgtgccccagggtgggccagtgctctgccgcgatgagatggaggagtggtccgcatcagaagccaacctttttgaggaagctctggaaaaatatgggaaagatttcaccgacattcaacaagattttgtaagtgctta

SEQ ID NO: 21622 - DNA, 1289 bp, Mus musculus
cctgcctccagtcaagcggcggcgaatgaactggatcgacgccccagatgatgtattttacatggccaccgaagagaccaggttggagccttttctgggaaaggacgggatatgagagtcttcagctaccaccctctgatttgtactggcttacctcttcccacaggaaaatccgaaagctgctctcatcctcagaaaccaagcgtgctgcccgccggccctacaaacccattgccctgcgccagagccaggccctgccgctgcggccacccccacctgcaccagtcaatgatgagcccattgttattgaggactaggcggtcacccacaccgtggcctgcctgggcccctccatcagccccagagtatccagtgaggcctgcagaggccaagcggcctccctcccccaccagactgctgcccaccccaccctctgtttccgtagtgccccaactcccgccctcacatgcagagaaactgctcctctggtggacatgtggggaagaagtgtggtctaacttattccgagacaccgaggaggagtcttttttagctttgtgtttactttctggctggagcagagctgaggagcgccctgggccgtgtgctgcagggcttctcacccggggtgggctctaaggttttgttgtgttctgttgaaggtgccattttaaattttatttttattacttttttgtagatgaacttgagctctgtaacttacacctggatgttaggattggtgcagcagccagcagcggccaagctgcctgcagggttggtcccctgtcttttcaagtaattttcatattaaacaaaaacaaagaaaaaaatctcataaaaaggaaaaccccaccaagcccttctgcgtcttttgttcccagtccctctcctggtttagttagggccatgaacctaggctgctccaatacccagaatacccagggcatcccttggcagaaagatgggcagtagccatagctagggtcagcttagcgctgggggtcttactcaggctggcagagaatatcactctgagacctattcctgtaggcctttggtcaagggcctgctgcccttccaagggggactgggcacagaggatgccttgtgcagaaacagtgtctcacgtgccacactgagagctgaccctacctgaggccccacaacttttttctaccagggttttctacctgggtcagcttggcacagaagcttaaggtccagggcccaccccctgtgcccagcagatcccttgccccagctgtcgggctttctgtgctaagctg

SEQ ID NO: 21623 - DNA, 1124 bp, Mus musculus
gctatggaatactctttggacccaaaggtgagtagagtcccggtggaggaggtgaggacctctttccctccccagatccctgttcgttcccgctcagccacgccgggcacttttctccgcaggagtgaatactggtgctgtgggcagctatatctacgacaaggacccggaaggcacagttcagccctagatctgcagatgctgtcctcggggtccccctgtttgacccggaggcaaagtggcctgttgcctagtcctgcctcagcgtgtctcgcctgcaaatccgggacctaagtggtggaggagaaagcctggatagtcccagagcttcagccccctttgtcaccttggcgtgtcccgtgctgcccaccgtttacttcctgtctgtgtgcctccgtagccccatgggtcctgtgttcctgtgtccctgatagctctccaaggtgactgtcctatgatatatccctttgcccacacctgcccaccagtattatttatgctctgcttgccggtgatggccgtgagctcacagcattcccagggtgatggctggcgcccttgcgaggagccctctgctggttccacactactccctacctaccctcacatggttcatggctatggagacttttgctgtcaataaatagtttggtttgaggattgcaagacccagtgtcgtgtgtgtgtgtgtgtgtgtgtgtgtgtgtgtgtgtgtgtgtgtgtgtgtgtgttgcatataaacacaagaccgtacccctttctccacagacatccccttgtatccatgggcccagtattggtagggatgtagtccaaagacatttctgaactggggaggctgacaggcatcagtgccaacggtgaagtgtgtgggaagcagcgaggagctgtactgggcagaggagggaaggaaaggggtccggatgatggacagatggaatccatggaggacagaaatgaggtatatacctgtgatgagcatggcggaacacctcacaggtgtgtgaagtccaacttgagaaaagcaggagccatgtaaatgaggcctggaggcagggaccagaaaggtcctgggcagagcatgtggagctggtgagaactgggtggaacctgaagtggaggac

SEQ ID NO: 21624 - DNA, 2337 bp, Mus musculus
agccacaaagaccccatcgactggtgagaagtaaagatggggcaccaagaccccaaggcctacaggcagccgaggtgatcaggacactgagcgccaaggaggcctgtctgaagaaggcgttgcaccaactgcagcggcaatgtcagcaggagctagccaggctggctggtgctctgcctggcttgatttggattctgcctcctgaacactgaaggccctaggatgtagccatctgtgtaggatctcagaggcaaggagcagagaggtccaggcttgtgttccctccagggccagagccctttcgcctatggttttggtgttacaacagtctggtcctcctgagaggtttggaggggacctatatatacgcggtagagctgttcctggggatacctggctgctgccctcttccactgtccctttatcttcctctttttggcacactgggatgtgtgtagcgtacggttggcaccatgctgtaatcacacatgccccaaagtacaggaagtattgggcctccctgagtggaacagctctggttgtttccctgaacctctttcttagactctggctctatgcctcctgcagcagagctccctcctgtactgggccacggatgcgcctgatgtgtgtgtgtggtgggaagctggatgggagcctgggggctctgcctgggagaccggaggagaggaagctgcggtgcagacagaaggcttttgttctgaaggctgctgggcaagctcggcgctcacaaagcagcctgtgtccgggacgtgcgtacagcctggtgggatagttctgtcctaacccagtctttcccagccagcaggctcaagcgggttccatggtctctagccctaccttccttccaatccccagctccaaacactgaccaggcactggacagccggtaggacccaccaggcagcctctgtctcttgcttatctaggccagaagccactacgtgactcggagccttgaacactaaaacattctttcatgggggtttcctgcttgtctggtggtgtgtgctggagtgacagctcatgtctgggtacaggtggcctgtggccctgaggcaggacaccatatggttagctacagtgaatgttcctagcccacttctggatggccagtgtctaataggtccttcctaacttttacggacatagctcctagaatctctggaacctcctgcctgccgctgggcctctgctggacctcctggcccgcagcccctgttcctgcttgcgaacacttgttcagctcttcttgctgcttccaccagtgggttccggctctggtccagggcatgtgggaacttgactgtctggctcctcatgactgtgatgtggtctataaacaaatctacttaagctcgctgtctctgaaaactgccctgctctaggacttccagtggtcctctggaactcacccttaaaaatccaaagcggattcagagctctcgcttctccatctgctctgcagagttagtgcaattcctgtcagaatcctctgtgtgtgtgtgtgtgtgtgtgtgtgtgtgtgtgtgtgtgtgtgtgtgtgtgtgtgtgtgtgtttgtttgtgtctgtctgtctcaggccatgagaaggcaagagcctgtaggggtagggggcttagccatgggactcatccttggtcaagttgtcacctgggaaggacctcagaactagcttttccacacaagggcttgaaatagcccacgtttgtggtctcagtgctctgtgtcctcagctcccatacttgggagccacacagtcaagtaggaataaaatgtagtgtcagttggccacaatgtccctggcagatcctgacgtcctggggcaagttcacaggttgatgaccgtgctgctccagggtcctgcagcataacagatcaggcattagggaccaccatcaaccctatcctccctgcctctgaggaagaccacgttgtccgccaggactcccaacctgatcctaaggtccgcagcatctttaatacttgtcacgagaactgaagctctggccacccacgggtacatttgaggccagcaggtggacagtggggccatgctctcgaaccagtgaggacatggagtttgttccttgggttcccacccaaggcagacacctccttgcttgaggtagtggggaataccagaggtggattcctgacaccggaatgtgctgactggaagggaagtttagtaattccaactcttgtcaaaactagaaacttctgtttaaaagtcgacattaataagatgtgtctcaatggcggaacgcttgagtgtcttatgtgaaattggatttcatctccatcttggtttga

SEQ ID NO: 21625 - DNA, 1211 bp, Mus musculus
gagccgccacgcactgggttgccactgtgggccgaaggcctcacctttttctattgctatatgctgctgttggtgctgccctgcgtagcgctcagcgaggtcagcatgcaaggggagcacatcgcaccgcagaagatgatgctgtacccggtgctcagcctcgccactgtcaatgtggtggctgtgctggctcgtgccgccaatatggcactcttccgcgatagccgagtctcggccatcttcgtaggcaagaacgtggtggcactggccaccaaggcctgcacgttcctcgagtaccgtcgccaggttcgcgattttccaccacctgcgcttgcacttgagctgcaaccaccgccttcccagcgcaactcggtgccgcctcctccaccactgcatggcccgccagtgcgcccccacgggccctcacccacgcgggatgcgctggacacgtgacagccccccccccccgcgcgggccgcacagacgctggactaactgcgcgcggtttgcatgggatgggatggggcaggctccccttagggacaggtgttgtgaatgcatacctgtgcagtgcctgcggtgcctggggccatgtctgcttcttcatctcaggaatctctcggaccacggactctcagcctccactccactagctcgcctcgatgcaaaggcagctggtgaggcctggtcttgagtggagatggctcaacccctgcctgatgcggggctgccgggatgggagggcgggcagtgttccaggagatctggacctatggtaggggcttctggctcagagtttggggccaaagaggcctctgtcattttaaagacttgtgtttacagttttgtacccaaagcctggctattattcctgtctcatgagtcccctgcctaacagctggccagagtagcaaggactggtgagtgctggtggccatggggcagtcaggtacttctggagcaaacaggtatttgtggggtctcttctccaggtagtccattgtggtcccgtgtcagagacaccctctcttctcccacctcactgtgactgtccccacagaatctgcttttgctatggtaccttgacttcctccttctcctcccattccacctctccacagcctcccaggcctcccacccctgtccaactcaggctcagaaaagtcctgcacctccacccccttcccgtgcagacttgctctgcctgtggg

SEQ ID NO: 21626 - DNA, 1178 bp, Mus musculus
ttctagttaataaataaataaattatgcacatgtgactcttaataactttacaagctttctagttacaaccgctccttaagaaaatttattgaaagtgcaattagtcactgcccctttacagccaagtatttaaaatatttggtcaactagttattaattcaaaagtttaggtattgtaaaattttaaaaatttaacttcttaaaagacaaaaaaagagaaaaattgtatccccgtacatactatttagtgcactcccatgcacactatttaagtcttaactttattttcaaaatttaatattttaatgtcaaaaagtttaataaatgctttatagtatcttagagggatctacttattggcttatagattgatcctaaaacagctaccttattagaaaaaggaaaaacaggttttctctacagaacgctacagaaacatattaattcgtgtgacgagctggtaggtaagttgactcatgtcctgattaaattgactaaaaaactaaattaaattcatgttttagatccatccttacttgtcatttttccagtttagattagcttctagctttttaactttatggcaatagtacatcagagactgtacattcagacttagtaaaattagtcatttaatagagtcataatgatttttctcctttcttcagtgtgaccagccattctaactcaatcttagactggtctaatattcagtccaatgttagagattctaaattacctaacaaagttaattcagagcacatcccccacttcccctagatccctaacctcagaaggattgctggccttacagctagtgaaaaaaagctattaaagagcaattggtcacttaatacattggtaaaatagaaggaccccctgactaacaaatggaagggtccagatccagttctaatttagagtaggggctcagtttgtgttttttcacgagatgaagatagagcgcagtggctgccagataaattaattcgtcagatgaacacagattctaaatcttctaaagtatcaccttgaggactaaaattcctcttttgcttaaaagtcagcttgaggactcaggctccgaaaaagctactctctgatccagctcgccaacaggaggccagagactagcctcagctttacaatttacatttaaataaagtacctggacttc

SEQ ID NO: 21627 - DNA, 1213 bp, Mus musculus
ctgtagattgcttttggcaagatagccatttttactatattgttcctgccaattcatgagcatgggagatctttccatcttctgagatcttctttaatgtcttccttcagagacttgaagttcttatcatacagatctttcacttccttagttagagtcaggccagggtattttatattatttgttactattgagaagggtgttgtttccctaattactttctcagcctgtttatcctttgtgtacagaaaagccattgacttgtttgagttaattttatatccagctacttcattgaagctgtttatcaggcttaggagttctctagtgggttttttagggtcacttatatatactatcttatcatctgcaaaaagtgatattttgacttcttcctttccaatttgtatccccttgatctccttttgttgtctaattgctctggctaggacttcaagtacaattttgaataggtagggagagagtggacagccttgtctagtccctgattttagtgcgattgcttccagcttctcaccatttaccttgatgttggctattggtttgctgtagattgcttttatcatgtttaggtgtgggccttgaattcctgaactttccaagacttttatcatgaatgggtgttggattttgtcaaatgctttctcagcatctaacaagatgatcatgtggtttttgtccttgagtttgtttatatacttgattacgttgatggaattctgtatattgaaccatccctgcatccctgagatgaaacctacttggtcaggatggatgattgttttgatgtgttcttggatttggttagcaagaactgtattgaagatttttccatcaatattcataagggaaattggtctgaagttctctatctttgttgggtctttttttgtggtttaggtatcagggtaattgtggcttcatagaatgagttgggtagagtaccttctgtttctatttgtggaatagtttgtgaagaactgggaatagatcttttttgaaggtctgatagaactctgcattaaacccatctggtcctgggcttttttggttgggagattattaatgactgcttctacttctttaggggatataggactgtttagatcattaaactgatcttgatttaactttggtacctggtatctgtctagaaacttgtccaattcttccaggttctccatttttgttg

SEQ ID NO: 21628 - DNA, 1248 bp, Mus musculus
agttggttcaggggcttggagtgcctccagagaggattatctatgcaaatccttgtaaacaagtctctcaaatcaagtatgcagccagtaacggagtccagatgatgacttttgacagtgaaattgaattgatgaaagtcgccagagcacatccaaaggcaaagttggttctgaggattgccactgatgattccaaagccgtctgtcgcctcagtgttaagtttggtgccacactcaaaaccagcaggcttctcttggaacgggcaaaagagctaaatattgatgtcattggcgtgagcttccatgtgggcagtggatgtactgaccccgagaccttcgtgcaggcagtgttggatgcccgctgtgtgtttgacatggcaacagaagttggtttcagcatgtatctgcttgatattggtggtggctttcctggatctgaagatacaaagcttaaatttgaagagatcaccagtgtaatcaacccagctctggacaagtacttcccatcagactctggagtgagaatcatagctgagacaggcagatactatgtcgcgtcagctttcatgcttgcagtcaacatcattgtcaaaaaaaccgtgtggaaggagcagcccggctctgacgatgaagatgagtcaaatgagcaaaccttcatgtattatgtgaatgatggagtatatggatcatttaactgcattctttatgatcatgcccatgtgaaggccctgctgcagaagagacccaagccagatgagaagtattactcacccagcatctggggccaacatgtgatggccttgatcggatcgtggagcgctgtaacctgcctgaaatgcatgtgggtgattggatgctgtttgagaacatgggtgcatacaccgttgctgctgcttctactttctttttttttttttaaattaggtatttagctcatttacatttccaatgctataccaaaagtcccccatatccacccacccccactcccctgcccacccactccccctttttggccctggtgttcccctgtactggggcatataaagtttgcaagtccaatgggcctctctttccagtgatggctgactaggccatcttttgatatatatgcagctagagtcaagagctccggggtactggttagttcataatgttgttccacctatagggttgcagatccctttagctccttggctactttctctagctcctccattgggagccctatgatccatccattagctg

SEQ ID NO: 21629 - DNA, 1152 bp, Mus musculus
agtccaactcttaaaacatgaggcatgaccatcagttgaagagaaaaatgaggtacactgcctgaaggttaagaatattcaaacaatgattgcagctatgaggtagaaacaatttctatccaggaaaataagcattggactagcgtgacaaggtcagagtgggactggagacctcactacttcatagaggaaaacatgagctcaaagtgaagatgaccaccattcctgaatagtctgtttagctgagctcagatgggaggcaagcatggaacctgaatgaacaggataccaaattcttgctgagttccaaatgggagagtgaggccacacagctatccaggcatatcagaagcatagctagatgtcagagactgaatgaaaatctctctgctttagaacattctcagaaaacactaccgtggtatctgcttacacagaactcagatactgtcctgtgagtttttattctcaatttgatgtaacttaaacagctaagaagagagaagcttaactgaattgcctatattgcattggtctgtggctatctttattggaaagtgtcttgattattggttgacatcagggttggggggtacacaagccaagcgtaagcaatcccatccctgggcaggtggtcctaagctgtataagaaagttttctgagtctgatctgataagcaagtgccagtaaccagttttcctttatggttgtctctgggctcccttgagtccctccttgaaattactcaaacatgggctaggttaaaattaagcactttctgccaaaagttgcttctgttcgtgttgtttctcacagcaacataaagcaaactagaatgggcatcagtggatctgcatttggaaaacacatgaccatacattgaacctatcagttatttatatctgaaatctgaaacgttgttcactccgtaaccattcttatcatattgtcttgcttcaccttctttactgtggaaagtccctttccatattttatcaaaaaatagatatgctaaaatgaaaaacatatttatttcaactaaatccaaagagcttccttgtaaaaatatttagtatcaaatgcaatgttaattgtcacaaaataaataggcaaaggtatcaacaagtaggagtacaggattttataatgcc

SEQ ID NO: 21630 - DNA, 1103 bp, Mus musculus
ggacagactggaacatgaggtgagagggaggttttgggatgctgtgcaggatgtgagcctcactcattttcctttttagcggagaagaacttactgagaatcgatggggttggagtggacgcactggactccactccaggtgcgtcaccccaaccccaaccccaacctctggttctggcaaacaatacctctcattcccagccacattgttcctagcttaaaatgtatgggtagatgcctcgtgccccagtccaggaagtgccgcaaacactcatgttcccacccctggatcgaaggtactcatgctggactccctgtgcagtagcactcttgtgtacctgggtagcgcctataaatatgaatgttcttgtgcaccatatattcacaatcaggactgtgtagctgtgccctgccctttacctatgcagctgcctctatgcaatgccctgcggtggtgtgtgaaatctttccatctgggctctctcctgggtgcttcctgaggctatagtgttctggccaggggagcactgcccctcagtggacaatgtctgcctcgcactatcttctgattgggcaggggattcccagtgtagaggtgaaacaagaggccttgaagagtgggccatggggaggggcaccaaaggtactgcctgcctgacaacagggctaaaggaacatttgagctgagaggccaggacctgtgtgagcaatattgttagaacccgtcttcctcccagcaacagaacagcatgatatgtgtgaaaccaggcacgagggacaggggtttgagctgtctcttgtaaattccaggcaacgtttcctgggaaagatgcccaccaaatgtgaaagagggcaatgcagagactcagcttcattgaaagttagctctatatcttggagctataacatcctagagaagatgctccactctccccctatcccccagagacagtgctacaccaagaacagtaatcacacacgtcagtgatcattcacagattctaagtagctgtgatagtcttaaacatagcagatcaaaatagttgagactgacacataccctaataagtcaagttctcaggatagggaagctgtcattcatc

SEQ ID NO: 21631 - DNA, 1365 bp, Mus musculus
tagtgaggatttttgtaactaaggaaaaaggtggtgagatctactgttgccagaataacctttgttgtgttttaaacaaaggtttttttatacacataaaaacaccttccatctaaggaatgcttcagaaataaataacacattgttattcatatttttcttggaaagtacatgtttacatgctttcaaaatttttgttttttgagctaggatctgagctctctgtagataaggatgatgccattctcctggttattcctttgagtgctaagaatccagggtatccttcatgcctgacttgtggaagactgtgtgttaaacccagagcctcttctgtgctggtctaccaactgagctctctcctcatccattttatttttgtttgtttgttttggctacattttcaatcggctttgcctacagtatgagtatgtctattttaccatcattttgtctgattatgtactttgcaatgcctaatcttaatagatagctaagaggatgattaattccactcactttatgtaatgcagaatttttctgtgctagttttgtaggaaattgtgagattgatttggagatcaaaagatatttttgtagagctggtgtgaaaagtattcaggtaagtttttttcaaattttcattttagagttttctagactgtattcagaaagaaaagctgtggagtttttattagctaggaaggtatttgaagtaattttctatttgtggttgtagttgaataaagtgtaaagctatgtgcttaaaagtcaccaagtgactttgaagagctatgttttctgacttgtggtttcctgtctgagttcagatccatgggacaatgcgggtgatactggagcccctgattggagacatgcctttagttggagctttgtccatcttcttccttaggaaaccagtaagtagacatttcatgatgtcatgtctatctttcctctcttggcagtaacatggatatgcagaaggatagaatggaggatcaaaattctgcccttcactcttccctatctgatgcatggtcaataaaaattacatttaaaagcacaacacatagagctgtacatgtagctcatcaaatactgcccccaacaccatcaaagaaggtatatttatctcagagtctttaacttctgtatgcctcaagtgagggttttatctcttgataaacaatggtctttcctgagtaaaaaaatgtttgtggaagttaggaaaatcatttttagctaagtaagttgaggatacatttggcctgttgctaagtatgattttataccatttgcttatttaatcctcatacttctaaagctaaatattgcttccttgtactgacctggagctgacat

SEQ ID NO: 21632 - DNA, 1171 bp, Mus musculus
tcctgatgattaggaccattctctttgattatgttggtatttattttaaacaaaattgtattagtcattttgattattgtgccataagtggtaaacaggaataaacaggaataaaagtgtagaaaaaaattataggtcattattcctcctctgagacttttaaattttgtgcttgtggtagcacagggatttgaagaactatgtcatcttagtgctccattttaattggtttgtgtgaataatcatcttgtcactcgacagacgtcggctcagttcttgttctgctgcatggattggattgtgtgttactttatcaagtgaagatagtgtagacacatgctcacagagacttgtctctcacctcgtaggtgctggcagacatcagagctgacaaggaccaagccagtgatggcctttcatctgcactgctgatcttgtatttggattctgcaaggaaccttccggtaggtaacacagagctaactcctgtgagtgtatttcttacttggaaactactaccttgtccagctacgatatattacctaatcttatgtggcagcaacagagaggggggcataaggtagtatttgctttgcacatctgtatttgtatctaattattacagcctagttatctcaaggtaaaactcctcctcttaaaatgaggaataaatgaagcagctctgatcacaaaccctaagtgtgtcttagaagtagcacagtggaaagtgagctgctgagctgtgactcctcagggttaaagcggaacattattaatgccaccaggtaggtgctgaccttcaggtacccgggatacttccaactgaacaaagacacaaacagagtcaaataataatgtttatttgtttatatcagattgttttggttttaggagggaaaaactataaaataaaaagtaatttgaacatgttagggatagtgaaattttcactttcctgctataaaccccactagctaaagtcatgttatcctcataaatgttacattattgggtaactttttaggtgccaatgtgcttgcatatgagggcattccctatgtcattgtgtcaacagctttttgttgaaagatagaacactgtcatcagttacaggtggtgtacccaccaagattacccattgcataattctgccttcatagtaaatgctcag

SEQ ID NO: 21633 - DNA, 1155 bp, Mus musculus
acctacaaaccccttcagatccctgggtcctttctctagctcctccattggagaccctgtgttcaatccaatggttggctgagagcatccacctctgtatttgtcaggtactggcagaaccactcaggagatagctatatcaggcacctgttagcaagcacttgttgggatccacaatagtgtctgggtttggtgactttatatgggatggatccccaggtgaggcagtctctggatggcctttccctcagtctctgctccacactttgtctctatatctcctcccatggagatatctatagtgaactattcatacttggtctttattcttctttcttttcctaattcttttttttgttttgttttggtttggtttggtttggttttggtttttcgagacagggtttctctgtgtagccctgctgttctggaactcactctgtagaccaggctggccttgaacccagaaatccacctgcctctgcctcccaagtgctgggattaaaggcttgcgccaccactgcccagcctctttcttcttcttgagtttcatttggtctgtgaattgtatcttgagtattctgagcttctgggctaatatccatttatcactgagtacataccaagtatgttcttttgtgattgggttacctcactcaggatgatattttctagatccatccatttgcccaagaatttcatgaactcatttttttaatagctgattagtattctaatgagtgaatgtaccacattttctgtatccattcctctgttaagggacatctgagttccttccagtttctggatattataaataaggctgctatgaacatagtggagcatgtgtctgtcctttttacatgttggagcatcatctgggtatattcccaggagtggtatagccaggttctcaggtagtactatgtccaattttctgaggaaatactaaactgattgctagagttgtaccagcttggagtcccatcagcagtggaggagtgttccttttgacatcctcgccagcatctgctgtcacctgagtttttgatcttagccatactaactggtgaggtggaatctcagggttgttttgatttgcatttccctgatgactaaggatgttgaacatttctttaggtgcttttcggccat

SEQ ID NO: 21634 - DNA, 3416 bp, Mus musculus
gctatgtaaaggttaaaatgatttttaaaaatgagaacctcaaaacatgagattttcatattgttaagaaattagagaggtaggaaggagtgatgaatgatctaaaaggaattacccaggaattttcacagaaccttcttttaatccacaggtgctggttgttctggcatctgaagaactcgccaagggctggacccagtggtgagtgcccctgtcccaagttgcaggcagttcccagagaaacctagctgctgcgtctaccatcccaaagcctgacccaagtctgttgtactttcttgtgctttctcaggtatgacctcacagaagatgggacaaggccacaggtgataacgtagctacgctggacgtaggtctatttttcagtgtatcacgtggcacctcaacatggaacacaccttctcgcagatgtaccaatgctatttttataattttaagtattgagttatacataccttaataattttataaaacttggcattgtaggaaaatttggccaatattattgttgaatctccctgttgagcttcctccagtgcttcaccagtggtgtagtgatgtgtttcctgtgctgtgtggagctctgtcagctgcacctgctggaaagcagatacctggacttgtttctgccttgtcctgcatcctggaggtgcactacaccatgtaaatagattcttttttataatatctacatgctggtttggataaagaagaaaatgaattaaggaaatatgtattttcttctaagacttattacattctgtgacaaattaatcattttcatcttttcagcaaaatgttctcatagatctgttgtgtgatatggctttttaaaggaaaaaatggaaagattattaaatattagaatttttatgtctattatgaacgataaaacaaatttcaaattactaacattattataaataggaaaatacagtgagaagtcagtgaatggctaattttaaaagttgtataactgagtactggacaataccgagagcattgtcaaggctctggagaatcacagtatactcatctgaaatgtattacataagaaaggaatgtgctgtttatttgtgtaattgtttgttataacagactcatgagtagtagagagatgcacacatgctaggcgttgtacctcacatctgtaatcccagggtatgggaggccacaccaagaagacccaagtgttaaaggccagcctgggctacacctcaaaactctgtcttgggaaaaagaaacatacattatattttgcccaaagcatattaggatataaggtgttatcaagagtgatgcaagcttaatttgttttgtccttgtttcttaccctaggaagacaggtctgttgttactgtaaagaggtgaaatgggatggatgcatagtaacaaagggtgctgagctaaagacgttagttagagcactgcacttgctcttgatgggagaacctggccataagtccacacacaggacagacaccttcccgagcttcccctcatacgtgacaaaagatcctgcgcagtgccagcaagctgctgtaaggcttgagatttcctggatatcctcattttgtgccatgccagatgttaatacaatttttattttggaatccttttatttttagattgggaaaagcatgttttgtatgtaagagatctcaaacctcttgtgaggtgaggctatgtcacagtattataagctatgcttgtctgtaagcaaaagatgcacaaatgtaggaagatttttttttcagtatgcattttaacctctaggatgaaaagggcttctcagctatgagatcatttaaaactatgtacacttatagcaggaaaatacagctttgtaatcaaaattggagtagttccattcacatgcttcttggaattaaacctatgggaagcttatgtgaccaaacataccaaagtgcctgtgatgaatatcgagtgctccttttgcactctcctcctgtctaaaagatgaaagtgtgcctcagtttgtaatgtaacacgtacagttgtaacacagtctgtggctcttcacagcacaccccaggtagtcataccgtcagagtaatctctctcctgccatctgacaccttcctctgaatcctgtttataaatcttttttcattagtgagtaggattgtgagaaagtttgtgtaggtacacacatgaacatatatgcacataaaatattcaagggtggcattttagttgcaggagaaaggcaggttatattaaaactagttgcttgaccatggtattagctttttttttccttaagtgtgtttttaattaagtccatttaagagcttctgtctataaaagagatttttttcctgaaattgtatcatggcaatcgttttttcaccaacaacctatctatcttagttttgcatccatagacttagttaagtgtgtattttatttaatggaatgcttttcataactaattaggcaaattgagtagagttaagggtacaatcccctaataaatcagtatgatccctactacagtcacaaaagctggtgccaatgagttcagatacagtgcccccacgtgcatcatctgagtcttcaagtagcatctccagtctaagtggaaaggagacagaaggtctagtaatactagtccacttagttgtagttctgagtgctgcatgaggagggctgacttgccatcaaggcacactccagtgtcctaaagatataaaatagatagatacttttagttctcaaaatgttaacttttagtttttaatgacttacctaggaaaaaagaatgttacattttctactttgagccaaaccaatgagggaaattagtgatttgaagtacagctctcctaacttattcatgtggtggcttatcctgtgccttaaagtacaaaggtgttttcaagtttcaggtgaaaacagaagcagccttgcaaccatatgtactaccatttgtattttgcactctatatttcttgtacaggcagtccctatgcagaggtgtttaggattagtttaaaaaacctcaggcagatacagagagtgcagcctgctgcagtgaatggtcccatctggattacccactgtagggtaatagagggtggttcttgttttttgttgtttgtttgtttgttttaatcatagaatgtcctttttgcttaattttatataacagcacatgtatttattcaataaaacttttatgttagtgtactcgtaatatgttttttgtttgtctcttgaacaagtttagtgtgggaacagctaatttggaaagctcacatgctgtttcaggtatatttgctatttgtgcattctttcactgttcatgtggtttgatattcctcttgttcccatcctcgttcaaagagcaagcagctcattttgaagggcaatga

SEQ ID NO: 21635 - DNA, 1638 bp, Mus musculus
tcctggcagaaatgctcccacctctggaaacaaaacttctaggccagcagtatttaaggttccagaaacaggaagcaaaaattttcctagtgagtcactaggagagatagggagtaaaccatttcctttttcaccccttgattcctggacctgtgaatcctggctatgagagaaaccatatgatatgttggacacttgatacaaagcttatatgaccttcaggagaaccctagcagtgttccagacggctgccacatactcaacattgtactgtgtcttcaaaaggccatttcatctctctatcaaggcttcaggatggtaggaaactggattccagaactgtgggttcactgttgtgcttccctgactgtgaagtgagttccttggtcagaagcaattctgtgtgcaataccatgatggtgggtaaggtatagtgatgtccatggatggtgatttggcagacactttatatataggaaaggcaaattcatatccagaaacagtatccactccagtaagagcaaagcattgttctttctatgcaggaagtggtttaatatattcagcctgctaccaggttgctgactgggcgccctgcggattgatgccatgtctggggttcagtgttgggtctctgttgttggtatctctggcactcaatagcagctgtagtcaggtcagagttggtgaatggcagtccatattgttgatccaaggcacatccctcatttctgtcaccaaggccactttgtccatgggcttattgggcaaagacaaggatggctggcaaaaaaaaaaaagaatgactatccatagaatagcacagtctatctatctacttgactactgaaagcctcttctgctgaagttatcttttgatgagcatttatatgggacaccagtatcttcacagatcacccatatgtagggatttatctacacatttctttctcagatgtctttgtcaccaaatcatgctctttctaagtccctgaccatctagacaattgaatcattgaacaatcacatatctggctagttctacctccaaacaaaatgtatacacatatatactgcctgaagttctgccaactgttaagatttcccttcacaagtgtctttcagggttgtctcagaaaggagttaataatgttgcagctatccacttctgggtggtgcctgcattatgtgcagaaccatcagcaaaccaagccctagttttctcttcctcagtcaaccaattgcaggatacaccccatgagtctacaggtgtgtgtttcacagctgacagcattgtaacagaattagaaaccatagaaatttgggcaacttcttcatgtaacttgtttgtaccttccggaactgctccagctggatcaagtacatagcatttgatattggattgctgctgagcatgtcctactttatgattcagcaggccagaaagcacccagctcatgtcttatggtaatttaatggtccattgtaaaatgttaagtttccagtaaggcccaatagtaagccaagagctgtttctcaaaggagaatagctgtctgcggatgatggtagaatcttgctccaaaatcctgaaggtctattctgtgattcatcgacagaggcttagcaaaggttccaaa

SEQ ID NO: 21636 - DNA, 1233 bp, Mus musculus
ctgggttttccccagggaaaggtttaggaaaaaatgaagatgggactttccatcccattgaggcccatggcaacactggaagaagaggctgggggtgttttttgatgcgggctgttgattcagctgcacccccaggtcgttgtgctgatcccatcacctggaagggggactcacccgtctgggtggatccatggtccctaaccaccaaaaaattacaagctagacaataataacagatccagggaggagaagccacctgagaacaccatttcttcatgaagattctcttccaactggaacagatcaaccagaatacaccttataacctgacttgagaagtcctcaatgctgaaggagacatcatcagaaagatgagcctgaatccactcaagttcttccgggtgtcttgtggtgaccactacaaagctgaggcatagttttagcaatggtgtaagtctaagaacaagacagcctaaggaaaacatgaagtcatcactgtagaactgctgagaacatatgaattgcttatgaaaattctgatcccagattctgcaagatagcttggcaggtaaaggcatttgccaccaagttctacaacctaagctcctgcttgcttttcccaccatcctctgagtctgacagtcttcatgctggtgctgcagccactggcttctaaaagagactcggtgagcactcttcataatcagtcttcctccttgcaagaaacacacacggtatagtccatgtggaaagagtactttgctgttattaggacaacttaatccttttcacctgcactgtgctgtcatttatgccatcagtgaactgtccagagttaaagcattcccaaatctcacaagcactaaatttgtctttttatcattatcccccatgagaactatgccttgacacaaattttgtgatatttacttataacagaccatcaaagtgctaaagatgttaggcaccagacgtggggaaataaaggggtgggagggacctgcgtcctgccggagctcggagacactgggcaggcagacttgggacactgccacgtgctctccactctgccagatgggcgtctggctctgagaagccacggaaccccagttcaagtgggtgcagagggagcagttccggtccctgggcctcacggagtccagggacaacaggttctagctcttgggcatcacaggacgtcactgaacaccgaagtagagctgataacatgtg

SEQ ID NO: 21637 - DNA, 1690 bp, Mus musculus
ctggaccacctaatggtgtcctagggatggctattttgaaccctagaaaggaattgcaggataaaatctcagccctaaaacaacaaataaaattagaggaagagtcagctacaagaattaaagcctaagaagacatctcaggaggggaaagccaccagagaaaatcccccaggacgtcaagttcctcaactcggagtccaaagacggcccctgccctctggctttagttcagcttcagatggcccagaggagggagaggctgaggctttccctgtatcagagatcaccgacgctcaaggggttgcttggagacatcacacagggttcaatttccaaatcattatagattttaaaaacgcagtgtcacaatacggtgccactgctccgtttactcttgcaattctggaatctgccacagaggagtggatgactcctggggattggaataccctagtgagagcatttcttagcggtggtgaccatcttatctggaaatcagagaatcatgagaattgtaaagagatggctaggaggaatgctcaggcaggcaatgcttggtcctttgatgccttagtgggagaagggcaattcgcttcaagtgatggccagatgcaatatgacccaggtttattcgctcaaattcaaaaaaggcttggcataaactcccggtaaagggagaccctggtgcatctttgacagcagtcaagggcctgatgagcgattttctgattttgttcattgatgacaacagcagggaggattttttggtaatgcagaggcaagtatagactatgtgaaacagcttgtagccattagaccctacaggaagaagacagaccttactgggtacatcagactctgacatagggccctcctatcaacagggcttggctatgctggctgccatgcaaggacagtcagtaagagacttcttggcaagtagagacaaaaaggcccctttttaagtgtgagaagcctggacattttgcaaaagattgcagggcaggaaacgagtcaactctgagacagcctgggaaataggctgggaaacattgcaaatgcagaaaacattgggctaataagtgtagatccaagacagatatacaagggaacatacttttccctaatcagggaaataggagcagggaccagccccagaccccgaaccaatacaagccaaaacaggcttatggggtggtcagcttcatgccagcaagcaaccacaattcctttcagaacttggtcaagcaatcccttgaagggcaggactagattctgccacccatatacagtactaaccccagaagtgggacctcaggctctacccgccagagtgttcggacctctatccaaatgtgtctggcctgatagtgggaagaagcactgctgccatgcagggactgcaattgttcctagtgttagagacaatgattatcaaggagagattaaggtaatggccaaggcaatatataatatagtcaccatccccacaggaaggaggatagctcagctgttgttacttccattgcttcctactaatcacaaatataagagtcctaagagaggggatcaaggctttagttcctctgatgcatactggttaaacaaaaacctatgatgacaatccagcttgatggaaaggcattccgaggcttggttgatacaggggctgatgtgactattataaaac

SEQ ID NO: 21638 - DNA, 1152 bp, Mus musculus
ccgggtttcatggtggaacaagtaccagtgtaactatgaggcctgtgtttccttgatacaaattaagtgggagctttctgtagagattttaaccatgttttctgtacttgactttttcagctgtggtgtgatttctgttctgagaaatcaggagagtgttacaggcaggagctactgtaccttgctcgattgtctctgttcctgggggcaagtggggcatgtcctggagctcattgtggactggctgcctacagtgccacctcaagccaaggtttgtatacagccgtggccctggaatgtggagaacaagggcatctggccactgtacagagttagttctgggaacacaagctctaattgcctctttgcttcactgctttccttcagagtaacttggcctctaaacggaaagtggaaatcaatgacacgtgctcagtgaaacctgagttagcattgttgtacatggagtatttgctgacccatcccaagaatcgagagtgtctcctctctgtaccccagaagaaactgaaccagcttttaaaagcactcgagggatccaaggtaactacttatcctggacattaaagtgacttcatatagcagtaacagtgatgcagtaagatagagttttcatggttttggtgctgtaatgtttgcaagctggaaaagaattgagaatgagcatctagactctgaagtgtacaggggaggctgagaacagagccatttccaggacctgtctccttacaagcagtgtttagagaccacatttctccaaggtttctagtgtgtcagggctccagtcctcatctcttctctcagaataggctgtgtagcagagtggtcagtgaggaaatactagctctcttaagtcttaagctgtgttttctaggaatcttaggaaactatgtgacatgaattcattgttccccaagcgcccttcggaatcttttttttttcctgtgctgccaccctgactacctcttgtatgattctccactgaacagtccttattgataccacccaggatggtggttcagaggagcctgccttgaggaaatggactgtggtatttgtgggtagtggttctgtggccccgtgaacctgccaactatgttgtgtgcttctgatgctcagcaggtagtgctaggt

SEQ ID NO: 21639 - DNA, 2759 bp, Mus musculus
tatgggctctgcgttgggtgctgagcctgtttacctttacggctgtgaaacttgtgctctgtgtagggcacaggctgttttcaaatgtgtctgctgcagaccatgtgtaaactctgcatttgaggggaactgaatctgtgtcttctctatttctttcagattcctatatgagtcatcaatgagaactttgggagaatttctgaatccatgacaaaaccaccgtcaaaaacactgggtgtgtagaaatagagaaaagactcatgaaagtgaaaatgtgtgtcttttgtatattgcttttttttttttcatcagactaagcccggagtcctaaggaccacacccaggtctgacggtgcccaaagatggagaccagtacaacactggtgctctactgtaccctgtgcctttaaccagcttgcagagatggagagtgatgaaagtcatgtgagagaaagactggcaagcagctcaccactctctccagaagagctggcaaagcttgtaggaactgtggcatgggcagctcttacgttccttggcctgtgacttacccattatttattatttgttgtgaaattctcctggaacagatttctctttggcctttcagcagggctatcattagcccacacaggacctttcttcaaaagacaaaaagaatcacttcatcaaaatattttattgccctctgttgaacagttgtaatatatacactgatatgaagtgtcttgcttactccattgcacttgggctcagctcaactcttacatctgagctgtgacttttacattttagccttactctaagggcaacagcctccttctacaaaaggcattctcagttcagagaagatttcttgtttgagtgttgctgtgtactatgcatagtcagggacagagcaggcattaagaaaaaaacaaaaacaaaacacaaaggcccaaaagccaaccaaagtggaagtgaattgaggaaggcctggaccaggagtgagttgccacctagaaatgattgttgtttctcaagccacagtgaagtattgctcagtggatacacgtgcccagttgcctctgttttccctctgcaggtcgatggcagaggcatcggccttttcctgtattgactattgaagagtaagcaaagaactcaagagttaaagggttgccctggtcctgtataaatgatgggttaatgatacaaaagagaaaaaggatcttgtttaaaagtgacataatatgcagccatacataggcaataatgagttcatgtccttcgttaaaaatgcttaaaaatgataggaggaaccatggcactagcaccatggtggaagaatctgctgggctgtagggcaatgctagaattctatagcctgtattaccccctcaacatcctttccctagcaaagactctggcaagtagggttgagtagccttagagagctcaggtatgactgactacactggcgatggagggtggcctcagcaggtgggaaagaggaaaggtaccagatcaggctgaggatttgacatcacacaggattagacagttgcagaagttgaaccagtgtgccttgcagacagctataatgacaaattcaacaaggatatgagggaagttggcaaactaacaagacttgactttgaatgatgtaatgtgctgctgggaggatcattagtataatgggaagaatttacatcatgacgtagcatgccttgcaacttactgagctgattatcctccaactcttaggacttttaaaaataatcatgattgggttgttttagttctcttatttttatgaggtggttatattgaagaagaaggaaggtagagtcaagatatctggtccctgaaagttagatgtcagatgatttcaaaattatagctaaattttttaaatactctgcttttcgttgatgggtgaggcctacagtattcattttaatagacaaaaaggaacatcagcaatactttgtttaatttatagactaacttggtctgaggtttcaaagactgttgaatgctaatccctagatgttgcctttactttcagtgtgaacactctcatgaggtgaccattgttacccttgttagaagtactaagattaagttttaaaagcaatttttcccatgtacttgcttatggatggcacagtttggacaggtagtattattccttggtcaaaatatttcagctaaatattaagaatgaattggaattattagacttatttttcttgctattaatcttgttgctagagatataacataaagattgggctggtaaaattaaaattttaaaatattgctgctaaagacaaggcctttgactgacttgagaagtcagttacttcttttctttttcagtacatcaaataacaatgtgtgatacaggtgttttcttttgggcataagaaaaacactaaaaagcaaaagtaaacaaggaaaaacaacagcaacaaaacacaatgtaaaaatgtagatagactcgaagcatattgactcgaggtttagggtcaactaatacaagttgttaagcttgtggctacaaagcgtttgataatatatatgaaaagctctagacattgtttttgaaacacaacctagctaatgctgtctcttatctgttggagaacatccaaattttattaagttccaagcctttatgcccaagatttagaatgaatggtattattcatcgttcccgctatttttggaaagatggaagtataagttttaatgcaaatatcactgtgacatcc

SEQ ID NO: 21640 - DNA, 1195 bp, Mus musculus
ccagtatctgtttcctaaactgtttcatccaggcttgccctgggcttggaagaagatgttcctcactcactgtcccttctcacttgtctcttcctcaggagcagtttgagtttgcgctgacagctgtggctgaggaggtgaatgccatcctgaaggcccttccccagtaggcgctgaagctggagctggcgggaccccaccacgagtgcttccagaaccgcaacaggatatcagtcctgcatcttctgtgtagtaacagggtccttcgggctccacagtcagtgcaggtggctagtcatgtgtacttctgattgaccaaatagcacatgtgtggaaacacccagttaggatggaaggaaggaatgaaggaaggatgggagggaggaagggagggagggagggagggagggagggaggaaggaaggaaggaaggaaggaaggaaggaaggaaggaaggaaggaaggaaggaaggaaggaaagactcagcttacttgtatcacagtcttgacaaaattccttttccctaaagcacactttgacattgtcacattattgacacagtaattagaaacccactgtggcctcttcaggagtgtgcttatgtctgtaaattgctggagagggggtagatgggccaggacaaccagcaagacacctgttgggaagcaccgggtatagaatcatatttggtgtttgcctgtaagacaactaggggagccctttaaggaaaagatcagtgtcctgcacccctggggcaaatgacaagggtattatcatggagttctgcctattcctactggtgtccaccagtcacacatttggaatgtagattccaaagacagaaaagataaagggtttcccaagggtagacaccttgaccatcctgaagtatgggtgctgtacctgttccagaagcgaggacccaggtgacagcctcacctttgcaaagttatagaggaacctgccctggtacatctttaatattaggattctgttttctacattgcaagcacaggcacccatagtacacttttgttgaagttacaaaaccagaatgagtatggcaagttccaagggtccccagtgcttcccattcagcatccccagggagcccccaaaggtactgaaaagtctctgatgctcctactcctggaaagaagtctgggaagcccctttcgctctgcctcctgcatc

SEQ ID NO: 21641 - DNA, 1138 bp, Mus musculus
agagtccggccctggcctcggcggccccggccgatggccctctgcgccgcagcccgagcgcccgggagccggagcgcgagccgcccgccgcgtctctgcggccgcgcctcagggacctgcctgcgctgctgcggagcgggctcacgctgcggaggaagcggagcgccgccggcgcccgggtgagtggcccgggcgcgcacgtggagccctcgactgccccgcgggcccgccacgccgtggctggaagttggggaggtggcgggactccgctggagcggggcctgggacgtcggggttagggggcgcccctcgggctgcgacggccacccttccccctagatgcacctgagcgcacccgggcgccggggcatcgcaggaagaagggctgtttgctgctttctgtggggaagctgcaggtgtccggtgactgagtcaaccagccccgtctcacagaaagtcttaggcctcccgcaggtcctgtttgcaggtggcctgcgacgtgcgtgcttgttttggaagactcagcagtgtctgggcgtcgggactgccctggcagccgccactgctgagggggagacttaggagttggaagagcttgggtgagctgctagcgctgggagcactcagtactccgggacgccccctagagcgggagagggtcggacccccgggaatctcaaatatcgactttctgatggtgtgttcagatatgacttcctggtgaaggagcattccttgtgttgtaagtgcatctcacgacctgagcaggccagacatgttttttatgttaaaaggagggcctgcttgtcatcctggtgatcctcaagccactcaagaaagccccagtaagctctcactgacttccttcctactcagcagagcttgggaataccttggtacatcctactcatactttttttaaaaattattttttgattattatgtagtatttactgaaaaatcgtaacaatggtgtgattttttttttttttgactagaagtcttagttatatgtcatgaaaggagacagtagttggagactcacagctcctgtgatgttattggcttgcggaaacctaagggctgaggaagcatttgttctgtcgtggcttcctatagatgggcaaggatctgaatt

SEQ ID NO: 21642 - DNA, 1099 bp, Mus musculus
tcagagaaacttcttatagtgggtggtgattaacacagagacccagaacttgacagtgtgcagagaaagagaaactttgggaccctcagctttaaatgggatgtctactaaatccttccactctagactcagacagaaagactctgaaaggtagaggtggtggataactccaaagaaacagtcttccatacacaacaggctgatgcacatagtaatgttcagggactgtggcaacaagcacaagacccacccaagttcaaaccagacaaaattccaccactgagaaagcaggagtagacacaaggtcttaccccttacccagaagccacttgtatatgataactaatgagaaaggagaaatcagttttttctgtttttgttttatctatctatctatctatctatctatctatttatttatttatttatttatttatttttcgagacagggtttctctgtgtagccctggctgtcctggaactcactttgtagaccaggctggcctcgaactcagaaatccacctgactctgcctcctgagggctgggattaaaggcgtgtgccaccatgcaggaaacagttttttctgaggtgatactatgtatcaatcacacctgagaaagggccccatgcccaggagttgctggtcacaagtaacagatcccatgcagttggtcagcatggaacagtccctatgcttttcattctgctttgccatttttctcttattgtattcttttgtccatttgcttgttttgagttttgtttttgtggttgttgttttctgaaaaagagaaagggaagggagaatataaagttgtataagcagggaggtggggaggatctggggaaagggaaagaatatgatcaaaatatatattgtataaacatttttgaagggcctggagagatggctcagtgtttaagaacacttattcttacagtggacccagtaatccacttcatgtggctcacaatcatctgtaattcctgtcccaggggatctggtatcctgtctgatgtctgtggacactaggcacacatgtggtacacagacatgtttgagcaaaacactcgtgcacataaagtctaaagaaaa

SEQ ID NO: 21643 - DNA, 1148 bp, Mus musculus
tgcaggttaaaaccctggaggtgtcaaaggaaggttttgagcctgtgtggggtagaatataaaacactgaaacaaaagaaaggcagtaacctaggactgcagtgtagctcaatgggagggggcttgtctagcatgtaaaagacactggattcaatccctagcaactcgggggataggggggagggaaggtgagaggacagacagacacacacacacacacacacatacacacacacacacacaccaatgataccttgatttgcctatgaagaatgtacttgaatgccaggtgcttgtgcactaaaacctttgatgactctctgaactattaaatggcattttcactgtaacttggcaagtacacctgacctttatttcagttttaagtagatcccatttccgtccaagtcactaataaagttcctggccatcaatgttactcataatcttggcacacgaaggaaatttgcccagacctgagaaaactcaccacaccctggaaaaattcttactaggtttttacaaaatgcattccccatctattccccatcttgctgtgctgtgtcccgccctctgtcatttgccatttatgtgtcttaactctgacttacaccttacattccacgcatggctaactcgggatctctatggatggatgcagagagaatgcctggttaatacaagacctaggctttgagattgtcctggtacagaacagaggaaccagaagccatgccttctctttctgaatgcagaaccacaagatgcatgtctcagcccttgagaccccatggaaggacaaaggcttgggtataggcaaacatctgctgtgtatgctttagctgaaggcaggagccacagacatgggaattgggaccctttggttactgagctgtcttcaggcagagccctgcatgtggcagtcatttatttagctaccacacataaagttcacatcgttgaagccctggataattttaatgttgacttagccttctttcttcatgcacagaggcacgttttttttgtttttttttttgttttgttttgttttgttttgttttttgagacctggtaatattcctttattatcacctccattcattgatagaaacagtgagtgaacaactgtgaccaagaatgaagct

SEQ ID NO: 21644 - DNA, 1160 bp, Mus musculus
cttactgtgttgttcccattaaatctcatttcctagtttccacacttgtctttctcccttaactttatcaactgccaagatctgaattattaacaaacttgtctctatccttggcctttgtgcaaaaaactgtgttttccttctaactgcctggtaaatatctacagtattccatcctgtcaatactcaaacatcagctgtcattctcagtctcttaggccacttatctttgaccaccaaaccccgtggcttccacttgccttggtcccctgcccttagcatcacctgaggatgtgaccaagctgtgcttctgatttcctggtaccagataacttagttcagagcagagtttgtcttctttgcttgctacttactgtccagcagggtgtcctacccaaaggaggccctctttgtttgctgcataacaactgtcaattacaagttttaatgcttctgtttcaaggatgatctgtcattgaacatattttccaccattagtcctaattcttatttttaccctagcaatttctgaaataaagatttaatgccccagctcgatggtgctgtttcctctttttcgggaaaaggaactggggacagatgccgagattcgggtgcatcgatttagtcctccttcatagacggttataacacaagggagtcttctgttttcacagcaggtttcaataatttacattttcccttgctcattgatttttctgcttctcctctcccttatttttaacaggttccaaatggaacctattacagtggcataagatgctattgatagtatatcaatccgactcagctattctcctgcccagtaaagtatgactgctgtgtgcacagccatgtcatacatatcacttacacagacattagcaaagtcctgcccatccatatgtatgtgtgcagcctgcagaagttaataatgccatatatcacatgcacataggatgtaaaatgtacttcagaatgacagtggctcatataagatgaatattggcttacgattagagggagctggggaaagactttgccttctcacatctgttctttcaaataatagaattatttgtctgattccacgtgtctcgtaccagctttcttctccccccccccccacctttgcaccatgtatgcccctctctccagcc

SEQ ID NO: 21645 - DNA, 1117 bp, Mus musculus
tgtgctttggattctatccctgcaaagcgagctcctaccagagtcagaacacaagtccatctaggaaaagtcacaaacgttctgaacatctcaaaggattcgcacacacatttgcagatgctccacagcctccacgtggcaacttgccgacaggttaccgtagcacatggtgtaactcgcagtctacctttttagtatctttaattgcattgagaatagattccttttcctgctccaatatctacaagcaagcagtgtaactcataccttgaatttagaggcatgaaaataaagtcccacccctcctagtttgtagggaggtatttcataggcggacagtcttctgagtgaggaagcgggagtatggatacgtggctgcttgtatagacctctcatcctgaagctcgtgtggctgcctaagtgtcagctctgtggttttgtacagactacacatgcattgcaaagcctgaaccaaatgacacaacccacgaaagcttatcagaattgggcaaaatcattaagtttagaagacaagggccactatagctgtccagcatagaatttcttctcaacttcaaagacatgtccttgaaatttcagcccactcagtaatgagtgggccagttttgctctagagagaacacattttgaaaattgccaaaaagtcagaagaaatgtactactgtataaagcaaagctgtatatactgagcatttttagcagagtaatatttatttgcatagcctatttattgtatttgtattacactgttattaaataccaggatgaaatcactgaccagaagcaagaactcttgcctttggatgtctcattgcttaggaccgccgtgatgctgtcagcttgggataacaattagaagatagaaaacccacagtccgggcgtctacctaacttctcagggactacacctcgtagttttccaccattataagcgctggtaaatatgaaacatttgttgagttaccagactgccgttgacagtgtttgatttctcatagttcatgctttctgcctctgtgtacatgactctgctgtgtatttatcaaagtaggaagcaataatttatatgtaaaaatggccaagcaatataaggtta

SEQ ID NO: 21646 - DNA, 1106 bp, Mus musculus
ttctccgtctgtaggatcctttggcagacataccccattgtcctctgtttgctgaaggaaagcagtttttgctgaacatccaaggctcctgaaaactctgctgtagtagtgactcgtgctatccagaattttaagagcctccagtaacaagttggataggtagttagttgtcctagagatctaactgtttcgtgcaggtggaccacagtgctataagaggctgtcaggcagtcggctaggtgatccagatgttgtttctttcaataataatcttccttatagttttttttaaatgtatctttctttgacgttagatatctagatgacaaacataaaactttgcccatttttataaagagctttcgaagagattgaaaatcaggtatttctatgctgtttgcaatgagtgggtgtggtctgtaaaaccacaccaagattcatgtaacaatattcaccttttggttttgagttgcttcaataaacttgaagaaataggcataacatccccgaggcctgcacttgggccgactggggttgctgggtgtgggaatgaagtctctggagttgtggtccctgcagattatatctgttttctcctggaatggtctccctaggccatccatcctaagaggcagtatgtttgtcctaccccgcagctggatgcctttccttcaagaggatgcagaacggatccgtgcagaaggagagcacattgcatgttgggcctgttggcctaaattttgaagtggtctcagcccctgctggagacctcccagccactattatgagggcctcaaagttatcccgagggtaacaggtaaccccacaatccagctcatgtggctagtgagtggaggggctcaccccaggcacaagttgaatatttgtcaaactgaaaagaaaaaggtggttgagggctaagtagagtggttggatatgtgaatggctgggtgggttatggctggttagatatatgagtggctgtgtggattgtgactggttggatatgtgaatggatgcatgggttatgactggttggatatgtgaatggctgggtgggttatggctggttagatatatgagtggctgtgtggattgtgactggt

SEQ ID NO: 21647 - DNA, 1163 bp, Mus musculus
tgtatccatacctgcatagacctgtattgtgacaagtgtctgctgaagagttaaaagcacagtttgagtggggcagagttaatgctcaggtaagttataaagaagaccttgtctgacagctctcgcctttgatactcagttcccccacggtcactcccttcctgcagaggctgttgctttgcctcctgagtgaccatagctcaaacctgatagtttatcctgctctggatattaaattctgggtcattaggaatttatattgaagaatgttactctaaactaccaagtgcaattaaccacacactgtgagtaaggtgtcctttttattaagagacaatagaaacagacactggaggcctcactgtgcttgcctcttccttcaggacctgcctggagcctgctgcttctatttttttaaaaaaaaatttttatagattatgctttttatagaacactcactgcattgtttccaagtcttagggatacaagataagccatggtgttttgaatgggtgttgggggaagctaaaatcaataagtattcatcccttataggtgtgtagtgtttggtccttgtgtactgtgattactcgccctcctcaaagaataattctctaacaaaagaatgtatacccctgttactaaaacatccttgctgtgtctggctgaagctggagggacgtgagctgtaaaaccaaggccgttcatgcttccagcagtagagccacacctgccagtacccacttagctatcctgtctttgctccttagcctgaacgtccacacgtaggtggggcctctcgctttggttttgtaaacagggcactcgtaggcatgcttaatttcttgtctgtccacgggcacggctttggcaaagatgacgggcatcatggacgttaactccttaaggcgggcatcaacaagggctcctgactggatgtcccacctggcacctgtggcagagacaacagttgtgtaactggcatgcgggttctgatgctcttaattgttccatgcaataaatgttccactttgaccatgttgtcacctgtctgtggcatccttgtgcggtttgagaagtttaactgctttataagatcaaattccagacatattcaaacccgtgaaagaagcacacagctctcttagcatcctttctcgctg

SEQ ID NO: 21648 - DNA, 1245 bp, Mus musculus
ccattggtcttgcaaactttagatgcttcagtacaggggaatgccagggccaagaagttagagtgggtggtcaggggagtgggggggggtatgggggattttggggatagcatttgaaatgtaaatgaggaaaatacctaatttaaaaaaaaagaaaaagaaaaaagaaaaagactgaggaacttagaggactcttggtacccatagatggcagcaaagggcagtcatgtactgagcaccttcaagcccatctttttcagatgcatgtattcttctcattctttccttaatacttttccaaattccagtcatttctctgatgaattagctactctagggaaacaattttaaagaactatagatgaatgctagcaggaacaagtaacaaaatgccaatgttgttcacagaagtaaagaaatgctttctaatgtatagcagaggtcagcaaatgttttcaacaaagggttaaatagtaaagagtttagactgtgaggccataggcccattatgcccaatagcatgactatagccaccagcaacatgtgtaagactgtgccaggagccggtagtggtggcacacgccggtaggacttgctgaaggaggcagaggcaggaggatcacgagttcgaggccagcctgggctacacatttttaagccgggcagtggtggtgcacgcctttaatcctagcatttgggagacagaggcaggcagatttctgagttcgaggccagcctggtctacaaagtgagttccaggacagccagggctatacagagaaacccagtctccaaaaaaacaaaacaaaacaaaacaaaacataacataacaaaagactgtgccaggtatgatggagcatataattttagcactccagaggtaggggaaatctctataagtttgagatcagcctggtttacatagcaagttccaagacagccatggcttcaaattgagaccctgtcttaaaaccaaacaagcaaaattttaaaaatctcattctgctaaacaagtataagtcaggattatctggcttatacagccagcttgagaatctcttaagcagaaaaacagcaggagagatgggtaataagaacactgtactagggagaaatatgaagccccaggagcctgtgatatctatgacataaagactaacactaataagccttagtgctcatcagttttgaaatttacccaaagatgaataccaaacaagagaaagtttggccagcctgaaactt

SEQ ID NO: 21649 - DNA, 1206 bp, Mus musculus
aaaggacccagatgtagctgtctcttgtgagactatgccggggcctagcaaacacagaagtggatgcccacagtcagctaatggatggatcacagggctcccaatggaggagctagagaaagtacccaaggagctaaagggatctgcaaccctataggtggatcaacattatgaactaaccagtaccccggagctcttgactctagctgcatatgtatcaaaagatggcctagtcggccatcactggaaagagaggcccattggacacacaaactttatatgccccagaacaggggaacgccagggccaaaaagggggagtgggcgggtaggggagtgggggtgggtgggtatgggggacttttggtatatcattggaaatgtaaatgagctaaatacctaataaaaaatggaaagaaaaaaaaaaaaagaaatgtacaaggcgaaccgcaggatgttggaggtgaggctgccactgctgagcaccctagatgactttgtcctggggtctgcgcgtctgtcggctcctgatccaggcgatccacaatgatggtgtcactgcgtcttcaacaacctcctctactaccaaaccaattaccttctctgctttggcatcagtcttgcgctggccgggtacattcgtctgctgcacaccctcctgagcgcactggtagtggtggtggccctcggggtgctggtgtgggctgctgaaacccgtgcagctgtgcgccgctgccgtagccagccaccctgctgcctgcctggctgcagtacttgccattagcctcttcattctctgggctgtgggtggcgccttcaccttcctgctctgcatcacagcgcctgtgcttttgatcctgctgcatgcttcactgcgtctgagaaaccttaaaaacaagattgagaacaagatcgagagcatcggtctaaagcggacaccaatgggattgcttctagaggctctgggacaggagcaggaagctggatcctaggaccttggcatctacaccctgaacgtagaggacccccaccccatacccaagaccaacccttttcctagccattaaaataggtgcctagagtcctctggcctggccaaaaagagacacctgtgattgatcactgcagccccaaactagtcgtctcttagcctccagcccctgttacctagggaccaaagtcttcctcggtcctgaatttgagactc

SEQ ID NO: 21650 - DNA, 1176 bp, Mus musculus
tgttgcagctaaagaattaaaagggttagaattacactataaagagaaaataattcaaaggattgcttgtttgtatttcattcaaaagcacttaactaatgaaatgccagcagaagcccccttttcagcatttaagagcctttaagagtgggataacagagatcattcagttttgttgcagtgattcccaaaatgtcactcaaagattttgttaaattttttttttttggaagtaatggcacacacctttaatcctagcagtcagagacaggtagatctctgtgaggtcaaggccagtttggtctacatagtgagttccagaacagccagagttacatagtgagatcctgtctccaaaacatcatcatcatcatcatcatcatcatcaacaacaacaacaaaaacaacaaaaacataagcagcagcaaccattacatttcttttttattttgagacagggtctcactgtatgcattggctgatctcaaactcattatctgacatcaaaaatcacagaatgctggttgtggtggcgcacgccgataggatttgctgaaggaggcagaagcaggagatcaaaatcacagaatatctgcctgcttctatctcctaagtgctactattaaagttgtgtaccatcacttccagccctagaaatgcaacttcttgagttctattgtcatctttccaaaatctacagttagactcaggaatgcgtctgttttgacaagcttttcaaacgatgctaatgaactattaaggttaagaactattattatttggcaagcaaatttttagaatcctcttgatcttgttaccaagtttaattattttcttgtctgtattaagatctattataggttataacacctcacatatgttttgggcatggggaggtagctcagtgggtaaagaacttgttatataagtatgaggacccagagtttggatccccagcaccctcataaagttggatggacatgatagcttatcaataaatactgaatattgcagaagggataaagattcccaaactgagcttcccagttggactaccagaatcagtgagtcctgggttcaagtaagagacgctaattcaatatatatgatggagaataatcaaagaagacactggtatcaaccttggatctccacaagcatctacacatgtgtgta

SEQ ID NO: 21651 - DNA, 1235 bp, Mus musculus
gctttccttctttcatttctcactcatggcattttaaaaagctggaatcagggaggccaaagtaatgtagaaaacccaaacacattttgagaagttttatggtataaaaagctcaaacaagaaatttaagtttacaaatcagcaacagttttacatttcaaaatctctgagaaaggatagatacagagaaatcactctcatactcaaaatttgcttagccctgatatgtctgtgtgctgactgatttctacaggctaagtggctatgagcctttctgagaacgtttggacagttgagacaaagttttgggtgttttacgctgtttgagatatgtcacaatttattttgttagggattaatttatatattagtgttttatcttcatgcatgcaagagcaatacatgaatgtggtaaccatagagaccagaagactggatcctttggaactggagccacagatcgttgtctgtcaccatgtgaatgcgtccttaggaagataagcctgtgctcttaaacatttaatgtctaaacagtacttaaatatacatattttggtctatggccgtaccaccctgaacttgcccgacctcgtctgatctcagaagctaagcagggccgggcctggttagtacttggatgggaggctacctgggaacctgataggcatggccgccagctgagggggcctcaaaatattaatccagagttcctcctgccaaaagaaaatgcaaggacaaagagtgtagcagaaactgaagggaaggccatccagtgactgccccacttagggatccatcccatttgaagacaccaaacccagacactattgctgatgccaagaagtgcttactgacaggagcccagtttagctgtcccctgagagctggaccaatacagatgcagatgtacacagccaagcattggactgagtgcggggacaccaacggagaagttagggcaaggactgtaggaactgaagtggtttgcaaccccataataagaacagcagtatcaaccaaccagaccctccaccccccaccgagcttccagggactaaaccaccaaccaaagagtacacgggagttggggcaacccatggctccagctggatatgtagcagaggattgccttatctgacatcgctgggaggggagccccttggtcctgtggagacttgatgcccaggataggggaattctagggcgctgaggcaggagtgggtgggcgggtgagg

SEQ ID NO: 21652 - DNA, 1212 bp, Mus musculus
caaacagtgcctgagaaagttttttccctgtgttcaagagaatttctttttaacagtgttgcagatctattcagatgtttaaaataatgcttaaattcaaagaattttgcttctagtgaactgtaatcactagaaaattctgccactaggtatggctaatatagctttacattatgtaagaaaaatttttattgtttctgcttctatacaagaagccaagagttttaatctttcagtgtatattgtttcctaagtgaaaagtattttattaactaatgcttcttgaagtttaccttaaatccttgctctcacccaaaagattcagagacaatatccttttattgcttagggttttagtttactacaaaagtttctacaaaaaataaagaaagcttttataattgttattaattggtaattaaaaattggttgtgcccaaaacaattctttggccaaaaagaaaaacattattgtaaagtcatttttctcatcctcccagctgatcgttggcccacgtgggcccaactagcttctgtggggcggagtcttaagacacagtttcccctatttcagcacagatgatctagttgtgtgctgtagatggtgttttaaaatgctgaataatcaaaccttaatttgtatattaatagtcaatgccatatctctgagctcgcaattgcttaaattgttcatccctcagatactattaattctcaaatttacaattgcttatgcatatttctagttgataaataaataaattatgcacatgtgactcctaataactttacaagccttctagttacaactgctccttaagaaaattgattgaaagtgcaattagtcactgcccctttacagccaagtatttaaaatgttttgtcaactagttattaattcaaaagtttaggtattgtaaaattttaaaactttaacttcttaaaagacaaaaaagagagaaattgtatccccatgcatacccatgcacactatttaagtcttacctttattttcaaataaaagggatctacttattggcttatagattgatcctaaaacagctaccttattagaaaagggaaaaacaggttttctccacagaacgctgcagaaacatattaattcgtgtgacgagctggtaggtaagttgactcatgtcctgattgaattgactaaaaaactaaattaaattcatgttttagatccatcctt

SEQ ID NO: 21653 - DNA, 1833 bp, Mus musculus
ttccccctctcaccccattcccttcccctaccccccacgtgctcatggctggcctctccctctccctctccctctccctctccctctccctctccctctgcctctccctctctctctgcctctccctctctctacctttctctgcctctgctaccctcttaacttcccctcttcatgctctgaatatactctattctgtactatactgtcatgtggctggtccctcagcgggaagcgataccttggcatacgccctctgaggcacccccttcccccatatctcaccatacctccatagaacataccccccttttcttgatctttttataaacacttcagttgtgagctgctgtgtgagtgctgggacctaaatctggatcctctgcaagcactcaagttcttttaactagtcagtcatctctctgccctcattaccagttatcttgaaaccatgaagaaaaacaaccatgaaaacaggatgagaaaataaaagacccgttcctagcgcagccatggctcgtggtcccaagaaacacctgaagcgtgtagctgctccaaaacattggatgctggataagttgactggcgtgtttgctcctcgtccatccactggtcctcacaagctgagggaatgcctgcctctcatcattttcctaaggaacagacttaagtatgccctgactggagatgaagtaaaagagatttgcatgcagcgattcattaagattgatgggaaaatcaggaccggtataatctaccctgctgggtttatggatgtcatcagcattgacaagaccggagagaacttccgtctgatctatgacaccaagggtcgctttgctgttcatcgtattacaccggaggaggccaagtacaagttgtgcaaagtgagaaagatctttgtgggcacaaaaggaatcccgcacctggtgacccatgatgctcttactattcggtaccctgatcccctcatcaaggtgaacgacaccattcagattgatttggagacaggcaaaataactgacttcatcaagtttgacactgggaacctgtgactggaggtgctaacttgggaagaattggtgtaatcaccaacagagagagacatcccggctcttttgatgtggttcatgtgaaagatgccaatggcaacagcattgccacgcggctgtccaacatttttgttattggcaagggtaacaaaccatggatctctcttcccagaggaaaaggaatccgcctcaccattgctgaagagagagacaagaggcttgcggccaaacagagcagtgggtgaaatggtctctaggggacatgctggaaaagtgtttgtacaagcctttctaggcaacatacatgctagattaaacagcatggtgaaagtaaaaaaaaaaaaaaaagaaaaagaaaagaaaagaaaagaaaagaaaagaaaagaaaagaaaagaaaagacaaagctttgaataatatccctgagctgcagaaccaatgatccagtttcttgggggttctttttccttgagaaattctcgctcgttcactgagtcagagttgccaagcatctgttaagccctagatcctgttctaggctgttgaacaaaatacaatgtcctcatagatcctcgtggagtcagagtctaacctggaatggcaattcattaaagatgagcaaggcaaggctactctatgtaaggaagcgtgtggagcgggcacggagactaaggagacaggcttttgtatccaattgaagacagggtgggttggccttgctaaggaagaaagattacactaatactataagaaacagaaagttctttctcaggctgtcagaa

SEQ ID NO: 21654 - DNA, 1122 bp, Mus musculus
actgaccccgactaaagtatccgcgaggagtccaggtctctgtataggcaccccaccttccacccacaaacacctatgcagacaaattcagtccgtgtccaggacagaagctaattactatcctgtaccttccccggttggctggtgggcttgcaatacaggacttactccctttatatcaactaaggtttttaattcatctcgtgatttttgtgtcatgatccagctgttaccccgcatatattatcaccctgcatccagtttagaagaaagctatgctggccagaggtcaaaaagagaaccaattactttaaccctggttgcattcatgggaataggtatggcagtaggagtggggacaggagtgtcagctttgatagaaggaagacagggaattcagtctttgagggatgctgtcaatgaagacctagcggcaatagagaagtccattgacactttagaaaaatctttgacctccctgtctgaggaagttttgcagaacagaagcggtcttgatttgttgttcctaaaggaaggaggactgtgtgctgtccttaaagaagagtgctgtccttgtaacgtttcacctgcaaaacacactcgaacaaccagatccttctacggcaaagctttattgcttacttctcaggaagaccctgaacccggaaaatggagctgcttaaatacccctctgtgtgacgtgtcagctcctgattaactgctcactataagctcagatgacaccacgggacaggcagggcacaaggaatggaaaaataccctagcacatgcgcagactatttgtttaccagttagaacaccggatatcaccgccatcttttaatggcgattgcaagggcggctcctcacatcttccccttttcttttatttaaaaggcaacaggccacccagtactgagagtggagatagagggcaaatccccagtgtgcaaaaataggggcattacacaaaaccttcttccaggctcatcacccggaggggtcttggtccactcccgtgtcatttttcctgggggaaggacacttggacactcaaccttcatacaagaagacatgtctccctagaataggctcattttatgccgcagagcctttctactg

SEQ ID NO: 21655 - DNA, 1141 bp, Mus musculus
agcaagcaaagttgactggagcgagtggacttgaccggagcaagtagagagaggtcctaaaaattcaattcccaacaaccacatgaaggcttacaaccatctgtacagctacagtgtactcacatgcataaaataaataaataaatctttaaaaaaaaaaaagatacagaattcaactctgaaactatgtaccatttactgaggttctgctgtgcaattgagtgctgtgaatgatctgtttagagagttgtgcaactagagtccaggttttgtcatgttgagtcatgacattggtgtttaaagtgcctccacagtcttactttctcagtgtcttattccatgtgctttttggaaaaaatatttttcaggcttaatgggactgtttgagaaacgccgtttcaggaagttcctggtttatgttgccaactttgatgaaaaagatcctagaactttcgagggtgttgatcctaagaagacctccatgagagatgtgtataagaagtttgatttgggccaagatgttatagactttactggccattctcttgcactgtacagaacagatgagtaagtaggctaatggctctcatcacctagctgtgcagaggctgtgagctattgtctagcagtgctaggaggtgtcttcctgcatgtggctttaggcaactttacagttcctgtattagatcagatatttattagagagtatcaacagcagaaaaaagggtgaggattccagtcaggaatgtttggttttcagatctgtgtttttctttaaactttgaactctgagactgttaagtgtgaaacttaggacttgtatgttgctgtctggccctgggaaagagggtctatttgcaaatgagtctaagactgttttaattaggggatagtcctttgagattactgcaggaaaaagagtttaaaatcaataagaagtagtgtttttctaatgttcatttgctttttttttttcccagctacttagatcagccgtgttgtgaaaccattaatagaattaaactttacagcgagtctttggcaagatacggtaaaagcccgtacctgtatccgctttatggtcttggagaattgccgcaaggatttgcaaggtgagtacctattttacccattagccctg

SEQ ID NO: 21656 - DNA, 1603 bp, Mus musculus
catgtccactaaaatcaaaactgagatgttggtatctgttgcatggtcacataattctgagaacaagattgccattggatgttgtggatctttagagtgcttctggtgtagataataaatcaaagctgtgatacttatctgtttttccccatatagatttgtcagcatcagtgacctctttgtacctaaagatttgggaacagatagtcaggtgagtgtgatgatctaaaaaggatgttactagtctttactgagcaatgtccatccctaagtagtctaattcttacttccagatcttcatttcccgtgcctatgatgctaccacgcactttgagacaacctgtgatgacattaaagatatctacaagaggatgacaggatctgagtttgactttgaggaaatgaagcgcaagaagaatgacatttatggagaagactaacagcagtacatattatgtaataattaggacaaacttaaaatttggcaaataatgtatattgtatgaaatcaatactgtaagccctgcttttatgatcaaaatggagattgaagagtgctataccagtgaatgctccttcactttctaatatcatgtattaacttgttttcatggaatggctagtcagaattggttggttctgttcagtttaaccagactgcattttgttctaaaacaaatattgatatcgatagagaacttgtatcatttaatcagtgtagcctttgcgattgtgtgatccaagagctggatccatacaatttgtgccaccctgaaattgggactctaaattgagtatcctttggtttctgaagacgttcaacgttttctctattttgttatgtcaagtatcacagcagggccaatagaagagagccacatgttttgtttatgagggtagccaaacttcagacctacaacagttgctgagaaaaggaaaggagccttaaggtaaagcaggtaaaatacaggagccccttttatcccagacacggctcctcccccggaccaagctgcaatgcagtattaatctgacagagcctcaatgtcaacgatgcctgttccaaaatggctccagatgatttctgtactgcaaaataaagccaaactctggaaaccactcttggtattgagtgtctgtgtcctggactaaaagaactgctgtgcgctaagattttggatgggtgtcatttcctggcttcagtttagtagtcagtgatcttcaaataccagacaagaagcaacctgtgtttgtttcatggtttgagtgtacaattctttcttaaaggtatcctggtgatggcctaaatgttgcacacagactacaaatgactgcattttcaattctttatttaaaaaaaaaaaaaaaagacaacacaaaacaacaaaaaaaaccaaactagaaactaggtataaaagcctaagtatacaaatggtttttttcttgtttgtattttaaagatttaagaagtttctaatatcataaataaaggatttcttcctcaattgacttttgtagtgcagcattaaaaaacccaagtgtaaaaatttgtcatttacaaaaaattttctttatctatgtagtgtttcttacgtaacagcaa

SEQ ID NO: 21657 - DNA, 2445 bp, Mus musculus
gtgctggaagacctgcaggacggggatgtgcgcatgggtggctccttccgaggggccttcggcaactcagacaaaggtagttactaaagggggccaggttagacggggaggaagggagtggaccagaatggccacacatttgaagctaacctgggctacagagtgagaccccatcttaacaaacaacactgaaaagaagaaacaaatgtccctaaatgaaattagactcaacccttagcattttgaaaatacaaccattccccagtcatatgctggcacagcatggagttggtcaacaacctctaactagcagctgtctttaacagtgtgtgtctcataagtactggaactttccttactgcatgaccactttctcagtcttgatttcttttttcctcccttcagctaaaaatatctttagggtccgcttccaagacccttctccaggccactcccacacactgcaagccaatgatgtgttccataagcagcagtggttcaactgtattcgcgcggccattgcccccttccagcgggccgccagccccttagagcttcagggcttgccagacctccacgaagagtgtgaagagaacaacccttctgctgggaacctcagagcccagcgacggtcatgcgtggttcctggtgtcatgcagatagacgaggaaagcgccctggattgtggctccagtgtacagacagtggaagacaccaggaacatgaaggcacagcggcctcagcctggcttacgaagagcaagggacaaagcacagtcaggtggcaaaaagaaagagactttggtgtaaagtgtgtattccctgatggggagctgtttatttataaatgtgtacagtttttcttataatgggagcatcaagggttactctgtaccagaagtaatgtgttcatggtttgggtctctctctcatcctctccctctcccttccccccgcccccaatcgtcgtcatgtcattgatgttgtccttgtcgtcctcgttgtcatcgtcatcgttgttattaatggcagctacagatacacagattactgttaaattggagactttaaaaaggtattttcatggattatttggaacatgccaacttggtgtattttatcagaagcagtgtgtgtggagccggtgctgtcctcacctggttccccatgactgagcaaatgtcacagtgtttgccaggcttaaacgcttgcaaatgctgagactccatcagtgttctctgtgaaacctcagagggagcatggaattgtaatagtgacacctacgatccgcatggaacagatttgagattgaaatcttttgtattgacagtgaagtcccgcttccttgagaacaagcgtgaagctggatgtcttccccctttgtctcaactggaatgaacaaacacccgtggcagtctcactgcacggttcgccttctgcattcatttattctgccaactatttaattttttttttattgtaaagtagtttttagtatttgcttttatttttttacattgatgcctttttaaagtggcatgtccttgaagtttttcctcctaattgtgtgtgtgtgtgtgtgtgtgtgtgtgtgtgtgtgtgtgtttgtgtgtgaatcattaattttatcaagtgaaaccaagccatattgtttgagccaattaagaaaagtgcagtttttacagtgtatcatgtgtggtaaagtcccatgaaatgacttagtgtattttagactactgaaaggaaccacaggaagggttgggtggaagtttttgtgttgtctgaaaagcaagagagaaggcaggagtctgggatagggaagggaagggaagagaagagaagagtagcttgtctaaagtaaattgtctggctgaaccagaggaggagccaggagcagcctggcctgagggatgtagaaagttgtagaaggcagaggggatgtgaactgtgtttgctttggtttctcatacctgcaaatgctacatttgaaaagaactgtacagtgtgttggaaatttgactatattaggttaattctggttggttttcttcatttaaaaaaaaacccgtgattcttgactacaaaatgtttgtgttaaaaatggggtcatgctctttacaggggggagaaggacagagaccccatgtcagcccagggttatactggcaatcagttcaagtcattgttaaccattatatgtgaaatatatctccagtggaaatgaaaattggaaaaggctgtaaatagatcaatgaaatgatttctttgtataaaagaattatataattaaaaaaaaagcacacacataataacccaaaacatttctctcctggtggttatttggggggccatccactgggccatgagggcttagctaaacctttaatggttaaggaaatcccaaataatttacccttttgaaatttgttgataagaaaagtccata

SEQ ID NO: 21658 - DNA, 1519 bp, Mus musculus
ctgaaggatcagatcagccttaacctgagagatttcgagctggtacactgatggcagtagcctcgcagttaaaggtaagcagaaggcagggacagcagtacggtggtgaacagaaagcaagtgatctaggccagcagcctccctgaagggatgtcggcccagaaagctgaacttgtgactttgagacaagctctatgaatggcaaaagaaaagtctacactgagagcaggtatgcttttgccactgtacaaagagggctgttgacatctgcagagaaagacctaagatgctgtggctaaagaaaatcagatggcagatctaaccgccaaacaggtggcccaaggagcaatgatcctggcagtcaaggagcctaaagattattatgacatcagagagaccagctttagatacacccctgagcactatcaagttatggacagtatttgacccacctgggggccaagaaattaaaaggtgtggttacgtcctttgactactatgttacaggactttctgacttggcagaagaaatagtcaaaagctgcaaggcctgtgctatgacgaggtagaatttctaaaagaaatcttcccaaggtagttgggtccaataacggacctgtctttgttgcccaggtaaatcagggactggccaagatattggggaatgattagaagttacattatgcatgcaggccccaaagctcaggacaggtagagagaatgaatagaaccattaagaaacccttaccaaattgacagcggagactggcgctaatgattgaatagctctcctaccctttgtgctcttcagggttagagatacccctggacagtttagactgacccccctataaattactctacagggggccccctccactggtaaaaatagcctctgtacatagtgctgacatgctgccttcccagcctttgttctctaggctcaaggtgctcgagtgggtgagacagctagcagcttcagaaggcctactcaagagaagaagacctgcaagccccacatcagttccaagttagagattcgttctacattagacatctccatgcagaaaaccttgagactcagtggaaagacccttatcttgtactcttgaacaccctactttctacctttatgggaccccttttgattttgcttctgcttttaattataggtccatgtgtgttaaataggcatgtcacctttattagaacaagaattaatgcagtgcagcttttagttttgagacaacattaccatgccctaaaggatcaagtatgtcagggaaaagatagtgtctagttctaagattagaactactaacaagtagaaggggggaatgaaagtataacaaagtaaaaacaaaattctaggcctttaggcccaggcttgggaatgtgacctctctgactcatttctccaaggtatgctaatcacaaaacagatagccacattcctctacccacccgcttcctgggttcaaagagtgttcattcaaagaaagtcaccctgaccattgaa

SEQ ID NO: 21659 - DNA, 1324 bp, Mus musculus
gtaatcccctaacagaagggggaggaacaggaattggtggattcccgatgctcagtaaccagtcagcatggcttactcgggaagttccagagcagtgagcatgcgcacacacaagaaaagctgatgctcctatcctggcgtattgagtgagtcgtgctgcgtaagtctgctcacagtcaccttctcctcaggtcactcctgtccccgagctgttcctgacagccgtgaagctcagccatgacaacacgggagccagatacctgcacctggcaagggaagacaagaacaacttattcaggtgtgtgctccttttaggagtgtgttcttccatgtctccatctagcacccctcccatgcagcctaaaaggggagggtaaaacaggccttgccgggcatggcaactcgccaggaaacccagtactagggaggcaggagcaggagcattgctgcaagttccaggcagtgctaggttacatagtgagttccaggccagagtaggcggcagtgcgagaatatttccacttctccctctcttcccaaagaggaagatctatggattcgtctaaagattctctcgtgtagatacattgaaatttttcagtatgactcggtgattcgtacatgatagatgcattttattaaaagattgtggtgtgagaatgattgtttttattgattcagggtggccccgggttcaggaattccttgtcacctgttcactctctttcctgtccctcagtgtgcagttccgcacaaccccaatggatagcactggggtcccacatgttctcgagcatacggtcctgtgcggctctcagaagtacccgtgcagagatcctttcttcaaaatgctcaacaggtcactgtccacatttatgaatgccatgacaggtaagaagacactattgcatatgccagcaagattttgctgaaaggaccctgatatagctgtctcatgtgaggctaggccagtgcctggcaaatacagaagtggatgctcactgtcatctattggatggatcacagggtccccaatggaggagctagagaaagcacccaaggagctaaaggggtctgcaaccctataggaggaacaacaatatgaactaaccagtacccccccagctcgtgtctctagctgcatatgtagcagaagatggcctagtcagccatcattgggaggagaggcccttggtctttcgaagattatatgccccaatacaggggaatgccagggccaggaagtgggagtgggtgggttggggagcagggggggggggtcggggggtagataggggacttttgggatagcatttgaattgta

SEQ ID NO: 21660 - DNA, 1224 bp, Mus musculus
aagtaggattcaatgtaggtggtgggttggtttgatttaaattgacatgagtaatttagttaatttgattgactgatttgtccagatagccttggcattttcagtccccctgcctcagcctctggagtaactgggattatagtcccacatgtggtccaaggcctggatttattggtcttttacattaataccacttgctttgggttttaaaattcatatcattaagcattccttaagagattaaggcattgtaaaacagcagtttattgtttgtagaattattttatcataacataaaaggttaggtaggactgacttatttaaaaaggtgagtgtgcatttgactagctacatacaggaggcaagtgcctgagaccatcggtttaacgcgttctctagtgagacgtgatgtaaaagccttcagtcctgatgtcagtagagtacatcccaaatgacagtgcttgggttttgatagtctgcctctttctgctttctagatataatggctatacacgggaggcttacttcagtgtcgggctccaagggatcgcagagaaagatgtcaagacggtcagagagctcgtagacaggacaatcgaagaagttatagagtacgtgtgtgtgtgtgtgtgtgtgtgtgatgacagcctgcccctgcttccacccttccttcatgagtgctctgtgggaaggagactgagccatctctaccactagcctcttgatgtcctgggacgtgtgttggttcaatttagtacttacgtatttgagttttatcctggatttctttctggcacagattgatggagtggtgtgacattttcatgtatttctatgattcgtccttatttttctttctcatcatcaccccactccttgctgtctttctttttccaacatgcgcacacgtgtgtgtgtttgtgtgtgtgtgtgtgtgtgtgtgtgtgtataatatatcacttgtgtaatcgtctcattattgcctctgccaccgtgtgcctctgaaacctctctctgtttcagcatctcatttattaatttgggtgtctcattttttttttttttttaggaaaggatttgaagatgatcggattgaagctctgcttcataaaatcgaaattcaaacgaagcatcagtcagccagctttggcctgaccctgacgtcagtacgtgatcttctcaccaccactgctttcccttctgtgttgtgtattgttccttctt

SEQ ID NO: 21661 - DNA, 1169 bp, Mus musculus
aatcaggtgagggtgtgagttagcccgaggttgaattcagaatggcttttgtaggaatcttccaagcccttacggccagctacctctttaacttggctgttaccattgaagtgggtgtggtgggaaaaggcctggagtgctcttgacctcccgcttcactgcttccgggatttcaggcttgctttgtggctggtggcatgagacaccgttatctctatgagagcattttcctggaaaatgataggttttttaattcagaccagggttgggcttcaatgtgcagctgtggaggctaggatgggatttgatttgatctgatttgatatgaactgagagtctcctgtatgctaggcaagcacttggtgacaaccccaggctaggtacactgtttccggtgaggcatctccaacctgccttgcatattttaatggtgattatctcacgtgtcatgtcggatacatttgtaatagatttgtgtatgcagctgagagagagtgtgtgtttctagaaattggggaatgttttgatcttttaatctacaggctctttttatttttccattttcatatgtgtgtgtgtgcacgcatacatgtatgtgggaatgtgtgggaacgtgtgtgcatgtcgaggttggtattgggaaccattctccactgacttcgtgcattgtttattaaggcagggtctttcaacccagagttgagcgctaggactactcttgctagacagccttttctggggactccacccttcacagctaaaactgcaggcgggctgctatgcccatgtggcattttacatgtcttgtctgcctggagatccaaactctggctctcacgcttgtgaggcaggaaccttacctaccgagtagtcacccagcccctcagatattttatttagaagtaaatctcattaagtgtctctaataagtttctatttctttaatagggacaataaatcagtcatcaaccagtgcttccattcagtttccatacagtgtagggcactgtgctaggtggagatctataaaatagaatcaagaaagcccaaggacattgagggcttgtggagtacagggcattacacactgctcctgaagggtaagggggctctgctgcggcagaccaacagcgtgtagaggagacgctgcgatggagtcaggtgttgtg

SEQ ID NO: 21662 - DNA, 1109 bp, Mus musculus
atcagcacacagaatttctacatgtttttctaagataactcccaccccattgcccgatatttgagcaaatgacgcatgtgtgagcatatttaggaggaagaaagtactcgtaaaagacgtacaagctaaaggctgggagatcacgttcagcctgatatctttactaaggggcactaactagctactgaagcctttagctagggtcctgagcactgaacatgagttccgaatggagaaatggcttcgtacctctgggagagggcacatgagctatgtagagagttaatgccagcatgctttcaaaactgcaaagtgtacaggacggatggagaattgtggctattgaattagcatacaataaactgtgcgtttgaaaatggtaggcacagatgctaactcgggtgctacccagatgggctccggtaaactcgggtatacttcttgttcatcaggctgggttgtggcatccttaactacagagagcaagcccaacagattgagctcaagacaggaggcatgagtgtcacgccccatgtgctccctgacgactcacagctggatacctacgagcaggtaggtaccccttcatgctccgtcatgatgtagtcaaaggcttgtttccagggtgtcctcgtttttaatggtaccctaattaattttgtcttgcatctttctttggtgatacagggtgtgttattttcatctctctgcctggagcggaacctgccagacatgatgcatctgtggagcgaaatatttaacaagtaactttactcacccatatattaataagtgagagtatgacatatgtaactctgagatgctttgccaagtgatttgcctcacttgtcagattctagtcagattttacttgtaattcctaagcacacagaaaaaaaatggaaagatactgagttcctctgtaataatttccctgtggtatcggagtgaagctggcccactctaagacatccctcttcttctgtagtccatgctttgaagaagaagaacacttcaaagtgttggtgaagatgaccgctcaggagctctccaatggaatttcagactcggggcatctctatgcagccctcagagcaagcaagacactg

SEQ ID NO: 21663 - DNA, 1151 bp, Mus musculus
ggagactttttgatcccaagcactgcggctgtcgggtaaagtctatttgaactgtgcagtatttggctgtcagtgtggtctgactcagtgtctgcctcctttggttcaggtgaaggtgatgaaaagaattgcagagatgacagacatcaagcccatcctgagaaaactgccccggatcaagaagtatctactaaactgtgacaacatgaggtcggtgtcccgcctgtccccaaacagctcttaggagtcccaccattttgtaaattgtcattttttaggtattttccatttgaagatgaaattccctgaatttatcttcaaaacagaaagtgtgttggtgtaggtgttaggtgataggactgactctagactttaaattaatgtgctgggggaataaaaaggattacattttaaattagttaaagttgcatgaggtggacaagaaagcaacgaattaaagtctagaacttcgggctagagacatggctcaacggtcaagagcactgactgttcttccaaaggtcctgagttcaattctcagcaacagcatggtggctcacgaccatctgtgatgaaatcttctgccgtaagattcattatcttttccctagcttctgtgagacgtagagaaggttatcttgctcagtatcagtgtcctggttcgggtttctgctgctgatgaaacaccacgacccaaagcaacttgggcaggaaagggtttatttggctgacgtaaccagagtcactgtccactgagagaagccaaggcaggccctcaaaccaggtgggaccctggaggcaggagctgatgtaaaggccacgagtggacactacctggtgggcttgtgcactgtggcttgctctgcctgctttcttatagaacccaagactaccagcccaggttggcaccacccacagtaggctggtccctctcccatcagtcactgattaagaaaatgccctacagctggatcttacaaagcatttttctcaattgaggtcccctctcagatgactctagcttgtgtcaaggtgataaaaagctagccaggacagccagtgtcttgaaacagtttggccacattacgttagctttctgtcctcgggctcgagcataaataaaaatgaattatcagtagtttacatattgt

SEQ ID NO: 21664 - DNA, 1150 bp, Mus musculus
ctaggtcattgtttttgttgttactgttacatttctgtctctctccctctccctctccctctccctctccctctccctctccctctccctctccctctccctctccctctccctctccctctccctctccctctccctctccctctccctctccctctccctctctctctctctctctctctgtgtgtgtgtgtgtgtgtgtgtgtgtgtgtatgtgaaggtcagagaacaacttgtggaatcagttgtctgttttcaacttgtaggaccaggtccattgagtcatctcactgggcatgaaagacatagttttatgactagaaagcacccggggtggtgggggagggggtgatggaaacactttaagtttgtacacgggctgtcttcatgaactatttgaaaagtgtgctaaagcttttatcactttacagtaggaagcctgtctgccttggctgactcaggtagggagctctgaaaacttcataaacatttcaaggaagtttctcttcactcttggattcttttttattttcagaaacccacacccagtggccccagtggagctgcacatgtcagtgggtcccagatcgtcagaaaattggtgacagtaagtgacccaagctgtcaggctgcgcttcctctgactctgagcgttctgctggtgggatcattctcgggctgagccgcaaccttagacctggggatgtgctatctctcgttgttaccagggggagcctttttcccttgagacagcccagaatgggtgtcatatcctttcataagcctctacttattgggccaagtggtctcatcacctcccagtttacttactgtagcgtcggatgcttccgtctcagcagccacctgcagatgggcagcagcatcaaccctctctacttctgggtttccacagttgtgctgcttgatctggtcctttgaatggtgctcatggaacatggtccacactctgaaatgcctttaatgtaatagtaatttctttttattgcatcttgccaaatggtggaatgttactggtttaagtgtcctcgtacgtcaagttctgctctcaggagtgcctccctagtgacacccatggagaaggagatgctggagtggtgccgcctgcttttactacctgagggccaccttg

SEQ ID NO: 21665 - DNA, 1139 bp, Mus musculus
cttgacagagaaaatgaagaccagcatccagaggggcctcgtactcaggtaatggagagggtttctggtcttccattttaggtgtaggttcttggacagaagttgtcatgggattcaaaccccagtgggatttttcctttgccactggttctgtggatgctaaagaagcacaggtttctttagaaacctgagttgtttaaaaaaaatcaggtcttcatctaaacaaaggacaaccttttacattttattcttgctctatagcctattggttattattttctagacacttgcccctcatttccttgagcccccctcccaaacagcctttatgagcaaagggaaatgtacagagtcagggtaggggcagagatgaaggaggctgacatggcaaatgactgggtgccttgagccttgagccagcctggctggctggagcagttcttcagaaagcccacactcaacccctccacagcccggagtaaacttgccatcttcacatccgtttcagaaacgaaagctgcagtgtaaattataccactgacttcatctaccagctctactcagaggagggcaaaggagtgtttgactgcaggaaaaacgtgctgggccatatgcagcaggtaggccaaggtcttctgtgatccctgagccccaggcatccccctcagaatggtgccattctgtgggacgtgagcacagatgaattcgaaagctcttgtaagtatgcggagttttcagacatatggaacgccatcccttttaggactctgtgtaatatgtgacatccgggtttatgggaagtacttagatgctttgctcttgcttgtgaccaaacagctgacaaaaagcaatataacagaggaaggatttatggtggccaacaatttaaggggatagcgccagcagtggcaggaaagacatcagggagggagtgggaggcagatgcttgctttgaatccacagtctggaggtagagggcgatcatgaggtggggctgggctaagagactacgaatgagcttccgtggtgacggtgacctgcttgctccaggtcatctacctcaagctccaccctaagttggggactaagtattttaagacatgagtctatggaggagacagtccaccctcaaaccacag

SEQ ID NO: 21666 - DNA, 2104 bp, Mus musculus
tagtctaatcagtttgtttatgtctgtctcatcaacagcctgtttggatcagagcttagagatccgtattcacagacctggggaacaaagtgttctttctttgtcatcttcttgaatcattaagtgactgcaacatagtgttctggattagtgggcatttgggaaagattaaagtaggacattaacctgtgtggctttgttccccgcaggggactgggtacctacctcagcagagccttctgttctgatctgcagtcttcctttacttgtaggagggctctgtaacaaagaccacacggtgaccctttcagcgcttgagtatcacagagagatatccagcacaacatgaaccccctcttcctttgttccatctctgtttctagagaatccagggcttcccacccaccaaagcacatgcagggggattcactagagaaattacagattggaatgtttttcttaaaacccatgtttgttcataagcatgatgatgtgttaagtataactcagagggatcatgtgaaaatctccaaatggctcttttgactttgcacattccctaaagatctgtgactgtgactgttgcagtccaagtaccccttcaccctcgtgacgtctctctcctcttccctcctgactgttaatgggcacttttcttttcagtgttaagcatctcctgtgttggaggcacagctggctgggacaggttctgtcatacctgtcctccatcagccccgcccagggctcctgtcctccagggacttcaatctggagaggaaatatccaaatctaataagacactttttaggaaagcatactgggatgaagggaggacacagagggactgtcactcctggaggtcacatagtgtcttcctgaggaaatgactttctaagtgggtcacagggtgcagataagagaacaggaaagagcctgagtggatttcttacaattgtaataaatggctgtatacttgctgttaacctaatagccatttgctcatagcagtgaggggcagaagtcagggaactgaagtcaaggtgtgagctctcagggagaggctgtccctatatcttctgctttcgcaaactgtgaccctggcattccatgaaccctaacctctgttgcatcctcttagatggcacaaaccctctcactcctttgtgtagtagctttgtgtagttattgtgccctggcttctcttgactcctttacagtgacactatgacaacctcttagatgatccagacaaaccccacctcaagatgtataagaggagttccagggagtgtgtatggaatacctttaggggcctctatgtttacttcttcactgtgcctggagactgctgtctgaaggtccagagaggctcaagagagtagcgtctctgagctaggacagcacctggacctgggagctggacagggtgctggggattggcagggctatgcatcccatagaaaagccttgaggagtacttacaagagagtgctgagggggttgaagaatccaaggacaccatcaggtttggattgcatgtgtggatctccatttccttggaacagaacgcatgctgagaatgaggtagaaggctaccactgatttctgaggaaaagattgacacttgcattgctgccgtgggtgtgaggccctgagtggttttcagctatcctccgtcctgaacctgggtccttttgtagaatggttggcagtgggtttcaatatgagagtgcctggaagatatctctgggtgcctttgtccaggaagctgttctctttggacataggtaccctttacgaaagatccaaggcaaacaaaacatccaacatcacaaagagcttttcacagtgaaacatcagcaaagtaaaaagaaaaaataggtagttggataaccaacattcctagagaaatattaattcacatcagctaaatattgacttgcaaaaaaaaatatacttccagcaaagatatagtcaaacagttcaggaagtgagctgagttgagtgactagtctccagggtaatggcctagccagggctccacctcggatgatcacagagatactgacaggctgcacatgagcagttttgccattgagcctct

SEQ ID NO: 21667 - DNA, 1062 bp, Mus musculus
gacggtggtcaagcatgtagggtggcatcttaccatgctcagttccttccaaaggcaacaagctgatctcttacttgacatgttcacatctgacctggtgcataaccctgtatgtcgtgaccccaagggggtgtcacatatcagataccctgtatatcaaatatttatattaccattcataacactagcaaaatcacagttataaagtagtaaggaaataattttatgtttgggggtcaccagaacacgaggaactccatctacgcatcacggagttaggaatgttgagaactactgccttagagcttacagtgagttttaaacattagagcgattccttatatcccaagttctctctactaagttaaattacttggcaggaaaaatgggaaggtgcccatttggaccaagcatccgaatcttccattaagatcttggcatgggactattaaatggattgcaatactctaggtatgtcccttctaacctgtctgttggtggagctcttaaacaatgtgaaagctcccctgacgcctacttatcttccttggagtttaataactttgcatgttaaatagaatcacacagaagcctgtagactgaaccctagtcattggatgacttagggccaagagagtccagagctttcccctctaacaacttggttgacagtgatatcataggtagaagtcctagatgggccaacatgcttcagccttctggcttagaccctgactgacagggaagtgaggatcagtcagttttctctgccggtacctagtatgacaagattctctctgcctagactgcctagccccttccctttctggcttccctcctgagttcttcagtaagtactctgaaagaataccagttatgggatcaggggcaaagagagaaggaaacctcttatcttgttaataagacatgattgcccccacactaattaatataacccttaaaggaagatctagttctgcgacagactctgccttaccgcctcacgtttcaagtatgttactgaaaagagaagtgtgtgtagcggactggccatgatgttgg

SEQ ID NO: 21668 - DNA, 1165 bp, Mus musculus
acatactgttgggagctgcctggatttaggaactgtgggtgagtagacctgtacgctaccactaacccagctctaatatctgaggcaggtgctggaaacctctgcatactaactagtagccttctttacaatagagtcagacagttttaattatcgcttcaaagcagtgcctgagattccaaatgatttctcttgcttcctgtaagcactgccaaaggtctaggaagaatgcttcctccaggagggagacagattttccagtggggagcagaggggcacagtgatgatggtgtgggtcttggggtagacctgcaggtaatgtaaaatgcatgcctcttttcctgtcagcctttggcggtggtgcagtgaaccagctgcattggtgatctcagtcatttgatgttctccatgagccccgtgctcctccccattctccactccacctaaagaagtgttgggatgggctttgcgccgaaaggcccccaacctcactctctttccccacctcctcttcaatgctgagaaaggagcagcagttccatctaatgactaaccctcgatgcacctctgtcccctcggcctgctacctgctttgctgtctgctttgccccaccttagccacttgtgtcttcttcctgtgggacaaggtgagggctgagggatatacccagtggcctgtgaatagttgaagcatgcccttcgcctgcccagatgccaattctggcctctcgtgggctctgctggcccatgtggaccaacttcccgctggttacttggttccctccctgtcacatccctggagttactgcccacgctcagtaacttggcaagtgatgtaccagcactttgctaactgctatggccctgctgcttcagggttatcatggtgccatcatgctatctgaggctcgaaacaaccatgaggagttttgtatcccaatatgtgttttgcctgccactattagcaacgatatccctggctcagacatcagtatcggttgtgatactgccctgaatgtgattgtcgaggtaagagaccttctgcttcaatttttactttgctttgcctgaacggggttgttctcctccatttagccctcctgacagctcaaattctcaacttgtagtctttaaccttcacctgtccgaccttaactagaaattg

SEQ ID NO: 21669 - DNA, 1215 bp, Mus musculus
ggccccttcaaaagatgtttagaagcactcgtttattgtggaagctgaccagagggctcatctctggagatgctagtggcccatgtccttatttaaacgtcctttgagactttctgacgtagattgatttcctgggctgaggtcacagctgatgtgggaagccagtttggctactgatgtggaagacatgggtgccaggagagtaaaacccaggatgtaggaacgtggtatcccaagtgcaagcttccagaaactaacccaagaggacagcaggcatcctgagtccaaaccctaaattctcatattgcctggcagttcttactagagttataatcttgctgttacagagatgagtggggatatccatggcagaacaggatagccccttactgaatcattgctttacagcatagaaagcaggcagagtgtgaaatctggggtggtctccggctatgcacatggtgtctcttgtgcatagaatgaggagttggctatctcttagtggttgcaattatcatttgcaggccagccgtatgggagtggaggctgtcattgccttgctggaagctacccccgagaccccagcctgtgtcgtgtcactaagaggaaaccaagcagtgcgcctgccactgatggagtgtgtgcaaatggtgagctcaggtgctgggtcaccacggacattggatggaccacctgtgggaacaagtgggtggttgctccactttgtgtggactgcttcagactcagtgagcactgggttaaagtggccttttggaggacagaatgatacccactggacaatggcagcagacttcctgtgtcctcggacagtgtgtgaaagcttccctgtggcttgcctgtaggtcatgagccttctccgctaagaactggaaaacccttaagaatctctgactgttgacacctatcgtcacagatggcccgtgcagtgcctgcacaccagaagcagcaagaccaagtgcaggaaaatggtcctgcctagaactggtgctgtaggcatgacaggcctaccatcctccagtgttacttcctgcccttttgtccccgaggacattctgatccgtgagggtattggggaacagattccaataaggttgagatagccccactcagtagacggaagtgtctactgagagatgaaagaaaaatggattctacttttccactcagtttttgagtagatgaggtgacagtggg

SEQ ID NO: 21670 - DNA, 1237 bp, Mus musculus
ggcacaggtgaactctcattctttgatatagtctggacccttcatgaggacaactacactgggactatgcttttaagtgaagtcaccaaaattacacacctttcagattgttcaaagatctgactcatgggagagccaggccatcatctgaaggcaggacaagtttgtgctacaggtcatggctgatgcccagtggagtgccagttcatctcttgtcaggacagttttgaccccaagaagctgggaggctgcagtgaccctgtacacacttgttctttccattcagtggatgctaccatccatctttcacgggtatcaggctagtgtgttcctttagggacttccactaaaggtaggaaactgagatgaaaatgaggaaaccccgtggaaagttctacaggtatcatggttcactgcctgtgccgatccacctgacttactgtcagtgagcgtgatttatgtcctttccagggtgggaccatcatcggtagtgcgcgctgcaaagcctttcgaagccgtgaagggcgcctgaaagctgcctgtaacttggcgcgcttgggcataaccaatctgtgcgtgatcggcggggacggaagtctcacgggagccaacctcttccgaaaggagtggagcggacttctggaagagctggctcggaatggtaggtttctctttctgtttccacccttgttagtgccttgctctgagtagtcggcctcaggtttctctgttggtgctttttaagagcttcggaagtaacacattgtgccttctttaagggggagggggggacgacagttattttatttatagctgacatggacatacatacttttgagccattttttaaaatttcgttttagtttctgagatgtggtctcactgtactgaccagcctggcatgtgaactcatagatctacctgtacctgcctcctgccagtttggccttcaaagtgtgtatcaccagttccagcttcatttttagtcatagccaaattgtggctgttgttttgcctcctatcatctggtaccacacagtttaaataagaacagaaatgacagtaagccctactgtgtgctaggaaatgccccctttcctagagaggcctgtaaaaccctcatgacagtaatcatgtacacccccatctaagagaagagtcccaggtcgtaggggaagccaggctgctgtaaccgtcatctttgggcatactggtccttggatgccagcatccatat

SEQ ID NO: 21671 - DNA, 1195 bp, Mus musculus
gttctgactgtcaggccaggaaagagccctgccggaagtgaggcgcgtgcctctgctctactgcacagacctctgggctccctcaaccgccaccctaacagctagagcaggtggggtaatgggcgccccacgagcctctgcgcccacgtggtgggctgacaggctccgcgcccacttgtgggatcatccctgcagctgcgctgccattcacttatgccacttatgggtttcctacccggctataatccctccatcccccgcttgagaaggcaccccaacccgactccacctctcagggaccacagcgatgcatccctaacagaacgcgtgtccatactatcctgtccacccctgcagagtgctggagtctttgacacaacaggccccgcccttgcgtgagtcccgcccatcgccacagcccattggcgctcgggcggggcgtgggcggctcctgcgggtgcaggcggggcagcggttccaaggctggcgcgcgtgggccagggcttcagtgcttgctgagtacgggagtgtctggcgtctctacctcctcatcatgagtgacttggattcttcgagctccagcgcctatccgaagtacctggagcacctctctggggatggcaaagctatcggtgtcctgaccagcggcggggatgcccaaggtgcgtgcctaccagctctctcgctggtctccaagggccgggcagggggcgagggcggctggagagggctgcagaggagggtaatcgggttgggaacagagggagagctggggagaaacgttgggtgacctggatctgggagaaaggatgaggaaagggcttggtgaaaattacctatgagagccgaggagaaccggtggctcaggagtagggaaaaccctaatctaggaacaactagggtgcctgaggagcgaccatagagttccattacgtggtgaggggcagaagataaaggatatttgtgtaggattcttcattcccaagatgaaccagttttccatccccaaatttattaattgagctagccaatggggtcgtctactgtctgggtcatatgagccaggcgttctttcctggaattaggtacagggcgacgataaggatgccacagcaccgccccaccctaatccctgggactcgtaggaaaaacagcggggtacccacagcgcctccatcccagtcctgcctcccaa

SEQ ID NO: 21672 - DNA, 1226 bp, Mus musculus
gcggcgtcgccagcagcggtggcatagaaaatggtgccaagacctgctggcttctcggagcgctgccttggagtgactgtgagaaggccgagtcccgggcgccagcggctcgggaacatggcggtgtgcatccggggagagttgaggactttaaggttggaaatctactgggtaaaggatcatttgctgatgtctacagagctgcgtccatacgcaccaactaatgagcaccacaccgttagcccaaacagagatttccaggactatccagatttgcaggacgcgttaagaaacgcttggactgatacaagagccagcaagaatgctgatacttctgccaatgttcatgctgtaaagcagctgagaaccatgaaatacatgagtgcacatcaccataaacctgaggtcatgccacaagagccgggcctacatcctcattctgaacaaagcaagtatggagtcatcactgggttaccagaaacctaccttaagaagcattacatctcctttgattgctcacagattaaaaccaatcaggcagaaaaccaaaaaggctgtggtgagcatccttgattgagaggaggggtgtgtggagcttctgagagagtgtgcatctgaaggatatgtggaagaagtgcttcagatatcgagtgatgggactatgatcactgtttattacccgaacgatggaagaggctttcctcgtgctgacagacctcccttgcctactgataacatcagtaggtacagctttgacaatttacccgaaaaatactggcggaaatatcagtatgcgtccagatccattcagcttgtaagatctaaaactccccaaaatcactcattttacaagatatgctaaatgtattttgatggaaaattctcctggtgctgatttcaaagtttggtttataatggagccaaaatacataaaacagaagatttaattcacataattgaggaaactgggatatcttacactttaaaaaatgaaaatgaagttaccagcctgaaagaggaagtgaaaatatatatggaccgtgctaatgagcgtcaccgtatttacttgccactggaatctggaatctctgaggaggaaaagggaagcagggctcctttattcttccctataattataggaagaaaacctggtaagactagttcacctaaatgtgacctccaccgagcctgaaactggctgagccagaccttgactttgctgccac

SEQ ID NO: 21673 - DNA, 1150 bp, Mus musculus
ccagtgtgatgagcaccgtggagtggaataaaaaagaggagcttgtagcagaacaagccatcaagcacttgaagcaatacagccctctacttgctgccttcactactcaaggtcagtcagagttgactctgcaactggagattcaggagtattgctatgacaacattcacttcatgaaagccttccagaaaacagtggtgcttttttataaagctgaggtcctgagtgaagagcccattctgaagtggtataaaagacgcacatgttgcaaagggcaaacgtgtcttccttgagcaaatggagaagtttgtagaatggctcaaaaatgctgcggaggaatctgagtctgaagctgaagaaggtgactgaattttgaaacaacatcctcagtaaagcaaacaggagttgtagataaaatgtcatgtctcatgtgtcctggttcttacatcttcctacctccctatagcaagcatgatataaggactttcatggcaatttttattttaactgtttttatggttactggaaatgttggctttggtttctgaaaccacgtgtgaggagcaagctgcaggagccgtagaattggatctgatgttgcattggttttcagttaccttctacctcctgtattttctaccgtaataatgtgatataaggccttccacaatgagcagttcactttattccctgggttttctatataaacagttttcaagatatgatttggttaaaaataatttgttacaaaaagattctgtttgcaaattaaactgtaaaagtattcaaactctcaaaaggcaatgatttgtgtgataacttagtgtgttcagagccctgttcatcagtgaaaatcctgtagatgattgaatctataacatgaatcctgacattagttataagtgagcattttcttatatttttaaccccagatgttgtttgattcctgggtatcgtccttagtaaagccatggatagcaaacttgagtttgagaactacatatggcagaggtaggaagaaggaagctgagtctttttccagaaacttctaggttcatttgcatctttccaggtagaacatgttgataactcctcacacaaacgttctaccccaggatacagctagactgttaaaagttcccacaaggac

SEQ ID NO: 21674 - DNA, 1207 bp, Mus musculus
cgaggatccccgagtcctgcagcatttggattacaggcacacaccaccataccccacctttgagacaggtgcttggcatctgagctcaggtcctcatgaatgtgaaataagtgctgtgctagtggtggcattggcctagctccttaagatgggtgttttaagtttgtattttaatgcttgaactgtttctcagttttcaccctgtgggcatttccggctactgttttcagtcactgagtacttatggtcagggattatcttcaagttaaaattcaaattcctggaaagaacccagatgtccttaaacagagcaatagatacagaaaatgtggtacatttttgaatggagtactactcagcaattaaaaacaatgaattcatgaacttcttaggcaaatggataaaatgagaaaatatcatcctgagtgaggtaactcagtcacagaagaacactctcacttataagtagatattaccccaaaagctcaaaatatccaagatacaattcatagaccacatgaagatcaagaagaaggaagactaaagtgtggatgtttcattccttcttagaagggggaacaaaatactcacaggaggaaatatggagacaaagtgtaaagcagagactgaaggaaaggccatctagagactgccccaccttgggatccatcccatagctagtcaccaaagccagatactattgtggatgccaagaagtgctagctgacaggagcctgttatagctgtatcctgagaggctccaccagagcctgacgaatacagaggccaaccactgggctgagcacgggtcaggtccccaatggaggagttagagaaaagactgaaggagctgaaggagtttgcaaccccataagaacataaatgtcaaccaaccagaattcccagagatcccaaggactaaaccaccaaccaaagagtacacatggagggactcatggctcctgctgcatatgtagcagaggatggcattgtcagacatcaatgggaggagatgcccttggtactgggaagactttatgccccagtgtagaggaatgccaggcagggaggtaggcgtgggggagcactgtcttagaagcagggaaagggaggagtggatgggggttcccaaaggggaaaccaggaaaggggataacatttgaagtgtaaataaataaaatatccaataaaaatttcaaattccaaa

SEQ ID NO: 21675 - DNA, 1447 bp, Mus musculus
accgcttggtgcagagatacttactgcaagggaaggtccggcttgaccatttctgagtttcctgtgagataaacccggtttgaaagaggttggtaccaaattttggttaaaaataaaaaatattctccggctctacctcgcctccccaaaaggtaccaagagccacatgtgtgggttttacccacgggaggaatcgggtccatgtccacccaagccaaggttaaaagcccactcatctacggatgagaaaatcatttgatcacctcagttaagcgttgccttatttaacttaattaataggggggagagagattggagacgtactattgaaagggcaagcccttcactgcctcccacccaaataaaaaggccaattggccttgtactacaagagccggtcactccttctccctgtttcccacctatcttccaaaaatgctaaggaattcaacttagtgttattttcacatcgttcagtcaaacttagccagagttccaaacgccctacttaaaattcaactagaaagttacctaccaagtactaattagcattataaagtcagagtctgcagctccaggcctttcagttgtttactagaaaggacagtcttaagccagatacagtttaccataagaaaagttaaagattcccagtgaagcaagttttttctttagccctagattccaggcagaactattgagcatagataattttcccccctcaggccagctttttctttttttttttattttgttaataacagggaggagatgtagtctcccctcccctagcctgaaacctgcttgctcggggtggagcttcctgctcattcgttctgccacgcccactgctggaacctgaggagccacacacgtgcacctttctactggaccagagattattcggcgggaatcgggtcccctcccccttccttcataactggtgtcgcaacaataaaatttgagccttgatcagagtaactgtcttggctacatttcttcttttgccccgtctagattcctctcttacagctcgagcggccttctcagtcgaaccgttcacgttgcgagctgctggcggccgcaacacttttctaaatttcctttggttgatattagaaagtgatagctattatcttttgggccaattaggtcattttattagaatggcttcataaaagtgatcatagaagttttcctaaataaaaaaatgtctactatatttaaatttcaattgtctttttaaatttttttaaacaagatactatagactcatcttgaaatttataatctaaaaatagtatttcatcaaaatactgttaactattctattctgggcattggtatgctatgtatttactatttatggctcatcaaatatggtaaacactatacaaaaagcctttaaatttattgataagaactgtcctgtgtgatgaaaattatg

SEQ ID NO: 21676 - DNA, 1145 bp, Mus musculus
cactgtgggagacaacgtcgtttcaggcagtgatgaccgcacagtaaaagtctgggatttaaaaaatatgagatctccaattgcgacaattcgtacagactctgccattaataggtaagggttgattgtaatttcttgtcttgtttgggcatacagcttttgggaagagagttcaacctcctggggaaatatattttattctcttcttatgtgatttcagtatctgtaactacttaaacttactcagtgtgtagtatggcagtgtagaaagacaagagtcggaaaagacctttggtagccagatgttttagggctttgttaactgagaggctctgtgtgctattggaccatgtgactgtattgtacgcgtgtgtggagtcacttgtgatctggcagttaagtgtgccatgagcttttgtccagtgtcataggcagacttcccatgtggtttactcacttagtttgtcttgaaatgaattattttctgtaaattcaaaatactacactgtcagttttatacaaacttgtttctttgtcttttttgtaggatcaatgtgtgtgttggccaaaaaatcatagccctcccccatgacaaccggcaagtgcgattgtttgatatgtcgggagtgaggctagcacggcttccccggagcagccgacaggtattgtgttcgttatgaacagcaaaggagaatttgtagtatcagtagtgcctcagagaaatacaaacagaccacattaaactatttagaagacataaaaatttaactttagcaagtgtttcatgagatgatgagctagtcatagattggtgggaagtcctggagatgggatacctacctctacctccgaccagagaaacatcttcctatggtggggtatcaccagaaatagaaactgttttccgtataagttagggaattattccttgctaccatcagacgtgagatacaggagtttggtggatgcttttgcctgttgtgttcatctcatcccctagtgcctgcattcacggctccagtttagcccagcaggatcagaatgtatccaaggaacacctagtcctggtgccttaaagcaggcccttggatgacttcttgatgctctgtgaagtgggggctggggcctcagcttatactatgtgg

SEQ ID NO: 21677 - DNA, 1204 bp, Mus musculus
aagtgactttcagttggcagtagcacagcagttcctggaaacaacggtgtgctggaagagttactaaaactaaagcttttggatccacttggagcaagataagccagattcctaacactcatggtggaggcaggaggacctcaagttgtaggccagcatggcctgcgatataaaatcttgtcacactgtctctcaaataacaagatgaagaggaaggaaggagaaaggaaaggaaaagcttttttcttttttgtttttgtttttgtttttttgagacagggtttctctgtgtagccctggctgtcctagaacatactctgtagaccaggctggcctcgaactcagaaatccgcctgcctctgcctcccgagtgctgggattaaaggcttgcgccaccatgactggcaaagcttttgttttgacttgggagcacccatttttttttctgagacctgtagtcttcctttgtaacagtcttatgggtggatgtcacagccaaggctggactcctgttttttgaggaaggggatacttggctttagctaagtatgtattatgtgaggttatcagtatttggatggtaggaacgacatggcgggatactttttacacattagaatttttgttgttgttgtttttggattctttgttttttcgagcccaaggtgcttctgatttgggggcaggttttctgtcaattttcttccaccactgaaagcattgtgtatgcaactgaatatgcttattctccatccggttgtgttgtcagaggcgtttgctcttcatgggtcacaggtctcaccatcagcacgatagtttatgaaagctcagactagtctaactaacatactacctcttcagataaaattgctaaaattaaaattgatggttggctgttgaaaattacttttagcttgtgagaaattactttctcactagattctggcttttaaaagtaaaagagcccaagaaatctagttagagagtttcttttcctgtttgaaattgttcttgtactttaaacatcttggatggtttgtaagtattagtttaaaacaaaagagggggtgacttttataatatttctgaaatttcatttggataactggcaactatttcttctcagaattttcttccccgccttagtgcctgtgcaaggataaagtccaaaggaactgccattacttcacacaattgagctgaa

SEQ ID NO: 21678 - DNA, 1173 bp, Mus musculus
gggtctcttagtaatcttgaccaagtcagtgtttatttgtttgtctattttttattgagacagggtctcttcacgtagtcctgactgtcctggaacttcctatgtagacaaggctgtctgataactcagagattctcctgcctctgcctcataactgttagaattaaaggtgtgctccatcatgccctgcttaagtcagtcagtggtctttctttctttctttctttcttcctttcttcctttctttcctttctttcctttctttcctttctttcctttctttcctttctttcctttctttcctttctttcctttcttcctttcttcctttcttcctttcttcctttcttcctttcttcctctctctctctctctctctctctctccccctctctctctaaagcataatgagcatatggaagtagcatgagatgatatgccacagtatcatgggcatcatgttatcctgtatctaaatagtgctcttccattctatcctgtgagtgggataggtaaggtaggaaagaaacgggcctcaatagttccttatactagcattctttatattagaaatgtcgagagacttggaaaatgttatttaccataacttgtgatggtggcaagttttatgtggtctctgactcctcctcctaagatgtcatagtgttgggcatctctgtgttttctgtaagctgaagctcttatagattatagagggatactttagttgattttaggagggacactagctttcagaaaggtaagatgacaatgatgggtttgaggtttgagcaagtccttttctgttttctataaagtttcaagcaagttaaatagaattgacttatacttgtaaaatgtcagtctcttcattgagctttctatttttgtctttactgtgttggggataatctgaaagcacattcctaattgatgtaacagattgtatctgcatatatttatgtaagagtaaatttatatacatgtcctgggctctgcaaaattattgttaaaagcaagctgtatgaattcattaaattctgattttgcttttttgcttgatttcatagactcatcattctttatatttttttgagttacttaacagttgaaactttctcatttatctgagagcagcttcacaactaaaaagtttaaagaaaattttgcatt

SEQ ID NO: 21679 - DNA, 1438 bp, Mus musculus
ttctgtttctgaggaagaatgtaaccttgaatccagatcccaacgagattaaaagctattgctatgtatcaaaggaagaagtcagagaaattttgaagaaggcagccagtggtgaaattaagttaactccgtggtttaagataattgcagatactttcctcttcaaatggtgggataacttaaaccatttgagtccatttgttgaccatgagaaaatacatagattgtgaatgtgtaaatgatttgaaaaattttctacctggtaagaatggtttggtttggttttaaattgggccctcttatatgatacataggtattttacaaccagaatttgttttgagaaaagaaaaactcaactagcttacagttttatatcatatatcccatatatatgcactgatgtctgtaaaagatatttaggtgaggttattgcaaaattatgccataagtaaaacttaatttagcctgtccaaatacctggctatgacaagattgaggaagtaactagaactcatattttacatttgatagacactttcagaactctttgctaattgtcaagtgttgtttatatctttagatttttatcatacatcagaaaattgagcagctgctttgaaacagcactaagaggttaaatgggcagggctcaggagacagctcagtgtaccatgattgccttgcaggcatgatgtcatgggttgttgagtccctaaccctaaagataattgtaacaacagcagcaacaggcagagcaggttcagagggaagtatatggcgctctctctctctctctctctctctctctctctctctctctcggtcttcagacaggatgattaatctcaggaaccctgtataaccaatactggatgctcaagtcgatagaaggtatcgtatttgcatattactgactacacttcacctcgtctctggcgtggccatgacactcaacccagcgtaaatgctcctgtaaatgatagttgtactatgctttatgataaggagacgtctgcatgtgcggcacagatcaaatattaatagacagttgcttgagcccttggatgtttggcccacagatttaaaaggccagttctgtatactaatttttgtcattctcacttgattttgtgctttaaccatcctgaaattattattttactacttaaaggtaactgttacttttggtagtaatggtaactgattagctattcagcaaaatctgtttatagtcctagtgaaaaagatggttagtcataatgtgtgagtgagttctactttaaaaagttgagaaaacctttgactctaccatggctggccctggatcctcttgttgtagggggtctggcttgagttagataatttagtagcattagcacccctttttaagacaacaacaacaaaagaaaatctagggaagagtgggggcgtgtttct

SEQ ID NO: 21680 - DNA, 1422 bp, Mus musculus
tttcagatgtcattttcatctggaagtctaggaagtgagtgttgaggcagcgttttcctatgaatctcaggctggctgagagtccagactggttgcttccatgttcagctgggattacaagagtgcactatggaactatgggttttaatactggcattgacatgagtcagatgtggcatgtgctctcatggtcctgagtttcagtgtgttactctgaaagcctggtccaaggtttcctcagatagtcatcaagttcctgcagatagtgtggtggtctgagagagagtggtgactgagacaacggggttgacatactggctttggtaaaatggttcccgggtagcacagaaatgtggttttcattaatgtgtcttctcctgcatagatggtgaagaaagccaagactatgatgaagaaagctcagaagaagatgaatcgcttggggaagaaaggggaagctgataggcatgtgtttgatatgaagcccaagcacttgctgtctgggaagaggaaagctggtaaaaaggacaggagataatgtcctcttcagttggaacagtttaagtagactcttggttattttgggtgtggtatggtgtgttatagaatttggaatcaccatctgttgaccaaaagaaacagtgggaatgacttttaaatgcttgctgctttgctggaaactggcaaaccctactaagtgtgcagtgctgtgctcactgcgcagtttgggtttttatgtccagtgcgttccgtacttgatgagcttctttcagcattttacagaaaagacttattggtgtacggaggctgcgtgggtggaggaaaactgttttgtagtgggacttttgtcacctaaagtacctatttttgttaagaaagtatacctgctgggaggtctaggcagaaggctatcctccttacatttagggtttatcagagcttaaactactcttaaattattttctaaacctgtagtacaatgtatcattgtaacttcaaccattttatccaaagtaaacacccagcaaaaacatagtttgatgacttacattttgtttgatttaattgcaatacacttgatgaccaaaaggggtggtggtggcagggaataggactttgcttttttgttcttagaataaaaaataaaggaagtaagtgcctggggtataggctcaaaaccaaaaaaaaaaaaaaaagaagaaagaaagaaagaaagaaagaaagaaagaaagaaagaaagaaagaaaatgtcttctttcataaacacttgctgaattaagattgatgtcctggaaagtacaaaaacatctacaagcgggatcccggtgtacctggaagtgcagccctgtcctcagattagaggataatcttcagacagtcagtgcttcctgttaggctgcagcttctggcctttatgagaat

SEQ ID NO: 21681 - DNA, 1186 bp, Mus musculus
ggcttgctttttcactgcatgtcagtgtttacatatttatcttctcatttatttatctgtgtgtatttatctgtttgtgcatgtgtgggtggtgcgtgtgtgtgtgtgtgtgtgtgtgtgtgtgtgtgcgctggggaattaacccaggatcttgtgcttgttaggctttgtcacttggctgcatccccaacctatatgtgtatttaaagtttcattttgtaaccagtttagtgtgctatttgagaggacgaatgggggtttgtacaaattcattttgtgtatctgctgggaacactagggaatgaaggaagagttccctacattttttatctttaaagacgaaatggaattggcaaaaatagtgcatatagtgttcatgctgtctctttggccttcatatgtccccttttccatgagattaactctatacaagtggggtccacttgtgactagaccatacagtattctcatattttcaggtacttaaggaaacatcattcctataaatatgttgctacacttccgtgcaagtttttctttgtgaattttgtgattctttttaaagaaattagaagagttggaaaaggaagaagagctaagaacagctgctggggagtatgacagtgactctgagagtgaagacgaggaaatgatggaaatccgacagctggcaaagcaaattagagaaaagaagaagttgaaaattctacagtccaaagaaaagaataaacagggacccaggatgccccgaactgccaagaaggtcagtcttgagcattgcagaggcaaggtccaagcttgcatgttggatcctgtataatcccccatgagtgacaggctgccactacctgggcatgacaggtagtggcacaccctgagattctcaggtacactggcttagcagggtctttgctttgggctttagattctgacagttgcgtcttttctccatgcattgcagttccaggtgcgtctttgttacagactgagtcattgctgccgtgatgtgttaaaactaaacttgaggtgcttgaggatgtttgttaattgttaaataggctctcattcagtccgggctagccttgagcctctagccaaggagctcctgactcctcctgccccatagataccaggattacagctctgtgctattatggctggtgctaacatttttatattacttaat

SEQ ID NO: 21682 - DNA, 1136 bp, Mus musculus
tgactgctcttctgaaggtcctgagttcaaatcccagcaactatatggtggctcacaaccatccacaatgagatctgataacctcttctggagtgtctgaagacagctacagtgtacttacatatagtaaataaataaatctttaaaaaaatgtttacctttaaaaaaaaataaagataggtctaatataggctaggatggccttgaactctttttttttttttttttttttttttggtttttcgagacagggtttctctgtataccctggctgtcctggaactcactttgtagaccaggctggcctcgaactcagaaatccacctggcttgctgttccacttattttttttatttaatttatttaattaacttaaagctgctattcaagaattaaaaacgagtcatagctattgagcaaatagtgtttgcaacttgcatttgcaaagtatactttgttctttgttctctgggaaactggaaaacaagaatgtacgttttgcttcttttttttttttttttttttctcttctagaaaatatttctagacttgcaggctgaaggattccctgtcatcgagaccagtaccctgactgaggaaggtgtcattcaagttaaaacagaggttggtactttcttaactgggtcagggccagtgtttttgttttagaaaggtcagttgtggtgggaaacttttcattttaggaattactgacactggaaataatttaggtgggttgttttgttttgttttgttttccttgaataggattagttgtttaaattgttagtgtcctatggggaacctagttaccttctgaaagaaaatatgtaggaagtcagcctgtggatgagtggaggactggattcttccttgtaatgtgaggctggggcctggagtcgattggctttgtttgtgactgttgtttttgtgctttcttaggcgtgtgacaggcttttggctcaccgagtagaaacgaaaatgaaaggaaataaagtgaatgaggttctgaacagattgcatttagctgtgcccaacaagagagatgataaggtaagatggccctttgcaggactcagttttgtgttgctatgattggtcagtgactgtttgccacggtcggttcctggtgctgc

SEQ ID NO: 21683 - DNA, 1099 bp, Mus musculus
ctttaagggggctcttcagggtttccttagacccctgcatgtattcttttgagacagacagggtctcactctagccagggtgaccttagctccctgcagaggtcactctagtcttaaactcatggcagtcctaggtttgcttccttggtccggattacaggtgtgagcccccatgccaagctcctggattgggtttttgtcttataaagaatatgtatttttttcttgttcctttgtctatttcattgtgggcagttttcaatgtcgtagtttactcgctagttttgttagaactgatttggaagtatgagagtgactctgggactagccaagacatttttgagtgagtgttctttactttggttaatgaagcctggttgttaggttgtagataccccagggattttggatcatcctttggaggatcggaacaccattgagatgcaggccatcacagccctggcccacctccgagctgcagttctgtatgtgatggatctgtctgagcagtgtggacatgggttaaaggagcagttagaactcttccagaatatcagacctctgtttatcaacaaggtaagtgtgctaactaatactttaatttacaagctagtaccttcttacttatagttaatgggttctaagaccacggaaaccatagatggtactgagtgttctatgttccttgaccacagatgttagtgatgtgacagttaatgtgatagcttacataacccaagtggctggctgcctggtagcacacacagtagtgagccagactggtttgtgtcctggttggaatgcagcactaagacaagactttactgcactgctcaggacaggacaccatttaaatttacatgttgtttatttatagaactttccactttatattttatagcgatagttgatttcagcttgggtaaatgaaattgcagaaagcaaatgcatggacaaggagaggggcctacattattctgtagtgtaaaagtaataacttctgttctttcttgctagcctcttattgttgtagcaaacaaatgtgatgtgaagagaatagctgaactttctgaagaagatcaggtaaatcactcataca

SEQ ID NO: 21684 - DNA, 3677 bp, Mus musculus
ccttaagtccacgcctggagtccccaaggatcagaggaggcagcctgggcgccgagcctctcctccagctgccgggaaacgcctgagcaaggaacagaacacgcctcccaagtctcctcagtgagagctgcgtgcctgcgagggctctggaagagctgtacccaccgtgagaagctctcccactcagtacggaatgagccgctggttaggagcttgcagtgtctgtggggcccgtgggatacctgcaagttacttccttctgtgagtcggatattccccctcttggaaaaaaaaatgtatttttcaggatttaattatataatataaaccttattttaggttggtgcttaactggaggtgatacagaagtctggtgttttcaggatagaaaatgtatttatcctaacaaatggatattttttattaagcctccacgtggctctgagtgcaaagctataatgagtttttctaaattaagggaactctgctacttcctttttttttttttttaatagttggtctacaagtgcgcattggtagggtgtccagcagatggatgggggctgatggcaggggcaggggcagccttggcctcacagagcaagggactggcatgtcaggacactgacagactggcataggagctgtgttttcatctaaacccttagcaacaggtaactctagctttaaaacaagatacagatgtacatacagttcttttttgatctagtgggcagaacctgcaaagagcaccctagaaagacctgaaacctttgagttttgatgtcctgcgagcaagtaaccagcctctcactccagttccaagtggctactatgtaaaataaattcaaagcacattgtgaatagaacctagatggaattagaaactgctgctgcccactgatgtcagaagttgtacacgatgtgtgtccctgtgagtgagtggctacctggctctcatcctccatgctctctctgtgtcccccacactctggagagtcgtgtcttagccagctctgtgtggatgtcttcttgtccctctgcatcagcacgtggatttagaagtacctagccgtgagagagtgctgtcggtggtcccctctggcttgcgaggacagagtccttgctcttttacctccaggacgagggttttcttgattgtttcagaagctgcacttctgaggagcgagagtgcagtcaagttagcaagttcataataaagttacagataaattattttgttttaaaacgcctaagatttttctttaagtattctaagcagcagacattaaactatttcctgctatatgtaaccatacagcttattccacaaaatgctatttaatgagactgaaggttgttttggtttcttttttctttttttttttctaaggaaaaaaattatttccatccaatatttaaagacttgaattttatttaaacttgaaaatgactttgccttaacttttgtataagacagcttagagctcacggagacctgcccctgggttggcgggagtggatcggttactcagttgccatgcggatctcctggtgttggttttgctgagaacgcatactgttgtacaagaactccagtggtttttgtaacatacctacagatcttcaacagttgatcttttttcagattgttgaaaagtcctgtaaatgcaaatagtcgctactgtgttaaatctgtgcacttgggagtgtgctctgcttgtacagtgtaaataatcagaacatatgagaaaggtaccctacagagaagaatctgataaaaattattgatatattataaatgttgctgttgagctgatgtagataaactaaatgttgtggtttgagtattattttaatttgttaaggtttttctttttccccttatactggtgtgttgaactgattttgcctctttgctgcaaaagggaaatggaaagtcttattgaaagcctttggatgttttcatactcttaaaaagaatgtaagtacatactaatcatatgtgatatgtgagggttttgaaggagagtatagagagcagagactggcaggatcttccaatgaaagtaaaaaacagaatgtgctaattaaaattatactctgttaagtgatttttcctgccagaggcaaagatggcctgatgcacgtgaccatttccttcagagcaactgtcattcagttacataggagtatacgcagtgctgatgtttcagacgcctgtgaaaggaacataggacgaatttccttatagatgtcagatcactgacaaaaaaaaaaaaaaaaaaaaagaaagaaagaaagaagaagaagaaaacagctggcctcttgaacccacactagcagatactgtctatctggaaaggcgagcctgaggcctcaggcccttcacatcacatctttgctggaagaggggccaaattatggtcagcaccccttacccccaagggtgctctcacagaggagctttgatttttaatgagaagtcctttccccaaggctgagcattgcagcacgaaacctgtgtggcagagccaagctgtaggtgcttgctgtctgctggctggaagtgtacagctcagtggccacacgcaagggcaggtgggcagatgcacgaggtgggacactgattactgcttagccagtgacagcctggcatcaggaactaaagccttgctcagatgtgatttttataagcactcgtttttcaggaagcaaaggtgatatgccaaatagctgtataatgtcaaaacagagacttcctgaacactttgaggttttccactcagaaaaaaaaggaagttatcaaaataggaagctgttgagggtgcatgcagactcttgctatgtcacatccagcaagtgtggtatgtggctttcataatctatttacgtttactcattcctttcagtatctcaaggtatagaatcagagataccacagtcacaaggacctttttaacctgtaaaattgtgtgatgatgcttacttaccatatggaaatacggactaggaatctggccccacctcaccagacaggaatttcaagtgattcctctctcatagtcagtgtcatgatgtctctgtgaacccctcctgtcattgcatcactggttgccactagtgggtggcaaaaaaaaaaagaaaaaaaaaagaaaagaaaaaaagacaaaaaaaaaaaaggaaaaaaaagtcttatattgctgtattagggtttctgcagttgatattgaaaaactggtccagtgtgtcacagcaggcgactgatggtgcatacctgtctctgtgtccccttcagtgagctgtagttgtgggtttgtgtgctttgtagcctgttatacggaaagcaacagacaatcgaagattccaggagtgctaactaacagctgcaagtcacagacggggagtgtaacaagtggaagcttgcctgagggcttctgtttctgttctacttttcattaagactggagtcaagcttacatgtaaactattggtgatttaagtttccttttgtgtcatttttgtgtaaaactgtctaatttgaaaaaaatgtagcttatgaaaaataaagatttaggcactgttcaatttttcttttgattcttttaaattaaaattttcttgaagaatgcatttttttaaagatttttttgtttccttcactgtacatgaagaag

SEQ ID NO: 21685 - DNA, 1164 bp, Mus musculus
ctggattccacccagcacctgtgaaaacaaaacaaaacaaaacaaaacaaaacacagctcagaccttttttttttttttttcctgagacagggttcctctgtatagccctggctgtcctggaactcactttgtagaccaggctggcctcgaactcagaaatctgcctgcctctgcctctcgagtgctgggactaaaggtgtgtgccaccaccgaccggccagctcataccttttaacacatatgtcactatcctctatttagagaatgagatagaacttcaaatggttggaagttaacacaaatgttgggctctgtggtttcctgaaaacttttcaacgcaaatgtatatcatgaaagttcagagcagcctacctatagttgacaccaaaaagttgggtgtctatctaacttttgcctgtgaggtgggctagggagcttagtgatcatcctagttatttggtggagagccaagctgtaacacttcaccccagtcaagtagcaagtccatgaggagaattcatgttttcaatatccttggctgtgattggtagaggcatatgctatgtgttttttgtagtgctcaacctctagaacagtggttcacaacctgtggattgtgacacctttgggagttgtatttaagatatcctgcatatcagatttgcacactacgattcataatgatagcaaaattatttgtgaagtagcaatgaaataattttatgattggggtcaccagaacgtgaggaactgtattaaagagtctcagcattaggaaggttgagaaccactgttctagaaccttatttaaaatcgaatccatagctagggatatagctcagttggtagagtacttgcctagcattaatgaagctacaggtcagattcccagcaccacataaatcacatatagtggtgggtgcctgcaatcctagcacttgggaaatggaggcaggaggatcagaagttcaataccagcctgagatacataagactgtgtctcaatatataaagctgtgtagaacacttgtaatcttaggggtggataaagagtgtctgctatgttctttaaattttctttgtgcttgaaaatttgcatgtttttcatagaagacagaggaaaatctaatctcttgcgattaactcttccttatgctttaaga

SEQ ID NO: 21686 - DNA, 1194 bp, Mus musculus
gcaagtgtatatctctagactctctcctgtgtgtctacttctgtgaacaacattacttgtattttaaaaagtatatgattataaagaaaagttcagttctgacatgaaaaaccctaaaggagtttggcattggtcatttcttagaatgcattttggtctctttgactgtggttggaagaatcctaaattttcatcttagaatgcattctaagggcagaatgtgtcaaagaggttagagtggactattgtgtgtgtgagttaatgcatttatttgcattgtctttaaaaaggcatacatttgaatcttctaaagccacactttgattcttactatcttttcctggactctggctttctggaacaaacggaaggagcagagactttcatgttagatttaagtgctttctctttggactaaataaagcacacacatttaggtgtaaataggacccttttcattttttgccttattcctgactctgtgctagacctactaaaggaactctaagacagatgttttaaataattgcatttttaaatagtttgcctattatgatacttgtaatcctggcttgtgtgtgagcactgaaacttggggtgtgttgtattcatgtgctgtgcctttggttgcctgaccatgatacatttggctaaactttacccatatgtcggccacttcgcaaatatttgtgctaccttttctatcttgggatgggtctggcttcctgagggtgcagaaaaattgttctttcagagcaactttagtttgaagttttggtgggggcagcatggaatgagatgcgttttctttttaagcatacagaagataattacagcggttggcagtattccttgtgctgaacaatagagactccagctggcctcctattgccttttcagagtccgggagggagggagcatgctggggtctagaaggtttccttagggagcttgttatccaaggagtgctgctctatactgtggctaatcctcagtgctgaggcactctgtagggccaacataacatggtgtcatgatgtgtctacctatgccctccaggctttattttgaagaaagcagtgtgaagaggacagggttggcttatccatgctcactcagcatgtattggtgcttcctaatatggaataccaagcgaagcaggctgtaagtggtcacccgaggaacctttcattc

SEQ ID NO: 21687 - DNA, 1106 bp, Mus musculus
cctgctttattcttaaagtatccacaggggtaggaggtattggttatttcattctggcagtttccttggtgtgatattgatgtctctcttgagtatataaaatcctgagtgaataaaagatgagtttgtgctccaatataaaattgccagttttgaatcaaatatttactgtgccaaccttgactgcatgattaagtttcatctatgcacacctatagtcaaatagtggatggagtttggagactcttggaaaaataagaggaaggattgcaggcactgaagcggataggaactccacaggaagaccaacagagtcaactaacctggacccttgcgtctctcagagtctgaaccaccaaccaaagaacatattctggctggacctaggcctacctgctcatatgtatcagatgcgcggcttgaccttcacgtgggtcccaaacaactggaatgggagctatcctaaaagctgttgcttgcacgtgggatatgttcttctagctggactgacttctctgacctcagtgggattgaaatgcctggcctcacagattcttgaagtgccagggaatgggggatactcagttggggggattacctgctaaaagaaaggggatgggtgaatgggggctgcggaggaaggattgtgggagggtgtggcaaggggaagggggagatcagtgagcaggatataaacggaacaagtaaaaaactaaaagaaaagtttcacctgagcacatgagtaggttttgctcagttgagtcatatcaaattgacaatactattttgaccatcaattaattattaattgaacatcaatttcatattatataatttagtatgtgataattatttcaaaaggccttttttgtggcaagtatagaagccaatgaagacaccatattctgtcgaagaactctatcatatttttaatgggggcatcagctctatagaatttcctcatgaagtgttaagggaaggctgtgaaaaaaatgacttcaatggattttttaaaatctgttttctggtgttgtccttctaggtgacagactgatgaggaacctctaagctctggttccttccttttcccgctctctgttgtctat

SEQ ID NO: 21688 - DNA, 1190 bp, Mus musculus
tgcttttcttgacctgaagaaactgcccacctccaaatccccccatcgctatacgaaagacgagctcttggatataaaagagcgtccatactccaagcagaggccatcatgcctctctgaaaaaaaaaaaaaaaaaaaaatgacagtgattgtgtctgggaccctgagaagtggcatgcctctctacccagccttgggacagagctcaccagtggaaagtctgaagaaagagacagaatcaggtctactttttctagtgcacaaaatagcaaacccacaagagtgagtgaaagaagaggacttagatgtcgttctcaatccagagacaaagctttggaggtggctgctggtgacagctgctcttagctccctacactctggcagttcattggagaaagacagtgatgggcttcgcctacttggtagacgaaggattggcagtgaaaagataatttctgcctgggcatttgaataggatcactgtctcagtgacaaggacctgcacaacttgagagatggagacagagagagggactacaaggacaagcatttcaggagggagtttggagatagtaaacgtgtctttggtgagcatagaagaaacgattcatacactgaggaagaaccagaatggttttcagcgggacctaccagtcagtccgaaacatagagctgataataagactctagaagaggatcacaaagggagaaaaagaacaaggtgacagagcaatggaggggtggaagaggacagggtggaagacattctggcccagggtccctctgctgatcaggaagttccaaagaatgccatcctacctgagcagtccccaggagaatttgactttaatgaattctttaaccctgataaggcaccatgtttggcttcgataatagaagatgttctgggggaagggtcagtctctgccagccacttcagtaggtggttctctaacccaagccgctcagggagcgtttccagcagccttggatctacatcccatgaaaaacttgagagactggcaggtttggagcaagccgtcctctctcctggccagaactcggggaattattttcctataccatcggtagaccgtgctgaaaatagagtggacattttagaaatgctacagaaaggcaaagtagatttaaaacctcttctttctagtctttctgcaaataaagaaaaa

SEQ ID NO: 21689 - DNA, 1200 bp, Mus musculus
aactagtatccagaatctttatatagaaagaactgtttcacaaaacattaatttatttctgccttctaaaagctagagaataacattcaatctgcatcctctcaaagtgcattgaagaattattttagctaataaaattagcatttactacttttccattgttatttctctgacatcaataagtggtttaatgtacatgtagaaagacattatatttcaaaacattgctttgagttggttagaatctgccaagagctcccatctttgagcccaaactgggtcagtgtgttacctgtgacagtatttccacagctgggatgtgtagtagtttgaatggggatgtcccacataggttccgacgtttgaacatttggtccccagttggtgatcctatttgggaagatttaagagagtccttgtttgaggaagtgtgtcactggaagcaagattttagagaaaaacaaaacaaaacaaaacaataaaagaaaaaaaaacaaacccttgtctatttctagtttgcgctttccactttgtgtttaaggttcaagatgtgaatgctgagcttcctgctcctgttgccatgcagttgcttgctgctctgctgccctgccatgattgactctatccttctgaaatcagaagccctagtgaacgtttccttctgtaacttgccttggctgtggtatgttatggtagcatcagaaacctgataattcagatggaattacccgctgctcaggccacagttactgtagtcagaggaggactttagcatttccagggagcctatcactcatgaacatatgcagttctaagagggagaaaagggctgttttctagtcacatagcttttctcttctatcattccaagacaccatttttttttctaaatttttaccagtaatgggtggtcccactcacaatctagagcctttgatggaccctgcacttacagcctgcccagcagcctgcttctttttaggcagatatccccagtggtcttctggaaagacaaaaattggtttgttcctgaaaagaagttatgctctttgtgtgattcatcttctatatttaactttatacaatgcagatgagtgtattaatatcatagtttgtgatcatatagttgaaatttcctatacatgtatctgcctggttaggttaataggctttaacattttaaaatgtggagccctgtag

SEQ ID NO: 21690 - DNA, 3159 bp, Mus musculus
agtggtcgtggtggacatcggggtcatccccatcaactcccggggagagaaacagcggatgcacttgcgagacgggttcttggcagaccagctggaccccatctacgtggcctataacatgtagtctcatcgctttgacttccacagacttttctacggacggacgtgaccatttttctttcttttttttccttctcagtgtccacagagacatgcagacactcgggccacactcaaaggaggagcctgatgcggtggggtttggggtagtacttctaggagcaatcaccctggcatggagatgaaatgtgaatttatgctggattttgctcagaaggactttggatcactgccttcagtttgctggataagatcattttaagaactttctttccttccttttttctttcttttttctttttttaattattggataagaagtgttctcttcgtaaatgtggtattttgttaagccgaaatagcaattaaaaaaaaatagtctacccttcaaatgggttcttttaaacaatttatgtagtgtgacaaggaattgttttttctgttttaatgtgtcatgggatcttactgacatggatctgttactaatttaagccatccctagatctcacccttctaggagagtttattgaggtacgagaaccttccaggtagcaccttccaattagattttagcagcttgctttgtcagagacacgctgaagaaacagaggccagttcatggcctttgaagttaacatagaaggagaagtgattataaataaggtatttcggcaactatcttgcagatatctttgtactaaactaaaaagataaaaataagttaacttcctcgatatgtaattatgtacaaaatgtttaatttattttgatctctttagaagtataaaagagaaaaaacattcaagaatattaaagtcttgtaatgtttgctaatataaaaaaagtgttgtattatcttgcgtggatagtatcacaacaaatatatatatatgaaatataaattcactaatgaacaaaggagattttaaagtttaactgcagaacttgtcacttgcatggtgcgccctccactgtatccacacacacttggctgtttccgagcaatcgcagatcgccaggaaccctgtcttagacccaagaccagcaagtggagtcaccgctgtctctgagagggtgaagggattcaatgctaacatgcactattttttcctttgctgtgaggacgacagtgaatgctttcctgccagcatgtgccagtgacattgaggggctccaggttggcaaacagcactgttttctcagctgcaagaatttgttgcatagtgtcaattttattttagcatttttgtgtcacattttataatttttgttgttgttgtcccttgatatgaagagaatgacaccctgtggtcatttgtaccacatttgtgtcactaatttaccactgccagtggccaatctgagcagataaatgaccagaacgcctttgagggaaaagctagctatatgtgatgtcttctcgactgtgtagacccagccaactctgatcctccaatcttgggaactccctagcttggccatgagagtaggcactagtccagggacttaaaacagcaaggagttctgccagcatcatccttgtactagccgttggggaactgatccctggtcccatgtgcctatattttcatgtgcacaggttagccactgtatccttgtctgtatccaaccaaggagaagatatcaacaatacaagacaatgtttattttgtaattgccacagtatggcttcagtggctcctagtatgagagaaacctaaaattgttattcggcaaaaatgaggttcctgattgctttatgggcgaggtctttgtctgccttagttacagctgccaacagtaagccctttgctaaaagagcgttttctatgacttccgagatccaaggctcatttgttttggtttgttattaatttaagtggtacatttcttttgaaaatttacatgtgtaaagcattattcatctccataaatcacttaatttttcaaatattgtttgctcattgctatatgtttctgcatgtttcaaatacacattcctacagtttgcagcttccccagggggggaaatccctgccacatacagaaagaattttcttgatacatgcatttgcacccccatacctcccccccccccagggaacttggtttaatgtttcagatagtagactgattggtaaacatgattacagtgtgcaggaaatcttccatctggctaatgtgaggaagcaaagcaaatttagatgtcactcagaacctactcttaacttttcaccatatcaacttcacacccaaggagggcgaaggctgcagcacaggggcaaagcccatcccagccggtctcttctgtaccctgccatctgtcacgtgacgctttaggtttcaaagagttggtggactcggttggaagcttagttgtgcaagaaaaagggaagaagacacttaagtaccaccagtttcagcaataaagaaggatcgttgtgtattagaaaccgtactgtagataaatcattcatgagaatgttttttaaaaagaaaaatgtttgtcttgtgaccatgtgcttttggagtcagccaaaaccgtgtaatcaacttgcacaaaaagagggtacacaatgaacattgagacacagacctaatcaaacaggagcagattcctcatggtgcttgtttattatatatatttaaccctgcttgacactttacccaaggggacggtccctttatcagttgaatgttagcagcgttatttcagagtgtggtgactggttagagaaaactcatgtactcaaccaatcacagtttcaaacaaaatttttatgtgcaaaggacagcaaccttcttgtatgttcaaccaccagtacgctttgtacatctgtgataacgcctgttttatattcaaatgaacaaataaaagcttttatttttgttgctctgaaaatagcagtttcttaattgataccctggggaaatgtctgggctggaccacttccctgtcaggaaggaggtgactcctgctgggaaatgtgtctgattctgtttacatgacttctgcataacttagtacagtgaccctgc

SEQ ID NO: 21691 - DNA, 1415 bp, Mus musculus
tatcctttagttattttttgaggttagagaaataatttgtaaatatttatttagacctttgatatttattaaagcaattactcaaaacagaagtgaaagagtcgggagaaaagcctttaagacagttttccccggttcatcagggtcactctaaagatgaaaggaaggagccgtctgtgaggcctcctccacgcagtgccggtgctactgcagacggcgtaactactgccacacacgcgcacggggcgagctcttttgtaaaaccaaccgtagcccaggagctccctcgggttatacaggaactgcaatagcttacaggcaccaccgccccctcctcgctgccgtgtaccatcactgctgctgcgctgcccgaacaaggacacttgacggtctttgattgttttcagacgttgatccacccctgtgagagcaagttattgtgggaatatttttggtgtaaaatcattccagagtatgtactatttacctgatagctgcatgaacgtgaggtccctgttactttggcttcttgtctctgtcgacacggctgcacatttccaagtaactacagtgtgaaaactgtgtgttttaaaaaaaaacaacaaaaaaaaaattaaaaaaagagattgtggcctggttttgtaaaagttttaggtaaaattacaattgattgttttaggactcattaaatttttctgcaatcctaaagctctatcaaggtgttgagtgtcccgctctgcacactgtaagtaccattgtggctgtccagttctatgatgccctctggcattttgtaagctgctctgactagcaatatatagatttcatttactgtgttaacattggttaataaatgtatttaaaaaacccaacaactcttgtcagtaagctgcttcagctcagtgtctgctgccagacacaacacagctacagaaaagcttggtcgagagcgggagttgctcatgatgatagtgaagccatgtcgggagctgggtaagagcactgactgctctggcagatggcccctcacaagcatctgtcactccagtcccagggaagccagtgtcttcttcagacctctgtggactccaggcacacacatggtgcacaccgctatgcaggcaacacaattcacacacataaaaatacaaaaaaaaaaaaaaaaaaaaaggaaaatgcaagtttatcaggtgcagttcttcacttcaacatttatactggattccatgggtcacttctcagaaagaagagggcgagatcatgtacttagggctgctcttgatggactctgagcagccagggccagcttgctctcattgggtggcagatgctgctgttttaccagtctccggccttcacgccaacgtcagcccgtcttcatgtagctctgcgtgctttcagcactgccgtctagt

SEQ ID NO: 21692 - DNA, 1334 bp, Mus musculus
caaactcaaagacaaaaaccacatgatcatctcgttagatgcagaaaaagcatttgacaagatccaacacccattcatgataaaagttctgtaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccatttcaacatagtacttgaagtattagccagagcaattcgacaacaaaaggagatcaaggggatacaaattggaaaagaggaagtcaaaatatcactttttgcagatgatatgatagtatatataagtgaccccaaaaattccaccagagaactcctaaacctgataaacagcttaggtgaagtagctggatataaaataaactcaaacaagtcaatggcctttctctatacaaagaataaacaggctgagaaagaaattagggatcgtccccgcggcggcgcggggtctccctccgctgggcgtcgggaccagggtccggtgcggagagccgttcgtcttgggaaacggggtgcggccggaaagggggccgccctctcgcccgtcacgttgaacgcacgttcgtgtggaacctggcgctaaaccattcgtagacgacctgcttctgggtcgggtttcgtacgtagcagagcagctccctcgctgcgatctattgaaagtcagccctcgacacaagggtttgaaaaaaaaaaaaaaaaaaaaaaaaaaaaaaaaaaaagaaattagggaaacaacacccttctcaatagtcacaaataatataaaatatctcggcatgactctaactaaggaagtgaaagatctgtatgataaaaacttcaagtctctgaagaaagaaattaaagaagatctcagaagatggaaggatctcccatgctcatggattggcaggatcaacattgtaaaaatggctatcttgccaaaagcaatctacagattcaatgcaatccccatcaaaattccaactcaattcttcaactaattagaaggagcaatttgcagattcatctgtaataacaaaaaacctaggatagcaaaaactcttctcaaggataaaagaacctctggtggaatcaccatgcctgacctaaagctttactacagagcaattgtgataaaaactgcatggtactggtatagagacagacaagtagaccaatggaatagaattgaagacccagaaatgaacccacacacctatggtcacttgatctttgacaagggagctaaaaccatccagtggaagaaagacagc

SEQ ID NO: 21693 - DNA, 1174 bp, Mus musculus
aaatgttatcccctttcctagtttctcctcccaaaatcccctatcccctcccacttccccctgctccccaacccacccactcccattcctggtcctgacattcccctatattggagcatagagccttcacaggaccaagggcctctcctcctattgatgaccgactaggccatcctctgctacatatacagctagagccacaagttccaccatgtgggtttttttagtttttgtttgtttgtttgtttgtttgtttgtttgtttgactggtggtatagttccaaggagctctgagggtactggttagttcatattgatgttcctcctatggggcttcagtccccttcagctccctgtgtatttctctggatccagtcacttaaaagccaagactaaaacatgaggagaccgttgtctgtggcaactgctatgaactttaaaccaactgtgctcaagatagtacagtgagtagtagtcagaatgtccggcagacatttagtagtctttatttttcagtttttctgcctgtctctctgtaggccttgctgctgcttcttgcgattctccttcacctctgtgcagaaactaagtgaatatattttttctcagcacttatggcaggaattctccccacagtgatgaagtgtgttcctgttaagagaacaaactaagttaatctcaatttttttctcagacttggatataaagaaatggtgctcatttgcaaacagtaaaaagtgttttatatttatttaaatgttaggttttatttaagctatctaattctttcactcacataaccatatttttttccttaaaccaacaaagaaacatgtgttgtccttttcatttcttttgaagttgtgtaagaggaaggttctaacaattgacctttcaacatctgattggatcagtgaatgaactgagcatttcaaacctctcctaatctgaatcgtggtgtatatttcctaatccccacgcaagtgctgcctaaaaacctttgaatatattatgctgccttctaattttaaacaaacttgatttaagcatgtatgcaaattgtttcatttgctagtgagaacaccttcccctgcagctcccagcaaggagcagtcttgggacaggatggatgaaattctgattttgaatattgatcagcttttctggtatcctg

SEQ ID NO: 21694 - DNA, 1194 bp, Mus musculus
ttggcattttaaatatttcatctggaaattttgtaaatagaagacatgttgacctagaattacaagttgtttcctttgtatggtttctatgaagtttgagttttattttcatgagaatacttttagcagaaaagttgatcatacatatgcctgggaggcaatgctctcaatggctttatttttggaatgatggctattaagaatctatttagaagaaacaaattgtaatgtttttggctcactggaatatggtgttcttattacatatctggatcattgtaatcttaaaaatccaagtggatgacaatgccagattcagccccaatctggtggatatcacagcccatatagtggtatataatggacatcacactgaaaaacagagtgagcttctataatagataatgatggctccaataataataccttacattttgattttcaccttagctagaactcatatgaattattaagtgatggaaacatgaacgagccttctaacactaatcaaacacttggctacctggtcagcatgggtgcttgtggccaagagtgcctggtaggtgcaccaggaggaatggataagatggaataggatgaggagtttctagccagacaaattactgggaaggttgaatgagcctcaaggatctgaaagccaatggaattgacttacaggcccagacgtagagaggctctggaaaggctgacagaacaaaagtgatgtgatatgcagcaagtgggatgtgggtcaagttggggagaagagtcaggcacggtacagagttggggcagacagaaagaaaggctgcctctgggtttagatcattggtcaagttcatctgacagtgagacctgaatgttaatccccaaatagaagttggccagcaaatcgtggccagtccaacccagcccaagacaggattttaaaggtcctggaaactgtcactcatccataagtaaagcagtcagccatgctacttacacaccagtagttttctgatttcagtgtgatttgagaggttcatacccaattcaagtaacatgctgctctttgcaaaatgcatgctacatggagaaatatcattgcattcttagtttaaaaacaagttgtatgcaatccatcacctatgaaaaccatttactttgagtttgaccacttgagggtaataaaaacaggaaaaaggtttagtc

SEQ ID NO: 21695 - DNA, 1993 bp, Mus musculus
gctggctccccaaatatgtcgttgatctaatcccatgacctatgtcatccccgtcatctttttcatcatcttcctcctattcttcctcctccttcctcttctctcttctccctttttccttttccttgcatgtttaggtaggtgtatagatactaagaaatataaaagaaaactcgaaagcatccttcttcatttattttaagtattccagagaagctgggctcaaagactaacgttctaaccggggccctgatgtgtgtgattgcatgcacctagcatgttccctcacagttggcctctgagatcctgacaggaactcattcacacttgaggcttgcatattcattagggctgcattccccgcccccgccccccacccccacccccccagtttagaattggacgtagccagaagtgctacccttgtctgtaatcacaggatttgggaagttgaggcaggaagatttgcttgagtaacaggccatcctgagttccatagcctctccaaaaacaaaaacaggaccagcaggaaggcttagtgagtaaatgcacaggctgccaaacctcacctggtttgtgctctgggacccacatggtagaagaaaaccaactccaaaggcgttttctccattttgctgcttgctctgctaccagtggctggtactagggcctagggatagtagtcttggtaactttctcctttgagctatttctctagcagttcccctccattcatagtaagcacacatgggactaactctttctaggtgattctctcatgtgtgtgctcctcacacacattgtgcttctttcatgtaccacttatttttcttctgcgctcacttaattcagtggagtcaggggaggtatgtttctcatctcttaccactgatgactttttaattaggccttcctagagagttgctttctctttatccccttccttatgacagtttttttattagcctctatggtcatttctcaactatatttttttttccttaagtttcttcttctacctacttcaagtcttacatcctgtattagttgctctcccagcctgttgtttcagaggttgatctcatctatcatactccaggaccctccatccttaatccttgttccttcataaggttgccccccccccagctcctgaaggagtacacacggcgtttcccagtaaagtgtcccaatccttgcttctaagtgtctcatctgctctccagtagaaagacgaattggtcccaccaaatcagcagattgcaggctcacccgatactgtccgtttttagactagttagctcaaaaatgtgataggctggtggtggaagtattcagggaaggtcctggttgcctcggtttaggacctgaagaacagagatggagcagcaggaaaggaacagatgagggacagtaaatagaagcattaaaggttatatagatgccagatctttccaaagtgaactataaagtcaaagatttccagcagttataccaactgatgtcatgacgaagataagcagatgattcatgtggaatgcaaagggtcaaaactggctagaggttgctgaagatgaagaaagattcagggaattcgtctgacagtacaccaaattttactgcagaaatagtgtcaggcgcagtacagaagtggcttacatcagtgccacccaaaaccaaagacctttgctaagcaagtgagtgatttaggtgagaagactttttttttttaagtaactaataagggattagctactagaatgtatagaaatgttctattttgaaaaatatagaagagagaaaggctttctcttgaggctggtaaacagatgctctgtggtgatgagaagtgtgagattcgggttcacatctatgacatttgcaagaacgtggcccacaatgtcagatctgtaagtagtcacatgctacatatcagtgctggagaacagttacacttcacagatgtgaacaaggccagaactccaggcatgtt

SEQ ID NO: 21696 - DNA, 1100 bp, Mus musculus
cacttctgaggtgtaactaagcggatgtagaactctgtggcagaggctcactgcttgctggacagacggactggaactgatatccctggtgtgccggtaggcacagtcatatccttcaaggtttcttgtctgttgtagtttcacagtcacttgctctaaggtggggatggaagagagaaagtgactcccaaaggcattatcatctgctgctctcagaatcaaacaggttgttagctgagccctgatgtcctgtgcagagctggaccaagggctgacttaaagccactcaactctttgcctgcacttgactccaactacttatattttagatatactacgttgtcttgttttttgatatttctggagaaattgctcagagcacaggctctgaaggcacggactcagactttaacttttctgtgtagctgctgtgtgacaggagccaagtgctgagacttccccacactgctcatctgaaaaacgagaacagtcgtgtcagtcggtctcattggggtgaggtttcaacaggattatgtatggagatggttctgatacatacacacagatatttaataagtggaggttctgtagagctctgtagtcttagccctgtaggtactcacaggaagaatgagagcgaagttaaggggggagggagagtaggggagtatgtatggggtgtgactgacctcctgggattagaaccccaacttacagtttacactgacagagaaagagaagccacctctcatgtgttatccatagcatcaggactcatcttgtgtgagacagactccttccttgcctcatatgttgttccaagccacttacaccaaacacgctccctggtgtatttggaggtgaaaagaagaaaatgatagttgggtaatgacaatcctatatgtttgtaatctttccaagcttattttcaagtagcacacactttttgtaccactggtccttagagtgaaaagaactgtctacttttctttaaggcatctttaacttgtcctaaattgtaaatgggactcactggcctgagtctcttagtttcgggacatagttccatggcaggcatgttctttaggctttggaacatt

SEQ ID NO: 21697 - DNA, 1175 bp, Mus musculus
ttatattttaaaatcctgtatctcccaaatgccgctcatgtgtcatcttttgagcaaagagaaaccttcattgctgcattagttggttgttgcccctagaggcttcaccttatttctgaattggtcttcctttaattattgtgatacatttattgataactcccagaattaaagtcaaatttcttcttcagaatccttctctctagtgttggcaacttttgtagagttatcttgctgcatgtgagttggggaagcccaggctgcgggaggtcctgtcccctttcttctcagcgggccatggagagtatagctctgcggtcctagtactcttctggtgaagccgtggtcccgttgacttcagaaaaatagcctagaattctcagatccctaaatacaatggcttagcactcagagtgagcccctaatgaaagtgcagtttttcctgaccatggccaggggtggaaagcagttcggtgccactgtgacgcaaggatagaggccacaggctgcttctgcctggttgtaccccctctcttctgtgttcacaggcctttgcagaggagctccatgagagagttcgccgagaactgtgggcctactctaggagtgagcagttgggcgtcccagacttgcgcagactccggtatgagggcatccggccagctcctggttaccccagccagcctgaccatactgagaagcttaccatgtggagactggccagcatcgagcaggccacaggtatgtggggaccgctcactgagcgcatgcactcaccaaagacatatgcagctaaagtccttataaagtgggagaacttaggatgaagtcatctctcatccccttctttctcaggtagatgggatctggctttttacttcaaaattgcaacaccgtattttttcttaactatttcagacttagcagtttaaactatttactcctgccccatcctggttgtggatttactgtgttcccttttctccccctgcctttcctgtcctagttttctgttcttggtacagtagtctctgtcttgtcagcggtgtgctctccctgcctgggcctgcgctgcttgctctagactggcaagccgccagcctcccatagccccttcctgactccctgcacttgtcactagcatccgtgctcctctgcggtcatcattcccctgt

SEQ ID NO: 21698 - DNA, 1193 bp, Mus musculus
actcacaaacctctcctctccttacttgcccaaggttttctgccattcagaacaatgtcccttctaggcttcaggaactccataattgaagtcatggtgctctgccttccatctttgtgtgggacattaggagagttgctaggatataaacgagagaatgaatagcagccccaggtgctgctgatgccttcttcccactctccttgcagttgcctacagctgacagttctttgggtctgccttggtctgatcctcagggtcattatggtggggcagctaactccaagaccgacttgtgtcctgaaagagctggtcgagtctgcagggtcagacttagaaccacaatgtggagctagtaaacacatgtcactctttactgtctcctcttctagtggcagtgtgaagccacagtgggtgggaaagggtagggattttcttttaaaagggttctgttttgtttatttggttatttgtctcgtttgcaaaagcttctacatcagcttccgtggccatgttttcattgtagagatagaaaagctaagtgattctgactattttcttcaacaggagagaaaatacgtacccctaagtcaagccagaaaacacggtttccacattgattggctctctgaacctcatccaggtctgtggctgctgctggactcacagctaagtgtgataactgacagtgtctaggacgtgttgcagtgcttggctacaaaggagcctgcagtgagaacttctcagttgtgtgtcatatgagccactccaccaatggaaaagaaagtagataggaagacctactgagtgccaccactgttgtgagatggattcatcatagtatactgagtccttgatgactctgtaccaagcatggctattgtgtccattttaactgaagagaagggaatttcagatagtaactggaatgactgtcaggtttctagtatcaggtttatcttctgtagcctgtgctgtgcttgagtgggacttctcaactgacctgagttgcatgcaggccaaagacttggcttggaatgtctgaaatataaaatggccttgcacttacaggtcttgagagactctgcagcaaagctgggtcccttttcactttcttgttctgtctctggatgcttcccttttaatttctgttatgtggtttcttcctgttttatttctagctacttttctta

SEQ ID NO: 21699 - DNA, 1089 bp, Mus musculus
tcgacagggacaccgcctttgccatcggtgagccacctttcacttagcaaagctcccagagcatgatatcggggagttgggggggggggaggttctgtattttcttgcccccccccccgttcgcttcccgagcagtaccttgttttcttggtaagggggtgggaaacagcaatactgctagatgtgtgaatgtatttataaataatggtatctgaaatttcacaaactaactaatatgtaaaaaggaagaaaagtaaagaaaccgagacaatgactgtggtgtgagaggagactttcagaactagatgtagttttaatgactaaaaagaagggctcgggtggagttcttgtcatgaagtactttcttttctcctagtgagtgggggtcagatttatcctatatgttaacaactaaagccagtgtttgagagtgtctaacacatggtaacagagttcatgagcttgggggtgaggagaacaggagagtatctgttgggtttgcctacaaagaagttacacgtgactctcctcctaggatgcactggcctggaggagcttcttgggattgaccctgcctttgaacagtttgaagcgccattgttcagccagctggcaaaaggcttggagcgcagcgtccagaccaaagcagtgaacaagcagctggatgaaaacatttcatcgttcctccttcacttgtctccttatttcctcctcaagccagcgcagaagtgtctggaatggctgattcacaggtagctaaaccttcattagttgccaacacttggtaagctagattgctttcacaaatttcaaaggttaacatgatgtttagaatgtcaagtgaacatgctcttcttgaatagggtgccattagttcctgtctagtgtgtttagggtttagggggtttgtttgtttgtttgtttgttttttgagacatggtctcagtgtgtatctctggttgacctcaaactcacagaaatctgccaccttcttccccaagtctgagaagtatgtcattgtctttggctagttttgttttggggataaggtcttattatagagctctcgtttgttgttattgttgtttg

SEQ ID NO: 21700 - DNA, 1200 bp, Mus musculus
tagagatgtgctaaggaagatctgaggatggaattcctaatgcacttctgcttgctgtgacccaggcagccctggctgaagcatatttgcctcttctcgccgggacactgtatggatcagcagttggtcagacagtttgtgcatatgcttagcagtaagagaggcggatggcagtggcactgaggagaccgagaggctctcgagttcacgccccgtctaggctgtctagtgagttcagggtcagtcttaacagtaaaaagaagtctgaagctggagctctgtggctggattactgtgtagcatgaccaagaccctagctgactgctctacactgggggtgggggaagaacagttgcttgaatgtggttgtgtgacttgggactcagacccaagcaggggagatgggaaagaagactggcccttcttgtagctctgattacaggttgttttggcttccatttcttcaggtccaccgctttctcaaactggttccagtccttctggccattgtgcaacataagaaaagggaggcagaggatgaacaggcaattaacagacagacagcgctgtacaccctgaaactcctgtgcaagaacttcggggcacagaaccgagagcctttcataccagttctcagcactgcagtaaagctgatagaaccagagaaaaaggaggagaagaatgtcctgggaagcgccctgctgtgcatagcagaggtgacgtccactctggaagcgctggccatcccccagctgcccaggtacctaggaacaggagccactacaacggaaatggggaaggaatgcgttcagggcttcggcttcttgaatagaaagtaaaggaaaatagagtagtgaaagaattgatcttttctttgctctggaaagtgcaccatttcctgtgaccttcagacattgcttggcgatgttcttcctttccagagtcgcagtgcttagggagcagcggaagcatggccagagcagccgtttgctgtggcagaggcaagctgggcgctcctgactctgcatttggctctgaccatagcctgctagcattgtaacaagttactaatcttaaaaccctgccatctgtaatacagggccatatcctctacacacacagacacacacacacacacacacacaccgtgtttctctttataggccttgttgtgctctgcacatgttcagccattgaaga

SEQ ID NO: 21701 - DNA, 1190 bp, Mus musculus
tgttatgaagactatatggtaggactttggttatactaacacttatttggtaactatccgtaaagtaatataatttacatagaaaagtttgatgtagagaaaaatcacgcatggctgtttttctatattgtttttacacaggacaagtttttactttgagtaatccttaaatgaagagtgggtaaagtgtgtatacggaagagagactccaatcaacaatatcaataagttgaaaaagaaaaatgttgtccttaaataacctacaaaatatcatctataacccggtaacagatttttaccttttttttttttttttttttttttttttttgcctgtggtaggattgacaggaaatacactcaagttgtaattatcactggggccaggcatgaacacacagttcagttagcacacacacacacacacacacacacacacacacatgtatgcataaaccttgacgctacaacacacacatgaagggaaggtctggggacaactcttgggaaattatattctaccatttgggtctggaagttgaactcaggtgatcagatttggcaggaggcacctttacctgctgagctatggtactggcttccttccttcccctgtctgtctgtctgtctgcccatctgttgtatagacgctagcacctatgacttcatgatttgggtggatgatagcactaggccgcactgtccgtccacccaccactcactgtccattcacttgtcagttttttctgattgtttgtttggttggttggttttctctgtgtagctctggctgtcctggaactcactttgtagaccaggctggcctcgaactcagaaatccgcctgcctctgcctcccgagtgctgggattaaaggtatgtgccctccccctgcctggctgcttgcttgttttaagatgtggcattgccatgttgtccagtctgacctcaaacttgaaatccacttgcctgaaaccccagtactgggattatagactggtgtgctcctccacacctggctttttgtggtgtttttgaaatgagaactgtacacaagaagttaatgtctcagacttctgctctgttttcccaacactgcttggaagtgtagcagaggaaatgtggagagccagaggcaagagagctgagcaaaccatgttgtccagtttaggctgctggtgggagtctgact

SEQ ID NO: 21702 - DNA, 1158 bp, Mus musculus
caggatgatgccctccaggtccatcctttttgcctaggaatttcataaattcattctttttaatagctgagtagtactccattgtgtaaatgtaccacattttctgtatccattcctctgttgaggggcatctgggttctttccagcttctggctattataaataaggctgctatgaacatagtggagcatgtgtccttcttaccggtggggacatcttctggatatatgcccaggagaggtattgcgggatcctccggtagtactatgtccaattttctgaggaactgccagactgatttccagagtggttgtacaagcttgcaatcccaccaacaatggattgcctctttctccacatcctcgccagcatctgctgtcacctgaatttttcatcttagccattctgaaagatgctgatgctgatacaccccaggactacataagaagtagtgctttcgagattacaagtcaaatactgtggctctgatgaagaaaaggggccttttagtaacgtggaacagaaaggtgttcaacaagctccaggttgcttaggttctgagaagtgttgtgcttgtgtgtgttgtgcttgtgtgtgttgtgcttgtgtgtgtgtgtgtgatctgtgagaagtgtgcttgtgtgtgttgtgcttgtgtgtgtgtgatctgtgagggcgtaaatactgcttcctgaataggccagcactgtgttgtaaagctcccttcgtggattttaaaaacagattgtctttgtttttatttagggtatgtgtgtgtccaccgaggcagtggagggtgtcagatttcctggagctgaggttacaggtggttctgagccactggatgaagagctgggcatccccagctgctggctgtctctctagctccctcatacgggtttcagtgtcctccctaagtaatttttcatagtagctattgtgtaaagttaactgtaaatttgtgactgttttcttcagactcagggtttaggaactgccttgaagatcctcttctctgaaaaggaaatccaaaaccttccggagaacagcccatccaaaggcttccagctcactcggcaggaaatcgttgctcttttaaatgcttttggaaggtaagcggagacctgattccctccaggtttcaacatacggcaaagg

SEQ ID NO: 21703 - DNA, 1219 bp, Mus musculus
aaccttcatctgcctccatgtttggatgcagatagcttactagtgtcttcttttcccctaagccttatctggttcacccctcaaattctgattttctataacctgagtggagcatatgttctgaactttagcctcctcagaactggagttcagagactcactttcttcagctcatatgagcctcaaaattcttccctctcaactcttgtttacataactgttacccatgactctgacacccactagtcactcgccgatcatggtcttccttcaagaccctaactgaagcataagagtgcatgcattcagataaacagggtcttctcaggcctgctgtgcgagtctctaacagatacctaactctttggacaaataaatggaggggactctttttttctttttttttttttgtggtttttcgagacagggtttctctgtgtagctctggctgtcctggaactcacttggtagaccaggctggcctcaaactcagaaatctgcctgcctctgtctgcctcccaagtgctgggattaaaggcgtgcaccaccatgcccgccagctcgtcttacaagatgacctctgactccatggtggtgtgctggacctctatgaatgttcccatttagcaagaactcagaactacccaaggtagctgaaaagaaaatctaagatgatctttacgttctaacagttaagttcaagaggttaaaagtacctttaatctaagattgtagttgtaggtagaatgcttgcccatgtgtccagttccccgcactgcataaagtgggcttggcagtttatacctgtggtcccagcacttggaagttgggagacaaagagaagaatcagaagttcaaggccatccttggctatatagggactttgaggatagtctgagacactaacgaccctgtaagtaaagaaagggaggggaggagggacccacaacagaaaacagttctgcattgctaggaggagttttttcaaagctcacgtggaatcatgaaaatctatagtatctaggaaaactaaaatggggcaggggaaggagagcgtgtagtcagtttgaacacaataataaattccaaatcaccaataacgtgttggtgacacattaaggaaagaaagcgtttccccttggtgtcatttaaccaagagtaagctcagattttattttctatttcatgttccctgtgtcttctgtcttcatcctctgtg

SEQ ID NO: 21704 - DNA, 1148 bp, Mus musculus
ttgggggggtgggtaggaatggtcacagaagcctttttcgctctttcttgactgtgagtctgcagccattgatatgactacaaaagtagcttctatatttttatagaataaaaacattcaaaatgtaacagtgggagtctagacagcagtaggatcactgttctccttcagtgaactgtcctttggacgttgcagttctctgaggctttcagatatgcataagggtcacttttaccccatctcaagttttccttggatattctgctttggaggaatcccacataacctaaaagtcctctttctgctatcttattcagttttactttacttgcaccataccagatactttccaagccatattcacagtgcaatacctgttactcagattctcttatgtctttcccacttctgtgctgtagccaaggcaggatctgagaggttctaatgagaaacacaatgtttctccctgcaactctcatactattatcatgcatatactcacacaattggtgtctttaccaggcacagataaattgagagctgatgacatgctgctggataagtctggacatttgaagttagcagattttggtacttgtatgaagatgaataaggaaggtatggtacgatgcgatacagcagttggaacacctgattatatctcacccgaagtattaaaatcccaaggtggtgatggctactatggacgagagtgtgactggtggtcagttggggtatttttatatgaaatgcttgtaggtgatacacctttttatgcagattctttggttgggacttacagtaaaattatgaaccataaaaattcacttactttccctgatgataatgacatatcaaaagaggcaaaaaatctcatttgtgccttccttacagacagagaagtgagattgtgcagaaatggtgtagaggaaatcaaatgtcatctcttcttcaaaaatcatcagtgggcttgggaaacgcttcgagacactgtagcaccagttgtgcctgatttaagtagtgacattgatactagtaattttgatgacttagaagaagataaaggagatgaaacatttcctattctaaaagcttttgttggcaatcagctaccttttgtaggatttacatattatagcaatcgtaga

SEQ ID NO: 21705 - DNA, 1141 bp, Mus musculus
ttataaacttaatgttttgttgatagtagtgaattttgtcggttgattactctttttaagctggcttgaagttttcttttttctttgctttttattttttaaagagttgcaagtattgccatgtgatgggaacgggccactctaagataaaaagcccaccaagtgaaagccagtgaccttgccctgtacaccagcgggttctgtagtgcccatttagaatgtaaggaaaggtggaaattttgcactttgtctatttttattttaaatgtggagattgtttggaaatgtcacttatcaccactgcagttagatgctattatttaaactattcgcttaaggggggaaaatcttcatttccacttgctgaacttttcttaactatgatttgttccaagcttaggacacacactagtacagtgtgttctacgaagttgaaagaaatggttgttagaatgaattccttcagtaagggaagtattctgaagttggtactcactggattaatttttaaatacgttagggtgtgttggtgtgtgcatagtgacatcaccatgacatctgaggactgtggagactgtgggactgtttggtgaccctggtgatgaatctgtaggaggctgtctgcccgttctgtcaccggtgcttgggggaattcaagcactgcttacattgtgagattgcttgtgacaaaacacttgctgtttgtctgtgtctcatcacctgctgtaaaaatctagcactcgacagcaagcctgactgaaacgattgtacctggtgccataacaatgtgaagaggaagtattttcattggtggcctgtatattcctttagtggcatccatgttagactaaaatggcccatgctcagtacccctcttgttttggattatgtggaggatcagccaaacaagataatcaattttgaaacttgccaactcagatgttggcccctgtattttgtgtatgaaatgctgtgctgtgtctctcgacctgcctaggtgccaccatgtgtaaggagggacaactgtgctggtcttcctcagcactgcttctcagcagtttgcagcctgaagttcctgcaggagcccctagtagtcaccaaaaggctcagaccagatacacgctgtgtacaccaagaaact

SEQ ID NO: 21706 - DNA, 1138 bp, Mus musculus
ccaaggtagctgaaaagaaaatctaagatctttacattctaacagttaagttcaagaggttaaaagtaccttgaatctaagattgtagttgtaggtagaatgcttgcccatgtgtccagttccccgcactgcataaaatgggcttggcagtttatacctgtggtcccagcacttggaagtggggagacagagaagaatcagaagttcaagaccacccttggctatatagggactttgaggatagtctgagacactaacgaccctgtaagtaaagaaagggaggggaggagggacccacaacagaaaacagttctgcattgctaggaggagtttttccaaagctcacgtggaatcatgaaaatctatagtatctaggaaaattaaaagggtgcaggggaaggagagcgcgtagtcagtttgaacacattaataataaattccaaatcaccaataacgtgttggtgacacattaaggaaagaaagcatttccccttggtgtcatttaaccaagagtaagctcagattttattttctatttcatgttccctgtgtcttctgtcttcatcctctgtgtgctacacgagtctaaatctgtgcctgcctgaagactgtcttgtaaatctatccccactgtgtgttcatctgtcacaaagggctttgttctctattgagcagcccagaaagcataacatggagaaggaatgagggataacagaaatctttaacagcgttttacaagggattattaaatcggactccaattaaccacaaccggcccagaaaacagtatctcaaacactattgtttatcgagcaatatttaaatgttgtgttcaacattcatggtggatattcgctgtaggagattgctttcaacttctgtgtttgctgttttcagcaaatgacacccattcgttactgttggtcagagacacggagagcacaggacttaagattacagctaggcacagggaaacccaagggtaagtaagggtgactgttaacaccggtttcttaaaagctgagcacacagtaggatagcatcttaagtcaaaagtgacttcagggtctactaaccttgcctgtaagatccatcaaaagttccactccagtctcttggagaggaccaagggctaata

SEQ ID NO: 21707 - DNA, 1149 bp, Mus musculus
atacgtggtctaatagtttaaagctttggggaaagtttccacaaatcttacctctgaaggtccctcttgtgagtgccacgtggtgggctcctttcaccgccactcaagcattccaagttcaggagaagcagagtaccatggtctgtacgtaacaggctcaacagcagcagcagcagcagcagcagcagcagcaatttctcgtaaactctgtcctaagcctggtccttcttcatctgaaagcactactacaagcactccagtaacaagtggatactgttaagatgtagttgctgacactattaaacctcctctgctgtgtgtgtagccattttgtagagttttcttcagcccggtgtaactgaatactcactacctcagtacctcagtaggatgcaaggactgtgccttctttgactcagccagtgcttgctatagtcaggctacaagccaagaggtccccacagagtattaacaataaatacttctggccttcaagctctaaaggattgcagactcctgacagcttttctgtaagacatgcctgtcatttgtatgaggctgacacggggctcactgcctgttatttttagatagtgttctattaaaagctatgtgtatgagaaagtaggctctgcctacgtggcggcagcatccccatatcagccagagagtgttccagacagtggtcctcttgtgccatctccgtgctgtcctgggaaaacgctggaacaacgtggccctcctggaggccggatgctctggcttcttctggtcctataggtcacagagccacgcccactttctcccattttgttatatttaagattgggagcccagtttccagtgggttgtaatggggtcttcgttgtacagaggacgacgtggaggaacttgcgcagccccgccccacaccctgcctttgggtttgagtaaacatctgggttgcaagccatttaaaattgcttctttgccagggtgaattctggcaaagcctacacaaatcgcctgtacgatagcactgtataaaagtttatctgtcaccatacctgcaatgatttggctgttgcagccagtgcccacagctcctgtgtccttgtctctagcagggcggtacctgtcagcagccaagggcaaggcttgctggaaagc

SEQ ID NO: 21708 - DNA, 1135 bp, Mus musculus
gaacaattatcactagagtgaatatattataagaaccaaaaattgaaatttgtcattcttaaccaattatttcctaagatactgacaagtgtcatctcgttcattgtttgctacagttctgtgaggtcagtataattaagctctcatggttccagatctgtgggagtcccttttctgggtaagcagcgtggctggccccggggcctacatacctcgatgccagagcacatgggaactgcctcctttgaaaattcacttgcagactggactgtgtcctttttggggtgggcacttacacatggtagcattcacaatggtgtgtgtatgctcaagacagtaaacaagctgtgcctggtgccttcagccagatccagagtctggatcagagctaggaaagggaggacgggaagcatcttgcggccctcagcccctcctctccctgtgcacctggatctacccaaggctcagaaagtcgtgcttgccttttgctctgtgtaacagtgaaagtccttcgaaatgggggaagtgctctgaaaggaccttggtttggaaataaagagctgagatagaacacattgctgtctcagagaggagggaggagagaccccctgatcagataacaagacaaggtagccagtaggggaaggcatagatgtcaagtcagactctggaagcaagccaacataaagatttctcagggtcaagagctctcctcctagagtctgagctccacctcttcctaaagcttctctcttatctaatctagctgccccacactttcaccctgtaaccccactggagtgctggagcgtccctaaccactacttgccagaagttactgagagggcagtactcgccctgtaccgagagcaagaaaagacccttttctatgatagaggaaactgaaaggtgtttttcagttccaatgatatctcagggatcgctcttgaggacttttataggtgtttactcaaccctgacaacagcccaaatagaaaattgctaatgtcttcctgttgcacagacaaggaacttgagacatagacattatctatccaaaacgcacgataatatcccaccttaggggtcacttttttttaattttatttttttttatttttttttatttctttgg

SEQ ID NO: 21709 - DNA, 1225 bp, Mus musculus
gggaggcagaagcaggcagatctctgtgagtttgagaccagcctggactacaaatttagttttaggacagttaggactggtacacagagaaattctgtctcaaaaaacaaaaatcaaaccaaccaaccaaccaaaaaccccaaaccaaaaaaattaagtaggttttacttcatgcaataaaaagaacatagtggtgaaatgactctctggtccctcatgagacagggcatataaactgtgaatagtacaagctggaggcattgagagtgtttggtgtcctgggacccaccctagagggtaagctcttcatggtgttgtgtctatttagattcagtctcactaaatagtccctgcctgtatgagttcttggataaccacccatggcattgctgccctcctggacagcagcccttgccaagggtagacacatgccacacctttcagatggacataggttactgatctcctcctgcctgcttggtaagtgggggctgcttgtgggctgtggcctattctcaagatgccttccttgcctctaggagcagcaacgctgggcaccagggtgtgtgggtgtttgagattggaagtcctgctaccgccaagggcgtggtgtctgcagatgtgaacctggacctggacgacgatggagcagactatgaagatgaagattatgacctagtaacctctcaccttggcctggaggatgtagccactccctccccctcccacagtccaagaaggggataccctgacccacacaatgtacctaggatcctctctcctggctatgaggctacagagagaccccgtggagtccccactgagaggaccagatctttccagctgccagcggagaggttccctcagcatcacccccaggtcattgatgtggatgaagtagaggaaacaggagttggtaagacatccattttacgagttggaacatgtatttgcctgcttggtttctagacaggagttggctagtgtagggtgggtcatgtgccccatgaggtgactttatgggggcggggcatatagcctgagggagcagagactgaatgctttcacaggagagcaatgggtgcttaggccccatgacttctcagtgacccagtgatcttttaggattagagatttggttttggacacggtgggagtatgcctcatttcatgatttctcataatgtattctattttaaagagagtcagggccagggagagatgg

SEQ ID NO: 21710 - DNA, 1102 bp, Mus musculus
gaactgtacacacacacacacacacacacacacacacacactaaataagtaactaaaaattctcaattggccataagttgtccagcttttctttataatcataactgcagaaaggtagtttattttaaagatttgcttacttttactctgggaaccaaacctggatccttgcaagagcagacttctgcttcttccaatgtgtttttgtcataccttggtaactcattcagcaggaaacacacacacatcacttagaaaaagcaaactgagggttggatcctaagttatgtaaagggcaaaaaccaatatctattctatattactttaggtatgtagaaaagtgtgtcttcaaatggatctcttctctgaggagaatgttttctatttgtctatgttccatgaggtttaaaaactctgcctttttatcgacaacttactgcagatattgatgagtgttcagagcagccttcccgctgtgggaaccatgcggtctgcaacaacctcccaggaaccttccgctgcgagtgtgtagagggctaccacttctcagacaggggaacatgtgtgggtaagtgctgcaagaaaatctcctggggaagctagctctatgggaaaggccccgttacaggttttgatcctggtggggaagcagataccagttcctgcggacagagaggggctggttacaaggggcatgagaagacctccttagacagtcgtggctgccaggatcaaagagtgtccttataaaatatacactaccacatgctggcgatacatcatcccacctgctgtcagctttctgtggtgcttgcttcttatacatttgctcggcccattttcagcatacatttaatggcaattgaagctgttaggcttcattctctgtgtcattagcagccatggaattcatggccgagcacctttatgttcttagctgtcttagattgaattctacctgagttacatcagaagggatatcccacttggtagcattccgtttatagtcttaatttaataaaccacaagccaaaacatagcttttaaggcttcctaggctacattgattttattaattcattaggccaattatgttcttgat

SEQ ID NO: 21711 - DNA, 2584 bp, Mus musculus
tcaggaatacatgtacttgcctgtcttatttatgataaagaaacaaacagcagctcaacttggctccttgagcccacaaggaggtaaatggggagcctgctgtaggtaccaagtcagtcagaggtaagactatgatgctgatttccatcttttccaggccacaattactgctcagtgaataatggtggatgtacccacctctgcttgcccactccagggagcaggacctgccgatgtcctgacaacaccctgggagttgactgcattgaacggaaatgatgtcaagaattccttgttccctctccaagtatttcatagtaacactctacttgaagtgacttgatccagactgaaaagtgtcctgcagtggaatgaccaccaggcccagatctagcctagcctgagctctcacaacctctccttaaccttccctagaacaattacctttagctcagtaatgggaaaatctctaccctaacatgagggcaggacacacacacacacacacacaccctttgatctcagtctttagacaagtttataaagttctggataaaaagccaagggtagtggtacatgcctgcaaccctagcacttgggaggcagaggcaggagaatcaggagttcaaggccaattatcttgtctgtatagcagggtttagaaataacccgagttacgtgagtcccttccaaaaaaaaaatcaggataaaaattatgtgtccattctagagccataggacttcttcctaattctagactctcccatggtaagcagagccttagcgacctaaggaggctacttcttggtggcattacaaactcagatattacccagtttctcaacataccacccagatccagcttaggcaaggtcatactttttctcttggttatgctcccatctaactactctcctgttgtataccttcattctgcccaagactgctttcagtgccttctctgccatatgatcaaaacccaaccatattccagggattcatggtatttggtagatggtaaaaagcaacccctcccaaattacaaagtcctggcatttcagcagtggccattgataatcacataggtaagtcaaggaaaagtcctgagagagggatttgaagtcaagatgtttgaagataggagattattatcttgatgtgtcttgaattgtagcaaattcttcttctttgccaaagtacctgtattagtttctggtctatgacgtcatgggaatcttcagcccactcctggtaccagttttcaagtcttctcatggagagtcatctggagctcaggttggggtaggactttgacaaagtagtgtccagtcatagtccctcacctttagaattgtgtctctgtttctccctctctctgtggccctttctgactagatcctcatctgaagacacaatctaggaagatctagttgggcatttctagtagtggttcggatccttatttgatcatcagtatagtttgagggactgttgctgccttccatgtttctgtctgtgatttgtttcaaaaatatccgctggccagatgcatagctactctcctgtctgttttgaggtgtctgtgttattgattccattctagggacaacagtataaacttagtaatcatttgttcttttctttttaaaaaacaaaacaacccttgtcccctctctcttccttctatctactattatctatcacctatctctctacttatctgtcatctatctctatctatctcctgttttccactgcttcctagacactcaaaggattaataattttggattggaagtcaagcatcagaagttcggtttgcatggtgtaaggtgagggcacagacaagactcaggcagaactattacaagtggtggataaggatggagaacagggatggaaaatcccagaagaaacagcagtggagaggcttaaaggcagctaaaactaaaagccttaaacaacttcagagaaaagtggcacatttgccaaaagaatgtttatccttgaagacataaaagaacttggcctgatgtttttcttggggaacagagccccctacctccttttcttctactttcactgtactcagcccccaaccctatctcctacctccacctcgacctgcttacattggactgggaatctaaattgggagggagtctttacttaaataattggaatttaaatcacaaagtttagggaacgtgtgactctttcatgcaccctcataaagtacccctagttttttttgtcatgttcctcatgatatatatcttttataacttttattcatttttactagattccttctaaaatgttttacatggtaaattgttaagctgtggaaaccactgaaggtgcttattaatggttctccagatgtatacaagtattggatgattcctcaagtttacagctgtacaaatattagtgcagaaaaaaaataattaaaatacaactgttaaaaataaaatcttattttgatgtgtttttgctgttttgttccacaacggggtgttgcagtgttgatgcccagacttgacctcagactctcaatcctcctgcctcagcttcttgggaa

SEQ ID NO: 21712 - DNA, 1144 bp, Mus musculus
ttgagctgcctcctttgtgatgggcagagttggaggtgggaaagatcctcatttctttttaactctgtgtttgctctgcaaacctgtcacacaacatagtgttaatagtggtaatgtatgctaccttattacatttccatacctagagaagcactcaaagcatatcatgaaactgttcaatacagacgttttattgataagatcagctcttggttttgatatttggagctgttaactaggagtgagaatgcaaaacaggtgtgtccttatgacagggtagcagtggaggtagagagaactaggtggttctcatttggcctagggtcagtaggagactcctagatgttcaaaagggctggggatctggacactggtgggaagtcaagaataatgtcaaaagaggtggaggagaatggaagagaaaactagccatacatggagcacacaattgaaaatccctggttctgtgtcctgcagtacttggaggaggagtatcgcaagggagctcgagaggatgaccccatgcctcctgtgcaaccctaccactatggctcccactactccaacagcggcaccgtgctccacttcctggtcaggatgccgcctttcactaaaatgtttctagcctatcaaggtaaggatgtcttttgtaactaccccaaagtcatgctgtatcgttagaacaaaaaacctcgactagcttcttaaaaactagccctaaccaagcccaagaaaaggaattctacttaagtagttactaaaatactcctttaaaaaaatggtagtcaaatcttgctcctgtctaagattttagctttagatagtgtctacatttacaaaaatgcagttgagttttaaaaattaatatataattcacaaactataaaatttgccagttaaattatattcagctcatttaatattttgtgtagccctggctgtcctggaactctacctgcctctacaatctgggtgctaggattaaaagttgtgtgccaccatacccagctcaactctcttttaaaggcttgcgacccagtaattatttcaaagcataatggttttgtagcttgtgtaatttttttgtataaagatctgttatgggaaagtattagtctttataatactagttaatagagaacat

SEQ ID NO: 21713 - DNA, 1178 bp, Mus musculus
gaaagacaacacacgtgcctctgtgcgcgcttccccagcctccgtgggcctgagagtaaagccctgccctcattccataatggcgtggaaggctgggtctgcacacactagccaattaaagtcagaatcttgatgctttttcccaaaaggttaggctgaatcaaagatcagggtctctgttctcctccgttttcaaaaagaaagagcagaacttaaattggctaattatttatctaaaatactaaacattatattttaaaagcatgtcccctatactcagcacacccaataaaaggaaacagaaaataggacttttcaggattcagaaagcaagttcttagtaggagcctctgcacccaatatatccggaacctctgaacagaacgtgagctctgctgctgcgtcactctcggccggctttgctgttgtcctctctgcccaaaggagagccaggggcacgagcttcagggactgttgcttccttcacatcctagctcctcataggcttctacttaaagtccataacactaggtatcagcgcccttggctcagtgactttcaaatataatggtaagtcttttagcacctgccgtaacagtccgtctgacagggctctgaactgtctgcactgggaagctccacacagcacctacagtgtaagcagtgtgatggaggcacagcagctaggaaagtgtgaaggaaggaaagcgagtgtgcagacagaggcagagtaagttacgtgttcctactaagctacgctctgagactcctggggcaggcactgtggcatgtgacagcagccccgctctggaactctgggactactgggctcttactcaaggtgctgctttgatggctttgaaaactattgtgtaggctcagaactatatcaccgtgggggagaagcatgtgttgctgcctataattgacttgtgcatttgttatggaaatctaattcatattatgtttacagaactacttttgtaacttccagactttgtaaaacattctgcttatatccacgagatgcaattccagagtctctgctgtggagacaggcacagggagagcattaggtcccattgacacgggccacctgtcactcctaaagtccacttcagaacagagacaacattactcctactcacgttgaagtgactgatttgtttttaaaaatt

SEQ ID NO: 21714 - DNA, 1660 bp, Mus musculus
actttttaaaagttaagtagcccacagcagatgttaactgtgctcagatttagactactgtttctactccatgtttacatcttcacatagtgaatgcagtaaggtgtgaaaacagaaagggcagagaaatcaatagtaatcaaagcctttattattctattaatatacaaccaaatggtcttttcccaacaaaacataacatcatttgtgagggcaaaggttttgtttctggtgtatacattccagtcgttaaactcttacggttggactgttaccatcgcactagtaggcaatctccattttccacagaataaaactgtaatggctgtaggtcattttctagttcaatttctctgcccggcatctaaaattaaaatcaagtagggagcagtaagaccgatctgatggtgcatgctatccatgccaccctccaagggcaggtgaggtgtgaagtcaaaggctgcctccatttagagcctgttatgtatggctcacagtactgtagaggactaagcttagctttgtgtttttgcttagcaacttaccttggaactttcgtaggacaacagaagttctgacacaggaactttgagaagacgtgacaacagtccctttaccttttgaactgtcatggagtctgtcaaagaaaagaaacttttaagtgacaactacatgtagaaacagctcaggagaggcagccattgatggaaggcttgagtcattctaccaggtgatcttttaacaaagtgggaaatggagccagtgtttgacccaagaggtcttgacagtgaggtgccataccatttcagtagcatttactatttcttcctcaatcggaataaccagaaataattatctcaccgaagaggacacaatctaggcctttgtgataacttcctaaggggttgctgaagttccctggagtgggggccttgcggggcccctcccagcacgagcatccagtcaccatcaggatgtgcacacatgaccactaggtgtgggaaaggaactctgaagaacaaatgcgctggtccgtcaagaacacactaggaatttctttccaaagacaggttgtggtatatatggatattttgattaagaatattagtttctctgaagctttagctgaaagtacagcaatagtgtggtgtcccacaattatcacaatgtagtcaattatttttctataaattgtttttataaatgctgtgtttttatgcaacttgtgataataaatattctctattttagaataaactagccttttcctatttttgactcacttcaacagctgtagtaccctgaatgtgcctaaccaaattcactgtgtctggagagaatggattggagcccatactgaatgaggagggaaagggagggggcaaagcaggttgagtgccagcatggctctgcttccctagtatggccgaacatgactactccacactccagcagtgtggttcctgctgtgcttcacctcctcaagccatggacagcataaaccttccttacgctacctgagtattttttcagagcaacaagaaaaaagttaatacacattgttaatttgtcattatatattacataccacagtaagagaaattagatttctagtttaaaaaaaaaaataagagaaattgtgagaaattggctgtaaact

SEQ ID NO: 21715 - DNA, 1317 bp, Mus musculus
cataggtatacaaacatgcacaatattcagacacataagatatttaatttttatttttttaaaaacaaagttgaaactatcaggaatcacataacgtaggtcataaatgtcagacactaagtgtgacagctcttcctacgaccccacgtgctctgggcttgtcaataaaaaagactgatcttccaagaaactatctgctttctaactatatgacatggagggttctcagtccatagatgacaattcaaaacaagtctctttagctaactgactaaaaagaccaaagaactgctgtttttccctaaatgataatgccaagagtacctcagttttgtctctgaagacctgtgtcaaagtctgaaaagacagaaagaatgcacaggcactcttccacccaacttgtttgtttcaatgcttgacaccccacaaattgtcctttttaacaaaagaggctccacttagtgaagttcaattcacaacctggttccattgtttttttctggtttgtttgtgttttttcttgtaacatttttctaccccaaactgattagtatctgtgattaatgtttctttgaaggaagaaaataatagaaaaggtgtttgtggagtacatgagtaatgccagcattccattggtagagtcaggaagatcagaagctcaaggttatactcagctatatataagtttgtgaccagtctgaactacaggggacattgcatcaaaagaaaagaaaaagaaaaaactgatatatattttttttaatttcttgagacaggtttcactcactatgcagttctagctggcctagaactcaagggtccatcagcttggcttctgcctctttgagagctaggatcaaatgtgtgtcctaccatgcctggcaaagactctgtaagtcaatttatttccttgcctaattaaattaattttggcctggtacttaatagtgaattaaggacctttttagagtcattttgtctatccaataatcaaaatctcgttctttatttggtctatggttcccaaatgttaattcagaagagacccaggaagctggagagatggctcagaggttaagaacactggctgctcttccagaggaccctggttcagttcccagcacccacatggcagttcacaactgtctgtaacttcagttccagaagatctaataccatctcacagacatacatgtaagcaaaatacaaatacacattaaaaaaaaattatctgaagagacccagaacatgagtagctgagttcatttaataaaatgactttatttgcttagatttgtgctacaataatgcttttcc

SEQ ID NO: 21716 - DNA, 1149 bp, Mus musculus
tatcagaaataaaaatatataatcactaaagaaaatattgttaaacaggtaaaaataaatatttagttggattaattaaaaacttgaaaaaagtgaatgctttcagtataaacagtcagatattaaatctgatttttctgaaccctcaaaatgtgaggtggctaaatccacttatactatttaatgggctcattcatctttattatgatttttttatctgaaataataatttccttattaaaatcagggttctagagagatggattggcagttaagaatggttgcttccctttcaaaaggaccagaatttagtcctaagcacccacattgggcgattattgtaactccagctccagcggatctgatggcttcttttggcttgcatgggcatcggctatcactcctctacacatgcagatagttagcacatacatacatacatacatacatacatacatacatacatacatacatacataggtgagtaagtaaataaaataaattttaagattaaggaaatcattctgagaccgggaggaggagggtgtgctttccacaggcttttcctgtttaactggtttgattttccttagctacagtgcttaagttactttctaaattagttttaatgacaaactttcatttgaggaaggaaatgagaagactgattacctcactgaaaagatattcattgctagccactttcctatcttactgtaatttgagttacgcatttctcactgaatcttctagaaacacgttttctttagttgccaattaatatctctgccttgttattttgatggtgacttgattattttaaggatacttgcattgtaacttttaaaaaattcttctatgtataacattttaaaattaaatgtatttcagccacagaaaaaaataaactgtaaataaatggtgggctcaatatggtggtacatgcctttaatgctagaggcatgcagatctgtgaattctagaccagccagggctatatactaaggctgtctcagaaaatgtatggtggtattaataagaaaaccttcattgtaatattaggtgtaactttgatctgattattttaagttttgacaggtctgttatattgctacaaagtattcatttaagcagatgaattgtaggatg

SEQ ID NO: 21717 - DNA, 1133 bp, Mus musculus
tagaacacctgccatagacacctggatgaacagggagatatatgccatgggagtagtagactactgtcattttaactctacatttaactcagcgcttaagttgatcaggttgtttttgctgggtattgctagttgatctaggaagcagcaacataaaagatatgaaaaggagagctgcagtttcatctgcacagtcaaaacaggacataaaaagtatggaagacttctttaggttaatctaggccttcaaagaatgtgcatttagtttaatgatagtttagtagcagtttagtgatagccctttgcaaatatcactacgaatcccttttctctacacttggtacactgtgacctttctgggggaaaaatagagaataggtgggtgagtggttgggtgatggtaggtaggtcaatgggtggaaagattcattgtactaatatcttcttgtgggaggtagggcattgtagaatgcttatctggctggataagtcatgttgccccccacccctcttattttttagcttctgaaagttcggctgaagacagtgagcaggaagatgagagatgtactcaggacgtagataacattggcaaagacgaatcaaaggtggaacattcaacccacagcagaaatgaactgatttcaaaagaggaacagagtagtccatctttgctagaagaaaacaaagtccatacagatttggtaatagccaaaacagtgtcaaaatctccagaaagattaagaaaagatatggaagcaatatcggaagatactgattttgaagaggaagatgaaatcacaaagaagagaaaggatgttaaaaaggacacaacagacaaggctttaaagccacaaacaaaacgtgggaaaagacggtattgcagtgcagatgaatgtttgcagactggatcccctggcaagaaggaagacagaaccaagagtaaagagccgctctgcacagaaaacagtagtaacagctcctcagatgaagatgaagaagaaaagtccaaagcaaagatgacaccaaccaagaaatataatggcttagaagaaaagagaaaatctctgcggacaactagtttctattcaggattttcagaagtagcagaaaaaaggataaagcttttaaat

SEQ ID NO: 21718 - DNA, 1140 bp, Mus musculus
taagtgcactttttttatgaagaaaaagtacaacgaactgcttttcctcaagcaataattgtttccaacttgtctgggaattgcgtgtgtctggtaacttgaaggccttccactgtggcagaggaggcttttcactgcctgtagagacgacacagtaggcagagaaaaggtgggccagaacatgtgagaagacttactgtatatgtattcccttgtattttgttaaagctggaacatttgatatttttccattcatttattaaaaatatgaacctattttcatttgtacaagctaattgttttttaaagcaagtcactttagggtgactttaattgtataagtcaagcacatgtaacaaattcaagacttgcagttagttaacaggatattattagacatcatcctggtaaccaaatattaaagattctctttaaaaatgactgaacatgtttacaggtttgaattaggctaaaaggtctgtggtggcttttcacaccccttcaaattgaaatgggactactgtactttgccatttttctataaatcagtatttttttttaattttgatataatacattgtgtgaaaaaagaaaatggctaataaactgtattaaatcttaaacaatgtataaagattgtacttagccagttcaaagtgtatatttattcataatgaattataacagttatatttttgtgttttcttgtaaatgtttcttttcccttaaatacagataattcatttgtattgcttattttattatgagcttacaacaaaaagacttcaggaacaaactgttagaatggttcaaggttgtttatatgacctgcctcacaaagatggttattattttaagtataagtagctagttgggtagtaggcctatacaattcaatgccttgtataaactgcagaatgaacgccaagctgttttcacttgtattgactttatgttgtatgattccaatctctgtttggcacttgtatttaattccccacctttgtaatacatttgtatattgcggatgtgttcattgaggctatttaaaacctggcgctgttaatacacagtacttcactgtacagaccgttttactgttttaattgtgattctgtgtgctttttttgaatgaggctg

SEQ ID NO: 21719 - DNA, 1099 bp, Mus musculus
cttaacttaaggttaaatataaatagtggtaatataactaaggtcagagctgcatctccctcattaatgagagaagagccttcactgtaagtccttagagcaaacaagtacttggggcatttaaacccatttcctttgtggaagtatgatgcatgattttaattggattttccctaggcatcgtaggataaaagacacttaggataatagactgtttgtgaatgtccttatcattatgaagaagtaggcagttctatggtttaaatgtaattgaaaagattttgatcaacattacataaaatttagaaatagctttattttagaatatttgttgacatgctgtactgtttctctacttactgtcacaatacatccgtagcttactaaggagacagtaacattttaagacatgggaaggtgacaccttggtctagagttactcgtgtatttattgtatatctgtggtgtgggtatgagcacgtgtgtttattgggtaccagtgatgtatcacttgaacccagagcttgcctgttgactaactagtctagctagtttgctctggaaatcctgtgtctaccttctgagtgctgggactaaaagctgccccacatttgtgtgggtgttctgtgtccatcctccaggtctcacatttgcactacaggtgctttagctgctgagccttaccccctgcagtgcccttctatttaagacgtgtgttgaggaactagagagatggctcattggttgagaccagttgttgctcttgcagagaatttgggattagttccaaatacccacacggtagctcataatcatctacagctccaatttcagaggagctgaaaccctcttaacctttgcgggcattaggtaagcacatatggacaacatacaagcagataaaacacaaaatattaaaaaaattactaaaggtcttgagtattattaataatctctctagattcgccttgatgtatttgagtccagcacagtattaatcataaggctttgtttggttttttttcgggtttttttttttgttgttggttttttttgttttttgtttttaattatctgactgcaaagaaattagaacagt

SEQ ID NO: 21720 - DNA, 1275 bp, Mus musculus
gaggccgttcttccaccactgattaagactggggtggcaggtgttaggggtaatattcatttagccttctgagctttctgggcagacttggtgactttgccagctccaacaaccttcttgtccacagctttgatgacacccacagcaactgtctgcctcatgtcacgaacagcaaaatgaccaagtagaggatagtcagagaagctctcagcacacgtgggcttgccagggaccatatcaacaatggcagatcaccagacttcaggaatttggggccatcttccagcttcttaccagaacgacgatcgatcttttctttaagctcagcaaacttgcatgctatgtaggcagtgtgacaatccagaacaggagcatagccagcactgatttggcctggatggttcaggataatcacctgagcagtgaagccagctgcttccattggtgggttgtttttgctgtcaccagcaacattgcctcgtctaacatctttgaccgacacgttctttacattgaagcccacattgtccccaggaagagcttcactcaaagcttcacctgcaaagatggcagtgccagtggcaccacgctgctggaagctttggattgtatcctaccactaactcgtccaactgacaagcctctgcgactgcccctccaggatatctataaaattggaggcattggcactgtccctgtgggccgagtggagactggtgttctcaaacctggcatggtggttacctttgcttcagtcaatgtaacaactgaagtcaagtctgttgatatgcacttccatgatttctaattgtgtcttcttgaaataccatttttcatctgttcatcctacagtaacatcttttctttatagtgaggggttgtggtaaatatttaacatcaatttggagtttctacctctctttagatcattaagttcccagataaaagactcacaggctttatatttagagtaagccttcagagcactacagctgggcaaatatctatcctctatgcgattatgtctacttccccgccactaaccctaaaatatgacttgctgtgttctgcctgggctgctcttacactcactggccagccctcgtggccagttctcacgatcccatactccatagcatcttctgtccccaacttctctttcctcctgtggtcctgtctcagaccccaagcccagaaaccaaattcccatctacctctcttctgcccagctacaggtcgaaggcatctttattcaaccaatagtcttaaattaag

SEQ ID NO: 21721 - DNA, 1648 bp, Mus musculus
ccagtgagtgtaagagcagcccaggcagaacacagcaagtcatattttagggttagtggcggggaagtagacataatcgcatagaggatagatatttgcccagctgtagtgctctgaaggcttactctaaatataaagcctgtgagtcttttatctgggaacttaatgatctaaagagaggtagaaactccaaattgatgttaaatatttaccacaacccctcactataaagaaaagatgttactgtaggatgaacagatgaaaaatggtatttcaagaagacacaattagaaatcatggaagtgcatatcaacagacttgacttcagttgttacattgactgaagcaaaggtaaccaccatgccaggtttgagaacaccagtctccactcggcccacagggacagtgccaatgcctccaattttatagatatcctggaggggcagtcgcagaggcttgtcagttggacgagttagtggtaggatacaatccaaagcttccagcagcgtggtgccactggcactgccatctttgcaggtgaagctttgagtgaagctcttcctggggacaatgtgggcttcaatgtaaagaacgtgtcggtcaaagatgttagacgaggcaatgttgctggtgacagcaaaaacaacccaccaatggaagcagctggcttcactgctcaggtgattatcctgaaccatccaggccaaatcagtgctggctatgctcctgttctggattgtcacactgcctacatagcatgcaagtttgctgagcttaaagaaaagatcgatcgtcgttctggtaagaagctggaagatggccccaaattcctgaagtctggtgatctgccattgttgatatggtccctggcaagcccacgtgtgctgagagcttctctgactatcctctacttggtcattttgctgttcgtgacatgaggcagacagttgctgtgggtgtcatcaaagctgtggacaagaaggttgttggagctggcaaagtcaccaagtctgcccagaaagctcagaaggctaaatgaatattacccctaacacctgccaccccagtcttaatcagtggtggaagaacggcctcagaactgtttgtctcaattggccatttaagtttaatagtaaaagactggttaatgataacaatgcatcataaaaccttcagaaggaaagaatgttttgtggaccttttttttttttttttttttttttgtgtgtgtgtgtgtgtgtgtgtgtgtgtggcagttttaagttattagttttcaaaatcagtactttttaatggaaacaacttgaccaaaaatctgtcacagaattttgagaccattaaaacacgttcaatgagaaaaaaaaaaaagaaagaaatcatggaagtgacactgttctattacaaagtagatttcaaaacaaaattaattagaagagataacagtcatttcagtcaattaagatcattaagtattaaattctaaacctgtatgccaaatttcacaaaatgaatattacctacaaaatagtttccactgactatttatactctatttatattctaaacactctaatgtacagaagtaccacagcacaataatggatgaatttaatatgcaatgttaatcagcaatggacagatctttctg

SEQ ID NO: 21722 - DNA, 1143 bp, Mus musculus
gctcctccgagtggcggaaattagagggacggggcgggggtgggggcgcgcgagggaagaaggagccgggaaggagagcagagtctgaccacatctgtgaaaacttggggaaggagggcggggaggaggaggagcgcaggagcgcgcggaggggagcgcgaagggcgcgcgcggcggagctcaacttttgcaaccggggcgctcggcctggacgggcccttagtcgttgaaaagtcgacttgacggtcggggggctcctttctttctctttctcctcccacccgcggttgaaccaaatcagaactgtcactcagggccggtgactcagagggatcagattacaggatccctgaaactgatgcgcgggctgcagcggcgggagggagcggaccgggccgcaccgccggcgcccgcacactcgtccgcccgcccgccgctcccctcctcgcccgctcgccccgtcgccggcccacgccacaccatgcccgccggggccgcacgctgggatcagtcaggccatccacggtagcccgagtccgcctgccgctccgccggcgcaggtctgtggatttgggacctgacagccaaagccgcaggtacgtcccgcctgaagttctttgttttgcgggccccgcagccctccctgtcgagcttcccggcggcgtcggagcggcttgtgtgcgctcgcgccttcccgcgctctcggggatcgggtctcggctctccggactgcagagctcctgccccagggcgcgcggaccaagtttgcagcggcggcgtccgtgcctacttctcgccaagtgctgcgcagagctccgggagtccggagctgcggctggtcctcgcgcccccgcaagccgcagcttggcttgcgcgcagcgcctggggatgcgccgagccgccgctgccccgctctccagggtcccgccttcacttctgagggtgggggtgcggggtgagcggatggagggcgcgcctccgcggtgggagaggaaaagtgaaagttgtgccatctgtgcgtgatttggaactctgtctcttcctttccagaggtagagcagaaagaaagaaaagagaaagaaagaaaagtagccgtggcccttgcggtaaccaagaggccgaatttgcacagagcagagttgg

SEQ ID NO: 21723 - DNA, 1099 bp, Mus musculus
agctctgtgccagctgttccacattttccagctgccacttcagtttgaaatgatggactgtcgtcctcaagtaaaagaactctttagtccgaggtatggagggccggccgctgtgcaaatacaggggcagtgccattagccccgctggtattattagttccaaaaacacctcgtgcccttcttttcctctccttctcctcctcaattacagcttttcacagcccagtacgtgcactctgctgaacattcaagtgattaaccccccactcccctttctaaatgattttgtgcagaacttggatgaggccggcaggctggttagctagcttgcttctcttttctttctttctttctttctttctttctttctttctttctttctttcttccttccttccttccttccttcctttctttctttctttctttctttctttctttcttttcctgaaatatgtgtctggtggaaataacttctagaaaaagagttgcagcttgagagcattgggcatggctgggggaaggggaactgtgctctgccatctgaaataatctcattttagtctattttaggggaaacctttccttcgttctcatgtcacaagcttgcactgtttgatgtcttcacgagttatagactgaattcttcaagaactggcctaaagtattaattttgagtatttatgtaattgctctgtaatttgaataggtgccttattgattgattcctgtaattatttcatttgggttttaaattaaaaattaataatagtctgacagtttcttaattacacgtgtcaagattattttgaagcaggaaaatgctgttttaaaatagtgaaataacctcagaatcacttcatttttctaaggcagcgcaatagaggatatattaaagcagtggagattggttttaacaatgtaaactgtgcagagtatctacagaatttgtttatgttaggaaatattggctttaacaatctggtccacgagctctgtggccagttagattatagtcagaccttaaaacaaacatgaaataacatttaaattagctgaaattgcatatttatacagagcagagagtttattttacacta

SEQ ID NO: 21724 - DNA, 1149 bp, Mus musculus
acctcaacaatttgtaaggagtccacctaagaaatgtcttagagatggaaagctgatatttttttaatcagggcagcagggctgctaaagtcaaaatgtcgccagcatttttccatcactccacaattagcatccccccaaattaaatttaaagttgcattcatcagcaatccttggctttgagacccagggctcgcattgtcagatgcagatgaaaacagctgcccttgtccatgtgaggcctcagaatacagacgagtgtgctgtgagtgaggccttgcatccttgagtgtatatgactccgttcatctggaatacatcccggggagctttgggctgtcgagttttattttagtaagtttcattttgggaaccagaaagggggttgaaagttattgcacttaatgttgttgtgacttcacttgctcctattcagtttgttcagatgtcagtgccagaacctttgtcaaaatggattcctcgggaggggcctagtaggtttcagatatttaggagatctctgtacctaaccatcatccttaagactgtgtgtgtgtgtgtgtgtgtgtgtgtgtgtgtgtgtgtgtgtgtgggtgtgtgtgtgtgtgtgtgcgtgagcgtgtgcgtgtgcgtgtaatgactttcttgctgggatgtttaaattgtgttttagtagtttcatattttttaatgggcaagggactctgcttaaaagtagataggtgcccctcaacattcctacccatagtgcacatccaacccttgagctgaggttcagaaggaagttaacattgccttaagactggtgacatcgtttttggtcagaaattacagcctcaggtcctaaatgcaaagaaccaactcaggattgcaggaagggtaatttgggagcgttcagagatttgagttcagcatttgagaaaagaaagtgcaggccctgtggtggcccacagctttagatcatctaggtcagtcagctacttggagaagacactgagtgtggtttctttgtcatttgaaaggtttcttcctcgagtgttctttttctgtacatagaagtccaagcacatggacacatgggttgacagttcccgtatttaataaatgataaacaaataaatattctacatacctgaggggccacacatc

SEQ ID NO: 21725 - DNA, 1177 bp, Mus musculus
agcccagccattctaagttcgttgttttactttttaaattttttgagattgtaatgtagttatagtgtttctccctttcctctctccaaaacctccctgtgcctctcctgctctctgataaatgcatggtctctgtgttcattaactgttactgcatgcacatagggtaggaagctcaagaaccccaaagacaaacctatgtgagttcatttctcaccattgtcaatcaggctgcataaatcctgaaactagaaggcaaactgttcattgcaatggtggtagtcatgagtaaattagcctgctgagctgggccaagtgtgccgatgtggaaggagacagtggggaagtgtagagacatgggttaacactaggacttacttcatgtttacttgatctgtgaacctcagtgttttttgaggcagggtttcactgtgtagccctggtactcactttgtagaccaggttggtctcgaactcacagagatatgcctgaccctgaccctgaccctgaccctgaccctgaccctgaccctgaccctgcccaagtgctgggattaacagcatgaggtgctaccacctggccttatctataatttttaaacacttgatttagcggctgaactccttatctctagtgtagattgacagtgccctcatgctttgttcaaaatgattatctttttgtttgaccaaccgtatggtatctatgcaccagaacatgctttcaagtaggagaaataaagtttgatatttatctaaacatctatttccatgatctgtttttgagaattggggctatccgattgacatatacatttataattagtgtgatggtttcagccataactgccccattttagaatggatctcttaccacacattgacttgctctgtagccaagagtgacctctatctcctagaatactgagatttcacacacacatcacatctatgcttgctttatgcagctttgggcatagaatccagtgctgtctgtatgttaggtatgcactccaccagctgagctaaatccccaacccctggctataatcacttaatccttgtcatttaggttttttccctcaacatttttcactattagaactaattaacatctttgtctaaaatgtttgttcctaatgtttattgttcccttctgctataatctttaaagcaa

SEQ ID NO: 21726 - DNA, 1190 bp, Mus musculus
cagctctgctctaccgtgcagaattattccggtcagttctatgaccaaaccatgggcttcagtcagcaagacaggaaagctggctcgttctccctctcagatgccaactgcctgctccaagggaatggcactgaaaactctgagttactctccccaggtgctaaccaggtaacaagcacagttgacagctttgagagtcatgacctagaaggtgtgcagattgattttgatgccatcatagatgatggggaccataccagcctaatgtcaggggccttgagcccaagtattattcagaacctttcccacagctcctcccgtctcaccactccgcgggcatccctcccattcccatccctatccatgggcaccaccaacatggctatcggggatatgagttctttgctgacctcccttgcagaagaaagcaagttccttgcagttatgcagtaggcggtaggcaaggaggaccacaaacacaaagactgaaatgacttgggatttttttttcttttttaagttctgtgtgtattttagcaatctcatctcacctgattgggatgtgtctcaagtatattccttttatggaaaaggactctgaaaaaccctaaggtattctaggggaggaactgtcttccatttcagtttgaatcagtattgtgacattcaaatcacccttgtttttttgttttttgtatttttttaaacctgtaagcctgccctcttttgagtgaaccaatgtaaatgtatactgcgcatgttctttcttttagaagagaagtcatcaagttaaaagatttggcctgcttctctgctaacccaggaactaggaattggtgggcttgtgaccaaggggtaacaggtccacctttttaaagtttttctttacagtactcagtgacttgcttttatgtgtgtatgtgtattttttattcccacactgagtacaagaattgaatgaatagtgagcttgaagattatttgtgggtgcactatagttagtataaatagcaggttttcacgtgtcctccaccttgattcaattcagggcatacttttaacagcttcacaaaagtggaaatgtggggatcctggaaatgaagtagtttgatgagggtttttatagggggtaattcttatgtaagtacgcatcccgtgggtatgtctatatggtcagctctccattatct

SEQ ID NO: 21727 - DNA, 1422 bp, Mus musculus
ttacttggaggactgttttttggacttgctataattattcattagtcccacctctttcctcattgtcataggtaactgagaattgaattgactatacatagctctaagtaggtatttaagcagcccacaactggatacatcactaccgtttattaaattcactacagcaagagaatatgtcctttctaagtgccctattataaaggaaagatgtgtaaaacctagttataaaaggcaaaactcacatacattgacatcagaaataaattactttaaccagttttagcactggagagcatgaaagttgatgtttagtagccatgtgaatttcagataccattagtccttaccattggactagggcttttgttttgtattcagattttaaagatttacacagtgcagctgctcttcacatgtagatcagatatgagagtcatactgtgtgtacacagagttcagggattatcttagcatactactttaaaaccgtaaacaattaaagtgtttacccatcagccccaacatggaatttccccaaggctgttattgaccgggttgtgtgacttctcctcttaaatcctgcctgtaaatttaggagtaggaaggcgaaacccagtaggtgttaggtaataggaaggatgctatgaccagccaatttcacttaggcctgttttctctcttttggagcccaaacttcaccagggaagaaactttgccatgtaggatgacgttgtggctaagctagctttctgatagatgtccccaggaccagtcaaaccatctgtaagttcaccgtgccctgcagccttctcccagaggttccttataaatcaaaggacagcccacaagaaaggggaattactggtctgagttcaggagagtaaataaagcaaggcttctttttgcctcaaacaggtcacagtgtcatcacaaaatgggtgatggaatccctgaatttcatttatcaaaagtcttttttgttttttaatctctggtttgggtctgacctggcatgccttattatttggccaaatctctttattacttttgatttcaaagaaggggttcaggaattcttccttcctcagcaagaagaatgagcttggtttctggtcacacccattgcctcctgcagcagagacctctctaggtggaggccttgcatgtgaccttgatgttctcaagtgcagtgattttccatgttagcggtccctcctaggaatgcagtgcacagagccagcacccctgccttcttaccttctgcttttgactttttcattgttttcttttttcattgtttttttttttcatccttatttttcaagctattgcctttagatttttggagttgatgtttccactcactatctgacctttcttgatatgaagatttcaggatacagatttaaaaaaaaaaaa

SEQ ID NO: 21728 - DNA, 1213 bp, Mus musculus
agtccttggctcttgtatttaggagaaacagctttggctctctcatgtcacacacagctgctttttaatgaaagtacaggctcatacatggtactcttgtttaatgtctgtgttaaatggtttggtgtttgtttgtttttttccataatttttctaaagaattaaagaactcacttccctgctcctcacgtgttggcttgtcctgagccacgggttttgattcttgcaatgtatgtgccttattttatgtttctcttgtcgatgagaaggaccagttgttgttgttgtccagtcagcactcagaggctgcatgcccagacagtgtcaccaggaagtgaacacaggactgtggcagtctgcggtgttgggtgacccgatttcctgtgttgtttgaagctaataggagggtgttctcctctgacaagttacgcttgtatatcctgcagatgtgtaaaataaactgtgttccttttcgccaccattttttagattttttaaagaagaaaatgtgtaatcctttttaaagaacaacacaatgtaaatacattcaagtattgtagacgtagagttgggatgtgatggcctcgggccttccttggaaaagcctgtggctgctcagtgctcctaagccatgagaatggcagcccagaaacatgaactctgccttggctttcagaaccacttagtccttttataacaaagaaaaaaataaataaataataaaaatgtttcttacagtgtcaataaaaaaaactttgtactgaaatattctactggatttcttttatttaattcctgtttttaagaaaaggacacgttctcaagaaaactccccaggctatagttgactccccagtgagtccatgggaaggagacttctgatggtaatgtggagggcactattgcaaaccagtgtgaacagcaaaggagacaacatttctgaatgtagatagtcactggaagctgtgttaaagtaagcctccatgggctggtgagatggctcattggttaatggcactggctgttccagagagttgagctttgattctcagcacccacatggtagcacataaaggcatgcaactctagctccagggttatattagacttatgttagaggtctctagagagacagagatcatagagatcgtgtgtgtgtttgtgtgtgtgtatgatttattaaactggcttacaagctgtggtctagctaatc

SEQ ID NO: 21729 - DNA, 1177 bp, Mus musculus
atagttctacatccatttttttgtatttttgttaagatattgaaacttaaaatcactggaagtcacttaatatgatttatacttctttattcacaaaaggccagaataaactatatatatgcagttcagtgctctgcccaaatttctctatatttggagcattgtaggcttactttctcttgaagcaaaagaaggtggtatgttgattttcattgtgataaaatgccaaaggaaaaccaaggagggactttggttcatagtttctaaagttccagtggaagttcagctggatctattagttggtcttgaggtgaatcaaaatatgtctgcggatatggcaaaagctgttcacctttggcaaccaagctgcagaaagacaggaggaggccagggataagaggagcctttctagagcaactttgcctgtctctacctcccagtgataacatcatgtgacccattaaggtattagtccacttaggaagtaaataccctgacaatctcatcacttccctgtgaccagacaagccttcaacacatgacccatttgggcagacacttcatatccataccacaacaaatgactaatagtaatctcaaatgacttccatgacaacgaaataaatatatatttgactccatcaaaccaaagaagacaaatgataatgcaagtttactgtgtctgagacagtaaggcctaattatcttgactcatagacacatttttttaatattttttattagatattttctttatatacatttcaaatgctatcccgaaagttccctataccctccccccagccctgctcccctacaagaagctcactccagcttcttggccctggtgttcccctgtactgaggcatataaagtttgcaagagcaaggggcctctcttcccagtgatggccgactaggccatcttctgctacatatgcagctagagacacgagctgtgggggtactggttagttcatattgttgtatggacacatttctaatctgaggaagagttctatgaactttagcttactttgcctggctggagtacaaggaaagggatgctatgtatatatacctgtattaatagagctaaaacttggaggagtattcctgagttatttaaagtcaagtcttgaacagtacagtatgtttaaaaaaattgtcgacattct

SEQ ID NO: 21730 - DNA, 1123 bp, Mus musculus
tttacaactcggaaattctgatgcactgtaactacataacttttatcatgtgtgtgtgttgcttggctttctgtggacatgttcactggaaggtgcagcgctctgagagatttttgtcgactatttgtcttctagtatttgtcttctgttagatggacatgggtatcagaatctgccaattccccatttgtactttattccagtttaatttttgccgtgaactgtacaaaggagcacccgtcagatggatgtgttggcttgctttctcaggtgaggatagtggtgttagcctatccacctgtttgattggagctgtttagaatgtcccatgggtctcagtttttctagtctttttttttttctttagtgatagctttagtaattattacaggtaacctttcattattactttagctcaagttatggaaataacattcctgctttcatcagttgttttggtggtatgtaaatagctcctttctggacaattcttgccctagaagggctttgttcggatagaactgctactatgctgggttggagcattacaaaaagaactgaaccaaaataactacaaagcagtagtcctggtgggccgtatctgtagcctgatctctagcaatagaagagattcttgcataatttttagctaaattttctggtgttcgcaaccccaaacatgctgacctgatagagaatttggttgaggtgagatagcaaactcaagcgtgaagtttgcagaatgaacgtggagtgagtgtgtttggccacattgctaccttacacattaagctactagccctatacaaagtcaatattaagggaagtgaagggggaaagttggaatgccagaataaattggctatttcttgatattcacaagaaaactgtctccttttgaaggtggcctggctagaagcagaagtcttttctgactgttacctacactccaagtggaaattttccatttttaaaaagctagattatctagcatcactcagtgaaataaaatgaaggaaaaagaaaacccttgctaagaatctactccctgtactcaggaagtggaggcaggagaataaaagtctaaggttgtactcagatacatcatgaattcaagggcagc

SEQ ID NO: 21731 - DNA, 1101 bp, Mus musculus
gatggtgcacctttagtcccagcatttgggaggcagagatagacagatctgagttcaaggccagcctggtctacagttctagtttctggacagccaggtctacacaaaaaaaatggaacctataaacagacaaaaaatactgcataggatactatataaaaatttaaatatatccactttcattctactttaaccacatacttgctccccattcattttgtagtaaaattcatgagttttagaaacaattttttaaaaagatgtttcagttcttacatacctttagccatttccagaacaattctgcagctatatttgggtggaatcttaaataagtttctttaagatcaagaatgggttttgctattcatataaccaacattttgtagcaagtttgttacacaaggaagaaaaatggcaagggggaggaaagagtggtatttactgccagataggactgtaagacaaatagaagtcagagagtcagaactgttagcattatagaaaacttgctgagttaccagaaacatgcaaaagaccaagcaaccatgaatgggtgagatctctactagcagtttgctttcccagggttggtaaggtagctcagtacacaaacacacttgtcatgaagcttgatttgagatctctctatggaagcacaggagggagagtgccaactcctacatggtgtccctctgacccccacttgtacacacaaattaacttaaactcagcataatttactgttactatggaaaaagactgaaataattacccatttcagtagggcaaaacattaagacactaaagaaaaaaaaagaatgcattttgaccgagcaattcctgtggactattcctgtactgaatcattcattcatttataaagtgaaaaaatacaaatgtgtctcagttacaattcctgttgctgtgatagtaatctgacaaaagcaatttcagaaaagattcatttgggcttagaatttagggtgcagtccatcatggccgggaagtcaggaagcagggactcaaaatagctggtcacatttcatctatgggaagaagaaagcaatgtatccttgtgtccagtaactacccctttta

SEQ ID NO: 21732 - DNA, 1811 bp, Mus musculus
ccttccacagggccagagagtactcatcccttgccagcaaagatgcacaactataactatggtggtaacttacaggaaaatccaggtggccctagcctcatgcatggacagacctggacttctcctgcccaaggacctggatattcacaaggatacaggggacacattagcacatcagctggcagaggtcgaggcagagggttaccatactgagtatctgtttttcctcaggcacatcatttttatctggaaagacttttctagctgcaatttcaggcagcaatccaagagacttgaataatattaattcaacaacagctttatttttatgtggaaagggtcttgcatacaatagtgaaaaaaacaaaacaacaaaaaaaatctttgcttaaattcatgctgttcttaaaactagctctattgattgtacatcgtcacagattttagttaacaattttattttgtattcttgcagttttaagtggatgctaacattagggacataatgtttttatggccctgtggcagatcttctgaactatgcacacttgtgcttttttttgtaagtttggaccaacttttatgtaaacaagctccccttccccccatgccccccatcccccttccagttttacaacaatcagaaagggcactgatttatttggtattttctttttacaaagctacctttagtcgaaggtcactgtcagtctttgcacctgctttcagtgttattgtgaaaggtgtactttgtgctcatttcagaaaaataaaacacaacctttctcttgatgcaacagttttatataaaaaatggtcaacattatttttgttttgtttttttcaggttaccataatacaggaaaattcattcaaatgaaatagtggtttttatatgaaaactatgggtagggtggggaggggttgagtaagtgccttaacaggtaagcttaaggtctgcggatgaaatgagccttcacaccactgtctttctaagggagtctgtactgtgctgacggggcagggagcttctccgctctcaggagttgcttggtcagttctgttagctccattccctctgcctgcctgtcacactgtccctttctgcctgtcttttggctgtgttgacttccactgttaccttctcttggtaggggtgtaagaggaaaagaaagggagaactcagaaccttatgttacttctgggaagtactaaaacttttttttatcaattaagtggttgaaagtagtagctgaatgagaattttagagtgctcctttctttctggctgtcatactgacccagtttctatttggagggcaggagttttgaagcaagtatgtataacaattcataaataaatacatatggtacataacaaatgtattgaagtccacagaaggagggtggcaaacaccttattttaagttatataattttaagaaaatgtcaacttaagtagaaacatgtcctagatctaatttagtaaagcaaacagaaaactcaaagagaaaaccttccctcttcctttcaattctgtgaaatttactataatttctgccagattagagcagtgctattctattagaatcaaccaagaaagaataactctgatgttgtcaagtcgcactatgtttacgttcacacacacacacacacacacacaaaaaaccaaaattctatttctgaaaaggaaccaaaggtaaatagccagcatcaccttcatcattcgtagataagagactctggggaaccgccctcgcgtgccgactgacaatttcaattgttgtagtacctttcccattggatac

SEQ ID NO: 21733 - DNA, 1113 bp, Mus musculus
caacagtttgtgccagaaaatataaccaagtgaggggagggggagtggggaggaatggaagacttctcctttctgagataacagtgatggcctgttgctgccctaattgttacatttcttagggaagttggttttttatttatttatttttggtttgtttatttgtttgttttaaatccaggtttatctttgggcattcacaggccagagaaaggaggaatattttaaagaaaattgtcatctggtattttactcactgacagcaacttcagaaacactaatattaccattttgaaattaagtaaaattgtttcatttcagagatttaaattagcactctacaaagtttaatttggttactgactaaatgttaaattatttttcatcagacgatctgccaaatcccgaagcagaagcccatattcatctaggcactcaagatctcggagcaggcacagattgtctagatcaagaagtcgtcattcaagcatttctcctagcacactaactctgaagagtagcttggcagctgaattgaacaagaataaaaaggcacgagctgcagaggcagcaagagctgcagaggcagcaaaagctgcagaagctgctaaggctgctgaagcagctgccaaagctgccaaagcctcaaatgcttctacacctaccaaggggaacacagaaactggtgccagtgtctcacagacaaaccatgtgaaggaagtcaaaaaacttaaaactgagcatgcaccttctccttcaagtggtgggaccgtcaaaagcgacaaagcaaaaacaaagccaccgcttcaagtaacaaaggtagacaataatttgacagtagagaaagccaccaagaaaacagttgttgggaaggagagtaaacctgctgctacaaaggaagaaccagtttccactaaagagaaaagcaagccactcacaccaagcacaggagccaaggagaaggagcagcatgtggctttagtgacctctacgttaccgccattacctttgcctcccatgctgcctgaagataaagatgctgataggtaagtccagacaaatttgaaattagtaactcttcaaagaaaaagtctgcttattttgctgtttttt

SEQ ID NO: 21734 - DNA, 1192 bp, Mus musculus
tttttttttttttttttttttttcgagacagggcttctctgtgtagccctggctgtcctggaactcactctgtagaccaggctggcctcaaactcagaactccacctgcctcagcctcctaaatgctgggattaaaggcgtgtgccaccactctgagggtagtcctgcctcagcctctggaaccaccagcattaaaggagtcagctactttaatataactgttttctcctacccattctagcccatggtttattagggaagttttttaactatgtagttaaatacttttgtctcttttgtaaggttgattataaacattgtgatacattgtgattcaatgcctttaatgatctaaccccattctatctctactcttatttttcaaacacttttctttttctttttcttttaagatttatttattattacacataagtacactatagctgtgcttagacacaccagaagagggcttcagatctcattttagatggttgtgacatgtggttgctgggatttgaactcaggacctccagaaaagcagtcagtactcttaccggctgagccatctcaccagtcccacttttattttctgtatctccctgataactgttcttcaagcttgaagaaacactgacaacctttttttccatatttgctgtttaccttgcattcacaaacttagtctcagctcttaacatcttgattgttcactcctctgcatgctcattttttcctctgtgctccttactgcacttttgttttatttttgctgtagatctgttaaaagtaccctgattctaccttagttaattggctgactgcatttgtttgtccttactagctggtaaactaaaggacgaatttacaaaatgtatttggtagtagtggtttaattccttaagatctcctcccctctttctctttcacagagtaaagaaaaccaatttgtacaggtaccatcatgaaacttgctagccattttggttcacatattctctaggattgtggaagtaattgtgatttatagggagagactttagtgggtaaaaatgtactgtacatttttgaatttggtttgaaagagctgattctggaaaattatcctttgaccttcattcacatgcccacagcctgagtgctccacacttaaacacacagacaataaaaactgttatttagaatcccccag

SEQ ID NO: 21735 - DNA, 1806 bp, Mus musculus
tatttcataattgcctacatttatcacagtcctgaatgtagcgtgtaagcttggtttttttttggggggggggcagtctttctcaaactgttaatcaagaggtaagatgggggcggggaagaaatgaccatttcctctggtgtttattataaagcttaaattttatattattttaaaatgtcttggtcttctactgccttgaaaaatgacaattgtgaacacgatagttaactgtactactttttaagctgttgttatgcaaatcttgaagaagttactggcatggttgttgcatatagtaaaactgagagtaattcacctgtgaatctgcatattaattacctgatgattaacttagaaaagagatgggaacttattatacatggacatttttgaatatgccttaatttagaaactgaaaaataatccagtgacatcattctgggtgtgttctcactagctcgcggggccacttgctgcccatgtgacgaataacagaagatcttatcttgccaggccgtggagagctacaagaaagattcctgagaaatgtccaactgctaggagtctgaccaaattacagatgtgtgccatactctggttcttagagttccagagctccttcattggttttaataaactctaaggtagttaaagatgaagggccagcatatatttatatgataagtttagattatgagcgtgagtaccaattaagtttgaatgaatgccccttttatgtagagtgctggtccccagtcattgctgtctgcaagtgatgcgcatttaagtgtttaatctcctgggagcagggcacagggaagactatgaggagagctaatgtggtctgtacaaggacactggaggaagtatgtttgctacctgtaagttctaaatgtgtactcctgaggttacagtttgggtgttaggagaagtctttgtagtctctttatgttcataatgaatactgtatcaatatttcctaacatgaagcagtcaaacatgtatggcacatactgaccagacgtcagtctgtgatgtttccgctgcaagaattcaagcatgctgttaggaatgtaatttcaatgggaagtaaaccactattaggttttttttcttttcctctgtggggctaagacacttgattaaacagtttttcttgttgcacagtcctaatttcataaggtcaaggagacactcaggcattccaggaaacaaatgtgtacatgatgttaccagaaacaggcattcaggaactctactgtctagatactacattcagcttaccataaatatttgtccttgaagggtttgatttaatattttcacagactaggccatgtgcaaaattagagttccctgtgtaaccccagccagcaggcccagcatggctgcgtgcactcattgcagtcttgttgaaccagggtcctaaccactaacattgcaatttgctttgagaccttccctgtcctgggtactaggtgctatgaagccagctgacagaagcatcacatgtcttgggctgatgccgctacccggttcatttatttgcaatttgagccatttaaagaccaataaaattccttttctataaatgtctgtggtgttcattgatgtttacagcgtgatagtcttactttaccacctgagtatcttgagcagaggtttacaaacagctgaatcttgagccatatgtttggagaccttggtgttagggcagatttcagggtggtgttggtgttcaagtttaagtcactgctgggcatgggaggctgctgtgacagctgctggcagatgggctctgtg

SEQ ID NO: 21736 - DNA, 1314 bp, Mus musculus
agcggaagggacttgtgccccagatcaggcccgggtagcctgcttccctatgtaccgcagtctcaagttccgcgcgattggattggggcaggcgctgtgttccactcaccagaggtcttaggatcccgtggggagtcccgtgtgggcccttgcgggtgttgggcaagactctgctggcaaggtagcccggggctcgagtcttgccactagccattgttaaacacttacaatgatgctgtggaatatgcttcctatagggatgttggcatttcggactaggtccttgttttgcaccgaaacattatcttgggggtttctttgttctttgtttggctttctggattacgcatttgaggacttgttacccgtaatctggtaacagacttgaaagtaacgctgtttaactactggaacctggtagattgttttttatatatgaaactagtgatccactagttcatctctttagtctgtaaccatcctagtttttgagaatattataactaacatttgccttttcaaagcttaagttttagagcccaaatataaatttctagaatctgtagttgggccctgatcagacaattttagagtcagtgtttccacttatcaaacgcacaccaaatggtagaaaatcgctgaagtttaagacgtatcattaagatataaagtctgtttgtctgtgtgtctgtcttctgtctgtctttttttctctctcactttttttttaatccaaaagttttttttttttttttttcagcatccaaagtataaatcccaaggcctcagtggaacagattgttactcatttgatgctcagggaaaaccattagatgataatacatcgaattgctcctatattgcggaattgtttggctgggtggtggtgacacatgcctgtagtactagcacttgggaggcagaggcagggagatctctatgagttcaagatcagcctggattatggagcgagttctaagacagttaaggctacacagagaaaccctgccttgaataccatccccctccccgaaaaagaggaatgtgtgagacatgaaattctgagtacacgatctctattgcttgtctgttatcagtgtgctgttacatagtggcattgctgtaggcatcgtacatttaaagcaagtgtgcccatctttaaaaacattatacagtctcctttcagggactcggttcagatcatgaactggccacttctcagaactctcagaaaacaaagctttcattttaaaacttccatatctgaagtgagttttctccacttccacaccaaacccaacagtggaagaaagg

SEQ ID NO: 21737 - DNA, 1130 bp, Mus musculus
cttggtgtcagaggagaaccatgaggggaagaagagtacaaaaagtgtggtccttagagctagccaattgaagtttaaaatagcccaaataaaacctcatacataataactcagggttatcaataaataaattttaacaacatagaggatagacaactgctcagcttttatactgtttaagtcttataaatatctaaaaaataaatggtctaaggcaagataaattcctggagacatagtttctacaacacagaggttgctagggggacctctgatgccctctatcttctgtgtgtgcaagcaaagacatatacccatacaccacacacaaaaggctgttggcttagggggagaaactctcttgctttttcaaaaagttctagagtagttcaaccagaaacagtaaaggagaatctacttgactgttgccttttgctttgctttctatgctgggaggcagccaggtctcatgaagaggccctaggtgaatgtagatgggaaggcaagggtgccctgcagctgtgaccagagtgtcatggcctgagattgcatctgaagtaagttacttatggcactgacacatctagatctttttaagcaaatatggaaggggggctttcctgacacttaagtcattagaactactaaggccaccaaattatgatttgcagagtaagtagccagctgaattaatctacaagcatctttatttgcagccatgcaccacttgctggggatagattttgagaaatgtaaccccggggagttccattaaacaaatataaaaatatataaagtgtttatgatgtcacaaagagatggggccttatgggaccatattatatctcatttttggccaaaacataactaggtggcacaatgactatctgccaaagtgcttgctaactgctttcatggtaaacccagataaagaccaaattgtgattctcaccctattcacagtaaggtttttattgctttgtgctctagtctaagacctaggggaaatagttacatgtgtgtgtgtgtctttaacttaatttttttaaattattcccaagtttggccagtagatgaaataaacatatgctgttcataaactaccagtcaagactttgctgtctagaaat

SEQ ID NO: 21738 - DNA, 1147 bp, Mus musculus
catagaaggaccagtactctcaactaatccagacctctgagatctctcagacactgagccaccaaccagggagcatgcactagctggtctgaggtccctgacacatgtacagcagaggacggcctgctctggcctcactgagagaagcacctaaccctggagagacttgaggccccagggagtgaggatgcctggcaggggttgtagggtggaggggtgaggacattctcttggagacagggaaaggaggaatagaatgaggaaccttgggagggcagaccaggagaggggcaatgactggactataaaaagtaaaagtaatttgaaaaaaaagaataaaaagatatagactggcaaatttagttagaaaccatgatcagtcctagttaggattaatactacaatgactaaacaccatgtctaaaagaacttggaaaggaaagtgtttatttgccttatacttccttatctctgtttatcaataaaggaaatcaggatagaaactcaaacagggaagcaacctggaggcaggagctgacacagaggacgcggaggagagctgcttactggcttgctccttagggcctgctcaggctgcttccttatacaacacaggaccagcaaaccaggggtatctaactcagtgatttcagccttgattttgattatgtcctgtcttctactcctctttggtatacttgctactttttattctagagattcaggtgtacttttaaattgctgatatgagaactttctaatttctttatgatgttgcttagtgctatgaactttcctcttagcactgctttccttgtgtcccataaattttggtatgttgtgccttcattttcattgaattctacaaagtctttaatttctttctttatttcttccctgacccagagatctttgagtagagtgttggtcaatttctaccagtgtctatgttttccagtatttctgttgtttttgaagtccagttttaattcatggtgttctgataggatacattgtgttatttcaatttttttttttttatatctgttgaggcttgctttgtgacctaatacctggtcagttttggaggaggacccatgaagtactgagaggaaagttttaagatgtctattgctagtagattgga

SEQ ID NO: 21739 - DNA, 1105 bp, Mus musculus
gggatggtgcaggccacctcagcagtggggaactcttccttggttacttttaacttttctgggaatatcttcatccgcggctttaggattggacgctgtgccactcataagtgccgtcattctgtacattttcatgaaacaatcgcagaataagacaggattaggtggttgcttatggcaagcttttagaactgaggtcgtgtttgtgccaaaatgacaaattcaaaacaagtatggctagcttgttcatttgtattacctaagaaacataagtagaatgagccttctctattgtttttcccctaggaaagagaatactgtgcaagacctagactggacatcatccagccacttccggagacttgtgaagagatctcctccgatgctttgacagtcagaggctttcaggagaatgaatgtagggattaccacttaggtgagacagcagagatgtgcttgtgtgccgtgttctgcttattcccttcagctcatccaaaggggaattgaaatacaggtactgacaggacgttagacagtacccgtgccggcctctgccagtgagagccagggtactagattcataaagactgcatatcctatcagagtgctcatagcaaaaaggaatgttagacataggacaggaaccaaggtgagaaatttgttctttttttgttgtgttttgtgtgtgtgtgtgtgttgttccatcagaccagctagtcagctagtttgctgtgctgggaatcaaacccttggctttaaacatgctaggaaatcattggcacccagcatatcccagccctatctgtttaagttacatttaacttgatatcaaacagcatgactctgtccaagccttatgttcctggaaggtttgcagtggaggcaaacctaagcggcagtgaagtccttgtgttgggagctgaggactaagacatggaaaaagtctcatcctgtcacagggactgtggaataagtgggtgactacactaatcacgactcagaagcaaaaggaaaactggaactctttagtcctgcctaaaaagtccattgttatatctttgtaaaatgcacttaagaaaaagaaagactttaagctctttagaat

SEQ ID NO: 21740 - DNA, 1176 bp, Mus musculus
tgatggacttggaggcaataactaactaactaactaaataaataaataaataaatggaaagaaaacccccaaaacaacaaacaaacccccaacccttttatgccaaagttgggtttttgttagtgtttttcgaaatgaacagaacgagcaaactagaacacctttacatacaaaggcagacagcttttggatattacccatatgtttaaaacatcttcggttacttacaataccaaatacaatgtaatgcttataaacagtttcacttttgtttagggaataaataaaaaaaaaggaaaagtgtacatgtttaagacagggcagcttttccttaggactgctgatgcgaggttgcatggatgcagaacaaggtagcgtcaatccatggatgcagaacccaggaactaggcaagatgaagaggagcaagtgtcttgtgtaaaagaattaagagataggatggtgggttgtaattgtggttgctgtgattccatcttcctttttcatttggcagcggatggctgacaacttaccatgctcggcataggcaggcactccttgtggaacatgtgccggcagtggaagaccaccacgctgaagggcttcgctgcatctgcaaggggcagtgacagaaggagcagaactcagtgcaccaggcagatcaggaaaggttaaaccagcctgagagaatttcctagcaacaggctccatttgacagggcttctttacaacaggccctggagtggggaggagcctaagcacagagcgggtgtagaaccacctgcctatgaagtacaattgacaggctactttcctggcctcagcatcacttaccaagataactaatgcagcacaatttcacagcaaatgtgatgtttatttgaaaaagtagaatatgtgtgtccctgtatgtgtcctgagcatgattccaactaccacagactgaaactgccaagatctctcgctgaggccagaggcagaactcggttaggaccccaggctctctgcacttaggacacttctgtttagtcaggtcctctcatctgctctgctgtgtggctggccagatgagctctgctaagacctactgcccaccacaggggaagctgaggatcgaactttacaatctgccacccctttcatggaaaggccacctaaagcgctgtggtttacagacg

SEQ ID NO: 21741 - DNA, 1281 bp, Mus musculus
gggcttgaactcaggccctcatgtttgtacttcactaactgagcggtctaaccgcctcgcttgtgtcctttgagctgcagagtcatagaagcatgtgtcctgtctgagctaaagcatcctctacggagccgggaacgatgctccatcacttcagagccctcggctccctggatgatgacagaatcacatttctgaatgtaaaggtagacattttttaacccatgtttttaaactgtttgcagaatgctcctgcacaatactgcaacatctgtagtgctaagaaccgtgggcctggaagtgccatcctggagatgaagaagtaggcctgcctgcctgcccaccctttgccactctccactgagtgactgctggaccacagcagctgtgtcaacgccagtgctgttgagtgacgtgttcagggctcctcggagctccccgtcagttgttttctccagaccttccttccagaagctgctccttgtcaccgatggagaagtcgaagctcttcccatgccatgaaatattgcattgctaatcagtatttcatgatttgtttatttggcttatttagttagcaaaagagttcaaagtgacttcgttataccctagttacacccaccaggcatgaactgcactactgagaacactgccagctacagtcggccaaaagttctgctggtaacagttctggcatgcctggctacactgtttgtcatcagctgtgggtagcctcctaaagcgcatttagaggtaaaaattaaaattaaaggtaaaatgctgagaactgacactccttcagtgacatgtgggaagaccattagctggggtactatagccttatgtttgctacctacgcgctgactagctcagttatctgccccatcaggtcatcaatatttgttgaatgaataaatgttgcccttctcattgtgaatcctttattgtgttgcaagcagacaagtgctctttaaggaatagaggtgagttttggcactgacaagctgtggttgataagtaggaggaagccagggaccctgtcagagttaagtgagactctccaaagaagggccaaggatagatttaaggtgtatctcactgcctggaagggttggcaggagtgtgcctcactgccttgactttttgttgttcttaatgtttccagtttgatgtcaaggttcggcttggtaagttttgtcacttcccttgctattcggagcaggtgcacggccagaaaaactaaatggaactcctgaaggggaggatgggtggtgccaggtccac
